United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 28

SEQ ID NO: 1224583 - RNA, 12 nt, Human
acaccugcccug

SEQ ID NO: 1224584 - RNA, 15 nt, Human
acaccugcccugccc

SEQ ID NO: 1224585 - RNA, 17 nt, Human
acaccugcccugcccug

SEQ ID NO: 1224586 - RNA, 18 nt, Human
acaccugcccugcccugc

SEQ ID NO: 1224587 - RNA, 20 nt, Human
acaccugcccugcccugcca

SEQ ID NO: 1224588 - RNA, 22 nt, Human
acaccugcccugcccugccacc

SEQ ID NO: 1224589 - RNA, 23 nt, Human
acaccugcccugcccugccaccu

SEQ ID NO: 1224590 - RNA, 23 nt, Human
acacccagcaauagagacgggac

SEQ ID NO: 1224591 - RNA, 13 nt, Human
acacccagcaaua

SEQ ID NO: 1224592 - RNA, 12 nt, Human
aauaaagugacc

SEQ ID NO: 1224593 - RNA, 15 nt, Human
aauaacgauaaaaga

SEQ ID NO: 1224594 - RNA, 21 nt, Human
aauaacaaugaaaguugauaa

SEQ ID NO: 1224595 - RNA, 22 nt, Human
uaaagguucaugcaaacuuuau

SEQ ID NO: 1224596 - RNA, 19 nt, Human
uaaaguaaaaacaaagaaa

SEQ ID NO: 1224597 - RNA, 21 nt, Human
uaaaguaaaaacaaagaaauu

SEQ ID NO: 1224598 - RNA, 22 nt, Human
uaaaguaaaaacaaagaaauua

SEQ ID NO: 1224599 - RNA, 19 nt, Human
uaaauagcuagacugguga

SEQ ID NO: 1224600 - RNA, 18 nt, Human
uaaauagcuagacuggug

SEQ ID NO: 1224601 - RNA, 15 nt, Human
uaaauagacacgcac

SEQ ID NO: 1224602 - RNA, 15 nt, Human
uaaaucugugaacuu

SEQ ID NO: 1224603 - RNA, 16 nt, Human
uaaaucugugaacuug

SEQ ID NO: 1224604 - RNA, 17 nt, Human
uaaaucugugaacuuga

SEQ ID NO: 1224605 - RNA, 18 nt, Human
uaaaucugugaacuugaa

SEQ ID NO: 1224606 - RNA, 19 nt, Human
uaaaucugugaacuugaaa

SEQ ID NO: 1224607 - RNA, 21 nt, Human
uaaaucugugaacuugaaauu

SEQ ID NO: 1224608 - RNA, 22 nt, Human
uaaaucugugaacuugaaauuu

SEQ ID NO: 1224609 - RNA, 22 nt, Human
uaaauguuaugacuauguaaac

SEQ ID NO: 1224610 - RNA, 23 nt, Human
uaaauguuaugacuauguaaacu

SEQ ID NO: 1224611 - RNA, 15 nt, Human
uaaauguugacaugg

SEQ ID NO: 1224612 - RNA, 24 nt, Human
uaaauguuuuuuuuuaaagacuuu

SEQ ID NO: 1224613 - RNA, 20 nt, Human
aauaauuuuuauauuugaaa

SEQ ID NO: 1224614 - RNA, 12 nt, Human
uaaauaaaguuu

SEQ ID NO: 1224615 - RNA, 21 nt, Human
uaaauaaaguuuguugaaaca

SEQ ID NO: 1224616 - RNA, 17 nt, Human
uaaauaaauaaauagcu

SEQ ID NO: 1224617 - RNA, 14 nt, Human
uaaauaaauagcua

SEQ ID NO: 1224618 - RNA, 19 nt, Human
aauaauuuuuauauuugaa

SEQ ID NO: 1224619 - RNA, 17 nt, Human
aauaauuuuuauauuug

SEQ ID NO: 1224620 - RNA, 16 nt, Human
aauaauuuuuauauuu

SEQ ID NO: 1224621 - RNA, 11 nt, Human
aauaauuuuau

SEQ ID NO: 1224622 - RNA, 14 nt, Human
aauaauuuuaucuc

SEQ ID NO: 1224623 - RNA, 15 nt, Human
aauauuucagauaau

SEQ ID NO: 1224624 - RNA, 18 nt, Human
aauauuguuuuacaauag

SEQ ID NO: 1224625 - RNA, 17 nt, Human
aauauuguuuuacaaua

SEQ ID NO: 1224626 - RNA, 17 nt, Human
aauauuuuaugauccag

SEQ ID NO: 1224627 - RNA, 18 nt, Human
aauauuuuaugauccagc

SEQ ID NO: 1224628 - RNA, 21 nt, Human
aauaucuccgucaacucauau

SEQ ID NO: 1224629 - RNA, 16 nt, Human
aauaucuccgucaacu

SEQ ID NO: 1224630 - RNA, 14 nt, Human
uaacaugauuuggg

SEQ ID NO: 1224631 - RNA, 15 nt, Human
uaacauaaaucugug

SEQ ID NO: 1224632 - RNA, 16 nt, Human
uaacauaaaucuguga

SEQ ID NO: 1224633 - RNA, 17 nt, Human
uaacauaaaucugugaa

SEQ ID NO: 1224634 - RNA, 18 nt, Human
uaacauaaaucugugaac

SEQ ID NO: 1224635 - RNA, 20 nt, Human
uaacauaaaucugugaacuu

SEQ ID NO: 1224636 - RNA, 16 nt, Human
uaaccucuaaauucuu

SEQ ID NO: 1224637 - RNA, 20 nt, Human
aauaucacuugucaauaaaa

SEQ ID NO: 1224638 - RNA, 15 nt, Human
aauaucacuugucaa

SEQ ID NO: 1224639 - RNA, 12 nt, Human
aauaucacuugu

SEQ ID NO: 1224640 - RNA, 24 nt, Human
aauagcuuuuuucucugauacaga

SEQ ID NO: 1224641 - RNA, 18 nt, Human
aauaggcguaacuaauuu

SEQ ID NO: 1224642 - RNA, 18 nt, Human
uaaguuuuuuuuuaaaaa

SEQ ID NO: 1224643 - RNA, 14 nt, Human
aaucagacuaugaa

SEQ ID NO: 1224644 - RNA, 17 nt, Human
aaucagacuaugaaguu

SEQ ID NO: 1224645 - RNA, 23 nt, Human
aaucaugaauuaguuuuauaugc

SEQ ID NO: 1224646 - RNA, 19 nt, Human
aaucaugaauuaguuuuau

SEQ ID NO: 1224647 - RNA, 17 nt, Human
aaucauggugcucagag

SEQ ID NO: 1224648 - RNA, 15 nt, Human
aaucaucaagucuuu

SEQ ID NO: 1224649 - RNA, 14 nt, Human
aaucuuauaauuua

SEQ ID NO: 1224650 - RNA, 16 nt, Human
aaucuuauaauuuaaa

SEQ ID NO: 1224651 - RNA, 13 nt, Human
aaucugugaacuu

SEQ ID NO: 1224652 - RNA, 15 nt, Human
aaucugugaacuuga

SEQ ID NO: 1224653 - RNA, 17 nt, Human
aaucugugaacuugaaa

SEQ ID NO: 1224654 - RNA, 18 nt, Human
aaucugugaacuugaaau

SEQ ID NO: 1224655 - RNA, 19 nt, Human
aaucugugaacuugaaauu

SEQ ID NO: 1224656 - RNA, 13 nt, Human
aauccuugaagau

SEQ ID NO: 1224657 - RNA, 20 nt, Human
aauccucaguuuuugugaaa

SEQ ID NO: 1224658 - RNA, 16 nt, Human
uaaugauaacuggaaa

SEQ ID NO: 1224659 - RNA, 19 nt, Human
aaucuuuaaaaaaaaaauu

SEQ ID NO: 1224660 - RNA, 20 nt, Human
aaucuuuaaaaaaaaaauug

SEQ ID NO: 1224661 - RNA, 21 nt, Human
aaugagagacacacugaagaa

SEQ ID NO: 1224662 - RNA, 13 nt, Human
aaugagacaucca

SEQ ID NO: 1224663 - RNA, 14 nt, Human
aaugagacauccag

SEQ ID NO: 1224664 - RNA, 15 nt, Human
aaugagacauccagc

SEQ ID NO: 1224665 - RNA, 15 nt, Human
aaugaaaaccacauu

SEQ ID NO: 1224666 - RNA, 14 nt, Human
uaauagguuuggac

SEQ ID NO: 1224667 - RNA, 19 nt, Human
uaauagguuuggacaaaau

SEQ ID NO: 1224668 - RNA, 20 nt, Human
uaauagggcaauuaauuccu

SEQ ID NO: 1224669 - RNA, 19 nt, Human
uacauauaagugauugcug

SEQ ID NO: 1224670 - RNA, 22 nt, Human
uacauauaagugauugcugguu

SEQ ID NO: 1224671 - RNA, 18 nt, Human
uacaguauaauuaacaug

SEQ ID NO: 1224672 - RNA, 19 nt, Human
uacaguauaauuaacaugu

SEQ ID NO: 1224673 - RNA, 23 nt, Human
uacaguauaauuaacauguuaaa

SEQ ID NO: 1224674 - RNA, 20 nt, Human
aauggacuguggugacuuug

SEQ ID NO: 1224675 - RNA, 19 nt, Human
aauggacuuuuguacauag

SEQ ID NO: 1224676 - RNA, 19 nt, Human
uacacuaagagagaaugag

SEQ ID NO: 1224677 - RNA, 14 nt, Human
uacaccauuaugug

SEQ ID NO: 1224678 - RNA, 14 nt, Human
uacaguauaauuaa

SEQ ID NO: 1224679 - RNA, 16 nt, Human
uacaguauaauuaaca

SEQ ID NO: 1224680 - RNA, 17 nt, Human
uacaguauaauuaacau

SEQ ID NO: 1224681 - RNA, 21 nt, Human
aaugccccugaauuuaaauag

SEQ ID NO: 1224682 - RNA, 12 nt, Human
ucagcucaugga

SEQ ID NO: 1224683 - RNA, 19 nt, Human
ucaggaaagagaacuucca

SEQ ID NO: 1224684 - RNA, 13 nt, Human
ucaggaaagagaa

SEQ ID NO: 1224685 - RNA, 23 nt, Human
accccagcuggggccaggcuggg

SEQ ID NO: 1224686 - RNA, 23 nt, Human
accauuucuugagguaaaagcau

SEQ ID NO: 1224687 - RNA, 21 nt, Human
acccagauaaagguucaugca

SEQ ID NO: 1224688 - RNA, 19 nt, Human
accaugggauaaaugccau

SEQ ID NO: 1224689 - RNA, 19 nt, Human
ucacccaggcuggacugca

SEQ ID NO: 1224690 - RNA, 19 nt, Human
ucacccagguuggagugca

SEQ ID NO: 1224691 - RNA, 15 nt, Human
accaaucaugaauua

SEQ ID NO: 1224692 - RNA, 13 nt, Human
accaaucaugaau

SEQ ID NO: 1224693 - RNA, 15 nt, Human
ucaauucuugccaaa

SEQ ID NO: 1224694 - RNA, 17 nt, Human
ucaauucuucccuaucu

SEQ ID NO: 1224695 - RNA, 19 nt, Human
ucaauucuucccuaucuuu

SEQ ID NO: 1224696 - RNA, 23 nt, Human
ucaauucuucccuaucuuugcca

SEQ ID NO: 1224697 - RNA, 18 nt, Human
accacuuguguuuugcaa

SEQ ID NO: 1224698 - RNA, 13 nt, Human
accacuuuuugca

SEQ ID NO: 1224699 - RNA, 14 nt, Human
accacuuuuugcag

SEQ ID NO: 1224700 - RNA, 15 nt, Human
accacuuuuugcagc

SEQ ID NO: 1224701 - RNA, 16 nt, Human
accacuuuuugcagcu

SEQ ID NO: 1224702 - RNA, 17 nt, Human
accacuuuuugcagcuu

SEQ ID NO: 1224703 - RNA, 18 nt, Human
accacuuuuugcagcuuu

SEQ ID NO: 1224704 - RNA, 20 nt, Human
accacuuuuugcagcuuucu

SEQ ID NO: 1224705 - RNA, 19 nt, Human
acauauauaacaaugcugu

SEQ ID NO: 1224706 - RNA, 20 nt, Human
acauagugggacccugucuc

SEQ ID NO: 1224707 - RNA, 20 nt, Human
acauagucuggcuguaccca

SEQ ID NO: 1224708 - RNA, 14 nt, Human
acauagucuggcug

SEQ ID NO: 1224709 - RNA, 15 nt, Human
acauagucuggcugu

SEQ ID NO: 1224710 - RNA, 12 nt, Human
acaucagcaaac

SEQ ID NO: 1224711 - RNA, 14 nt, Human
acauaaaaaggaca

SEQ ID NO: 1224712 - RNA, 16 nt, Human
uauuucuauauuuuca

SEQ ID NO: 1224713 - RNA, 17 nt, Human
uauuucuauauuuucau

SEQ ID NO: 1224714 - RNA, 18 nt, Human
uauuucuauauuuucauu

SEQ ID NO: 1224715 - RNA, 21 nt, Human
uaugaaauauuauguuaaaac

SEQ ID NO: 1224716 - RNA, 20 nt, Human
uaugaacuugaggacacaug

SEQ ID NO: 1224717 - RNA, 21 nt, Human
uaugaacuugaggacacaugu

SEQ ID NO: 1224718 - RNA, 23 nt, Human
uaugaacuugaggacacaugucc

SEQ ID NO: 1224719 - RNA, 22 nt, Human
uaugaacuugaggacacauguc

SEQ ID NO: 1224720 - RNA, 21 nt, Human
acauguccagugggaggugag

SEQ ID NO: 1224721 - RNA, 22 nt, Human
acauuaaauuuuuuuuacauuu

SEQ ID NO: 1224722 - RNA, 13 nt, Human
acauuccauccuu

SEQ ID NO: 1224723 - RNA, 22 nt, Human
ucaagaacacagcccugcuucu

SEQ ID NO: 1224724 - RNA, 20 nt, Human
ucaaauacgugggcauucaa

SEQ ID NO: 1224725 - RNA, 16 nt, Human
acaugaaguccaagca

SEQ ID NO: 1224726 - RNA, 14 nt, Human
ucaaagcugaaaug

SEQ ID NO: 1224727 - RNA, 19 nt, Human
ucaaaguugccuaaaucca

SEQ ID NO: 1224728 - RNA, 21 nt, Human
ucaaaguugccuaaauccauu

SEQ ID NO: 1224729 - RNA, 22 nt, Human
ucaaaguugccuaaauccauuu

SEQ ID NO: 1224730 - RNA, 21 nt, Human
ucaaaauaugccccauucaac

SEQ ID NO: 1224731 - RNA, 16 nt, Human
ucaaaauuguuacaaa

SEQ ID NO: 1224732 - RNA, 19 nt, Human
ucaaaauuguuacaaauug

SEQ ID NO: 1224733 - RNA, 16 nt, Human
uauuuuuauauuuacu

SEQ ID NO: 1224734 - RNA, 21 nt, Human
ucaugaauuaguuuuauaugc

SEQ ID NO: 1224735 - RNA, 17 nt, Human
accucgugauccacccg

SEQ ID NO: 1224736 - RNA, 14 nt, Human
accucuaaauucuu

SEQ ID NO: 1224737 - RNA, 19 nt, Human
accucucaauauucaauaa

SEQ ID NO: 1224738 - RNA, 20 nt, Human
accucucaauauucaauaaa

SEQ ID NO: 1224739 - RNA, 21 nt, Human
accucucaauauucaauaaag

SEQ ID NO: 1224740 - RNA, 23 nt, Human
accucucaauauucaauaaagcu

SEQ ID NO: 1224741 - RNA, 16 nt, Human
accucuccagccucag

SEQ ID NO: 1224742 - RNA, 18 nt, Human
accucuccagccucagcu

SEQ ID NO: 1224743 - RNA, 20 nt, Human
accucuccagccucagcucu

SEQ ID NO: 1224744 - RNA, 22 nt, Human
accucuccagccucagcucuca

SEQ ID NO: 1224745 - RNA, 19 nt, Human
accucccucaaccucaucc

SEQ ID NO: 1224746 - RNA, 22 nt, Human
ucauccucuccacagcugccuc

SEQ ID NO: 1224747 - RNA, 18 nt, Human
ucaucuagguaaauuaca

SEQ ID NO: 1224748 - RNA, 16 nt, Human
ucaugaauuaguuuua

SEQ ID NO: 1224749 - RNA, 13 nt, Human
ucaucucagcuca

SEQ ID NO: 1224750 - RNA, 18 nt, Human
ucaucucagcucacugca

SEQ ID NO: 1224751 - RNA, 21 nt, Human
accuagggugauauuaaccag

SEQ ID NO: 1224752 - RNA, 13 nt, Human
uccaacccuagca

SEQ ID NO: 1224753 - RNA, 14 nt, Human
uccaacccuagcaa

SEQ ID NO: 1224754 - RNA, 15 nt, Human
uccaacccuagcaaa

SEQ ID NO: 1224755 - RNA, 14 nt, Human
acgagaaaacaaua

SEQ ID NO: 1224756 - RNA, 20 nt, Human
accuuuuggucuggagggaa

SEQ ID NO: 1224757 - RNA, 12 nt, Human
ucccaucccugc

SEQ ID NO: 1224758 - RNA, 14 nt, Human
ucccaucccugcgu

SEQ ID NO: 1224759 - RNA, 20 nt, Human
acuacaggcacacaccacca

SEQ ID NO: 1224760 - RNA, 15 nt, Human
acuacaguuagggcu

SEQ ID NO: 1224761 - RNA, 20 nt, Human
uccauccuugagucaaaaaa

SEQ ID NO: 1224762 - RNA, 20 nt, Human
uccaucucuuguuuaaauuc

SEQ ID NO: 1224763 - RNA, 12 nt, Human
uccauucuggaa

SEQ ID NO: 1224764 - RNA, 13 nt, Human
uccauucuggaag

SEQ ID NO: 1224765 - RNA, 14 nt, Human
uccauucuggaagu

SEQ ID NO: 1224766 - RNA, 18 nt, Human
uccauuuaauaauuauau

SEQ ID NO: 1224767 - RNA, 21 nt, Human
ucccaaagaaguucugguaug

SEQ ID NO: 1224768 - RNA, 14 nt, Human
ucccaaaaaacuac

SEQ ID NO: 1224769 - RNA, 20 nt, Human
ucccaaaagcccauucauuc

SEQ ID NO: 1224770 - RNA, 21 nt, Human
ucccaaaguccugggauuaca

SEQ ID NO: 1224771 - RNA, 20 nt, Human
ucccaaguagcugagacuac

SEQ ID NO: 1224772 - RNA, 18 nt, Human
acgggacugcggaggaag

SEQ ID NO: 1224773 - RNA, 15 nt, Human
acggggacucagccc

SEQ ID NO: 1224774 - RNA, 22 nt, Human
acguauaaaagccuguuuaaga

SEQ ID NO: 1224775 - RNA, 20 nt, Human
acgugggcauucaaauguau

SEQ ID NO: 1224776 - RNA, 17 nt, Human
acgugggcauucaaaug

SEQ ID NO: 1224777 - RNA, 21 nt, Human
acuacuagggaaaugccuuug

SEQ ID NO: 1224778 - RNA, 19 nt, Human
uccuaaauauauuuuaaga

SEQ ID NO: 1224779 - RNA, 22 nt, Human
ucguuuucaaaauuguuacaaa

SEQ ID NO: 1224780 - RNA, 16 nt, Human
ucguaaaauuaagaaa

SEQ ID NO: 1224781 - RNA, 13 nt, Human
ucguaaaauuaag

SEQ ID NO: 1224782 - RNA, 18 nt, Human
acugggacaggggagaac

SEQ ID NO: 1224783 - RNA, 16 nt, Human
acugggagaaaugaaa

SEQ ID NO: 1224784 - RNA, 17 nt, Human
acugggagaaaugaaaa

SEQ ID NO: 1224785 - RNA, 18 nt, Human
acuguggguagacacaca

SEQ ID NO: 1224786 - RNA, 12 nt, Human
acuguggugacu

SEQ ID NO: 1224787 - RNA, 14 nt, Human
acuguggugacuuu

SEQ ID NO: 1224788 - RNA, 15 nt, Human
acuguggugacuuug

SEQ ID NO: 1224789 - RNA, 18 nt, Human
acuguggugacuuuggau

SEQ ID NO: 1224790 - RNA, 20 nt, Human
acuguggugacuuuggauaa

SEQ ID NO: 1224791 - RNA, 21 nt, Human
acuguggugacuuuggauaau

SEQ ID NO: 1224792 - RNA, 12 nt, Human
acugugugcuca

SEQ ID NO: 1224793 - RNA, 15 nt, Human
acugugugcucagga

SEQ ID NO: 1224794 - RNA, 19 nt, Human
acugugugcucaggagccc

SEQ ID NO: 1224795 - RNA, 20 nt, Human
acugugugcucaggagcccu

SEQ ID NO: 1224796 - RNA, 21 nt, Human
acugugugcucaggagcccug

SEQ ID NO: 1224797 - RNA, 14 nt, Human
acuuauaguacaug

SEQ ID NO: 1224798 - RNA, 15 nt, Human
acuuauaguacauga

SEQ ID NO: 1224799 - RNA, 17 nt, Human
acuuauaguacaugaua

SEQ ID NO: 1224800 - RNA, 18 nt, Human
acuuauaguacaugauaa

SEQ ID NO: 1224801 - RNA, 19 nt, Human
acuguuguagaagacaaaa

SEQ ID NO: 1224802 - RNA, 20 nt, Human
ucuaaagccauuguaguccu

SEQ ID NO: 1224803 - RNA, 14 nt, Human
acugcauccagccu

SEQ ID NO: 1224804 - RNA, 15 nt, Human
acugcauccagccug

SEQ ID NO: 1224805 - RNA, 14 nt, Human
acugcauuauauuu

SEQ ID NO: 1224806 - RNA, 15 nt, Human
acugcauuauauuua

SEQ ID NO: 1224807 - RNA, 16 nt, Human
acugccuauuuuaaua

SEQ ID NO: 1224808 - RNA, 21 nt, Human
acugccuauuuuaauaaacac

SEQ ID NO: 1224809 - RNA, 16 nt, Human
acugcuuaauucaaau

SEQ ID NO: 1224810 - RNA, 13 nt, Human
acugcuuaauuca

SEQ ID NO: 1224811 - RNA, 15 nt, Human
acugcucuccuccac

SEQ ID NO: 1224812 - RNA, 20 nt, Human
acugccuucucaacuccaaa

SEQ ID NO: 1224813 - RNA, 19 nt, Human
acugccuucucaacuccaa

SEQ ID NO: 1224814 - RNA, 13 nt, Human
acugccuucucaa

SEQ ID NO: 1224815 - RNA, 12 nt, Human
ucgaagugcuga

SEQ ID NO: 1224816 - RNA, 13 nt, Human
ucgaagugcugag

SEQ ID NO: 1224817 - RNA, 12 nt, Human
acuggccccacc

SEQ ID NO: 1224818 - RNA, 13 nt, Human
acuggccccaccc

SEQ ID NO: 1224819 - RNA, 21 nt, Human
ucucacagcuccaagaauuuc

SEQ ID NO: 1224820 - RNA, 19 nt, Human
acuugaaauuugaauuuug

SEQ ID NO: 1224821 - RNA, 20 nt, Human
acuugaaauuugaauuuugu

SEQ ID NO: 1224822 - RNA, 11 nt, Human
acuugaggaca

SEQ ID NO: 1224823 - RNA, 12 nt, Human
acuugaggacac

SEQ ID NO: 1224824 - RNA, 13 nt, Human
acuugaggacaca

SEQ ID NO: 1224825 - RNA, 14 nt, Human
acuugaggacacau

SEQ ID NO: 1224826 - RNA, 15 nt, Human
acuugaggacacaug

SEQ ID NO: 1224827 - RNA, 16 nt, Human
acuugaggacacaugu

SEQ ID NO: 1224828 - RNA, 14 nt, Human
acuugcucuugaug

SEQ ID NO: 1224829 - RNA, 20 nt, Human
ucuccauggcccugccaugc

SEQ ID NO: 1224830 - RNA, 24 nt, Human
ucuccauggcccugccaugcucuc

SEQ ID NO: 1224831 - RNA, 16 nt, Human
ucuccauggcccugcc

SEQ ID NO: 1224832 - RNA, 17 nt, Human
ucuccauggcccugcca

SEQ ID NO: 1224833 - RNA, 19 nt, Human
ucuccuaagcuggagugca

SEQ ID NO: 1224834 - RNA, 16 nt, Human
acuuguguuuugcaag

SEQ ID NO: 1224835 - RNA, 14 nt, Human
acuuguuagaucua

SEQ ID NO: 1224836 - RNA, 15 nt, Human
acuuguuagaucuag

SEQ ID NO: 1224837 - RNA, 23 nt, Human
acuuguuagaucuaguucacucu

SEQ ID NO: 1224838 - RNA, 14 nt, Human
ucuccaaaccacuu

SEQ ID NO: 1224839 - RNA, 18 nt, Human
ucucagcucacugcaacc

SEQ ID NO: 1224840 - RNA, 15 nt, Human
ucucagcucacugca

SEQ ID NO: 1224841 - RNA, 16 nt, Human
ucucagcucacugcaa

SEQ ID NO: 1224842 - RNA, 18 nt, Human
ucucuuuaaaaggaaaga

SEQ ID NO: 1224843 - RNA, 19 nt, Human
ucucuuuaaaaggaaagaa

SEQ ID NO: 1224844 - RNA, 21 nt, Human
ucucuuuaaaaggaaagaaaa

SEQ ID NO: 1224845 - RNA, 21 nt, Human
agaaaacuuguauuaugugug

SEQ ID NO: 1224846 - RNA, 19 nt, Human
ucucuggaauuugaaacac

SEQ ID NO: 1224847 - RNA, 15 nt, Human
ucucuggaauuugaa

SEQ ID NO: 1224848 - RNA, 15 nt, Human
ucucucauacccucc

SEQ ID NO: 1224849 - RNA, 21 nt, Human
ucucucacuuguuuuauuuaa

SEQ ID NO: 1224850 - RNA, 17 nt, Human
ucucucacuuguuuuau

SEQ ID NO: 1224851 - RNA, 15 nt, Human
ucugaagucagaucu

SEQ ID NO: 1224852 - RNA, 19 nt, Human
ucugaagucagaucugccu

SEQ ID NO: 1224853 - RNA, 12 nt, Human
ucugaagaagau

SEQ ID NO: 1224854 - RNA, 18 nt, Human
agaaaugaaaaaauauau

SEQ ID NO: 1224855 - RNA, 23 nt, Human
agaaaugaaaaaauauauaucaa

SEQ ID NO: 1224856 - RNA, 12 nt, Human
agaaaucuaaaa

SEQ ID NO: 1224857 - RNA, 15 nt, Human
agaaaucuaaaaaac

SEQ ID NO: 1224858 - RNA, 17 nt, Human
agaaaugaaaaaauaua

SEQ ID NO: 1224859 - RNA, 15 nt, Human
ucugcaggucccuaa

SEQ ID NO: 1224860 - RNA, 16 nt, Human
ucugcaggucccuaau

SEQ ID NO: 1224861 - RNA, 17 nt, Human
ucugcaggucccuaaua

SEQ ID NO: 1224862 - RNA, 18 nt, Human
ucugcaggucccuaauaa

SEQ ID NO: 1224863 - RNA, 19 nt, Human
ucugcaggucccuaauaaa

SEQ ID NO: 1224864 - RNA, 13 nt, Human
agaaauuaugugc

SEQ ID NO: 1224865 - RNA, 21 nt, Human
agaaauuaugugccagauuua

SEQ ID NO: 1224866 - RNA, 22 nt, Human
agaaauuaugugccagauuuau

SEQ ID NO: 1224867 - RNA, 16 nt, Human
agaaauuuauaaacuu

SEQ ID NO: 1224868 - RNA, 17 nt, Human
agaaauuuauaaacuuu

SEQ ID NO: 1224869 - RNA, 13 nt, Human
ucugauacagaaa

SEQ ID NO: 1224870 - RNA, 14 nt, Human
ucuuuaauuuuaca

SEQ ID NO: 1224871 - RNA, 13 nt, Human
ucuuuaauuuugg

SEQ ID NO: 1224872 - RNA, 18 nt, Human
agacuggguaggaaagag

SEQ ID NO: 1224873 - RNA, 22 nt, Human
agacuggguaggaaagaggaag

SEQ ID NO: 1224874 - RNA, 12 nt, Human
agacuggugacu

SEQ ID NO: 1224875 - RNA, 13 nt, Human
agacuggugacug

SEQ ID NO: 1224876 - RNA, 14 nt, Human
agacuggugacuga

SEQ ID NO: 1224877 - RNA, 16 nt, Human
agacuggugacugauu

SEQ ID NO: 1224878 - RNA, 17 nt, Human
agacuggugacugauuc

SEQ ID NO: 1224879 - RNA, 19 nt, Human
agacuggugacugauucuu

SEQ ID NO: 1224880 - RNA, 20 nt, Human
agacauuuuaaaaaaugguc

SEQ ID NO: 1224881 - RNA, 15 nt, Human
agaccgaucggcggc

SEQ ID NO: 1224882 - RNA, 17 nt, Human
ucuucugaauaaagcaa

SEQ ID NO: 1224883 - RNA, 18 nt, Human
ucuucugaauaaagcaau

SEQ ID NO: 1224884 - RNA, 19 nt, Human
agacauuuuaaaaaauggu

SEQ ID NO: 1224885 - RNA, 22 nt, Human
agacauuuuaaaaaauggucac

SEQ ID NO: 1224886 - RNA, 23 nt, Human
ucuuagaugcaguucugaagaag

SEQ ID NO: 1224887 - RNA, 22 nt, Human
ucuuacugcuuaauucaaauaa

SEQ ID NO: 1224888 - RNA, 19 nt, Human
ucuuacugucuuuuuucua

SEQ ID NO: 1224889 - RNA, 12 nt, Human
agaauucuguau

SEQ ID NO: 1224890 - RNA, 17 nt, Human
agacacacugaagaagc

SEQ ID NO: 1224891 - RNA, 16 nt, Human
agacacacugaagaag

SEQ ID NO: 1224892 - RNA, 13 nt, Human
agacacgcacggc

SEQ ID NO: 1224893 - RNA, 15 nt, Human
agacacgcacggcag

SEQ ID NO: 1224894 - RNA, 20 nt, Human
agacacgcacggcagccaca

SEQ ID NO: 1224895 - RNA, 21 nt, Human
agacacgcacggcagccacag

SEQ ID NO: 1224896 - RNA, 22 nt, Human
agacacgcacggcagccacagc

SEQ ID NO: 1224897 - RNA, 12 nt, Human
agacagaaaaaa

SEQ ID NO: 1224898 - RNA, 13 nt, Human
ucuguacuuuuug

SEQ ID NO: 1224899 - RNA, 14 nt, Human
ucuguacuuuuugg

SEQ ID NO: 1224900 - RNA, 17 nt, Human
ucuguacuuuuuggcau

SEQ ID NO: 1224901 - RNA, 22 nt, Human
ucugguaugaacuugaggacac

SEQ ID NO: 1224902 - RNA, 23 nt, Human
ucugguaugaacuugaggacaca

SEQ ID NO: 1224903 - RNA, 19 nt, Human
ucugugaacuugaaauuug

SEQ ID NO: 1224904 - RNA, 22 nt, Human
ucugugaacuugaaauuugaau

SEQ ID NO: 1224905 - RNA, 18 nt, Human
ugaaauauuauguuaaaa

SEQ ID NO: 1224906 - RNA, 15 nt, Human
ugaaauuguauuaca

SEQ ID NO: 1224907 - RNA, 21 nt, Human
ugaaauuguaauuauaucuga

SEQ ID NO: 1224908 - RNA, 14 nt, Human
ugaaauuugaauuu

SEQ ID NO: 1224909 - RNA, 15 nt, Human
ugaaauuugaauuuu

SEQ ID NO: 1224910 - RNA, 16 nt, Human
ugaaauuugaauuuug

SEQ ID NO: 1224911 - RNA, 17 nt, Human
ugaaauuugaauuuugu

SEQ ID NO: 1224912 - RNA, 22 nt, Human
agagauuuuuuuguuguuuguu

SEQ ID NO: 1224913 - RNA, 23 nt, Human
agagauuuuuuuguuguuuguuu

SEQ ID NO: 1224914 - RNA, 12 nt, Human
agagcacugcuc

SEQ ID NO: 1224915 - RNA, 16 nt, Human
agagcacugcuccagu

SEQ ID NO: 1224916 - RNA, 21 nt, Human
ugaacuaggauuguaguccca

SEQ ID NO: 1224917 - RNA, 11 nt, Human
ugaacuuugcu

SEQ ID NO: 1224918 - RNA, 15 nt, Human
ugaacuuugcugagc

SEQ ID NO: 1224919 - RNA, 16 nt, Human
ugaacuuugcugagcc

SEQ ID NO: 1224920 - RNA, 21 nt, Human
agagcuggagaugaggccaga

SEQ ID NO: 1224921 - RNA, 23 nt, Human
agagcuggagaugaggccagacc

SEQ ID NO: 1224922 - RNA, 22 nt, Human
agagcuggagaugaggccagac

SEQ ID NO: 1224923 - RNA, 22 nt, Human
ugaagcacagugaucaaguuau

SEQ ID NO: 1224924 - RNA, 12 nt, Human
agagguuuuaaa

SEQ ID NO: 1224925 - RNA, 21 nt, Human
ugaauuuauuggcuuuucuga

SEQ ID NO: 1224926 - RNA, 16 nt, Human
ugaauuuuacauggcu

SEQ ID NO: 1224927 - RNA, 22 nt, Human
ugaauuuauuggcuuuucugau

SEQ ID NO: 1224928 - RNA, 23 nt, Human
ugaauuuauuggcuuuucugauc

SEQ ID NO: 1224929 - RNA, 14 nt, Human
agauacuggauugu

SEQ ID NO: 1224930 - RNA, 17 nt, Human
agauaaagguucaugca

SEQ ID NO: 1224931 - RNA, 15 nt, Human
agauacugaaauaaa

SEQ ID NO: 1224932 - RNA, 13 nt, Human
agauacugaaaua

SEQ ID NO: 1224933 - RNA, 12 nt, Human
agauacugaaau

SEQ ID NO: 1224934 - RNA, 20 nt, Human
agaguugaugguuguacaua

SEQ ID NO: 1224935 - RNA, 17 nt, Human
agaguuuagcuggaaaa

SEQ ID NO: 1224936 - RNA, 16 nt, Human
agaguuuagcuggaaa

SEQ ID NO: 1224937 - RNA, 13 nt, Human
agaucaggaagag

SEQ ID NO: 1224938 - RNA, 17 nt, Human
agaucaggaagagaagg

SEQ ID NO: 1224939 - RNA, 18 nt, Human
agaucaggaagagaagga

SEQ ID NO: 1224940 - RNA, 19 nt, Human
agaucaggaagagaaggag

SEQ ID NO: 1224941 - RNA, 12 nt, Human
agaucauuguga

SEQ ID NO: 1224942 - RNA, 20 nt, Human
agaugcaguucugaagaaga

SEQ ID NO: 1224943 - RNA, 19 nt, Human
agaugcaguucugaagaag

SEQ ID NO: 1224944 - RNA, 18 nt, Human
agaugcaguucugaagaa

SEQ ID NO: 1224945 - RNA, 23 nt, Human
ugauuugacauagucuggcugua

SEQ ID NO: 1224946 - RNA, 19 nt, Human
agccacggggacucagccc

SEQ ID NO: 1224947 - RNA, 15 nt, Human
agccacgguguucug

SEQ ID NO: 1224948 - RNA, 12 nt, Human
ugcaaauuucau

SEQ ID NO: 1224949 - RNA, 21 nt, Human
ugcaagccagauuuuccugaa

SEQ ID NO: 1224950 - RNA, 15 nt, Human
ugcaagccagauuuu

SEQ ID NO: 1224951 - RNA, 21 nt, Human
ugcaaggccugguguuucuug

SEQ ID NO: 1224952 - RNA, 23 nt, Human
ugcaaggccugguguuucuugau

SEQ ID NO: 1224953 - RNA, 18 nt, Human
agcccugggaggcucugg

SEQ ID NO: 1224954 - RNA, 20 nt, Human
agcccugggaggcucuggag

SEQ ID NO: 1224955 - RNA, 19 nt, Human
ugcauggaaauucccuuca

SEQ ID NO: 1224956 - RNA, 23 nt, Human
ugcauggaaauucccuucaucug

SEQ ID NO: 1224957 - RNA, 11 nt, Human
ugcauggaaau

SEQ ID NO: 1224958 - RNA, 17 nt, Human
ugcauagaauaaaauuu

SEQ ID NO: 1224959 - RNA, 11 nt, Human
ugcaggucccu

SEQ ID NO: 1224960 - RNA, 22 nt, Human
ugcaggucccuaauaaagcugu

SEQ ID NO: 1224961 - RNA, 17 nt, Human
agccuccuuagaaaaaa

SEQ ID NO: 1224962 - RNA, 19 nt, Human
agcagucaggaaagagaac

SEQ ID NO: 1224963 - RNA, 18 nt, Human
agcagucaggaaagagaa

SEQ ID NO: 1224964 - RNA, 17 nt, Human
agcagucaggaaagaga

SEQ ID NO: 1224965 - RNA, 15 nt, Human
agcauauauuuuuau

SEQ ID NO: 1224966 - RNA, 18 nt, Human
agcauauauuuuuauauu

SEQ ID NO: 1224967 - RNA, 20 nt, Human
agcauauauuuuuauauuua

SEQ ID NO: 1224968 - RNA, 22 nt, Human
agcauauauuuuuauauuuacu

SEQ ID NO: 1224969 - RNA, 22 nt, Human
agcauuuagauguauagguuga

SEQ ID NO: 1224970 - RNA, 18 nt, Human
agcauuuguguugaagag

SEQ ID NO: 1224971 - RNA, 17 nt, Human
agcauuuguguugaaga

SEQ ID NO: 1224972 - RNA, 17 nt, Human
ugaucaccgacugaaaa

SEQ ID NO: 1224973 - RNA, 19 nt, Human
ugaucaccgacugaaaaua

SEQ ID NO: 1224974 - RNA, 13 nt, Human
agcauccuggaau

SEQ ID NO: 1224975 - RNA, 15 nt, Human
agcauccuggaauau

SEQ ID NO: 1224976 - RNA, 14 nt, Human
agcauccuggaaua

SEQ ID NO: 1224977 - RNA, 15 nt, Human
agcaucccucaccca

SEQ ID NO: 1224978 - RNA, 13 nt, Human
ugauccagaaaga

SEQ ID NO: 1224979 - RNA, 23 nt, Human
ugauccagaaagaaaacuuguau

SEQ ID NO: 1224980 - RNA, 19 nt, Human
ugauccagcagauuauuca

SEQ ID NO: 1224981 - RNA, 20 nt, Human
ugauccagcagauuauucac

SEQ ID NO: 1224982 - RNA, 16 nt, Human
ugauuaaguaaugaua

SEQ ID NO: 1224983 - RNA, 15 nt, Human
ugauuaaguaaugau

SEQ ID NO: 1224984 - RNA, 16 nt, Human
aggacuucuuuaauuu

SEQ ID NO: 1224985 - RNA, 21 nt, Human
aggacuucuuuaauuuuggaa

SEQ ID NO: 1224986 - RNA, 22 nt, Human
aggacuucuuuaauuuuggaau

SEQ ID NO: 1224987 - RNA, 23 nt, Human
aggacuucuuuaauuuuggaauu

SEQ ID NO: 1224988 - RNA, 14 nt, Human
aggacuucuuuaau

SEQ ID NO: 1224989 - RNA, 23 nt, Human
aggagcccuucuauacccaccca

SEQ ID NO: 1224990 - RNA, 13 nt, Human
aggaauucuguau

SEQ ID NO: 1224991 - RNA, 14 nt, Human
aggaauucuguaua

SEQ ID NO: 1224992 - RNA, 15 nt, Human
aggaauucuguauag

SEQ ID NO: 1224993 - RNA, 15 nt, Human
aggaucaguuaacua

SEQ ID NO: 1224994 - RNA, 23 nt, Human
aggaucaguuaacuauugcauuu

SEQ ID NO: 1224995 - RNA, 17 nt, Human
aggaucaguuaacuauu

SEQ ID NO: 1224996 - RNA, 11 nt, Human
aggauccaggc

SEQ ID NO: 1224997 - RNA, 12 nt, Human
aggaggacccag

SEQ ID NO: 1224998 - RNA, 13 nt, Human
aggaggacccagg

SEQ ID NO: 1224999 - RNA, 14 nt, Human
aggaggacccagga

SEQ ID NO: 1225000 - RNA, 15 nt, Human
aggaggacccaggac

SEQ ID NO: 1225001 - RNA, 16 nt, Human
aggaggacccaggaca

SEQ ID NO: 1225002 - RNA, 17 nt, Human
aggaggacccaggacag

SEQ ID NO: 1225003 - RNA, 18 nt, Human
aggaggacccaggacagg

SEQ ID NO: 1225004 - RNA, 16 nt, Human
ugcuuuuuauggccug

SEQ ID NO: 1225005 - RNA, 14 nt, Human
uggaguugaaaauc

SEQ ID NO: 1225006 - RNA, 13 nt, Human
uggagugcagugg

SEQ ID NO: 1225007 - RNA, 12 nt, Human
uggauuccagag

SEQ ID NO: 1225008 - RNA, 23 nt, Human
aggcacacaccaccacgccuggc

SEQ ID NO: 1225009 - RNA, 21 nt, Human
uggagcucgugggacagucac

SEQ ID NO: 1225010 - RNA, 21 nt, Human
uggagcucguggaacaguuac

SEQ ID NO: 1225011 - RNA, 17 nt, Human
uggagcucguggaacag

SEQ ID NO: 1225012 - RNA, 22 nt, Human
ugccugcuuuuuauggccugug

SEQ ID NO: 1225013 - RNA, 20 nt, Human
ugccugcuuuuuauggccug

SEQ ID NO: 1225014 - RNA, 21 nt, Human
ugccugcuuuuuauggccugu

SEQ ID NO: 1225015 - RNA, 14 nt, Human
ugccaucaauaaaa

SEQ ID NO: 1225016 - RNA, 22 nt, Human
ugccaucaauaaaaaauuauga

SEQ ID NO: 1225017 - RNA, 19 nt, Human
ugccuuuucccaacuccag

SEQ ID NO: 1225018 - RNA, 16 nt, Human
ugcuaauuuugaaaaa

SEQ ID NO: 1225019 - RNA, 18 nt, Human
ugcuaauuuugaaaaacu

SEQ ID NO: 1225020 - RNA, 19 nt, Human
ugcuaauuuugaaaaacug

SEQ ID NO: 1225021 - RNA, 20 nt, Human
ugcuaauuuugaaaaacugc

SEQ ID NO: 1225022 - RNA, 19 nt, Human
aggaagcaaauagaagaga

SEQ ID NO: 1225023 - RNA, 18 nt, Human
aggaagaucccccagaaa

SEQ ID NO: 1225024 - RNA, 17 nt, Human
aggaagaucccccagaa

SEQ ID NO: 1225025 - RNA, 22 nt, Human
aggaaggaggacccaggacagg

SEQ ID NO: 1225026 - RNA, 16 nt, Human
aggaaggcagggagga

SEQ ID NO: 1225027 - RNA, 18 nt, Human
aggaaggcagggaggagg

SEQ ID NO: 1225028 - RNA, 20 nt, Human
aggaaggcagggaggaggca

SEQ ID NO: 1225029 - RNA, 22 nt, Human
aggaaggcagggaggaggcaga

SEQ ID NO: 1225030 - RNA, 16 nt, Human
aggaauuacgugcucu

SEQ ID NO: 1225031 - RNA, 23 nt, Human
ugcugagccuguaaaauaaaagg

SEQ ID NO: 1225032 - RNA, 16 nt, Human
aggaagaucccccaga

SEQ ID NO: 1225033 - RNA, 17 nt, Human
ugcucuugaugccuggc

SEQ ID NO: 1225034 - RNA, 23 nt, Human
aggaaaccaguuaggucucaaua

SEQ ID NO: 1225035 - RNA, 22 nt, Human
ugcuauuucuauauuuucauuc

SEQ ID NO: 1225036 - RNA, 19 nt, Human
ugggccccauguuaacccc

SEQ ID NO: 1225037 - RNA, 20 nt, Human
ugggccccugccucucugca

SEQ ID NO: 1225038 - RNA, 15 nt, Human
ugggccccugccucu

SEQ ID NO: 1225039 - RNA, 19 nt, Human
ugggccccugccucucugc

SEQ ID NO: 1225040 - RNA, 20 nt, Human
agggaggaggcagagaagaa

SEQ ID NO: 1225041 - RNA, 23 nt, Human
uggggcuccuccaggguggcagc

SEQ ID NO: 1225042 - RNA, 16 nt, Human
aggggaauugaggaca

SEQ ID NO: 1225043 - RNA, 20 nt, Human
uggucacguuuggugcuucu

SEQ ID NO: 1225044 - RNA, 16 nt, Human
ugggucgcccuggacu

SEQ ID NO: 1225045 - RNA, 18 nt, Human
ugggucgcccuggacugu

SEQ ID NO: 1225046 - RNA, 21 nt, Human
ugggucgcccuggacugugug

SEQ ID NO: 1225047 - RNA, 16 nt, Human
uggugcccugcuuuca

SEQ ID NO: 1225048 - RNA, 19 nt, Human
uggugcccugcuuucagau

SEQ ID NO: 1225049 - RNA, 20 nt, Human
uggugcccugcuuucagaua

SEQ ID NO: 1225050 - RNA, 23 nt, Human
uggugcuucucagauuucugagg

SEQ ID NO: 1225051 - RNA, 19 nt, Human
aggucuucuuaauauguuc

SEQ ID NO: 1225052 - RNA, 14 nt, Human
aggugagaccaccu

SEQ ID NO: 1225053 - RNA, 15 nt, Human
aggugagaccaccuc

SEQ ID NO: 1225054 - RNA, 16 nt, Human
aggugagaccaccucu

SEQ ID NO: 1225055 - RNA, 15 nt, Human
uguaaauacaauuuu

SEQ ID NO: 1225056 - RNA, 18 nt, Human
aguagcguuuuuuaaaug

SEQ ID NO: 1225057 - RNA, 19 nt, Human
aguagcguuuuuuaaaugu

SEQ ID NO: 1225058 - RNA, 20 nt, Human
aguagcguuuuuuaaaugua

SEQ ID NO: 1225059 - RNA, 16 nt, Human
uguaguagcguuuuuu

SEQ ID NO: 1225060 - RNA, 21 nt, Human
uguaguagcguuuuuuaaaug

SEQ ID NO: 1225061 - RNA, 22 nt, Human
uguaguagcguuuuuuaaaugu

SEQ ID NO: 1225062 - RNA, 23 nt, Human
uguaguagcguuuuuuaaaugua

SEQ ID NO: 1225063 - RNA, 22 nt, Human
aguacaugauaaaugauagaca

SEQ ID NO: 1225064 - RNA, 17 nt, Human
aguaaaauaauaauuuu

SEQ ID NO: 1225065 - RNA, 17 nt, Human
aguaaugauaacuggaa

SEQ ID NO: 1225066 - RNA, 20 nt, Human
aguaaugauaacuggaaacu

SEQ ID NO: 1225067 - RNA, 18 nt, Human
aguaaugauaacuggaaa

SEQ ID NO: 1225068 - RNA, 13 nt, Human
aguaaaauccaca

SEQ ID NO: 1225069 - RNA, 22 nt, Human
uguacuugcucuugaugccugg

SEQ ID NO: 1225070 - RNA, 23 nt, Human
uguacuugcucuugaugccuggc

SEQ ID NO: 1225071 - RNA, 17 nt, Human
agucaccucauggaauu

SEQ ID NO: 1225072 - RNA, 15 nt, Human
agucaccucauggaa

SEQ ID NO: 1225073 - RNA, 14 nt, Human
agucaccucaugga

SEQ ID NO: 1225074 - RNA, 21 nt, Human
aguauuagaauaccacaggaa

SEQ ID NO: 1225075 - RNA, 22 nt, Human
aguauuucuaugaaauauuaug

SEQ ID NO: 1225076 - RNA, 18 nt, Human
aguauuucuaugaaauau

SEQ ID NO: 1225077 - RNA, 17 nt, Human
aguauuucuaugaaaua

SEQ ID NO: 1225078 - RNA, 21 nt, Human
ugucaauaaaauccauacauu

SEQ ID NO: 1225079 - RNA, 18 nt, Human
aguauuagaauaccacag

SEQ ID NO: 1225080 - RNA, 13 nt, Human
uguauuacaaauc

SEQ ID NO: 1225081 - RNA, 22 nt, Human
uguauuacaaauccaaugaaau

SEQ ID NO: 1225082 - RNA, 16 nt, Human
uguaguguuggagaag

SEQ ID NO: 1225083 - RNA, 15 nt, Human
uguaguguuggagaa

SEQ ID NO: 1225084 - RNA, 14 nt, Human
uguaguguuggaga

SEQ ID NO: 1225085 - RNA, 17 nt, Human
agucuuuggaacccuaa

SEQ ID NO: 1225086 - RNA, 15 nt, Human
agucucuauaccaau

SEQ ID NO: 1225087 - RNA, 17 nt, Human
agucucuauaccaauaa

SEQ ID NO: 1225088 - RNA, 19 nt, Human
agucucuauaccaauaaag

SEQ ID NO: 1225089 - RNA, 20 nt, Human
agucucuauaccaauaaagu

SEQ ID NO: 1225090 - RNA, 21 nt, Human
agucucuauaccaauaaagug

SEQ ID NO: 1225091 - RNA, 22 nt, Human
agucucuauaccaauaaaguga

SEQ ID NO: 1225092 - RNA, 12 nt, Human
ugugaaauuauu

SEQ ID NO: 1225093 - RNA, 20 nt, Human
ugugaacaguuguguuugaa

SEQ ID NO: 1225094 - RNA, 22 nt, Human
ugugaacaguuguguuugaagc

SEQ ID NO: 1225095 - RNA, 12 nt, Human
ugugaacuugaa

SEQ ID NO: 1225096 - RNA, 14 nt, Human
ugugaacuugaaau

SEQ ID NO: 1225097 - RNA, 15 nt, Human
ugugaacuugaaauu

SEQ ID NO: 1225098 - RNA, 16 nt, Human
ugugaacuugaaauuu

SEQ ID NO: 1225099 - RNA, 15 nt, Human
agugaaagaaaauaa

SEQ ID NO: 1225100 - RNA, 17 nt, Human
agugaaagaaaauaaca

SEQ ID NO: 1225101 - RNA, 20 nt, Human
ugugccagauuuaugcauau

SEQ ID NO: 1225102 - RNA, 18 nt, Human
ugugccagauuuaugcau

SEQ ID NO: 1225103 - RNA, 18 nt, Human
ugugcugggguuaucuga

SEQ ID NO: 1225104 - RNA, 19 nt, Human
ugugcugggguuaucugaa

SEQ ID NO: 1225105 - RNA, 14 nt, Human
uguuacaaauugua

SEQ ID NO: 1225106 - RNA, 13 nt, Human
aguggacaggagu

SEQ ID NO: 1225107 - RNA, 15 nt, Human
uguucugugauauaa

SEQ ID NO: 1225108 - RNA, 18 nt, Human
uguucugugauauaagug

SEQ ID NO: 1225109 - RNA, 15 nt, Human
uguuauaaucuuuca

SEQ ID NO: 1225110 - RNA, 19 nt, Human
agugaguuggguguauugu

SEQ ID NO: 1225111 - RNA, 20 nt, Human
agugaguuggguguauugug

SEQ ID NO: 1225112 - RNA, 15 nt, Human
agugcugaauuuccc

SEQ ID NO: 1225113 - RNA, 19 nt, Human
agugcugaauuucccucuc

SEQ ID NO: 1225114 - RNA, 18 nt, Human
uguguaagacaaaaagcu

SEQ ID NO: 1225115 - RNA, 13 nt, Human
uguguaaguagau

SEQ ID NO: 1225116 - RNA, 20 nt, Human
ugugugaaagguacuucaaa

SEQ ID NO: 1225117 - RNA, 13 nt, Human
uguguugaagagg

SEQ ID NO: 1225118 - RNA, 21 nt, Human
uguuuuauuuaaccucuaaau

SEQ ID NO: 1225119 - RNA, 19 nt, Human
uguuuggaccaaaaaccag

SEQ ID NO: 1225120 - RNA, 19 nt, Human
aguucuuacugcuuaauuc

SEQ ID NO: 1225121 - RNA, 23 nt, Human
aguucuuacugcuuaauucaaau

SEQ ID NO: 1225122 - RNA, 14 nt, Human
uguuuugcaagcca

SEQ ID NO: 1225123 - RNA, 18 nt, Human
uguuucuuuguaaugaaa

SEQ ID NO: 1225124 - RNA, 19 nt, Human
uguuucuuuguaaugaaaa

SEQ ID NO: 1225125 - RNA, 19 nt, Human
uguugccuugcauaauggu

SEQ ID NO: 1225126 - RNA, 22 nt, Human
uguuuagucuugucucagauuu

SEQ ID NO: 1225127 - RNA, 23 nt, Human
uguuuagucuugucucagauuuu

SEQ ID NO: 1225128 - RNA, 14 nt, Human
uguuuauuacagua

SEQ ID NO: 1225129 - RNA, 18 nt, Human
uguuuauuacaguauaau

SEQ ID NO: 1225130 - RNA, 16 nt, Human
aguuggguguauugug

SEQ ID NO: 1225131 - RNA, 22 nt, Human
aguugcauagguuuaauaauuu

SEQ ID NO: 1225132 - RNA, 10 nt, Human
aguugcagcc

SEQ ID NO: 1225133 - RNA, 22 nt, Human
aguugccuaaauccauuuggaa

SEQ ID NO: 1225134 - RNA, 23 nt, Human
aguugccuaaauccauuuggaaa

SEQ ID NO: 1225135 - RNA, 17 nt, Human
aguuggguguauugugc

SEQ ID NO: 1225136 - RNA, 20 nt, Human
aguuggguguauugugcgcu

SEQ ID NO: 1225137 - RNA, 20 nt, Human
aguuuaauauuaaagccaug

SEQ ID NO: 1225138 - RNA, 15 nt, Human
aguuuaauauuaaag

SEQ ID NO: 1225139 - RNA, 16 nt, Human
aguuuaauauuaaagc

SEQ ID NO: 1225140 - RNA, 18 nt, Human
aguuuaauauuaaagcca

SEQ ID NO: 1225141 - RNA, 19 nt, Human
aguuuaauauuaaagccau

SEQ ID NO: 1225142 - RNA, 18 nt, Human
uuaaauuuuuuuuacauu

SEQ ID NO: 1225143 - RNA, 19 nt, Human
uuaaauuuuuuuuacauuu

SEQ ID NO: 1225144 - RNA, 20 nt, Human
uuaaauuuuuuuuacauuuu

SEQ ID NO: 1225145 - RNA, 14 nt, Human
uuaacaacagcugg

SEQ ID NO: 1225146 - RNA, 16 nt, Human
uuaaaauuacaacuaa

SEQ ID NO: 1225147 - RNA, 20 nt, Human
auaaaauuuuuaaucuuuaa

SEQ ID NO: 1225148 - RNA, 13 nt, Human
uuaauaaacacuc

SEQ ID NO: 1225149 - RNA, 17 nt, Human
uuaauaaacacucuuga

SEQ ID NO: 1225150 - RNA, 17 nt, Human
uuaauuccuucagcacu

SEQ ID NO: 1225151 - RNA, 19 nt, Human
uuaauuccuucagcacuuu

SEQ ID NO: 1225152 - RNA, 20 nt, Human
uuaauuccuucagcacuuua

SEQ ID NO: 1225153 - RNA, 22 nt, Human
uuaagaagacugcauuauauuu

SEQ ID NO: 1225154 - RNA, 18 nt, Human
uuaaguaaggaauuuuau

SEQ ID NO: 1225155 - RNA, 18 nt, Human
uuaaguaaugauaacugg

SEQ ID NO: 1225156 - RNA, 19 nt, Human
auaaaauccauacauuugu

SEQ ID NO: 1225157 - RNA, 18 nt, Human
auaaaauccauacauuug

SEQ ID NO: 1225158 - RNA, 22 nt, Human
auaaaauaauuuuuauauuuga

SEQ ID NO: 1225159 - RNA, 21 nt, Human
auaaaauaauuuuuauauuug

SEQ ID NO: 1225160 - RNA, 16 nt, Human
auaaaauaauuuuuau

SEQ ID NO: 1225161 - RNA, 20 nt, Human
auaaaaggucggaccagcuu

SEQ ID NO: 1225162 - RNA, 13 nt, Human
uuacaguauaauu

SEQ ID NO: 1225163 - RNA, 16 nt, Human
uuacaguauaauuaac

SEQ ID NO: 1225164 - RNA, 17 nt, Human
uuacaguauaauuaaca

SEQ ID NO: 1225165 - RNA, 18 nt, Human
uuacaguauaauuaacau

SEQ ID NO: 1225166 - RNA, 19 nt, Human
uuacaguauaauuaacaug

SEQ ID NO: 1225167 - RNA, 20 nt, Human
uuacaguauaauuaacaugu

SEQ ID NO: 1225168 - RNA, 20 nt, Human
auaaaucugugaacuugaaa

SEQ ID NO: 1225169 - RNA, 21 nt, Human
auaaaucugugaacuugaaau

SEQ ID NO: 1225170 - RNA, 22 nt, Human
auaaaucugugaacuugaaauu

SEQ ID NO: 1225171 - RNA, 16 nt, Human
auaaauagcuagacug

SEQ ID NO: 1225172 - RNA, 18 nt, Human
auaaauagcuagacuggu

SEQ ID NO: 1225173 - RNA, 21 nt, Human
auaaauagcuagacuggugac

SEQ ID NO: 1225174 - RNA, 18 nt, Human
auaaacacucuugaaaaa

SEQ ID NO: 1225175 - RNA, 15 nt, Human
uuacuguaagaaaau

SEQ ID NO: 1225176 - RNA, 21 nt, Human
uucagcaaaaauauuuuauga

SEQ ID NO: 1225177 - RNA, 18 nt, Human
auagucaaauugugugaa

SEQ ID NO: 1225178 - RNA, 19 nt, Human
auauauaacaaugcuguau

SEQ ID NO: 1225179 - RNA, 18 nt, Human
auauauaacaaugcugua

SEQ ID NO: 1225180 - RNA, 17 nt, Human
auauauaacaaugcugu

SEQ ID NO: 1225181 - RNA, 15 nt, Human
auauaacaaugcugu

SEQ ID NO: 1225182 - RNA, 12 nt, Human
auauaacaaugc

SEQ ID NO: 1225183 - RNA, 19 nt, Human
auauaagcuuguauuccuu

SEQ ID NO: 1225184 - RNA, 17 nt, Human
auauaacaaugcuguau

SEQ ID NO: 1225185 - RNA, 13 nt, Human
auaugugaacagu

SEQ ID NO: 1225186 - RNA, 22 nt, Human
auaugauucaaaugucuauaaa

SEQ ID NO: 1225187 - RNA, 13 nt, Human
auaugauucaaau

SEQ ID NO: 1225188 - RNA, 15 nt, Human
auaucugaggaauuc

SEQ ID NO: 1225189 - RNA, 16 nt, Human
auaucugaggaauucu

SEQ ID NO: 1225190 - RNA, 17 nt, Human
auaucugaggaauucug

SEQ ID NO: 1225191 - RNA, 18 nt, Human
auaucugaggaauucugu

SEQ ID NO: 1225192 - RNA, 19 nt, Human
auaucugaggaauucugua

SEQ ID NO: 1225193 - RNA, 20 nt, Human
auaucugaggaauucuguau

SEQ ID NO: 1225194 - RNA, 21 nt, Human
auaucugaggaauucuguaua

SEQ ID NO: 1225195 - RNA, 22 nt, Human
auaucugaggaauucuguauag

SEQ ID NO: 1225196 - RNA, 23 nt, Human
auaucugaggaauucuguauaga

SEQ ID NO: 1225197 - RNA, 22 nt, Human
auaucuauauuuuacauaaauu

SEQ ID NO: 1225198 - RNA, 20 nt, Human
auaucuauauuuuacauaaa

SEQ ID NO: 1225199 - RNA, 17 nt, Human
auaucuauauuuuacau

SEQ ID NO: 1225200 - RNA, 18 nt, Human
auauauucagccuggcuu

SEQ ID NO: 1225201 - RNA, 12 nt, Human
uuauuucaauau

SEQ ID NO: 1225202 - RNA, 18 nt, Human
auagcuagacuggugacu

SEQ ID NO: 1225203 - RNA, 19 nt, Human
auagcuagacuggugacug

SEQ ID NO: 1225204 - RNA, 23 nt, Human
auagcuagacuggugacugauuc

SEQ ID NO: 1225205 - RNA, 18 nt, Human
auagcuacuaauuuuaaa

SEQ ID NO: 1225206 - RNA, 14 nt, Human
auagcuagacuggu

SEQ ID NO: 1225207 - RNA, 15 nt, Human
auagcuagacuggug

SEQ ID NO: 1225208 - RNA, 16 nt, Human
auagcuagacugguga

SEQ ID NO: 1225209 - RNA, 14 nt, Human
auagcuacuaauuu

SEQ ID NO: 1225210 - RNA, 17 nt, Human
auagcuacuaauuuuaa

SEQ ID NO: 1225211 - RNA, 13 nt, Human
auagcuaaguaca

SEQ ID NO: 1225212 - RNA, 14 nt, Human
auagcuaaguacac

SEQ ID NO: 1225213 - RNA, 15 nt, Human
auagcuaaguacaca

SEQ ID NO: 1225214 - RNA, 18 nt, Human
auagcuaaguacacaaua

SEQ ID NO: 1225215 - RNA, 13 nt, Human
uucaauaaagcug

SEQ ID NO: 1225216 - RNA, 12 nt, Human
uucaauaaagcu

SEQ ID NO: 1225217 - RNA, 19 nt, Human
uucacauuguauucagagu

SEQ ID NO: 1225218 - RNA, 14 nt, Human
uucacauuggaaac

SEQ ID NO: 1225219 - RNA, 17 nt, Human
auaggcacaggaaacca

SEQ ID NO: 1225220 - RNA, 21 nt, Human
auagggcaauuaauuccuuca

SEQ ID NO: 1225221 - RNA, 22 nt, Human
auagggcaauuaauuccuucag

SEQ ID NO: 1225222 - RNA, 23 nt, Human
auagggcaauuaauuccuucagc

SEQ ID NO: 1225223 - RNA, 18 nt, Human
uucaagugcuucuccagc

SEQ ID NO: 1225224 - RNA, 15 nt, Human
uucaaacauauauaa

SEQ ID NO: 1225225 - RNA, 16 nt, Human
uucaaaauuguuacaa

SEQ ID NO: 1225226 - RNA, 13 nt, Human
uucuguacuuuuu

SEQ ID NO: 1225227 - RNA, 20 nt, Human
aucauuuuaccuuugacaaa

SEQ ID NO: 1225228 - RNA, 21 nt, Human
uucugaaauuuccugggagcu

SEQ ID NO: 1225229 - RNA, 13 nt, Human
uucugaagaagau

SEQ ID NO: 1225230 - RNA, 12 nt, Human
uucugaagaaga

SEQ ID NO: 1225231 - RNA, 14 nt, Human
uucugaagaagaug

SEQ ID NO: 1225232 - RNA, 21 nt, Human
uucugguaugaacuugaggac

SEQ ID NO: 1225233 - RNA, 22 nt, Human
uucugguaugaacuugaggaca

SEQ ID NO: 1225234 - RNA, 20 nt, Human
uucucacagcuccaagaauu

SEQ ID NO: 1225235 - RNA, 18 nt, Human
uucucaacuccaaacuga

SEQ ID NO: 1225236 - RNA, 14 nt, Human
uucucaacuccaaa

SEQ ID NO: 1225237 - RNA, 14 nt, Human
aucauucauuuucu

SEQ ID NO: 1225238 - RNA, 13 nt, Human
auauuuucauucu

SEQ ID NO: 1225239 - RNA, 14 nt, Human
auauuuuaagacga

SEQ ID NO: 1225240 - RNA, 12 nt, Human
auauuuuaugau

SEQ ID NO: 1225241 - RNA, 13 nt, Human
auauuuuaugauc

SEQ ID NO: 1225242 - RNA, 17 nt, Human
auauuuuaugauccagc

SEQ ID NO: 1225243 - RNA, 22 nt, Human
auauuuuaugauccagcagauu

SEQ ID NO: 1225244 - RNA, 18 nt, Human
uuccucugucuccuaagc

SEQ ID NO: 1225245 - RNA, 15 nt, Human
uuccugggagcuuuu

SEQ ID NO: 1225246 - RNA, 16 nt, Human
uuccugggagcuuuug

SEQ ID NO: 1225247 - RNA, 19 nt, Human
uuccuucagcacuuuagaa

SEQ ID NO: 1225248 - RNA, 16 nt, Human
uuccuucagcacuuua

SEQ ID NO: 1225249 - RNA, 21 nt, Human
auauuuucaugcuguucauga

SEQ ID NO: 1225250 - RNA, 18 nt, Human
auauuuucaugcuguuca

SEQ ID NO: 1225251 - RNA, 15 nt, Human
auauuaaagccaugu

SEQ ID NO: 1225252 - RNA, 18 nt, Human
auauuaaagccauguuua

SEQ ID NO: 1225253 - RNA, 23 nt, Human
auauuaaagccauguuuauuaca

SEQ ID NO: 1225254 - RNA, 22 nt, Human
auauugauccagaaagaaaacu

SEQ ID NO: 1225255 - RNA, 23 nt, Human
auauucucacagcuccaagaauu

SEQ ID NO: 1225256 - RNA, 22 nt, Human
auauucucacagcuccaagaau

SEQ ID NO: 1225257 - RNA, 13 nt, Human
auauuugaaauau

SEQ ID NO: 1225258 - RNA, 23 nt, Human
auauuugaaauauugacuuuuua

SEQ ID NO: 1225259 - RNA, 19 nt, Human
auauuugaaauauugacuu

SEQ ID NO: 1225260 - RNA, 14 nt, Human
auauuugaaauauu

SEQ ID NO: 1225261 - RNA, 12 nt, Human
uugacuuuuuau

SEQ ID NO: 1225262 - RNA, 11 nt, Human
uugagaaaaau

SEQ ID NO: 1225263 - RNA, 19 nt, Human
uugagaaaaauauauacua

SEQ ID NO: 1225264 - RNA, 13 nt, Human
uugacaugggaca

SEQ ID NO: 1225265 - RNA, 16 nt, Human
aucucuuguuuaaauu

SEQ ID NO: 1225266 - RNA, 16 nt, Human
aucugaagucagaucu

SEQ ID NO: 1225267 - RNA, 17 nt, Human
aucugaagucagaucug

SEQ ID NO: 1225268 - RNA, 18 nt, Human
aucugaagucagaucugc

SEQ ID NO: 1225269 - RNA, 23 nt, Human
aucugaagucagaucugccuaag

SEQ ID NO: 1225270 - RNA, 22 nt, Human
uugcaagccagauuuuccugaa

SEQ ID NO: 1225271 - RNA, 18 nt, Human
uugcaacuuuguauaaaa

SEQ ID NO: 1225272 - RNA, 16 nt, Human
uugcaacuuuguauaa

SEQ ID NO: 1225273 - RNA, 17 nt, Human
uugcaacuuuguauaaa

SEQ ID NO: 1225274 - RNA, 14 nt, Human
uugcucuugaugcc

SEQ ID NO: 1225275 - RNA, 17 nt, Human
uugcucuugaugccugg

SEQ ID NO: 1225276 - RNA, 18 nt, Human
uugcucuugaugccuggc

SEQ ID NO: 1225277 - RNA, 20 nt, Human
uugcuuuguauuguauauua

SEQ ID NO: 1225278 - RNA, 16 nt, Human
uugcuuuuaaaaucca

SEQ ID NO: 1225279 - RNA, 15 nt, Human
uuggagaagaacuga

SEQ ID NO: 1225280 - RNA, 22 nt, Human
uuggagaagaacugaaaucaua

SEQ ID NO: 1225281 - RNA, 17 nt, Human
uuggagaagaacugaaa

SEQ ID NO: 1225282 - RNA, 16 nt, Human
aucuuauaauuuaaaa

SEQ ID NO: 1225283 - RNA, 15 nt, Human
aucuuauaauuuaaa

SEQ ID NO: 1225284 - RNA, 15 nt, Human
augaagcaaugcuuc

SEQ ID NO: 1225285 - RNA, 14 nt, Human
augaagcaaugcuu

SEQ ID NO: 1225286 - RNA, 13 nt, Human
augaaauauuaug

SEQ ID NO: 1225287 - RNA, 13 nt, Human
uuggccaugcaga

SEQ ID NO: 1225288 - RNA, 19 nt, Human
uuggccaugcagaaagcau

SEQ ID NO: 1225289 - RNA, 20 nt, Human
uugguuuucacauuggaaac

SEQ ID NO: 1225290 - RNA, 22 nt, Human
uuguaagcaugcacaaauucug

SEQ ID NO: 1225291 - RNA, 12 nt, Human
uuguaaugaaaa

SEQ ID NO: 1225292 - RNA, 21 nt, Human
augcuucuguuuuauaauuuu

SEQ ID NO: 1225293 - RNA, 22 nt, Human
augcuguauuuuaaaagaauga

SEQ ID NO: 1225294 - RNA, 23 nt, Human
augcuguauuuuaaaagaaugau

SEQ ID NO: 1225295 - RNA, 21 nt, Human
uuucaugcuguucaugaaaga

SEQ ID NO: 1225296 - RNA, 19 nt, Human
uuucaaacauauauaacaa

SEQ ID NO: 1225297 - RNA, 19 nt, Human
uuucacauuggaaacaagu

SEQ ID NO: 1225298 - RNA, 14 nt, Human
uuucacauuggaaa

SEQ ID NO: 1225299 - RNA, 13 nt, Human
uuucacauuggaa

SEQ ID NO: 1225300 - RNA, 17 nt, Human
uuuagggguagcauuug

SEQ ID NO: 1225301 - RNA, 21 nt, Human
uuuauaugcuucuguuuuaua

SEQ ID NO: 1225302 - RNA, 21 nt, Human
uuuauauguaccguaggcuuu

SEQ ID NO: 1225303 - RNA, 17 nt, Human
uuuagucuugucucaga

SEQ ID NO: 1225304 - RNA, 23 nt, Human
uuuagucuugucucagauuuuau

SEQ ID NO: 1225305 - RNA, 19 nt, Human
augcgagugcucauuucag

SEQ ID NO: 1225306 - RNA, 22 nt, Human
augccuuuucccaacuccagaa

SEQ ID NO: 1225307 - RNA, 20 nt, Human
augccuuuucccaacuccag

SEQ ID NO: 1225308 - RNA, 14 nt, Human
augccaucaauaaa

SEQ ID NO: 1225309 - RNA, 20 nt, Human
augccccugaauuuaaauag

SEQ ID NO: 1225310 - RNA, 15 nt, Human
augccccugaauuua

SEQ ID NO: 1225311 - RNA, 16 nt, Human
augcagaaagcauccc

SEQ ID NO: 1225312 - RNA, 15 nt, Human
augcagaaagcaucc

SEQ ID NO: 1225313 - RNA, 18 nt, Human
uuuaaaaaaauuccaagu

SEQ ID NO: 1225314 - RNA, 14 nt, Human
uuuaagagacagcc

SEQ ID NO: 1225315 - RNA, 12 nt, Human
uuuaaauguaua

SEQ ID NO: 1225316 - RNA, 13 nt, Human
uuuaaauguauac

SEQ ID NO: 1225317 - RNA, 21 nt, Human
uuuaaauauaugcuaagucuu

SEQ ID NO: 1225318 - RNA, 20 nt, Human
uuuaaaaaagaaacauuugg

SEQ ID NO: 1225319 - RNA, 18 nt, Human
uuguagcauccuggaaua

SEQ ID NO: 1225320 - RNA, 16 nt, Human
uuguagcauccuggaa

SEQ ID NO: 1225321 - RNA, 20 nt, Human
uugucaauaaaauccauaca

SEQ ID NO: 1225322 - RNA, 23 nt, Human
uuuuuggcauaacauaaaucugu

SEQ ID NO: 1225323 - RNA, 24 nt, Human
uuuuuggcauaacauaaaucugug

SEQ ID NO: 1225324 - RNA, 20 nt, Human
uuuuugggcagcaauuuaaa

SEQ ID NO: 1225325 - RNA, 21 nt, Human
uuuuugggcagcaauuuaaau

SEQ ID NO: 1225326 - RNA, 23 nt, Human
uuuuugggcagcaauuuaaaugu

SEQ ID NO: 1225327 - RNA, 11 nt, Human
uuuuuguagua

SEQ ID NO: 1225328 - RNA, 17 nt, Human
uuuuuauauuugaaaua

SEQ ID NO: 1225329 - RNA, 13 nt, Human
uuuuucaaaagaa

SEQ ID NO: 1225330 - RNA, 16 nt, Human
uuuuugagacagaguc

SEQ ID NO: 1225331 - RNA, 15 nt, Human
uuuuggaauuuuccu

SEQ ID NO: 1225332 - RNA, 14 nt, Human
uuuugugaagcaaa

SEQ ID NO: 1225333 - RNA, 12 nt, Human
uuuuuacauuuu

SEQ ID NO: 1225334 - RNA, 11 nt, Human
uuuuuacauuu

SEQ ID NO: 1225335 - RNA, 20 nt, Human
uuuuuauauuuacuaaaaug

SEQ ID NO: 1225336 - RNA, 16 nt, Human
auuacuguaagaaaau

SEQ ID NO: 1225337 - RNA, 15 nt, Human
auuacuguaagaaaa

SEQ ID NO: 1225338 - RNA, 17 nt, Human
auuauaugcuauuucua

SEQ ID NO: 1225339 - RNA, 17 nt, Human
auuccaagugauugaaa

SEQ ID NO: 1225340 - RNA, 12 nt, Human
auucacugauuu

SEQ ID NO: 1225341 - RNA, 17 nt, Human
auucacugauuugacau

SEQ ID NO: 1225342 - RNA, 14 nt, Human
auucagccuggcuu

SEQ ID NO: 1225343 - RNA, 20 nt, Human
auuauauggcuugaguuuaa

SEQ ID NO: 1225344 - RNA, 18 nt, Human
auuauaugcuauuucuau

SEQ ID NO: 1225345 - RNA, 19 nt, Human
auuauaugcuauuucuaua

SEQ ID NO: 1225346 - RNA, 18 nt, Human
auuauucaaaguugccua

SEQ ID NO: 1225347 - RNA, 19 nt, Human
auuauucaaaguugccuaa

SEQ ID NO: 1225348 - RNA, 22 nt, Human
auuauucaaaguugccuaaauc

SEQ ID NO: 1225349 - RNA, 24 nt, Human
auuauucaaaguugccuaaaucca

SEQ ID NO: 1225350 - RNA, 19 nt, Human
auuauucacugauuugaca

SEQ ID NO: 1225351 - RNA, 18 nt, Human
auuauaucugaggaauuc

SEQ ID NO: 1225352 - RNA, 19 nt, Human
auuauaucugaggaauucu

SEQ ID NO: 1225353 - RNA, 20 nt, Human
auuauaucugaggaauucug

SEQ ID NO: 1225354 - RNA, 21 nt, Human
auuauaucugaggaauucugu

SEQ ID NO: 1225355 - RNA, 22 nt, Human
auuauaucugaggaauucugua

SEQ ID NO: 1225356 - RNA, 16 nt, Human
auuauaugcuauuucu

SEQ ID NO: 1225357 - RNA, 16 nt, Human
auucaaaaauuaucua

SEQ ID NO: 1225358 - RNA, 23 nt, Human
auucaaaaauuaucuauagcuaa

SEQ ID NO: 1225359 - RNA, 15 nt, Human
auucagccuggcuuc

SEQ ID NO: 1225360 - RNA, 18 nt, Human
uuugacaaagguaaauca

SEQ ID NO: 1225361 - RNA, 12 nt, Human
uuugaauuuugu

SEQ ID NO: 1225362 - RNA, 14 nt, Human
uuugaauuuugugu

SEQ ID NO: 1225363 - RNA, 20 nt, Human
uuugagacagagucuuccuc

SEQ ID NO: 1225364 - RNA, 19 nt, Human
uuugcuaagcauuccaacu

SEQ ID NO: 1225365 - RNA, 21 nt, Human
uuugggcagcaauuuaaaugu

SEQ ID NO: 1225366 - RNA, 19 nt, Human
auguauacuauaguaccag

SEQ ID NO: 1225367 - RNA, 23 nt, Human
augucgucaaagcugaaauggac

SEQ ID NO: 1225368 - RNA, 17 nt, Human
uuuguaguagcguuuuu

SEQ ID NO: 1225369 - RNA, 17 nt, Human
uuuguaguguuggagaa

SEQ ID NO: 1225370 - RNA, 19 nt, Human
uuuguaguagcguuuuuua

SEQ ID NO: 1225371 - RNA, 15 nt, Human
uuuguaguagcguuu

SEQ ID NO: 1225372 - RNA, 12 nt, Human
auguuuauuaca

SEQ ID NO: 1225373 - RNA, 21 nt, Human
uuuucuuaaccagaucauugu

SEQ ID NO: 1225374 - RNA, 15 nt, Human
auguuuauuacagua

SEQ ID NO: 1225375 - RNA, 16 nt, Human
auguuuauuacaguau

SEQ ID NO: 1225376 - RNA, 18 nt, Human
auguuuauuacaguauaa

SEQ ID NO: 1225377 - RNA, 19 nt, Human
auguuuauuacaguauaau

SEQ ID NO: 1225378 - RNA, 22 nt, Human
auguuuauuacaguauaauuaa

SEQ ID NO: 1225379 - RNA, 23 nt, Human
auguuuauuacaguauaauuaac

SEQ ID NO: 1225380 - RNA, 15 nt, Human
auguuuuuuuuuaaa

SEQ ID NO: 1225381 - RNA, 19 nt, Human
uuuuaguugcaacuuugua

SEQ ID NO: 1225382 - RNA, 20 nt, Human
uuuucaggcuagauguaugu

SEQ ID NO: 1225383 - RNA, 17 nt, Human
uuuucucugauacagaa

SEQ ID NO: 1225384 - RNA, 16 nt, Human
uuuucuauaauuuaaa

SEQ ID NO: 1225385 - RNA, 20 nt, Human
auguucuuuuaaaugauuga

SEQ ID NO: 1225386 - RNA, 18 nt, Human
auguuaugacuauguaaa

SEQ ID NO: 1225387 - RNA, 24 nt, Human
auguuaugacuauguaaacuacuu

SEQ ID NO: 1225388 - RNA, 21 nt, Human
augugcuaguaauuggaaagg

SEQ ID NO: 1225389 - RNA, 15 nt, Human
auguguguuuuaaaa

SEQ ID NO: 1225390 - RNA, 19 nt, Human
auuggagcucgugggacag

SEQ ID NO: 1225391 - RNA, 17 nt, Human
auuggagcucgugggac

SEQ ID NO: 1225392 - RNA, 16 nt, Human
auuggagcucguggaa

SEQ ID NO: 1225393 - RNA, 14 nt, Human
auuggggauucuua

SEQ ID NO: 1225394 - RNA, 15 nt, Human
auuggggauucuuaa

SEQ ID NO: 1225395 - RNA, 16 nt, Human
auuggggauucuuaaa

SEQ ID NO: 1225396 - RNA, 20 nt, Human
auuggggauucuuaaaguug

SEQ ID NO: 1225397 - RNA, 21 nt, Human
auuggggauucuuaaaguuga

SEQ ID NO: 1225398 - RNA, 22 nt, Human
auuggggauucuuaaaguugaa

SEQ ID NO: 1225399 - RNA, 14 nt, Human
auuggaaacaaguc

SEQ ID NO: 1225400 - RNA, 15 nt, Human
auuugaauuuugugu

SEQ ID NO: 1225401 - RNA, 13 nt, Human
auuugaauuuugu

SEQ ID NO: 1225402 - RNA, 19 nt, Human
auuugauaugugaacaguu

SEQ ID NO: 1225403 - RNA, 18 nt, Human
auuugauaugugaacagu

SEQ ID NO: 1225404 - RNA, 15 nt, Human
auuugguuuucacau

SEQ ID NO: 1225405 - RNA, 14 nt, Human
auuugguuuucaca

SEQ ID NO: 1225406 - RNA, 12 nt, Human
auuugguuuuca

SEQ ID NO: 1225407 - RNA, 14 nt, Human
auuuccuaaauaua

SEQ ID NO: 1225408 - RNA, 21 nt, Human
auuuccuaaauauauuuuaag

SEQ ID NO: 1225409 - RNA, 22 nt, Human
auuuccugggagcuuuuguaga

SEQ ID NO: 1225410 - RNA, 20 nt, Human
auuuauuggcuuuucugauc

SEQ ID NO: 1225411 - RNA, 23 nt, Human
auuuauuggcuuuucugauccag

SEQ ID NO: 1225412 - RNA, 20 nt, Human
auuuauuacuguaagaaaau

SEQ ID NO: 1225413 - RNA, 19 nt, Human
auuuauuacuguaagaaaa

SEQ ID NO: 1225414 - RNA, 14 nt, Human
auuuauuggcuuuu

SEQ ID NO: 1225415 - RNA, 18 nt, Human
auuuauuggcuuuucuga

SEQ ID NO: 1225416 - RNA, 16 nt, Human
auuuaguguucauaaa

SEQ ID NO: 1225417 - RNA, 16 nt, Human
auuuaguuguaaacca

SEQ ID NO: 1225418 - RNA, 17 nt, Human
auuuaguguucauaaau

SEQ ID NO: 1225419 - RNA, 15 nt, Human
auuuauaaacuuuuu

SEQ ID NO: 1225420 - RNA, 20 nt, Human
auuguagcauccuggaauau

SEQ ID NO: 1225421 - RNA, 17 nt, Human
auuguagcauccuggaa

SEQ ID NO: 1225422 - RNA, 15 nt, Human
auuguacuuugugcu

SEQ ID NO: 1225423 - RNA, 16 nt, Human
auuguaguccuguaau

SEQ ID NO: 1225424 - RNA, 16 nt, Human
auuuaaauagcuuuuu

SEQ ID NO: 1225425 - RNA, 23 nt, Human
auuuaaauguuaugacuauguaa

SEQ ID NO: 1225426 - RNA, 22 nt, Human
auuuaccacuuguguuuugcaa

SEQ ID NO: 1225427 - RNA, 15 nt, Human
auuuaccacuugugu

SEQ ID NO: 1225428 - RNA, 16 nt, Human
auuuacuaaaauggac

SEQ ID NO: 1225429 - RNA, 19 nt, Human
auuuacuaaaauggacugu

SEQ ID NO: 1225430 - RNA, 20 nt, Human
auuuacuaaaauggacugug

SEQ ID NO: 1225431 - RNA, 20 nt, Human
caccauguuggccaggcuug

SEQ ID NO: 1225432 - RNA, 21 nt, Human
caccauauuggccagucuggu

SEQ ID NO: 1225433 - RNA, 20 nt, Human
cacaugcuucccuuuccuga

SEQ ID NO: 1225434 - RNA, 20 nt, Human
cacaugaaguccaagcauuu

SEQ ID NO: 1225435 - RNA, 17 nt, Human
cacaugaaguccaagca

SEQ ID NO: 1225436 - RNA, 14 nt, Human
caauauucaauaaa

SEQ ID NO: 1225437 - RNA, 15 nt, Human
caauauucaauaaag

SEQ ID NO: 1225438 - RNA, 16 nt, Human
caauauucaauaaagc

SEQ ID NO: 1225439 - RNA, 17 nt, Human
caauauucaauaaagcu

SEQ ID NO: 1225440 - RNA, 13 nt, Human
caauuuuguuucu

SEQ ID NO: 1225441 - RNA, 14 nt, Human
caauuuuguuucug

SEQ ID NO: 1225442 - RNA, 16 nt, Human
caauuuuguuucugua

SEQ ID NO: 1225443 - RNA, 17 nt, Human
caauuuuguuucuguac

SEQ ID NO: 1225444 - RNA, 22 nt, Human
cacaccuacuagucaccagaga

SEQ ID NO: 1225445 - RNA, 12 nt, Human
caaagaaauuau

SEQ ID NO: 1225446 - RNA, 13 nt, Human
caaagaaauuaug

SEQ ID NO: 1225447 - RNA, 15 nt, Human
caaagaaauuaugug

SEQ ID NO: 1225448 - RNA, 19 nt, Human
auuuuaauaauguuucaaa

SEQ ID NO: 1225449 - RNA, 18 nt, Human
auuuuaauaauguuucaa

SEQ ID NO: 1225450 - RNA, 17 nt, Human
auuuuaacaacagcugg

SEQ ID NO: 1225451 - RNA, 14 nt, Human
caaaguugccuaaa

SEQ ID NO: 1225452 - RNA, 15 nt, Human
caaaguugccuaaau

SEQ ID NO: 1225453 - RNA, 17 nt, Human
caaaguugccuaaaucc

SEQ ID NO: 1225454 - RNA, 17 nt, Human
caaauuguaagcaugca

SEQ ID NO: 1225455 - RNA, 18 nt, Human
caaaguugccuaaaucca

SEQ ID NO: 1225456 - RNA, 15 nt, Human
caaccucauccucuc

SEQ ID NO: 1225457 - RNA, 20 nt, Human
caaccuccgcauccgggguu

SEQ ID NO: 1225458 - RNA, 19 nt, Human
caagcauuuagauguauag

SEQ ID NO: 1225459 - RNA, 16 nt, Human
caagcauuuagaugua

SEQ ID NO: 1225460 - RNA, 16 nt, Human
caagaccgaucggcgg

SEQ ID NO: 1225461 - RNA, 14 nt, Human
cauuugcucaugga

SEQ ID NO: 1225462 - RNA, 13 nt, Human
cauuugcucaugg

SEQ ID NO: 1225463 - RNA, 19 nt, Human
cauuuuagggguagcauuu

SEQ ID NO: 1225464 - RNA, 12 nt, Human
cauuuaauaauu

SEQ ID NO: 1225465 - RNA, 14 nt, Human
cauuuaauaauuau

SEQ ID NO: 1225466 - RNA, 15 nt, Human
cauuuaauaauuaua

SEQ ID NO: 1225467 - RNA, 16 nt, Human
cauuuaauaauuauau

SEQ ID NO: 1225468 - RNA, 17 nt, Human
cauuuaauaauuauaug

SEQ ID NO: 1225469 - RNA, 19 nt, Human
cauuuaauaauuauaugcu

SEQ ID NO: 1225470 - RNA, 23 nt, Human
cauuuaauaauuauaugcuauuu

SEQ ID NO: 1225471 - RNA, 23 nt, Human
cauuguauucagaguugaugguu

SEQ ID NO: 1225472 - RNA, 12 nt, Human
ccaacccuagca

SEQ ID NO: 1225473 - RNA, 22 nt, Human
ccaaacugacucuuaagaagac

SEQ ID NO: 1225474 - RNA, 21 nt, Human
ccaacaagauugcuuaauaaa

SEQ ID NO: 1225475 - RNA, 16 nt, Human
ccaaggucuucuuaau

SEQ ID NO: 1225476 - RNA, 20 nt, Human
ccaaguaacugggauuacag

SEQ ID NO: 1225477 - RNA, 20 nt, Human
ccaaguagcugagacuacag

SEQ ID NO: 1225478 - RNA, 17 nt, Human
ccaagcuauucaauucu

SEQ ID NO: 1225479 - RNA, 17 nt, Human
ccaagcauuuagaugua

SEQ ID NO: 1225480 - RNA, 14 nt, Human
ccaagcaaguauua

SEQ ID NO: 1225481 - RNA, 20 nt, Human
ccaagcaccugggauuacaa

SEQ ID NO: 1225482 - RNA, 14 nt, Human
ccacuucagccucc

SEQ ID NO: 1225483 - RNA, 22 nt, Human
ccaccugucugucugucugucc

SEQ ID NO: 1225484 - RNA, 11 nt, Human
ccaccugucug

SEQ ID NO: 1225485 - RNA, 12 nt, Human
ccaccugucugu

SEQ ID NO: 1225486 - RNA, 14 nt, Human
ccaccugucugucu

SEQ ID NO: 1225487 - RNA, 16 nt, Human
ccaccugucugucugu

SEQ ID NO: 1225488 - RNA, 17 nt, Human
ccacggggacucagccc

SEQ ID NO: 1225489 - RNA, 14 nt, Human
ccacgguguucugu

SEQ ID NO: 1225490 - RNA, 16 nt, Human
ccaccauggccagcua

SEQ ID NO: 1225491 - RNA, 20 nt, Human
ccacaggaaccacaagacug

SEQ ID NO: 1225492 - RNA, 19 nt, Human
ccaggcuuuuuuaucaugu

SEQ ID NO: 1225493 - RNA, 18 nt, Human
ccaguaucucuucagucu

SEQ ID NO: 1225494 - RNA, 20 nt, Human
ccaguaucucuucagucucu

SEQ ID NO: 1225495 - RNA, 20 nt, Human
ccaguaggggcuuauaauaa

SEQ ID NO: 1225496 - RNA, 15 nt, Human
ccaguaucucuucag

SEQ ID NO: 1225497 - RNA, 16 nt, Human
ccaguaucucuucagu

SEQ ID NO: 1225498 - RNA, 20 nt, Human
ccaggaauggagccugcacg

SEQ ID NO: 1225499 - RNA, 17 nt, Human
ccagcuggggccaggcu

SEQ ID NO: 1225500 - RNA, 18 nt, Human
ccagcuggggccaggcug

SEQ ID NO: 1225501 - RNA, 19 nt, Human
ccagcuggggccaggcugg

SEQ ID NO: 1225502 - RNA, 20 nt, Human
ccagcuggggccaggcuggg

SEQ ID NO: 1225503 - RNA, 21 nt, Human
ccagcuggggccaggcugggu

SEQ ID NO: 1225504 - RNA, 22 nt, Human
ccagcuggggccaggcuggguc

SEQ ID NO: 1225505 - RNA, 23 nt, Human
ccagcuggggccaggcugggucg

SEQ ID NO: 1225506 - RNA, 15 nt, Human
ccaggacaggaucca

SEQ ID NO: 1225507 - RNA, 17 nt, Human
ccaggacaggauccagg

SEQ ID NO: 1225508 - RNA, 19 nt, Human
ccaggacaggauccaggcc

SEQ ID NO: 1225509 - RNA, 13 nt, Human
ccaggacaggauc

SEQ ID NO: 1225510 - RNA, 19 nt, Human
ccauucuggaagugacuuu

SEQ ID NO: 1225511 - RNA, 12 nt, Human
ccauucuggaag

SEQ ID NO: 1225512 - RNA, 15 nt, Human
ccauucuggaaguga

SEQ ID NO: 1225513 - RNA, 16 nt, Human
ccaugauguuuagaaa

SEQ ID NO: 1225514 - RNA, 11 nt, Human
ccaugcagaaa

SEQ ID NO: 1225515 - RNA, 15 nt, Human
ccaugcagaaagcau

SEQ ID NO: 1225516 - RNA, 14 nt, Human
ccaugcagaaagca

SEQ ID NO: 1225517 - RNA, 19 nt, Human
ccaucaauaaaaaauuaug

SEQ ID NO: 1225518 - RNA, 20 nt, Human
ccaucaauaaaaaauuauga

SEQ ID NO: 1225519 - RNA, 23 nt, Human
ccaucagaaacacccucacacug

SEQ ID NO: 1225520 - RNA, 18 nt, Human
cccagguuggagugcagu

SEQ ID NO: 1225521 - RNA, 19 nt, Human
cccagguuggagugcagug

SEQ ID NO: 1225522 - RNA, 15 nt, Human
cccaguaucucuuca

SEQ ID NO: 1225523 - RNA, 16 nt, Human
cccaguaucucuucag

SEQ ID NO: 1225524 - RNA, 15 nt, Human
cccaauugagaaaaa

SEQ ID NO: 1225525 - RNA, 13 nt, Human
ccgugcuaaggac

SEQ ID NO: 1225526 - RNA, 14 nt, Human
ccgugcuaaggacu

SEQ ID NO: 1225527 - RNA, 18 nt, Human
ccuaaaagaaacccugca

SEQ ID NO: 1225528 - RNA, 15 nt, Human
ccuacccuaaccaag

SEQ ID NO: 1225529 - RNA, 16 nt, Human
ccuacccuaaccaagu

SEQ ID NO: 1225530 - RNA, 18 nt, Human
ccuacccuaaccaaguuc

SEQ ID NO: 1225531 - RNA, 21 nt, Human
ccucacccacccuuuuuuaaa

SEQ ID NO: 1225532 - RNA, 18 nt, Human
cccccaguaucucuucag

SEQ ID NO: 1225533 - RNA, 20 nt, Human
ccccuaaaagaaacccugca

SEQ ID NO: 1225534 - RNA, 16 nt, Human
cccuugaugaagaagu

SEQ ID NO: 1225535 - RNA, 16 nt, Human
cccuuuccugaguccc

SEQ ID NO: 1225536 - RNA, 13 nt, Human
ccugauuaaagaa

SEQ ID NO: 1225537 - RNA, 12 nt, Human
ccugauuaaaga

SEQ ID NO: 1225538 - RNA, 23 nt, Human
ccucuuagaugcaguucugaaga

SEQ ID NO: 1225539 - RNA, 22 nt, Human
ccugaagcuaucguaaaauuaa

SEQ ID NO: 1225540 - RNA, 23 nt, Human
ccugaagcuaucguaaaauuaag

SEQ ID NO: 1225541 - RNA, 20 nt, Human
ccugaacaggauauucucac

SEQ ID NO: 1225542 - RNA, 20 nt, Human
ccucagaaaacaaggaugaa

SEQ ID NO: 1225543 - RNA, 22 nt, Human
ccucccuacccuaaccaaguuc

SEQ ID NO: 1225544 - RNA, 17 nt, Human
ccucccucaaccucauc

SEQ ID NO: 1225545 - RNA, 21 nt, Human
ccucccucaaccucauccucu

SEQ ID NO: 1225546 - RNA, 17 nt, Human
ccuccugggaaugaagc

SEQ ID NO: 1225547 - RNA, 16 nt, Human
ccucugcagucucuau

SEQ ID NO: 1225548 - RNA, 17 nt, Human
ccucugcagucucuaua

SEQ ID NO: 1225549 - RNA, 23 nt, Human
ccucugcagucucuauaccaaua

SEQ ID NO: 1225550 - RNA, 19 nt, Human
ccuguggaacauaaaaagg

SEQ ID NO: 1225551 - RNA, 23 nt, Human
ccuguggaacauaaaaaggacau

SEQ ID NO: 1225552 - RNA, 24 nt, Human
ccuguggaacauaaaaaggacauc

SEQ ID NO: 1225553 - RNA, 13 nt, Human
ccuucaucuggaa

SEQ ID NO: 1225554 - RNA, 20 nt, Human
ccuucaucuggauuccagag

SEQ ID NO: 1225555 - RNA, 14 nt, Human
ccuucaucuggaac

SEQ ID NO: 1225556 - RNA, 13 nt, Human
ccuuccacccagu

SEQ ID NO: 1225557 - RNA, 14 nt, Human
ccuugaugaagaag

SEQ ID NO: 1225558 - RNA, 22 nt, Human
ccugugagcuaggaauuguguu

SEQ ID NO: 1225559 - RNA, 21 nt, Human
ccugcuuucagauacuggauu

SEQ ID NO: 1225560 - RNA, 14 nt, Human
ccuggaaaccuucc

SEQ ID NO: 1225561 - RNA, 15 nt, Human
ccugcuuucagauac

SEQ ID NO: 1225562 - RNA, 16 nt, Human
ccugcuuucagauacu

SEQ ID NO: 1225563 - RNA, 13 nt, Human
ccugggaggcucu

SEQ ID NO: 1225564 - RNA, 21 nt, Human
ccugggaggcucuggagccca

SEQ ID NO: 1225565 - RNA, 13 nt, Human
ccugggauuacag

SEQ ID NO: 1225566 - RNA, 12 nt, Human
ccuggcggggug

SEQ ID NO: 1225567 - RNA, 19 nt, Human
ccuggacuuggccccugcc

SEQ ID NO: 1225568 - RNA, 17 nt, Human
ccuggacugugugcuca

SEQ ID NO: 1225569 - RNA, 20 nt, Human
ccuggacugugugcucagga

SEQ ID NO: 1225570 - RNA, 17 nt, Human
ccuggaaaccuuccacc

SEQ ID NO: 1225571 - RNA, 18 nt, Human
ccuggaaaccuuccaccc

SEQ ID NO: 1225572 - RNA, 20 nt, Human
ccuggaaaccuuccacccag

SEQ ID NO: 1225573 - RNA, 15 nt, Human
cggaccccagccauc

SEQ ID NO: 1225574 - RNA, 13 nt, Human
cggaugauuucua

SEQ ID NO: 1225575 - RNA, 14 nt, Human
cggaugauuucuau

SEQ ID NO: 1225576 - RNA, 21 nt, Human
cggaagaagagaucaggaaga

SEQ ID NO: 1225577 - RNA, 22 nt, Human
cggaagaagagaucaggaagag

SEQ ID NO: 1225578 - RNA, 13 nt, Human
cgcagaaggaagg

SEQ ID NO: 1225579 - RNA, 13 nt, Human
cgcguugaaauug

SEQ ID NO: 1225580 - RNA, 14 nt, Human
cgcgaucucagcuc

SEQ ID NO: 1225581 - RNA, 15 nt, Human
cgcgaucucagcuca

SEQ ID NO: 1225582 - RNA, 17 nt, Human
cgcguugaaauuguaau

SEQ ID NO: 1225583 - RNA, 21 nt, Human
cgcguugaaauuguaauuaua

SEQ ID NO: 1225584 - RNA, 22 nt, Human
cgcguugaaauuguaauuauau

SEQ ID NO: 1225585 - RNA, 18 nt, Human
ccuuuggcaggugcagcc

SEQ ID NO: 1225586 - RNA, 19 nt, Human
ccuuuggcaggugcagccc

SEQ ID NO: 1225587 - RNA, 20 nt, Human
ccuuuggcaggugcagcccc

SEQ ID NO: 1225588 - RNA, 14 nt, Human
ccuuugacaaaggu

SEQ ID NO: 1225589 - RNA, 15 nt, Human
ccuuugaccugccuc

SEQ ID NO: 1225590 - RNA, 15 nt, Human
ccuuggccaugcaga

SEQ ID NO: 1225591 - RNA, 17 nt, Human
ccuuggccaugcagaaa

SEQ ID NO: 1225592 - RNA, 16 nt, Human
ccuuucucuuucguua

SEQ ID NO: 1225593 - RNA, 12 nt, Human
cgcagaaggaag

SEQ ID NO: 1225594 - RNA, 20 nt, Human
cgaucuugguucacugcaac

SEQ ID NO: 1225595 - RNA, 13 nt, Human
cgaucucagcuca

SEQ ID NO: 1225596 - RNA, 22 nt, Human
cguucauggaacgcguugaaau

SEQ ID NO: 1225597 - RNA, 23 nt, Human
cguucauggaacgcguugaaauu

SEQ ID NO: 1225598 - RNA, 13 nt, Human
cguugaaauugua

SEQ ID NO: 1225599 - RNA, 18 nt, Human
cguugaaauuguaauuau

SEQ ID NO: 1225600 - RNA, 16 nt, Human
cguauaaaagccuguu

SEQ ID NO: 1225601 - RNA, 17 nt, Human
cguauaaaagccuguuu

SEQ ID NO: 1225602 - RNA, 21 nt, Human
cguauaaaagccuguuuaaga

SEQ ID NO: 1225603 - RNA, 22 nt, Human
cguauaaaagccuguuuaagag

SEQ ID NO: 1225604 - RNA, 20 nt, Human
cgucaacucauauuuucaug

SEQ ID NO: 1225605 - RNA, 16 nt, Human
cgucaacucauauuuu

SEQ ID NO: 1225606 - RNA, 18 nt, Human
cuccuaucaccugucuug

SEQ ID NO: 1225607 - RNA, 17 nt, Human
cucuaaauucuuucauu

SEQ ID NO: 1225608 - RNA, 13 nt, Human
cucuaaauucuuu

SEQ ID NO: 1225609 - RNA, 13 nt, Human
cucuaacauuucc

SEQ ID NO: 1225610 - RNA, 14 nt, Human
cuccuuagaaaaaa

SEQ ID NO: 1225611 - RNA, 13 nt, Human
cuccuuagaaaaa

SEQ ID NO: 1225612 - RNA, 12 nt, Human
cuccagccucag

SEQ ID NO: 1225613 - RNA, 15 nt, Human
cuccagccucagccu

SEQ ID NO: 1225614 - RNA, 17 nt, Human
cuccagccucagccucc

SEQ ID NO: 1225615 - RNA, 14 nt, Human
cuccagccucagcu

SEQ ID NO: 1225616 - RNA, 14 nt, Human
cuccacucuuucuu

SEQ ID NO: 1225617 - RNA, 15 nt, Human
cuccacagcugccuc

SEQ ID NO: 1225618 - RNA, 17 nt, Human
cguuuuuuaaauguaua

SEQ ID NO: 1225619 - RNA, 17 nt, Human
cucaucuccccaucauu

SEQ ID NO: 1225620 - RNA, 21 nt, Human
cucaucuagguaaauuacagu

SEQ ID NO: 1225621 - RNA, 14 nt, Human
cucauauuuucaug

SEQ ID NO: 1225622 - RNA, 20 nt, Human
cucugaggggcuaccaggaa

SEQ ID NO: 1225623 - RNA, 21 nt, Human
cucugaggggcuaccaggaaa

SEQ ID NO: 1225624 - RNA, 22 nt, Human
cucugcagucucuauaccaaua

SEQ ID NO: 1225625 - RNA, 23 nt, Human
cucugcaggucccuaauaaagcu

SEQ ID NO: 1225626 - RNA, 14 nt, Human
cucugcagucucua

SEQ ID NO: 1225627 - RNA, 14 nt, Human
cucuggaauuugaa

SEQ ID NO: 1225628 - RNA, 12 nt, Human
cucuggagccca

SEQ ID NO: 1225629 - RNA, 12 nt, Human
cucucugcaggu

SEQ ID NO: 1225630 - RNA, 13 nt, Human
cucucugcagguc

SEQ ID NO: 1225631 - RNA, 14 nt, Human
cucucugcaggucc

SEQ ID NO: 1225632 - RNA, 16 nt, Human
cucucugcaggucccu

SEQ ID NO: 1225633 - RNA, 17 nt, Human
cucucugcaggucccua

SEQ ID NO: 1225634 - RNA, 19 nt, Human
cucucugcaggucccuaau

SEQ ID NO: 1225635 - RNA, 22 nt, Human
cucucugcaggucccuaauaaa

SEQ ID NO: 1225636 - RNA, 13 nt, Human
cucuccauuuaau

SEQ ID NO: 1225637 - RNA, 13 nt, Human
cucucccaaaaaa

SEQ ID NO: 1225638 - RNA, 17 nt, Human
cucuccacagcugccuc

SEQ ID NO: 1225639 - RNA, 15 nt, Human
cucucaguugcagcc

SEQ ID NO: 1225640 - RNA, 19 nt, Human
cucucaguugcagcccugc

SEQ ID NO: 1225641 - RNA, 22 nt, Human
cucucaguugcagcccugcugc

SEQ ID NO: 1225642 - RNA, 15 nt, Human
cucucauacccuccc

SEQ ID NO: 1225643 - RNA, 15 nt, Human
cucuggagcccacug

SEQ ID NO: 1225644 - RNA, 19 nt, Human
cucuggagcccacuguacu

SEQ ID NO: 1225645 - RNA, 21 nt, Human
cucuguugccaggcuggagug

SEQ ID NO: 1225646 - RNA, 13 nt, Human
cucuuaagaagac

SEQ ID NO: 1225647 - RNA, 13 nt, Human
cucuucagucucu

SEQ ID NO: 1225648 - RNA, 23 nt, Human
cugaauuuaaauagcuuuuuucu

SEQ ID NO: 1225649 - RNA, 13 nt, Human
cugaauuucccuc

SEQ ID NO: 1225650 - RNA, 18 nt, Human
cugaauuuaaauagcuuu

SEQ ID NO: 1225651 - RNA, 14 nt, Human
cugaauuuaaauag

SEQ ID NO: 1225652 - RNA, 14 nt, Human
cugaagucagaucu

SEQ ID NO: 1225653 - RNA, 15 nt, Human
cugaagucagaucug

SEQ ID NO: 1225654 - RNA, 16 nt, Human
cugaagucagaucugc

SEQ ID NO: 1225655 - RNA, 21 nt, Human
cugaagucagaucugccuaag

SEQ ID NO: 1225656 - RNA, 15 nt, Human
cugauucuucagcaa

SEQ ID NO: 1225657 - RNA, 13 nt, Human
cugagucccaucc

SEQ ID NO: 1225658 - RNA, 20 nt, Human
cugauagaggaagccugauu

SEQ ID NO: 1225659 - RNA, 20 nt, Human
cugauccaguuuuguuugga

SEQ ID NO: 1225660 - RNA, 20 nt, Human
cugccuaaggacuucuuuaa

SEQ ID NO: 1225661 - RNA, 21 nt, Human
cugccuaaggacuucuuuaau

SEQ ID NO: 1225662 - RNA, 22 nt, Human
cugccuaaggacuucuuuaauu

SEQ ID NO: 1225663 - RNA, 18 nt, Human
cugccucuucccucuucc

SEQ ID NO: 1225664 - RNA, 19 nt, Human
cugccucuucccucuuccu

SEQ ID NO: 1225665 - RNA, 12 nt, Human
cugccucucugc

SEQ ID NO: 1225666 - RNA, 13 nt, Human
cugccucucugca

SEQ ID NO: 1225667 - RNA, 14 nt, Human
cugccucucugcag

SEQ ID NO: 1225668 - RNA, 11 nt, Human
cugcccugcca

SEQ ID NO: 1225669 - RNA, 13 nt, Human
cugcccugccacc

SEQ ID NO: 1225670 - RNA, 14 nt, Human
cugcccugccaccu

SEQ ID NO: 1225671 - RNA, 15 nt, Human
cugcccugccaccug

SEQ ID NO: 1225672 - RNA, 16 nt, Human
cugcccugccaccugu

SEQ ID NO: 1225673 - RNA, 17 nt, Human
cugcccugccaccuguc

SEQ ID NO: 1225674 - RNA, 18 nt, Human
cugcccugccaccugucu

SEQ ID NO: 1225675 - RNA, 20 nt, Human
cugcccugccaccugucugu

SEQ ID NO: 1225676 - RNA, 21 nt, Human
cugcccugccaccugucuguc

SEQ ID NO: 1225677 - RNA, 11 nt, Human
cugcccugccc

SEQ ID NO: 1225678 - RNA, 19 nt, Human
cuggguaggaaagaggaag

SEQ ID NO: 1225679 - RNA, 19 nt, Human
cugggccccugccucucug

SEQ ID NO: 1225680 - RNA, 14 nt, Human
cuggguaggaaaga

SEQ ID NO: 1225681 - RNA, 15 nt, Human
cuggguaggaaagag

SEQ ID NO: 1225682 - RNA, 17 nt, Human
cuggguaggaaagagga

SEQ ID NO: 1225683 - RNA, 12 nt, Human
cugggccccugc

SEQ ID NO: 1225684 - RNA, 16 nt, Human
cugggccccugccucu

SEQ ID NO: 1225685 - RNA, 17 nt, Human
cugggccccugccucuc

SEQ ID NO: 1225686 - RNA, 17 nt, Human
cugggaggcucuggagc

SEQ ID NO: 1225687 - RNA, 15 nt, Human
cugggaggcucugga

SEQ ID NO: 1225688 - RNA, 16 nt, Human
cugggaggcucuggag

SEQ ID NO: 1225689 - RNA, 16 nt, Human
cugggagcuuuuguag

SEQ ID NO: 1225690 - RNA, 23 nt, Human
cuggaauaauccuaaacauauga

SEQ ID NO: 1225691 - RNA, 18 nt, Human
cugcuuucagauacugga

SEQ ID NO: 1225692 - RNA, 21 nt, Human
cugcuuucagauacuggauug

SEQ ID NO: 1225693 - RNA, 22 nt, Human
cuggagcuagaauuugauaugu

SEQ ID NO: 1225694 - RNA, 17 nt, Human
cuggagcuagaauuuga

SEQ ID NO: 1225695 - RNA, 16 nt, Human
cuggagcuagaauuug

SEQ ID NO: 1225696 - RNA, 21 nt, Human
cuggagcccacuguacuugcu

SEQ ID NO: 1225697 - RNA, 13 nt, Human
cuggagcccacug

SEQ ID NO: 1225698 - RNA, 15 nt, Human
cuggagcccacugua

SEQ ID NO: 1225699 - RNA, 16 nt, Human
cuggagcccacuguac

SEQ ID NO: 1225700 - RNA, 17 nt, Human
cuggagcccacuguacu

SEQ ID NO: 1225701 - RNA, 20 nt, Human
cuggagcccacuguacuugc

SEQ ID NO: 1225702 - RNA, 17 nt, Human
cuggauuauauuaugaa

SEQ ID NO: 1225703 - RNA, 21 nt, Human
cuggauuccagagcacugcuc

SEQ ID NO: 1225704 - RNA, 13 nt, Human
cuggauuccagag

SEQ ID NO: 1225705 - RNA, 19 nt, Human
cuggauuguacuuugugcu

SEQ ID NO: 1225706 - RNA, 20 nt, Human
cuggauuguacuuugugcug

SEQ ID NO: 1225707 - RNA, 11 nt, Human
cuuuucugauc

SEQ ID NO: 1225708 - RNA, 14 nt, Human
cuuuucugauccag

SEQ ID NO: 1225709 - RNA, 15 nt, Human
cuuuucugauccagu

SEQ ID NO: 1225710 - RNA, 16 nt, Human
cuuuucugauccaguu

SEQ ID NO: 1225711 - RNA, 18 nt, Human
cuuuucugauccaguuuu

SEQ ID NO: 1225712 - RNA, 12 nt, Human
cuuuuucauuau

SEQ ID NO: 1225713 - RNA, 13 nt, Human
cuuuuucauuauu

SEQ ID NO: 1225714 - RNA, 14 nt, Human
cuuuuucauuauuu

SEQ ID NO: 1225715 - RNA, 21 nt, Human
cuuuuucauuauuuuauuaug

SEQ ID NO: 1225716 - RNA, 12 nt, Human
cuuuuugcagcu

SEQ ID NO: 1225717 - RNA, 13 nt, Human
cuuuuugcagcuu

SEQ ID NO: 1225718 - RNA, 14 nt, Human
cuuuuugcagcuuu

SEQ ID NO: 1225719 - RNA, 15 nt, Human
cuuuuuuaaauaaau

SEQ ID NO: 1225720 - RNA, 13 nt, Human
gaaaacauuccau

SEQ ID NO: 1225721 - RNA, 17 nt, Human
gaaaacauuccauccuu

SEQ ID NO: 1225722 - RNA, 20 nt, Human
gaaaaguauguuagugcaaa

SEQ ID NO: 1225723 - RNA, 14 nt, Human
gaaaaguauguuag

SEQ ID NO: 1225724 - RNA, 19 nt, Human
gaaaauaacaauaaaagac

SEQ ID NO: 1225725 - RNA, 19 nt, Human
gaaaaauauauacuaaaca

SEQ ID NO: 1225726 - RNA, 14 nt, Human
gaaaacaaggauga

SEQ ID NO: 1225727 - RNA, 19 nt, Human
cuuugacaaagguaaauca

SEQ ID NO: 1225728 - RNA, 16 nt, Human
cuuugccacccucaug

SEQ ID NO: 1225729 - RNA, 17 nt, Human
cuuugccacccucaugc

SEQ ID NO: 1225730 - RNA, 18 nt, Human
cuuugccacccucaugcu

SEQ ID NO: 1225731 - RNA, 16 nt, Human
cuuuggauaauaagga

SEQ ID NO: 1225732 - RNA, 13 nt, Human
cuuuggcaggugc

SEQ ID NO: 1225733 - RNA, 24 nt, Human
cuuuggcaggugcagcccccacug

SEQ ID NO: 1225734 - RNA, 17 nt, Human
cuuugacaaagguaaau

SEQ ID NO: 1225735 - RNA, 13 nt, Human
cuuguuucauauu

SEQ ID NO: 1225736 - RNA, 13 nt, Human
cuuguuagaucua

SEQ ID NO: 1225737 - RNA, 16 nt, Human
cuuguuagaucuaguu

SEQ ID NO: 1225738 - RNA, 18 nt, Human
cuuggggcugaugcaguu

SEQ ID NO: 1225739 - RNA, 16 nt, Human
cuuggggcugaugcag

SEQ ID NO: 1225740 - RNA, 13 nt, Human
cuugccacacccc

SEQ ID NO: 1225741 - RNA, 19 nt, Human
cuugccacaccccccaccc

SEQ ID NO: 1225742 - RNA, 23 nt, Human
cuugccacaccccccaccccuag

SEQ ID NO: 1225743 - RNA, 17 nt, Human
cuugcucuugaugccug

SEQ ID NO: 1225744 - RNA, 18 nt, Human
cuugcucuugaugccugg

SEQ ID NO: 1225745 - RNA, 19 nt, Human
cuugcucuugaugccuggc

SEQ ID NO: 1225746 - RNA, 20 nt, Human
cuugcuugauuguauggugg

SEQ ID NO: 1225747 - RNA, 20 nt, Human
cuuagaugcaguucugaaga

SEQ ID NO: 1225748 - RNA, 19 nt, Human
cuuagaugcaguucugaag

SEQ ID NO: 1225749 - RNA, 21 nt, Human
cuuaggguuaugauuaaguaa

SEQ ID NO: 1225750 - RNA, 13 nt, Human
cuuauaauuuaaa

SEQ ID NO: 1225751 - RNA, 14 nt, Human
cuuauaauaaagga

SEQ ID NO: 1225752 - RNA, 16 nt, Human
cuuauaauaaaggacu

SEQ ID NO: 1225753 - RNA, 20 nt, Human
cuuauaauaaaggacuguaa

SEQ ID NO: 1225754 - RNA, 17 nt, Human
cuuauaauaaaggacug

SEQ ID NO: 1225755 - RNA, 14 nt, Human
cuuauaauuuaaaa

SEQ ID NO: 1225756 - RNA, 13 nt, Human
cuuauaguacaug

SEQ ID NO: 1225757 - RNA, 17 nt, Human
cuuauaguacaugauaa

SEQ ID NO: 1225758 - RNA, 19 nt, Human
cuuauaguacaugauaaau

SEQ ID NO: 1225759 - RNA, 21 nt, Human
cuuaagaagacugcauuauau

SEQ ID NO: 1225760 - RNA, 14 nt, Human
cuguuuuuuuguua

SEQ ID NO: 1225761 - RNA, 19 nt, Human
cuguuuuauaauuuuguga

SEQ ID NO: 1225762 - RNA, 22 nt, Human
cuucccucuuccuucccugcug

SEQ ID NO: 1225763 - RNA, 18 nt, Human
cuucagcgguuuauauaa

SEQ ID NO: 1225764 - RNA, 17 nt, Human
cuucuccauggcccugc

SEQ ID NO: 1225765 - RNA, 19 nt, Human
cuucuccauggcccugcca

SEQ ID NO: 1225766 - RNA, 14 nt, Human
cuucucagauuucu

SEQ ID NO: 1225767 - RNA, 19 nt, Human
cuucucagauuucugagga

SEQ ID NO: 1225768 - RNA, 22 nt, Human
cuucucagauuucugaggaaau

SEQ ID NO: 1225769 - RNA, 16 nt, Human
cuuccuucccugcugu

SEQ ID NO: 1225770 - RNA, 13 nt, Human
gacugagaaauuu

SEQ ID NO: 1225771 - RNA, 13 nt, Human
gacugauucuuca

SEQ ID NO: 1225772 - RNA, 16 nt, Human
gacugauucuucagca

SEQ ID NO: 1225773 - RNA, 11 nt, Human
gacugagaaau

SEQ ID NO: 1225774 - RNA, 16 nt, Human
gacuuauaguacauga

SEQ ID NO: 1225775 - RNA, 17 nt, Human
gacuuauaguacaugau

SEQ ID NO: 1225776 - RNA, 18 nt, Human
gacuuauaguacaugaua

SEQ ID NO: 1225777 - RNA, 15 nt, Human
gacugcggaggaagg

SEQ ID NO: 1225778 - RNA, 23 nt, Human
gacugcggaggaaggaggaccca

SEQ ID NO: 1225779 - RNA, 14 nt, Human
gaauuucccucucu

SEQ ID NO: 1225780 - RNA, 14 nt, Human
gacacgcacggcag

SEQ ID NO: 1225781 - RNA, 19 nt, Human
gacacgcacggcagccaca

SEQ ID NO: 1225782 - RNA, 20 nt, Human
gacacgcacggcagccacag

SEQ ID NO: 1225783 - RNA, 21 nt, Human
gacacgcacggcagccacagc

SEQ ID NO: 1225784 - RNA, 22 nt, Human
gacacgcacggcagccacagcu

SEQ ID NO: 1225785 - RNA, 14 nt, Human
gacacuacacccag

SEQ ID NO: 1225786 - RNA, 15 nt, Human
gacacuacacccagc

SEQ ID NO: 1225787 - RNA, 16 nt, Human
gacacuacacccagca

SEQ ID NO: 1225788 - RNA, 17 nt, Human
gacacuacacccagcaa

SEQ ID NO: 1225789 - RNA, 18 nt, Human
gacacuacacccagcaau

SEQ ID NO: 1225790 - RNA, 19 nt, Human
gacacuacacccagcaaua

SEQ ID NO: 1225791 - RNA, 20 nt, Human
gacacuacacccagcaauag

SEQ ID NO: 1225792 - RNA, 14 nt, Human
gacaucagcaaaca

SEQ ID NO: 1225793 - RNA, 13 nt, Human
gacauccagcaga

SEQ ID NO: 1225794 - RNA, 22 nt, Human
gacauccagcagauuuccagcc

SEQ ID NO: 1225795 - RNA, 15 nt, Human
gaccccagccaucca

SEQ ID NO: 1225796 - RNA, 11 nt, Human
gaauucuguau

SEQ ID NO: 1225797 - RNA, 19 nt, Human
gaauucuuuaaaauuacaa

SEQ ID NO: 1225798 - RNA, 22 nt, Human
gaauuuauuggcuuuucugauc

SEQ ID NO: 1225799 - RNA, 14 nt, Human
gaauuuauuggcuu

SEQ ID NO: 1225800 - RNA, 16 nt, Human
gaauuuauuggcuuuu

SEQ ID NO: 1225801 - RNA, 20 nt, Human
gaauuuauuggcuuuucuga

SEQ ID NO: 1225802 - RNA, 21 nt, Human
gaauuuauuggcuuuucugau

SEQ ID NO: 1225803 - RNA, 22 nt, Human
gaauuuaaauagcuuuuuucuc

SEQ ID NO: 1225804 - RNA, 15 nt, Human
gaauuguguuuauaa

SEQ ID NO: 1225805 - RNA, 23 nt, Human
gaauuguguuuauaauuuuaaau

SEQ ID NO: 1225806 - RNA, 15 nt, Human
gaauggaggggcaga

SEQ ID NO: 1225807 - RNA, 16 nt, Human
gaauggaggggcagag

SEQ ID NO: 1225808 - RNA, 20 nt, Human
gaauggaggggcagagccag

SEQ ID NO: 1225809 - RNA, 21 nt, Human
gaauggaggggcagagccagg

SEQ ID NO: 1225810 - RNA, 22 nt, Human
gaauggaggggcagagccagga

SEQ ID NO: 1225811 - RNA, 20 nt, Human
gaaugguccgugcuaaggac

SEQ ID NO: 1225812 - RNA, 22 nt, Human
gaaugguccgugcuaaggacuu

SEQ ID NO: 1225813 - RNA, 23 nt, Human
gaaugguccgugcuaaggacuug

SEQ ID NO: 1225814 - RNA, 19 nt, Human
gaaugaagauacugaaaua

SEQ ID NO: 1225815 - RNA, 21 nt, Human
gaaugaagauacugaaauaaa

SEQ ID NO: 1225816 - RNA, 18 nt, Human
gaaugaagauacugaaau

SEQ ID NO: 1225817 - RNA, 17 nt, Human
gaaugaagauacugaaa

SEQ ID NO: 1225818 - RNA, 20 nt, Human
gaauaauccuaaacauauga

SEQ ID NO: 1225819 - RNA, 20 nt, Human
gaauacucuuauaucuauau

SEQ ID NO: 1225820 - RNA, 22 nt, Human
gaaguccaagcauuuagaugua

SEQ ID NO: 1225821 - RNA, 12 nt, Human
gaaguccaagca

SEQ ID NO: 1225822 - RNA, 15 nt, Human
gaacgcguugaaauu

SEQ ID NO: 1225823 - RNA, 21 nt, Human
gaacuagaguuuagcuggaaa

SEQ ID NO: 1225824 - RNA, 14 nt, Human
gaacuacugaggau

SEQ ID NO: 1225825 - RNA, 14 nt, Human
gaacaucccuccug

SEQ ID NO: 1225826 - RNA, 18 nt, Human
gaaauuguauuacaaauc

SEQ ID NO: 1225827 - RNA, 16 nt, Human
gaaauuuauaaacuuu

SEQ ID NO: 1225828 - RNA, 17 nt, Human
gaaauuuauaaacuuuu

SEQ ID NO: 1225829 - RNA, 16 nt, Human
gaaauuguauuacaaa

SEQ ID NO: 1225830 - RNA, 14 nt, Human
gaacauaaaaagga

SEQ ID NO: 1225831 - RNA, 16 nt, Human
gaacauaaaaaggaca

SEQ ID NO: 1225832 - RNA, 18 nt, Human
gaacauaaaaaggacauc

SEQ ID NO: 1225833 - RNA, 22 nt, Human
gaacauaaaaaggacaucagca

SEQ ID NO: 1225834 - RNA, 20 nt, Human
gaagagguuuuaaagcuucc

SEQ ID NO: 1225835 - RNA, 15 nt, Human
gaagauacugaaaua

SEQ ID NO: 1225836 - RNA, 21 nt, Human
gaacucaucuagguaaauuac

SEQ ID NO: 1225837 - RNA, 20 nt, Human
gaacucaucuagguaaauua

SEQ ID NO: 1225838 - RNA, 22 nt, Human
gaacucaucuagguaaauuaca

SEQ ID NO: 1225839 - RNA, 19 nt, Human
gaacuuugcugagccugua

SEQ ID NO: 1225840 - RNA, 19 nt, Human
gaagacugcauuauauuua

SEQ ID NO: 1225841 - RNA, 12 nt, Human
gaagaacugaaa

SEQ ID NO: 1225842 - RNA, 12 nt, Human
gaagagaaggag

SEQ ID NO: 1225843 - RNA, 13 nt, Human
gaagagaaggagc

SEQ ID NO: 1225844 - RNA, 14 nt, Human
gaagagaaggagca

SEQ ID NO: 1225845 - RNA, 15 nt, Human
gaagagaaggagcag

SEQ ID NO: 1225846 - RNA, 17 nt, Human
gaagagaucaggaagag

SEQ ID NO: 1225847 - RNA, 16 nt, Human
gaagagaucaggaaga

SEQ ID NO: 1225848 - RNA, 12 nt, Human
gcaaaugugaau

SEQ ID NO: 1225849 - RNA, 23 nt, Human
gcaaaugugaaucauuuuaccuu

SEQ ID NO: 1225850 - RNA, 20 nt, Human
gcaaacuuuauuuuguguuu

SEQ ID NO: 1225851 - RNA, 18 nt, Human
gcaaacuuuauuuugugu

SEQ ID NO: 1225852 - RNA, 22 nt, Human
gcaacuuuguauaaaagggacu

SEQ ID NO: 1225853 - RNA, 23 nt, Human
gcaagauggggagugagaggcug

SEQ ID NO: 1225854 - RNA, 20 nt, Human
gcaaguauuagaauaccaca

SEQ ID NO: 1225855 - RNA, 23 nt, Human
gcaauccucccacuucagccucc

SEQ ID NO: 1225856 - RNA, 14 nt, Human
gauuaaguaaugau

SEQ ID NO: 1225857 - RNA, 22 nt, Human
gauuaaguaaugauaacuggaa

SEQ ID NO: 1225858 - RNA, 16 nt, Human
gauugggaauccgccc

SEQ ID NO: 1225859 - RNA, 14 nt, Human
gauccuggaaauca

SEQ ID NO: 1225860 - RNA, 17 nt, Human
gaucuaguucacucucc

SEQ ID NO: 1225861 - RNA, 18 nt, Human
gaugcaguucugaagaag

SEQ ID NO: 1225862 - RNA, 17 nt, Human
gauaggucagugcaaau

SEQ ID NO: 1225863 - RNA, 23 nt, Human
gaucagcuuauugucuagugaaa

SEQ ID NO: 1225864 - RNA, 12 nt, Human
gaucaggaagag

SEQ ID NO: 1225865 - RNA, 15 nt, Human
gaucaggaagagaag

SEQ ID NO: 1225866 - RNA, 16 nt, Human
gaucaggaagagaagg

SEQ ID NO: 1225867 - RNA, 18 nt, Human
gaucaggaagagaaggag

SEQ ID NO: 1225868 - RNA, 17 nt, Human
gaucaggaagagaagga

SEQ ID NO: 1225869 - RNA, 16 nt, Human
gauaucaugcaaauuu

SEQ ID NO: 1225870 - RNA, 23 nt, Human
gaucaccgacugaaaauauuguu

SEQ ID NO: 1225871 - RNA, 22 nt, Human
gauaauaaggaaaaguuuaaua

SEQ ID NO: 1225872 - RNA, 20 nt, Human
gauaauaaggaaaaguuuaa

SEQ ID NO: 1225873 - RNA, 21 nt, Human
gauaauaaggaaaaguuuaau

SEQ ID NO: 1225874 - RNA, 12 nt, Human
gaguguugaaac

SEQ ID NO: 1225875 - RNA, 16 nt, Human
gcauuuuacuguacag

SEQ ID NO: 1225876 - RNA, 17 nt, Human
gcauuuuacuguacaga

SEQ ID NO: 1225877 - RNA, 15 nt, Human
gcaugaauuugugaa

SEQ ID NO: 1225878 - RNA, 17 nt, Human
gcaugaauuugugaagg

SEQ ID NO: 1225879 - RNA, 15 nt, Human
gcaugccuucaaauc

SEQ ID NO: 1225880 - RNA, 23 nt, Human
gcauggaaauucccuucaucugg

SEQ ID NO: 1225881 - RNA, 15 nt, Human
gcauuauaaaaagaa

SEQ ID NO: 1225882 - RNA, 23 nt, Human
gcauauuauuuuauguugcauag

SEQ ID NO: 1225883 - RNA, 18 nt, Human
gcauauuauuuuauguug

SEQ ID NO: 1225884 - RNA, 11 nt, Human
gcauauauuuu

SEQ ID NO: 1225885 - RNA, 14 nt, Human
gcauauauuuuuau

SEQ ID NO: 1225886 - RNA, 15 nt, Human
gcauauauuuuuaua

SEQ ID NO: 1225887 - RNA, 16 nt, Human
gcauauauuuuuauau

SEQ ID NO: 1225888 - RNA, 20 nt, Human
gcauauauuuuuauauuuac

SEQ ID NO: 1225889 - RNA, 19 nt, Human
gcauauuuauaaaaauaaa

SEQ ID NO: 1225890 - RNA, 14 nt, Human
gcaguucugaagaa

SEQ ID NO: 1225891 - RNA, 13 nt, Human
gcaguucugaaga

SEQ ID NO: 1225892 - RNA, 12 nt, Human
gcaggucccuaa

SEQ ID NO: 1225893 - RNA, 13 nt, Human
gcaggucccuaau

SEQ ID NO: 1225894 - RNA, 10 nt, Human
gcaggucccu

SEQ ID NO: 1225895 - RNA, 11 nt, Human
gcaggucccua

SEQ ID NO: 1225896 - RNA, 20 nt, Human
gcacagccucuuagaugcag

SEQ ID NO: 1225897 - RNA, 11 nt, Human
gcagcaacaau

SEQ ID NO: 1225898 - RNA, 16 nt, Human
gcagcaacaauaaaua

SEQ ID NO: 1225899 - RNA, 20 nt, Human
gcaggaguuucguuuucaaa

SEQ ID NO: 1225900 - RNA, 21 nt, Human
gcaggaguuucguuuucaaaa

SEQ ID NO: 1225901 - RNA, 19 nt, Human
gccaggaagaucccccaga

SEQ ID NO: 1225902 - RNA, 16 nt, Human
gcccacagcuguauga

SEQ ID NO: 1225903 - RNA, 22 nt, Human
gcccaucugggggccucuucug

SEQ ID NO: 1225904 - RNA, 13 nt, Human
gccuucaaaucaa

SEQ ID NO: 1225905 - RNA, 18 nt, Human
gccuuggggcugaugcag

SEQ ID NO: 1225906 - RNA, 12 nt, Human
gccuuuuucauu

SEQ ID NO: 1225907 - RNA, 16 nt, Human
gccuuuuucauuauuu

SEQ ID NO: 1225908 - RNA, 20 nt, Human
gccuuuuucauuauuuuauu

SEQ ID NO: 1225909 - RNA, 22 nt, Human
gccuuuuucauuauuuuauuau

SEQ ID NO: 1225910 - RNA, 23 nt, Human
gccuuuuucauuauuuuauuaug

SEQ ID NO: 1225911 - RNA, 18 nt, Human
gcgccuccaacccuagca

SEQ ID NO: 1225912 - RNA, 13 nt, Human
gcuagacugguga

SEQ ID NO: 1225913 - RNA, 15 nt, Human
gcuagacuggugacu

SEQ ID NO: 1225914 - RNA, 16 nt, Human
gcuagacuggugacug

SEQ ID NO: 1225915 - RNA, 19 nt, Human
gcuagacuggugacugauu

SEQ ID NO: 1225916 - RNA, 20 nt, Human
gcuagacuggugacugauuc

SEQ ID NO: 1225917 - RNA, 22 nt, Human
gcuagacuggugacugauucuu

SEQ ID NO: 1225918 - RNA, 13 nt, Human
gcuaccaggaaag

SEQ ID NO: 1225919 - RNA, 16 nt, Human
gcuacagaagaaacug

SEQ ID NO: 1225920 - RNA, 14 nt, Human
gccucccauguuca

SEQ ID NO: 1225921 - RNA, 10 nt, Human
gccucucugc

SEQ ID NO: 1225922 - RNA, 14 nt, Human
gccucucugcaggu

SEQ ID NO: 1225923 - RNA, 16 nt, Human
gccucucugcaggucc

SEQ ID NO: 1225924 - RNA, 17 nt, Human
gccucucugcagguccc

SEQ ID NO: 1225925 - RNA, 18 nt, Human
gccucucugcaggucccu

SEQ ID NO: 1225926 - RNA, 11 nt, Human
gccuaaaucca

SEQ ID NO: 1225927 - RNA, 18 nt, Human
gccuaaggacuucuuuaa

SEQ ID NO: 1225928 - RNA, 14 nt, Human
gccuaaggacuucu

SEQ ID NO: 1225929 - RNA, 15 nt, Human
gccuaaggacuucuu

SEQ ID NO: 1225930 - RNA, 12 nt, Human
gccuaaggacuu

SEQ ID NO: 1225931 - RNA, 13 nt, Human
gccuaaggacuuc

SEQ ID NO: 1225932 - RNA, 17 nt, Human
gccuauuuuaauaaaca

SEQ ID NO: 1225933 - RNA, 20 nt, Human
gcccuucuauacccacccag

SEQ ID NO: 1225934 - RNA, 19 nt, Human
gcccuucuuuccacagaag

SEQ ID NO: 1225935 - RNA, 21 nt, Human
gcccuucuauacccacccaga

SEQ ID NO: 1225936 - RNA, 22 nt, Human
gcccuucuauacccacccagaa

SEQ ID NO: 1225937 - RNA, 18 nt, Human
gcuagauguauguacuuc

SEQ ID NO: 1225938 - RNA, 12 nt, Human
gcuagcaaauag

SEQ ID NO: 1225939 - RNA, 16 nt, Human
gcuagcaaauaguaau

SEQ ID NO: 1225940 - RNA, 24 nt, Human
gcuggugcccugcuuucagauacu

SEQ ID NO: 1225941 - RNA, 16 nt, Human
gcuggggccaggcugg

SEQ ID NO: 1225942 - RNA, 19 nt, Human
gcuggggccaggcuggguc

SEQ ID NO: 1225943 - RNA, 20 nt, Human
ggaaaaaauaacaaugaaag

SEQ ID NO: 1225944 - RNA, 19 nt, Human
ggaaaaguuuaauauuaaa

SEQ ID NO: 1225945 - RNA, 18 nt, Human
ggaaauauuuauuuuaau

SEQ ID NO: 1225946 - RNA, 17 nt, Human
ggaaauauuuauuuuaa

SEQ ID NO: 1225947 - RNA, 15 nt, Human
ggaaauauuuauuuu

SEQ ID NO: 1225948 - RNA, 13 nt, Human
ggaaauauuuauu

SEQ ID NO: 1225949 - RNA, 12 nt, Human
ggaaauauuuau

SEQ ID NO: 1225950 - RNA, 21 nt, Human
ggaacgcguugaaauuguaau

SEQ ID NO: 1225951 - RNA, 17 nt, Human
ggaacgcguugaaauug

SEQ ID NO: 1225952 - RNA, 18 nt, Human
ggaagaucccccagaaaa

SEQ ID NO: 1225953 - RNA, 22 nt, Human
ggaagaucccccagaaaagaaa

SEQ ID NO: 1225954 - RNA, 14 nt, Human
ggaagaucccccag

SEQ ID NO: 1225955 - RNA, 15 nt, Human
ggacugcggaggaag

SEQ ID NO: 1225956 - RNA, 16 nt, Human
ggacugcggaggaagg

SEQ ID NO: 1225957 - RNA, 12 nt, Human
ggagcccuggga

SEQ ID NO: 1225958 - RNA, 13 nt, Human
ggagcccugggag

SEQ ID NO: 1225959 - RNA, 16 nt, Human
ggaaggaggacccagg

SEQ ID NO: 1225960 - RNA, 19 nt, Human
ggaaggaggacccaggaca

SEQ ID NO: 1225961 - RNA, 15 nt, Human
ggaccagcuuuuccc

SEQ ID NO: 1225962 - RNA, 17 nt, Human
ggaccagcuuuucccaa

SEQ ID NO: 1225963 - RNA, 22 nt, Human
ggaccagcuuuucccaaaagcc

SEQ ID NO: 1225964 - RNA, 10 nt, Human
ggacccagga

SEQ ID NO: 1225965 - RNA, 13 nt, Human
ggacccaggacag

SEQ ID NO: 1225966 - RNA, 17 nt, Human
ggaggaggcagagaaga

SEQ ID NO: 1225967 - RNA, 18 nt, Human
ggaggaggcagagaagaa

SEQ ID NO: 1225968 - RNA, 16 nt, Human
ggcagcaauuuaaaug

SEQ ID NO: 1225969 - RNA, 17 nt, Human
ggcagcaacaauaaaua

SEQ ID NO: 1225970 - RNA, 22 nt, Human
ggcagcaacaauaaauagacac

SEQ ID NO: 1225971 - RNA, 15 nt, Human
ggcagcaauuuaaau

SEQ ID NO: 1225972 - RNA, 15 nt, Human
ggcagcaacaauaaa

SEQ ID NO: 1225973 - RNA, 21 nt, Human
ggaucaguuaacuauugcauu

SEQ ID NO: 1225974 - RNA, 18 nt, Human
ggccaggcugggucgccc

SEQ ID NO: 1225975 - RNA, 22 nt, Human
ggccaggcugggucgcccugga

SEQ ID NO: 1225976 - RNA, 20 nt, Human
ggccaggcaggagcccuucu

SEQ ID NO: 1225977 - RNA, 16 nt, Human
ggcucuggagcccacu

SEQ ID NO: 1225978 - RNA, 13 nt, Human
ggccccugccucu

SEQ ID NO: 1225979 - RNA, 20 nt, Human
ggccccugccaccuccugcc

SEQ ID NO: 1225980 - RNA, 13 nt, Human
ggcucuggagccc

SEQ ID NO: 1225981 - RNA, 14 nt, Human
ggcucuggagccca

SEQ ID NO: 1225982 - RNA, 15 nt, Human
ggcugcugcuacaau

SEQ ID NO: 1225983 - RNA, 13 nt, Human
ggcuuuucugauc

SEQ ID NO: 1225984 - RNA, 16 nt, Human
ggcuuuucugauccag

SEQ ID NO: 1225985 - RNA, 12 nt, Human
ggcuuuucugau

SEQ ID NO: 1225986 - RNA, 22 nt, Human
ggcuugaguuuaaauuguaaua

SEQ ID NO: 1225987 - RNA, 20 nt, Human
gggaccggcggaccccagcc

SEQ ID NO: 1225988 - RNA, 22 nt, Human
gggacguucgugguccugcgcu

SEQ ID NO: 1225989 - RNA, 13 nt, Human
gggaaugaagaua

SEQ ID NO: 1225990 - RNA, 17 nt, Human
ggcuuuucugauccagu

SEQ ID NO: 1225991 - RNA, 15 nt, Human
gggacugagaaauuu

SEQ ID NO: 1225992 - RNA, 18 nt, Human
gggaggugagaccaccuc

SEQ ID NO: 1225993 - RNA, 12 nt, Human
gggacucagccc

SEQ ID NO: 1225994 - RNA, 13 nt, Human
gggacugagaaau

SEQ ID NO: 1225995 - RNA, 13 nt, Human
gggcaagaggaau

SEQ ID NO: 1225996 - RNA, 20 nt, Human
gggcaauuaauuccuucagc

SEQ ID NO: 1225997 - RNA, 21 nt, Human
gggcaauuaauuccuucagca

SEQ ID NO: 1225998 - RNA, 22 nt, Human
gggccccugccucucugcaggu

SEQ ID NO: 1225999 - RNA, 13 nt, Human
gggccccugccuc

SEQ ID NO: 1226000 - RNA, 15 nt, Human
gggccccugccucuc

SEQ ID NO: 1226001 - RNA, 17 nt, Human
gggccccugccucucug

SEQ ID NO: 1226002 - RNA, 18 nt, Human
gggccccugccucucugc

SEQ ID NO: 1226003 - RNA, 19 nt, Human
gggccccugccucucugca

SEQ ID NO: 1226004 - RNA, 21 nt, Human
gggccccugccucucugcagg

SEQ ID NO: 1226005 - RNA, 20 nt, Human
ggucacguuuggugcuucuc

SEQ ID NO: 1226006 - RNA, 18 nt, Human
gguagcauuuguguugaa

SEQ ID NO: 1226007 - RNA, 17 nt, Human
gggugcugggccccugc

SEQ ID NO: 1226008 - RNA, 18 nt, Human
gggugcugggccccugcc

SEQ ID NO: 1226009 - RNA, 11 nt, Human
ggggauucuua

SEQ ID NO: 1226010 - RNA, 15 nt, Human
ggggauucuuaaagu

SEQ ID NO: 1226011 - RNA, 14 nt, Human
ggggcuaccaggaa

SEQ ID NO: 1226012 - RNA, 18 nt, Human
ggggugcugggccccugc

SEQ ID NO: 1226013 - RNA, 20 nt, Human
gggguggggggggugcuggg

SEQ ID NO: 1226014 - RNA, 14 nt, Human
ggugagaccaccuc

SEQ ID NO: 1226015 - RNA, 15 nt, Human
ggugagaccaccucu

SEQ ID NO: 1226016 - RNA, 20 nt, Human
ggucucuucugaauaaagca

SEQ ID NO: 1226017 - RNA, 21 nt, Human
ggucucuucugaauaaagcaa

SEQ ID NO: 1226018 - RNA, 22 nt, Human
ggucucuucugaauaaagcaau

SEQ ID NO: 1226019 - RNA, 14 nt, Human
ggugacuuuggaua

SEQ ID NO: 1226020 - RNA, 18 nt, Human
ggugacuuuggauaauaa

SEQ ID NO: 1226021 - RNA, 19 nt, Human
ggugacuuuggauaauaag

SEQ ID NO: 1226022 - RNA, 20 nt, Human
ggugacuuuggauaauaagg

SEQ ID NO: 1226023 - RNA, 21 nt, Human
ggugacuuuggauaauaagga

SEQ ID NO: 1226024 - RNA, 20 nt, Human
gguuaucugaagucagaucu

SEQ ID NO: 1226025 - RNA, 16 nt, Human
gguuagggaaaacauu

SEQ ID NO: 1226026 - RNA, 16 nt, Human
gguguaugugugaagu

SEQ ID NO: 1226027 - RNA, 13 nt, Human
uacuugcucuuga

SEQ ID NO: 1226028 - RNA, 21 nt, Human
uacuugcucuugaugccuggc

SEQ ID NO: 1226029 - RNA, 11 nt, Human
uagaaagcuau

SEQ ID NO: 1226030 - RNA, 15 nt, Human
uacuccccuccuuga

SEQ ID NO: 1226031 - RNA, 19 nt, Human
uaccuuugacaaagguaaa

SEQ ID NO: 1226032 - RNA, 21 nt, Human
uacaguuagggcuccuauuca

SEQ ID NO: 1226033 - RNA, 18 nt, Human
uacaguuccuagguauaa

SEQ ID NO: 1226034 - RNA, 11 nt, Human
uacauuugugu

SEQ ID NO: 1226035 - RNA, 17 nt, Human
uacauuuguauaaaaua

SEQ ID NO: 1226036 - RNA, 16 nt, Human
uacauuuguauaaaau

SEQ ID NO: 1226037 - RNA, 18 nt, Human
uaccaccagucugacugu

SEQ ID NO: 1226038 - RNA, 23 nt, Human
uaccacaggaaccacaagacugc

SEQ ID NO: 1226039 - RNA, 18 nt, Human
uaccaaggucuucuuaau

SEQ ID NO: 1226040 - RNA, 12 nt, Human
uaccaauaaagu

SEQ ID NO: 1226041 - RNA, 13 nt, Human
uaccaauaaagug

SEQ ID NO: 1226042 - RNA, 17 nt, Human
uaccaauaaagugaccc

SEQ ID NO: 1226043 - RNA, 14 nt, Human
uaccaauaaaguga

SEQ ID NO: 1226044 - RNA, 12 nt, Human
uacccacccaga

SEQ ID NO: 1226045 - RNA, 15 nt, Human
uacccaaauuaagag

SEQ ID NO: 1226046 - RNA, 14 nt, Human
uacacaauaagcaa

SEQ ID NO: 1226047 - RNA, 15 nt, Human
uacacaauaagcaaa

SEQ ID NO: 1226048 - RNA, 13 nt, Human
uaauuuugugaag

SEQ ID NO: 1226049 - RNA, 12 nt, Human
uaauuuuggaau

SEQ ID NO: 1226050 - RNA, 13 nt, Human
uaauuuuggaauu

SEQ ID NO: 1226051 - RNA, 13 nt, Human
uaauuuugaaaaa

SEQ ID NO: 1226052 - RNA, 17 nt, Human
uaauuuugaaaaacugc

SEQ ID NO: 1226053 - RNA, 19 nt, Human
uacaauuuuguuucuguac

SEQ ID NO: 1226054 - RNA, 21 nt, Human
uacaauuuuguuucuguacuu

SEQ ID NO: 1226055 - RNA, 22 nt, Human
uacagaaaaguugaauuuuaca

SEQ ID NO: 1226056 - RNA, 18 nt, Human
uacagaaaaguugaauuu

SEQ ID NO: 1226057 - RNA, 13 nt, Human
uacagaauuuuau

SEQ ID NO: 1226058 - RNA, 11 nt, Human
uacagaacuac

SEQ ID NO: 1226059 - RNA, 14 nt, Human
uacagaagaaacug

SEQ ID NO: 1226060 - RNA, 19 nt, Human
uauauuuuuauauuuacua

SEQ ID NO: 1226061 - RNA, 12 nt, Human
uaucucuucagu

SEQ ID NO: 1226062 - RNA, 13 nt, Human
uaucucuucaguc

SEQ ID NO: 1226063 - RNA, 14 nt, Human
uaucucuucagucu

SEQ ID NO: 1226064 - RNA, 16 nt, Human
uaucucuucagucucu

SEQ ID NO: 1226065 - RNA, 17 nt, Human
uaucaugugaaaucauu

SEQ ID NO: 1226066 - RNA, 22 nt, Human
uaucaugugaaaucauucauuu

SEQ ID NO: 1226067 - RNA, 18 nt, Human
uauaugcuauuucuauau

SEQ ID NO: 1226068 - RNA, 16 nt, Human
uauaugcuauuucuau

SEQ ID NO: 1226069 - RNA, 23 nt, Human
uauauuuauuacuguaagaaaau

SEQ ID NO: 1226070 - RNA, 19 nt, Human
uauauguaccguaggcuuu

SEQ ID NO: 1226071 - RNA, 20 nt, Human
uauauuugaaauauugacuu

SEQ ID NO: 1226072 - RNA, 14 nt, Human
uauauuugaaauau

SEQ ID NO: 1226073 - RNA, 13 nt, Human
uauauuugaaaua

SEQ ID NO: 1226074 - RNA, 13 nt, Human
uauauuuuaagac

SEQ ID NO: 1226075 - RNA, 14 nt, Human
uauauuuuaagacg

SEQ ID NO: 1226076 - RNA, 15 nt, Human
uauaauucaccuucu

SEQ ID NO: 1226077 - RNA, 15 nt, Human
uauacccacccagaa

SEQ ID NO: 1226078 - RNA, 22 nt, Human
uauacccacccagaaugagaca

SEQ ID NO: 1226079 - RNA, 20 nt, Human
uauacuauaguaccaguagg

SEQ ID NO: 1226080 - RNA, 18 nt, Human
uauaacaaugcuguauuu

SEQ ID NO: 1226081 - RNA, 15 nt, Human
uaguuuuauaugcuu

SEQ ID NO: 1226082 - RNA, 18 nt, Human
uaguuguaaaccaaguga

SEQ ID NO: 1226083 - RNA, 18 nt, Human
uagucaaauugugugaaa

SEQ ID NO: 1226084 - RNA, 17 nt, Human
uaggaaguugacuuaua

SEQ ID NO: 1226085 - RNA, 14 nt, Human
uaggaauuguguuu

SEQ ID NO: 1226086 - RNA, 22 nt, Human
uaggaaguugacuuauaguaca

SEQ ID NO: 1226087 - RNA, 16 nt, Human
uaggaauuguguuuau

SEQ ID NO: 1226088 - RNA, 14 nt, Human
uagagaguguugaa

SEQ ID NO: 1226089 - RNA, 15 nt, Human
uagagaguguugaaa

SEQ ID NO: 1226090 - RNA, 18 nt, Human
uagaguuuagcuggaaaa

SEQ ID NO: 1226091 - RNA, 17 nt, Human
uagaguuuagcuggaaa

SEQ ID NO: 1226092 - RNA, 13 nt, Human
uagacuggugacu

SEQ ID NO: 1226093 - RNA, 14 nt, Human
uagacuggugacug

SEQ ID NO: 1226094 - RNA, 17 nt, Human
uagacuggugacugauu

SEQ ID NO: 1226095 - RNA, 18 nt, Human
uagacuggugacugauuc

SEQ ID NO: 1226096 - RNA, 20 nt, Human
uagauguauguacuucaugc

SEQ ID NO: 1226097 - RNA, 16 nt, Human
uagauguauguacuuc

SEQ ID NO: 1226098 - RNA, 17 nt, Human
uaagagagucuauuuac

SEQ ID NO: 1226099 - RNA, 15 nt, Human
uaaggcaaucauggu

SEQ ID NO: 1226100 - RNA, 19 nt, Human
uaagcauauauuuuuauau

SEQ ID NO: 1226101 - RNA, 21 nt, Human
uaagcauauauuuuuauauuu

SEQ ID NO: 1226102 - RNA, 22 nt, Human
uaagcauauauuuuuauauuua

SEQ ID NO: 1226103 - RNA, 23 nt, Human
uaagcauauauuuuuauauuuac

SEQ ID NO: 1226104 - RNA, 15 nt, Human
uaagcaugcacaaau

SEQ ID NO: 1226105 - RNA, 20 nt, Human
uaagcauuccaacuaucuca

SEQ ID NO: 1226106 - RNA, 18 nt, Human
uaagcauuccaacuaucu

SEQ ID NO: 1226107 - RNA, 16 nt, Human
uaagcauuccaacuau

SEQ ID NO: 1226108 - RNA, 17 nt, Human
uaacauguuaaaccaug

SEQ ID NO: 1226109 - RNA, 18 nt, Human
uaacauguuaaaccaugg

SEQ ID NO: 1226110 - RNA, 11 nt, Human
uaaccaaguuc

SEQ ID NO: 1226111 - RNA, 12 nt, Human
uaaccaaguucc

SEQ ID NO: 1226112 - RNA, 17 nt, Human
uaaccaggggccaugaa

SEQ ID NO: 1226113 - RNA, 22 nt, Human
uaaauuuaguauuuuguuucag

SEQ ID NO: 1226114 - RNA, 14 nt, Human
uaaauuuaguauuu

SEQ ID NO: 1226115 - RNA, 18 nt, Human
uaaauccauuuggaaauc

SEQ ID NO: 1226116 - RNA, 19 nt, Human
uaaauccauuuggaaaucu

SEQ ID NO: 1226117 - RNA, 22 nt, Human
uaaauccauuuggaaaucuuua

SEQ ID NO: 1226118 - RNA, 23 nt, Human
uaaauccauuuggaaaucuuuaa

SEQ ID NO: 1226119 - RNA, 16 nt, Human
uaaaucccauuauuca

SEQ ID NO: 1226120 - RNA, 17 nt, Human
uaaaucccauuauucaa

SEQ ID NO: 1226121 - RNA, 19 nt, Human
uaaaucccauuauucaaag

SEQ ID NO: 1226122 - RNA, 15 nt, Human
uaaucuuauuuagga

SEQ ID NO: 1226123 - RNA, 15 nt, Human
uaaucuucaauaguu

SEQ ID NO: 1226124 - RNA, 15 nt, Human
uaauauuaaagccau

SEQ ID NO: 1226125 - RNA, 12 nt, Human
uaauauuaaagc

SEQ ID NO: 1226126 - RNA, 13 nt, Human
uaauauuaaagcc

SEQ ID NO: 1226127 - RNA, 14 nt, Human
uaauauuaaagcca

SEQ ID NO: 1226128 - RNA, 20 nt, Human
uaauauguucuuuuaaauga

SEQ ID NO: 1226129 - RNA, 11 nt, Human
uaauaaagcug

SEQ ID NO: 1226130 - RNA, 20 nt, Human
uaauaaggaaaaguuuaaua

SEQ ID NO: 1226131 - RNA, 20 nt, Human
uaauaauuuuuaagaaauaa

SEQ ID NO: 1226132 - RNA, 15 nt, Human
uaauaauguuucaaa

SEQ ID NO: 1226133 - RNA, 15 nt, Human
uaauaauuauaugcu

SEQ ID NO: 1226134 - RNA, 16 nt, Human
uaauaauuauaugcua

SEQ ID NO: 1226135 - RNA, 19 nt, Human
uaauaauuauaugcuauuu

SEQ ID NO: 1226136 - RNA, 20 nt, Human
uaauaauuauaugcuauuuc

SEQ ID NO: 1226137 - RNA, 22 nt, Human
uaauaauuauaugcuauuucua

SEQ ID NO: 1226138 - RNA, 23 nt, Human
uaauaauuauaugcuauuucuau

SEQ ID NO: 1226139 - RNA, 23 nt, Human
uaauuuguaguguuggagaagaa

SEQ ID NO: 1226140 - RNA, 17 nt, Human
uaauuugguuuucacau

SEQ ID NO: 1226141 - RNA, 15 nt, Human
uaauuugguuuucac

SEQ ID NO: 1226142 - RNA, 18 nt, Human
uaauuugguuuucacauu

SEQ ID NO: 1226143 - RNA, 20 nt, Human
uaauuuguaguguuggagaa

SEQ ID NO: 1226144 - RNA, 22 nt, Human
uaauuggaaaggcagcucuaaa

SEQ ID NO: 1226145 - RNA, 22 nt, Human
uaauguuucaaacauauauaac

SEQ ID NO: 1226146 - RNA, 15 nt, Human
uaauguuucaaacau

SEQ ID NO: 1226147 - RNA, 14 nt, Human
uaauguuucaaaca

SEQ ID NO: 1226148 - RNA, 12 nt, Human
uaauuaacaugu

SEQ ID NO: 1226149 - RNA, 14 nt, Human
uaauuaacauguua

SEQ ID NO: 1226150 - RNA, 15 nt, Human
uaauuaacauguuaa

SEQ ID NO: 1226151 - RNA, 17 nt, Human
uaauuaacauguuaaac

SEQ ID NO: 1226152 - RNA, 18 nt, Human
uaauuaacauguuaaacc

SEQ ID NO: 1226153 - RNA, 19 nt, Human
uaauuaacauguuaaacca

SEQ ID NO: 1226154 - RNA, 20 nt, Human
uaauuaacauguuaaaccau

SEQ ID NO: 1226155 - RNA, 14 nt, Human
uaaaguuuguugaa

SEQ ID NO: 1226156 - RNA, 17 nt, Human
uaaauaaaaauaauccu

SEQ ID NO: 1226157 - RNA, 13 nt, Human
uaaaguugaauuu

SEQ ID NO: 1226158 - RNA, 14 nt, Human
uaaaguugaauuua

SEQ ID NO: 1226159 - RNA, 15 nt, Human
uaaaguugaauuuau

SEQ ID NO: 1226160 - RNA, 17 nt, Human
uaaaguugaauuuauug

SEQ ID NO: 1226161 - RNA, 19 nt, Human
uaaaguugaauuuauuggc

SEQ ID NO: 1226162 - RNA, 21 nt, Human
uaaaguugaauuuauuggcuu

SEQ ID NO: 1226163 - RNA, 23 nt, Human
uaaaguugaauuuauuggcuuuu

SEQ ID NO: 1226164 - RNA, 12 nt, Human
uaaaggacugua

SEQ ID NO: 1226165 - RNA, 14 nt, Human
uaaaggacuguaau

SEQ ID NO: 1226166 - RNA, 13 nt, Human
uaaacuuuucuga

SEQ ID NO: 1226167 - RNA, 14 nt, Human
uaaacuuuucugau

SEQ ID NO: 1226168 - RNA, 15 nt, Human
uaaacuuuucugaua

SEQ ID NO: 1226169 - RNA, 20 nt, Human
uaaacuuuuuucuuacuguc

SEQ ID NO: 1226170 - RNA, 20 nt, Human
uaaaucagacuaugaaguuu

SEQ ID NO: 1226171 - RNA, 14 nt, Human
uaaauccauuugga

SEQ ID NO: 1226172 - RNA, 15 nt, Human
uaaauccauuuggaa

SEQ ID NO: 1226173 - RNA, 16 nt, Human
uaaauccauuuggaaa

SEQ ID NO: 1226174 - RNA, 18 nt, Human
uaaauauaugcuaagucu

SEQ ID NO: 1226175 - RNA, 16 nt, Human
uaaauauauuuuaaga

SEQ ID NO: 1226176 - RNA, 22 nt, Human
uaaauauauuuuaagacgaaac

SEQ ID NO: 1226177 - RNA, 21 nt, Human
uaaacacucuugaaaaaugca

SEQ ID NO: 1226178 - RNA, 22 nt, Human
uaaaaauggaaacuauauugac

SEQ ID NO: 1226179 - RNA, 17 nt, Human
uaaaagggacugagaaa

SEQ ID NO: 1226180 - RNA, 19 nt, Human
uaaaagggacugagaaauu

SEQ ID NO: 1226181 - RNA, 20 nt, Human
uaaaagggacugagaaauuu

SEQ ID NO: 1226182 - RNA, 21 nt, Human
uaaaagggacugagaaauuua

SEQ ID NO: 1226183 - RNA, 19 nt, Human
uaaaauccauacauuugug

SEQ ID NO: 1226184 - RNA, 15 nt, Human
uaaaaggaaagaaaa

SEQ ID NO: 1226185 - RNA, 13 nt, Human
uaaaaugagaaau

SEQ ID NO: 1226186 - RNA, 15 nt, Human
uaaaaugagaaaucu

SEQ ID NO: 1226187 - RNA, 16 nt, Human
uaaaaugagaaaucua

SEQ ID NO: 1226188 - RNA, 12 nt, Human
guuuguuuaguc

SEQ ID NO: 1226189 - RNA, 18 nt, Human
guuuucaggcuagaugua

SEQ ID NO: 1226190 - RNA, 12 nt, Human
uaaaaaacacug

SEQ ID NO: 1226191 - RNA, 16 nt, Human
uaaaaaagaaacauuu

SEQ ID NO: 1226192 - RNA, 14 nt, Human
uaaaaaauggucac

SEQ ID NO: 1226193 - RNA, 17 nt, Human
uaaaaacaaagaaauua

SEQ ID NO: 1226194 - RNA, 11 nt, Human
uaaaaaacacu

SEQ ID NO: 1226195 - RNA, 23 nt, Human
guuugugcugguguaugugugaa

SEQ ID NO: 1226196 - RNA, 14 nt, Human
guuucuuuguaaug

SEQ ID NO: 1226197 - RNA, 17 nt, Human
guuucuuuguaaugaaa

SEQ ID NO: 1226198 - RNA, 18 nt, Human
guuucuuuguaaugaaaa

SEQ ID NO: 1226199 - RNA, 16 nt, Human
guuuccuuauauuaug

SEQ ID NO: 1226200 - RNA, 20 nt, Human
guuuagcuggaaaaguaugu

SEQ ID NO: 1226201 - RNA, 16 nt, Human
guuuaguaaucauauu

SEQ ID NO: 1226202 - RNA, 14 nt, Human
guuuagucuugucu

SEQ ID NO: 1226203 - RNA, 18 nt, Human
guuuagucuugucucaga

SEQ ID NO: 1226204 - RNA, 23 nt, Human
ucacaggacagcccuucuuucca

SEQ ID NO: 1226205 - RNA, 11 nt, Human
ucaaccucauc

SEQ ID NO: 1226206 - RNA, 19 nt, Human
ucaacuccaaacugacucu

SEQ ID NO: 1226207 - RNA, 16 nt, Human
uaucugaggaauucug

SEQ ID NO: 1226208 - RNA, 17 nt, Human
uaucugaagucagaucu

SEQ ID NO: 1226209 - RNA, 18 nt, Human
uaucugaagucagaucug

SEQ ID NO: 1226210 - RNA, 15 nt, Human
uaucugaggaauucu

SEQ ID NO: 1226211 - RNA, 22 nt, Human
uauuucuaugaaauauuauguu

SEQ ID NO: 1226212 - RNA, 13 nt, Human
uauuuauuacugu

SEQ ID NO: 1226213 - RNA, 18 nt, Human
ucaaacuacauauuguaa

SEQ ID NO: 1226214 - RNA, 17 nt, Human
uauuuuuuucugaaauu

SEQ ID NO: 1226215 - RNA, 16 nt, Human
uauuuuuuucugaaau

SEQ ID NO: 1226216 - RNA, 22 nt, Human
uauuuuuuucugaauuauuuuc

SEQ ID NO: 1226217 - RNA, 17 nt, Human
uauuuuauguugcauag

SEQ ID NO: 1226218 - RNA, 12 nt, Human
uauuuuaugauc

SEQ ID NO: 1226219 - RNA, 15 nt, Human
uauuuuauguugcau

SEQ ID NO: 1226220 - RNA, 16 nt, Human
uauuuuauguugcaua

SEQ ID NO: 1226221 - RNA, 17 nt, Human
ucacuugucaauaaaau

SEQ ID NO: 1226222 - RNA, 22 nt, Human
ucagaguugaugguuguacaua

SEQ ID NO: 1226223 - RNA, 21 nt, Human
ucagcaaacaggaucaguuaa

SEQ ID NO: 1226224 - RNA, 18 nt, Human
ucacucuccauuuaauaa

SEQ ID NO: 1226225 - RNA, 11 nt, Human
ucccuaauaaa

SEQ ID NO: 1226226 - RNA, 12 nt, Human
ucccuaauaaag

SEQ ID NO: 1226227 - RNA, 13 nt, Human
ucccuaauaaagc

SEQ ID NO: 1226228 - RNA, 14 nt, Human
ucccuaauaaagcu

SEQ ID NO: 1226229 - RNA, 14 nt, Human
uccauggcccugcc

SEQ ID NO: 1226230 - RNA, 20 nt, Human
ucccaaguaacugggauuac

SEQ ID NO: 1226231 - RNA, 21 nt, Human
ucccaaguaacugggauuaca

SEQ ID NO: 1226232 - RNA, 20 nt, Human
uccaagcauuuagauguaua

SEQ ID NO: 1226233 - RNA, 15 nt, Human
uccaagcaaauguga

SEQ ID NO: 1226234 - RNA, 14 nt, Human
uccaccucaacucc

SEQ ID NO: 1226235 - RNA, 15 nt, Human
uccaccgcagaagga

SEQ ID NO: 1226236 - RNA, 16 nt, Human
uccaccgcagaaggaa

SEQ ID NO: 1226237 - RNA, 17 nt, Human
uccaccgcagaaggaag

SEQ ID NO: 1226238 - RNA, 18 nt, Human
uccaccgcagaaggaagg

SEQ ID NO: 1226239 - RNA, 20 nt, Human
uccagcagauuauucacuga

SEQ ID NO: 1226240 - RNA, 22 nt, Human
uccagcagauuauucacugauu

SEQ ID NO: 1226241 - RNA, 22 nt, Human
uccagcagauuuccagccuucu

SEQ ID NO: 1226242 - RNA, 17 nt, Human
uccagauccuggaaauc

SEQ ID NO: 1226243 - RNA, 16 nt, Human
uccagauccuggaaau

SEQ ID NO: 1226244 - RNA, 17 nt, Human
uccaagcauuuagaugu

SEQ ID NO: 1226245 - RNA, 13 nt, Human
uccaagcaaaugu

SEQ ID NO: 1226246 - RNA, 14 nt, Human
uccaagaauuucua

SEQ ID NO: 1226247 - RNA, 23 nt, Human
uccaaacugacucuuaagaagac

SEQ ID NO: 1226248 - RNA, 22 nt, Human
ucauucagauaugauucaaaug

SEQ ID NO: 1226249 - RNA, 13 nt, Human
ucauuauuuuauu

SEQ ID NO: 1226250 - RNA, 14 nt, Human
ucauuauuuuauua

SEQ ID NO: 1226251 - RNA, 15 nt, Human
ucauuauuuuauuau

SEQ ID NO: 1226252 - RNA, 16 nt, Human
ucauuauuuuauuaug

SEQ ID NO: 1226253 - RNA, 18 nt, Human
ucauuauuuuauuaugaa

SEQ ID NO: 1226254 - RNA, 19 nt, Human
ucauuauuuuauuaugaaa

SEQ ID NO: 1226255 - RNA, 22 nt, Human
ucauuauuuuauuaugaaacuu

SEQ ID NO: 1226256 - RNA, 15 nt, Human
ucauaauuauuauuu

SEQ ID NO: 1226257 - RNA, 12 nt, Human
ucaguugcagcc

SEQ ID NO: 1226258 - RNA, 21 nt, Human
ucagcacuuuagaauaugccu

SEQ ID NO: 1226259 - RNA, 20 nt, Human
ucugaggaauucuguauaga

SEQ ID NO: 1226260 - RNA, 14 nt, Human
ucugaaauuuccug

SEQ ID NO: 1226261 - RNA, 13 nt, Human
ucucuucagucuc

SEQ ID NO: 1226262 - RNA, 17 nt, Human
ucucuucagucucuaua

SEQ ID NO: 1226263 - RNA, 11 nt, Human
ucucugcaggu

SEQ ID NO: 1226264 - RNA, 19 nt, Human
ucucuucugaauaaagcaa

SEQ ID NO: 1226265 - RNA, 20 nt, Human
ucucuucugaauaaagcaau

SEQ ID NO: 1226266 - RNA, 19 nt, Human
ucucuaggaaauauuuauu

SEQ ID NO: 1226267 - RNA, 13 nt, Human
ucucuaggaaaua

SEQ ID NO: 1226268 - RNA, 14 nt, Human
ucucuauaccaaua

SEQ ID NO: 1226269 - RNA, 16 nt, Human
ucucuauaccaauaaa

SEQ ID NO: 1226270 - RNA, 17 nt, Human
ucucuauaccaauaaag

SEQ ID NO: 1226271 - RNA, 19 nt, Human
ucucuauaccaauaaagug

SEQ ID NO: 1226272 - RNA, 15 nt, Human
ucucucgugaguaua

SEQ ID NO: 1226273 - RNA, 21 nt, Human
ucucaguugcagcccugcugc

SEQ ID NO: 1226274 - RNA, 14 nt, Human
ucucaguugcagcc

SEQ ID NO: 1226275 - RNA, 16 nt, Human
ucucaaacuccugacc

SEQ ID NO: 1226276 - RNA, 15 nt, Human
ucucaacuccaaacu

SEQ ID NO: 1226277 - RNA, 21 nt, Human
ucuacacuaagagagaaugag

SEQ ID NO: 1226278 - RNA, 16 nt, Human
ucuaaauucuuucauu

SEQ ID NO: 1226279 - RNA, 10 nt, Human
ucggaccagc

SEQ ID NO: 1226280 - RNA, 22 nt, Human
ugaacuuguaaaggaauuuaaa

SEQ ID NO: 1226281 - RNA, 22 nt, Human
ugaaguccaagcauuuagaugu

SEQ ID NO: 1226282 - RNA, 21 nt, Human
ugaaguccaagcauuuagaug

SEQ ID NO: 1226283 - RNA, 19 nt, Human
ugaagagguuuuaaagcuu

SEQ ID NO: 1226284 - RNA, 19 nt, Human
ugaaauggacuuuuguaca

SEQ ID NO: 1226285 - RNA, 13 nt, Human
ugaaagauucaau

SEQ ID NO: 1226286 - RNA, 16 nt, Human
ucuuuuuucaaaagaa

SEQ ID NO: 1226287 - RNA, 17 nt, Human
ucuuucacauuuaaaua

SEQ ID NO: 1226288 - RNA, 15 nt, Human
ucuugccuuuuucau

SEQ ID NO: 1226289 - RNA, 18 nt, Human
ucuuuaaaaaaaaaauug

SEQ ID NO: 1226290 - RNA, 19 nt, Human
ucuuuaaaaaaaaaauugg

SEQ ID NO: 1226291 - RNA, 16 nt, Human
ucuuuaaaaggaaaga

SEQ ID NO: 1226292 - RNA, 18 nt, Human
ucuuuaaaaggaaagaaa

SEQ ID NO: 1226293 - RNA, 19 nt, Human
ucuugucucagauuuuauu

SEQ ID NO: 1226294 - RNA, 14 nt, Human
ucuguaaaacuaag

SEQ ID NO: 1226295 - RNA, 21 nt, Human
ucuguaaaacuaagaaacuua

SEQ ID NO: 1226296 - RNA, 22 nt, Human
ucuguuuuauaauuuugugaag

SEQ ID NO: 1226297 - RNA, 22 nt, Human
ugccuaaguccaguguuucuuu

SEQ ID NO: 1226298 - RNA, 23 nt, Human
ugccuaaggacuucuuuaauuuu

SEQ ID NO: 1226299 - RNA, 15 nt, Human
ugccuggcggggugg

SEQ ID NO: 1226300 - RNA, 21 nt, Human
ugcgcccuuaacugcauccag

SEQ ID NO: 1226301 - RNA, 22 nt, Human
ugccuucucaacuccaaacuga

SEQ ID NO: 1226302 - RNA, 14 nt, Human
ugcuaguaauugga

SEQ ID NO: 1226303 - RNA, 14 nt, Human
ugcucaggagcccu

SEQ ID NO: 1226304 - RNA, 11 nt, Human
ugcucauggaa

SEQ ID NO: 1226305 - RNA, 15 nt, Human
ugcucaggagcccug

SEQ ID NO: 1226306 - RNA, 15 nt, Human
ugcugaguuugugcu

SEQ ID NO: 1226307 - RNA, 17 nt, Human
ugcugaguuugugcugg

SEQ ID NO: 1226308 - RNA, 21 nt, Human
ugcauccagccuggggcugag

SEQ ID NO: 1226309 - RNA, 21 nt, Human
ugcauuauauuuauuacugua

SEQ ID NO: 1226310 - RNA, 20 nt, Human
ugcauuauauuuauuacugu

SEQ ID NO: 1226311 - RNA, 15 nt, Human
ugcauuauauuuauu

SEQ ID NO: 1226312 - RNA, 20 nt, Human
ugccaggcuggagugcagug

SEQ ID NO: 1226313 - RNA, 15 nt, Human
ugcacaucaaaauau

SEQ ID NO: 1226314 - RNA, 22 nt, Human
ugcacggugaauggcuuuguau

SEQ ID NO: 1226315 - RNA, 23 nt, Human
ugcacggugaauggcuuuguaua

SEQ ID NO: 1226316 - RNA, 15 nt, Human
uggcauaacauaaau

SEQ ID NO: 1226317 - RNA, 17 nt, Human
uggcauaacauaaaucu

SEQ ID NO: 1226318 - RNA, 19 nt, Human
uggagaugaggccagacca

SEQ ID NO: 1226319 - RNA, 22 nt, Human
uggagaugaggccagaccaugg

SEQ ID NO: 1226320 - RNA, 24 nt, Human
uggagaugaggccagaccauggac

SEQ ID NO: 1226321 - RNA, 13 nt, Human
uggagauguuuag

SEQ ID NO: 1226322 - RNA, 17 nt, Human
ugcuucuguuuuauaau

SEQ ID NO: 1226323 - RNA, 14 nt, Human
ugcuucuguuuuau

SEQ ID NO: 1226324 - RNA, 12 nt, Human
ugcuuucagaua

SEQ ID NO: 1226325 - RNA, 16 nt, Human
ugcuuucagauacugg

SEQ ID NO: 1226326 - RNA, 17 nt, Human
ugcuuucagauacugga

SEQ ID NO: 1226327 - RNA, 20 nt, Human
ugcuuucagauacuggauug

SEQ ID NO: 1226328 - RNA, 21 nt, Human
ugcuuucagauacuggauugu

SEQ ID NO: 1226329 - RNA, 19 nt, Human
uggaacccuaaauaauaaa

SEQ ID NO: 1226330 - RNA, 16 nt, Human
uggaauacucuuauau

SEQ ID NO: 1226331 - RNA, 18 nt, Human
uggcgcgaucucagcuca

SEQ ID NO: 1226332 - RNA, 17 nt, Human
ugggaauggaggggcag

SEQ ID NO: 1226333 - RNA, 19 nt, Human
ugggaauggaggggcagag

SEQ ID NO: 1226334 - RNA, 21 nt, Human
ugggacagucaccucauggaa

SEQ ID NO: 1226335 - RNA, 20 nt, Human
ugggacagucaccucaugga

SEQ ID NO: 1226336 - RNA, 18 nt, Human
ugggacagucaccucaug

SEQ ID NO: 1226337 - RNA, 23 nt, Human
ugggaauggaggggcagagccag

SEQ ID NO: 1226338 - RNA, 15 nt, Human
uggcuguacccagga

SEQ ID NO: 1226339 - RNA, 14 nt, Human
uggcuuuguauaga

SEQ ID NO: 1226340 - RNA, 22 nt, Human
uggcuuuguauagaaccucuuu

SEQ ID NO: 1226341 - RNA, 20 nt, Human
ugggacauuugcucauggaa

SEQ ID NO: 1226342 - RNA, 19 nt, Human
ugggacauuugcucaugga

SEQ ID NO: 1226343 - RNA, 16 nt, Human
ugggagcuuuuguaga

SEQ ID NO: 1226344 - RNA, 13 nt, Human
ugggcauucaaau

SEQ ID NO: 1226345 - RNA, 19 nt, Human
ugggguggggggggugcug

SEQ ID NO: 1226346 - RNA, 17 nt, Human
uggguagacacacauga

SEQ ID NO: 1226347 - RNA, 21 nt, Human
ugggguggggggggugcuggg

SEQ ID NO: 1226348 - RNA, 22 nt, Human
ugggguggggggggugcugggc

SEQ ID NO: 1226349 - RNA, 23 nt, Human
uggguaggaaagaggaagcaaau

SEQ ID NO: 1226350 - RNA, 12 nt, Human
uguuuguuuagu

SEQ ID NO: 1226351 - RNA, 18 nt, Human
uguuuuaaaaugagaaau

SEQ ID NO: 1226352 - RNA, 21 nt, Human
uguuuguuuagucuugucuca

SEQ ID NO: 1226353 - RNA, 16 nt, Human
uguuucuauuuuuuga

SEQ ID NO: 1226354 - RNA, 22 nt, Human
uguuucuauuuuuugaaaagca

SEQ ID NO: 1226355 - RNA, 23 nt, Human
uguuuuaaaaugagaaaucuaaa

SEQ ID NO: 1226356 - RNA, 19 nt, Human
uuaaaagaaugauuaugaa

SEQ ID NO: 1226357 - RNA, 12 nt, Human
uuaacauguuaa

SEQ ID NO: 1226358 - RNA, 18 nt, Human
uuaacauguuaaaccaug

SEQ ID NO: 1226359 - RNA, 19 nt, Human
uuaacauguuaaaccaugg

SEQ ID NO: 1226360 - RNA, 19 nt, Human
uuaaauagcuuuuuucucu

SEQ ID NO: 1226361 - RNA, 20 nt, Human
uuaaagcuuccauuguuguc

SEQ ID NO: 1226362 - RNA, 15 nt, Human
uuaaagcuuccauug

SEQ ID NO: 1226363 - RNA, 16 nt, Human
uuaauagguuuggaca

SEQ ID NO: 1226364 - RNA, 20 nt, Human
uuaauaauuauaugcuauuu

SEQ ID NO: 1226365 - RNA, 23 nt, Human
uuaauaauuauaugcuauuucua

SEQ ID NO: 1226366 - RNA, 18 nt, Human
uuaauaauguuucaaaca

SEQ ID NO: 1226367 - RNA, 18 nt, Human
uuaauaauuauaugcuau

SEQ ID NO: 1226368 - RNA, 21 nt, Human
uuaauagguuuggacaaaaug

SEQ ID NO: 1226369 - RNA, 20 nt, Human
uuacauuuguauaaaauaau

SEQ ID NO: 1226370 - RNA, 21 nt, Human
uuaccacuuguguuuugcaag

SEQ ID NO: 1226371 - RNA, 16 nt, Human
uuacggaacucaaaua

SEQ ID NO: 1226372 - RNA, 15 nt, Human
uuacaauaguucugu

SEQ ID NO: 1226373 - RNA, 17 nt, Human
uuacaauaguucugugg

SEQ ID NO: 1226374 - RNA, 23 nt, Human
uuacauggcuggagcuagaauuu

SEQ ID NO: 1226375 - RNA, 22 nt, Human
uuacauggcuggagcuagaauu

SEQ ID NO: 1226376 - RNA, 15 nt, Human
uuacauuuguauaaa

SEQ ID NO: 1226377 - RNA, 14 nt, Human
uuacauuuguauaa

SEQ ID NO: 1226378 - RNA, 18 nt, Human
uguuaaaccaugggauaa

SEQ ID NO: 1226379 - RNA, 20 nt, Human
uguuaaaccaugggauaaau

SEQ ID NO: 1226380 - RNA, 21 nt, Human
uguuaaaccaugggauaaaug

SEQ ID NO: 1226381 - RNA, 23 nt, Human
uguuaaaccaugggauaaaugcc

SEQ ID NO: 1226382 - RNA, 21 nt, Human
uguucaagcgauucuccugcc

SEQ ID NO: 1226383 - RNA, 16 nt, Human
uguucacaauauauuu

SEQ ID NO: 1226384 - RNA, 12 nt, Human
uguuauaaucuu

SEQ ID NO: 1226385 - RNA, 16 nt, Human
uguuagaucuaguuca

SEQ ID NO: 1226386 - RNA, 17 nt, Human
ugugugaagugagugag

SEQ ID NO: 1226387 - RNA, 22 nt, Human
uguguuuaggaacuacugagga

SEQ ID NO: 1226388 - RNA, 20 nt, Human
uguugaaacggaugauuucu

SEQ ID NO: 1226389 - RNA, 21 nt, Human
uguugaaacggaugauuucua

SEQ ID NO: 1226390 - RNA, 22 nt, Human
uguugaaacggaugauuucuau

SEQ ID NO: 1226391 - RNA, 23 nt, Human
uguugaaacggaugauuucuaug

SEQ ID NO: 1226392 - RNA, 12 nt, Human
uguucuauagcu

SEQ ID NO: 1226393 - RNA, 13 nt, Human
uguucauaaauaa

SEQ ID NO: 1226394 - RNA, 14 nt, Human
uguucauuccucca

SEQ ID NO: 1226395 - RNA, 15 nt, Human
uguucauuccuccag

SEQ ID NO: 1226396 - RNA, 16 nt, Human
uguucauuccuccagg

SEQ ID NO: 1226397 - RNA, 21 nt, Human
uguuggagaagaacugaaauc

SEQ ID NO: 1226398 - RNA, 19 nt, Human
uguugaagagguuuuaaag

SEQ ID NO: 1226399 - RNA, 14 nt, Human
uguuguuuguuuag

SEQ ID NO: 1226400 - RNA, 14 nt, Human
ugugcgcuaaacuu

SEQ ID NO: 1226401 - RNA, 19 nt, Human
ugugcgcuaaacuuuucug

SEQ ID NO: 1226402 - RNA, 22 nt, Human
ugugcgcuaaacuuuucugaua

SEQ ID NO: 1226403 - RNA, 23 nt, Human
ugugcgcuaaacuuuucugauag

SEQ ID NO: 1226404 - RNA, 14 nt, Human
ugucuuuuuucuaa

SEQ ID NO: 1226405 - RNA, 13 nt, Human
ugugaaacauguu

SEQ ID NO: 1226406 - RNA, 16 nt, Human
ugugaaucauuuuacc

SEQ ID NO: 1226407 - RNA, 13 nt, Human
ugugauauaagug

SEQ ID NO: 1226408 - RNA, 19 nt, Human
uguauacuauaguaccagu

SEQ ID NO: 1226409 - RNA, 15 nt, Human
uguauacuauaguac

SEQ ID NO: 1226410 - RNA, 17 nt, Human
uguauacuauaguacca

SEQ ID NO: 1226411 - RNA, 16 nt, Human
uguauagaaccucuuu

SEQ ID NO: 1226412 - RNA, 14 nt, Human
uguauacuauagua

SEQ ID NO: 1226413 - RNA, 16 nt, Human
uguaugcacaguaaaa

SEQ ID NO: 1226414 - RNA, 16 nt, Human
uguauuguauauuaca

SEQ ID NO: 1226415 - RNA, 18 nt, Human
uguauuguauauuacaau

SEQ ID NO: 1226416 - RNA, 13 nt, Human
uguacucaauuuu

SEQ ID NO: 1226417 - RNA, 17 nt, Human
uguagauaauacaguuc

SEQ ID NO: 1226418 - RNA, 22 nt, Human
uuguauucaaaaauuaucuaua

SEQ ID NO: 1226419 - RNA, 14 nt, Human
uuguauucagaguu

SEQ ID NO: 1226420 - RNA, 21 nt, Human
uuguauucagaguugaugguu

SEQ ID NO: 1226421 - RNA, 16 nt, Human
uuguaaaggaauuuaa

SEQ ID NO: 1226422 - RNA, 15 nt, Human
uuggcuuuucugauc

SEQ ID NO: 1226423 - RNA, 19 nt, Human
uuggcuuuucugauccagu

SEQ ID NO: 1226424 - RNA, 22 nt, Human
uuggcuuuucugauccaguuuu

SEQ ID NO: 1226425 - RNA, 12 nt, Human
uugguaaaccuu

SEQ ID NO: 1226426 - RNA, 14 nt, Human
uugguaaaccuuuu

SEQ ID NO: 1226427 - RNA, 12 nt, Human
uuggaaaucuuu

SEQ ID NO: 1226428 - RNA, 15 nt, Human
uuggaaaucuuuaaa

SEQ ID NO: 1226429 - RNA, 21 nt, Human
uuggaccaaaaaccaguauug

SEQ ID NO: 1226430 - RNA, 16 nt, Human
uugccacccucaugcu

SEQ ID NO: 1226431 - RNA, 13 nt, Human
uugccacccucau

SEQ ID NO: 1226432 - RNA, 14 nt, Human
uugcauagaauaaa

SEQ ID NO: 1226433 - RNA, 13 nt, Human
uugaugaagaagu

SEQ ID NO: 1226434 - RNA, 12 nt, Human
uugaugaagaag

SEQ ID NO: 1226435 - RNA, 21 nt, Human
uugauuggugauuagguggug

SEQ ID NO: 1226436 - RNA, 15 nt, Human
uugaggacacugaua

SEQ ID NO: 1226437 - RNA, 14 nt, Human
uugaggacacugau

SEQ ID NO: 1226438 - RNA, 13 nt, Human
uugaggacacaug

SEQ ID NO: 1226439 - RNA, 14 nt, Human
uugaggacacaugu

SEQ ID NO: 1226440 - RNA, 15 nt, Human
uugaggacacauguc

SEQ ID NO: 1226441 - RNA, 16 nt, Human
uugaggacacaugucc

SEQ ID NO: 1226442 - RNA, 11 nt, Human
uugaggacaca

SEQ ID NO: 1226443 - RNA, 21 nt, Human
uugaccugccucccuucaugc

SEQ ID NO: 1226444 - RNA, 23 nt, Human
uugaccugccucccuucaugcau

SEQ ID NO: 1226445 - RNA, 22 nt, Human
uugaccugccucccuucaugca

SEQ ID NO: 1226446 - RNA, 14 nt, Human
uucugagcauuuaa

SEQ ID NO: 1226447 - RNA, 21 nt, Human
uugaaacggaugauuucuaug

SEQ ID NO: 1226448 - RNA, 22 nt, Human
uugaaacggaugauuucuaugc

SEQ ID NO: 1226449 - RNA, 15 nt, Human
uucuauauuuucauu

SEQ ID NO: 1226450 - RNA, 16 nt, Human
uucuauauuuucauuc

SEQ ID NO: 1226451 - RNA, 18 nt, Human
uucuauauuuucauucuc

SEQ ID NO: 1226452 - RNA, 21 nt, Human
uucuauauuuucauucuccua

SEQ ID NO: 1226453 - RNA, 11 nt, Human
uucuauauuuu

SEQ ID NO: 1226454 - RNA, 14 nt, Human
uucuauauuuucau

SEQ ID NO: 1226455 - RNA, 17 nt, Human
uucuaugcugaguuugu

SEQ ID NO: 1226456 - RNA, 18 nt, Human
uucuccauggcccugcca

SEQ ID NO: 1226457 - RNA, 23 nt, Human
uucucuccucuccccaugauguu

SEQ ID NO: 1226458 - RNA, 17 nt, Human
uucucugauacagaaaa

SEQ ID NO: 1226459 - RNA, 16 nt, Human
uucucugauacagaaa

SEQ ID NO: 1226460 - RNA, 15 nt, Human
uucucugauacagaa

SEQ ID NO: 1226461 - RNA, 14 nt, Human
uucucugauacaga

SEQ ID NO: 1226462 - RNA, 15 nt, Human
uuccuucccugcugu

SEQ ID NO: 1226463 - RNA, 19 nt, Human
uuccuucccugcugugaaa

SEQ ID NO: 1226464 - RNA, 21 nt, Human
uuccuucccugcugugaaaga

SEQ ID NO: 1226465 - RNA, 20 nt, Human
uuccuagguauaauucacau

SEQ ID NO: 1226466 - RNA, 13 nt, Human
uucccuuuccuga

SEQ ID NO: 1226467 - RNA, 14 nt, Human
uucccuucaucugg

SEQ ID NO: 1226468 - RNA, 15 nt, Human
uucccuucaucugga

SEQ ID NO: 1226469 - RNA, 16 nt, Human
uucccuucaucuggaa

SEQ ID NO: 1226470 - RNA, 15 nt, Human
uucaucuaggauuuu

SEQ ID NO: 1226471 - RNA, 22 nt, Human
uucaguuuauuugaaccaauaa

SEQ ID NO: 1226472 - RNA, 16 nt, Human
uucaugaccaguaaag

SEQ ID NO: 1226473 - RNA, 11 nt, Human
uucccaaaagc

SEQ ID NO: 1226474 - RNA, 21 nt, Human
uucccaaaagcccauucauuc

SEQ ID NO: 1226475 - RNA, 11 nt, Human
uucacugauuu

SEQ ID NO: 1226476 - RNA, 15 nt, Human
uuacgugcucugugg

SEQ ID NO: 1226477 - RNA, 15 nt, Human
uuacuaaaauggacu

SEQ ID NO: 1226478 - RNA, 16 nt, Human
uuacuaaaauggacug

SEQ ID NO: 1226479 - RNA, 17 nt, Human
uuacuaaaauggacugu

SEQ ID NO: 1226480 - RNA, 18 nt, Human
uuacuaaaauggacugug

SEQ ID NO: 1226481 - RNA, 19 nt, Human
uucaaugccccugaauuua

SEQ ID NO: 1226482 - RNA, 13 nt, Human
uuuuaugauccag

SEQ ID NO: 1226483 - RNA, 15 nt, Human
uuuuaugauccagca

SEQ ID NO: 1226484 - RNA, 13 nt, Human
uuuuccugaaaac

SEQ ID NO: 1226485 - RNA, 16 nt, Human
uuuuaugauacuugaa

SEQ ID NO: 1226486 - RNA, 20 nt, Human
uuuuaugauacuugaaaauu

SEQ ID NO: 1226487 - RNA, 10 nt, Human
uuuuauauuu

SEQ ID NO: 1226488 - RNA, 20 nt, Human
uuuuauaugcuucuguuuua

SEQ ID NO: 1226489 - RNA, 15 nt, Human
uuuuauaugcuucug

SEQ ID NO: 1226490 - RNA, 14 nt, Human
uuuuacuguacaga

SEQ ID NO: 1226491 - RNA, 21 nt, Human
uuuuaauuugguuuucacauu

SEQ ID NO: 1226492 - RNA, 17 nt, Human
uuuuaauuugguuuuca

SEQ ID NO: 1226493 - RNA, 22 nt, Human
uuuuacauaaauuuaguauuuu

SEQ ID NO: 1226494 - RNA, 13 nt, Human
uuuuacauuaaau

SEQ ID NO: 1226495 - RNA, 19 nt, Human
uuuguuguuuguuuagucu

SEQ ID NO: 1226496 - RNA, 15 nt, Human
uuuuaaaaugagaaa

SEQ ID NO: 1226497 - RNA, 22 nt, Human
uuuuaaaaugagaaaucuaaaa

SEQ ID NO: 1226498 - RNA, 12 nt, Human
uuuguguuagag

SEQ ID NO: 1226499 - RNA, 12 nt, Human
uuuguuguuugu

SEQ ID NO: 1226500 - RNA, 14 nt, Human
uuuguuguuuguuu

SEQ ID NO: 1226501 - RNA, 21 nt, Human
uuuguauaaaauaauuuuuau

SEQ ID NO: 1226502 - RNA, 11 nt, Human
uuuguauagaa

SEQ ID NO: 1226503 - RNA, 16 nt, Human
uuuggaaaucuuuaaa

SEQ ID NO: 1226504 - RNA, 18 nt, Human
uuuggaacccuaaauaau

SEQ ID NO: 1226505 - RNA, 11 nt, Human
uuugcagcuuu

SEQ ID NO: 1226506 - RNA, 19 nt, Human
uuugcauaacguauaaaag

SEQ ID NO: 1226507 - RNA, 23 nt, Human
uuugcauaacguauaaaagccug

SEQ ID NO: 1226508 - RNA, 22 nt, Human
uuucuuacugucuuuuuucuaa

SEQ ID NO: 1226509 - RNA, 21 nt, Human
uuucagauaaucacaauacau

SEQ ID NO: 1226510 - RNA, 15 nt, Human
uuucagcagcugcag

SEQ ID NO: 1226511 - RNA, 15 nt, Human
uuucagauaaucaca

SEQ ID NO: 1226512 - RNA, 17 nt, Human
uuucuaggacugaauua

SEQ ID NO: 1226513 - RNA, 16 nt, Human
uuucuaggacugaauu

SEQ ID NO: 1226514 - RNA, 14 nt, Human
uuucucuuucguua

SEQ ID NO: 1226515 - RNA, 17 nt, Human
uuuauuggcuuuucuga

SEQ ID NO: 1226516 - RNA, 21 nt, Human
uuuauuggcuuuucugaucca

SEQ ID NO: 1226517 - RNA, 14 nt, Human
uuuaugcauauuau

SEQ ID NO: 1226518 - RNA, 13 nt, Human
uuuaugauccagc

SEQ ID NO: 1226519 - RNA, 18 nt, Human
uuguauuguauauuacaa

SEQ ID NO: 1226520 - RNA, 19 nt, Human
uuguauuguauauuacaau

SEQ ID NO: 1226521 - RNA, 17 nt, Human
uuuacauggcuggagcu

SEQ ID NO: 1226522 - RNA, 17 nt, Human
uuuacaauaguucugug

SEQ ID NO: 1226523 - RNA, 22 nt, Human
uuuacauggcuggagcuagaau

SEQ ID NO: 1226524 - RNA, 12 nt, Human
uuuagaaacaca

SEQ ID NO: 1226525 - RNA, 20 nt, Human
uuuagaaacacaacuauauu

SEQ ID NO: 1226526 - RNA, 17 nt, Human
uuuagaauaugccuugu

SEQ ID NO: 1226527 - RNA, 12 nt, Human
uuuuuucugaaa

SEQ ID NO: 1226528 - RNA, 20 nt, Human
uuuuuuauacaggaugauga

SEQ ID NO: 1226529 - RNA, 20 nt, Human
uuuugaaaagcagacauuuu

SEQ ID NO: 1226530 - RNA, 13 nt, Human
uuuuuucuuacug

SEQ ID NO: 1226531 - RNA, 12 nt, Human
ggagugcagugg

SEQ ID NO: 1226532 - RNA, 12 nt, Human
ggauaaaugcca

SEQ ID NO: 1226533 - RNA, 22 nt, Human
ggauaauaaggaaaaguuuaau

SEQ ID NO: 1226534 - RNA, 14 nt, Human
ggcacacaccacca

SEQ ID NO: 1226535 - RNA, 17 nt, Human
ggcaauuaauuccuuca

SEQ ID NO: 1226536 - RNA, 20 nt, Human
ggcaauuaauuccuucagca

SEQ ID NO: 1226537 - RNA, 19 nt, Human
ggcaauuaauuccuucagc

SEQ ID NO: 1226538 - RNA, 18 nt, Human
ggaggaaggaggacccag

SEQ ID NO: 1226539 - RNA, 12 nt, Human
ggaggacccagg

SEQ ID NO: 1226540 - RNA, 14 nt, Human
ggaggacccaggac

SEQ ID NO: 1226541 - RNA, 13 nt, Human
ggaggacccagga

SEQ ID NO: 1226542 - RNA, 17 nt, Human
ggaggugagaccaccuc

SEQ ID NO: 1226543 - RNA, 18 nt, Human
ggccaggcuugucucgaa

SEQ ID NO: 1226544 - RNA, 16 nt, Human
ggcacuggcgaggaga

SEQ ID NO: 1226545 - RNA, 23 nt, Human
ggccccacccucguggacaccug

SEQ ID NO: 1226546 - RNA, 16 nt, Human
aaaacauuccauccuu

SEQ ID NO: 1226547 - RNA, 15 nt, Human
aaaacccagauaaag

SEQ ID NO: 1226548 - RNA, 21 nt, Human
gggacauuugcucauggaauu

SEQ ID NO: 1226549 - RNA, 20 nt, Human
gggacauuugcucauggaau

SEQ ID NO: 1226550 - RNA, 15 nt, Human
aaaaauauauacuaa

SEQ ID NO: 1226551 - RNA, 14 nt, Human
aaaaauauuuuaug

SEQ ID NO: 1226552 - RNA, 22 nt, Human
gggaggcucuggagcccacugu

SEQ ID NO: 1226553 - RNA, 14 nt, Human
aaaagcagacauuu

SEQ ID NO: 1226554 - RNA, 13 nt, Human
aaaagcagacauu

SEQ ID NO: 1226555 - RNA, 19 nt, Human
aaaaguauguuagugcaaa

SEQ ID NO: 1226556 - RNA, 21 nt, Human
gggccaggcugggucgcccug

SEQ ID NO: 1226557 - RNA, 14 nt, Human
gggccaggcugggu

SEQ ID NO: 1226558 - RNA, 15 nt, Human
gggccaggcuggguc

SEQ ID NO: 1226559 - RNA, 12 nt, Human
gggcuaccagga

SEQ ID NO: 1226560 - RNA, 15 nt, Human
gggcuaccaggaaag

SEQ ID NO: 1226561 - RNA, 13 nt, Human
ggggccaggcugg

SEQ ID NO: 1226562 - RNA, 20 nt, Human
aaacaagcacuaaacaaaga

SEQ ID NO: 1226563 - RNA, 15 nt, Human
aaacacccucacacu

SEQ ID NO: 1226564 - RNA, 18 nt, Human
ggguggggggggugcugg

SEQ ID NO: 1226565 - RNA, 16 nt, Human
aaagaaugauuaugaa

SEQ ID NO: 1226566 - RNA, 23 nt, Human
gguaugaacuugaggacacaugu

SEQ ID NO: 1226567 - RNA, 22 nt, Human
gguaugaacuugaggacacaug

SEQ ID NO: 1226568 - RNA, 19 nt, Human
aaagcaggcagaacucauc

SEQ ID NO: 1226569 - RNA, 17 nt, Human
aaagcaggcagaacuca

SEQ ID NO: 1226570 - RNA, 12 nt, Human
aaagcaucccuc

SEQ ID NO: 1226571 - RNA, 15 nt, Human
aaagcaucccucacc

SEQ ID NO: 1226572 - RNA, 17 nt, Human
aaagcaucccucaccca

SEQ ID NO: 1226573 - RNA, 24 nt, Human
aaagcaucccucacccauccuaga

SEQ ID NO: 1226574 - RNA, 20 nt, Human
ggugcugggccccugccucu

SEQ ID NO: 1226575 - RNA, 13 nt, Human
ggucggaccagcu

SEQ ID NO: 1226576 - RNA, 14 nt, Human
ggucggaccagcuu

SEQ ID NO: 1226577 - RNA, 16 nt, Human
aaagccuguuuaagag

SEQ ID NO: 1226578 - RNA, 18 nt, Human
aaagccuguuuaagagac

SEQ ID NO: 1226579 - RNA, 19 nt, Human
gguuucaccauguuggcca

SEQ ID NO: 1226580 - RNA, 16 nt, Human
aaaguuuguugaaaca

SEQ ID NO: 1226581 - RNA, 16 nt, Human
aaaguugaauuuuaca

SEQ ID NO: 1226582 - RNA, 16 nt, Human
aaaguugaauuuauug

SEQ ID NO: 1226583 - RNA, 22 nt, Human
aaaguugaauuuauuggcuuuu

SEQ ID NO: 1226584 - RNA, 13 nt, Human
aaaguugaauuua

SEQ ID NO: 1226585 - RNA, 16 nt, Human
aaaguuuaauauuaaa

SEQ ID NO: 1226586 - RNA, 19 nt, Human
aaaguuuaauauuaaagcc

SEQ ID NO: 1226587 - RNA, 20 nt, Human
aaaguuuaauauuaaagcca

SEQ ID NO: 1226588 - RNA, 21 nt, Human
aaaguuuaauauuaaagccau

SEQ ID NO: 1226589 - RNA, 22 nt, Human
aaaguuuaauauuaaagccaug

SEQ ID NO: 1226590 - RNA, 20 nt, Human
gguuuggacaaaauggaaua

SEQ ID NO: 1226591 - RNA, 19 nt, Human
aaauaaugaauacauuucc

SEQ ID NO: 1226592 - RNA, 20 nt, Human
aaauaauuuuuauauuugaa

SEQ ID NO: 1226593 - RNA, 18 nt, Human
aaauaauuuuuauauuug

SEQ ID NO: 1226594 - RNA, 21 nt, Human
aaauaauuuuuauauuugaaa

SEQ ID NO: 1226595 - RNA, 18 nt, Human
gcuggagaugaggccaga

SEQ ID NO: 1226596 - RNA, 20 nt, Human
gcuggagaugaggccagacc

SEQ ID NO: 1226597 - RNA, 21 nt, Human
gcuggagaugaggccagacca

SEQ ID NO: 1226598 - RNA, 17 nt, Human
gcucuggagcccacugu

SEQ ID NO: 1226599 - RNA, 17 nt, Human
gcugaauuucccucucu

SEQ ID NO: 1226600 - RNA, 24 nt, Human
gcugaauuucccucucucauaccc

SEQ ID NO: 1226601 - RNA, 15 nt, Human
gcucuggagcccacu

SEQ ID NO: 1226602 - RNA, 16 nt, Human
gcucuggagcccacug

SEQ ID NO: 1226603 - RNA, 15 nt, Human
gcuuuuuuaucaugu

SEQ ID NO: 1226604 - RNA, 18 nt, Human
gcuuuuuuaucaugugaa

SEQ ID NO: 1226605 - RNA, 20 nt, Human
gcuuuuuuaucaugugaaau

SEQ ID NO: 1226606 - RNA, 17 nt, Human
ggaaaccuuccacccag

SEQ ID NO: 1226607 - RNA, 22 nt, Human
gcuuuuuucucugauacagaaa

SEQ ID NO: 1226608 - RNA, 12 nt, Human
gcuuuucugauc

SEQ ID NO: 1226609 - RNA, 15 nt, Human
gcuuuucugauccag

SEQ ID NO: 1226610 - RNA, 16 nt, Human
gcuuuucugauccagu

SEQ ID NO: 1226611 - RNA, 11 nt, Human
gcuuuucugau

SEQ ID NO: 1226612 - RNA, 19 nt, Human
ggaaauucccuucaucugg

SEQ ID NO: 1226613 - RNA, 22 nt, Human
ggaaauucccuucaucuggaac

SEQ ID NO: 1226614 - RNA, 20 nt, Human
ggaaauucccuucaucugga

SEQ ID NO: 1226615 - RNA, 18 nt, Human
ggaaaccuuccacccagu

SEQ ID NO: 1226616 - RNA, 21 nt, Human
ggaaacuaggugcauauuuau

SEQ ID NO: 1226617 - RNA, 20 nt, Human
ggaagaagagaucaggaaga

SEQ ID NO: 1226618 - RNA, 21 nt, Human
ggaagaagagaucaggaagag

SEQ ID NO: 1226619 - RNA, 22 nt, Human
ggaagaagagaucaggaagaga

SEQ ID NO: 1226620 - RNA, 19 nt, Human
gcuuccuggcaauagucaa

SEQ ID NO: 1226621 - RNA, 18 nt, Human
gcuguauuuuaaaagaau

SEQ ID NO: 1226622 - RNA, 13 nt, Human
gcuguauuuuaaa

SEQ ID NO: 1226623 - RNA, 12 nt, Human
gcuguauuuuaa

SEQ ID NO: 1226624 - RNA, 20 nt, Human
gcuggagugcaguggcgcga

SEQ ID NO: 1226625 - RNA, 13 nt, Human
gcuguuuuuuugu

SEQ ID NO: 1226626 - RNA, 14 nt, Human
gcuuaauucaaaua

SEQ ID NO: 1226627 - RNA, 15 nt, Human
gcuuaauucaaauaa

SEQ ID NO: 1226628 - RNA, 16 nt, Human
gcuucaaauuguaagc

SEQ ID NO: 1226629 - RNA, 22 nt, Human
gccaugugcuaguaauuggaaa

SEQ ID NO: 1226630 - RNA, 24 nt, Human
gccaucaauaaaaaauuaugacau

SEQ ID NO: 1226631 - RNA, 17 nt, Human
gccccugccucucugca

SEQ ID NO: 1226632 - RNA, 18 nt, Human
gccccugccucucugcag

SEQ ID NO: 1226633 - RNA, 15 nt, Human
gccccugccucucug

SEQ ID NO: 1226634 - RNA, 16 nt, Human
gccccugccucucugc

SEQ ID NO: 1226635 - RNA, 20 nt, Human
gccccacccucguggacacc

SEQ ID NO: 1226636 - RNA, 21 nt, Human
gccccacccucguggacaccu

SEQ ID NO: 1226637 - RNA, 22 nt, Human
gccccacccucguggacaccug

SEQ ID NO: 1226638 - RNA, 23 nt, Human
gccccacccucguggacaccugc

SEQ ID NO: 1226639 - RNA, 16 nt, Human
gcccauucauuccauu

SEQ ID NO: 1226640 - RNA, 19 nt, Human
gcccauucauuccauucug

SEQ ID NO: 1226641 - RNA, 23 nt, Human
gcccauucauuccauucuggaag

SEQ ID NO: 1226642 - RNA, 16 nt, Human
gccauaugaaaaggcu

SEQ ID NO: 1226643 - RNA, 23 nt, Human
gcguugaaauuguaauuauaucu

SEQ ID NO: 1226644 - RNA, 24 nt, Human
gcguugaaauuguaauuauaucug

SEQ ID NO: 1226645 - RNA, 18 nt, Human
gcuaauuuugaaaaacug

SEQ ID NO: 1226646 - RNA, 18 nt, Human
gcuacuguaaggcaauca

SEQ ID NO: 1226647 - RNA, 19 nt, Human
gcuacuguaaggcaaucau

SEQ ID NO: 1226648 - RNA, 12 nt, Human
gcgugaucucag

SEQ ID NO: 1226649 - RNA, 15 nt, Human
gcgugaucucagcuc

SEQ ID NO: 1226650 - RNA, 16 nt, Human
gcgugaucucagcuca

SEQ ID NO: 1226651 - RNA, 23 nt, Human
gcggaggaaggaggacccaggac

SEQ ID NO: 1226652 - RNA, 19 nt, Human
gcgagauaccccaccuccc

SEQ ID NO: 1226653 - RNA, 23 nt, Human
gcgauucuccugccucagccucc

SEQ ID NO: 1226654 - RNA, 16 nt, Human
gccuccaacccuagca

SEQ ID NO: 1226655 - RNA, 20 nt, Human
gccuccaacccuagcaaaag

SEQ ID NO: 1226656 - RNA, 14 nt, Human
gagauguagccccu

SEQ ID NO: 1226657 - RNA, 15 nt, Human
gacugaaaauauugu

SEQ ID NO: 1226658 - RNA, 19 nt, Human
gacugaaaauauuguuuua

SEQ ID NO: 1226659 - RNA, 21 nt, Human
gacuggguaggaaagaggaag

SEQ ID NO: 1226660 - RNA, 12 nt, Human
gacuggugacug

SEQ ID NO: 1226661 - RNA, 15 nt, Human
gacuggugacugauu

SEQ ID NO: 1226662 - RNA, 18 nt, Human
gacuggugacugauucuu

SEQ ID NO: 1226663 - RNA, 14 nt, Human
gacucaaaccaaau

SEQ ID NO: 1226664 - RNA, 16 nt, Human
gacucuuaagaagacu

SEQ ID NO: 1226665 - RNA, 18 nt, Human
gacucuuaagaagacugc

SEQ ID NO: 1226666 - RNA, 17 nt, Human
gacucuuaagaagacug

SEQ ID NO: 1226667 - RNA, 23 nt, Human
gaaugagagacacacugaagaag

SEQ ID NO: 1226668 - RNA, 22 nt, Human
gaaugagagacacacugaagaa

SEQ ID NO: 1226669 - RNA, 13 nt, Human
gaaugagacaucc

SEQ ID NO: 1226670 - RNA, 15 nt, Human
gaaugagacauccag

SEQ ID NO: 1226671 - RNA, 20 nt, Human
gaaugagagacacacugaag

SEQ ID NO: 1226672 - RNA, 13 nt, Human
gaagggcaaguuu

SEQ ID NO: 1226673 - RNA, 13 nt, Human
gaagugacuuugg

SEQ ID NO: 1226674 - RNA, 15 nt, Human
gaagugacuuuggcu

SEQ ID NO: 1226675 - RNA, 20 nt, Human
gaagugacuuuggcugcaug

SEQ ID NO: 1226676 - RNA, 21 nt, Human
gaagugacuuuggcugcaugc

SEQ ID NO: 1226677 - RNA, 17 nt, Human
gacagucaccucaugga

SEQ ID NO: 1226678 - RNA, 14 nt, Human
gacagugaaagaaa

SEQ ID NO: 1226679 - RNA, 13 nt, Human
gaauuuuguguua

SEQ ID NO: 1226680 - RNA, 16 nt, Human
gaauuuuguguuagag

SEQ ID NO: 1226681 - RNA, 22 nt, Human
gaauuuuguguuagagauuuuu

SEQ ID NO: 1226682 - RNA, 15 nt, Human
gacaaaauggaauac

SEQ ID NO: 1226683 - RNA, 14 nt, Human
gaauuaugaaacuu

SEQ ID NO: 1226684 - RNA, 12 nt, Human
gaauuaugaaac

SEQ ID NO: 1226685 - RNA, 11 nt, Human
gaauuaguuuu

SEQ ID NO: 1226686 - RNA, 12 nt, Human
gacacacaugaa

SEQ ID NO: 1226687 - RNA, 13 nt, Human
gacacacugaaga

SEQ ID NO: 1226688 - RNA, 14 nt, Human
gacacacugaagaa

SEQ ID NO: 1226689 - RNA, 23 nt, Human
gauccaggccggcuugccacacc

SEQ ID NO: 1226690 - RNA, 11 nt, Human
gauccaguuuu

SEQ ID NO: 1226691 - RNA, 17 nt, Human
gauccaguuuuguuugg

SEQ ID NO: 1226692 - RNA, 22 nt, Human
gauccaguuuuguuuggaccaa

SEQ ID NO: 1226693 - RNA, 18 nt, Human
gauuacugccuauuuuaa

SEQ ID NO: 1226694 - RNA, 14 nt, Human
gauuagaauucugu

SEQ ID NO: 1226695 - RNA, 15 nt, Human
gauuagaauucugua

SEQ ID NO: 1226696 - RNA, 23 nt, Human
gauuagaauucuguauagauuag

SEQ ID NO: 1226697 - RNA, 22 nt, Human
gauuacaggugugagccaccac

SEQ ID NO: 1226698 - RNA, 14 nt, Human
gauuagagaguguu

SEQ ID NO: 1226699 - RNA, 18 nt, Human
gauuagagaguguugaaa

SEQ ID NO: 1226700 - RNA, 13 nt, Human
gauuauucacuga

SEQ ID NO: 1226701 - RNA, 15 nt, Human
gauuauucacugauu

SEQ ID NO: 1226702 - RNA, 16 nt, Human
gauuauucacugauuu

SEQ ID NO: 1226703 - RNA, 21 nt, Human
gauuauucacugauuugacau

SEQ ID NO: 1226704 - RNA, 19 nt, Human
gagugcugaaggaauggaa

SEQ ID NO: 1226705 - RNA, 16 nt, Human
gaguuuagcuggaaaa

SEQ ID NO: 1226706 - RNA, 14 nt, Human
gauaugugaacagu

SEQ ID NO: 1226707 - RNA, 13 nt, Human
gauaugugaacag

SEQ ID NO: 1226708 - RNA, 16 nt, Human
gauacuugaaaauuaa

SEQ ID NO: 1226709 - RNA, 17 nt, Human
gauacuugaaaauuaac

SEQ ID NO: 1226710 - RNA, 14 nt, Human
gcagagccaggaag

SEQ ID NO: 1226711 - RNA, 15 nt, Human
gcagagccaggaaga

SEQ ID NO: 1226712 - RNA, 18 nt, Human
gcacuuuagaauaugccu

SEQ ID NO: 1226713 - RNA, 19 nt, Human
gcacuuuagaauaugccuu

SEQ ID NO: 1226714 - RNA, 20 nt, Human
gcacuuuagaauaugccuug

SEQ ID NO: 1226715 - RNA, 20 nt, Human
gcagaaagcaucccucaccc

SEQ ID NO: 1226716 - RNA, 21 nt, Human
gcauaacauaaaucugugaac

SEQ ID NO: 1226717 - RNA, 23 nt, Human
gcauaacauaaaucugugaacuu

SEQ ID NO: 1226718 - RNA, 22 nt, Human
gcauaacguauaaaagccuguu

SEQ ID NO: 1226719 - RNA, 18 nt, Human
gcagagcugauggagaag

SEQ ID NO: 1226720 - RNA, 19 nt, Human
gcagagcugauggagaagg

SEQ ID NO: 1226721 - RNA, 16 nt, Human
gcagagccaggaagau

SEQ ID NO: 1226722 - RNA, 15 nt, Human
cugcuacaauguccu

SEQ ID NO: 1226723 - RNA, 17 nt, Human
cugcuuuuuauggccug

SEQ ID NO: 1226724 - RNA, 18 nt, Human
cugcuuuuuauggccugu

SEQ ID NO: 1226725 - RNA, 21 nt, Human
cuggaaaucaggguuaguauu

SEQ ID NO: 1226726 - RNA, 15 nt, Human
cuggaaccaucagaa

SEQ ID NO: 1226727 - RNA, 16 nt, Human
cuggaaccaucagaaa

SEQ ID NO: 1226728 - RNA, 13 nt, Human
cuggacugugugc

SEQ ID NO: 1226729 - RNA, 14 nt, Human
cuguacuuuuuggc

SEQ ID NO: 1226730 - RNA, 15 nt, Human
cuguacuuuuuggca

SEQ ID NO: 1226731 - RNA, 22 nt, Human
cugucacccagguuggagugca

SEQ ID NO: 1226732 - RNA, 13 nt, Human
cuguaaaacuaag

SEQ ID NO: 1226733 - RNA, 17 nt, Human
cuguaaaauaaaagguc

SEQ ID NO: 1226734 - RNA, 22 nt, Human
cuguacuugcucuugaugccug

SEQ ID NO: 1226735 - RNA, 23 nt, Human
cuguacuugcucuugaugccugg

SEQ ID NO: 1226736 - RNA, 16 nt, Human
cuggacugugugcuca

SEQ ID NO: 1226737 - RNA, 19 nt, Human
cuggacugugugcucagga

SEQ ID NO: 1226738 - RNA, 10 nt, Human
cugggacagg

SEQ ID NO: 1226739 - RNA, 16 nt, Human
cuggugcacuggcccc

SEQ ID NO: 1226740 - RNA, 19 nt, Human
cuggugcacuggccccacc

SEQ ID NO: 1226741 - RNA, 14 nt, Human
cuuaugcuuaaauu

SEQ ID NO: 1226742 - RNA, 14 nt, Human
cuuauuauuuuuga

SEQ ID NO: 1226743 - RNA, 16 nt, Human
cuuauuauuuuugaga

SEQ ID NO: 1226744 - RNA, 20 nt, Human
cuuauuguagcauccuggaa

SEQ ID NO: 1226745 - RNA, 23 nt, Human
cuuauuguagcauccuggaauau

SEQ ID NO: 1226746 - RNA, 13 nt, Human
cuucaugcaugga

SEQ ID NO: 1226747 - RNA, 15 nt, Human
cuucaugcauggaaa

SEQ ID NO: 1226748 - RNA, 21 nt, Human
cuucaugcauggaaauucccu

SEQ ID NO: 1226749 - RNA, 11 nt, Human
cuucaucugga

SEQ ID NO: 1226750 - RNA, 12 nt, Human
cuucaucuggaa

SEQ ID NO: 1226751 - RNA, 13 nt, Human
cuucaucuggaac

SEQ ID NO: 1226752 - RNA, 15 nt, Human
cuucaucuggaacca

SEQ ID NO: 1226753 - RNA, 19 nt, Human
cuucaucuggauuccagag

SEQ ID NO: 1226754 - RNA, 15 nt, Human
cuucacuguaaaaua

SEQ ID NO: 1226755 - RNA, 12 nt, Human
cuugaugaagaa

SEQ ID NO: 1226756 - RNA, 13 nt, Human
cuugaugaagaag

SEQ ID NO: 1226757 - RNA, 12 nt, Human
cuugaugccugg

SEQ ID NO: 1226758 - RNA, 13 nt, Human
cuugaugccuggc

SEQ ID NO: 1226759 - RNA, 14 nt, Human
cuugccuuuuucau

SEQ ID NO: 1226760 - RNA, 15 nt, Human
cuugccuuuuucauu

SEQ ID NO: 1226761 - RNA, 20 nt, Human
cuugccuuuuucauuauuuu

SEQ ID NO: 1226762 - RNA, 22 nt, Human
cuugccuuuuucauuauuuuau

SEQ ID NO: 1226763 - RNA, 23 nt, Human
cuugccuuuuucauuauuuuauu

SEQ ID NO: 1226764 - RNA, 13 nt, Human
gaaaaaaaauuau

SEQ ID NO: 1226765 - RNA, 19 nt, Human
cuuuuguagaagucacauu

SEQ ID NO: 1226766 - RNA, 15 nt, Human
cuuuuggcauuuuac

SEQ ID NO: 1226767 - RNA, 17 nt, Human
gaaauauuuauuuuaau

SEQ ID NO: 1226768 - RNA, 22 nt, Human
gaaauauuuauuuuaauaaugu

SEQ ID NO: 1226769 - RNA, 18 nt, Human
gaaauauuuauuuuaaua

SEQ ID NO: 1226770 - RNA, 15 nt, Human
gaaacuuuuggaagg

SEQ ID NO: 1226771 - RNA, 13 nt, Human
gaaacuuuuggaa

SEQ ID NO: 1226772 - RNA, 13 nt, Human
cuuuguaaugaaa

SEQ ID NO: 1226773 - RNA, 11 nt, Human
cuuuguauaga

SEQ ID NO: 1226774 - RNA, 20 nt, Human
cuuuguauagaaccucuuug

SEQ ID NO: 1226775 - RNA, 14 nt, Human
cuuuuaugugaaac

SEQ ID NO: 1226776 - RNA, 18 nt, Human
cuuuuaugugaaacaugu

SEQ ID NO: 1226777 - RNA, 18 nt, Human
cuuuccugagucccaucc

SEQ ID NO: 1226778 - RNA, 20 nt, Human
cuuuccugagucccaucccu

SEQ ID NO: 1226779 - RNA, 22 nt, Human
cuuuccugagucccaucccugc

SEQ ID NO: 1226780 - RNA, 12 nt, Human
ccaaauuaagag

SEQ ID NO: 1226781 - RNA, 18 nt, Human
ccaaagugcugggauuaa

SEQ ID NO: 1226782 - RNA, 21 nt, Human
cauucuccuaucaccugucuu

SEQ ID NO: 1226783 - RNA, 22 nt, Human
cauggcuggagcuagaauuuga

SEQ ID NO: 1226784 - RNA, 12 nt, Human
cauuuccaagca

SEQ ID NO: 1226785 - RNA, 16 nt, Human
ccaaaaaccaguauug

SEQ ID NO: 1226786 - RNA, 19 nt, Human
ccaaaaaccaguauuguac

SEQ ID NO: 1226787 - RNA, 20 nt, Human
ccaaaaaccaguauuguaca

SEQ ID NO: 1226788 - RNA, 21 nt, Human
caugauugguuucuaggcagu

SEQ ID NO: 1226789 - RNA, 16 nt, Human
caugaauuugugaagg

SEQ ID NO: 1226790 - RNA, 14 nt, Human
caugaauuugugaa

SEQ ID NO: 1226791 - RNA, 16 nt, Human
caugaauuaguuuuau

SEQ ID NO: 1226792 - RNA, 14 nt, Human
caugaccaguaaag

SEQ ID NO: 1226793 - RNA, 14 nt, Human
cauccuugagucaa

SEQ ID NO: 1226794 - RNA, 11 nt, Human
caucagcaaac

SEQ ID NO: 1226795 - RNA, 17 nt, Human
cagagcuggagaugagg

SEQ ID NO: 1226796 - RNA, 21 nt, Human
cagagcuggagaugaggccag

SEQ ID NO: 1226797 - RNA, 22 nt, Human
cagagcuggagaugaggccaga

SEQ ID NO: 1226798 - RNA, 23 nt, Human
cagagcuggagaugaggccagac

SEQ ID NO: 1226799 - RNA, 22 nt, Human
cagaucauugugaaauuauuca

SEQ ID NO: 1226800 - RNA, 13 nt, Human
cagauacuggauu

SEQ ID NO: 1226801 - RNA, 16 nt, Human
cagaucauugugaaau

SEQ ID NO: 1226802 - RNA, 21 nt, Human
cagcccccacugccuuugacc

SEQ ID NO: 1226803 - RNA, 24 nt, Human
caggacagcccuucuuuccacaga

SEQ ID NO: 1226804 - RNA, 23 nt, Human
caggacagcccuucuuuccacag

SEQ ID NO: 1226805 - RNA, 21 nt, Human
cagggaggaggcagagaagaa

SEQ ID NO: 1226806 - RNA, 15 nt, Human
cagggaggaggcaga

SEQ ID NO: 1226807 - RNA, 12 nt, Human
caggguggcagc

SEQ ID NO: 1226808 - RNA, 15 nt, Human
caagcuauucaauuc

SEQ ID NO: 1226809 - RNA, 15 nt, Human
caauaaagcugcuga

SEQ ID NO: 1226810 - RNA, 17 nt, Human
caauaaagcugcugaga

SEQ ID NO: 1226811 - RNA, 23 nt, Human
caauaaagcugcugagaaucuag

SEQ ID NO: 1226812 - RNA, 22 nt, Human
caauaaagcugcugagaaucua

SEQ ID NO: 1226813 - RNA, 15 nt, Human
caauucuugccaaau

SEQ ID NO: 1226814 - RNA, 21 nt, Human
caauucuucccuaucuuugcc

SEQ ID NO: 1226815 - RNA, 22 nt, Human
caauucuucccuaucuuugcca

SEQ ID NO: 1226816 - RNA, 19 nt, Human
caauucuuuuaacuguugu

SEQ ID NO: 1226817 - RNA, 11 nt, Human
caauuuaaaug

SEQ ID NO: 1226818 - RNA, 13 nt, Human
caauuuaaauguu

SEQ ID NO: 1226819 - RNA, 14 nt, Human
caauuuaaauguua

SEQ ID NO: 1226820 - RNA, 17 nt, Human
caaugcuguauuuuaaa

SEQ ID NO: 1226821 - RNA, 16 nt, Human
caaugcuguauuuuaa

SEQ ID NO: 1226822 - RNA, 23 nt, Human
caaugcuguauuuuaaaagaaug

SEQ ID NO: 1226823 - RNA, 21 nt, Human
cacagccucuuagaugcaguu

SEQ ID NO: 1226824 - RNA, 17 nt, Human
cacagccucuuagaugc

SEQ ID NO: 1226825 - RNA, 21 nt, Human
cacaguaaaaauggaaacuau

SEQ ID NO: 1226826 - RNA, 22 nt, Human
cacacaugaaguccaagcauuu

SEQ ID NO: 1226827 - RNA, 17 nt, Human
cacacaugaaguccaag

SEQ ID NO: 1226828 - RNA, 18 nt, Human
cacacaugcuucccuuuc

SEQ ID NO: 1226829 - RNA, 13 nt, Human
cacccucaugcug

SEQ ID NO: 1226830 - RNA, 14 nt, Human
cacccucaugcugu

SEQ ID NO: 1226831 - RNA, 16 nt, Human
cacccucaugcugugu

SEQ ID NO: 1226832 - RNA, 21 nt, Human
cacccucaugcugugugacuc

SEQ ID NO: 1226833 - RNA, 21 nt, Human
cacccucguggacaccugccc

SEQ ID NO: 1226834 - RNA, 23 nt, Human
cacccucguggacaccugcccug

SEQ ID NO: 1226835 - RNA, 18 nt, Human
caccugcccugcccugcc

SEQ ID NO: 1226836 - RNA, 19 nt, Human
caccugcccugcccugcca

SEQ ID NO: 1226837 - RNA, 20 nt, Human
caccugcccugcccugccac

SEQ ID NO: 1226838 - RNA, 21 nt, Human
caccugcccugcccugccacc

SEQ ID NO: 1226839 - RNA, 22 nt, Human
caccugcccugcccugccaccu

SEQ ID NO: 1226840 - RNA, 23 nt, Human
caccugcccugcccugccaccug

SEQ ID NO: 1226841 - RNA, 14 nt, Human
cacuaguauuucua

SEQ ID NO: 1226842 - RNA, 14 nt, Human
cacucuuucuuuca

SEQ ID NO: 1226843 - RNA, 15 nt, Human
cacucuuucuuucaa

SEQ ID NO: 1226844 - RNA, 19 nt, Human
cacuuguguuuugcaagcc

SEQ ID NO: 1226845 - RNA, 16 nt, Human
cacuugucaauaaaau

SEQ ID NO: 1226846 - RNA, 22 nt, Human
cacuuguguuuugcaagccaga

SEQ ID NO: 1226847 - RNA, 18 nt, Human
cacugggagaaaugaaaa

SEQ ID NO: 1226848 - RNA, 17 nt, Human
cacugggacuugcaaaa

SEQ ID NO: 1226849 - RNA, 21 nt, Human
caaagucucuggaauuugaaa

SEQ ID NO: 1226850 - RNA, 14 nt, Human
caacacuaacauga

SEQ ID NO: 1226851 - RNA, 15 nt, Human
caaauccuugaagau

SEQ ID NO: 1226852 - RNA, 12 nt, Human
caacaauaaaua

SEQ ID NO: 1226853 - RNA, 20 nt, Human
caaacaggaucaguuaacua

SEQ ID NO: 1226854 - RNA, 17 nt, Human
auuugcucauggaauug

SEQ ID NO: 1226855 - RNA, 14 nt, Human
auuugcucauggaa

SEQ ID NO: 1226856 - RNA, 13 nt, Human
auuuggaaaucuu

SEQ ID NO: 1226857 - RNA, 17 nt, Human
auuuggaaaucuuuaaa

SEQ ID NO: 1226858 - RNA, 11 nt, Human
auuuggaaauc

SEQ ID NO: 1226859 - RNA, 12 nt, Human
auuuggaaaucu

SEQ ID NO: 1226860 - RNA, 19 nt, Human
auuuuauagcuacuaauuu

SEQ ID NO: 1226861 - RNA, 14 nt, Human
auuuuaugauccag

SEQ ID NO: 1226862 - RNA, 15 nt, Human
auuuuaugauccagc

SEQ ID NO: 1226863 - RNA, 16 nt, Human
auuuuaugauccagca

SEQ ID NO: 1226864 - RNA, 21 nt, Human
auucauaauuauuauuuggcc

SEQ ID NO: 1226865 - RNA, 14 nt, Human
auuaugaaacuugu

SEQ ID NO: 1226866 - RNA, 15 nt, Human
auuaugaaacuugug

SEQ ID NO: 1226867 - RNA, 18 nt, Human
auuaugaaacuuuuggaa

SEQ ID NO: 1226868 - RNA, 21 nt, Human
auuaugaaacuuguguaaaua

SEQ ID NO: 1226869 - RNA, 18 nt, Human
auuaugaaacuuguguaa

SEQ ID NO: 1226870 - RNA, 20 nt, Human
auuaugaaacuuguguaaau

SEQ ID NO: 1226871 - RNA, 17 nt, Human
auuaugaauuacauuug

SEQ ID NO: 1226872 - RNA, 14 nt, Human
auuaugaauuacau

SEQ ID NO: 1226873 - RNA, 17 nt, Human
auucaaaguugccuaaa

SEQ ID NO: 1226874 - RNA, 18 nt, Human
auucaaaguugccuaaau

SEQ ID NO: 1226875 - RNA, 20 nt, Human
auucaaaguugccuaaaucc

SEQ ID NO: 1226876 - RNA, 21 nt, Human
auucaaaguugccuaaaucca

SEQ ID NO: 1226877 - RNA, 22 nt, Human
auucaaaguugccuaaauccau

SEQ ID NO: 1226878 - RNA, 18 nt, Human
auuaugaauuacauuugu

SEQ ID NO: 1226879 - RNA, 20 nt, Human
auucaaugccccugaauuua

SEQ ID NO: 1226880 - RNA, 18 nt, Human
auucaaugccccugaauu

SEQ ID NO: 1226881 - RNA, 18 nt, Human
auucaaauguauuacagu

SEQ ID NO: 1226882 - RNA, 16 nt, Human
auucaaauguauuaca

SEQ ID NO: 1226883 - RNA, 15 nt, Human
auuacaacggaguca

SEQ ID NO: 1226884 - RNA, 17 nt, Human
auuacaacggagucaaa

SEQ ID NO: 1226885 - RNA, 22 nt, Human
auuaauuccuucagcacuuuag

SEQ ID NO: 1226886 - RNA, 19 nt, Human
auuacaguggggaaugaag

SEQ ID NO: 1226887 - RNA, 12 nt, Human
auuacaguauaa

SEQ ID NO: 1226888 - RNA, 14 nt, Human
auuacaguauaauu

SEQ ID NO: 1226889 - RNA, 15 nt, Human
auuacaguauaauua

SEQ ID NO: 1226890 - RNA, 16 nt, Human
auuacaguauaauuaa

SEQ ID NO: 1226891 - RNA, 18 nt, Human
auuagcagucccuccaca

SEQ ID NO: 1226892 - RNA, 13 nt, Human
auuguaauuauau

SEQ ID NO: 1226893 - RNA, 14 nt, Human
auuguaauuauauc

SEQ ID NO: 1226894 - RNA, 16 nt, Human
auuguugucugcaacu

SEQ ID NO: 1226895 - RNA, 16 nt, Human
ccuauuuccagaaaua

SEQ ID NO: 1226896 - RNA, 15 nt, Human
ccuauuuuaauaaac

SEQ ID NO: 1226897 - RNA, 16 nt, Human
ccguagguuauuuuca

SEQ ID NO: 1226898 - RNA, 18 nt, Human
ccuaagcuggagugcagu

SEQ ID NO: 1226899 - RNA, 19 nt, Human
ccuaagcuggagugcagug

SEQ ID NO: 1226900 - RNA, 14 nt, Human
ccuaauaaagcugu

SEQ ID NO: 1226901 - RNA, 23 nt, Human
ccuaauaaagcuguguggcaguc

SEQ ID NO: 1226902 - RNA, 11 nt, Human
cccucacccau

SEQ ID NO: 1226903 - RNA, 13 nt, Human
cccucacccaucc

SEQ ID NO: 1226904 - RNA, 17 nt, Human
cccucacccauccuaga

SEQ ID NO: 1226905 - RNA, 17 nt, Human
cccuucuuuccacagaa

SEQ ID NO: 1226906 - RNA, 23 nt, Human
ccucucugcaggucccuaauaaa

SEQ ID NO: 1226907 - RNA, 21 nt, Human
ccucucugcaggucccuaaua

SEQ ID NO: 1226908 - RNA, 22 nt, Human
ccucucugcaggucccuaauaa

SEQ ID NO: 1226909 - RNA, 13 nt, Human
ccucucugcaggu

SEQ ID NO: 1226910 - RNA, 15 nt, Human
ccucucugcaggucc

SEQ ID NO: 1226911 - RNA, 23 nt, Human
ccugacccuccaccgcagaagga

SEQ ID NO: 1226912 - RNA, 14 nt, Human
cccacugccuuuga

SEQ ID NO: 1226913 - RNA, 13 nt, Human
cccacuucagccu

SEQ ID NO: 1226914 - RNA, 15 nt, Human
cccacuucagccucc

SEQ ID NO: 1226915 - RNA, 22 nt, Human
cccacccucguggacaccugcc

SEQ ID NO: 1226916 - RNA, 23 nt, Human
cccacccucguggacaccugccc

SEQ ID NO: 1226917 - RNA, 20 nt, Human
cccacccucguggacaccug

SEQ ID NO: 1226918 - RNA, 14 nt, Human
cccauccuagaggc

SEQ ID NO: 1226919 - RNA, 18 nt, Human
ccagcagauuuccagccu

SEQ ID NO: 1226920 - RNA, 21 nt, Human
ccagcagauuauucacugauu

SEQ ID NO: 1226921 - RNA, 22 nt, Human
ccagcagauuauucacugauuu

SEQ ID NO: 1226922 - RNA, 17 nt, Human
ccaggaagaucccccag

SEQ ID NO: 1226923 - RNA, 18 nt, Human
ccaggaagaucccccaga

SEQ ID NO: 1226924 - RNA, 19 nt, Human
ccaggaagaucccccagaa

SEQ ID NO: 1226925 - RNA, 20 nt, Human
ccaggaaagcgccuccaacc

SEQ ID NO: 1226926 - RNA, 15 nt, Human
ccagauccuggaaau

SEQ ID NO: 1226927 - RNA, 18 nt, Human
ccagagugcugaaggaau

SEQ ID NO: 1226928 - RNA, 17 nt, Human
ccuuuuucauuauuuua

SEQ ID NO: 1226929 - RNA, 15 nt, Human
cgccggaucugaggg

SEQ ID NO: 1226930 - RNA, 17 nt, Human
cggagucaaaaauuaaa

SEQ ID NO: 1226931 - RNA, 23 nt, Human
cuaguugaucagcuuauugucua

SEQ ID NO: 1226932 - RNA, 16 nt, Human
cuacaaccuccgccuc

SEQ ID NO: 1226933 - RNA, 11 nt, Human
cuaauuuuugu

SEQ ID NO: 1226934 - RNA, 20 nt, Human
cuaauuuuuguauuuuuagu

SEQ ID NO: 1226935 - RNA, 13 nt, Human
cuaauuuuuuugu

SEQ ID NO: 1226936 - RNA, 18 nt, Human
cuaccucuccagccucag

SEQ ID NO: 1226937 - RNA, 16 nt, Human
cuaagaaacuuaaauu

SEQ ID NO: 1226938 - RNA, 13 nt, Human
cuaaacuuuucug

SEQ ID NO: 1226939 - RNA, 15 nt, Human
cuaaacuuuucugau

SEQ ID NO: 1226940 - RNA, 19 nt, Human
cuccaggguggcagcaaca

SEQ ID NO: 1226941 - RNA, 23 nt, Human
cuccagguauucguuaucuaaua

SEQ ID NO: 1226942 - RNA, 18 nt, Human
cucagccucccaaguaac

SEQ ID NO: 1226943 - RNA, 16 nt, Human
cuccaaagucucugga

SEQ ID NO: 1226944 - RNA, 18 nt, Human
cuccaacccuagcaaaag

SEQ ID NO: 1226945 - RNA, 15 nt, Human
cucuuagaugcaguu

SEQ ID NO: 1226946 - RNA, 15 nt, Human
cucuccccaugaugu

SEQ ID NO: 1226947 - RNA, 18 nt, Human
cucucaauauucaauaaa

SEQ ID NO: 1226948 - RNA, 10 nt, Human
cucucaauau

SEQ ID NO: 1226949 - RNA, 21 nt, Human
cucucaauauucaauaaagcu

SEQ ID NO: 1226950 - RNA, 19 nt, Human
cucucaauauucaauaaag

SEQ ID NO: 1226951 - RNA, 21 nt, Human
cucucacuuguuuuauuuaac

SEQ ID NO: 1226952 - RNA, 22 nt, Human
cugaaaauugaugggauuuggu

SEQ ID NO: 1226953 - RNA, 21 nt, Human
cucuuagaugcaguucugaag

SEQ ID NO: 1226954 - RNA, 20 nt, Human
cucuuagaugcaguucugaa

SEQ ID NO: 1226955 - RNA, 18 nt, Human
aacuuccagauccuggaa

SEQ ID NO: 1226956 - RNA, 19 nt, Human
aacugcuaaucuacuuucu

SEQ ID NO: 1226957 - RNA, 17 nt, Human
aacugggacaggggaga

SEQ ID NO: 1226958 - RNA, 16 nt, Human
aacuggggcuccucca

SEQ ID NO: 1226959 - RNA, 14 nt, Human
gugaacuugaaauu

SEQ ID NO: 1226960 - RNA, 15 nt, Human
gugaacuugaaauuu

SEQ ID NO: 1226961 - RNA, 16 nt, Human
aacucuucaaggucug

SEQ ID NO: 1226962 - RNA, 19 nt, Human
aacucuucaaggucugcuu

SEQ ID NO: 1226963 - RNA, 13 nt, Human
aacugaaaucaua

SEQ ID NO: 1226964 - RNA, 12 nt, Human
aacugaaaucau

SEQ ID NO: 1226965 - RNA, 14 nt, Human
aacccagauaaagg

SEQ ID NO: 1226966 - RNA, 24 nt, Human
aaccucuaaauucuuucauuuuag

SEQ ID NO: 1226967 - RNA, 12 nt, Human
aaccucuaaauu

SEQ ID NO: 1226968 - RNA, 14 nt, Human
aaccucauccucuc

SEQ ID NO: 1226969 - RNA, 20 nt, Human
aaccaagugaucaaacuaca

SEQ ID NO: 1226970 - RNA, 21 nt, Human
aacuagaguuuagcuggaaaa

SEQ ID NO: 1226971 - RNA, 16 nt, Human
gucuuucacauuuaaa

SEQ ID NO: 1226972 - RNA, 14 nt, Human
gucugucugucugu

SEQ ID NO: 1226973 - RNA, 16 nt, Human
gucugucugucugucc

SEQ ID NO: 1226974 - RNA, 17 nt, Human
aacacaacuauauuguu

SEQ ID NO: 1226975 - RNA, 24 nt, Human
guccagugggaggugagaccaccu

SEQ ID NO: 1226976 - RNA, 15 nt, Human
guccaguguuucuuu

SEQ ID NO: 1226977 - RNA, 15 nt, Human
aacaaugcuguauuu

SEQ ID NO: 1226978 - RNA, 12 nt, Human
aacaauaaaaga

SEQ ID NO: 1226979 - RNA, 16 nt, Human
aacacaacuauauugu

SEQ ID NO: 1226980 - RNA, 15 nt, Human
aacacaacuauauug

SEQ ID NO: 1226981 - RNA, 22 nt, Human
aacaaugcuguauuuuaaaaga

SEQ ID NO: 1226982 - RNA, 17 nt, Human
aacaaugcuguauuuua

SEQ ID NO: 1226983 - RNA, 21 nt, Human
aacaagccuccuuuuaaagua

SEQ ID NO: 1226984 - RNA, 20 nt, Human
aaauuuuuguaguagcguuu

SEQ ID NO: 1226985 - RNA, 20 nt, Human
aaauuuuuucucuaggaaau

SEQ ID NO: 1226986 - RNA, 13 nt, Human
gucagaauagaaa

SEQ ID NO: 1226987 - RNA, 17 nt, Human
gucagaauagaaauuag

SEQ ID NO: 1226988 - RNA, 12 nt, Human
aaauuugccaag

SEQ ID NO: 1226989 - RNA, 20 nt, Human
aaauggucucuaacauuucc

SEQ ID NO: 1226990 - RNA, 20 nt, Human
guaguguuggagaagaacug

SEQ ID NO: 1226991 - RNA, 17 nt, Human
guaguugccuuaaaaua

SEQ ID NO: 1226992 - RNA, 19 nt, Human
guauaaaagggacugagaa

SEQ ID NO: 1226993 - RNA, 21 nt, Human
guauaaaauaauuuuuauauu

SEQ ID NO: 1226994 - RNA, 15 nt, Human
guauaaaauaauuuu

SEQ ID NO: 1226995 - RNA, 10 nt, Human
guauaauuaa

SEQ ID NO: 1226996 - RNA, 15 nt, Human
aaauguauuacagug

SEQ ID NO: 1226997 - RNA, 18 nt, Human
guauguacuucaugcugu

SEQ ID NO: 1226998 - RNA, 17 nt, Human
gucaacacuaacaugau

SEQ ID NO: 1226999 - RNA, 22 nt, Human
aaauuuauuucaauauuagcaa

SEQ ID NO: 1227000 - RNA, 15 nt, Human
aaauuguaauuauau

SEQ ID NO: 1227001 - RNA, 16 nt, Human
aaauucugucucugga

SEQ ID NO: 1227002 - RNA, 18 nt, Human
aaauucugucucuggauu

SEQ ID NO: 1227003 - RNA, 20 nt, Human
aaauuguaagcaugcacaaa

SEQ ID NO: 1227004 - RNA, 14 nt, Human
aaauuguaauuaua

SEQ ID NO: 1227005 - RNA, 17 nt, Human
aagacugcauuauauuu

SEQ ID NO: 1227006 - RNA, 16 nt, Human
aagacugcacaucaaa

SEQ ID NO: 1227007 - RNA, 19 nt, Human
aagaggaauuacgugcucu

SEQ ID NO: 1227008 - RNA, 16 nt, Human
aagcuagcaaauagua

SEQ ID NO: 1227009 - RNA, 20 nt, Human
aagcucacagaccuuugaac

SEQ ID NO: 1227010 - RNA, 14 nt, Human
aagcuccagguaga

SEQ ID NO: 1227011 - RNA, 13 nt, Human
aagcuccagguag

SEQ ID NO: 1227012 - RNA, 23 nt, Human
guuagggaaaacauuccauccuu

SEQ ID NO: 1227013 - RNA, 15 nt, Human
guuagggaaaacauu

SEQ ID NO: 1227014 - RNA, 20 nt, Human
guuagggaaaacauuccauc

SEQ ID NO: 1227015 - RNA, 16 nt, Human
aagcccauucauucca

SEQ ID NO: 1227016 - RNA, 21 nt, Human
aagcccauucauuccauucug

SEQ ID NO: 1227017 - RNA, 23 nt, Human
aagcccauucauuccauucugga

SEQ ID NO: 1227018 - RNA, 16 nt, Human
aagcauuuagauguau

SEQ ID NO: 1227019 - RNA, 13 nt, Human
aagcaucccucac

SEQ ID NO: 1227020 - RNA, 14 nt, Human
aagcaucccucacc

SEQ ID NO: 1227021 - RNA, 23 nt, Human
aagcaucccucacccauccuaga

SEQ ID NO: 1227022 - RNA, 15 nt, Human
guuuuucauaaagca

SEQ ID NO: 1227023 - RNA, 16 nt, Human
aagucuuucacauuua

SEQ ID NO: 1227024 - RNA, 19 nt, Human
aaguaaugauaacuggaaa

SEQ ID NO: 1227025 - RNA, 14 nt, Human
aaguaaugauaacu

SEQ ID NO: 1227026 - RNA, 15 nt, Human
aaguauuaagcauau

SEQ ID NO: 1227027 - RNA, 13 nt, Human
aaguauuagaaua

SEQ ID NO: 1227028 - RNA, 16 nt, Human
aaguauuaagcauaua

SEQ ID NO: 1227029 - RNA, 17 nt, Human
aaguauuaagcauauau

SEQ ID NO: 1227030 - RNA, 18 nt, Human
aaguauuaagcauauauu

SEQ ID NO: 1227031 - RNA, 21 nt, Human
aagugaucaaacuacauauug

SEQ ID NO: 1227032 - RNA, 20 nt, Human
uaaaauaauuuuuauauuug

SEQ ID NO: 1227033 - RNA, 22 nt, Human
uaaaauaauuuuaucucuuucu

SEQ ID NO: 1227034 - RNA, 20 nt, Human
uaaaagacagugaaagaaaa

SEQ ID NO: 1227035 - RNA, 18 nt, Human
uaaaaauaaaaaacacug

SEQ ID NO: 1227036 - RNA, 19 nt, Human
uaaaaauaaaaaacacugg

SEQ ID NO: 1227037 - RNA, 21 nt, Human
uaaaaauaaaaaacacuggga

SEQ ID NO: 1227038 - RNA, 16 nt, Human
uaaaaauaaacauguu

SEQ ID NO: 1227039 - RNA, 18 nt, Human
uaaaacgcaguugcaaac

SEQ ID NO: 1227040 - RNA, 11 nt, Human
uaaaacuaaga

SEQ ID NO: 1227041 - RNA, 12 nt, Human
uaaaagaaugau

SEQ ID NO: 1227042 - RNA, 22 nt, Human
guugccuaaauccauuuggaaa

SEQ ID NO: 1227043 - RNA, 11 nt, Human
aaggauaaagu

SEQ ID NO: 1227044 - RNA, 19 nt, Human
aaggcauuauaaaaagaau

SEQ ID NO: 1227045 - RNA, 15 nt, Human
aaggaaagaaaacau

SEQ ID NO: 1227046 - RNA, 20 nt, Human
guuuaauauuaaagccaugu

SEQ ID NO: 1227047 - RNA, 17 nt, Human
guuucuauuuuuugaaa

SEQ ID NO: 1227048 - RNA, 18 nt, Human
aagguauuuaauagguuu

SEQ ID NO: 1227049 - RNA, 16 nt, Human
aaguaaggaauuuuau

SEQ ID NO: 1227050 - RNA, 14 nt, Human
aagguacuucaaau

SEQ ID NO: 1227051 - RNA, 16 nt, Human
aaucagccuaguugau

SEQ ID NO: 1227052 - RNA, 16 nt, Human
aaucaggguuaguauu

SEQ ID NO: 1227053 - RNA, 15 nt, Human
aauauuuauuuuaau

SEQ ID NO: 1227054 - RNA, 13 nt, Human
uaagcauauauuu

SEQ ID NO: 1227055 - RNA, 16 nt, Human
uaagcauauauuuuua

SEQ ID NO: 1227056 - RNA, 21 nt, Human
uaagcauaagcuuaugcuuaa

SEQ ID NO: 1227057 - RNA, 17 nt, Human
uaaggaaaaguuuaaua

SEQ ID NO: 1227058 - RNA, 19 nt, Human
uaaggaaaaguuuaauauu

SEQ ID NO: 1227059 - RNA, 21 nt, Human
uaaggaaaaguuuaauauuaa

SEQ ID NO: 1227060 - RNA, 22 nt, Human
uaaggaauuuuauuuuuuucug

SEQ ID NO: 1227061 - RNA, 14 nt, Human
uaaggacuucuuua

SEQ ID NO: 1227062 - RNA, 15 nt, Human
uaaggacuucuuuaa

SEQ ID NO: 1227063 - RNA, 16 nt, Human
uaaggacuucuuuaau

SEQ ID NO: 1227064 - RNA, 22 nt, Human
uaaggacuucuuuaauuuugga

SEQ ID NO: 1227065 - RNA, 13 nt, Human
uaaggacuuguua

SEQ ID NO: 1227066 - RNA, 15 nt, Human
uaaggacuuguuaga

SEQ ID NO: 1227067 - RNA, 16 nt, Human
uaaggacuuguuagau

SEQ ID NO: 1227068 - RNA, 19 nt, Human
uaaggacuuguuagaucua

SEQ ID NO: 1227069 - RNA, 20 nt, Human
uaaguaaugauaacuggaaa

SEQ ID NO: 1227070 - RNA, 18 nt, Human
uaaguacacaauaagcaa

SEQ ID NO: 1227071 - RNA, 17 nt, Human
uaaguguguguuuuuca

SEQ ID NO: 1227072 - RNA, 14 nt, Human
aaucccauuauuca

SEQ ID NO: 1227073 - RNA, 16 nt, Human
aaucccauuauucaaa

SEQ ID NO: 1227074 - RNA, 13 nt, Human
uaauaaaaauaaa

SEQ ID NO: 1227075 - RNA, 21 nt, Human
aaucccauuauucaaaguugc

SEQ ID NO: 1227076 - RNA, 11 nt, Human
aaucuguaaaa

SEQ ID NO: 1227077 - RNA, 19 nt, Human
uaaauguuaugacuaugua

SEQ ID NO: 1227078 - RNA, 21 nt, Human
uaaauguuaugacuauguaaa

SEQ ID NO: 1227079 - RNA, 20 nt, Human
uaaauguuaugacuauguaa

SEQ ID NO: 1227080 - RNA, 13 nt, Human
uaacaaugcugua

SEQ ID NO: 1227081 - RNA, 23 nt, Human
aauaccacaggaaccacaagacu

SEQ ID NO: 1227082 - RNA, 14 nt, Human
aauagcuagacugg

SEQ ID NO: 1227083 - RNA, 20 nt, Human
aauagcuagacuggugacug

SEQ ID NO: 1227084 - RNA, 21 nt, Human
aauagcuagacuggugacuga

SEQ ID NO: 1227085 - RNA, 21 nt, Human
aauauauucagccuggcuuca

SEQ ID NO: 1227086 - RNA, 21 nt, Human
aauauauuuuaagacgaaaca

SEQ ID NO: 1227087 - RNA, 20 nt, Human
uaacaugaauauuuaguguu

SEQ ID NO: 1227088 - RNA, 21 nt, Human
uaacaugaauauuuaguguuc

SEQ ID NO: 1227089 - RNA, 12 nt, Human
uaacauguuaaa

SEQ ID NO: 1227090 - RNA, 15 nt, Human
uaacauguuaaacca

SEQ ID NO: 1227091 - RNA, 16 nt, Human
uaacauguuaaaccau

SEQ ID NO: 1227092 - RNA, 19 nt, Human
uaacaugaauauuuagugu

SEQ ID NO: 1227093 - RNA, 13 nt, Human
uaacguauaaaag

SEQ ID NO: 1227094 - RNA, 17 nt, Human
uaacguauaaaagccug

SEQ ID NO: 1227095 - RNA, 23 nt, Human
uaagacaaaaagcuacuuauugu

SEQ ID NO: 1227096 - RNA, 13 nt, Human
uaagacaaauaug

SEQ ID NO: 1227097 - RNA, 13 nt, Human
uacauuuccuaaa

SEQ ID NO: 1227098 - RNA, 18 nt, Human
aauguucacaauauauuu

SEQ ID NO: 1227099 - RNA, 19 nt, Human
aauguuaugacuauguaaa

SEQ ID NO: 1227100 - RNA, 22 nt, Human
aauguuaugacuauguaaacua

SEQ ID NO: 1227101 - RNA, 15 nt, Human
aauuaugugacauuu

SEQ ID NO: 1227102 - RNA, 17 nt, Human
aauuaugugacauuuua

SEQ ID NO: 1227103 - RNA, 20 nt, Human
aauuaugugacauuuuacau

SEQ ID NO: 1227104 - RNA, 22 nt, Human
aauuaugugccagauuuaugca

SEQ ID NO: 1227105 - RNA, 22 nt, Human
aauuaugugacauuuuacauua

SEQ ID NO: 1227106 - RNA, 14 nt, Human
aauuacauuuguau

SEQ ID NO: 1227107 - RNA, 13 nt, Human
aauuacauuugua

SEQ ID NO: 1227108 - RNA, 23 nt, Human
uaccugaagcuaucguaaaauua

SEQ ID NO: 1227109 - RNA, 14 nt, Human
uacccuaaccaagu

SEQ ID NO: 1227110 - RNA, 16 nt, Human
uacccuaaccaaguuc

SEQ ID NO: 1227111 - RNA, 17 nt, Human
uacccuaaccaaguucc

SEQ ID NO: 1227112 - RNA, 21 nt, Human
uaauuuuuuucaccuagauuu

SEQ ID NO: 1227113 - RNA, 21 nt, Human
aaugcuguauuuuaaaagaau

SEQ ID NO: 1227114 - RNA, 22 nt, Human
aaugcuguauuuuaaaagaaug

SEQ ID NO: 1227115 - RNA, 19 nt, Human
aauggaggggcagagccag

SEQ ID NO: 1227116 - RNA, 20 nt, Human
aauggaggggcagagccagg

SEQ ID NO: 1227117 - RNA, 21 nt, Human
aauggaggggcagagccagga

SEQ ID NO: 1227118 - RNA, 22 nt, Human
aauggaggggcagagccaggaa

SEQ ID NO: 1227119 - RNA, 11 nt, Human
uacacccagca

SEQ ID NO: 1227120 - RNA, 12 nt, Human
uacacccagcaa

SEQ ID NO: 1227121 - RNA, 14 nt, Human
uacacccagcaaua

SEQ ID NO: 1227122 - RNA, 22 nt, Human
aaugagagacacacugaagaag

SEQ ID NO: 1227123 - RNA, 12 nt, Human
aaugagaaaucu

SEQ ID NO: 1227124 - RNA, 22 nt, Human
aaugagaaaucuaaaaaacgaa

SEQ ID NO: 1227125 - RNA, 19 nt, Human
uaauuauaucugaggaauu

SEQ ID NO: 1227126 - RNA, 21 nt, Human
uaauuauaucugaggaauucu

SEQ ID NO: 1227127 - RNA, 22 nt, Human
uaauuauaucugaggaauucug

SEQ ID NO: 1227128 - RNA, 23 nt, Human
uaauuauaucugaggaauucugu

SEQ ID NO: 1227129 - RNA, 14 nt, Human
uaauuauaugcuau

SEQ ID NO: 1227130 - RNA, 18 nt, Human
uaauuauaugcuauuucu

SEQ ID NO: 1227131 - RNA, 19 nt, Human
uaauuauaugcuauuucua

SEQ ID NO: 1227132 - RNA, 20 nt, Human
uaauuauaugcuauuucuau

SEQ ID NO: 1227133 - RNA, 22 nt, Human
uaauuccguagguuauuuucag

SEQ ID NO: 1227134 - RNA, 21 nt, Human
uaauuuuuauauuugaaauau

SEQ ID NO: 1227135 - RNA, 19 nt, Human
uaauuuuuauauuugaaau

SEQ ID NO: 1227136 - RNA, 18 nt, Human
uaauuuuuauauuugaaa

SEQ ID NO: 1227137 - RNA, 22 nt, Human
acaggaaccacaagacugcaca

SEQ ID NO: 1227138 - RNA, 23 nt, Human
acagcuguaugauucccagccag

SEQ ID NO: 1227139 - RNA, 20 nt, Human
acagcuguaugauucccagc

SEQ ID NO: 1227140 - RNA, 19 nt, Human
acagcuguaugauucccag

SEQ ID NO: 1227141 - RNA, 14 nt, Human
acagcuguaugauu

SEQ ID NO: 1227142 - RNA, 20 nt, Human
uaugaagcuuuuaugugaaa

SEQ ID NO: 1227143 - RNA, 22 nt, Human
uaugaagcuuuuaugugaaaca

SEQ ID NO: 1227144 - RNA, 23 nt, Human
uaugaagcuuuuaugugaaacau

SEQ ID NO: 1227145 - RNA, 19 nt, Human
acagcccuucuuuccacag

SEQ ID NO: 1227146 - RNA, 14 nt, Human
uaugaaacuugugu

SEQ ID NO: 1227147 - RNA, 19 nt, Human
uaugaaacuuguguaaaua

SEQ ID NO: 1227148 - RNA, 21 nt, Human
uaugaaacuuguguaaauaca

SEQ ID NO: 1227149 - RNA, 15 nt, Human
uaucuauauuuuaca

SEQ ID NO: 1227150 - RNA, 17 nt, Human
uaugauacuugaaaauu

SEQ ID NO: 1227151 - RNA, 22 nt, Human
uaugcuauuucuauauuuucau

SEQ ID NO: 1227152 - RNA, 23 nt, Human
uaugcuauuucuauauuuucauu

SEQ ID NO: 1227153 - RNA, 14 nt, Human
uaugcuauuucuau

SEQ ID NO: 1227154 - RNA, 15 nt, Human
uaugcuauuucuaua

SEQ ID NO: 1227155 - RNA, 16 nt, Human
uaugcuauuucuauau

SEQ ID NO: 1227156 - RNA, 18 nt, Human
uaugcuauuucuauauuu

SEQ ID NO: 1227157 - RNA, 17 nt, Human
uaugccauauaauucac

SEQ ID NO: 1227158 - RNA, 15 nt, Human
uaugccccauucaac

SEQ ID NO: 1227159 - RNA, 15 nt, Human
uagucaccagagacu

SEQ ID NO: 1227160 - RNA, 18 nt, Human
uagucaccagagacuuua

SEQ ID NO: 1227161 - RNA, 19 nt, Human
uauaagugauugcugguuu

SEQ ID NO: 1227162 - RNA, 18 nt, Human
uauagauuagaauucugu

SEQ ID NO: 1227163 - RNA, 19 nt, Human
uauagauuagaauucugua

SEQ ID NO: 1227164 - RNA, 21 nt, Human
uauaucuauauuuuacauaaa

SEQ ID NO: 1227165 - RNA, 20 nt, Human
uauauauuuuuuucugaaau

SEQ ID NO: 1227166 - RNA, 19 nt, Human
uauauauuuuuuucugaaa

SEQ ID NO: 1227167 - RNA, 21 nt, Human
uauauauguguaugcacagua

SEQ ID NO: 1227168 - RNA, 23 nt, Human
uauauauguguaugcacaguaaa

SEQ ID NO: 1227169 - RNA, 14 nt, Human
acagaccuuugaac

SEQ ID NO: 1227170 - RNA, 23 nt, Human
uauccaccaaaagggcucccuga

SEQ ID NO: 1227171 - RNA, 13 nt, Human
uaucuauagcuaa

SEQ ID NO: 1227172 - RNA, 16 nt, Human
uagguaaauuacaguu

SEQ ID NO: 1227173 - RNA, 21 nt, Human
acaaugaucaccgacugaaaa

SEQ ID NO: 1227174 - RNA, 14 nt, Human
acacaacuauauug

SEQ ID NO: 1227175 - RNA, 13 nt, Human
acacaacuauauu

SEQ ID NO: 1227176 - RNA, 14 nt, Human
acacaauaagcaaa

SEQ ID NO: 1227177 - RNA, 13 nt, Human
acacaauaagcaa

SEQ ID NO: 1227178 - RNA, 12 nt, Human
uaguaaucauau

SEQ ID NO: 1227179 - RNA, 13 nt, Human
uagggaaaacauu

SEQ ID NO: 1227180 - RNA, 16 nt, Human
uagggaaaacauucca

SEQ ID NO: 1227181 - RNA, 18 nt, Human
uagggaaaacauuccauc

SEQ ID NO: 1227182 - RNA, 18 nt, Human
uagggcaauuaauuccuu

SEQ ID NO: 1227183 - RNA, 21 nt, Human
uagggcaauuaauuccuucag

SEQ ID NO: 1227184 - RNA, 23 nt, Human
uagggcaauuaauuccuucagca

SEQ ID NO: 1227185 - RNA, 21 nt, Human
uaggggcuuauaauaaaggac

SEQ ID NO: 1227186 - RNA, 22 nt, Human
uaggggcuuauaauaaaggacu

SEQ ID NO: 1227187 - RNA, 23 nt, Human
uaggggcuuauaauaaaggacug

SEQ ID NO: 1227188 - RNA, 16 nt, Human
uagcguuuuuuaaaug

SEQ ID NO: 1227189 - RNA, 17 nt, Human
uagcguuuuuuaaaugu

SEQ ID NO: 1227190 - RNA, 18 nt, Human
uagcguuuuuuaaaugua

SEQ ID NO: 1227191 - RNA, 23 nt, Human
uagcuuuuuucucugauacagaa

SEQ ID NO: 1227192 - RNA, 13 nt, Human
uagcuuuuuucuc

SEQ ID NO: 1227193 - RNA, 22 nt, Human
uagcguuuuuuaaauguauacu

SEQ ID NO: 1227194 - RNA, 14 nt, Human
uagcuaaguacaca

SEQ ID NO: 1227195 - RNA, 14 nt, Human
uagaggguguguaa

SEQ ID NO: 1227196 - RNA, 13 nt, Human
acaaaguauuaag

SEQ ID NO: 1227197 - RNA, 15 nt, Human
acaaaguauuaagca

SEQ ID NO: 1227198 - RNA, 16 nt, Human
acaaaguauuaagcau

SEQ ID NO: 1227199 - RNA, 18 nt, Human
acaaaguauuaagcauau

SEQ ID NO: 1227200 - RNA, 13 nt, Human
acaaauaauuuag

SEQ ID NO: 1227201 - RNA, 14 nt, Human
acaaauaauuuaga

SEQ ID NO: 1227202 - RNA, 16 nt, Human
acaaaaagcuacuuau

SEQ ID NO: 1227203 - RNA, 20 nt, Human
aauuuuacauggcuggagcu

SEQ ID NO: 1227204 - RNA, 12 nt, Human
aauuuuacauuu

SEQ ID NO: 1227205 - RNA, 16 nt, Human
uagacacgcacggcag

SEQ ID NO: 1227206 - RNA, 13 nt, Human
uagacacacauga

SEQ ID NO: 1227207 - RNA, 20 nt, Human
uagaauuugauaugugaaca

SEQ ID NO: 1227208 - RNA, 22 nt, Human
uagaauuugauaugugaacagu

SEQ ID NO: 1227209 - RNA, 15 nt, Human
uagaaaaaaaauuau

SEQ ID NO: 1227210 - RNA, 18 nt, Human
uagaagacaaaauguuca

SEQ ID NO: 1227211 - RNA, 15 nt, Human
uagaaacacaacuau

SEQ ID NO: 1227212 - RNA, 22 nt, Human
accugaagcuaucguaaaauua

SEQ ID NO: 1227213 - RNA, 16 nt, Human
ucauaauaaguugcau

SEQ ID NO: 1227214 - RNA, 22 nt, Human
accugccucccuucaugcaugg

SEQ ID NO: 1227215 - RNA, 21 nt, Human
accugccucccuucaugcaug

SEQ ID NO: 1227216 - RNA, 23 nt, Human
accugccucccuucaugcaugga

SEQ ID NO: 1227217 - RNA, 18 nt, Human
uccacauuucccccuagc

SEQ ID NO: 1227218 - RNA, 13 nt, Human
acgcguugaaauu

SEQ ID NO: 1227219 - RNA, 14 nt, Human
acgcguugaaauug

SEQ ID NO: 1227220 - RNA, 18 nt, Human
acgcguugaaauuguaau

SEQ ID NO: 1227221 - RNA, 20 nt, Human
acgcguugaaauuguaauua

SEQ ID NO: 1227222 - RNA, 15 nt, Human
acggaugauuucuau

SEQ ID NO: 1227223 - RNA, 15 nt, Human
acggcagccacagcu

SEQ ID NO: 1227224 - RNA, 17 nt, Human
uccauuuaauaauuaua

SEQ ID NO: 1227225 - RNA, 12 nt, Human
uccauuuggaaa

SEQ ID NO: 1227226 - RNA, 19 nt, Human
uccauuuggaaaucuuuaa

SEQ ID NO: 1227227 - RNA, 20 nt, Human
uccauuuggaaaucuuuaaa

SEQ ID NO: 1227228 - RNA, 16 nt, Human
ucccaauugagaaaaa

SEQ ID NO: 1227229 - RNA, 12 nt, Human
uccauuuaauaa

SEQ ID NO: 1227230 - RNA, 11 nt, Human
acuauguaaac

SEQ ID NO: 1227231 - RNA, 12 nt, Human
acuauguaaacu

SEQ ID NO: 1227232 - RNA, 14 nt, Human
acuauguaaacuac

SEQ ID NO: 1227233 - RNA, 16 nt, Human
acuauguaaacuacuu

SEQ ID NO: 1227234 - RNA, 13 nt, Human
acuacgccuggcu

SEQ ID NO: 1227235 - RNA, 14 nt, Human
acuacuagggaaau

SEQ ID NO: 1227236 - RNA, 23 nt, Human
acuacuucuuuuuucaaaagaaa

SEQ ID NO: 1227237 - RNA, 20 nt, Human
acuagaguuuagcuggaaaa

SEQ ID NO: 1227238 - RNA, 22 nt, Human
ucccucuuccuucccugcugug

SEQ ID NO: 1227239 - RNA, 23 nt, Human
ucccucuuccuucccugcuguga

SEQ ID NO: 1227240 - RNA, 23 nt, Human
acucaucuagguaaauuacaguu

SEQ ID NO: 1227241 - RNA, 21 nt, Human
acuccaaacugacucuuaaga

SEQ ID NO: 1227242 - RNA, 23 nt, Human
uccgugcuaaggacuuguuagau

SEQ ID NO: 1227243 - RNA, 14 nt, Human
uccgugcuuaacca

SEQ ID NO: 1227244 - RNA, 21 nt, Human
uccgugcuuaaccaaagaagc

SEQ ID NO: 1227245 - RNA, 18 nt, Human
acuccagaaagugacaag

SEQ ID NO: 1227246 - RNA, 14 nt, Human
acuccagaaaguga

SEQ ID NO: 1227247 - RNA, 17 nt, Human
uccgugcuaaggacuug

SEQ ID NO: 1227248 - RNA, 18 nt, Human
uccgugcuaaggacuugu

SEQ ID NO: 1227249 - RNA, 20 nt, Human
acucuucaaggucugcuuuu

SEQ ID NO: 1227250 - RNA, 19 nt, Human
acucuucaaggucugcuuu

SEQ ID NO: 1227251 - RNA, 13 nt, Human
acucuugaaaaau

SEQ ID NO: 1227252 - RNA, 15 nt, Human
acucguguguuucua

SEQ ID NO: 1227253 - RNA, 23 nt, Human
acucguguguuucuauuuuuuga

SEQ ID NO: 1227254 - RNA, 21 nt, Human
acucuugaaaaaugcauguug

SEQ ID NO: 1227255 - RNA, 14 nt, Human
acucuugaaaaaug

SEQ ID NO: 1227256 - RNA, 19 nt, Human
acucuugaaaaaugcaugu

SEQ ID NO: 1227257 - RNA, 20 nt, Human
uccucccacuucagccuccc

SEQ ID NO: 1227258 - RNA, 17 nt, Human
uccucuccccaugaugu

SEQ ID NO: 1227259 - RNA, 21 nt, Human
uccugaccccaaguuauccac

SEQ ID NO: 1227260 - RNA, 19 nt, Human
acucuuucuuucaauaaaa

SEQ ID NO: 1227261 - RNA, 18 nt, Human
acugaaaauauuguuuua

SEQ ID NO: 1227262 - RNA, 22 nt, Human
uccugaaaacccuugccaugug

SEQ ID NO: 1227263 - RNA, 21 nt, Human
uccugaaaacccuugccaugu

SEQ ID NO: 1227264 - RNA, 24 nt, Human
ucauaaagcaggcagaacucaucu

SEQ ID NO: 1227265 - RNA, 18 nt, Human
ucauaaauaaaguuuguu

SEQ ID NO: 1227266 - RNA, 21 nt, Human
accgaacugauguaaguaaac

SEQ ID NO: 1227267 - RNA, 11 nt, Human
acccucccucc

SEQ ID NO: 1227268 - RNA, 17 nt, Human
acccucccucccuaccc

SEQ ID NO: 1227269 - RNA, 20 nt, Human
acccucaugcugugugacuc

SEQ ID NO: 1227270 - RNA, 13 nt, Human
ucagaucugccua

SEQ ID NO: 1227271 - RNA, 15 nt, Human
ucagaucugccuaag

SEQ ID NO: 1227272 - RNA, 18 nt, Human
ucagaucugccuaaggac

SEQ ID NO: 1227273 - RNA, 20 nt, Human
ucagaucugccuaaggacuu

SEQ ID NO: 1227274 - RNA, 21 nt, Human
ucagaucugccuaaggacuuc

SEQ ID NO: 1227275 - RNA, 14 nt, Human
acccagcaauagag

SEQ ID NO: 1227276 - RNA, 16 nt, Human
ucagaauagaaauuag

SEQ ID NO: 1227277 - RNA, 17 nt, Human
acccaggacaggaucca

SEQ ID NO: 1227278 - RNA, 20 nt, Human
acccaggacaggauccaggc

SEQ ID NO: 1227279 - RNA, 15 nt, Human
ucagauuucugagga

SEQ ID NO: 1227280 - RNA, 19 nt, Human
accccagcuggggccaggc

SEQ ID NO: 1227281 - RNA, 22 nt, Human
accccagcuggggccaggcugg

SEQ ID NO: 1227282 - RNA, 23 nt, Human
accauguuggccaggcuugucuc

SEQ ID NO: 1227283 - RNA, 21 nt, Human
accauggacacuacacccagc

SEQ ID NO: 1227284 - RNA, 22 nt, Human
accauggacacuacacccagca

SEQ ID NO: 1227285 - RNA, 23 nt, Human
accauggacacuacacccagcaa

SEQ ID NO: 1227286 - RNA, 24 nt, Human
accauggacacuacacccagcaau

SEQ ID NO: 1227287 - RNA, 20 nt, Human
accauggccagcuaauuuuu

SEQ ID NO: 1227288 - RNA, 17 nt, Human
accaugggauaaaugcc

SEQ ID NO: 1227289 - RNA, 18 nt, Human
accaugggauaaaugcca

SEQ ID NO: 1227290 - RNA, 18 nt, Human
ucacugcaaccucugccu

SEQ ID NO: 1227291 - RNA, 18 nt, Human
ucacugcaaccuccaccu

SEQ ID NO: 1227292 - RNA, 19 nt, Human
ucacauuccugaacaggau

SEQ ID NO: 1227293 - RNA, 16 nt, Human
ucaccagcccuggcaa

SEQ ID NO: 1227294 - RNA, 21 nt, Human
ucacugaacuuugcugagccu

SEQ ID NO: 1227295 - RNA, 16 nt, Human
accacaagacugcaca

SEQ ID NO: 1227296 - RNA, 23 nt, Human
accaaaaaucucaauauuucaga

SEQ ID NO: 1227297 - RNA, 12 nt, Human
accaaaaaccag

SEQ ID NO: 1227298 - RNA, 13 nt, Human
accaaaaaccagu

SEQ ID NO: 1227299 - RNA, 20 nt, Human
ucacauuccugaacaggaua

SEQ ID NO: 1227300 - RNA, 17 nt, Human
ucacauuccugaacagg

SEQ ID NO: 1227301 - RNA, 13 nt, Human
ucacauuccugaa

SEQ ID NO: 1227302 - RNA, 19 nt, Human
ucacagcuccaagaauuuc

SEQ ID NO: 1227303 - RNA, 16 nt, Human
ucacagaccuuugaac

SEQ ID NO: 1227304 - RNA, 15 nt, Human
ucaaggucugcuuuu

SEQ ID NO: 1227305 - RNA, 14 nt, Human
ucaaggucugcuuu

SEQ ID NO: 1227306 - RNA, 15 nt, Human
acauuuuacauuaaa

SEQ ID NO: 1227307 - RNA, 18 nt, Human
acauuuuacauuaaauuu

SEQ ID NO: 1227308 - RNA, 14 nt, Human
acauuuuacauuaa

SEQ ID NO: 1227309 - RNA, 16 nt, Human
acauuggaaacaaguc

SEQ ID NO: 1227310 - RNA, 14 nt, Human
acauugguguugua

SEQ ID NO: 1227311 - RNA, 16 nt, Human
acauugguguuguacu

SEQ ID NO: 1227312 - RNA, 22 nt, Human
acauugguguuguacucaauuu

SEQ ID NO: 1227313 - RNA, 23 nt, Human
acauugguguuguacucaauuuu

SEQ ID NO: 1227314 - RNA, 22 nt, Human
acauggcuggagcuagaauuug

SEQ ID NO: 1227315 - RNA, 21 nt, Human
ucaaauauauucagccuggcu

SEQ ID NO: 1227316 - RNA, 23 nt, Human
ucaaauacgugggcauucaaaug

SEQ ID NO: 1227317 - RNA, 13 nt, Human
ucaaauauauuca

SEQ ID NO: 1227318 - RNA, 22 nt, Human
ucaaauacgugggcauucaaau

SEQ ID NO: 1227319 - RNA, 21 nt, Human
ucaaauacgugggcauucaaa

SEQ ID NO: 1227320 - RNA, 15 nt, Human
ucaaaguugccuaaa

SEQ ID NO: 1227321 - RNA, 18 nt, Human
ucaaaguugccuaaaucc

SEQ ID NO: 1227322 - RNA, 17 nt, Human
uauuuuguguuuaggaa

SEQ ID NO: 1227323 - RNA, 20 nt, Human
uauuuuguguuuaggaacua

SEQ ID NO: 1227324 - RNA, 13 nt, Human
uauuuuacauaaa

SEQ ID NO: 1227325 - RNA, 22 nt, Human
uauuuuaauaauguuucaaaca

SEQ ID NO: 1227326 - RNA, 19 nt, Human
uauuuuaauaauguuucaa

SEQ ID NO: 1227327 - RNA, 17 nt, Human
uauuuuaauaaacacuc

SEQ ID NO: 1227328 - RNA, 14 nt, Human
uauuuuaauaaaca

SEQ ID NO: 1227329 - RNA, 18 nt, Human
uauuuuaaaagaaugauu

SEQ ID NO: 1227330 - RNA, 14 nt, Human
uauuuuaaaagaau

SEQ ID NO: 1227331 - RNA, 14 nt, Human
uauuuuaagacgaa

SEQ ID NO: 1227332 - RNA, 22 nt, Human
uauuuuaagacgaaacauuugu

SEQ ID NO: 1227333 - RNA, 11 nt, Human
acaucuuuaag

SEQ ID NO: 1227334 - RNA, 20 nt, Human
acaucuuuaaggggaggaac

SEQ ID NO: 1227335 - RNA, 23 nt, Human
uaugugccagauuuaugcauauu

SEQ ID NO: 1227336 - RNA, 14 nt, Human
uaugugccagauuu

SEQ ID NO: 1227337 - RNA, 19 nt, Human
uaugugccagauuuaugca

SEQ ID NO: 1227338 - RNA, 17 nt, Human
ucuaccaaaaaucucaa

SEQ ID NO: 1227339 - RNA, 13 nt, Human
acuguggguagac

SEQ ID NO: 1227340 - RNA, 14 nt, Human
ucguuaucuaauag

SEQ ID NO: 1227341 - RNA, 15 nt, Human
acuguacuugcucuu

SEQ ID NO: 1227342 - RNA, 23 nt, Human
acuguacuugcucuugaugccug

SEQ ID NO: 1227343 - RNA, 20 nt, Human
acuguacagacagaaaaaac

SEQ ID NO: 1227344 - RNA, 18 nt, Human
acuguacagacagaaaaa

SEQ ID NO: 1227345 - RNA, 22 nt, Human
acugaagaagcaccaaucauga

SEQ ID NO: 1227346 - RNA, 18 nt, Human
ucgcccuggacugugugc

SEQ ID NO: 1227347 - RNA, 16 nt, Human
ucgccggaucugaggg

SEQ ID NO: 1227348 - RNA, 17 nt, Human
ucgccggaucugaggga

SEQ ID NO: 1227349 - RNA, 12 nt, Human
ucgccucagccu

SEQ ID NO: 1227350 - RNA, 20 nt, Human
ucuauuuuuugaaaagcaga

SEQ ID NO: 1227351 - RNA, 15 nt, Human
acuuguauuaugugu

SEQ ID NO: 1227352 - RNA, 13 nt, Human
acuuguauuaugu

SEQ ID NO: 1227353 - RNA, 14 nt, Human
acuuguauuaugug

SEQ ID NO: 1227354 - RNA, 17 nt, Human
acuugaggacacauguc

SEQ ID NO: 1227355 - RNA, 18 nt, Human
acuugaggacacaugucc

SEQ ID NO: 1227356 - RNA, 19 nt, Human
acuugaggacacaugucca

SEQ ID NO: 1227357 - RNA, 16 nt, Human
acuugaaauuugaauu

SEQ ID NO: 1227358 - RNA, 21 nt, Human
acuucucuuguuagguaauuu

SEQ ID NO: 1227359 - RNA, 17 nt, Human
acuugaaaauuaacaug

SEQ ID NO: 1227360 - RNA, 18 nt, Human
acuugaaaauuaacauga

SEQ ID NO: 1227361 - RNA, 16 nt, Human
ucuaguucacucucca

SEQ ID NO: 1227362 - RNA, 19 nt, Human
ucuaguucacucuccauuu

SEQ ID NO: 1227363 - RNA, 12 nt, Human
ucuaguucacuc

SEQ ID NO: 1227364 - RNA, 13 nt, Human
ucuauaaaccgaa

SEQ ID NO: 1227365 - RNA, 13 nt, Human
ucuauaauuuaaa

SEQ ID NO: 1227366 - RNA, 20 nt, Human
acuuccagauccuggaaauc

SEQ ID NO: 1227367 - RNA, 22 nt, Human
ucucugcaggucccuaauaaag

SEQ ID NO: 1227368 - RNA, 19 nt, Human
ucucugcaggucccuaaua

SEQ ID NO: 1227369 - RNA, 20 nt, Human
ucucugcaggucccuaauaa

SEQ ID NO: 1227370 - RNA, 21 nt, Human
ucucugcaggucccuaauaaa

SEQ ID NO: 1227371 - RNA, 15 nt, Human
agaaacauuugguaa

SEQ ID NO: 1227372 - RNA, 21 nt, Human
agaaacuuaaauuuuaguucu

SEQ ID NO: 1227373 - RNA, 17 nt, Human
agaaacacccucacacu

SEQ ID NO: 1227374 - RNA, 16 nt, Human
agaaacacaacuauau

SEQ ID NO: 1227375 - RNA, 16 nt, Human
agaaaacaaggaugaa

SEQ ID NO: 1227376 - RNA, 17 nt, Human
agaaagcaucccucacc

SEQ ID NO: 1227377 - RNA, 19 nt, Human
agaaagcaucccucaccca

SEQ ID NO: 1227378 - RNA, 22 nt, Human
agaaagcaucccucacccaucc

SEQ ID NO: 1227379 - RNA, 20 nt, Human
ucugaaggguaauuauauag

SEQ ID NO: 1227380 - RNA, 16 nt, Human
agaaaugaaaaaauau

SEQ ID NO: 1227381 - RNA, 13 nt, Human
agaaaugaaaaaa

SEQ ID NO: 1227382 - RNA, 12 nt, Human
agaaaugaaaaa

SEQ ID NO: 1227383 - RNA, 22 nt, Human
acuuguuuuauuuaaccucuaa

SEQ ID NO: 1227384 - RNA, 17 nt, Human
acuuuagaauaugccuu

SEQ ID NO: 1227385 - RNA, 13 nt, Human
acuuuagggaagu

SEQ ID NO: 1227386 - RNA, 22 nt, Human
acuuugugcugggguuaucuga

SEQ ID NO: 1227387 - RNA, 22 nt, Human
ucucucacuuguuuuauuuaac

SEQ ID NO: 1227388 - RNA, 19 nt, Human
agaagcaccaaucaugaau

SEQ ID NO: 1227389 - RNA, 13 nt, Human
agaagcaaguaaa

SEQ ID NO: 1227390 - RNA, 21 nt, Human
agaagccccacccugccucac

SEQ ID NO: 1227391 - RNA, 12 nt, Human
agaacggaagaa

SEQ ID NO: 1227392 - RNA, 13 nt, Human
agaacggaagaag

SEQ ID NO: 1227393 - RNA, 14 nt, Human
ucugaauaaagcaa

SEQ ID NO: 1227394 - RNA, 17 nt, Human
ucugaauaaagcaauua

SEQ ID NO: 1227395 - RNA, 21 nt, Human
ucugcaggucccuaauaaagc

SEQ ID NO: 1227396 - RNA, 22 nt, Human
ucugcaggucccuaauaaagcu

SEQ ID NO: 1227397 - RNA, 23 nt, Human
ucugcaggucccuaauaaagcug

SEQ ID NO: 1227398 - RNA, 12 nt, Human
agaaauuaugug

SEQ ID NO: 1227399 - RNA, 13 nt, Human
agaaguugauaug

SEQ ID NO: 1227400 - RNA, 14 nt, Human
ucuggauuccagag

SEQ ID NO: 1227401 - RNA, 18 nt, Human
ucuggaagugacuuuggc

SEQ ID NO: 1227402 - RNA, 19 nt, Human
ucuggaagugacuuuggcu

SEQ ID NO: 1227403 - RNA, 22 nt, Human
ucuggaagugacuuuggcugca

SEQ ID NO: 1227404 - RNA, 22 nt, Human
ucuggauuccagagcacugcuc

SEQ ID NO: 1227405 - RNA, 22 nt, Human
ucuucuuaauauguucuuuuaa

SEQ ID NO: 1227406 - RNA, 21 nt, Human
ucuugaugccuggcggggugg

SEQ ID NO: 1227407 - RNA, 23 nt, Human
ugaaaaaauauauaucaaauaua

SEQ ID NO: 1227408 - RNA, 16 nt, Human
ugaaaauauuguuuua

SEQ ID NO: 1227409 - RNA, 20 nt, Human
ugaaaauauuguuuuacaau

SEQ ID NO: 1227410 - RNA, 23 nt, Human
ugaaaauauuguuuuacaauagu

SEQ ID NO: 1227411 - RNA, 20 nt, Human
ugaaaaucuuauaauuuaaa

SEQ ID NO: 1227412 - RNA, 15 nt, Human
ugaaacggaugauuu

SEQ ID NO: 1227413 - RNA, 17 nt, Human
ugaaacuuguguaaaua

SEQ ID NO: 1227414 - RNA, 23 nt, Human
ugaaacuuguguaaauacaauuu

SEQ ID NO: 1227415 - RNA, 19 nt, Human
ugaaacucguuaauuugua

SEQ ID NO: 1227416 - RNA, 17 nt, Human
ugaaacggaugauuucu

SEQ ID NO: 1227417 - RNA, 18 nt, Human
ugaaacggaugauuucua

SEQ ID NO: 1227418 - RNA, 19 nt, Human
ugaaacggaugauuucuau

SEQ ID NO: 1227419 - RNA, 20 nt, Human
ugaaacggaugauuucuaug

SEQ ID NO: 1227420 - RNA, 18 nt, Human
agagcaagaccccaucuc

SEQ ID NO: 1227421 - RNA, 16 nt, Human
agagcugauggagaag

SEQ ID NO: 1227422 - RNA, 17 nt, Human
agagcugauggagaagg

SEQ ID NO: 1227423 - RNA, 18 nt, Human
agagcugauggagaagga

SEQ ID NO: 1227424 - RNA, 14 nt, Human
agagaucaggaaga

SEQ ID NO: 1227425 - RNA, 15 nt, Human
agagaucaggaagag

SEQ ID NO: 1227426 - RNA, 19 nt, Human
agagaucaggaagagaagg

SEQ ID NO: 1227427 - RNA, 20 nt, Human
agagaucaggaagagaagga

SEQ ID NO: 1227428 - RNA, 12 nt, Human
ugaaacuuuugg

SEQ ID NO: 1227429 - RNA, 13 nt, Human
ugaauuugugaag

SEQ ID NO: 1227430 - RNA, 21 nt, Human
ugaauuugugaagguggaaau

SEQ ID NO: 1227431 - RNA, 23 nt, Human
ugaauuugugaagguggaaauaa

SEQ ID NO: 1227432 - RNA, 17 nt, Human
ugaauuuuguguuagag

SEQ ID NO: 1227433 - RNA, 21 nt, Human
ugaauuuuguguuagagauuu

SEQ ID NO: 1227434 - RNA, 20 nt, Human
ugacaaagguaaaucagacu

SEQ ID NO: 1227435 - RNA, 17 nt, Human
agauacuggauuguacu

SEQ ID NO: 1227436 - RNA, 22 nt, Human
ugaaggguaauuauauaguuac

SEQ ID NO: 1227437 - RNA, 14 nt, Human
ugaauaaagcaauu

SEQ ID NO: 1227438 - RNA, 15 nt, Human
ugaauacuuuauaaa

SEQ ID NO: 1227439 - RNA, 17 nt, Human
ugaauggcuuuguauag

SEQ ID NO: 1227440 - RNA, 18 nt, Human
ugaauggcuuuguauaga

SEQ ID NO: 1227441 - RNA, 19 nt, Human
ugaauggcuuuguauagaa

SEQ ID NO: 1227442 - RNA, 22 nt, Human
ugaauggcuuuguauagaaccu

SEQ ID NO: 1227443 - RNA, 18 nt, Human
ugaauauuuaguguucau

SEQ ID NO: 1227444 - RNA, 12 nt, Human
ugaauggcuuug

SEQ ID NO: 1227445 - RNA, 15 nt, Human
ugaauggcuuuguau

SEQ ID NO: 1227446 - RNA, 19 nt, Human
agagcugauggagaaggaa

SEQ ID NO: 1227447 - RNA, 20 nt, Human
agagcugauggagaaggaag

SEQ ID NO: 1227448 - RNA, 21 nt, Human
agagcugauggagaaggaagg

SEQ ID NO: 1227449 - RNA, 20 nt, Human
ugaagcuaucguaaaauuaa

SEQ ID NO: 1227450 - RNA, 14 nt, Human
agauuucugaggaa

SEQ ID NO: 1227451 - RNA, 15 nt, Human
agauuucugaggaaa

SEQ ID NO: 1227452 - RNA, 14 nt, Human
agauuuuauuaugu

SEQ ID NO: 1227453 - RNA, 15 nt, Human
agauuuuauuaugua

SEQ ID NO: 1227454 - RNA, 16 nt, Human
agauuuuauuauguaa

SEQ ID NO: 1227455 - RNA, 17 nt, Human
agauuuuauuauguaaa

SEQ ID NO: 1227456 - RNA, 18 nt, Human
agauuuuauuauguaaau

SEQ ID NO: 1227457 - RNA, 19 nt, Human
agauuuuauuauguaaauc

SEQ ID NO: 1227458 - RNA, 20 nt, Human
agauuuuauuauguaaaucc

SEQ ID NO: 1227459 - RNA, 15 nt, Human
agauuuuuuuguugu

SEQ ID NO: 1227460 - RNA, 16 nt, Human
agauuuuuuuguuguu

SEQ ID NO: 1227461 - RNA, 18 nt, Human
agauuuuuuuguuguuug

SEQ ID NO: 1227462 - RNA, 19 nt, Human
agauuuuuuuguuguuugu

SEQ ID NO: 1227463 - RNA, 23 nt, Human
agauuuuuuuguuguuuguuuag

SEQ ID NO: 1227464 - RNA, 17 nt, Human
agcaagaccccaucuca

SEQ ID NO: 1227465 - RNA, 17 nt, Human
agaugcaguucugaaga

SEQ ID NO: 1227466 - RNA, 16 nt, Human
agaugcaguucugaag

SEQ ID NO: 1227467 - RNA, 13 nt, Human
agccauguuuauu

SEQ ID NO: 1227468 - RNA, 14 nt, Human
agccauguuuauua

SEQ ID NO: 1227469 - RNA, 17 nt, Human
agccauguuuauuacag

SEQ ID NO: 1227470 - RNA, 16 nt, Human
agccauguuuauuaca

SEQ ID NO: 1227471 - RNA, 20 nt, Human
agccaggaagaucccccaga

SEQ ID NO: 1227472 - RNA, 21 nt, Human
agccaggaagaucccccagaa

SEQ ID NO: 1227473 - RNA, 22 nt, Human
agccaggaagaucccccagaaa

SEQ ID NO: 1227474 - RNA, 15 nt, Human
ugauggugguauguu

SEQ ID NO: 1227475 - RNA, 21 nt, Human
ugauccagcagauuauucacu

SEQ ID NO: 1227476 - RNA, 22 nt, Human
ugauccagcagauuauucacug

SEQ ID NO: 1227477 - RNA, 22 nt, Human
ugauccaguuuuguuuggacca

SEQ ID NO: 1227478 - RNA, 17 nt, Human
ugaugaagaaguugaua

SEQ ID NO: 1227479 - RNA, 17 nt, Human
agcaugucgucaaagcu

SEQ ID NO: 1227480 - RNA, 20 nt, Human
agcaugucgucaaagcugaa

SEQ ID NO: 1227481 - RNA, 20 nt, Human
agcaucacaugaacuuguaa

SEQ ID NO: 1227482 - RNA, 19 nt, Human
ugaucaaaaucaauuaaaa

SEQ ID NO: 1227483 - RNA, 16 nt, Human
ugauaugugaacaguu

SEQ ID NO: 1227484 - RNA, 15 nt, Human
ugauaugugaacagu

SEQ ID NO: 1227485 - RNA, 12 nt, Human
ugauaugggucu

SEQ ID NO: 1227486 - RNA, 17 nt, Human
ugauagacaauugaggu

SEQ ID NO: 1227487 - RNA, 18 nt, Human
ugauagacaauugaggua

SEQ ID NO: 1227488 - RNA, 17 nt, Human
ugaguagaguugaucaa

SEQ ID NO: 1227489 - RNA, 14 nt, Human
ugaguagaguugau

SEQ ID NO: 1227490 - RNA, 22 nt, Human
ugaguaacugauuuguaacaag

SEQ ID NO: 1227491 - RNA, 21 nt, Human
agcauaauacuugcuuuggaa

SEQ ID NO: 1227492 - RNA, 23 nt, Human
agcauaaauguugacaugggaca

SEQ ID NO: 1227493 - RNA, 21 nt, Human
ugauacagaaaaguugaauuu

SEQ ID NO: 1227494 - RNA, 12 nt, Human
ugauacagaaaa

SEQ ID NO: 1227495 - RNA, 15 nt, Human
ugagucaaaaaaucu

SEQ ID NO: 1227496 - RNA, 20 nt, Human
ugcacaccuacuagucacca

SEQ ID NO: 1227497 - RNA, 22 nt, Human
ugcacaccuacuagucaccaga

SEQ ID NO: 1227498 - RNA, 17 nt, Human
agcccuucuuuccacag

SEQ ID NO: 1227499 - RNA, 23 nt, Human
agcccuucuauacccacccagaa

SEQ ID NO: 1227500 - RNA, 21 nt, Human
agcccuucuccauggcccugc

SEQ ID NO: 1227501 - RNA, 23 nt, Human
agcccuucuccauggcccugcca

SEQ ID NO: 1227502 - RNA, 19 nt, Human
agcccuucuauacccaccc

SEQ ID NO: 1227503 - RNA, 20 nt, Human
agcccuucuauacccaccca

SEQ ID NO: 1227504 - RNA, 22 nt, Human
agcccuucuauacccacccaga

SEQ ID NO: 1227505 - RNA, 23 nt, Human
ugcauaacguauaaaagccuguu

SEQ ID NO: 1227506 - RNA, 16 nt, Human
ugcagucucuauacca

SEQ ID NO: 1227507 - RNA, 18 nt, Human
ugcagucucuauaccaau

SEQ ID NO: 1227508 - RNA, 19 nt, Human
ugcagucucuauaccaaua

SEQ ID NO: 1227509 - RNA, 20 nt, Human
ugcagucucuauaccaauaa

SEQ ID NO: 1227510 - RNA, 21 nt, Human
ugcagucucuauaccaauaaa

SEQ ID NO: 1227511 - RNA, 23 nt, Human
ugcagucucuauaccaauaaagu

SEQ ID NO: 1227512 - RNA, 22 nt, Human
ugcagucucuauaccaauaaag

SEQ ID NO: 1227513 - RNA, 17 nt, Human
ugcaggucccuaauaaa

SEQ ID NO: 1227514 - RNA, 12 nt, Human
ugcaggucccua

SEQ ID NO: 1227515 - RNA, 14 nt, Human
ugcaggucccuaau

SEQ ID NO: 1227516 - RNA, 15 nt, Human
ugcaggucccuaaua

SEQ ID NO: 1227517 - RNA, 16 nt, Human
ugcaggucccuaauaa

SEQ ID NO: 1227518 - RNA, 14 nt, Human
ugcagcccugcugc

SEQ ID NO: 1227519 - RNA, 17 nt, Human
ugcagcccccacugccu

SEQ ID NO: 1227520 - RNA, 23 nt, Human
ugcagcccccacugccuuugacc

SEQ ID NO: 1227521 - RNA, 22 nt, Human
ugcagcccugcugcugccugcc

SEQ ID NO: 1227522 - RNA, 20 nt, Human
agccuuggggcugaugcagu

SEQ ID NO: 1227523 - RNA, 18 nt, Human
agcgccuccaacccuagc

SEQ ID NO: 1227524 - RNA, 19 nt, Human
agcgccuccaacccuagca

SEQ ID NO: 1227525 - RNA, 22 nt, Human
agcgccuccaacccuagcaaaa

SEQ ID NO: 1227526 - RNA, 23 nt, Human
agcgccuccaacccuagcaaaag

SEQ ID NO: 1227527 - RNA, 13 nt, Human
agccuguuuaaga

SEQ ID NO: 1227528 - RNA, 15 nt, Human
agccuguuuaagaga

SEQ ID NO: 1227529 - RNA, 13 nt, Human
agcuagacuggug

SEQ ID NO: 1227530 - RNA, 14 nt, Human
agcuagacugguga

SEQ ID NO: 1227531 - RNA, 16 nt, Human
agcuagacuggugacu

SEQ ID NO: 1227532 - RNA, 17 nt, Human
agcuagacuggugacug

SEQ ID NO: 1227533 - RNA, 21 nt, Human
agcuagacuggugacugauuc

SEQ ID NO: 1227534 - RNA, 16 nt, Human
agcuagaauuugauau

SEQ ID NO: 1227535 - RNA, 13 nt, Human
agcuagaauuuga

SEQ ID NO: 1227536 - RNA, 19 nt, Human
agcuacuaauuuuaaaaug

SEQ ID NO: 1227537 - RNA, 18 nt, Human
agcuaggaauuguguuua

SEQ ID NO: 1227538 - RNA, 12 nt, Human
ugcuaaggacuu

SEQ ID NO: 1227539 - RNA, 17 nt, Human
ugccuuuucccaacucc

SEQ ID NO: 1227540 - RNA, 21 nt, Human
ugcggaggaaggaggacccag

SEQ ID NO: 1227541 - RNA, 22 nt, Human
ugcggaggaaggaggacccagg

SEQ ID NO: 1227542 - RNA, 23 nt, Human
ugcggaggaaggaggacccagga

SEQ ID NO: 1227543 - RNA, 13 nt, Human
ugccuuugaccug

SEQ ID NO: 1227544 - RNA, 17 nt, Human
ugccuuugaccugccuc

SEQ ID NO: 1227545 - RNA, 23 nt, Human
ugccuuugaccugccucccuuca

SEQ ID NO: 1227546 - RNA, 12 nt, Human
ugcuacaauguc

SEQ ID NO: 1227547 - RNA, 13 nt, Human
ugcuaaggacuug

SEQ ID NO: 1227548 - RNA, 18 nt, Human
ugcuaaggacuuguuaga

SEQ ID NO: 1227549 - RNA, 22 nt, Human
ugcuaaggacuuguuagaucua

SEQ ID NO: 1227550 - RNA, 15 nt, Human
ugccugcccuauucu

SEQ ID NO: 1227551 - RNA, 14 nt, Human
agcuguguggcagu

SEQ ID NO: 1227552 - RNA, 16 nt, Human
agcuguguggcagucu

SEQ ID NO: 1227553 - RNA, 23 nt, Human
ugcuguauuuuaaaagaaugauu

SEQ ID NO: 1227554 - RNA, 11 nt, Human
aggacacaugu

SEQ ID NO: 1227555 - RNA, 12 nt, Human
aggacacauguc

SEQ ID NO: 1227556 - RNA, 13 nt, Human
aggacacaugucc

SEQ ID NO: 1227557 - RNA, 14 nt, Human
aggaauggaagucc

SEQ ID NO: 1227558 - RNA, 23 nt, Human
aggaauggagccugcacggugaa

SEQ ID NO: 1227559 - RNA, 13 nt, Human
ugcuguauuuuaa

SEQ ID NO: 1227560 - RNA, 22 nt, Human
ugcuguauuuuaaaagaaugau

SEQ ID NO: 1227561 - RNA, 21 nt, Human
ugcuguauuuuaaaagaauga

SEQ ID NO: 1227562 - RNA, 12 nt, Human
aggaaauauuua

SEQ ID NO: 1227563 - RNA, 13 nt, Human
aggaaauauuuau

SEQ ID NO: 1227564 - RNA, 21 nt, Human
aggaagccugauuaaagaaug

SEQ ID NO: 1227565 - RNA, 17 nt, Human
aggaagccugauuaaag

SEQ ID NO: 1227566 - RNA, 18 nt, Human
aggaagccugauuaaaga

SEQ ID NO: 1227567 - RNA, 14 nt, Human
ugcucauggaauug

SEQ ID NO: 1227568 - RNA, 14 nt, Human
ugcucauuucagga

SEQ ID NO: 1227569 - RNA, 17 nt, Human
uggauuauauuaugaag

SEQ ID NO: 1227570 - RNA, 21 nt, Human
uggcauaacauaaaucuguga

SEQ ID NO: 1227571 - RNA, 22 nt, Human
uggcauaacauaaaucugugaa

SEQ ID NO: 1227572 - RNA, 13 nt, Human
uggagaagaacug

SEQ ID NO: 1227573 - RNA, 15 nt, Human
uggacugugugcuca

SEQ ID NO: 1227574 - RNA, 14 nt, Human
uggagaagaacuga

SEQ ID NO: 1227575 - RNA, 14 nt, Human
uggagcucguggaa

SEQ ID NO: 1227576 - RNA, 13 nt, Human
aggcaaucauggu

SEQ ID NO: 1227577 - RNA, 15 nt, Human
uggacuguggugacu

SEQ ID NO: 1227578 - RNA, 16 nt, Human
uggacuguggugacuu

SEQ ID NO: 1227579 - RNA, 17 nt, Human
uggacuguggugacuuu

SEQ ID NO: 1227580 - RNA, 19 nt, Human
uggacuguggugacuuugg

SEQ ID NO: 1227581 - RNA, 21 nt, Human
uggacuguggugacuuuggau

SEQ ID NO: 1227582 - RNA, 22 nt, Human
uggacuguggugacuuuggaua

SEQ ID NO: 1227583 - RNA, 14 nt, Human
uggaaaucuuuaaa

SEQ ID NO: 1227584 - RNA, 15 nt, Human
uggaaaucuuuaaaa

SEQ ID NO: 1227585 - RNA, 17 nt, Human
uggaagguauuuaauag

SEQ ID NO: 1227586 - RNA, 13 nt, Human
uggaagguauuua

SEQ ID NO: 1227587 - RNA, 23 nt, Human
aggacagcccuucuuuccacaga

SEQ ID NO: 1227588 - RNA, 14 nt, Human
ugggaguacaaaag

SEQ ID NO: 1227589 - RNA, 19 nt, Human
ugggaggugagaccaccuc

SEQ ID NO: 1227590 - RNA, 16 nt, Human
ugggauuuggucaaca

SEQ ID NO: 1227591 - RNA, 15 nt, Human
uggggaaugaagaua

SEQ ID NO: 1227592 - RNA, 14 nt, Human
uggggaaugaagau

SEQ ID NO: 1227593 - RNA, 23 nt, Human
agguauaauucacauuguauuca

SEQ ID NO: 1227594 - RNA, 23 nt, Human
agguacuucaaauccuugaagau

SEQ ID NO: 1227595 - RNA, 18 nt, Human
agguauucguuaucuaau

SEQ ID NO: 1227596 - RNA, 20 nt, Human
agguauucguuaucuaauag

SEQ ID NO: 1227597 - RNA, 17 nt, Human
aggguuaugauuaagua

SEQ ID NO: 1227598 - RNA, 16 nt, Human
agggggcaagaggaau

SEQ ID NO: 1227599 - RNA, 17 nt, Human
aggggcuaccaggaaag

SEQ ID NO: 1227600 - RNA, 14 nt, Human
aggggcuaccagga

SEQ ID NO: 1227601 - RNA, 15 nt, Human
aggggcuaccaggaa

SEQ ID NO: 1227602 - RNA, 11 nt, Human
aggguggcagc

SEQ ID NO: 1227603 - RNA, 13 nt, Human
aggguggcagcaa

SEQ ID NO: 1227604 - RNA, 15 nt, Human
aggguggcagcaaca

SEQ ID NO: 1227605 - RNA, 16 nt, Human
aggguggcagcaacaa

SEQ ID NO: 1227606 - RNA, 20 nt, Human
ugguaaggggaauugaggac

SEQ ID NO: 1227607 - RNA, 16 nt, Human
agucaggaaagagaac

SEQ ID NO: 1227608 - RNA, 17 nt, Human
agucagaucugccuaag

SEQ ID NO: 1227609 - RNA, 22 nt, Human
aguccaggcuuuuuuaucaugu

SEQ ID NO: 1227610 - RNA, 20 nt, Human
ugucaaucagccuaguugau

SEQ ID NO: 1227611 - RNA, 17 nt, Human
uguauuuuuaguagaga

SEQ ID NO: 1227612 - RNA, 20 nt, Human
agucacauuccugaacagga

SEQ ID NO: 1227613 - RNA, 19 nt, Human
agucacauuccugaacagg

SEQ ID NO: 1227614 - RNA, 16 nt, Human
aguauuucuaugaaau

SEQ ID NO: 1227615 - RNA, 15 nt, Human
aguauuucuaugaaa

SEQ ID NO: 1227616 - RNA, 13 nt, Human
aguauuucuauga

SEQ ID NO: 1227617 - RNA, 19 nt, Human
aguagauaggccaugggca

SEQ ID NO: 1227618 - RNA, 22 nt, Human
aguagagacgagguuucacugu

SEQ ID NO: 1227619 - RNA, 19 nt, Human
aguacuuuuggcauuuuac

SEQ ID NO: 1227620 - RNA, 15 nt, Human
aguaauccaagcaaa

SEQ ID NO: 1227621 - RNA, 21 nt, Human
aguaauccaagcaaaugugaa

SEQ ID NO: 1227622 - RNA, 16 nt, Human
aguacacaauaagcaa

SEQ ID NO: 1227623 - RNA, 17 nt, Human
aguacacaauaagcaaa

SEQ ID NO: 1227624 - RNA, 18 nt, Human
aguacacaauaagcaaaa

SEQ ID NO: 1227625 - RNA, 21 nt, Human
aguacacaauaagcaaaaaca

SEQ ID NO: 1227626 - RNA, 22 nt, Human
aguacacaauaagcaaaaacaa

SEQ ID NO: 1227627 - RNA, 23 nt, Human
aguaaggaauuuuauuuuuuucu

SEQ ID NO: 1227628 - RNA, 17 nt, Human
uguacuuuuuggcauaa

SEQ ID NO: 1227629 - RNA, 12 nt, Human
uguacuuuuugg

SEQ ID NO: 1227630 - RNA, 15 nt, Human
uguacuuuuuggcau

SEQ ID NO: 1227631 - RNA, 16 nt, Human
uguacuuuuuggcaua

SEQ ID NO: 1227632 - RNA, 20 nt, Human
aggugcauauuuauaaaaau

SEQ ID NO: 1227633 - RNA, 21 nt, Human
agguggugguagagaagcaag

SEQ ID NO: 1227634 - RNA, 19 nt, Human
uguaaaucccauuauucaa

SEQ ID NO: 1227635 - RNA, 20 nt, Human
uguaaaucccauuauucaaa

SEQ ID NO: 1227636 - RNA, 22 nt, Human
uguaaaucccauuauucaaagu

SEQ ID NO: 1227637 - RNA, 11 nt, Human
aggucccuaau

SEQ ID NO: 1227638 - RNA, 10 nt, Human
aggucccuaa

SEQ ID NO: 1227639 - RNA, 13 nt, Human
uguaaaucccauu

SEQ ID NO: 1227640 - RNA, 16 nt, Human
uguaaaucccauuauu

SEQ ID NO: 1227641 - RNA, 18 nt, Human
uguaaaucccauuauuca

SEQ ID NO: 1227642 - RNA, 15 nt, Human
uguaaguaaacgguc

SEQ ID NO: 1227643 - RNA, 13 nt, Human
uguaauuauaucu

SEQ ID NO: 1227644 - RNA, 14 nt, Human
uguaauuauaucug

SEQ ID NO: 1227645 - RNA, 15 nt, Human
uguaauuauaucuga

SEQ ID NO: 1227646 - RNA, 17 nt, Human
uguaagaaaauaucacu

SEQ ID NO: 1227647 - RNA, 21 nt, Human
agugcaaauugucacaggaca

SEQ ID NO: 1227648 - RNA, 18 nt, Human
agugcaaauugucacagg

SEQ ID NO: 1227649 - RNA, 22 nt, Human
agugcaaauugucacaggacag

SEQ ID NO: 1227650 - RNA, 14 nt, Human
agugcacuaaugug

SEQ ID NO: 1227651 - RNA, 20 nt, Human
agugcuggcauuacaggugu

SEQ ID NO: 1227652 - RNA, 16 nt, Human
uguggugacuuuggau

SEQ ID NO: 1227653 - RNA, 17 nt, Human
uguggugacuuuggaua

SEQ ID NO: 1227654 - RNA, 22 nt, Human
aguucacucuccauuuaauaau

SEQ ID NO: 1227655 - RNA, 24 nt, Human
aguucacucuccauuuaauaauua

SEQ ID NO: 1227656 - RNA, 19 nt, Human
aguucggugagcuacaaau

SEQ ID NO: 1227657 - RNA, 20 nt, Human
aguucggugagcuacaaaug

SEQ ID NO: 1227658 - RNA, 13 nt, Human
uguuuaguaauca

SEQ ID NO: 1227659 - RNA, 14 nt, Human
uguuuaguaaucau

SEQ ID NO: 1227660 - RNA, 17 nt, Human
uguuuaguaaucauauu

SEQ ID NO: 1227661 - RNA, 13 nt, Human
uguuuagucuugu

SEQ ID NO: 1227662 - RNA, 17 nt, Human
uguuuagucuugucuca

SEQ ID NO: 1227663 - RNA, 18 nt, Human
uguuuagucuugucucag

SEQ ID NO: 1227664 - RNA, 19 nt, Human
uguuuagucuugucucaga

SEQ ID NO: 1227665 - RNA, 20 nt, Human
uguuuagucuugucucagau

SEQ ID NO: 1227666 - RNA, 16 nt, Human
uguugucugcaacucu

SEQ ID NO: 1227667 - RNA, 13 nt, Human
uguugucugcaac

SEQ ID NO: 1227668 - RNA, 21 nt, Human
aguguucauaaauaaaguuug

SEQ ID NO: 1227669 - RNA, 16 nt, Human
aguguuggagaagaac

SEQ ID NO: 1227670 - RNA, 14 nt, Human
aguguuggagaaga

SEQ ID NO: 1227671 - RNA, 21 nt, Human
aguguugaaacggaugauuuc

SEQ ID NO: 1227672 - RNA, 18 nt, Human
aguguuggagaagaacug

SEQ ID NO: 1227673 - RNA, 17 nt, Human
aguguuggagaagaacu

SEQ ID NO: 1227674 - RNA, 23 nt, Human
aguguuggagaagaacugaaauc

SEQ ID NO: 1227675 - RNA, 20 nt, Human
uuaagaagacugcauuauau

SEQ ID NO: 1227676 - RNA, 24 nt, Human
uuaaggggaggaaccagagugcug

SEQ ID NO: 1227677 - RNA, 15 nt, Human
auaaaauaauuuuua

SEQ ID NO: 1227678 - RNA, 22 nt, Human
auaaaauaauuuuaucucuuuc

SEQ ID NO: 1227679 - RNA, 12 nt, Human
auaaaauaauuu

SEQ ID NO: 1227680 - RNA, 18 nt, Human
auaaaagccuguuuaaga

SEQ ID NO: 1227681 - RNA, 19 nt, Human
auaaaagccuguuuaagag

SEQ ID NO: 1227682 - RNA, 13 nt, Human
auaaaagccuguu

SEQ ID NO: 1227683 - RNA, 14 nt, Human
aguuuaaauuguaa

SEQ ID NO: 1227684 - RNA, 19 nt, Human
uguuucaaacauauauaac

SEQ ID NO: 1227685 - RNA, 13 nt, Human
uguuucaaacaua

SEQ ID NO: 1227686 - RNA, 11 nt, Human
aguugccuaaa

SEQ ID NO: 1227687 - RNA, 15 nt, Human
aguugccuaaaucca

SEQ ID NO: 1227688 - RNA, 16 nt, Human
aguugccuaaauccau

SEQ ID NO: 1227689 - RNA, 17 nt, Human
aguugccuaaauccauu

SEQ ID NO: 1227690 - RNA, 19 nt, Human
aguugccuaaauccauuug

SEQ ID NO: 1227691 - RNA, 13 nt, Human
uuaccuuugacaa

SEQ ID NO: 1227692 - RNA, 20 nt, Human
uuaccuuugacaaagguaaa

SEQ ID NO: 1227693 - RNA, 22 nt, Human
auaacgauaaaagacagugaaa

SEQ ID NO: 1227694 - RNA, 14 nt, Human
auaacguauaaaag

SEQ ID NO: 1227695 - RNA, 13 nt, Human
auaaauaaaaaua

SEQ ID NO: 1227696 - RNA, 17 nt, Human
auaaagguucaugcaaa

SEQ ID NO: 1227697 - RNA, 15 nt, Human
auaaagguucaugca

SEQ ID NO: 1227698 - RNA, 14 nt, Human
auaaauaaaaauaa

SEQ ID NO: 1227699 - RNA, 22 nt, Human
auaaauagcuagacuggugacu

SEQ ID NO: 1227700 - RNA, 18 nt, Human
auaauccuaaacauauga

SEQ ID NO: 1227701 - RNA, 11 nt, Human
auaauaaagga

SEQ ID NO: 1227702 - RNA, 13 nt, Human
auaauaaaggacu

SEQ ID NO: 1227703 - RNA, 18 nt, Human
auaauaaaggacuguaau

SEQ ID NO: 1227704 - RNA, 19 nt, Human
auaauacuugcuuuggaaa

SEQ ID NO: 1227705 - RNA, 15 nt, Human
uuagggaaaacauuc

SEQ ID NO: 1227706 - RNA, 17 nt, Human
uuagggaaaacauucca

SEQ ID NO: 1227707 - RNA, 12 nt, Human
auauauuuuaag

SEQ ID NO: 1227708 - RNA, 13 nt, Human
auauauuuuaaga

SEQ ID NO: 1227709 - RNA, 19 nt, Human
uucauaauuauuauuuggc

SEQ ID NO: 1227710 - RNA, 12 nt, Human
auaugauucaaa

SEQ ID NO: 1227711 - RNA, 21 nt, Human
auaucuccgucaacucauauu

SEQ ID NO: 1227712 - RNA, 20 nt, Human
auaucuccgucaacucauau

SEQ ID NO: 1227713 - RNA, 19 nt, Human
auaucuccgucaacucaua

SEQ ID NO: 1227714 - RNA, 16 nt, Human
auaucuauauuuuaca

SEQ ID NO: 1227715 - RNA, 14 nt, Human
auauauuuuaagac

SEQ ID NO: 1227716 - RNA, 15 nt, Human
auauauuuuaagacg

SEQ ID NO: 1227717 - RNA, 23 nt, Human
uucccaaaggcauuauaaaaaga

SEQ ID NO: 1227718 - RNA, 18 nt, Human
uucccaacuccagaaagu

SEQ ID NO: 1227719 - RNA, 23 nt, Human
uuccacccagugcugaauuuccc

SEQ ID NO: 1227720 - RNA, 16 nt, Human
uucauuccauucugga

SEQ ID NO: 1227721 - RNA, 12 nt, Human
uucauuccucca

SEQ ID NO: 1227722 - RNA, 13 nt, Human
uucauuccuccag

SEQ ID NO: 1227723 - RNA, 14 nt, Human
uucauuccuccagg

SEQ ID NO: 1227724 - RNA, 14 nt, Human
auagucucuuuaaa

SEQ ID NO: 1227725 - RNA, 21 nt, Human
auagucucuuuaaaaggaaag

SEQ ID NO: 1227726 - RNA, 13 nt, Human
auagucuggcugu

SEQ ID NO: 1227727 - RNA, 14 nt, Human
auauauaacaaugc

SEQ ID NO: 1227728 - RNA, 21 nt, Human
auauauauuuuuuucugaaau

SEQ ID NO: 1227729 - RNA, 21 nt, Human
uucaagcgauucuccugccuc

SEQ ID NO: 1227730 - RNA, 17 nt, Human
uucaaggucugcuuuuc

SEQ ID NO: 1227731 - RNA, 18 nt, Human
uucaagcgauucuccugc

SEQ ID NO: 1227732 - RNA, 14 nt, Human
uucaagcaauccuc

SEQ ID NO: 1227733 - RNA, 16 nt, Human
uucaagcaauccuccc

SEQ ID NO: 1227734 - RNA, 21 nt, Human
uucaaaauuguuacaaauugu

SEQ ID NO: 1227735 - RNA, 13 nt, Human
uucaaaagaaagu

SEQ ID NO: 1227736 - RNA, 14 nt, Human
uucaaacauauaua

SEQ ID NO: 1227737 - RNA, 13 nt, Human
uuauuuuuuucug

SEQ ID NO: 1227738 - RNA, 17 nt, Human
uuauuuuuuucugaauu

SEQ ID NO: 1227739 - RNA, 12 nt, Human
uucaaaagaaag

SEQ ID NO: 1227740 - RNA, 17 nt, Human
auaggcguaacuaauuu

SEQ ID NO: 1227741 - RNA, 15 nt, Human
auagcuuuuuucucu

SEQ ID NO: 1227742 - RNA, 13 nt, Human
uucacauuggaaa

SEQ ID NO: 1227743 - RNA, 22 nt, Human
auagcuuuucccuuuuuuuaag

SEQ ID NO: 1227744 - RNA, 19 nt, Human
uugaaauauugacuuuuua

SEQ ID NO: 1227745 - RNA, 12 nt, Human
uugaaccaauaa

SEQ ID NO: 1227746 - RNA, 18 nt, Human
uucuguacuuuuuggcau

SEQ ID NO: 1227747 - RNA, 19 nt, Human
uucuguacuuuuuggcaua

SEQ ID NO: 1227748 - RNA, 14 nt, Human
auccauacauuugu

SEQ ID NO: 1227749 - RNA, 20 nt, Human
auccauuuggaaaucuuuaa

SEQ ID NO: 1227750 - RNA, 13 nt, Human
auccauuuggaaa

SEQ ID NO: 1227751 - RNA, 17 nt, Human
auccauuuggaaaucuu

SEQ ID NO: 1227752 - RNA, 19 nt, Human
auccauuuggaaaucuuua

SEQ ID NO: 1227753 - RNA, 18 nt, Human
auccaguuuuguuuggac

SEQ ID NO: 1227754 - RNA, 20 nt, Human
auccaguuuuguuuggacca

SEQ ID NO: 1227755 - RNA, 21 nt, Human
auccaguuuuguuuggaccaa

SEQ ID NO: 1227756 - RNA, 12 nt, Human
uucucuaggaaa

SEQ ID NO: 1227757 - RNA, 14 nt, Human
aucaaguuauuuuu

SEQ ID NO: 1227758 - RNA, 16 nt, Human
auauuuuuauauuuac

SEQ ID NO: 1227759 - RNA, 14 nt, Human
uuccuucagcacuu

SEQ ID NO: 1227760 - RNA, 17 nt, Human
auauuuucauucuccua

SEQ ID NO: 1227761 - RNA, 15 nt, Human
uuccuucagcacuuu

SEQ ID NO: 1227762 - RNA, 16 nt, Human
uucccuaucuuugcca

SEQ ID NO: 1227763 - RNA, 20 nt, Human
auauuuuacauaaauuuagu

SEQ ID NO: 1227764 - RNA, 16 nt, Human
auauuuuacauaaauu

SEQ ID NO: 1227765 - RNA, 15 nt, Human
auauuuuacauaaau

SEQ ID NO: 1227766 - RNA, 15 nt, Human
aucaauaaaaaauua

SEQ ID NO: 1227767 - RNA, 17 nt, Human
aucaauaaaaaauuaug

SEQ ID NO: 1227768 - RNA, 18 nt, Human
aucaauaaaaaauuauga

SEQ ID NO: 1227769 - RNA, 15 nt, Human
uucuaaaguaaaaac

SEQ ID NO: 1227770 - RNA, 15 nt, Human
uucucagauuucuga

SEQ ID NO: 1227771 - RNA, 20 nt, Human
uucucagauuucugaggaaa

SEQ ID NO: 1227772 - RNA, 16 nt, Human
uucucagauuucugag

SEQ ID NO: 1227773 - RNA, 16 nt, Human
aucagaaacacccuca

SEQ ID NO: 1227774 - RNA, 20 nt, Human
aucagaaacacccucacacu

SEQ ID NO: 1227775 - RNA, 19 nt, Human
aucagacuaugaaguuuuu

SEQ ID NO: 1227776 - RNA, 13 nt, Human
uucuauaauuuaa

SEQ ID NO: 1227777 - RNA, 14 nt, Human
uucuauaauuuaaa

SEQ ID NO: 1227778 - RNA, 15 nt, Human
uucuaguguagaauu

SEQ ID NO: 1227779 - RNA, 17 nt, Human
augcaguucugaagaag

SEQ ID NO: 1227780 - RNA, 15 nt, Human
augcaguucugaaga

SEQ ID NO: 1227781 - RNA, 14 nt, Human
uuuaauuuuggaau

SEQ ID NO: 1227782 - RNA, 15 nt, Human
uuuaauuuuggaauu

SEQ ID NO: 1227783 - RNA, 17 nt, Human
uuuaauuuuggaauuuu

SEQ ID NO: 1227784 - RNA, 19 nt, Human
augcaguucugaagaagau

SEQ ID NO: 1227785 - RNA, 18 nt, Human
augcaguucugaagaaga

SEQ ID NO: 1227786 - RNA, 12 nt, Human
uuuaauuuuaca

SEQ ID NO: 1227787 - RNA, 14 nt, Human
uuuaaauguauacu

SEQ ID NO: 1227788 - RNA, 15 nt, Human
uuuaaauguauacua

SEQ ID NO: 1227789 - RNA, 14 nt, Human
uuuaaauguuuuuu

SEQ ID NO: 1227790 - RNA, 23 nt, Human
uugugugaaagguacuucaaauc

SEQ ID NO: 1227791 - RNA, 19 nt, Human
uuguguaaauacaauuuug

SEQ ID NO: 1227792 - RNA, 23 nt, Human
augagagacacacugaagaagca

SEQ ID NO: 1227793 - RNA, 21 nt, Human
augagagacacacugaagaag

SEQ ID NO: 1227794 - RNA, 20 nt, Human
augagagacacacugaagaa

SEQ ID NO: 1227795 - RNA, 16 nt, Human
augauuucuaugcuga

SEQ ID NO: 1227796 - RNA, 12 nt, Human
augauuucuaug

SEQ ID NO: 1227797 - RNA, 13 nt, Human
augauuucuaugc

SEQ ID NO: 1227798 - RNA, 22 nt, Human
augauuaugaauuacauuugua

SEQ ID NO: 1227799 - RNA, 15 nt, Human
uuguugucugcaacu

SEQ ID NO: 1227800 - RNA, 21 nt, Human
augauucaaaugucuauaaac

SEQ ID NO: 1227801 - RNA, 12 nt, Human
augauucccagc

SEQ ID NO: 1227802 - RNA, 19 nt, Human
uuucaugcuguucaugaaa

SEQ ID NO: 1227803 - RNA, 17 nt, Human
uuucaugaccaguaaag

SEQ ID NO: 1227804 - RNA, 24 nt, Human
uuucaugaccaguaaaggcugcug

SEQ ID NO: 1227805 - RNA, 16 nt, Human
auggaauacucuuaua

SEQ ID NO: 1227806 - RNA, 17 nt, Human
auggaauacucuuauau

SEQ ID NO: 1227807 - RNA, 19 nt, Human
augcucuccaaaccacuuu

SEQ ID NO: 1227808 - RNA, 16 nt, Human
uuuauuacuguaagaa

SEQ ID NO: 1227809 - RNA, 23 nt, Human
uuuauuacaguauaauuaacaug

SEQ ID NO: 1227810 - RNA, 22 nt, Human
augcugucuacacuaagagaga

SEQ ID NO: 1227811 - RNA, 23 nt, Human
augcugucuacacuaagagagaa

SEQ ID NO: 1227812 - RNA, 13 nt, Human
uuuauauaagcuu

SEQ ID NO: 1227813 - RNA, 22 nt, Human
uuuauuacaguauaauuaacau

SEQ ID NO: 1227814 - RNA, 22 nt, Human
uuuagcuggaaaaguauguuag

SEQ ID NO: 1227815 - RNA, 22 nt, Human
uuuaggaaguugacuuauagua

SEQ ID NO: 1227816 - RNA, 16 nt, Human
uuuaguaucuuuuuau

SEQ ID NO: 1227817 - RNA, 14 nt, Human
uuuagucuugucuc

SEQ ID NO: 1227818 - RNA, 15 nt, Human
uuuagucuugucuca

SEQ ID NO: 1227819 - RNA, 15 nt, Human
augagaaaucuaaaa

SEQ ID NO: 1227820 - RNA, 18 nt, Human
augagaaaucuaaaaaac

SEQ ID NO: 1227821 - RNA, 23 nt, Human
augagaaaucuaaaaaacgaaaa

SEQ ID NO: 1227822 - RNA, 19 nt, Human
augagagacacacugaaga

SEQ ID NO: 1227823 - RNA, 17 nt, Human
augagagacacacugaa

SEQ ID NO: 1227824 - RNA, 14 nt, Human
augagagacacacu

SEQ ID NO: 1227825 - RNA, 13 nt, Human
augagagacacac

SEQ ID NO: 1227826 - RNA, 19 nt, Human
uuguauaaaauaauuuuua

SEQ ID NO: 1227827 - RNA, 23 nt, Human
uuguaguguuggagaagaacuga

SEQ ID NO: 1227828 - RNA, 17 nt, Human
uuguauaaaauaauuuu

SEQ ID NO: 1227829 - RNA, 16 nt, Human
uuguauaaaauaauuu

SEQ ID NO: 1227830 - RNA, 21 nt, Human
uuguaguagcguuuuuuaaau

SEQ ID NO: 1227831 - RNA, 22 nt, Human
uuguaguagcguuuuuuaaaug

SEQ ID NO: 1227832 - RNA, 23 nt, Human
uuguaguagcguuuuuuaaaugu

SEQ ID NO: 1227833 - RNA, 15 nt, Human
uuguacaaaguauua

SEQ ID NO: 1227834 - RNA, 17 nt, Human
uuguacaaaguauuaag

SEQ ID NO: 1227835 - RNA, 20 nt, Human
uuguacaaaguauuaagcau

SEQ ID NO: 1227836 - RNA, 21 nt, Human
uuguacaaaguauuaagcaua

SEQ ID NO: 1227837 - RNA, 22 nt, Human
uuguacaaaguauuaagcauau

SEQ ID NO: 1227838 - RNA, 13 nt, Human
uuguacaaaguau

SEQ ID NO: 1227839 - RNA, 14 nt, Human
uuguacaaaguauu

SEQ ID NO: 1227840 - RNA, 22 nt, Human
aucuuuaauuuuacauuuccua

SEQ ID NO: 1227841 - RNA, 16 nt, Human
aucuuuaauuuuacau

SEQ ID NO: 1227842 - RNA, 21 nt, Human
aucuuuaauuuuacauuuccu

SEQ ID NO: 1227843 - RNA, 16 nt, Human
aucuuugccacccuca

SEQ ID NO: 1227844 - RNA, 15 nt, Human
aucuuugccacccuc

SEQ ID NO: 1227845 - RNA, 14 nt, Human
aucuuugccacccu

SEQ ID NO: 1227846 - RNA, 12 nt, Human
augaaagauuca

SEQ ID NO: 1227847 - RNA, 13 nt, Human
aucuuuuuauuca

SEQ ID NO: 1227848 - RNA, 15 nt, Human
uuggagugcaguggc

SEQ ID NO: 1227849 - RNA, 15 nt, Human
uuggauaauaaggaa

SEQ ID NO: 1227850 - RNA, 19 nt, Human
uuggauaauaaggaaaagu

SEQ ID NO: 1227851 - RNA, 21 nt, Human
uuggauaauaaggaaaaguuu

SEQ ID NO: 1227852 - RNA, 15 nt, Human
uuggggauucuuaaa

SEQ ID NO: 1227853 - RNA, 15 nt, Human
augaauuaaguuuuu

SEQ ID NO: 1227854 - RNA, 13 nt, Human
uuggggauucuua

SEQ ID NO: 1227855 - RNA, 20 nt, Human
augaaauauuauguuaaaac

SEQ ID NO: 1227856 - RNA, 18 nt, Human
augaaauauuauguuaaa

SEQ ID NO: 1227857 - RNA, 17 nt, Human
augaaauauuauguuaa

SEQ ID NO: 1227858 - RNA, 17 nt, Human
augaagauacugaaaua

SEQ ID NO: 1227859 - RNA, 16 nt, Human
augaagauacugaaau

SEQ ID NO: 1227860 - RNA, 19 nt, Human
uugauggugguauguuuuc

SEQ ID NO: 1227861 - RNA, 18 nt, Human
uugauggugguauguuuu

SEQ ID NO: 1227862 - RNA, 15 nt, Human
uugaugggauuuggu

SEQ ID NO: 1227863 - RNA, 12 nt, Human
uugaugccuggc

SEQ ID NO: 1227864 - RNA, 12 nt, Human
aucucuucaguc

SEQ ID NO: 1227865 - RNA, 13 nt, Human
aucucuucagucu

SEQ ID NO: 1227866 - RNA, 21 nt, Human
aucucuucagucucuauacca

SEQ ID NO: 1227867 - RNA, 14 nt, Human
uugcaucugaaaau

SEQ ID NO: 1227868 - RNA, 14 nt, Human
aucucagcucacug

SEQ ID NO: 1227869 - RNA, 11 nt, Human
aucucagcuca

SEQ ID NO: 1227870 - RNA, 13 nt, Human
aucucagcucacu

SEQ ID NO: 1227871 - RNA, 15 nt, Human
aucucagcucacuac

SEQ ID NO: 1227872 - RNA, 13 nt, Human
aucucaauauuuc

SEQ ID NO: 1227873 - RNA, 14 nt, Human
aucucaauucuucc

SEQ ID NO: 1227874 - RNA, 16 nt, Human
aucucaauucuucccu

SEQ ID NO: 1227875 - RNA, 22 nt, Human
aucuccauugugccuaagucca

SEQ ID NO: 1227876 - RNA, 16 nt, Human
aucuccccaucauugg

SEQ ID NO: 1227877 - RNA, 23 nt, Human
aucucauuuccaagcaaguauua

SEQ ID NO: 1227878 - RNA, 21 nt, Human
aucucauuuccaagcaaguau

SEQ ID NO: 1227879 - RNA, 13 nt, Human
uugccuaaaucca

SEQ ID NO: 1227880 - RNA, 14 nt, Human
uugccuaaauccau

SEQ ID NO: 1227881 - RNA, 15 nt, Human
uugccuaaauccauu

SEQ ID NO: 1227882 - RNA, 22 nt, Human
uugccuaaauccauuuggaaau

SEQ ID NO: 1227883 - RNA, 15 nt, Human
aucugaggaauucug

SEQ ID NO: 1227884 - RNA, 16 nt, Human
aucugaggaauucugu

SEQ ID NO: 1227885 - RNA, 17 nt, Human
aucugaggaauucugua

SEQ ID NO: 1227886 - RNA, 18 nt, Human
aucugaggaauucuguau

SEQ ID NO: 1227887 - RNA, 20 nt, Human
aucugaggaauucuguauag

SEQ ID NO: 1227888 - RNA, 21 nt, Human
aucugaggaauucuguauaga

SEQ ID NO: 1227889 - RNA, 20 nt, Human
aucugccuaaggacuucuuu

SEQ ID NO: 1227890 - RNA, 18 nt, Human
aucugccuaaggacuucu

SEQ ID NO: 1227891 - RNA, 19 nt, Human
aucugccuaaggacuucuu

SEQ ID NO: 1227892 - RNA, 14 nt, Human
aucugccuaaggac

SEQ ID NO: 1227893 - RNA, 15 nt, Human
aucugccuaaggacu

SEQ ID NO: 1227894 - RNA, 16 nt, Human
aucugccuaaggacuu

SEQ ID NO: 1227895 - RNA, 17 nt, Human
aucugccuaaggacuuc

SEQ ID NO: 1227896 - RNA, 13 nt, Human
aucugugaacuug

SEQ ID NO: 1227897 - RNA, 17 nt, Human
aucugugaacuugaaau

SEQ ID NO: 1227898 - RNA, 18 nt, Human
aucugugaacuugaaauu

SEQ ID NO: 1227899 - RNA, 19 nt, Human
aucugugaacuugaaauuu

SEQ ID NO: 1227900 - RNA, 18 nt, Human
auuuuauguugcauagaa

SEQ ID NO: 1227901 - RNA, 21 nt, Human
auuuuauguugcauagaauaa

SEQ ID NO: 1227902 - RNA, 18 nt, Human
auuuuauuaugaaacuug

SEQ ID NO: 1227903 - RNA, 21 nt, Human
auuuuauuaugaaacuugugu

SEQ ID NO: 1227904 - RNA, 11 nt, Human
auuuuauuaug

SEQ ID NO: 1227905 - RNA, 12 nt, Human
auuuuauuauga

SEQ ID NO: 1227906 - RNA, 13 nt, Human
auuuuauuaugaa

SEQ ID NO: 1227907 - RNA, 14 nt, Human
auuuuauuaugaaa

SEQ ID NO: 1227908 - RNA, 13 nt, Human
auuuuauuaugua

SEQ ID NO: 1227909 - RNA, 14 nt, Human
auuuuauuauguaa

SEQ ID NO: 1227910 - RNA, 15 nt, Human
auuuuauuauguaaa

SEQ ID NO: 1227911 - RNA, 13 nt, Human
auuuuacauaaau

SEQ ID NO: 1227912 - RNA, 20 nt, Human
auuuuacuguacagacagaa

SEQ ID NO: 1227913 - RNA, 22 nt, Human
auuuuacuguacagacagaaaa

SEQ ID NO: 1227914 - RNA, 16 nt, Human
auuuuaauaauguuuc

SEQ ID NO: 1227915 - RNA, 15 nt, Human
auuuuaauaauguuu

SEQ ID NO: 1227916 - RNA, 14 nt, Human
auuuuaauaauguu

SEQ ID NO: 1227917 - RNA, 19 nt, Human
auuuguaguguuggagaag

SEQ ID NO: 1227918 - RNA, 23 nt, Human
auuugguaaggggaauugaggac

SEQ ID NO: 1227919 - RNA, 17 nt, Human
auuugguuuucacauug

SEQ ID NO: 1227920 - RNA, 22 nt, Human
auuugguuuucacauuggaaac

SEQ ID NO: 1227921 - RNA, 21 nt, Human
auuugguuuucacauuggaaa

SEQ ID NO: 1227922 - RNA, 18 nt, Human
auuuguaguguuggagaa

SEQ ID NO: 1227923 - RNA, 20 nt, Human
auuuggaaaucuuuaaaaaa

SEQ ID NO: 1227924 - RNA, 22 nt, Human
auuuauuacuguaagaaaauau

SEQ ID NO: 1227925 - RNA, 15 nt, Human
auuuacuaaaaugga

SEQ ID NO: 1227926 - RNA, 16 nt, Human
auuuaggaaguugacu

SEQ ID NO: 1227927 - RNA, 23 nt, Human
auuuaggaaguugacuuauagua

SEQ ID NO: 1227928 - RNA, 23 nt, Human
auuuccugggagcuuuuguagaa

SEQ ID NO: 1227929 - RNA, 13 nt, Human
auuggcuuuucug

SEQ ID NO: 1227930 - RNA, 15 nt, Human
auuguauauuacaau

SEQ ID NO: 1227931 - RNA, 17 nt, Human
auuguauauuacaauga

SEQ ID NO: 1227932 - RNA, 18 nt, Human
auuguauauuacaaugau

SEQ ID NO: 1227933 - RNA, 19 nt, Human
auuguauauuacaaugauc

SEQ ID NO: 1227934 - RNA, 20 nt, Human
auuguauauuacaaugauca

SEQ ID NO: 1227935 - RNA, 15 nt, Human
auugugaaauuauuc

SEQ ID NO: 1227936 - RNA, 14 nt, Human
auuguauuacaaau

SEQ ID NO: 1227937 - RNA, 15 nt, Human
auuguauuacaaauc

SEQ ID NO: 1227938 - RNA, 23 nt, Human
auugugcgcuaaacuuuucugau

SEQ ID NO: 1227939 - RNA, 16 nt, Human
auuuacaaaugggaaa

SEQ ID NO: 1227940 - RNA, 18 nt, Human
auuuaaccucuaaauucu

SEQ ID NO: 1227941 - RNA, 16 nt, Human
auuuaaccucuaaauu

SEQ ID NO: 1227942 - RNA, 22 nt, Human
auucucacagcuccaagaauuu

SEQ ID NO: 1227943 - RNA, 21 nt, Human
auucucacagcuccaagaauu

SEQ ID NO: 1227944 - RNA, 19 nt, Human
auucucacagcuccaagaa

SEQ ID NO: 1227945 - RNA, 22 nt, Human
auugaccuauuuccagaaauac

SEQ ID NO: 1227946 - RNA, 21 nt, Human
auuauuuuauuaugaaacuug

SEQ ID NO: 1227947 - RNA, 22 nt, Human
auuauuuuauuaugaaacuugu

SEQ ID NO: 1227948 - RNA, 14 nt, Human
auucagcucaugga

SEQ ID NO: 1227949 - RNA, 16 nt, Human
auucccuucaucugga

SEQ ID NO: 1227950 - RNA, 19 nt, Human
auucccuucaucuggaacc

SEQ ID NO: 1227951 - RNA, 21 nt, Human
auuccauucuggaagugacuu

SEQ ID NO: 1227952 - RNA, 16 nt, Human
auuacauuuguauaaa

SEQ ID NO: 1227953 - RNA, 15 nt, Human
auuacauuuguauaa

SEQ ID NO: 1227954 - RNA, 13 nt, Human
auuacauuuguau

SEQ ID NO: 1227955 - RNA, 20 nt, Human
auuaagagagucuauuuacg

SEQ ID NO: 1227956 - RNA, 23 nt, Human
uuuuuuaaaaaagaaacauuugg

SEQ ID NO: 1227957 - RNA, 21 nt, Human
auuaaguaaugauaacuggaa

SEQ ID NO: 1227958 - RNA, 15 nt, Human
auuaaguaaugauaa

SEQ ID NO: 1227959 - RNA, 13 nt, Human
auuaaguaaugau

SEQ ID NO: 1227960 - RNA, 16 nt, Human
auuauuuuauguugca

SEQ ID NO: 1227961 - RNA, 18 nt, Human
auuauuuuauguugcaua

SEQ ID NO: 1227962 - RNA, 15 nt, Human
auuauuuuauuauga

SEQ ID NO: 1227963 - RNA, 17 nt, Human
auuauauuuacaaaugg

SEQ ID NO: 1227964 - RNA, 19 nt, Human
auuaucuauagcuaaguac

SEQ ID NO: 1227965 - RNA, 22 nt, Human
auuaucuauagcuaaguacaca

SEQ ID NO: 1227966 - RNA, 16 nt, Human
auuauauuuacaaaug

SEQ ID NO: 1227967 - RNA, 19 nt, Human
auuagagaguguugaaacg

SEQ ID NO: 1227968 - RNA, 15 nt, Human
auuagagaguguuga

SEQ ID NO: 1227969 - RNA, 16 nt, Human
auuagagaguguugaa

SEQ ID NO: 1227970 - RNA, 17 nt, Human
auuagagaguguugaaa

SEQ ID NO: 1227971 - RNA, 18 nt, Human
auuagagaguguugaaac

SEQ ID NO: 1227972 - RNA, 15 nt, Human
auguugacaugggac

SEQ ID NO: 1227973 - RNA, 15 nt, Human
auguugcauagaaua

SEQ ID NO: 1227974 - RNA, 14 nt, Human
uuuuauaauuuugu

SEQ ID NO: 1227975 - RNA, 19 nt, Human
uuuuauggcacuaguauuu

SEQ ID NO: 1227976 - RNA, 22 nt, Human
uuuuauggcacuaguauuucua

SEQ ID NO: 1227977 - RNA, 21 nt, Human
uuuuauaauuuugugaagcaa

SEQ ID NO: 1227978 - RNA, 18 nt, Human
uuuuaugugaaacauguu

SEQ ID NO: 1227979 - RNA, 19 nt, Human
uuuuaugugaaacauguuu

SEQ ID NO: 1227980 - RNA, 22 nt, Human
uuuuauguugcauagaauaaaa

SEQ ID NO: 1227981 - RNA, 12 nt, Human
uuuuauuaugua

SEQ ID NO: 1227982 - RNA, 15 nt, Human
uuuucauuauuuuau

SEQ ID NO: 1227983 - RNA, 21 nt, Human
uuuucauuauuuuauuaugaa

SEQ ID NO: 1227984 - RNA, 22 nt, Human
uuuucauucuccuaucaccugu

SEQ ID NO: 1227985 - RNA, 13 nt, Human
uuuuauuauguaa

SEQ ID NO: 1227986 - RNA, 14 nt, Human
uuuuauuauguaaa

SEQ ID NO: 1227987 - RNA, 21 nt, Human
uuuuauucagcucauggacuu

SEQ ID NO: 1227988 - RNA, 12 nt, Human
auuaaagccaug

SEQ ID NO: 1227989 - RNA, 16 nt, Human
auuaaagccauguuua

SEQ ID NO: 1227990 - RNA, 17 nt, Human
auuaaagccauguuuau

SEQ ID NO: 1227991 - RNA, 21 nt, Human
auuaaagccauguuuauuaca

SEQ ID NO: 1227992 - RNA, 19 nt, Human
auuaacauguuaaaccaug

SEQ ID NO: 1227993 - RNA, 13 nt, Human
auuaacauguuaa

SEQ ID NO: 1227994 - RNA, 14 nt, Human
auuaacauguuaaa

SEQ ID NO: 1227995 - RNA, 15 nt, Human
auuaacauguuaaac

SEQ ID NO: 1227996 - RNA, 17 nt, Human
auuaacauguuaaacca

SEQ ID NO: 1227997 - RNA, 21 nt, Human
auguuucaaacauauauaaca

SEQ ID NO: 1227998 - RNA, 18 nt, Human
auguuucaaacauauaua

SEQ ID NO: 1227999 - RNA, 17 nt, Human
auguuuaguaaucauau

SEQ ID NO: 1228000 - RNA, 13 nt, Human
uuuuaaaaaagaa

SEQ ID NO: 1228001 - RNA, 16 nt, Human
uuuuaaaaaaugguca

SEQ ID NO: 1228002 - RNA, 17 nt, Human
uuuuaaaaaauggucac

SEQ ID NO: 1228003 - RNA, 15 nt, Human
uuuuaaaagaaugau

SEQ ID NO: 1228004 - RNA, 14 nt, Human
uuuuaaaagaauga

SEQ ID NO: 1228005 - RNA, 16 nt, Human
uuuuaaguaaggaauu

SEQ ID NO: 1228006 - RNA, 12 nt, Human
uuuguuucugua

SEQ ID NO: 1228007 - RNA, 13 nt, Human
uuuguuucuguac

SEQ ID NO: 1228008 - RNA, 18 nt, Human
uuuguuucuguacuuuuu

SEQ ID NO: 1228009 - RNA, 17 nt, Human
uuuguagaagucacauu

SEQ ID NO: 1228010 - RNA, 15 nt, Human
uuugucuacaccauu

SEQ ID NO: 1228011 - RNA, 13 nt, Human
uuugcucauggaa

SEQ ID NO: 1228012 - RNA, 12 nt, Human
uuugcucaugga

SEQ ID NO: 1228013 - RNA, 11 nt, Human
uuugcucaugg

SEQ ID NO: 1228014 - RNA, 22 nt, Human
augucuauaaaccgaacugaug

SEQ ID NO: 1228015 - RNA, 21 nt, Human
auaacaaugcuguauuuuaaa

SEQ ID NO: 1228016 - RNA, 20 nt, Human
auaacaaugcuguauuuuaa

SEQ ID NO: 1228017 - RNA, 19 nt, Human
auaacaaugcuguauuuua

SEQ ID NO: 1228018 - RNA, 17 nt, Human
auaacaaugcuguauuu

SEQ ID NO: 1228019 - RNA, 15 nt, Human
auaacaaugcuguau

SEQ ID NO: 1228020 - RNA, 14 nt, Human
auaacaaugaaagu

SEQ ID NO: 1228021 - RNA, 11 nt, Human
auaaagcaauu

SEQ ID NO: 1228022 - RNA, 11 nt, Human
auaaaaaggac

SEQ ID NO: 1228023 - RNA, 14 nt, Human
auaaaaaggacauc

SEQ ID NO: 1228024 - RNA, 19 nt, Human
auaaaaaggacaucagcaa

SEQ ID NO: 1228025 - RNA, 13 nt, Human
auaauguuucaaa

SEQ ID NO: 1228026 - RNA, 13 nt, Human
auaauggucagag

SEQ ID NO: 1228027 - RNA, 23 nt, Human
auaauguuucaaacauauauaac

SEQ ID NO: 1228028 - RNA, 18 nt, Human
auaauguuucaaacauau

SEQ ID NO: 1228029 - RNA, 13 nt, Human
auacagaaaaguu

SEQ ID NO: 1228030 - RNA, 13 nt, Human
auauuauguuaaa

SEQ ID NO: 1228031 - RNA, 13 nt, Human
auauucaauaaag

SEQ ID NO: 1228032 - RNA, 15 nt, Human
auauucaauaaagcu

SEQ ID NO: 1228033 - RNA, 20 nt, Human
auauucaauaaagcugcuga

SEQ ID NO: 1228034 - RNA, 16 nt, Human
auauuauguuaaaacu

SEQ ID NO: 1228035 - RNA, 14 nt, Human
auauuauguuaaaa

SEQ ID NO: 1228036 - RNA, 15 nt, Human
auauuauuuuauguu

SEQ ID NO: 1228037 - RNA, 22 nt, Human
auauuauuuuauguugcauaga

SEQ ID NO: 1228038 - RNA, 19 nt, Human
auauauuuuuuucugaaau

SEQ ID NO: 1228039 - RNA, 18 nt, Human
auauauuuuuuucugaaa

SEQ ID NO: 1228040 - RNA, 20 nt, Human
auauauuuuuauauuuacua

SEQ ID NO: 1228041 - RNA, 18 nt, Human
auauauuuuuauauuuac

SEQ ID NO: 1228042 - RNA, 19 nt, Human
auauauuuuuauauuuacu

SEQ ID NO: 1228043 - RNA, 12 nt, Human
auagaaagcuau

SEQ ID NO: 1228044 - RNA, 24 nt, Human
auagguuuggacaaaauggaauac

SEQ ID NO: 1228045 - RNA, 20 nt, Human
auaguacaugauaaaugaua

SEQ ID NO: 1228046 - RNA, 15 nt, Human
aguugacuuauagua

SEQ ID NO: 1228047 - RNA, 17 nt, Human
aguugacuuauaguaca

SEQ ID NO: 1228048 - RNA, 18 nt, Human
aguugacuuauaguacau

SEQ ID NO: 1228049 - RNA, 21 nt, Human
aguugacuuauaguacaugau

SEQ ID NO: 1228050 - RNA, 17 nt, Human
agugaucugcccgccuc

SEQ ID NO: 1228051 - RNA, 15 nt, Human
agugcuaauuuugaa

SEQ ID NO: 1228052 - RNA, 18 nt, Human
agugcuaauuuugaaaaa

SEQ ID NO: 1228053 - RNA, 20 nt, Human
agugcuaauuuugaaaaacu

SEQ ID NO: 1228054 - RNA, 15 nt, Human
agucaaaaauuaaac

SEQ ID NO: 1228055 - RNA, 14 nt, Human
aguauuuuguuuca

SEQ ID NO: 1228056 - RNA, 17 nt, Human
aguauuuuguuucagug

SEQ ID NO: 1228057 - RNA, 17 nt, Human
agugacccugcucucac

SEQ ID NO: 1228058 - RNA, 23 nt, Human
augaaguccaagcauuuagaugu

SEQ ID NO: 1228059 - RNA, 20 nt, Human
augaaguccaagcauuuaga

SEQ ID NO: 1228060 - RNA, 13 nt, Human
augaccaguaaag

SEQ ID NO: 1228061 - RNA, 18 nt, Human
aucugggggccucuucug

SEQ ID NO: 1228062 - RNA, 13 nt, Human
aucuuauuuagga

SEQ ID NO: 1228063 - RNA, 15 nt, Human
aucuggauuccagag

SEQ ID NO: 1228064 - RNA, 20 nt, Human
aucuccgucaacucauauuu

SEQ ID NO: 1228065 - RNA, 14 nt, Human
aucuauauuuuaca

SEQ ID NO: 1228066 - RNA, 17 nt, Human
aucuauagaaagcuaua

SEQ ID NO: 1228067 - RNA, 16 nt, Human
aucuauagaaagcuau

SEQ ID NO: 1228068 - RNA, 21 nt, Human
aucaugaauuaguuuuauaug

SEQ ID NO: 1228069 - RNA, 17 nt, Human
aucaugaauuaguuuua

SEQ ID NO: 1228070 - RNA, 14 nt, Human
aucaugugaaauca

SEQ ID NO: 1228071 - RNA, 12 nt, Human
aucaugugaaau

SEQ ID NO: 1228072 - RNA, 13 nt, Human
aucagcuuauugu

SEQ ID NO: 1228073 - RNA, 14 nt, Human
aucaggaagagaag

SEQ ID NO: 1228074 - RNA, 17 nt, Human
aucaggaagagaaggag

SEQ ID NO: 1228075 - RNA, 19 nt, Human
aucaggaagagaaggagca

SEQ ID NO: 1228076 - RNA, 22 nt, Human
aucaaauauauucagccuggcu

SEQ ID NO: 1228077 - RNA, 16 nt, Human
aucaccgacugaaaau

SEQ ID NO: 1228078 - RNA, 14 nt, Human
aucaaauauauuca

SEQ ID NO: 1228079 - RNA, 16 nt, Human
auccuugagucaaaaa

SEQ ID NO: 1228080 - RNA, 22 nt, Human
auccuucaucuggauuccagag

SEQ ID NO: 1228081 - RNA, 17 nt, Human
auccaccugccuuggcu

SEQ ID NO: 1228082 - RNA, 14 nt, Human
aucccauuauucaa

SEQ ID NO: 1228083 - RNA, 15 nt, Human
aucccauuauucaaa

SEQ ID NO: 1228084 - RNA, 20 nt, Human
aucccauuauucaaaguugc

SEQ ID NO: 1228085 - RNA, 19 nt, Human
auccucaguuuuugugaaa

SEQ ID NO: 1228086 - RNA, 22 nt, Human
auggguuagggaaaacauucca

SEQ ID NO: 1228087 - RNA, 21 nt, Human
augucaaucagccuaguugau

SEQ ID NO: 1228088 - RNA, 15 nt, Human
augguccgugcuaag

SEQ ID NO: 1228089 - RNA, 18 nt, Human
augguccgugcuaaggac

SEQ ID NO: 1228090 - RNA, 19 nt, Human
augguccgugcuaaggacu

SEQ ID NO: 1228091 - RNA, 14 nt, Human
augugaaacauguu

SEQ ID NO: 1228092 - RNA, 15 nt, Human
augugaaacauguuu

SEQ ID NO: 1228093 - RNA, 17 nt, Human
augugaaaucauucauu

SEQ ID NO: 1228094 - RNA, 18 nt, Human
augugaaaucauucauuu

SEQ ID NO: 1228095 - RNA, 15 nt, Human
auguguaugcacagu

SEQ ID NO: 1228096 - RNA, 19 nt, Human
auguguaugcacaguaaaa

SEQ ID NO: 1228097 - RNA, 20 nt, Human
auguguaugcacaguaaaaa

SEQ ID NO: 1228098 - RNA, 19 nt, Human
auguguaagacaaaaagcu

SEQ ID NO: 1228099 - RNA, 17 nt, Human
auguguaagacaaaaag

SEQ ID NO: 1228100 - RNA, 20 nt, Human
augcugaguuugugcuggug

SEQ ID NO: 1228101 - RNA, 14 nt, Human
auggaggggcagag

SEQ ID NO: 1228102 - RNA, 15 nt, Human
auggaggggcagagc

SEQ ID NO: 1228103 - RNA, 19 nt, Human
auggaggggcagagccagg

SEQ ID NO: 1228104 - RNA, 18 nt, Human
auggauaggcacaggaaa

SEQ ID NO: 1228105 - RNA, 17 nt, Human
auggauaggcacaggaa

SEQ ID NO: 1228106 - RNA, 19 nt, Human
auggcuuuguauagaaccu

SEQ ID NO: 1228107 - RNA, 18 nt, Human
augccuuguuucauauuu

SEQ ID NO: 1228108 - RNA, 23 nt, Human
augcacaaauucugucucuggau

SEQ ID NO: 1228109 - RNA, 15 nt, Human
augcacaaauucugu

SEQ ID NO: 1228110 - RNA, 22 nt, Human
augcacaaauucugucucugga

SEQ ID NO: 1228111 - RNA, 23 nt, Human
aggccaugggcacuguggguaga

SEQ ID NO: 1228112 - RNA, 21 nt, Human
aggccaugggcacugugggua

SEQ ID NO: 1228113 - RNA, 20 nt, Human
aggagagggcgcuccucucu

SEQ ID NO: 1228114 - RNA, 13 nt, Human
aggcagagaagaa

SEQ ID NO: 1228115 - RNA, 14 nt, Human
aggcagagaagaaa

SEQ ID NO: 1228116 - RNA, 15 nt, Human
aggcagagaagaaag

SEQ ID NO: 1228117 - RNA, 14 nt, Human
agggaccggcggac

SEQ ID NO: 1228118 - RNA, 19 nt, Human
aggccggcuugccacaccc

SEQ ID NO: 1228119 - RNA, 20 nt, Human
aggccggcuugccacacccc

SEQ ID NO: 1228120 - RNA, 21 nt, Human
aggccggcuugccacaccccc

SEQ ID NO: 1228121 - RNA, 17 nt, Human
agccuggggcugaggcu

SEQ ID NO: 1228122 - RNA, 17 nt, Human
agccuggcuucaaauug

SEQ ID NO: 1228123 - RNA, 18 nt, Human
agccuggcuucaaauugu

SEQ ID NO: 1228124 - RNA, 19 nt, Human
agcucacugcaaccuccac

SEQ ID NO: 1228125 - RNA, 12 nt, Human
agcuacaaaugc

SEQ ID NO: 1228126 - RNA, 11 nt, Human
agcguuuuuua

SEQ ID NO: 1228127 - RNA, 14 nt, Human
agcguuuuuuaaau

SEQ ID NO: 1228128 - RNA, 17 nt, Human
agcguuuuuuaaaugua

SEQ ID NO: 1228129 - RNA, 18 nt, Human
agcguuuuuuaaauguau

SEQ ID NO: 1228130 - RNA, 19 nt, Human
agcguuuuuuaaauguaua

SEQ ID NO: 1228131 - RNA, 20 nt, Human
agcguuuuuuaaauguauac

SEQ ID NO: 1228132 - RNA, 23 nt, Human
agcguuuuuuaaauguauacuau

SEQ ID NO: 1228133 - RNA, 18 nt, Human
agcuucacuguaaaauaa

SEQ ID NO: 1228134 - RNA, 18 nt, Human
aggaaguugacuuauagu

SEQ ID NO: 1228135 - RNA, 22 nt, Human
aggaaguugacuuauaguacau

SEQ ID NO: 1228136 - RNA, 23 nt, Human
aggaaguugacuuauaguacaug

SEQ ID NO: 1228137 - RNA, 15 nt, Human
agcuuuuaugugaaa

SEQ ID NO: 1228138 - RNA, 21 nt, Human
agcuuuuaugugaaacauguu

SEQ ID NO: 1228139 - RNA, 21 nt, Human
agcaauuacaacggagucaaa

SEQ ID NO: 1228140 - RNA, 24 nt, Human
agcaaaauuuuuucucuaggaaau

SEQ ID NO: 1228141 - RNA, 19 nt, Human
agaucugccuaaggacuuc

SEQ ID NO: 1228142 - RNA, 21 nt, Human
agauguagccccucuccugga

SEQ ID NO: 1228143 - RNA, 22 nt, Human
agacagccaacuauggccugug

SEQ ID NO: 1228144 - RNA, 14 nt, Human
agaaugagacaucc

SEQ ID NO: 1228145 - RNA, 22 nt, Human
agaaugagagacacacugaaga

SEQ ID NO: 1228146 - RNA, 17 nt, Human
agaaugagagacacacu

SEQ ID NO: 1228147 - RNA, 22 nt, Human
agaagucacauuccugaacagg

SEQ ID NO: 1228148 - RNA, 18 nt, Human
agaagacugcauuauauu

SEQ ID NO: 1228149 - RNA, 21 nt, Human
agaagucacauuccugaacag

SEQ ID NO: 1228150 - RNA, 20 nt, Human
agaagucacauuccugaaca

SEQ ID NO: 1228151 - RNA, 18 nt, Human
agaagucacauuccugaa

SEQ ID NO: 1228152 - RNA, 17 nt, Human
agaagagaucaggaaga

SEQ ID NO: 1228153 - RNA, 18 nt, Human
agaggaauuacgugcucu

SEQ ID NO: 1228154 - RNA, 20 nt, Human
aaaucugugaacuugaaauu

SEQ ID NO: 1228155 - RNA, 21 nt, Human
aaaucugugaacuugaaauuu

SEQ ID NO: 1228156 - RNA, 17 nt, Human
aacacccucacacuggg

SEQ ID NO: 1228157 - RNA, 21 nt, Human
aacacccucacacugggacuu

SEQ ID NO: 1228158 - RNA, 22 nt, Human
aaauguuuuuuuuuaaagacuu

SEQ ID NO: 1228159 - RNA, 23 nt, Human
aaauuggggauucuuaaaguuga

SEQ ID NO: 1228160 - RNA, 19 nt, Human
aaauuguaagcaugcacaa

SEQ ID NO: 1228161 - RNA, 18 nt, Human
aaauugaugggauuuggu

SEQ ID NO: 1228162 - RNA, 18 nt, Human
aaauuggggauucuuaaa

SEQ ID NO: 1228163 - RNA, 19 nt, Human
aaauuggggauucuuaaag

SEQ ID NO: 1228164 - RNA, 20 nt, Human
aaauuggggauucuuaaagu

SEQ ID NO: 1228165 - RNA, 22 nt, Human
aaauuggggauucuuaaaguug

SEQ ID NO: 1228166 - RNA, 18 nt, Human
aaauguuuuuuuuuaaag

SEQ ID NO: 1228167 - RNA, 21 nt, Human
aaauguuuuuuuuuaaagacu

SEQ ID NO: 1228168 - RNA, 15 nt, Human
aacguauaaaagccu

SEQ ID NO: 1228169 - RNA, 13 nt, Human
aacgcguugaaau

SEQ ID NO: 1228170 - RNA, 14 nt, Human
aacgcguugaaauu

SEQ ID NO: 1228171 - RNA, 15 nt, Human
aacgcguugaaauug

SEQ ID NO: 1228172 - RNA, 17 nt, Human
aacgcguugaaauugua

SEQ ID NO: 1228173 - RNA, 18 nt, Human
aacucauauuuucaugcu

SEQ ID NO: 1228174 - RNA, 16 nt, Human
aacucauauuuucaug

SEQ ID NO: 1228175 - RNA, 15 nt, Human
aacucauauuuucau

SEQ ID NO: 1228176 - RNA, 22 nt, Human
aacucaucuagguaaauuacag

SEQ ID NO: 1228177 - RNA, 11 nt, Human
aaccaguauug

SEQ ID NO: 1228178 - RNA, 13 nt, Human
aaccaguauugua

SEQ ID NO: 1228179 - RNA, 14 nt, Human
aaccaguauuguac

SEQ ID NO: 1228180 - RNA, 15 nt, Human
aaccaguauuguaca

SEQ ID NO: 1228181 - RNA, 20 nt, Human
aacaggaucaguuaacuauu

SEQ ID NO: 1228182 - RNA, 13 nt, Human
aaaauuaagaaag

SEQ ID NO: 1228183 - RNA, 20 nt, Human
aaaauuaagaaaggauaaag

SEQ ID NO: 1228184 - RNA, 19 nt, Human
aaaauccauacauuugugu

SEQ ID NO: 1228185 - RNA, 20 nt, Human
aaaauuaaaccggaccaucu

SEQ ID NO: 1228186 - RNA, 22 nt, Human
aaaauuaacaugaauauuuagu

SEQ ID NO: 1228187 - RNA, 12 nt, Human
aaaauuaagaaa

SEQ ID NO: 1228188 - RNA, 14 nt, Human
aaaauuacaacuaa

SEQ ID NO: 1228189 - RNA, 13 nt, Human
aaaauuaucuaua

SEQ ID NO: 1228190 - RNA, 21 nt, Human
aaaauccacuuuaucuugaau

SEQ ID NO: 1228191 - RNA, 23 nt, Human
aaaaguuuaauauuaaagccaug

SEQ ID NO: 1228192 - RNA, 21 nt, Human
aaaaguuuaauauuaaagcca

SEQ ID NO: 1228193 - RNA, 22 nt, Human
aaaaguuuaauauuaaagccau

SEQ ID NO: 1228194 - RNA, 15 nt, Human
aaaauaaaaaacacu

SEQ ID NO: 1228195 - RNA, 12 nt, Human
aaacaggaucag

SEQ ID NO: 1228196 - RNA, 19 nt, Human
aaacccuugccaugugcua

SEQ ID NO: 1228197 - RNA, 12 nt, Human
aaagaaaauuuu

SEQ ID NO: 1228198 - RNA, 19 nt, Human
aaagaaaauuuuuguagua

SEQ ID NO: 1228199 - RNA, 13 nt, Human
aaagaaacauuug

SEQ ID NO: 1228200 - RNA, 15 nt, Human
aaagaacggaagaag

SEQ ID NO: 1228201 - RNA, 19 nt, Human
aaagaacggaagaagagau

SEQ ID NO: 1228202 - RNA, 16 nt, Human
aaagcccauucauucc

SEQ ID NO: 1228203 - RNA, 17 nt, Human
aaagcccauucauucca

SEQ ID NO: 1228204 - RNA, 17 nt, Human
aaauaaacgucuuaaau

SEQ ID NO: 1228205 - RNA, 16 nt, Human
aaauaaacgucuuaaa

SEQ ID NO: 1228206 - RNA, 15 nt, Human
aaauaaacgucuuaa

SEQ ID NO: 1228207 - RNA, 15 nt, Human
aauggguuacuugau

SEQ ID NO: 1228208 - RNA, 22 nt, Human
aauggucacguuuggugcuucu

SEQ ID NO: 1228209 - RNA, 23 nt, Human
aauggucacguuuggugcuucuc

SEQ ID NO: 1228210 - RNA, 20 nt, Human
aaugguccgugcuaaggacu

SEQ ID NO: 1228211 - RNA, 22 nt, Human
aaugguccgugcuaaggacuug

SEQ ID NO: 1228212 - RNA, 17 nt, Human
aaugauaacuggaaacu

SEQ ID NO: 1228213 - RNA, 21 nt, Human
aaugauagacaauugagguaa

SEQ ID NO: 1228214 - RNA, 16 nt, Human
aaugauaacuggaaac

SEQ ID NO: 1228215 - RNA, 15 nt, Human
aaugauaacuggaaa

SEQ ID NO: 1228216 - RNA, 14 nt, Human
aaugauaacuggaa

SEQ ID NO: 1228217 - RNA, 17 nt, Human
aauccauacauuugugu

SEQ ID NO: 1228218 - RNA, 16 nt, Human
aauccauacauuugug

SEQ ID NO: 1228219 - RNA, 17 nt, Human
aauccaagcaaauguga

SEQ ID NO: 1228220 - RNA, 22 nt, Human
aauauuaaagccauguuuauua

SEQ ID NO: 1228221 - RNA, 13 nt, Human
aauauuaaagcca

SEQ ID NO: 1228222 - RNA, 14 nt, Human
aauauuaaagccau

SEQ ID NO: 1228223 - RNA, 15 nt, Human
aauauuaaagccaug

SEQ ID NO: 1228224 - RNA, 16 nt, Human
aauauuaaagccaugu

SEQ ID NO: 1228225 - RNA, 18 nt, Human
aauauuaaagccauguuu

SEQ ID NO: 1228226 - RNA, 19 nt, Human
aauauuaaagccauguuua

SEQ ID NO: 1228227 - RNA, 20 nt, Human
aauauuaaagccauguuuau

SEQ ID NO: 1228228 - RNA, 20 nt, Human
aauacgugggcauucaaaug

SEQ ID NO: 1228229 - RNA, 19 nt, Human
aauacgugggcauucaaau

SEQ ID NO: 1228230 - RNA, 22 nt, Human
aaguugauaugccuuuucccaa

SEQ ID NO: 1228231 - RNA, 16 nt, Human
aauaaacgucuuaaau

SEQ ID NO: 1228232 - RNA, 15 nt, Human
aauaaacgucuuaaa

SEQ ID NO: 1228233 - RNA, 11 nt, Human
aauaaagcugu

SEQ ID NO: 1228234 - RNA, 19 nt, Human
aauaaagcuguguggcagu

SEQ ID NO: 1228235 - RNA, 14 nt, Human
aauaaagcugcuga

SEQ ID NO: 1228236 - RNA, 11 nt, Human
aauaaaggacu

SEQ ID NO: 1228237 - RNA, 18 nt, Human
aauaaaggacuguaaucu

SEQ ID NO: 1228238 - RNA, 22 nt, Human
aauaaaggacuguaaucuuauu

SEQ ID NO: 1228239 - RNA, 12 nt, Human
aauaaaauuuuu

SEQ ID NO: 1228240 - RNA, 12 nt, Human
aauaauguuuca

SEQ ID NO: 1228241 - RNA, 19 nt, Human
aauaauguuucaaacauau

SEQ ID NO: 1228242 - RNA, 14 nt, Human
aauaauguuucaaa

SEQ ID NO: 1228243 - RNA, 12 nt, Human
aaggaauuuuau

SEQ ID NO: 1228244 - RNA, 20 nt, Human
aaggcagcucuaaaugucaa

SEQ ID NO: 1228245 - RNA, 21 nt, Human
aagcugcugagaaucuagccu

SEQ ID NO: 1228246 - RNA, 17 nt, Human
aagcuggagugcagugg

SEQ ID NO: 1228247 - RNA, 20 nt, Human
aagcuggagugcaguggcau

SEQ ID NO: 1228248 - RNA, 15 nt, Human
aagggacugagaaau

SEQ ID NO: 1228249 - RNA, 17 nt, Human
aagggacugagaaauuu

SEQ ID NO: 1228250 - RNA, 12 nt, Human
aaggucugcuuu

SEQ ID NO: 1228251 - RNA, 21 nt, Human
aagauucaaugccccugaauu

SEQ ID NO: 1228252 - RNA, 20 nt, Human
aagauucaaugccccugaau

SEQ ID NO: 1228253 - RNA, 20 nt, Human
aagauacugaaauaaacguc

SEQ ID NO: 1228254 - RNA, 16 nt, Human
aagauacugaaauaaa

SEQ ID NO: 1228255 - RNA, 23 nt, Human
aagacagugaaagaaaauaacaa

SEQ ID NO: 1228256 - RNA, 18 nt, Human
aacuguuguagaagacaa

SEQ ID NO: 1228257 - RNA, 19 nt, Human
aacuguuguagaagacaaa

SEQ ID NO: 1228258 - RNA, 15 nt, Human
aagagaacuuccaga

SEQ ID NO: 1228259 - RNA, 15 nt, Human
aagacuuuuaugaua

SEQ ID NO: 1228260 - RNA, 13 nt, Human
aagagaaggagca

SEQ ID NO: 1228261 - RNA, 20 nt, Human
acucuuaagaagacugcauu

SEQ ID NO: 1228262 - RNA, 20 nt, Human
acucuguucauuccuccagg

SEQ ID NO: 1228263 - RNA, 15 nt, Human
acucuuaagaagacu

SEQ ID NO: 1228264 - RNA, 14 nt, Human
acucuuaagaagac

SEQ ID NO: 1228265 - RNA, 15 nt, Human
acucuguucauuccu

SEQ ID NO: 1228266 - RNA, 16 nt, Human
acucuguucauuccuc

SEQ ID NO: 1228267 - RNA, 18 nt, Human
acucuguucauuccucca

SEQ ID NO: 1228268 - RNA, 19 nt, Human
acucuguucauuccuccag

SEQ ID NO: 1228269 - RNA, 12 nt, Human
acugauucuuca

SEQ ID NO: 1228270 - RNA, 13 nt, Human
acugauucuucag

SEQ ID NO: 1228271 - RNA, 15 nt, Human
acugauucuucagca

SEQ ID NO: 1228272 - RNA, 22 nt, Human
acugauucuucagcaaaaauau

SEQ ID NO: 1228273 - RNA, 19 nt, Human
acuucagcgguuuauauaa

SEQ ID NO: 1228274 - RNA, 18 nt, Human
acuucagcgguuuauaua

SEQ ID NO: 1228275 - RNA, 20 nt, Human
acuucaaauccuugaagauu

SEQ ID NO: 1228276 - RNA, 23 nt, Human
accggcggaccccagccauccag

SEQ ID NO: 1228277 - RNA, 20 nt, Human
accucugccucagaaaacaa

SEQ ID NO: 1228278 - RNA, 12 nt, Human
accugcccugcc

SEQ ID NO: 1228279 - RNA, 13 nt, Human
accugcccugccc

SEQ ID NO: 1228280 - RNA, 16 nt, Human
accugcccugcccugc

SEQ ID NO: 1228281 - RNA, 17 nt, Human
accugcccugcccugcc

SEQ ID NO: 1228282 - RNA, 18 nt, Human
accugcccugcccugcca

SEQ ID NO: 1228283 - RNA, 20 nt, Human
accugcccugcccugccacc

SEQ ID NO: 1228284 - RNA, 21 nt, Human
accugcccugcccugccaccu

SEQ ID NO: 1228285 - RNA, 22 nt, Human
accugcccugcccugccaccug

SEQ ID NO: 1228286 - RNA, 23 nt, Human
accugcccugcccugccaccugu

SEQ ID NO: 1228287 - RNA, 18 nt, Human
accugucugucugucugu

SEQ ID NO: 1228288 - RNA, 20 nt, Human
accugucugucugucugucc

SEQ ID NO: 1228289 - RNA, 19 nt, Human
accugucuugccuuuuuca

SEQ ID NO: 1228290 - RNA, 21 nt, Human
accugucuugccuuuuucauu

SEQ ID NO: 1228291 - RNA, 22 nt, Human
accugucuugccuuuuucauua

SEQ ID NO: 1228292 - RNA, 18 nt, Human
accucugccucagaaaac

SEQ ID NO: 1228293 - RNA, 17 nt, Human
accucugccucagaaaa

SEQ ID NO: 1228294 - RNA, 15 nt, Human
acgcacggcagccac

SEQ ID NO: 1228295 - RNA, 17 nt, Human
acgcacggcagccacag

SEQ ID NO: 1228296 - RNA, 15 nt, Human
acuauugcauuuaua

SEQ ID NO: 1228297 - RNA, 18 nt, Human
acuaguauuucuaugaaa

SEQ ID NO: 1228298 - RNA, 19 nt, Human
acuaguauuucuaugaaau

SEQ ID NO: 1228299 - RNA, 20 nt, Human
acaauuuuguuucuguacuu

SEQ ID NO: 1228300 - RNA, 13 nt, Human
acacugggacuug

SEQ ID NO: 1228301 - RNA, 18 nt, Human
acacugggacuugcaaaa

SEQ ID NO: 1228302 - RNA, 19 nt, Human
acacugggacuugcaaaaa

SEQ ID NO: 1228303 - RNA, 20 nt, Human
acacugggagaaaugaaaaa

SEQ ID NO: 1228304 - RNA, 16 nt, Human
acagaagcuccaggua

SEQ ID NO: 1228305 - RNA, 11 nt, Human
aauuuuggaau

SEQ ID NO: 1228306 - RNA, 12 nt, Human
aauuuuggaauu

SEQ ID NO: 1228307 - RNA, 18 nt, Human
aauuuugugaagcaaaau

SEQ ID NO: 1228308 - RNA, 17 nt, Human
aauuuugugaagcaaaa

SEQ ID NO: 1228309 - RNA, 18 nt, Human
aauuuucaucuaggauuu

SEQ ID NO: 1228310 - RNA, 15 nt, Human
acaaaauggaauacu

SEQ ID NO: 1228311 - RNA, 14 nt, Human
acaaaauggaauac

SEQ ID NO: 1228312 - RNA, 13 nt, Human
acaaaauggaaua

SEQ ID NO: 1228313 - RNA, 12 nt, Human
acaaagaaauua

SEQ ID NO: 1228314 - RNA, 14 nt, Human
acaaagaaauuaug

SEQ ID NO: 1228315 - RNA, 16 nt, Human
acaaagaaauuaugug

SEQ ID NO: 1228316 - RNA, 21 nt, Human
acaaggaugaauuaaguuuuu

SEQ ID NO: 1228317 - RNA, 21 nt, Human
aaugguccgugcuaaggacuu

SEQ ID NO: 1228318 - RNA, 16 nt, Human
aauuggggauucuuaa

SEQ ID NO: 1228319 - RNA, 17 nt, Human
aauuggggauucuuaaa

SEQ ID NO: 1228320 - RNA, 20 nt, Human
aauuggggauucuuaaaguu

SEQ ID NO: 1228321 - RNA, 23 nt, Human
aauuuauuggcuuuucugaucca

SEQ ID NO: 1228322 - RNA, 17 nt, Human
aauuuauuggcuuuucu

SEQ ID NO: 1228323 - RNA, 19 nt, Human
aauuuauuggcuuuucuga

SEQ ID NO: 1228324 - RNA, 20 nt, Human
aauuuauuggcuuuucugau

SEQ ID NO: 1228325 - RNA, 21 nt, Human
aauuuauuggcuuuucugauc

SEQ ID NO: 1228326 - RNA, 21 nt, Human
aauuuccugggagcuuuugua

SEQ ID NO: 1228327 - RNA, 18 nt, Human
aauuuccugggagcuuuu

SEQ ID NO: 1228328 - RNA, 14 nt, Human
acagcugccucuuc

SEQ ID NO: 1228329 - RNA, 15 nt, Human
acagcugccucuucc

SEQ ID NO: 1228330 - RNA, 21 nt, Human
acagggccuuuggcaggugca

SEQ ID NO: 1228331 - RNA, 19 nt, Human
acaguggggaaugaagaua

SEQ ID NO: 1228332 - RNA, 15 nt, Human
acaguggggaaugaa

SEQ ID NO: 1228333 - RNA, 18 nt, Human
acauuuccuuacagaacu

SEQ ID NO: 1228334 - RNA, 16 nt, Human
acauuuccuaaauaua

SEQ ID NO: 1228335 - RNA, 17 nt, Human
acauuuccuaaauauau

SEQ ID NO: 1228336 - RNA, 12 nt, Human
acccacccagaa

SEQ ID NO: 1228337 - RNA, 15 nt, Human
acccacccagaauga

SEQ ID NO: 1228338 - RNA, 22 nt, Human
accaucaccagaauuaauuuua

SEQ ID NO: 1228339 - RNA, 20 nt, Human
accaucagaaacacccucac

SEQ ID NO: 1228340 - RNA, 23 nt, Human
accaucagaaacacccucacacu

SEQ ID NO: 1228341 - RNA, 15 nt, Human
accaucucuccaacu

SEQ ID NO: 1228342 - RNA, 19 nt, Human
cacaggaaccacaagacug

SEQ ID NO: 1228343 - RNA, 13 nt, Human
cacaggaaaccag

SEQ ID NO: 1228344 - RNA, 15 nt, Human
cacagcugccucuuc

SEQ ID NO: 1228345 - RNA, 22 nt, Human
cacagcugccucuucccucuuc

SEQ ID NO: 1228346 - RNA, 16 nt, Human
caaacugacucuuaag

SEQ ID NO: 1228347 - RNA, 21 nt, Human
caaacugacucuuaagaagac

SEQ ID NO: 1228348 - RNA, 17 nt, Human
caaacugacucuuaaga

SEQ ID NO: 1228349 - RNA, 16 nt, Human
caaaaucaauuaaaau

SEQ ID NO: 1228350 - RNA, 20 nt, Human
caaaucaaucuguaaaacua

SEQ ID NO: 1228351 - RNA, 17 nt, Human
caaaucaaucuguaaaa

SEQ ID NO: 1228352 - RNA, 23 nt, Human
caacauagugggacccugucucu

SEQ ID NO: 1228353 - RNA, 23 nt, Human
caacagcuggugcccugcuuuca

SEQ ID NO: 1228354 - RNA, 14 nt, Human
cacacugaagaagc

SEQ ID NO: 1228355 - RNA, 13 nt, Human
cacacugaagaag

SEQ ID NO: 1228356 - RNA, 14 nt, Human
cacagcugccucuu

SEQ ID NO: 1228357 - RNA, 13 nt, Human
cacaauaagcaaa

SEQ ID NO: 1228358 - RNA, 19 nt, Human
caauagucaaauuguguga

SEQ ID NO: 1228359 - RNA, 12 nt, Human
caauaagcaaaa

SEQ ID NO: 1228360 - RNA, 21 nt, Human
caauaaagugacccugcucuc

SEQ ID NO: 1228361 - RNA, 14 nt, Human
caauaaagugaccc

SEQ ID NO: 1228362 - RNA, 13 nt, Human
caauaaauagaca

SEQ ID NO: 1228363 - RNA, 17 nt, Human
caauaaauagacacgca

SEQ ID NO: 1228364 - RNA, 18 nt, Human
caaggaaaaaauaacaau

SEQ ID NO: 1228365 - RNA, 20 nt, Human
caaggaaaaaauaacaauga

SEQ ID NO: 1228366 - RNA, 21 nt, Human
ccccagcuggggccaggcugg

SEQ ID NO: 1228367 - RNA, 22 nt, Human
ccccagcuggggccaggcuggg

SEQ ID NO: 1228368 - RNA, 20 nt, Human
cccuaaaagaaacccugcac

SEQ ID NO: 1228369 - RNA, 19 nt, Human
cccuaaauaauaaaaauaa

SEQ ID NO: 1228370 - RNA, 15 nt, Human
cccuaaccaaguucc

SEQ ID NO: 1228371 - RNA, 12 nt, Human
cccuaauaaagc

SEQ ID NO: 1228372 - RNA, 13 nt, Human
cccuaauaaagcu

SEQ ID NO: 1228373 - RNA, 14 nt, Human
cccuaauaaagcug

SEQ ID NO: 1228374 - RNA, 15 nt, Human
cccuaauaaagcugu

SEQ ID NO: 1228375 - RNA, 18 nt, Human
cccuaauaaagcugugug

SEQ ID NO: 1228376 - RNA, 12 nt, Human
cccucaugcugu

SEQ ID NO: 1228377 - RNA, 16 nt, Human
cccugggaggcucugg

SEQ ID NO: 1228378 - RNA, 17 nt, Human
cccugggaggcucugga

SEQ ID NO: 1228379 - RNA, 18 nt, Human
cccugggaggcucuggag

SEQ ID NO: 1228380 - RNA, 15 nt, Human
cccuggaaaccuucc

SEQ ID NO: 1228381 - RNA, 16 nt, Human
cccuggaaaccuucca

SEQ ID NO: 1228382 - RNA, 19 nt, Human
cccuggaaaccuuccaccc

SEQ ID NO: 1228383 - RNA, 21 nt, Human
cccuggaaaccuuccacccag

SEQ ID NO: 1228384 - RNA, 22 nt, Human
cccuggaaaccuuccacccagu

SEQ ID NO: 1228385 - RNA, 21 nt, Human
cccugccucucugcagguccc

SEQ ID NO: 1228386 - RNA, 22 nt, Human
cccugccucucugcaggucccu

SEQ ID NO: 1228387 - RNA, 14 nt, Human
cccugccaccuccu

SEQ ID NO: 1228388 - RNA, 17 nt, Human
cccugccaccuccugcc

SEQ ID NO: 1228389 - RNA, 18 nt, Human
cccugccaccuccugccu

SEQ ID NO: 1228390 - RNA, 11 nt, Human
cccugccucuc

SEQ ID NO: 1228391 - RNA, 18 nt, Human
cccugccucucugcaggu

SEQ ID NO: 1228392 - RNA, 22 nt, Human
ccuagguauaauucacauugua

SEQ ID NO: 1228393 - RNA, 13 nt, Human
ccuaaacauauga

SEQ ID NO: 1228394 - RNA, 19 nt, Human
ccuaaauccauuuggaaau

SEQ ID NO: 1228395 - RNA, 20 nt, Human
ccuaaauccauuuggaaauc

SEQ ID NO: 1228396 - RNA, 21 nt, Human
ccuaaauccauuuggaaaucu

SEQ ID NO: 1228397 - RNA, 16 nt, Human
cccuucaugcauggaa

SEQ ID NO: 1228398 - RNA, 14 nt, Human
cccuucaucuggaa

SEQ ID NO: 1228399 - RNA, 16 nt, Human
cccuucaucuggaacc

SEQ ID NO: 1228400 - RNA, 16 nt, Human
ccggaucugagggaga

SEQ ID NO: 1228401 - RNA, 12 nt, Human
ccucacacuggg

SEQ ID NO: 1228402 - RNA, 13 nt, Human
ccucacacuggga

SEQ ID NO: 1228403 - RNA, 15 nt, Human
ccucacacugggacu

SEQ ID NO: 1228404 - RNA, 21 nt, Human
ccuauucaacacacacaugcu

SEQ ID NO: 1228405 - RNA, 23 nt, Human
ccuauucaacacacacaugcuuc

SEQ ID NO: 1228406 - RNA, 18 nt, Human
ccucaccagcccuggcaa

SEQ ID NO: 1228407 - RNA, 15 nt, Human
ccucguggacaccug

SEQ ID NO: 1228408 - RNA, 16 nt, Human
ccucguggacaccugc

SEQ ID NO: 1228409 - RNA, 17 nt, Human
ccucguggacaccugcc

SEQ ID NO: 1228410 - RNA, 18 nt, Human
ccucguggacaccugccc

SEQ ID NO: 1228411 - RNA, 20 nt, Human
ccucguggacaccugcccug

SEQ ID NO: 1228412 - RNA, 21 nt, Human
ccucguggacaccugcccugc

SEQ ID NO: 1228413 - RNA, 22 nt, Human
ccucguggacaccugcccugcc

SEQ ID NO: 1228414 - RNA, 20 nt, Human
ccuccacucuuucuuucaau

SEQ ID NO: 1228415 - RNA, 15 nt, Human
ccuccacucuuucuu

SEQ ID NO: 1228416 - RNA, 20 nt, Human
ccuccaggguggcagcaaca

SEQ ID NO: 1228417 - RNA, 21 nt, Human
ccuccaggguggcagcaacaa

SEQ ID NO: 1228418 - RNA, 12 nt, Human
cccauuauucaa

SEQ ID NO: 1228419 - RNA, 19 nt, Human
ccauggacacuacacccag

SEQ ID NO: 1228420 - RNA, 20 nt, Human
ccauggacacuacacccagc

SEQ ID NO: 1228421 - RNA, 21 nt, Human
ccauggacacuacacccagca

SEQ ID NO: 1228422 - RNA, 22 nt, Human
ccauggacacuacacccagcaa

SEQ ID NO: 1228423 - RNA, 23 nt, Human
ccauggacacuacacccagcaau

SEQ ID NO: 1228424 - RNA, 20 nt, Human
ccauucauuccauucuggaa

SEQ ID NO: 1228425 - RNA, 17 nt, Human
cccaggacaggauccag

SEQ ID NO: 1228426 - RNA, 10 nt, Human
cccaggacag

SEQ ID NO: 1228427 - RNA, 14 nt, Human
ccagggaccggcgg

SEQ ID NO: 1228428 - RNA, 12 nt, Human
ccagugcugaau

SEQ ID NO: 1228429 - RNA, 22 nt, Human
ccagugcugaauuucccucucu

SEQ ID NO: 1228430 - RNA, 20 nt, Human
ccagugggaggugagaccac

SEQ ID NO: 1228431 - RNA, 23 nt, Human
ccagugggaggugagaccaccuc

SEQ ID NO: 1228432 - RNA, 20 nt, Human
ccaucagaaacacccucaca

SEQ ID NO: 1228433 - RNA, 22 nt, Human
ccaucagaaacacccucacacu

SEQ ID NO: 1228434 - RNA, 18 nt, Human
ccaucagaaacacccuca

SEQ ID NO: 1228435 - RNA, 18 nt, Human
cauuugcucauggaauug

SEQ ID NO: 1228436 - RNA, 16 nt, Human
cauuugcucauggaau

SEQ ID NO: 1228437 - RNA, 15 nt, Human
cauuugcucauggaa

SEQ ID NO: 1228438 - RNA, 15 nt, Human
cauuuccuaaauaua

SEQ ID NO: 1228439 - RNA, 12 nt, Human
cauuauuuuauu

SEQ ID NO: 1228440 - RNA, 14 nt, Human
cauuauuuuauuau

SEQ ID NO: 1228441 - RNA, 16 nt, Human
cauuauuuuauuauga

SEQ ID NO: 1228442 - RNA, 15 nt, Human
cauugaccuauuucc

SEQ ID NO: 1228443 - RNA, 21 nt, Human
cauugaccuauuuccagaaau

SEQ ID NO: 1228444 - RNA, 17 nt, Human
cauuauuuuauuaugaa

SEQ ID NO: 1228445 - RNA, 15 nt, Human
caugcauggaaauuc

SEQ ID NO: 1228446 - RNA, 17 nt, Human
caugcauggaaauuccc

SEQ ID NO: 1228447 - RNA, 23 nt, Human
caugcugucuacacuaagagaga

SEQ ID NO: 1228448 - RNA, 19 nt, Human
cauggaacgcguugaaauu

SEQ ID NO: 1228449 - RNA, 20 nt, Human
cauggaacgcguugaaauug

SEQ ID NO: 1228450 - RNA, 23 nt, Human
cauggaacgcguugaaauuguaa

SEQ ID NO: 1228451 - RNA, 20 nt, Human
caugcuucccuuuccugagu

SEQ ID NO: 1228452 - RNA, 15 nt, Human
caugcuucccuuucc

SEQ ID NO: 1228453 - RNA, 18 nt, Human
cauggaacgcguugaaau

SEQ ID NO: 1228454 - RNA, 22 nt, Human
cauggacacuacacccagcaau

SEQ ID NO: 1228455 - RNA, 23 nt, Human
cauggacacuacacccagcaaua

SEQ ID NO: 1228456 - RNA, 22 nt, Human
cauguuucuuuguaaugaaaac

SEQ ID NO: 1228457 - RNA, 12 nt, Human
cauguuuauuac

SEQ ID NO: 1228458 - RNA, 13 nt, Human
cauguuuauuaca

SEQ ID NO: 1228459 - RNA, 18 nt, Human
cauguuuauuacaguaua

SEQ ID NO: 1228460 - RNA, 19 nt, Human
cauguuuauuacaguauaa

SEQ ID NO: 1228461 - RNA, 20 nt, Human
cauguuuauuacaguauaau

SEQ ID NO: 1228462 - RNA, 22 nt, Human
cauguuuauuacaguauaauua

SEQ ID NO: 1228463 - RNA, 21 nt, Human
cauguuucuuuguaaugaaaa

SEQ ID NO: 1228464 - RNA, 15 nt, Human
caugugaaaucauuc

SEQ ID NO: 1228465 - RNA, 16 nt, Human
caugugaaaucauuca

SEQ ID NO: 1228466 - RNA, 17 nt, Human
caugugaaaucauucau

SEQ ID NO: 1228467 - RNA, 11 nt, Human
cauuauuuuau

SEQ ID NO: 1228468 - RNA, 13 nt, Human
caucccucaccca

SEQ ID NO: 1228469 - RNA, 14 nt, Human
caucccucacccau

SEQ ID NO: 1228470 - RNA, 20 nt, Human
caucccucacccauccuaga

SEQ ID NO: 1228471 - RNA, 23 nt, Human
cauccagcagauuuccagccuuc

SEQ ID NO: 1228472 - RNA, 13 nt, Human
cauccagggggca

SEQ ID NO: 1228473 - RNA, 19 nt, Human
caucucagcucacugcaac

SEQ ID NO: 1228474 - RNA, 20 nt, Human
caucucagcucacugcaacc

SEQ ID NO: 1228475 - RNA, 22 nt, Human
caucuagugagcagucaggaaa

SEQ ID NO: 1228476 - RNA, 17 nt, Human
caucuauagaaagcuau

SEQ ID NO: 1228477 - RNA, 11 nt, Human
cauccucucca

SEQ ID NO: 1228478 - RNA, 12 nt, Human
caucuaggauuu

SEQ ID NO: 1228479 - RNA, 14 nt, Human
caucuagugagcag

SEQ ID NO: 1228480 - RNA, 18 nt, Human
caucuagguaaauuacag

SEQ ID NO: 1228481 - RNA, 17 nt, Human
caucuagguaaauuaca

SEQ ID NO: 1228482 - RNA, 16 nt, Human
caucucuuguuuaaau

SEQ ID NO: 1228483 - RNA, 15 nt, Human
cauaugauguacaug

SEQ ID NO: 1228484 - RNA, 17 nt, Human
cauaugauguacaugua

SEQ ID NO: 1228485 - RNA, 21 nt, Human
cauaugauguacauguacuga

SEQ ID NO: 1228486 - RNA, 14 nt, Human
cauagaauaaaauu

SEQ ID NO: 1228487 - RNA, 20 nt, Human
cauagaauaaaauuuuuaau

SEQ ID NO: 1228488 - RNA, 12 nt, Human
cauauuuauaaa

SEQ ID NO: 1228489 - RNA, 17 nt, Human
cauauuuauaaaaauaa

SEQ ID NO: 1228490 - RNA, 22 nt, Human
caucaagucuuucacauuuaaa

SEQ ID NO: 1228491 - RNA, 12 nt, Human
cauauuuucaug

SEQ ID NO: 1228492 - RNA, 21 nt, Human
caguuuuguuuggaccaaaaa

SEQ ID NO: 1228493 - RNA, 11 nt, Human
caguugcagcc

SEQ ID NO: 1228494 - RNA, 22 nt, Human
cauaaaaaggacaucagcaaac

SEQ ID NO: 1228495 - RNA, 13 nt, Human
cauaaaaaggaca

SEQ ID NO: 1228496 - RNA, 19 nt, Human
cauaaaaaggacaucagca

SEQ ID NO: 1228497 - RNA, 20 nt, Human
cauaaaaaggacaucagcaa

SEQ ID NO: 1228498 - RNA, 21 nt, Human
cauaaaaaggacaucagcaaa

SEQ ID NO: 1228499 - RNA, 14 nt, Human
cauaaagcaggcag

SEQ ID NO: 1228500 - RNA, 16 nt, Human
cauaaagcaggcagaa

SEQ ID NO: 1228501 - RNA, 21 nt, Human
cauaacauaaaucugugaacu

SEQ ID NO: 1228502 - RNA, 20 nt, Human
cauaaauuuaguauuuuguu

SEQ ID NO: 1228503 - RNA, 19 nt, Human
cauaaauuuaguauuuugu

SEQ ID NO: 1228504 - RNA, 12 nt, Human
cauaacauaaau

SEQ ID NO: 1228505 - RNA, 19 nt, Human
cauaacauaaaucugugaa

SEQ ID NO: 1228506 - RNA, 14 nt, Human
cauaaaucugugaa

SEQ ID NO: 1228507 - RNA, 16 nt, Human
cauaaaucugugaacu

SEQ ID NO: 1228508 - RNA, 18 nt, Human
cauaaaucugugaacuug

SEQ ID NO: 1228509 - RNA, 22 nt, Human
cauaaaucugugaacuugaaau

SEQ ID NO: 1228510 - RNA, 23 nt, Human
cauaaaucugugaacuugaaauu

SEQ ID NO: 1228511 - RNA, 18 nt, Human
cauaagcuuaugcuuaaa

SEQ ID NO: 1228512 - RNA, 17 nt, Human
cauaauccaguaaaaua

SEQ ID NO: 1228513 - RNA, 18 nt, Human
cauaauccaguaaaauaa

SEQ ID NO: 1228514 - RNA, 15 nt, Human
cauaauacuugcuuu

SEQ ID NO: 1228515 - RNA, 22 nt, Human
caguucggugagcuacaaaugc

SEQ ID NO: 1228516 - RNA, 12 nt, Human
caguucugaaga

SEQ ID NO: 1228517 - RNA, 14 nt, Human
caguucugaagaag

SEQ ID NO: 1228518 - RNA, 13 nt, Human
caguucugaagaa

SEQ ID NO: 1228519 - RNA, 22 nt, Human
caguucugaagaagaugguacc

SEQ ID NO: 1228520 - RNA, 16 nt, Human
caguucugaagaagau

SEQ ID NO: 1228521 - RNA, 15 nt, Human
caguucugaagaaga

SEQ ID NO: 1228522 - RNA, 21 nt, Human
caguuaccucugccucagaaa

SEQ ID NO: 1228523 - RNA, 21 nt, Human
caguuaacuauugcauuuaua

SEQ ID NO: 1228524 - RNA, 24 nt, Human
caguuaacuauugcauuuauaugu

SEQ ID NO: 1228525 - RNA, 21 nt, Human
caguggcaucaucucagcuca

SEQ ID NO: 1228526 - RNA, 21 nt, Human
caguggcgcgaucucagcuca

SEQ ID NO: 1228527 - RNA, 21 nt, Human
caguggcgugaucucagcuca

SEQ ID NO: 1228528 - RNA, 16 nt, Human
cgcccuggacugugug

SEQ ID NO: 1228529 - RNA, 17 nt, Human
cggcccacaauuaauuu

SEQ ID NO: 1228530 - RNA, 13 nt, Human
cgggacugcggag

SEQ ID NO: 1228531 - RNA, 14 nt, Human
cggggacucagccc

SEQ ID NO: 1228532 - RNA, 18 nt, Human
cggugaauggcuuuguau

SEQ ID NO: 1228533 - RNA, 20 nt, Human
cggugaauggcuuuguauag

SEQ ID NO: 1228534 - RNA, 22 nt, Human
cggugaauggcuuuguauagaa

SEQ ID NO: 1228535 - RNA, 17 nt, Human
cggugagcuacaaaugc

SEQ ID NO: 1228536 - RNA, 13 nt, Human
cggugaauggcuu

SEQ ID NO: 1228537 - RNA, 14 nt, Human
cggugaauggcuuu

SEQ ID NO: 1228538 - RNA, 15 nt, Human
cggugaauggcuuug

SEQ ID NO: 1228539 - RNA, 16 nt, Human
cggugaauggcuuugu

SEQ ID NO: 1228540 - RNA, 23 nt, Human
cguugaaauuguaauuauaucug

SEQ ID NO: 1228541 - RNA, 12 nt, Human
cgugcuaaggac

SEQ ID NO: 1228542 - RNA, 13 nt, Human
cgugcuaaggacu

SEQ ID NO: 1228543 - RNA, 14 nt, Human
cgugcuaaggacuu

SEQ ID NO: 1228544 - RNA, 15 nt, Human
cgugcuaaggacuug

SEQ ID NO: 1228545 - RNA, 16 nt, Human
cgugcuaaggacuugu

SEQ ID NO: 1228546 - RNA, 12 nt, Human
cguggacaccug

SEQ ID NO: 1228547 - RNA, 13 nt, Human
cguggacaccugc

SEQ ID NO: 1228548 - RNA, 14 nt, Human
cguggacaccugcc

SEQ ID NO: 1228549 - RNA, 15 nt, Human
cguggacaccugccc

SEQ ID NO: 1228550 - RNA, 17 nt, Human
cguggacaccugcccug

SEQ ID NO: 1228551 - RNA, 18 nt, Human
cguggacaccugcccugc

SEQ ID NO: 1228552 - RNA, 19 nt, Human
cguggacaccugcccugcc

SEQ ID NO: 1228553 - RNA, 18 nt, Human
cuaaauauauuuuaagac

SEQ ID NO: 1228554 - RNA, 20 nt, Human
cuaaauauauuuuaagacga

SEQ ID NO: 1228555 - RNA, 16 nt, Human
cuaaauccauuuggaa

SEQ ID NO: 1228556 - RNA, 17 nt, Human
cuaaauccauuuggaaa

SEQ ID NO: 1228557 - RNA, 19 nt, Human
cuaaauccauuuggaaauc

SEQ ID NO: 1228558 - RNA, 20 nt, Human
cuaaauccauuuggaaaucu

SEQ ID NO: 1228559 - RNA, 15 nt, Human
cuaacaugauuuggg

SEQ ID NO: 1228560 - RNA, 18 nt, Human
cuauuuuaauaaacacuc

SEQ ID NO: 1228561 - RNA, 22 nt, Human
cuauuuuaauaaacacucuuga

SEQ ID NO: 1228562 - RNA, 17 nt, Human
cucacccauccuagagg

SEQ ID NO: 1228563 - RNA, 14 nt, Human
cucacccauccuag

SEQ ID NO: 1228564 - RNA, 15 nt, Human
cucacccauccuaga

SEQ ID NO: 1228565 - RNA, 13 nt, Human
cucacauuuauau

SEQ ID NO: 1228566 - RNA, 19 nt, Human
cuauauuguuugcuaagca

SEQ ID NO: 1228567 - RNA, 12 nt, Human
cuaguucacucu

SEQ ID NO: 1228568 - RNA, 18 nt, Human
cuaugaaauauuauguua

SEQ ID NO: 1228569 - RNA, 21 nt, Human
cuaucuuugccacccucaugc

SEQ ID NO: 1228570 - RNA, 13 nt, Human
cuaugaaauauua

SEQ ID NO: 1228571 - RNA, 14 nt, Human
cuaucuuugccacc

SEQ ID NO: 1228572 - RNA, 15 nt, Human
cuaucuuugccaccc

SEQ ID NO: 1228573 - RNA, 18 nt, Human
cuaucuuugccacccuca

SEQ ID NO: 1228574 - RNA, 19 nt, Human
cuaucuuugccacccucau

SEQ ID NO: 1228575 - RNA, 12 nt, Human
cuaucuuugcca

SEQ ID NO: 1228576 - RNA, 13 nt, Human
cuaguguagaauu

SEQ ID NO: 1228577 - RNA, 20 nt, Human
cuaguguagaauugugcaac

SEQ ID NO: 1228578 - RNA, 20 nt, Human
cuaggcaguucaaagcagga

SEQ ID NO: 1228579 - RNA, 20 nt, Human
cuaguauuucuaugaaauau

SEQ ID NO: 1228580 - RNA, 19 nt, Human
cuaguauuucuaugaaaua

SEQ ID NO: 1228581 - RNA, 22 nt, Human
cuaguauuucuaugaaauauua

SEQ ID NO: 1228582 - RNA, 22 nt, Human
cuaggacugaauuaugaaacuu

SEQ ID NO: 1228583 - RNA, 17 nt, Human
cuagcaaaagugcaaga

SEQ ID NO: 1228584 - RNA, 16 nt, Human
cuagcaaaagugcaag

SEQ ID NO: 1228585 - RNA, 16 nt, Human
cuacccuaaccaaguu

SEQ ID NO: 1228586 - RNA, 15 nt, Human
cuacccuaaccaagu

SEQ ID NO: 1228587 - RNA, 21 nt, Human
cuacuguaaggcaaucauggu

SEQ ID NO: 1228588 - RNA, 22 nt, Human
cuacuuauuguagcauccugga

SEQ ID NO: 1228589 - RNA, 22 nt, Human
cuacuuucugugucuauggauu

SEQ ID NO: 1228590 - RNA, 23 nt, Human
cuacuucuuuuuucaaaagaaag

SEQ ID NO: 1228591 - RNA, 11 nt, Human
cuaaggacuug

SEQ ID NO: 1228592 - RNA, 16 nt, Human
cuaaggacuuguuaga

SEQ ID NO: 1228593 - RNA, 17 nt, Human
cuaaggacuuguuagau

SEQ ID NO: 1228594 - RNA, 12 nt, Human
cuaauaaagcug

SEQ ID NO: 1228595 - RNA, 13 nt, Human
cuaauaaagcugu

SEQ ID NO: 1228596 - RNA, 14 nt, Human
cuaauaaagcugug

SEQ ID NO: 1228597 - RNA, 16 nt, Human
cuaaucuacuuucugu

SEQ ID NO: 1228598 - RNA, 23 nt, Human
cuaauguggaccuuagaauacag

SEQ ID NO: 1228599 - RNA, 12 nt, Human
cuaccaggaaag

SEQ ID NO: 1228600 - RNA, 13 nt, Human
cucccuacccuaa

SEQ ID NO: 1228601 - RNA, 21 nt, Human
cucccaaagugcugggauuaa

SEQ ID NO: 1228602 - RNA, 22 nt, Human
cucccaagcaccugggauuaca

SEQ ID NO: 1228603 - RNA, 20 nt, Human
cuccauggcccugccaugcu

SEQ ID NO: 1228604 - RNA, 15 nt, Human
cuccuccaccucaac

SEQ ID NO: 1228605 - RNA, 14 nt, Human
cuccuccaccucaa

SEQ ID NO: 1228606 - RNA, 21 nt, Human
cuccuccaggguggcagcaac

SEQ ID NO: 1228607 - RNA, 22 nt, Human
cuccuccaggguggcagcaaca

SEQ ID NO: 1228608 - RNA, 17 nt, Human
cucuaggaaauauuuau

SEQ ID NO: 1228609 - RNA, 15 nt, Human
cucuaggaaauauuu

SEQ ID NO: 1228610 - RNA, 15 nt, Human
cucuauaccaauaaa

SEQ ID NO: 1228611 - RNA, 16 nt, Human
cucuauaccaauaaag

SEQ ID NO: 1228612 - RNA, 17 nt, Human
cucuauaccaauaaagu

SEQ ID NO: 1228613 - RNA, 15 nt, Human
cucuccaaaccacuu

SEQ ID NO: 1228614 - RNA, 16 nt, Human
cucuccaaaccacuuu

SEQ ID NO: 1228615 - RNA, 18 nt, Human
cucuccagccucagcucu

SEQ ID NO: 1228616 - RNA, 21 nt, Human
cucucucauacccucccuccc

SEQ ID NO: 1228617 - RNA, 17 nt, Human
cugacucuuaagaagac

SEQ ID NO: 1228618 - RNA, 11 nt, Human
cugagaaauuu

SEQ ID NO: 1228619 - RNA, 14 nt, Human
cugagaaauuuaua

SEQ ID NO: 1228620 - RNA, 17 nt, Human
cugaggaucagaguaau

SEQ ID NO: 1228621 - RNA, 19 nt, Human
cugaggaucagaguaaucc

SEQ ID NO: 1228622 - RNA, 15 nt, Human
cucuguucauuccuc

SEQ ID NO: 1228623 - RNA, 17 nt, Human
cucuguucauuccucca

SEQ ID NO: 1228624 - RNA, 18 nt, Human
cucuguucauuccuccag

SEQ ID NO: 1228625 - RNA, 19 nt, Human
cucuguucauuccuccagg

SEQ ID NO: 1228626 - RNA, 22 nt, Human
cucugucuccuaagcuggagug

SEQ ID NO: 1228627 - RNA, 23 nt, Human
cugaagaagcaccaaucaugaau

SEQ ID NO: 1228628 - RNA, 16 nt, Human
cugaaauuuccuggga

SEQ ID NO: 1228629 - RNA, 23 nt, Human
cugaaauuuccugggagcuuuug

SEQ ID NO: 1228630 - RNA, 13 nt, Human
cugaaauuuccug

SEQ ID NO: 1228631 - RNA, 17 nt, Human
cucuuucuuucaauaaa

SEQ ID NO: 1228632 - RNA, 21 nt, Human
cugaaauaaacgucuuaaaua

SEQ ID NO: 1228633 - RNA, 20 nt, Human
cucuuuaaaaggaaagaaaa

SEQ ID NO: 1228634 - RNA, 23 nt, Human
cucuuuaaaaggaaagaaaacau

SEQ ID NO: 1228635 - RNA, 19 nt, Human
cucuuuaaaaggaaagaaa

SEQ ID NO: 1228636 - RNA, 13 nt, Human
cugcugccugccu

SEQ ID NO: 1228637 - RNA, 19 nt, Human
cugcuucugacauaaucca

SEQ ID NO: 1228638 - RNA, 12 nt, Human
cugcuuucagau

SEQ ID NO: 1228639 - RNA, 15 nt, Human
cugcuuucagauacu

SEQ ID NO: 1228640 - RNA, 16 nt, Human
cugcuuucagauacug

SEQ ID NO: 1228641 - RNA, 15 nt, Human
cuggaagugacuuug

SEQ ID NO: 1228642 - RNA, 18 nt, Human
cuggaagugacuuuggcu

SEQ ID NO: 1228643 - RNA, 14 nt, Human
cugcccugcccugc

SEQ ID NO: 1228644 - RNA, 15 nt, Human
cugcccugcccugcc

SEQ ID NO: 1228645 - RNA, 22 nt, Human
cugcccucucccaaaaaacuac

SEQ ID NO: 1228646 - RNA, 22 nt, Human
cugcgcccuuaacugcauccag

SEQ ID NO: 1228647 - RNA, 22 nt, Human
cugccugcuuuuuauggccugu

SEQ ID NO: 1228648 - RNA, 11 nt, Human
cugcugccugc

SEQ ID NO: 1228649 - RNA, 14 nt, Human
cugcugccugcuuu

SEQ ID NO: 1228650 - RNA, 23 nt, Human
cugcugccugcuuuuuauggccu

SEQ ID NO: 1228651 - RNA, 11 nt, Human
cugcagguccc

SEQ ID NO: 1228652 - RNA, 12 nt, Human
cugcaggucccu

SEQ ID NO: 1228653 - RNA, 13 nt, Human
cugcaggucccua

SEQ ID NO: 1228654 - RNA, 14 nt, Human
cugcaggucccuaa

SEQ ID NO: 1228655 - RNA, 15 nt, Human
cugcaggucccuaau

SEQ ID NO: 1228656 - RNA, 16 nt, Human
cugcaggucccuaaua

SEQ ID NO: 1228657 - RNA, 17 nt, Human
cugcaggucccuaauaa

SEQ ID NO: 1228658 - RNA, 18 nt, Human
cugcaggucccuaauaaa

SEQ ID NO: 1228659 - RNA, 17 nt, Human
cugcagucucuauacca

SEQ ID NO: 1228660 - RNA, 21 nt, Human
cugcagucucuauaccaauaa

SEQ ID NO: 1228661 - RNA, 23 nt, Human
cugcagucucuauaccaauaaag

SEQ ID NO: 1228662 - RNA, 19 nt, Human
cugcaggucccuaauaaag

SEQ ID NO: 1228663 - RNA, 20 nt, Human
cugcaggucccuaauaaagc

SEQ ID NO: 1228664 - RNA, 21 nt, Human
cugcaggucccuaauaaagcu

SEQ ID NO: 1228665 - RNA, 22 nt, Human
cugcaggucccuaauaaagcug

SEQ ID NO: 1228666 - RNA, 23 nt, Human
cugcaggucccuaauaaagcugu

SEQ ID NO: 1228667 - RNA, 23 nt, Human
cuggcauuacaggugugagccac

SEQ ID NO: 1228668 - RNA, 20 nt, Human
cuggaagugcuaauuuugaa

SEQ ID NO: 1228669 - RNA, 21 nt, Human
cuggaagugcuaauuuugaaa

SEQ ID NO: 1228670 - RNA, 10 nt, Human
cugggccccu

SEQ ID NO: 1228671 - RNA, 23 nt, Human
cugggauuacaggugugagccac

SEQ ID NO: 1228672 - RNA, 22 nt, Human
cugggaggcucuggagcccacu

SEQ ID NO: 1228673 - RNA, 18 nt, Human
cugggaggcucuggagcc

SEQ ID NO: 1228674 - RNA, 20 nt, Human
cugggaggcucuggagccca

SEQ ID NO: 1228675 - RNA, 21 nt, Human
cugggaggcucuggagcccac

SEQ ID NO: 1228676 - RNA, 13 nt, Human
cugguguuucuug

SEQ ID NO: 1228677 - RNA, 14 nt, Human
cugguguuucuuga

SEQ ID NO: 1228678 - RNA, 18 nt, Human
cuguaaggcaaucauggu

SEQ ID NO: 1228679 - RNA, 17 nt, Human
cugggucgcccuggacu

SEQ ID NO: 1228680 - RNA, 18 nt, Human
cugggucgcccuggacug

SEQ ID NO: 1228681 - RNA, 22 nt, Human
cugggucgcccuggacugugug

SEQ ID NO: 1228682 - RNA, 19 nt, Human
cuguauuuuaaaagaauga

SEQ ID NO: 1228683 - RNA, 16 nt, Human
cuguauuuuaaaagaa

SEQ ID NO: 1228684 - RNA, 13 nt, Human
cuguauuuuaaaa

SEQ ID NO: 1228685 - RNA, 15 nt, Human
cuguaugauucccag

SEQ ID NO: 1228686 - RNA, 15 nt, Human
cuguauagauuagag

SEQ ID NO: 1228687 - RNA, 16 nt, Human
cuguauagauuagaga

SEQ ID NO: 1228688 - RNA, 12 nt, Human
cuugaggacaca

SEQ ID NO: 1228689 - RNA, 13 nt, Human
cuugaggacacau

SEQ ID NO: 1228690 - RNA, 14 nt, Human
cuugaggacacaug

SEQ ID NO: 1228691 - RNA, 15 nt, Human
cuugaggacacaugu

SEQ ID NO: 1228692 - RNA, 16 nt, Human
cuugaggacacauguc

SEQ ID NO: 1228693 - RNA, 17 nt, Human
cuugaggacacaugucc

SEQ ID NO: 1228694 - RNA, 18 nt, Human
cuugaggacacaugucca

SEQ ID NO: 1228695 - RNA, 19 nt, Human
cuucuuuuuucaaaagaaa

SEQ ID NO: 1228696 - RNA, 20 nt, Human
cuucuuuuuucaaaagaaag

SEQ ID NO: 1228697 - RNA, 19 nt, Human
cuucuuuccacagaagcuc

SEQ ID NO: 1228698 - RNA, 13 nt, Human
cuucuuuccacag

SEQ ID NO: 1228699 - RNA, 19 nt, Human
cuugaaauuugaauuuugu

SEQ ID NO: 1228700 - RNA, 20 nt, Human
cuugaaauuugaauuuugug

SEQ ID NO: 1228701 - RNA, 15 nt, Human
cuugcuuuuaaaauc

SEQ ID NO: 1228702 - RNA, 17 nt, Human
cuugccaaauauaaaua

SEQ ID NO: 1228703 - RNA, 18 nt, Human
cuuguaaaggaauuuaaa

SEQ ID NO: 1228704 - RNA, 18 nt, Human
cuuguauuauguguguuu

SEQ ID NO: 1228705 - RNA, 13 nt, Human
cuuguauuaugug

SEQ ID NO: 1228706 - RNA, 19 nt, Human
cuuuauuuuguguuuagga

SEQ ID NO: 1228707 - RNA, 21 nt, Human
cuuugccacccucaugcugug

SEQ ID NO: 1228708 - RNA, 21 nt, Human
cuuucuuucaauaaaacgcag

SEQ ID NO: 1228709 - RNA, 19 nt, Human
cuuuuuuaucaugugaaau

SEQ ID NO: 1228710 - RNA, 16 nt, Human
cuuuuuucaaaagaaa

SEQ ID NO: 1228711 - RNA, 14 nt, Human
cuuuggauaauaag

SEQ ID NO: 1228712 - RNA, 22 nt, Human
cuuuuaacuguuguagaagaca

SEQ ID NO: 1228713 - RNA, 22 nt, Human
cuuuuaaaugauugaauuauau

SEQ ID NO: 1228714 - RNA, 15 nt, Human
gaaaccuuccaccca

SEQ ID NO: 1228715 - RNA, 17 nt, Human
gaaaccuuccacccagu

SEQ ID NO: 1228716 - RNA, 20 nt, Human
gaaacuaggugcauauuuau

SEQ ID NO: 1228717 - RNA, 16 nt, Human
gaaacggaugauuucu

SEQ ID NO: 1228718 - RNA, 20 nt, Human
gaaagucagccauaucucca

SEQ ID NO: 1228719 - RNA, 17 nt, Human
gaacaggauauucucac

SEQ ID NO: 1228720 - RNA, 20 nt, Human
gaacaguuguguuugaagca

SEQ ID NO: 1228721 - RNA, 24 nt, Human
gaacaguuaccucugccucagaaa

SEQ ID NO: 1228722 - RNA, 22 nt, Human
gaacaguuguguuugaagcaca

SEQ ID NO: 1228723 - RNA, 21 nt, Human
gaaauuuccugggagcuuuug

SEQ ID NO: 1228724 - RNA, 13 nt, Human
gaaauuugaauuu

SEQ ID NO: 1228725 - RNA, 16 nt, Human
gaaauuugaauuuugu

SEQ ID NO: 1228726 - RNA, 24 nt, Human
gaaauuugaauuuuguguuagaga

SEQ ID NO: 1228727 - RNA, 23 nt, Human
gaaauuaguacuccccuccuuga

SEQ ID NO: 1228728 - RNA, 22 nt, Human
gaaauuaugugacauuuuacau

SEQ ID NO: 1228729 - RNA, 23 nt, Human
gaaauuaugugacauuuuacauu

SEQ ID NO: 1228730 - RNA, 17 nt, Human
gaaauucccuucaucug

SEQ ID NO: 1228731 - RNA, 21 nt, Human
gaaauucccuucaucuggaac

SEQ ID NO: 1228732 - RNA, 22 nt, Human
gaaauucccuucaucuggaacc

SEQ ID NO: 1228733 - RNA, 13 nt, Human
gaaauauuuauuu

SEQ ID NO: 1228734 - RNA, 16 nt, Human
gaaauauuuauuuuaa

SEQ ID NO: 1228735 - RNA, 15 nt, Human
gaaauauuuauuuua

SEQ ID NO: 1228736 - RNA, 21 nt, Human
gaaauaaacgucuuaaauauu

SEQ ID NO: 1228737 - RNA, 18 nt, Human
gaaauaaacgucuuaaau

SEQ ID NO: 1228738 - RNA, 17 nt, Human
gaaauaaacgucuuaaa

SEQ ID NO: 1228739 - RNA, 16 nt, Human
gaaauaaacgucuuaa

SEQ ID NO: 1228740 - RNA, 14 nt, Human
gaaauaaacgucuu

SEQ ID NO: 1228741 - RNA, 13 nt, Human
gaaggaggaccca

SEQ ID NO: 1228742 - RNA, 14 nt, Human
gaaggaggacccag

SEQ ID NO: 1228743 - RNA, 15 nt, Human
gaaggaggacccagg

SEQ ID NO: 1228744 - RNA, 16 nt, Human
gaaggaggacccagga

SEQ ID NO: 1228745 - RNA, 17 nt, Human
gaaggaggacccaggac

SEQ ID NO: 1228746 - RNA, 18 nt, Human
gaaggaggacccaggaca

SEQ ID NO: 1228747 - RNA, 19 nt, Human
gaaggaggacccaggacag

SEQ ID NO: 1228748 - RNA, 18 nt, Human
gaaggaaggcagggagga

SEQ ID NO: 1228749 - RNA, 19 nt, Human
gaaggaaggcagggaggag

SEQ ID NO: 1228750 - RNA, 20 nt, Human
gaaggaaggcagggaggagg

SEQ ID NO: 1228751 - RNA, 22 nt, Human
gaaggaaggcuccaucuccagu

SEQ ID NO: 1228752 - RNA, 21 nt, Human
gaaggugaggagcuugaaacc

SEQ ID NO: 1228753 - RNA, 14 nt, Human
gaaguaacuacagu

SEQ ID NO: 1228754 - RNA, 20 nt, Human
gaagucacauuccugaacag

SEQ ID NO: 1228755 - RNA, 16 nt, Human
gaagucacauuccuga

SEQ ID NO: 1228756 - RNA, 21 nt, Human
gaagucacauuccugaacagg

SEQ ID NO: 1228757 - RNA, 14 nt, Human
gaagucagaucugc

SEQ ID NO: 1228758 - RNA, 22 nt, Human
gaagucagaucugccuaaggac

SEQ ID NO: 1228759 - RNA, 23 nt, Human
gaagucagaucugccuaaggacu

SEQ ID NO: 1228760 - RNA, 23 nt, Human
gaaguccaagcauuuagauguau

SEQ ID NO: 1228761 - RNA, 19 nt, Human
gaaccaauaaaauaauuuu

SEQ ID NO: 1228762 - RNA, 15 nt, Human
gaaccacaagacugc

SEQ ID NO: 1228763 - RNA, 14 nt, Human
gaaccacaagacug

SEQ ID NO: 1228764 - RNA, 12 nt, Human
gaacuugaaauu

SEQ ID NO: 1228765 - RNA, 13 nt, Human
gaacuugaaauuu

SEQ ID NO: 1228766 - RNA, 15 nt, Human
gaacuugaaauuuga

SEQ ID NO: 1228767 - RNA, 22 nt, Human
gaacuugaaauuugaauuuugu

SEQ ID NO: 1228768 - RNA, 17 nt, Human
gaagauugagauguguu

SEQ ID NO: 1228769 - RNA, 22 nt, Human
gaagauugagauguguucacaa

SEQ ID NO: 1228770 - RNA, 14 nt, Human
gaagaucccccaga

SEQ ID NO: 1228771 - RNA, 15 nt, Human
gaagaucccccagaa

SEQ ID NO: 1228772 - RNA, 18 nt, Human
gaagaucccccagaaaag

SEQ ID NO: 1228773 - RNA, 22 nt, Human
gacagccaacuauggccugugg

SEQ ID NO: 1228774 - RNA, 19 nt, Human
gacagccaacuauggccug

SEQ ID NO: 1228775 - RNA, 23 nt, Human
gacaggaugguucccuugaugaa

SEQ ID NO: 1228776 - RNA, 18 nt, Human
gacaggauccaggccggc

SEQ ID NO: 1228777 - RNA, 13 nt, Human
gacaggauccagg

SEQ ID NO: 1228778 - RNA, 15 nt, Human
gacaggauccaggcc

SEQ ID NO: 1228779 - RNA, 16 nt, Human
gacauagucuggcugu

SEQ ID NO: 1228780 - RNA, 13 nt, Human
gaccaaaaaccag

SEQ ID NO: 1228781 - RNA, 19 nt, Human
gaccaaaaaccaguauugu

SEQ ID NO: 1228782 - RNA, 20 nt, Human
gaccaaaaaccaguauugua

SEQ ID NO: 1228783 - RNA, 22 nt, Human
gacaugggacauuugcucaugg

SEQ ID NO: 1228784 - RNA, 15 nt, Human
gacaagcucacagac

SEQ ID NO: 1228785 - RNA, 13 nt, Human
gacaccugcccug

SEQ ID NO: 1228786 - RNA, 14 nt, Human
gacaccugcccugc

SEQ ID NO: 1228787 - RNA, 15 nt, Human
gacaccugcccugcc

SEQ ID NO: 1228788 - RNA, 16 nt, Human
gacaccugcccugccc

SEQ ID NO: 1228789 - RNA, 22 nt, Human
gacaccugcccugcccugccac

SEQ ID NO: 1228790 - RNA, 23 nt, Human
gacaccugcccugcccugccacc

SEQ ID NO: 1228791 - RNA, 9 nt, Human
gacaccugc

SEQ ID NO: 1228792 - RNA, 10 nt, Human
gacaccugcc

SEQ ID NO: 1228793 - RNA, 11 nt, Human
gacaccugccc

SEQ ID NO: 1228794 - RNA, 12 nt, Human
gacaccugcccu

SEQ ID NO: 1228795 - RNA, 12 nt, Human
gacccaggacag

SEQ ID NO: 1228796 - RNA, 13 nt, Human
gacccaggacagg

SEQ ID NO: 1228797 - RNA, 22 nt, Human
gacccaggacaggauccaggcc

SEQ ID NO: 1228798 - RNA, 23 nt, Human
gaccugauuucugagcauuuaau

SEQ ID NO: 1228799 - RNA, 11 nt, Human
gaccugccucc

SEQ ID NO: 1228800 - RNA, 22 nt, Human
gaccugccucccuucaugcaug

SEQ ID NO: 1228801 - RNA, 19 nt, Human
gaccggcggaccccagcca

SEQ ID NO: 1228802 - RNA, 20 nt, Human
gaccggcggaccccagccau

SEQ ID NO: 1228803 - RNA, 16 nt, Human
gacggguuucaccaug

SEQ ID NO: 1228804 - RNA, 12 nt, Human
gagaccaccucu

SEQ ID NO: 1228805 - RNA, 11 nt, Human
gagacauccag

SEQ ID NO: 1228806 - RNA, 12 nt, Human
gagacauccagc

SEQ ID NO: 1228807 - RNA, 17 nt, Human
gagauacagaauuuuau

SEQ ID NO: 1228808 - RNA, 19 nt, Human
gagagacacacugaagaag

SEQ ID NO: 1228809 - RNA, 17 nt, Human
gagagagguugaaaaac

SEQ ID NO: 1228810 - RNA, 19 nt, Human
gagagagguugaaaaacaa

SEQ ID NO: 1228811 - RNA, 12 nt, Human
gagaaaugaaaa

SEQ ID NO: 1228812 - RNA, 12 nt, Human
gacuuguuagau

SEQ ID NO: 1228813 - RNA, 18 nt, Human
gagacacacugaagaagc

SEQ ID NO: 1228814 - RNA, 16 nt, Human
gagacagccaacuaug

SEQ ID NO: 1228815 - RNA, 16 nt, Human
gagaagaacugaaauc

SEQ ID NO: 1228816 - RNA, 14 nt, Human
gagaagaacugaaa

SEQ ID NO: 1228817 - RNA, 22 nt, Human
gagaagcaaguaaaaaggcuaa

SEQ ID NO: 1228818 - RNA, 20 nt, Human
gagcagagcugauggagaag

SEQ ID NO: 1228819 - RNA, 23 nt, Human
gagcagagcugauggagaaggaa

SEQ ID NO: 1228820 - RNA, 20 nt, Human
gagccaggaagaucccccag

SEQ ID NO: 1228821 - RNA, 21 nt, Human
gagccaggaagaucccccaga

SEQ ID NO: 1228822 - RNA, 18 nt, Human
gagcccacuguacuugcu

SEQ ID NO: 1228823 - RNA, 21 nt, Human
gagcccacuguacuugcucuu

SEQ ID NO: 1228824 - RNA, 23 nt, Human
gagcccacuguacuugcucuuga

SEQ ID NO: 1228825 - RNA, 18 nt, Human
gaggaagccugauuaaag

SEQ ID NO: 1228826 - RNA, 19 nt, Human
gaggaagccugauuaaaga

SEQ ID NO: 1228827 - RNA, 14 nt, Human
gagcuuuuguagaa

SEQ ID NO: 1228828 - RNA, 15 nt, Human
gagcugauggagaag

SEQ ID NO: 1228829 - RNA, 16 nt, Human
gagcugauggagaagg

SEQ ID NO: 1228830 - RNA, 18 nt, Human
gagcugauggagaaggaa

SEQ ID NO: 1228831 - RNA, 16 nt, Human
gagcucgugggacagu

SEQ ID NO: 1228832 - RNA, 21 nt, Human
gaucaaguuauuuuuaauuug

SEQ ID NO: 1228833 - RNA, 14 nt, Human
gaucaguuaacuau

SEQ ID NO: 1228834 - RNA, 14 nt, Human
gaucauugugaaau

SEQ ID NO: 1228835 - RNA, 20 nt, Human
gaucauugugaaauuauuca

SEQ ID NO: 1228836 - RNA, 12 nt, Human
gaucccccagaa

SEQ ID NO: 1228837 - RNA, 19 nt, Human
gauaaaguugguaaaccuu

SEQ ID NO: 1228838 - RNA, 11 nt, Human
gauacagaaaa

SEQ ID NO: 1228839 - RNA, 13 nt, Human
gauccuggaaauc

SEQ ID NO: 1228840 - RNA, 12 nt, Human
gaucucagcuca

SEQ ID NO: 1228841 - RNA, 17 nt, Human
gaucucagcucacuaca

SEQ ID NO: 1228842 - RNA, 17 nt, Human
gaucucagcucacugca

SEQ ID NO: 1228843 - RNA, 19 nt, Human
gaucucagcucacugcaac

SEQ ID NO: 1228844 - RNA, 10 nt, Human
gcaagccaga

SEQ ID NO: 1228845 - RNA, 20 nt, Human
gcaaggccugguguuucuug

SEQ ID NO: 1228846 - RNA, 20 nt, Human
gcaauccucccacuucagcc

SEQ ID NO: 1228847 - RNA, 21 nt, Human
gcaaacaggaucaguuaacua

SEQ ID NO: 1228848 - RNA, 18 nt, Human
gauggggguuucaccaua

SEQ ID NO: 1228849 - RNA, 19 nt, Human
gauuccagagcacugcucc

SEQ ID NO: 1228850 - RNA, 13 nt, Human
gauuuuauuaugu

SEQ ID NO: 1228851 - RNA, 15 nt, Human
gauuuuauuauguaa

SEQ ID NO: 1228852 - RNA, 18 nt, Human
gauuuuauuauguaaauc

SEQ ID NO: 1228853 - RNA, 19 nt, Human
gauuuuauuauguaaaucc

SEQ ID NO: 1228854 - RNA, 20 nt, Human
gauuuuauuauguaaauccc

SEQ ID NO: 1228855 - RNA, 23 nt, Human
gauuuuauuauguaaaucccauu

SEQ ID NO: 1228856 - RNA, 15 nt, Human
gauuuuccugaaaac

SEQ ID NO: 1228857 - RNA, 22 nt, Human
gauuuggucaacacuaacauga

SEQ ID NO: 1228858 - RNA, 14 nt, Human
gauuucugaggaaa

SEQ ID NO: 1228859 - RNA, 15 nt, Human
gauuuccagccuucu

SEQ ID NO: 1228860 - RNA, 14 nt, Human
gcacggcagccaca

SEQ ID NO: 1228861 - RNA, 16 nt, Human
gcacggcagccacagc

SEQ ID NO: 1228862 - RNA, 18 nt, Human
gcacggugaauggcuuug

SEQ ID NO: 1228863 - RNA, 20 nt, Human
gcagcccugcugcugccugc

SEQ ID NO: 1228864 - RNA, 21 nt, Human
gcagcccugcugcugccugcc

SEQ ID NO: 1228865 - RNA, 17 nt, Human
gcagcaauuuaaauguu

SEQ ID NO: 1228866 - RNA, 12 nt, Human
gcagcaauuuaa

SEQ ID NO: 1228867 - RNA, 15 nt, Human
gcagcaauuuaaaug

SEQ ID NO: 1228868 - RNA, 16 nt, Human
gcagcaauuuaaaugu

SEQ ID NO: 1228869 - RNA, 17 nt, Human
gcagacauuuuaaaaaa

SEQ ID NO: 1228870 - RNA, 18 nt, Human
gcagauuauucacugauu

SEQ ID NO: 1228871 - RNA, 15 nt, Human
gcaguucugaagaag

SEQ ID NO: 1228872 - RNA, 17 nt, Human
gcaguucugaagaagau

SEQ ID NO: 1228873 - RNA, 13 nt, Human
gcauagaaguaaa

SEQ ID NO: 1228874 - RNA, 22 nt, Human
gcaguggcgugaucucagcuca

SEQ ID NO: 1228875 - RNA, 18 nt, Human
gcaguggcgcgaucucag

SEQ ID NO: 1228876 - RNA, 22 nt, Human
gcaguggcgcgaucucagcuca

SEQ ID NO: 1228877 - RNA, 17 nt, Human
gcauagguuuaauaauu

SEQ ID NO: 1228878 - RNA, 22 nt, Human
gcaguggcaucaucucagcuca

SEQ ID NO: 1228879 - RNA, 13 nt, Human
gcauuauauuuau

SEQ ID NO: 1228880 - RNA, 16 nt, Human
gcaucugaaaauugau

SEQ ID NO: 1228881 - RNA, 16 nt, Human
gcauuuguguugaaga

SEQ ID NO: 1228882 - RNA, 19 nt, Human
gcauucaaauguauuacag

SEQ ID NO: 1228883 - RNA, 20 nt, Human
gccccuggucccucugcagu

SEQ ID NO: 1228884 - RNA, 23 nt, Human
gccaggcugggucgcccuggacu

SEQ ID NO: 1228885 - RNA, 17 nt, Human
gccaggcugggucgccc

SEQ ID NO: 1228886 - RNA, 15 nt, Human
gccaugcagaaagca

SEQ ID NO: 1228887 - RNA, 14 nt, Human
gcccugcuuucaga

SEQ ID NO: 1228888 - RNA, 16 nt, Human
gcccugcuuucagaua

SEQ ID NO: 1228889 - RNA, 22 nt, Human
gccuaaauccauuuggaaaucu

SEQ ID NO: 1228890 - RNA, 23 nt, Human
gccuaaauccauuuggaaaucuu

SEQ ID NO: 1228891 - RNA, 12 nt, Human
gccuaaauccau

SEQ ID NO: 1228892 - RNA, 13 nt, Human
gccuaaauccauu

SEQ ID NO: 1228893 - RNA, 19 nt, Human
gccuaaauccauuuggaaa

SEQ ID NO: 1228894 - RNA, 21 nt, Human
gccuaaauccauuuggaaauc

SEQ ID NO: 1228895 - RNA, 14 nt, Human
gccucccagguuca

SEQ ID NO: 1228896 - RNA, 15 nt, Human
gccucccuucaugca

SEQ ID NO: 1228897 - RNA, 18 nt, Human
gccucccuucaugcaugg

SEQ ID NO: 1228898 - RNA, 20 nt, Human
gccucccuucaugcauggaa

SEQ ID NO: 1228899 - RNA, 22 nt, Human
gccucccuucaugcauggaaau

SEQ ID NO: 1228900 - RNA, 23 nt, Human
gccucccuucaugcauggaaauu

SEQ ID NO: 1228901 - RNA, 12 nt, Human
gccuguuuaaga

SEQ ID NO: 1228902 - RNA, 13 nt, Human
gccuguuuaagag

SEQ ID NO: 1228903 - RNA, 13 nt, Human
gccuuuggcaggu

SEQ ID NO: 1228904 - RNA, 15 nt, Human
gccuuuggcaggugc

SEQ ID NO: 1228905 - RNA, 16 nt, Human
gccuuugaccugccuc

SEQ ID NO: 1228906 - RNA, 13 nt, Human
gcuaaacuuuucu

SEQ ID NO: 1228907 - RNA, 15 nt, Human
gcuaaacuuuucuga

SEQ ID NO: 1228908 - RNA, 17 nt, Human
gcuaaacuuuucugaua

SEQ ID NO: 1228909 - RNA, 15 nt, Human
gcgcgaucucagcuc

SEQ ID NO: 1228910 - RNA, 16 nt, Human
gcgcgaucucagcuca

SEQ ID NO: 1228911 - RNA, 13 nt, Human
uuuugaaaaacug

SEQ ID NO: 1228912 - RNA, 21 nt, Human
uuuuggcauaacauaaaucug

SEQ ID NO: 1228913 - RNA, 18 nt, Human
uuuuggucuggagggaag

SEQ ID NO: 1228914 - RNA, 14 nt, Human
uuuuccugaaaacc

SEQ ID NO: 1228915 - RNA, 18 nt, Human
uuuucuaaaguaaaaaca

SEQ ID NO: 1228916 - RNA, 18 nt, Human
uuuuuaaaaaagaaacau

SEQ ID NO: 1228917 - RNA, 12 nt, Human
uuuuuaaagacu

SEQ ID NO: 1228918 - RNA, 13 nt, Human
uuuuuaaagacuu

SEQ ID NO: 1228919 - RNA, 18 nt, Human
uuuuuaaagacuuuuaug

SEQ ID NO: 1228920 - RNA, 23 nt, Human
uuuuucucugauacagaaaaguu

SEQ ID NO: 1228921 - RNA, 19 nt, Human
uuuuucucuaggaaauauu

SEQ ID NO: 1228922 - RNA, 15 nt, Human
uuuuugaagcuguau

SEQ ID NO: 1228923 - RNA, 10 nt, Human
uuuuuugaga

SEQ ID NO: 1228924 - RNA, 16 nt, Human
uuuuuugggcagcaau

SEQ ID NO: 1228925 - RNA, 20 nt, Human
uuuuugaaaagcagacauuu

SEQ ID NO: 1228926 - RNA, 12 nt, Human
uuuuaaauguau

SEQ ID NO: 1228927 - RNA, 16 nt, Human
uuuuaaauguauacua

SEQ ID NO: 1228928 - RNA, 18 nt, Human
uuuuaaagacuuuuauga

SEQ ID NO: 1228929 - RNA, 21 nt, Human
uuuuaaaagaaugauuaugaa

SEQ ID NO: 1228930 - RNA, 22 nt, Human
uuuggaauuuuccuccuuucuc

SEQ ID NO: 1228931 - RNA, 15 nt, Human
uuugcaucugaaaau

SEQ ID NO: 1228932 - RNA, 19 nt, Human
uuugguuuucacauuggaa

SEQ ID NO: 1228933 - RNA, 21 nt, Human
uuuggugcuucucagauuucu

SEQ ID NO: 1228934 - RNA, 16 nt, Human
uuuguauaaaauaauu

SEQ ID NO: 1228935 - RNA, 14 nt, Human
uuuguauaaaauaa

SEQ ID NO: 1228936 - RNA, 13 nt, Human
uuuguauaaaaua

SEQ ID NO: 1228937 - RNA, 19 nt, Human
uuuggacaaaauggaauac

SEQ ID NO: 1228938 - RNA, 16 nt, Human
uuuggauaauaaggaa

SEQ ID NO: 1228939 - RNA, 18 nt, Human
uuugaagcacagugauca

SEQ ID NO: 1228940 - RNA, 18 nt, Human
uuugaaucaucaagucuu

SEQ ID NO: 1228941 - RNA, 21 nt, Human
uuacauuuuuugggcagcaau

SEQ ID NO: 1228942 - RNA, 12 nt, Human
uuucuaaaguaa

SEQ ID NO: 1228943 - RNA, 14 nt, Human
uuucuaaaguaaaa

SEQ ID NO: 1228944 - RNA, 21 nt, Human
uuucugaaauuuccugggagc

SEQ ID NO: 1228945 - RNA, 18 nt, Human
uuucucugauacagaaaa

SEQ ID NO: 1228946 - RNA, 17 nt, Human
uuucucugauacagaaa

SEQ ID NO: 1228947 - RNA, 16 nt, Human
uuucucugauacagaa

SEQ ID NO: 1228948 - RNA, 15 nt, Human
uuucucugauacaga

SEQ ID NO: 1228949 - RNA, 13 nt, Human
guauauuacaaug

SEQ ID NO: 1228950 - RNA, 14 nt, Human
guauauuacaauga

SEQ ID NO: 1228951 - RNA, 15 nt, Human
guauauuacaaugau

SEQ ID NO: 1228952 - RNA, 12 nt, Human
guaucucuucag

SEQ ID NO: 1228953 - RNA, 13 nt, Human
guaucucuucagu

SEQ ID NO: 1228954 - RNA, 17 nt, Human
guaucucuucagucucu

SEQ ID NO: 1228955 - RNA, 19 nt, Human
guauagaaccucuuugucu

SEQ ID NO: 1228956 - RNA, 14 nt, Human
guauagauuagaau

SEQ ID NO: 1228957 - RNA, 19 nt, Human
guaugaacuugaggacaca

SEQ ID NO: 1228958 - RNA, 20 nt, Human
guaugaacuugaggacacau

SEQ ID NO: 1228959 - RNA, 22 nt, Human
guaugaacuugaggacacaugu

SEQ ID NO: 1228960 - RNA, 23 nt, Human
guaugaacuugaggacacauguc

SEQ ID NO: 1228961 - RNA, 17 nt, Human
guaugaaccaccgcgcc

SEQ ID NO: 1228962 - RNA, 15 nt, Human
guaugaacuugagga

SEQ ID NO: 1228963 - RNA, 16 nt, Human
guaugaacuugaggac

SEQ ID NO: 1228964 - RNA, 17 nt, Human
guauguuagugcaaauu

SEQ ID NO: 1228965 - RNA, 21 nt, Human
guagcauuuguguugaagagg

SEQ ID NO: 1228966 - RNA, 16 nt, Human
guagcauccuggaaua

SEQ ID NO: 1228967 - RNA, 19 nt, Human
guagaguugaucaaaauca

SEQ ID NO: 1228968 - RNA, 22 nt, Human
guaggggcuuauaauaaaggac

SEQ ID NO: 1228969 - RNA, 22 nt, Human
guaguagcguuuuuuaaaugua

SEQ ID NO: 1228970 - RNA, 17 nt, Human
guaguguuggagaagaa

SEQ ID NO: 1228971 - RNA, 13 nt, Human
guauaauuaacau

SEQ ID NO: 1228972 - RNA, 14 nt, Human
guauaauuaacaug

SEQ ID NO: 1228973 - RNA, 15 nt, Human
guaguguuggagaag

SEQ ID NO: 1228974 - RNA, 14 nt, Human
guaguguuggagaa

SEQ ID NO: 1228975 - RNA, 15 nt, Human
guauaauuaacaugu

SEQ ID NO: 1228976 - RNA, 17 nt, Human
guauaauuaacauguua

SEQ ID NO: 1228977 - RNA, 19 nt, Human
guauaauuaacauguuaaa

SEQ ID NO: 1228978 - RNA, 22 nt, Human
guauaauuaacauguuaaacca

SEQ ID NO: 1228979 - RNA, 17 nt, Human
guauaauucacauugua

SEQ ID NO: 1228980 - RNA, 23 nt, Human
guauaauuaacauguuaaaccau

SEQ ID NO: 1228981 - RNA, 15 nt, Human
guauacuauaguacc

SEQ ID NO: 1228982 - RNA, 16 nt, Human
gucagaucugccuaag

SEQ ID NO: 1228983 - RNA, 18 nt, Human
gucagaucugccuaagga

SEQ ID NO: 1228984 - RNA, 19 nt, Human
gucagaucugccuaaggac

SEQ ID NO: 1228985 - RNA, 20 nt, Human
gucagaucugccuaaggacu

SEQ ID NO: 1228986 - RNA, 21 nt, Human
gucagaucugccuaaggacuu

SEQ ID NO: 1228987 - RNA, 16 nt, Human
gucacuacgccuggcu

SEQ ID NO: 1228988 - RNA, 22 nt, Human
gucaauaaaauccauacauuug

SEQ ID NO: 1228989 - RNA, 23 nt, Human
gucaauaaaauccauacauuugu

SEQ ID NO: 1228990 - RNA, 13 nt, Human
gucaccagagacu

SEQ ID NO: 1228991 - RNA, 16 nt, Human
gucaccagagacuuua

SEQ ID NO: 1228992 - RNA, 20 nt, Human
guauuuuaaaagaaugauua

SEQ ID NO: 1228993 - RNA, 15 nt, Human
guauuaagcauauau

SEQ ID NO: 1228994 - RNA, 16 nt, Human
guauuaagcauauauu

SEQ ID NO: 1228995 - RNA, 17 nt, Human
guauuaagcauauauuu

SEQ ID NO: 1228996 - RNA, 18 nt, Human
guauuaagcauauauuuu

SEQ ID NO: 1228997 - RNA, 21 nt, Human
guauuaagcauauauuuuuau

SEQ ID NO: 1228998 - RNA, 13 nt, Human
gucaggaaagaga

SEQ ID NO: 1228999 - RNA, 21 nt, Human
gucauucagauaugauucaaa

SEQ ID NO: 1229000 - RNA, 15 nt, Human
gucccaucccugcgu

SEQ ID NO: 1229001 - RNA, 16 nt, Human
gucccuaauaaagcug

SEQ ID NO: 1229002 - RNA, 17 nt, Human
gucccuaauaaagcugu

SEQ ID NO: 1229003 - RNA, 18 nt, Human
gucccuaauaaagcugug

SEQ ID NO: 1229004 - RNA, 20 nt, Human
gucccuaauaaagcugugug

SEQ ID NO: 1229005 - RNA, 19 nt, Human
gucucuucugaauaaagca

SEQ ID NO: 1229006 - RNA, 20 nt, Human
gucucuucugaauaaagcaa

SEQ ID NO: 1229007 - RNA, 21 nt, Human
gucucuucugaauaaagcaau

SEQ ID NO: 1229008 - RNA, 22 nt, Human
gucucuucugaauaaagcaauu

SEQ ID NO: 1229009 - RNA, 23 nt, Human
gucucuucugaauaaagcaauua

SEQ ID NO: 1229010 - RNA, 21 nt, Human
gucucuggauuauauuaugaa

SEQ ID NO: 1229011 - RNA, 19 nt, Human
gucucugaggggcuaccag

SEQ ID NO: 1229012 - RNA, 17 nt, Human
gucucuggaauuugaaa

SEQ ID NO: 1229013 - RNA, 15 nt, Human
gucucagauuuuauu

SEQ ID NO: 1229014 - RNA, 16 nt, Human
gucucagauuuuauua

SEQ ID NO: 1229015 - RNA, 17 nt, Human
gucucagauuuuauuau

SEQ ID NO: 1229016 - RNA, 21 nt, Human
gucucagauuuuauuauguaa

SEQ ID NO: 1229017 - RNA, 17 nt, Human
gucucuauaccaauaaa

SEQ ID NO: 1229018 - RNA, 18 nt, Human
gucucuauaccaauaaag

SEQ ID NO: 1229019 - RNA, 19 nt, Human
gucucuauaccaauaaagu

SEQ ID NO: 1229020 - RNA, 20 nt, Human
gucucuauaccaauaaagug

SEQ ID NO: 1229021 - RNA, 18 nt, Human
gucgucaaagcugaaaug

SEQ ID NO: 1229022 - RNA, 15 nt, Human
gucuugccuuuuuca

SEQ ID NO: 1229023 - RNA, 16 nt, Human
gucuugccuuuuucau

SEQ ID NO: 1229024 - RNA, 17 nt, Human
gucuugccuuuuucauu

SEQ ID NO: 1229025 - RNA, 18 nt, Human
gucuugccuuuuucauua

SEQ ID NO: 1229026 - RNA, 20 nt, Human
gucuugccuuuuucauuauu

SEQ ID NO: 1229027 - RNA, 15 nt, Human
gucuugucucagauu

SEQ ID NO: 1229028 - RNA, 20 nt, Human
gucuugucucagauuuuauu

SEQ ID NO: 1229029 - RNA, 22 nt, Human
gucuugucucagauuuuauuau

SEQ ID NO: 1229030 - RNA, 19 nt, Human
gugauauaaguguguguuu

SEQ ID NO: 1229031 - RNA, 14 nt, Human
gugagcuacaaaug

SEQ ID NO: 1229032 - RNA, 18 nt, Human
gugaggagcuugaaaccc

SEQ ID NO: 1229033 - RNA, 17 nt, Human
gugcgcuaaacuuuucu

SEQ ID NO: 1229034 - RNA, 21 nt, Human
gugcgcuaaacuuuucugaua

SEQ ID NO: 1229035 - RNA, 12 nt, Human
gugcuaaggacu

SEQ ID NO: 1229036 - RNA, 13 nt, Human
gugcuaaggacuu

SEQ ID NO: 1229037 - RNA, 14 nt, Human
gugcuaaggacuug

SEQ ID NO: 1229038 - RNA, 20 nt, Human
gugcuaaggacuuguuagau

SEQ ID NO: 1229039 - RNA, 19 nt, Human
gugcagcccccacugccuu

SEQ ID NO: 1229040 - RNA, 20 nt, Human
gugauccacccgccucagcc

SEQ ID NO: 1229041 - RNA, 24 nt, Human
gugauccacccgccucagccuccc

SEQ ID NO: 1229042 - RNA, 13 nt, Human
gugcacuggcccc

SEQ ID NO: 1229043 - RNA, 16 nt, Human
gugcacuggccccacc

SEQ ID NO: 1229044 - RNA, 17 nt, Human
gugcacuggccccaccc

SEQ ID NO: 1229045 - RNA, 18 nt, Human
gugcacuggccccacccu

SEQ ID NO: 1229046 - RNA, 13 nt, Human
gugcuaauuuuga

SEQ ID NO: 1229047 - RNA, 15 nt, Human
gugcuaauuuugaaa

SEQ ID NO: 1229048 - RNA, 15 nt, Human
gugggcauucaaaug

SEQ ID NO: 1229049 - RNA, 13 nt, Human
gugguagagaagc

SEQ ID NO: 1229050 - RNA, 13 nt, Human
guggugacuuugg

SEQ ID NO: 1229051 - RNA, 15 nt, Human
guggugacuuuggau

SEQ ID NO: 1229052 - RNA, 21 nt, Human
guguaaguagauaggccaugg

SEQ ID NO: 1229053 - RNA, 17 nt, Human
guguaagacaaaaagcu

SEQ ID NO: 1229054 - RNA, 16 nt, Human
guggugacuuuggaua

SEQ ID NO: 1229055 - RNA, 14 nt, Human
guguaugcacagua

SEQ ID NO: 1229056 - RNA, 13 nt, Human
guguguuuuaaaa

SEQ ID NO: 1229057 - RNA, 16 nt, Human
guguguuuuaaaauga

SEQ ID NO: 1229058 - RNA, 19 nt, Human
guguguuuuaaaaugagaa

SEQ ID NO: 1229059 - RNA, 14 nt, Human
guguguuuuucaua

SEQ ID NO: 1229060 - RNA, 13 nt, Human
guguucugugaua

SEQ ID NO: 1229061 - RNA, 18 nt, Human
guguuuuucauaaagcag

SEQ ID NO: 1229062 - RNA, 13 nt, Human
guuacagaagccc

SEQ ID NO: 1229063 - RNA, 17 nt, Human
guuaacuauugcauuua

SEQ ID NO: 1229064 - RNA, 18 nt, Human
guuaaaccaugggauaaa

SEQ ID NO: 1229065 - RNA, 21 nt, Human
guuaaaccaugggauaaaugc

SEQ ID NO: 1229066 - RNA, 18 nt, Human
gugugcucaggagcccug

SEQ ID NO: 1229067 - RNA, 19 nt, Human
gugugcucaggagcccugg

SEQ ID NO: 1229068 - RNA, 16 nt, Human
gugugcucaggagccc

SEQ ID NO: 1229069 - RNA, 17 nt, Human
gugugcucaggagcccu

SEQ ID NO: 1229070 - RNA, 12 nt, Human
guguguuuuaaa

SEQ ID NO: 1229071 - RNA, 13 nt, Human
guucauuccucca

SEQ ID NO: 1229072 - RNA, 14 nt, Human
guucauuccuccag

SEQ ID NO: 1229073 - RNA, 15 nt, Human
guucauuccuccagg

SEQ ID NO: 1229074 - RNA, 12 nt, Human
guucaugaaaga

SEQ ID NO: 1229075 - RNA, 22 nt, Human
guucauggaacgcguugaaauu

SEQ ID NO: 1229076 - RNA, 23 nt, Human
guucauggaacgcguugaaauug

SEQ ID NO: 1229077 - RNA, 19 nt, Human
guucacucuccauuuaaua

SEQ ID NO: 1229078 - RNA, 17 nt, Human
guuauuauauuuacaaa

SEQ ID NO: 1229079 - RNA, 17 nt, Human
guuaugacuauguaaac

SEQ ID NO: 1229080 - RNA, 15 nt, Human
guuaugacuauguaa

SEQ ID NO: 1229081 - RNA, 20 nt, Human
guuauccaccugccuuggcu

SEQ ID NO: 1229082 - RNA, 19 nt, Human
guuaucuaauagggcaauu

SEQ ID NO: 1229083 - RNA, 19 nt, Human
guuaucugaagucagaucu

SEQ ID NO: 1229084 - RNA, 16 nt, Human
guuacccaaauuaaga

SEQ ID NO: 1229085 - RNA, 23 nt, Human
guuaccucugccucagaaaacaa

SEQ ID NO: 1229086 - RNA, 14 nt, Human
guuggagugcagug

SEQ ID NO: 1229087 - RNA, 15 nt, Human
guuggagugcagugg

SEQ ID NO: 1229088 - RNA, 23 nt, Human
guugcagcccugcugcugccugc

SEQ ID NO: 1229089 - RNA, 16 nt, Human
guugcaacuuuguaua

SEQ ID NO: 1229090 - RNA, 14 nt, Human
guugcaacuuugua

SEQ ID NO: 1229091 - RNA, 18 nt, Human
guugaagagguuuuaaag

SEQ ID NO: 1229092 - RNA, 21 nt, Human
guugaaacggaugauuucuau

SEQ ID NO: 1229093 - RNA, 22 nt, Human
guugaaacggaugauuucuaug

SEQ ID NO: 1229094 - RNA, 15 nt, Human
guugaaauuguaauu

SEQ ID NO: 1229095 - RNA, 16 nt, Human
guugaaauuguaauua

SEQ ID NO: 1229096 - RNA, 20 nt, Human
guugaaauuguaauuauauc

SEQ ID NO: 1229097 - RNA, 21 nt, Human
guugauggugguauguuuuca

SEQ ID NO: 1229098 - RNA, 20 nt, Human
guugauggugguauguuuuc

SEQ ID NO: 1229099 - RNA, 21 nt, Human
guugaauuuauuggcuuuucu

SEQ ID NO: 1229100 - RNA, 22 nt, Human
guugaauuuauuggcuuuucug

SEQ ID NO: 1229101 - RNA, 14 nt, Human
guugaauuuauugg

SEQ ID NO: 1229102 - RNA, 15 nt, Human
guucugaagaagaug

SEQ ID NO: 1229103 - RNA, 14 nt, Human
guucugaagaagau

SEQ ID NO: 1229104 - RNA, 13 nt, Human
guucugaagaaga

SEQ ID NO: 1229105 - RNA, 12 nt, Human
guucugaagaag

SEQ ID NO: 1229106 - RNA, 18 nt, Human
guuccuuggccaugcaga

SEQ ID NO: 1229107 - RNA, 18 nt, Human
uaaaauccauacauuugu

SEQ ID NO: 1229108 - RNA, 15 nt, Human
uaaacacucuugaaa

SEQ ID NO: 1229109 - RNA, 17 nt, Human
uaaacacucuugaaaaa

SEQ ID NO: 1229110 - RNA, 18 nt, Human
uaaacacucuugaaaaau

SEQ ID NO: 1229111 - RNA, 18 nt, Human
uaaagcaggcagaacuca

SEQ ID NO: 1229112 - RNA, 11 nt, Human
uaaagccaugu

SEQ ID NO: 1229113 - RNA, 13 nt, Human
uaaagccauguuu

SEQ ID NO: 1229114 - RNA, 15 nt, Human
uaaagccauguuuau

SEQ ID NO: 1229115 - RNA, 20 nt, Human
uaaagccauguuuauuacag

SEQ ID NO: 1229116 - RNA, 14 nt, Human
uaaaguguuugaaa

SEQ ID NO: 1229117 - RNA, 14 nt, Human
uaaaggaauuuaaa

SEQ ID NO: 1229118 - RNA, 22 nt, Human
uaaaacaagcacuaaacaaaga

SEQ ID NO: 1229119 - RNA, 21 nt, Human
uaaaaacaaagaaauuaugug

SEQ ID NO: 1229120 - RNA, 21 nt, Human
uaaaaggaaagaaaacaucuu

SEQ ID NO: 1229121 - RNA, 17 nt, Human
uaaaauccauacauuug

SEQ ID NO: 1229122 - RNA, 15 nt, Human
uaaaauccauacauu

SEQ ID NO: 1229123 - RNA, 13 nt, Human
guuuggugcuucu

SEQ ID NO: 1229124 - RNA, 19 nt, Human
guuucuuuguaaugaaaac

SEQ ID NO: 1229125 - RNA, 17 nt, Human
guuuccuccaagcuauu

SEQ ID NO: 1229126 - RNA, 15 nt, Human
guuuuaaaaugagaa

SEQ ID NO: 1229127 - RNA, 16 nt, Human
guuuuaaaaugagaaa

SEQ ID NO: 1229128 - RNA, 20 nt, Human
guuuucaaaauuguuacaaa

SEQ ID NO: 1229129 - RNA, 17 nt, Human
guuuuaaaaugagaaau

SEQ ID NO: 1229130 - RNA, 19 nt, Human
guugucugcaacucugaag

SEQ ID NO: 1229131 - RNA, 20 nt, Human
guuuauauaagcuuguauuc

SEQ ID NO: 1229132 - RNA, 19 nt, Human
guuuaggaacuacugagga

SEQ ID NO: 1229133 - RNA, 21 nt, Human
guuuagcuggaaaaguauguu

SEQ ID NO: 1229134 - RNA, 22 nt, Human
guuucauauuuuucauagcuaa

SEQ ID NO: 1229135 - RNA, 13 nt, Human
uaaccagaucauu

SEQ ID NO: 1229136 - RNA, 15 nt, Human
uaacuauugcauuua

SEQ ID NO: 1229137 - RNA, 16 nt, Human
uaacuauugcauuuau

SEQ ID NO: 1229138 - RNA, 21 nt, Human
uaacuauugcauuuauaugua

SEQ ID NO: 1229139 - RNA, 23 nt, Human
uaacuauugcauuuauauguacc

SEQ ID NO: 1229140 - RNA, 15 nt, Human
uaacuggaaacuuca

SEQ ID NO: 1229141 - RNA, 21 nt, Human
uaagaaaauaucacuugucaa

SEQ ID NO: 1229142 - RNA, 13 nt, Human
uaagagagaauga

SEQ ID NO: 1229143 - RNA, 23 nt, Human
uaagagagaaugagagacacacu

SEQ ID NO: 1229144 - RNA, 14 nt, Human
uaagagagaaugag

SEQ ID NO: 1229145 - RNA, 16 nt, Human
uaaaugccaucaauaa

SEQ ID NO: 1229146 - RNA, 23 nt, Human
uaaaugccaucaauaaaaaauua

SEQ ID NO: 1229147 - RNA, 16 nt, Human
uaaaguugguaaaccu

SEQ ID NO: 1229148 - RNA, 17 nt, Human
uaaaguugguaaaccuu

SEQ ID NO: 1229149 - RNA, 20 nt, Human
uaaauggcuuccuggcaaua

SEQ ID NO: 1229150 - RNA, 15 nt, Human
uaaauguauacuaua

SEQ ID NO: 1229151 - RNA, 17 nt, Human
uaaauguauacuauagu

SEQ ID NO: 1229152 - RNA, 20 nt, Human
uaaauguauacuauaguacc

SEQ ID NO: 1229153 - RNA, 12 nt, Human
uaaauguauacu

SEQ ID NO: 1229154 - RNA, 13 nt, Human
uaaauguauacua

SEQ ID NO: 1229155 - RNA, 13 nt, Human
uaaauucuuucau

SEQ ID NO: 1229156 - RNA, 21 nt, Human
uaauuaacauguuaaaccaug

SEQ ID NO: 1229157 - RNA, 23 nt, Human
uaaugauaacuggaaacuucagc

SEQ ID NO: 1229158 - RNA, 22 nt, Human
uaaugauaacuggaaacuucag

SEQ ID NO: 1229159 - RNA, 17 nt, Human
uaaugauaacuggaaac

SEQ ID NO: 1229160 - RNA, 17 nt, Human
uaauauuaaagccaugu

SEQ ID NO: 1229161 - RNA, 20 nt, Human
uaauauuaaagccauguuua

SEQ ID NO: 1229162 - RNA, 21 nt, Human
uaauauuaaagccauguuuau

SEQ ID NO: 1229163 - RNA, 16 nt, Human
uaauauuaaagccaug

SEQ ID NO: 1229164 - RNA, 14 nt, Human
uaauaauguuucaa

SEQ ID NO: 1229165 - RNA, 19 nt, Human
uaaggggaggaaccagagu

SEQ ID NO: 1229166 - RNA, 14 nt, Human
uaaggcaaucaugg

SEQ ID NO: 1229167 - RNA, 12 nt, Human
uaauaaagcugu

SEQ ID NO: 1229168 - RNA, 12 nt, Human
uaauaaaggacu

SEQ ID NO: 1229169 - RNA, 13 nt, Human
uaauaaaggacug

SEQ ID NO: 1229170 - RNA, 16 nt, Human
uaauaaaggacuguaa

SEQ ID NO: 1229171 - RNA, 20 nt, Human
uaauaaaggacuguaaucuu

SEQ ID NO: 1229172 - RNA, 16 nt, Human
uaauaaggaaaaguuu

SEQ ID NO: 1229173 - RNA, 18 nt, Human
uaauaaggaaaaguuuaa

SEQ ID NO: 1229174 - RNA, 22 nt, Human
uaagugauugcugguuuuaguu

SEQ ID NO: 1229175 - RNA, 12 nt, Human
uaaguccagugu

SEQ ID NO: 1229176 - RNA, 14 nt, Human
uacugccuauuuua

SEQ ID NO: 1229177 - RNA, 21 nt, Human
uacugccuauuuuaauaaaca

SEQ ID NO: 1229178 - RNA, 20 nt, Human
uacuugcucuugaugccugg

SEQ ID NO: 1229179 - RNA, 14 nt, Human
uacuugcucuugau

SEQ ID NO: 1229180 - RNA, 18 nt, Human
uacuugcucuugaugccu

SEQ ID NO: 1229181 - RNA, 19 nt, Human
uacuugcucuugaugccug

SEQ ID NO: 1229182 - RNA, 13 nt, Human
uacugcuuaauuc

SEQ ID NO: 1229183 - RNA, 19 nt, Human
uacugcuuaauucaaauaa

SEQ ID NO: 1229184 - RNA, 20 nt, Human
uacugcuuaauucaaauaau

SEQ ID NO: 1229185 - RNA, 15 nt, Human
uacugcucuccucca

SEQ ID NO: 1229186 - RNA, 23 nt, Human
uaccucuccagccucagcucuca

SEQ ID NO: 1229187 - RNA, 17 nt, Human
uacuaaaauggacugug

SEQ ID NO: 1229188 - RNA, 23 nt, Human
uacuaaaauggacuguggugacu

SEQ ID NO: 1229189 - RNA, 20 nt, Human
uaccguaggcuuuguauuca

SEQ ID NO: 1229190 - RNA, 23 nt, Human
uacauggcuggagcuagaauuug

SEQ ID NO: 1229191 - RNA, 20 nt, Human
uacauuuuuugggcagcaau

SEQ ID NO: 1229192 - RNA, 22 nt, Human
uaccaaaaaucucaauauuuca

SEQ ID NO: 1229193 - RNA, 12 nt, Human
uacaaaguauua

SEQ ID NO: 1229194 - RNA, 13 nt, Human
uacaaaguauuaa

SEQ ID NO: 1229195 - RNA, 14 nt, Human
uacaaaguauuaag

SEQ ID NO: 1229196 - RNA, 15 nt, Human
uacaaaguauuaagc

SEQ ID NO: 1229197 - RNA, 16 nt, Human
uacaaaguauuaagca

SEQ ID NO: 1229198 - RNA, 18 nt, Human
uacaaaguauuaagcaua

SEQ ID NO: 1229199 - RNA, 19 nt, Human
uacaaaguauuaagcauau

SEQ ID NO: 1229200 - RNA, 17 nt, Human
uaauuuuuauauuugaa

SEQ ID NO: 1229201 - RNA, 16 nt, Human
uaauuuuuauauuuga

SEQ ID NO: 1229202 - RNA, 12 nt, Human
uaauuuuuauau

SEQ ID NO: 1229203 - RNA, 18 nt, Human
uaauuuugugaagcaaaa

SEQ ID NO: 1229204 - RNA, 14 nt, Human
uaauuccuucagca

SEQ ID NO: 1229205 - RNA, 21 nt, Human
uaauuccuucagcacuuuaga

SEQ ID NO: 1229206 - RNA, 20 nt, Human
uaauuccuucagcacuuuag

SEQ ID NO: 1229207 - RNA, 17 nt, Human
uacaauuuuguuucugu

SEQ ID NO: 1229208 - RNA, 18 nt, Human
uacaauuuuguuucugua

SEQ ID NO: 1229209 - RNA, 12 nt, Human
uacaauuuuguu

SEQ ID NO: 1229210 - RNA, 15 nt, Human
uacaauuuuguuucu

SEQ ID NO: 1229211 - RNA, 16 nt, Human
uacaauuuuguuucug

SEQ ID NO: 1229212 - RNA, 15 nt, Human
uacaacggagucaaa

SEQ ID NO: 1229213 - RNA, 22 nt, Human
uacaacggagucaaaaauuaaa

SEQ ID NO: 1229214 - RNA, 15 nt, Human
uacaaccuccgccuc

SEQ ID NO: 1229215 - RNA, 14 nt, Human
uacaggauuugaaa

SEQ ID NO: 1229216 - RNA, 20 nt, Human
uacaggaugaugacuaugga

SEQ ID NO: 1229217 - RNA, 23 nt, Human
uacaguucggugagcuacaaaug

SEQ ID NO: 1229218 - RNA, 18 nt, Human
uacaguuuugaguagagu

SEQ ID NO: 1229219 - RNA, 21 nt, Human
uacauggcuggagcuagaauu

SEQ ID NO: 1229220 - RNA, 13 nt, Human
uagagaagcaagu

SEQ ID NO: 1229221 - RNA, 16 nt, Human
uagagaagcaaguaaa

SEQ ID NO: 1229222 - RNA, 11 nt, Human
uagaauucugu

SEQ ID NO: 1229223 - RNA, 13 nt, Human
uagaauucuguau

SEQ ID NO: 1229224 - RNA, 14 nt, Human
uagaauucuguaua

SEQ ID NO: 1229225 - RNA, 15 nt, Human
uagaauucuguauag

SEQ ID NO: 1229226 - RNA, 16 nt, Human
uagaauucuguauaga

SEQ ID NO: 1229227 - RNA, 21 nt, Human
uagaauucuguauagauuaga

SEQ ID NO: 1229228 - RNA, 20 nt, Human
uagacuggugacugauucuu

SEQ ID NO: 1229229 - RNA, 21 nt, Human
uagacuggugacugauucuuc

SEQ ID NO: 1229230 - RNA, 23 nt, Human
uagacuggugacugauucuucag

SEQ ID NO: 1229231 - RNA, 23 nt, Human
uagaauaccacaggaaccacaag

SEQ ID NO: 1229232 - RNA, 23 nt, Human
uagaauacaguuuugaguagagu

SEQ ID NO: 1229233 - RNA, 13 nt, Human
uagaauaugccuu

SEQ ID NO: 1229234 - RNA, 16 nt, Human
uagccccucuccugga

SEQ ID NO: 1229235 - RNA, 14 nt, Human
uagauaggccaugg

SEQ ID NO: 1229236 - RNA, 17 nt, Human
uagauaggccaugggca

SEQ ID NO: 1229237 - RNA, 14 nt, Human
uagauuagaauucu

SEQ ID NO: 1229238 - RNA, 15 nt, Human
uagauuagaauucug

SEQ ID NO: 1229239 - RNA, 16 nt, Human
uagauuagaauucugu

SEQ ID NO: 1229240 - RNA, 17 nt, Human
uagauuagaauucugua

SEQ ID NO: 1229241 - RNA, 19 nt, Human
uagauuagaauucuguaua

SEQ ID NO: 1229242 - RNA, 20 nt, Human
uagauuagaauucuguauag

SEQ ID NO: 1229243 - RNA, 20 nt, Human
uagauuagagaguguugaaa

SEQ ID NO: 1229244 - RNA, 18 nt, Human
uagcauccuggaauaucu

SEQ ID NO: 1229245 - RNA, 16 nt, Human
uagcauccuggaauau

SEQ ID NO: 1229246 - RNA, 15 nt, Human
uagcauccuggaaua

SEQ ID NO: 1229247 - RNA, 13 nt, Human
uagcauccuggaa

SEQ ID NO: 1229248 - RNA, 19 nt, Human
uaguagcguuuuuuaaaug

SEQ ID NO: 1229249 - RNA, 21 nt, Human
uaguagcguuuuuuaaaugua

SEQ ID NO: 1229250 - RNA, 23 nt, Human
uaguagcguuuuuuaaauguaua

SEQ ID NO: 1229251 - RNA, 17 nt, Human
uaguucuuacugcuuaa

SEQ ID NO: 1229252 - RNA, 16 nt, Human
uaguauuucuaugaaa

SEQ ID NO: 1229253 - RNA, 17 nt, Human
uaguauuguccaggucu

SEQ ID NO: 1229254 - RNA, 18 nt, Human
uauaaaccgaacugaugu

SEQ ID NO: 1229255 - RNA, 16 nt, Human
uauaugcuucuguuuu

SEQ ID NO: 1229256 - RNA, 14 nt, Human
uauaugcuucuguu

SEQ ID NO: 1229257 - RNA, 20 nt, Human
uauauuuuuuucugaaauuu

SEQ ID NO: 1229258 - RNA, 19 nt, Human
uauauuuuuuucugaaauu

SEQ ID NO: 1229259 - RNA, 16 nt, Human
uauauuuuuuucugaa

SEQ ID NO: 1229260 - RNA, 18 nt, Human
uauauuuuuauauuuacu

SEQ ID NO: 1229261 - RNA, 16 nt, Human
uauauuuucauucucc

SEQ ID NO: 1229262 - RNA, 19 nt, Human
uauauaacaaugcuguauu

SEQ ID NO: 1229263 - RNA, 17 nt, Human
uauauaacaaugcugua

SEQ ID NO: 1229264 - RNA, 23 nt, Human
uauaucugaggaauucuguauag

SEQ ID NO: 1229265 - RNA, 12 nt, Human
uauaguacauga

SEQ ID NO: 1229266 - RNA, 13 nt, Human
uauaguacaugau

SEQ ID NO: 1229267 - RNA, 14 nt, Human
uauaguacaugaua

SEQ ID NO: 1229268 - RNA, 16 nt, Human
uauaguacaugauaaa

SEQ ID NO: 1229269 - RNA, 13 nt, Human
uauagaaagcuau

SEQ ID NO: 1229270 - RNA, 24 nt, Human
uauagaaagcuauauaagacaaga

SEQ ID NO: 1229271 - RNA, 20 nt, Human
uauagaaccucuuugucuac

SEQ ID NO: 1229272 - RNA, 21 nt, Human
uauagaaccucuuugucuaca

SEQ ID NO: 1229273 - RNA, 22 nt, Human
ucagucucuauaccaauaaagu

SEQ ID NO: 1229274 - RNA, 23 nt, Human
ucagucucuauaccaauaaagug

SEQ ID NO: 1229275 - RNA, 16 nt, Human
ucaguuaacuauugca

SEQ ID NO: 1229276 - RNA, 20 nt, Human
ucaguuaacuauugcauuua

SEQ ID NO: 1229277 - RNA, 22 nt, Human
ucauauuuuucauagcuaaaaa

SEQ ID NO: 1229278 - RNA, 13 nt, Human
ucaucuggaacca

SEQ ID NO: 1229279 - RNA, 17 nt, Human
ucaucuggauuccagag

SEQ ID NO: 1229280 - RNA, 12 nt, Human
ucaucuggaacc

SEQ ID NO: 1229281 - RNA, 18 nt, Human
ucaucuggaaccaucaga

SEQ ID NO: 1229282 - RNA, 13 nt, Human
ucaugaaagauuc

SEQ ID NO: 1229283 - RNA, 15 nt, Human
ucaugaaagauucaa

SEQ ID NO: 1229284 - RNA, 21 nt, Human
ucauggaauuggagcucgugg

SEQ ID NO: 1229285 - RNA, 24 nt, Human
ucauggacuucugccagcauaaua

SEQ ID NO: 1229286 - RNA, 19 nt, Human
ucagcucucaguugcagcc

SEQ ID NO: 1229287 - RNA, 18 nt, Human
ucagauaugauucaaaug

SEQ ID NO: 1229288 - RNA, 17 nt, Human
ucagauaugauucaaau

SEQ ID NO: 1229289 - RNA, 16 nt, Human
ucagauacuggauugu

SEQ ID NO: 1229290 - RNA, 19 nt, Human
ucagauacuggauuguacu

SEQ ID NO: 1229291 - RNA, 20 nt, Human
ucagauacuggauuguacuu

SEQ ID NO: 1229292 - RNA, 14 nt, Human
ucagauacuggauu

SEQ ID NO: 1229293 - RNA, 15 nt, Human
ucagauacuggauug

SEQ ID NO: 1229294 - RNA, 23 nt, Human
uccacagcugccucuucccucuu

SEQ ID NO: 1229295 - RNA, 17 nt, Human
uccaagcaaaugugaau

SEQ ID NO: 1229296 - RNA, 15 nt, Human
uccacuuuaucuuga

SEQ ID NO: 1229297 - RNA, 17 nt, Human
uccacuuuaucuugaau

SEQ ID NO: 1229298 - RNA, 17 nt, Human
uccagagcacugcucca

SEQ ID NO: 1229299 - RNA, 21 nt, Human
ucccacuucagccucccaagc

SEQ ID NO: 1229300 - RNA, 21 nt, Human
ucccaagcaccugggauuaca

SEQ ID NO: 1229301 - RNA, 20 nt, Human
ucccaagcaccugggauuac

SEQ ID NO: 1229302 - RNA, 12 nt, Human
uccauacauuug

SEQ ID NO: 1229303 - RNA, 21 nt, Human
ucccucuuccuucccugcugu

SEQ ID NO: 1229304 - RNA, 22 nt, Human
ucccucugcagucucuauacca

SEQ ID NO: 1229305 - RNA, 16 nt, Human
ucccucugcagucucu

SEQ ID NO: 1229306 - RNA, 19 nt, Human
ucccuacccuaaccaaguu

SEQ ID NO: 1229307 - RNA, 15 nt, Human
ucuauauuuucauuc

SEQ ID NO: 1229308 - RNA, 16 nt, Human
ucuauauuuucauucu

SEQ ID NO: 1229309 - RNA, 19 nt, Human
ucuauauuuucauucuccu

SEQ ID NO: 1229310 - RNA, 13 nt, Human
ucuaugaaauauu

SEQ ID NO: 1229311 - RNA, 14 nt, Human
ucucagauuucuga

SEQ ID NO: 1229312 - RNA, 17 nt, Human
ucucagauuucugagga

SEQ ID NO: 1229313 - RNA, 18 nt, Human
ucucagauuucugaggaa

SEQ ID NO: 1229314 - RNA, 13 nt, Human
ucucagauuuuau

SEQ ID NO: 1229315 - RNA, 14 nt, Human
ucucagauuuuauu

SEQ ID NO: 1229316 - RNA, 15 nt, Human
ucucagauuuuauua

SEQ ID NO: 1229317 - RNA, 16 nt, Human
ucucagauuuuauuau

SEQ ID NO: 1229318 - RNA, 17 nt, Human
ucucagauuuuauuaug

SEQ ID NO: 1229319 - RNA, 18 nt, Human
ucucagauuuuauuaugu

SEQ ID NO: 1229320 - RNA, 19 nt, Human
ucucagauuuuauuaugua

SEQ ID NO: 1229321 - RNA, 21 nt, Human
ucuaggcaguucaaagcagga

SEQ ID NO: 1229322 - RNA, 15 nt, Human
ucuagguaaauuaca

SEQ ID NO: 1229323 - RNA, 13 nt, Human
ucuauauuuuaca

SEQ ID NO: 1229324 - RNA, 13 nt, Human
ucuauauuuucau

SEQ ID NO: 1229325 - RNA, 14 nt, Human
ucuauauuuucauu

SEQ ID NO: 1229326 - RNA, 19 nt, Human
uccuuagaaaaaaaauuau

SEQ ID NO: 1229327 - RNA, 14 nt, Human
ucugcagucucuau

SEQ ID NO: 1229328 - RNA, 18 nt, Human
ucugcagucucuauacca

SEQ ID NO: 1229329 - RNA, 20 nt, Human
ucugcagucucuauaccaau

SEQ ID NO: 1229330 - RNA, 21 nt, Human
ucugcagucucuauaccaaua

SEQ ID NO: 1229331 - RNA, 20 nt, Human
ucugccuaaggacuucuuua

SEQ ID NO: 1229332 - RNA, 21 nt, Human
ucugccuaaggacuucuuuaa

SEQ ID NO: 1229333 - RNA, 23 nt, Human
ucugccuaaggacuucuuuaauu

SEQ ID NO: 1229334 - RNA, 14 nt, Human
ucuggaauuugaaa

SEQ ID NO: 1229335 - RNA, 18 nt, Human
ucuguaagcauaagcuua

SEQ ID NO: 1229336 - RNA, 23 nt, Human
ucuggagcccacuguacuugcuc

SEQ ID NO: 1229337 - RNA, 12 nt, Human
ucuggagcccac

SEQ ID NO: 1229338 - RNA, 16 nt, Human
ucuggagcccacugua

SEQ ID NO: 1229339 - RNA, 22 nt, Human
ucuggagcccacuguacuugcu

SEQ ID NO: 1229340 - RNA, 18 nt, Human
ugaaaaccacauuggaga

SEQ ID NO: 1229341 - RNA, 15 nt, Human
ugaaacacuuugcau

SEQ ID NO: 1229342 - RNA, 21 nt, Human
ucuuugccacccucaugcugu

SEQ ID NO: 1229343 - RNA, 22 nt, Human
ucuuugccacccucaugcugug

SEQ ID NO: 1229344 - RNA, 12 nt, Human
ucuugucucaga

SEQ ID NO: 1229345 - RNA, 14 nt, Human
ucuugucucagauu

SEQ ID NO: 1229346 - RNA, 15 nt, Human
ucuugucucagauuu

SEQ ID NO: 1229347 - RNA, 17 nt, Human
ucuugucucagauuuua

SEQ ID NO: 1229348 - RNA, 19 nt, Human
ucuuuccacagaagcucca

SEQ ID NO: 1229349 - RNA, 17 nt, Human
ucuuuccacagaagcuc

SEQ ID NO: 1229350 - RNA, 19 nt, Human
ucuugccaaauauaaauaa

SEQ ID NO: 1229351 - RNA, 13 nt, Human
ucuuauaauuuaa

SEQ ID NO: 1229352 - RNA, 14 nt, Human
ucuuauaauuuaaa

SEQ ID NO: 1229353 - RNA, 15 nt, Human
ugagcagucaggaaa

SEQ ID NO: 1229354 - RNA, 19 nt, Human
ugaggaucagaguaaucca

SEQ ID NO: 1229355 - RNA, 13 nt, Human
ugaggaucagagu

SEQ ID NO: 1229356 - RNA, 17 nt, Human
ugaggaucagaguaauc

SEQ ID NO: 1229357 - RNA, 15 nt, Human
ugaggcacuggcgag

SEQ ID NO: 1229358 - RNA, 13 nt, Human
ugagacauccagc

SEQ ID NO: 1229359 - RNA, 13 nt, Human
ugagaaaucuaaa

SEQ ID NO: 1229360 - RNA, 10 nt, Human
ugagacaucc

SEQ ID NO: 1229361 - RNA, 12 nt, Human
ugagacauccag

SEQ ID NO: 1229362 - RNA, 18 nt, Human
ugagaaaaauauauacua

SEQ ID NO: 1229363 - RNA, 16 nt, Human
ugacucuuaagaagac

SEQ ID NO: 1229364 - RNA, 15 nt, Human
ugacucuuaagaaga

SEQ ID NO: 1229365 - RNA, 14 nt, Human
ugacucuuaagaag

SEQ ID NO: 1229366 - RNA, 12 nt, Human
ugacuuuggaua

SEQ ID NO: 1229367 - RNA, 13 nt, Human
ugacuuuggauaa

SEQ ID NO: 1229368 - RNA, 14 nt, Human
ugacuuuggauaau

SEQ ID NO: 1229369 - RNA, 15 nt, Human
ugacuuuggauaaua

SEQ ID NO: 1229370 - RNA, 16 nt, Human
ugacuuuggauaauaa

SEQ ID NO: 1229371 - RNA, 20 nt, Human
ugacuuuggauaauaaggaa

SEQ ID NO: 1229372 - RNA, 22 nt, Human
ugacuuuggauaauaaggaaaa

SEQ ID NO: 1229373 - RNA, 16 nt, Human
ugacuuuggcugcaug

SEQ ID NO: 1229374 - RNA, 16 nt, Human
ugacaugggacauuug

SEQ ID NO: 1229375 - RNA, 14 nt, Human
ugaauuacauuugu

SEQ ID NO: 1229376 - RNA, 13 nt, Human
ugaauuacauuug

SEQ ID NO: 1229377 - RNA, 14 nt, Human
ugaauuaaguuuuu

SEQ ID NO: 1229378 - RNA, 16 nt, Human
ugaauuuaaauagcuu

SEQ ID NO: 1229379 - RNA, 21 nt, Human
ugaacuugaggacacaugucc

SEQ ID NO: 1229380 - RNA, 22 nt, Human
ugaacuugaggacacaugucca

SEQ ID NO: 1229381 - RNA, 17 nt, Human
ugaacuugaggacacau

SEQ ID NO: 1229382 - RNA, 18 nt, Human
ugaacuugaggacacaug

SEQ ID NO: 1229383 - RNA, 19 nt, Human
ugaacuugaggacacaugu

SEQ ID NO: 1229384 - RNA, 20 nt, Human
ugaacuugaggacacauguc

SEQ ID NO: 1229385 - RNA, 13 nt, Human
ugaacuugaaauu

SEQ ID NO: 1229386 - RNA, 14 nt, Human
ugaacuugaaauuu

SEQ ID NO: 1229387 - RNA, 18 nt, Human
ugaacuugaaauuugaau

SEQ ID NO: 1229388 - RNA, 16 nt, Human
ugaacuugaggacaca

SEQ ID NO: 1229389 - RNA, 16 nt, Human
ugaaacacuuugcaua

SEQ ID NO: 1229390 - RNA, 13 nt, Human
ugaaacauguuuc

SEQ ID NO: 1229391 - RNA, 21 nt, Human
ugaagcuuuuaugugaaacau

SEQ ID NO: 1229392 - RNA, 21 nt, Human
ugaagagguuuuaaagcuucc

SEQ ID NO: 1229393 - RNA, 20 nt, Human
ugaagagguuuuaaagcuuc

SEQ ID NO: 1229394 - RNA, 9 nt, Human
ugccucucu

SEQ ID NO: 1229395 - RNA, 20 nt, Human
ugcgagugcucauuucagga

SEQ ID NO: 1229396 - RNA, 17 nt, Human
ugccuucucaacuccaa

SEQ ID NO: 1229397 - RNA, 15 nt, Human
ugccuucucaacucc

SEQ ID NO: 1229398 - RNA, 17 nt, Human
ugcucagagcaguguuu

SEQ ID NO: 1229399 - RNA, 19 nt, Human
ugcuaagcauuccaacuau

SEQ ID NO: 1229400 - RNA, 15 nt, Human
ugcuaagcauuccaa

SEQ ID NO: 1229401 - RNA, 22 nt, Human
ugcaguucugaagaagauggua

SEQ ID NO: 1229402 - RNA, 19 nt, Human
ugcaguucugaagaagaug

SEQ ID NO: 1229403 - RNA, 22 nt, Human
ugcaguggcaucaucucagcuc

SEQ ID NO: 1229404 - RNA, 22 nt, Human
ugcaguggcgcgaucucagcuc

SEQ ID NO: 1229405 - RNA, 22 nt, Human
ugcaguggcgugaucucagcuc

SEQ ID NO: 1229406 - RNA, 18 nt, Human
ugcaguucugaagaagau

SEQ ID NO: 1229407 - RNA, 17 nt, Human
ugcaguucugaagaaga

SEQ ID NO: 1229408 - RNA, 16 nt, Human
ugcaguucugaagaag

SEQ ID NO: 1229409 - RNA, 15 nt, Human
ugcaguucugaagaa

SEQ ID NO: 1229410 - RNA, 15 nt, Human
ugcacuggccccacc

SEQ ID NO: 1229411 - RNA, 16 nt, Human
ugcacuggccccaccc

SEQ ID NO: 1229412 - RNA, 17 nt, Human
ugcacuggccccacccu

SEQ ID NO: 1229413 - RNA, 14 nt, Human
ugcacggugaaugg

SEQ ID NO: 1229414 - RNA, 18 nt, Human
ugcacggugaauggcuuu

SEQ ID NO: 1229415 - RNA, 19 nt, Human
ugcacggugaauggcuuug

SEQ ID NO: 1229416 - RNA, 19 nt, Human
ugccaaauauaaauaaaaa

SEQ ID NO: 1229417 - RNA, 22 nt, Human
ugccaaauauaaauaaaaauaa

SEQ ID NO: 1229418 - RNA, 17 nt, Human
ugccaaauauaaauaaa

SEQ ID NO: 1229419 - RNA, 18 nt, Human
ugccaaauauaaauaaaa

SEQ ID NO: 1229420 - RNA, 20 nt, Human
ugcauauuuauaaaaauaaa

SEQ ID NO: 1229421 - RNA, 21 nt, Human
ugcauauuuauaaaaauaaaa

SEQ ID NO: 1229422 - RNA, 16 nt, Human
ugccacccucaugcug

SEQ ID NO: 1229423 - RNA, 17 nt, Human
ugccacccucaugcugu

SEQ ID NO: 1229424 - RNA, 11 nt, Human
uggagggaagc

SEQ ID NO: 1229425 - RNA, 15 nt, Human
uggcaggugcagccc

SEQ ID NO: 1229426 - RNA, 14 nt, Human
uggaaagaguacuc

SEQ ID NO: 1229427 - RNA, 23 nt, Human
uggaaacuucagcgguuuauaua

SEQ ID NO: 1229428 - RNA, 17 nt, Human
uggaaacaagucaguca

SEQ ID NO: 1229429 - RNA, 22 nt, Human
uggaauaauccuaaacauauga

SEQ ID NO: 1229430 - RNA, 16 nt, Human
uggaauaucuccguca

SEQ ID NO: 1229431 - RNA, 18 nt, Human
uggaacgcguugaaauug

SEQ ID NO: 1229432 - RNA, 19 nt, Human
uggaacgcguugaaauugu

SEQ ID NO: 1229433 - RNA, 18 nt, Human
uggcuuuucugauccagu

SEQ ID NO: 1229434 - RNA, 19 nt, Human
uggcuuuucugauccaguu

SEQ ID NO: 1229435 - RNA, 14 nt, Human
uggcuuuucugauc

SEQ ID NO: 1229436 - RNA, 17 nt, Human
uggcuuuucugauccag

SEQ ID NO: 1229437 - RNA, 21 nt, Human
uggcuugaguuuaaauuguaa

SEQ ID NO: 1229438 - RNA, 16 nt, Human
uggcuuccuggcaaua

SEQ ID NO: 1229439 - RNA, 22 nt, Human
uggccccacccucguggacacc

SEQ ID NO: 1229440 - RNA, 19 nt, Human
ugguaugaacuugaggaca

SEQ ID NO: 1229441 - RNA, 21 nt, Human
ugguaugaacuugaggacaca

SEQ ID NO: 1229442 - RNA, 22 nt, Human
ugguaugaacuugaggacacau

SEQ ID NO: 1229443 - RNA, 23 nt, Human
ugguaugaacuugaggacacaug

SEQ ID NO: 1229444 - RNA, 16 nt, Human
uggguuagggaaaaca

SEQ ID NO: 1229445 - RNA, 18 nt, Human
uggguuagggaaaacauu

SEQ ID NO: 1229446 - RNA, 19 nt, Human
uggguuagggaaaacauuc

SEQ ID NO: 1229447 - RNA, 21 nt, Human
uggguuagggaaaacauucca

SEQ ID NO: 1229448 - RNA, 12 nt, Human
ugggcagcaauu

SEQ ID NO: 1229449 - RNA, 18 nt, Human
uggggauucuuaaaguug

SEQ ID NO: 1229450 - RNA, 20 nt, Human
uggggauucuuaaaguugaa

SEQ ID NO: 1229451 - RNA, 12 nt, Human
uggggauucuua

SEQ ID NO: 1229452 - RNA, 13 nt, Human
uggggauucuuaa

SEQ ID NO: 1229453 - RNA, 16 nt, Human
uggggauucuuaaagu

SEQ ID NO: 1229454 - RNA, 16 nt, Human
uguaugauucccagcc

SEQ ID NO: 1229455 - RNA, 21 nt, Human
uguauuguauauuacaaugau

SEQ ID NO: 1229456 - RNA, 21 nt, Human
uguauugugcgcuaaacuuuu

SEQ ID NO: 1229457 - RNA, 15 nt, Human
uguaugauucccagc

SEQ ID NO: 1229458 - RNA, 22 nt, Human
uguauaaaagggacugagaaau

SEQ ID NO: 1229459 - RNA, 22 nt, Human
ugucacccagguuggagugcag

SEQ ID NO: 1229460 - RNA, 22 nt, Human
uguaccguaggcuuuguauuca

SEQ ID NO: 1229461 - RNA, 20 nt, Human
uguaaucuuauuuaggaagu

SEQ ID NO: 1229462 - RNA, 11 nt, Human
uguaaugaaaa

SEQ ID NO: 1229463 - RNA, 18 nt, Human
uguagcauccuggaauau

SEQ ID NO: 1229464 - RNA, 17 nt, Human
uguagcauccuggaaua

SEQ ID NO: 1229465 - RNA, 16 nt, Human
uguagcauccuggaau

SEQ ID NO: 1229466 - RNA, 14 nt, Human
uguagcauccugga

SEQ ID NO: 1229467 - RNA, 18 nt, Human
uguagccccucuccugga

SEQ ID NO: 1229468 - RNA, 15 nt, Human
ugugacauuuuacau

SEQ ID NO: 1229469 - RNA, 17 nt, Human
ugugacauuuuacauua

SEQ ID NO: 1229470 - RNA, 18 nt, Human
ugugacauuuuacauuaa

SEQ ID NO: 1229471 - RNA, 16 nt, Human
ugugauauaagugugu

SEQ ID NO: 1229472 - RNA, 19 nt, Human
ugugcuaguaauuggaaag

SEQ ID NO: 1229473 - RNA, 20 nt, Human
ugugcucaggagcccuggga

SEQ ID NO: 1229474 - RNA, 17 nt, Human
ugugcucaggagcccug

SEQ ID NO: 1229475 - RNA, 15 nt, Human
ugugcucaggagccc

SEQ ID NO: 1229476 - RNA, 16 nt, Human
ugugcucaggagcccu

SEQ ID NO: 1229477 - RNA, 16 nt, Human
uguggaacauaaaaag

SEQ ID NO: 1229478 - RNA, 21 nt, Human
uguggaacauaaaaaggacau

SEQ ID NO: 1229479 - RNA, 19 nt, Human
uguggaacauaaaaaggac

SEQ ID NO: 1229480 - RNA, 12 nt, Human
uuacagaagccc

SEQ ID NO: 1229481 - RNA, 14 nt, Human
uuacauuuccuaaa

SEQ ID NO: 1229482 - RNA, 18 nt, Human
uuaauauuaaagccaugu

SEQ ID NO: 1229483 - RNA, 19 nt, Human
uuaauauuaaagccauguu

SEQ ID NO: 1229484 - RNA, 20 nt, Human
uuaauauuaaagccauguuu

SEQ ID NO: 1229485 - RNA, 16 nt, Human
uuacaacggagucaaa

SEQ ID NO: 1229486 - RNA, 19 nt, Human
uuacaacggagucaaaaau

SEQ ID NO: 1229487 - RNA, 23 nt, Human
uuacaacggagucaaaaauuaaa

SEQ ID NO: 1229488 - RNA, 12 nt, Human
uuaaauguauac

SEQ ID NO: 1229489 - RNA, 14 nt, Human
uuaaauguauacua

SEQ ID NO: 1229490 - RNA, 19 nt, Human
uuaaauguauacuauagua

SEQ ID NO: 1229491 - RNA, 16 nt, Human
uuaaauguuaugacua

SEQ ID NO: 1229492 - RNA, 20 nt, Human
uuaaauguuaugacuaugua

SEQ ID NO: 1229493 - RNA, 12 nt, Human
uuaagaguaaaa

SEQ ID NO: 1229494 - RNA, 16 nt, Human
uuaauaauguuucaaa

SEQ ID NO: 1229495 - RNA, 11 nt, Human
uuaauauuaaa

SEQ ID NO: 1229496 - RNA, 13 nt, Human
uuaauauuaaagc

SEQ ID NO: 1229497 - RNA, 14 nt, Human
uuaauauuaaagcc

SEQ ID NO: 1229498 - RNA, 16 nt, Human
uuaauauuaaagccau

SEQ ID NO: 1229499 - RNA, 17 nt, Human
uuaauauuaaagccaug

SEQ ID NO: 1229500 - RNA, 12 nt, Human
uuaaagccaugu

SEQ ID NO: 1229501 - RNA, 14 nt, Human
uuaaagccauguuu

SEQ ID NO: 1229502 - RNA, 18 nt, Human
uuaaagccauguuuauua

SEQ ID NO: 1229503 - RNA, 20 nt, Human
uuaaagccauguuuauuaca

SEQ ID NO: 1229504 - RNA, 15 nt, Human
uuaaaaaaaaaauug

SEQ ID NO: 1229505 - RNA, 11 nt, Human
uguuucuguac

SEQ ID NO: 1229506 - RNA, 22 nt, Human
uguuucuguacuuuuuggcaua

SEQ ID NO: 1229507 - RNA, 23 nt, Human
uguuucuguacuuuuuggcauaa

SEQ ID NO: 1229508 - RNA, 20 nt, Human
uguuggagaagaacugaaau

SEQ ID NO: 1229509 - RNA, 19 nt, Human
uguuggagaagaacugaaa

SEQ ID NO: 1229510 - RNA, 17 nt, Human
uguuggagaagaacuga

SEQ ID NO: 1229511 - RNA, 16 nt, Human
uguuggagaagaacug

SEQ ID NO: 1229512 - RNA, 14 nt, Human
uguuggagaagaac

SEQ ID NO: 1229513 - RNA, 12 nt, Human
uguuuaagagac

SEQ ID NO: 1229514 - RNA, 20 nt, Human
uguucaugaaagauucaaug

SEQ ID NO: 1229515 - RNA, 14 nt, Human
uguucaugaaagau

SEQ ID NO: 1229516 - RNA, 13 nt, Human
uguucaugaaaga

SEQ ID NO: 1229517 - RNA, 20 nt, Human
uguucuuuuaaaugauugaa

SEQ ID NO: 1229518 - RNA, 20 nt, Human
uguugacaugggacauuugc

SEQ ID NO: 1229519 - RNA, 16 nt, Human
uguuaaaccaugggau

SEQ ID NO: 1229520 - RNA, 14 nt, Human
uguuagugcaaauu

SEQ ID NO: 1229521 - RNA, 17 nt, Human
uguucauaaauaaaguu

SEQ ID NO: 1229522 - RNA, 13 nt, Human
uguguuugaagca

SEQ ID NO: 1229523 - RNA, 19 nt, Human
uguguuuugcaagccagau

SEQ ID NO: 1229524 - RNA, 13 nt, Human
uguguuuugcaag

SEQ ID NO: 1229525 - RNA, 15 nt, Human
uguguuuuucauaaa

SEQ ID NO: 1229526 - RNA, 18 nt, Human
uguguuuuucauaaagca

SEQ ID NO: 1229527 - RNA, 22 nt, Human
ugugugaaagguacuucaaauc

SEQ ID NO: 1229528 - RNA, 21 nt, Human
ugugugaaagguacuucaaau

SEQ ID NO: 1229529 - RNA, 12 nt, Human
uuuuuuguuauu

SEQ ID NO: 1229530 - RNA, 17 nt, Human
ggccccugccucucugc

SEQ ID NO: 1229531 - RNA, 18 nt, Human
ggccccugccucucugca

SEQ ID NO: 1229532 - RNA, 19 nt, Human
ggccccugccucucugcag

SEQ ID NO: 1229533 - RNA, 21 nt, Human
ggccccugccucucugcaggu

SEQ ID NO: 1229534 - RNA, 20 nt, Human
ggcuaagcuucacuguaaaa

SEQ ID NO: 1229535 - RNA, 23 nt, Human
ggcgugaucucagcucacugcaa

SEQ ID NO: 1229536 - RNA, 14 nt, Human
ggcuaccaggaaag

SEQ ID NO: 1229537 - RNA, 17 nt, Human
ggcuagacuagucucaa

SEQ ID NO: 1229538 - RNA, 14 nt, Human
aaaaauaaaaaaca

SEQ ID NO: 1229539 - RNA, 10 nt, Human
aaaaaacuac

SEQ ID NO: 1229540 - RNA, 18 nt, Human
ggcauuuuacuguacaga

SEQ ID NO: 1229541 - RNA, 16 nt, Human
ggccagaccauggaca

SEQ ID NO: 1229542 - RNA, 17 nt, Human
ggcaucaucucagcuca

SEQ ID NO: 1229543 - RNA, 23 nt, Human
ggcaucaucucagcucacugcaa

SEQ ID NO: 1229544 - RNA, 15 nt, Human
ggaggcucuggagcc

SEQ ID NO: 1229545 - RNA, 14 nt, Human
ggauuguaguccca

SEQ ID NO: 1229546 - RNA, 13 nt, Human
gggccaggcuggg

SEQ ID NO: 1229547 - RNA, 15 nt, Human
aaaauggucucuaac

SEQ ID NO: 1229548 - RNA, 17 nt, Human
aaaaggacaucagcaaa

SEQ ID NO: 1229549 - RNA, 19 nt, Human
aaaaggacaucagcaaaca

SEQ ID NO: 1229550 - RNA, 12 nt, Human
aaaauacauugu

SEQ ID NO: 1229551 - RNA, 20 nt, Human
aaaauaauuuuuauauuuga

SEQ ID NO: 1229552 - RNA, 17 nt, Human
aaaauaauuuuuauauu

SEQ ID NO: 1229553 - RNA, 16 nt, Human
aaaauaauuuuuauau

SEQ ID NO: 1229554 - RNA, 11 nt, Human
aaaauaauuuu

SEQ ID NO: 1229555 - RNA, 11 nt, Human
aaaaugagaaa

SEQ ID NO: 1229556 - RNA, 12 nt, Human
aaaaugagaaau

SEQ ID NO: 1229557 - RNA, 18 nt, Human
aaaauauuuuaugaucca

SEQ ID NO: 1229558 - RNA, 20 nt, Human
aaaauauuguuuuacaauag

SEQ ID NO: 1229559 - RNA, 19 nt, Human
aaaauauuguuuuacaaua

SEQ ID NO: 1229560 - RNA, 15 nt, Human
aaaauauuuuaugau

SEQ ID NO: 1229561 - RNA, 16 nt, Human
aaaccuuccacccagu

SEQ ID NO: 1229562 - RNA, 23 nt, Human
aaaccuuccacccagugcugaau

SEQ ID NO: 1229563 - RNA, 20 nt, Human
aaaccacuuuuugcagcuuu

SEQ ID NO: 1229564 - RNA, 10 nt, Human
aaaccacuuu

SEQ ID NO: 1229565 - RNA, 22 nt, Human
gguaaaucagacuaugaaguuu

SEQ ID NO: 1229566 - RNA, 16 nt, Human
gguaugaacuugagga

SEQ ID NO: 1229567 - RNA, 19 nt, Human
gguaugaacuugaggacac

SEQ ID NO: 1229568 - RNA, 20 nt, Human
gguaugaacuugaggacaca

SEQ ID NO: 1229569 - RNA, 21 nt, Human
gguaugaacuugaggacacau

SEQ ID NO: 1229570 - RNA, 14 nt, Human
ggucagugcaaaua

SEQ ID NO: 1229571 - RNA, 18 nt, Human
gguaaguuuuuugaaauu

SEQ ID NO: 1229572 - RNA, 15 nt, Human
guaauuuuuuucacc

SEQ ID NO: 1229573 - RNA, 20 nt, Human
guacaaaguauuaagcauau

SEQ ID NO: 1229574 - RNA, 21 nt, Human
guacaaaguauuaagcauaua

SEQ ID NO: 1229575 - RNA, 13 nt, Human
guaaguuuuuuga

SEQ ID NO: 1229576 - RNA, 21 nt, Human
guaaagcccauuuuuaaaaua

SEQ ID NO: 1229577 - RNA, 18 nt, Human
guacacaauaagcaaaaa

SEQ ID NO: 1229578 - RNA, 20 nt, Human
guacacaauaagcaaaaaca

SEQ ID NO: 1229579 - RNA, 16 nt, Human
aaauauauacuaaaca

SEQ ID NO: 1229580 - RNA, 12 nt, Human
aaauauauacua

SEQ ID NO: 1229581 - RNA, 22 nt, Human
aaauacgugggcauucaaaugu

SEQ ID NO: 1229582 - RNA, 21 nt, Human
aaauacgugggcauucaaaug

SEQ ID NO: 1229583 - RNA, 20 nt, Human
aaauacgugggcauucaaau

SEQ ID NO: 1229584 - RNA, 22 nt, Human
aaauaucacuugucaauaaaau

SEQ ID NO: 1229585 - RNA, 16 nt, Human
aaauauauuuuaagac

SEQ ID NO: 1229586 - RNA, 22 nt, Human
aaauauauuuuaagacgaaaca

SEQ ID NO: 1229587 - RNA, 18 nt, Human
aaauauaugcuaagucuu

SEQ ID NO: 1229588 - RNA, 14 nt, Human
aaauauauaucaaa

SEQ ID NO: 1229589 - RNA, 17 nt, Human
aaagcagccuggccaac

SEQ ID NO: 1229590 - RNA, 14 nt, Human
aaagcuguguggca

SEQ ID NO: 1229591 - RNA, 14 nt, Human
gguggcagcaacaa

SEQ ID NO: 1229592 - RNA, 13 nt, Human
gguggcagcaaca

SEQ ID NO: 1229593 - RNA, 22 nt, Human
aaagggcuguuauaaucuuuca

SEQ ID NO: 1229594 - RNA, 20 nt, Human
aaagggcuguuauaaucuuu

SEQ ID NO: 1229595 - RNA, 18 nt, Human
aaagguucaugcaaacuu

SEQ ID NO: 1229596 - RNA, 21 nt, Human
aaaguaaaaacaaagaaauua

SEQ ID NO: 1229597 - RNA, 19 nt, Human
gguguuguacucaauuuua

SEQ ID NO: 1229598 - RNA, 20 nt, Human
gguguuguacucaauuuuaa

SEQ ID NO: 1229599 - RNA, 17 nt, Human
gguggggggggugcugg

SEQ ID NO: 1229600 - RNA, 17 nt, Human
aaaguauguuagugcaa

SEQ ID NO: 1229601 - RNA, 17 nt, Human
gguuuucacauuggaaa

SEQ ID NO: 1229602 - RNA, 15 nt, Human
gcccacuguacuugc

SEQ ID NO: 1229603 - RNA, 20 nt, Human
gcccacuguacuugcucuug

SEQ ID NO: 1229604 - RNA, 22 nt, Human
gcccacuguacuugcucuugau

SEQ ID NO: 1229605 - RNA, 12 nt, Human
gcauuuagaugu

SEQ ID NO: 1229606 - RNA, 13 nt, Human
gcauuuagaugua

SEQ ID NO: 1229607 - RNA, 13 nt, Human
gccauguuuauua

SEQ ID NO: 1229608 - RNA, 14 nt, Human
gccauguuuauuac

SEQ ID NO: 1229609 - RNA, 18 nt, Human
gccauguuuauuacagua

SEQ ID NO: 1229610 - RNA, 22 nt, Human
gccauguuuauuacaguauaau

SEQ ID NO: 1229611 - RNA, 15 nt, Human
gccggaucugaggga

SEQ ID NO: 1229612 - RNA, 17 nt, Human
gccggaucugagggaga

SEQ ID NO: 1229613 - RNA, 20 nt, Human
gcccugccaccugucugucu

SEQ ID NO: 1229614 - RNA, 22 nt, Human
gcguucauggaacgcguugaaa

SEQ ID NO: 1229615 - RNA, 12 nt, Human
gcguugaaauug

SEQ ID NO: 1229616 - RNA, 18 nt, Human
gcguugaaauuguaauua

SEQ ID NO: 1229617 - RNA, 12 nt, Human
gcuaaggacuug

SEQ ID NO: 1229618 - RNA, 23 nt, Human
gcuaaggacuuguuagaucuagu

SEQ ID NO: 1229619 - RNA, 19 nt, Human
gccuucucuaaacauuuca

SEQ ID NO: 1229620 - RNA, 22 nt, Human
gcucaggagcccugggaggcuc

SEQ ID NO: 1229621 - RNA, 23 nt, Human
gcucaggagcccugggaggcucu

SEQ ID NO: 1229622 - RNA, 16 nt, Human
gcucagagcaguguuu

SEQ ID NO: 1229623 - RNA, 21 nt, Human
gcuaggaauuguguuuauaau

SEQ ID NO: 1229624 - RNA, 11 nt, Human
gcuauuucuau

SEQ ID NO: 1229625 - RNA, 13 nt, Human
gcuauuucuauau

SEQ ID NO: 1229626 - RNA, 15 nt, Human
gcuauuucuauauuu

SEQ ID NO: 1229627 - RNA, 16 nt, Human
gcuauuucuauauuuu

SEQ ID NO: 1229628 - RNA, 18 nt, Human
gcuauuucuauauuuuca

SEQ ID NO: 1229629 - RNA, 19 nt, Human
gcuauuucuauauuuucau

SEQ ID NO: 1229630 - RNA, 20 nt, Human
gcuauuucuauauuuucauu

SEQ ID NO: 1229631 - RNA, 22 nt, Human
gcuauuucuauauuuucauucu

SEQ ID NO: 1229632 - RNA, 21 nt, Human
gcuaguaauuggaaaggcagc

SEQ ID NO: 1229633 - RNA, 20 nt, Human
gcuaaguacacaauaagcaa

SEQ ID NO: 1229634 - RNA, 21 nt, Human
gcuaaguacacaauaagcaaa

SEQ ID NO: 1229635 - RNA, 22 nt, Human
gcuaaguacacaauaagcaaaa

SEQ ID NO: 1229636 - RNA, 12 nt, Human
ggacaucagcaa

SEQ ID NO: 1229637 - RNA, 14 nt, Human
ggacaucagcaaac

SEQ ID NO: 1229638 - RNA, 15 nt, Human
ggacaucagcaaaca

SEQ ID NO: 1229639 - RNA, 14 nt, Human
ggacaccugcccug

SEQ ID NO: 1229640 - RNA, 15 nt, Human
ggacaccugcccugc

SEQ ID NO: 1229641 - RNA, 16 nt, Human
ggacaccugcccugcc

SEQ ID NO: 1229642 - RNA, 13 nt, Human
ggacaccugcccu

SEQ ID NO: 1229643 - RNA, 10 nt, Human
ggacaccugc

SEQ ID NO: 1229644 - RNA, 11 nt, Human
ggacaccugcc

SEQ ID NO: 1229645 - RNA, 12 nt, Human
ggacaccugccc

SEQ ID NO: 1229646 - RNA, 21 nt, Human
ggacagucaccucauggaauu

SEQ ID NO: 1229647 - RNA, 18 nt, Human
ggacagucaccucaugga

SEQ ID NO: 1229648 - RNA, 17 nt, Human
ggacagucaccucaugg

SEQ ID NO: 1229649 - RNA, 15 nt, Human
ggaagccugauuaaa

SEQ ID NO: 1229650 - RNA, 19 nt, Human
ggaauacucuuauaucuau

SEQ ID NO: 1229651 - RNA, 12 nt, Human
ggacacaugucc

SEQ ID NO: 1229652 - RNA, 13 nt, Human
ggacacaugucca

SEQ ID NO: 1229653 - RNA, 19 nt, Human
ggacacauguccaguggga

SEQ ID NO: 1229654 - RNA, 19 nt, Human
ggaaaucaggguuaguauu

SEQ ID NO: 1229655 - RNA, 13 nt, Human
ggaaaucuuuaaa

SEQ ID NO: 1229656 - RNA, 16 nt, Human
ggaaaaaauaacaaug

SEQ ID NO: 1229657 - RNA, 19 nt, Human
ggaaagcagccuggccaac

SEQ ID NO: 1229658 - RNA, 23 nt, Human
ggaaagcgccuccaacccuagca

SEQ ID NO: 1229659 - RNA, 19 nt, Human
ggaaagcgccuccaacccu

SEQ ID NO: 1229660 - RNA, 21 nt, Human
gcuuuucccuuuuuuuaagua

SEQ ID NO: 1229661 - RNA, 20 nt, Human
gcuuuucccuuuuuuuaagu

SEQ ID NO: 1229662 - RNA, 18 nt, Human
gcugggccccugccucuc

SEQ ID NO: 1229663 - RNA, 20 nt, Human
gcugggccccugccucucug

SEQ ID NO: 1229664 - RNA, 12 nt, Human
gcugggccccug

SEQ ID NO: 1229665 - RNA, 13 nt, Human
gcugggccccugc

SEQ ID NO: 1229666 - RNA, 14 nt, Human
gcugggccccugcc

SEQ ID NO: 1229667 - RNA, 21 nt, Human
gcugggaauggaggggcagag

SEQ ID NO: 1229668 - RNA, 22 nt, Human
gcuguauuuuaaaagaaugauu

SEQ ID NO: 1229669 - RNA, 21 nt, Human
gcuguauuuuaaaagaaugau

SEQ ID NO: 1229670 - RNA, 20 nt, Human
gcuguauuuuaaaagaauga

SEQ ID NO: 1229671 - RNA, 18 nt, Human
gcugccucuucccucuuc

SEQ ID NO: 1229672 - RNA, 14 nt, Human
gcugccucuucccu

SEQ ID NO: 1229673 - RNA, 20 nt, Human
gcugccccuggugcacuggc

SEQ ID NO: 1229674 - RNA, 15 nt, Human
gcaaaaacaaaaaga

SEQ ID NO: 1229675 - RNA, 20 nt, Human
gcaaaaacaaaaagaaaaga

SEQ ID NO: 1229676 - RNA, 21 nt, Human
gcaaaaacaaaaagaaaagaa

SEQ ID NO: 1229677 - RNA, 12 nt, Human
gauccacccgcc

SEQ ID NO: 1229678 - RNA, 16 nt, Human
gauacuggauuguacu

SEQ ID NO: 1229679 - RNA, 20 nt, Human
gauacuggauuguacuuugu

SEQ ID NO: 1229680 - RNA, 12 nt, Human
gauacugaaaua

SEQ ID NO: 1229681 - RNA, 13 nt, Human
gaucugagggaga

SEQ ID NO: 1229682 - RNA, 19 nt, Human
gauccagcagauuauucac

SEQ ID NO: 1229683 - RNA, 18 nt, Human
gauccacucgccucagcc

SEQ ID NO: 1229684 - RNA, 18 nt, Human
gauccagcagauuauuca

SEQ ID NO: 1229685 - RNA, 21 nt, Human
gauccacccgccucagccucc

SEQ ID NO: 1229686 - RNA, 12 nt, Human
gaucugccuaag

SEQ ID NO: 1229687 - RNA, 15 nt, Human
gaucugccuaaggac

SEQ ID NO: 1229688 - RNA, 16 nt, Human
gaucugccuaaggacu

SEQ ID NO: 1229689 - RNA, 17 nt, Human
gaucugccuaaggacuu

SEQ ID NO: 1229690 - RNA, 12 nt, Human
gaugauuucuau

SEQ ID NO: 1229691 - RNA, 13 nt, Human
gaugauuucuaug

SEQ ID NO: 1229692 - RNA, 23 nt, Human
gaugauuucuaugcugaguuugu

SEQ ID NO: 1229693 - RNA, 11 nt, Human
gcauccagccu

SEQ ID NO: 1229694 - RNA, 21 nt, Human
gcaucccucacccauccuaga

SEQ ID NO: 1229695 - RNA, 20 nt, Human
gcaucuagcaugucgucaaa

SEQ ID NO: 1229696 - RNA, 22 nt, Human
gcaguuguugcccacagcugua

SEQ ID NO: 1229697 - RNA, 17 nt, Human
gcagucucuauaccaau

SEQ ID NO: 1229698 - RNA, 18 nt, Human
gcagucucuauaccaaua

SEQ ID NO: 1229699 - RNA, 20 nt, Human
gcagucucuauaccaauaaa

SEQ ID NO: 1229700 - RNA, 21 nt, Human
gcagucucuauaccaauaaag

SEQ ID NO: 1229701 - RNA, 22 nt, Human
gcagucucuauaccaauaaagu

SEQ ID NO: 1229702 - RNA, 23 nt, Human
gcagucucuauaccaauaaagug

SEQ ID NO: 1229703 - RNA, 21 nt, Human
gcagagcugauggagaaggaa

SEQ ID NO: 1229704 - RNA, 22 nt, Human
gcagagcugauggagaaggaag

SEQ ID NO: 1229705 - RNA, 23 nt, Human
gcagagcugauggagaaggaagg

SEQ ID NO: 1229706 - RNA, 19 nt, Human
gcagaaagcaucccucacc

SEQ ID NO: 1229707 - RNA, 23 nt, Human
gagacgggacugcggaggaagga

SEQ ID NO: 1229708 - RNA, 13 nt, Human
gagaaggagcaga

SEQ ID NO: 1229709 - RNA, 22 nt, Human
gacuuuuuauggcacuaguauu

SEQ ID NO: 1229710 - RNA, 13 nt, Human
gaggggcagagcc

SEQ ID NO: 1229711 - RNA, 20 nt, Human
gaggggcagagccaggaaga

SEQ ID NO: 1229712 - RNA, 16 nt, Human
gaggggcagagccagg

SEQ ID NO: 1229713 - RNA, 14 nt, Human
gaggacccaggaca

SEQ ID NO: 1229714 - RNA, 15 nt, Human
gaggacccaggacag

SEQ ID NO: 1229715 - RNA, 14 nt, Human
gagcagucaggaaa

SEQ ID NO: 1229716 - RNA, 12 nt, Human
gagcccugggag

SEQ ID NO: 1229717 - RNA, 16 nt, Human
gagcccugggaggcuc

SEQ ID NO: 1229718 - RNA, 18 nt, Human
gagcccugggaggcucug

SEQ ID NO: 1229719 - RNA, 19 nt, Human
gagcccugggaggcucugg

SEQ ID NO: 1229720 - RNA, 20 nt, Human
gagcccugggaggcucugga

SEQ ID NO: 1229721 - RNA, 22 nt, Human
gagcuggagaugaggccagacc

SEQ ID NO: 1229722 - RNA, 23 nt, Human
gagcuggagaugaggccagacca

SEQ ID NO: 1229723 - RNA, 20 nt, Human
gacauuuuaaaaaaugguca

SEQ ID NO: 1229724 - RNA, 13 nt, Human
gacauuuuacauu

SEQ ID NO: 1229725 - RNA, 14 nt, Human
gacauuuuacauua

SEQ ID NO: 1229726 - RNA, 15 nt, Human
gacauuuuacauuaa

SEQ ID NO: 1229727 - RNA, 21 nt, Human
gacauuuuacauuaaauuuuu

SEQ ID NO: 1229728 - RNA, 18 nt, Human
gacagucaccucauggaa

SEQ ID NO: 1229729 - RNA, 14 nt, Human
gacaaaaagcuacu

SEQ ID NO: 1229730 - RNA, 20 nt, Human
gaauuacauuuguauaaaau

SEQ ID NO: 1229731 - RNA, 15 nt, Human
gaauuacgugcucug

SEQ ID NO: 1229732 - RNA, 19 nt, Human
gaauuacgugcucuguggg

SEQ ID NO: 1229733 - RNA, 18 nt, Human
gaauuacauuuguauaaa

SEQ ID NO: 1229734 - RNA, 15 nt, Human
gaauuacauuuguau

SEQ ID NO: 1229735 - RNA, 13 nt, Human
gaauuacauuugu

SEQ ID NO: 1229736 - RNA, 22 nt, Human
gaaugauuaugaauuacauuug

SEQ ID NO: 1229737 - RNA, 14 nt, Human
gaaugauuaugaau

SEQ ID NO: 1229738 - RNA, 22 nt, Human
gaauaucuccgucaacucauau

SEQ ID NO: 1229739 - RNA, 11 nt, Human
gaauaugccuu

SEQ ID NO: 1229740 - RNA, 23 nt, Human
cuggaaaaguauguuagugcaaa

SEQ ID NO: 1229741 - RNA, 17 nt, Human
cuggaaaccuuccaccc

SEQ ID NO: 1229742 - RNA, 20 nt, Human
cuggaaaccuuccacccagu

SEQ ID NO: 1229743 - RNA, 15 nt, Human
cugugaacuugaaau

SEQ ID NO: 1229744 - RNA, 16 nt, Human
cugugaacuugaaauu

SEQ ID NO: 1229745 - RNA, 17 nt, Human
cugugaacuugaaauuu

SEQ ID NO: 1229746 - RNA, 18 nt, Human
cugugaacuugaaauuug

SEQ ID NO: 1229747 - RNA, 22 nt, Human
cuuaaaauaaugaauacauuuc

SEQ ID NO: 1229748 - RNA, 13 nt, Human
cuggugacugauu

SEQ ID NO: 1229749 - RNA, 14 nt, Human
cuggugacugauuc

SEQ ID NO: 1229750 - RNA, 15 nt, Human
cuggugacugauucu

SEQ ID NO: 1229751 - RNA, 17 nt, Human
cuggugacugauucuuc

SEQ ID NO: 1229752 - RNA, 18 nt, Human
cuggugacugauucuuca

SEQ ID NO: 1229753 - RNA, 15 nt, Human
cuggugcccugcuuu

SEQ ID NO: 1229754 - RNA, 16 nt, Human
cuggugcccugcuuuc

SEQ ID NO: 1229755 - RNA, 19 nt, Human
cuggugcccugcuuucaga

SEQ ID NO: 1229756 - RNA, 21 nt, Human
cuggugcccugcuuucagaua

SEQ ID NO: 1229757 - RNA, 23 nt, Human
cuggugcccugcuuucagauacu

SEQ ID NO: 1229758 - RNA, 21 nt, Human
cuguacuugcucuugaugccu

SEQ ID NO: 1229759 - RNA, 16 nt, Human
cuguacuugcucuuga

SEQ ID NO: 1229760 - RNA, 19 nt, Human
cuguacuugcucuugaugc

SEQ ID NO: 1229761 - RNA, 20 nt, Human
cuguacuugcucuugaugcc

SEQ ID NO: 1229762 - RNA, 20 nt, Human
cuguaagaaaauaucacuug

SEQ ID NO: 1229763 - RNA, 20 nt, Human
cugucuacacuaagagagaa

SEQ ID NO: 1229764 - RNA, 13 nt, Human
gaaaauuuuugua

SEQ ID NO: 1229765 - RNA, 16 nt, Human
gaaaauuuuuguagua

SEQ ID NO: 1229766 - RNA, 18 nt, Human
gaaaacuuguauuaugug

SEQ ID NO: 1229767 - RNA, 14 nt, Human
gaaaauuaacauga

SEQ ID NO: 1229768 - RNA, 15 nt, Human
gaaaagcagacauuu

SEQ ID NO: 1229769 - RNA, 16 nt, Human
gaaaagcagacauuuu

SEQ ID NO: 1229770 - RNA, 14 nt, Human
gaaaaaauauauau

SEQ ID NO: 1229771 - RNA, 18 nt, Human
cuuuuggaagguauuuaa

SEQ ID NO: 1229772 - RNA, 19 nt, Human
cuuuuaugugaaacauguu

SEQ ID NO: 1229773 - RNA, 23 nt, Human
gaaacuucagcgguuuauauaag

SEQ ID NO: 1229774 - RNA, 14 nt, Human
gaaacuuguguaaa

SEQ ID NO: 1229775 - RNA, 16 nt, Human
gaaacuuguguaaaua

SEQ ID NO: 1229776 - RNA, 20 nt, Human
gaaacuuguguaaauacaau

SEQ ID NO: 1229777 - RNA, 15 nt, Human
cuucuauacccaccc

SEQ ID NO: 1229778 - RNA, 18 nt, Human
cuucuauacccacccaga

SEQ ID NO: 1229779 - RNA, 17 nt, Human
cuucuauacccacccag

SEQ ID NO: 1229780 - RNA, 23 nt, Human
cuucccaaaguccugggauuaca

SEQ ID NO: 1229781 - RNA, 14 nt, Human
cucguuaauuugua

SEQ ID NO: 1229782 - RNA, 14 nt, Human
cucguguguuucua

SEQ ID NO: 1229783 - RNA, 19 nt, Human
cucuauaccaauaaaguga

SEQ ID NO: 1229784 - RNA, 18 nt, Human
cucuauaccaauaaagug

SEQ ID NO: 1229785 - RNA, 14 nt, Human
cuccaagaauuucu

SEQ ID NO: 1229786 - RNA, 13 nt, Human
cuccaagaauuuc

SEQ ID NO: 1229787 - RNA, 18 nt, Human
cucugcaggucccuaaua

SEQ ID NO: 1229788 - RNA, 14 nt, Human
cucugcaggucccu

SEQ ID NO: 1229789 - RNA, 15 nt, Human
cucugcaggucccua

SEQ ID NO: 1229790 - RNA, 16 nt, Human
cucugcaggucccuaa

SEQ ID NO: 1229791 - RNA, 17 nt, Human
cucugcaggucccuaau

SEQ ID NO: 1229792 - RNA, 22 nt, Human
cucuuagaugcaguucugaaga

SEQ ID NO: 1229793 - RNA, 21 nt, Human
cugaagcuaucguaaaauuaa

SEQ ID NO: 1229794 - RNA, 22 nt, Human
cugaagcuaucguaaaauuaag

SEQ ID NO: 1229795 - RNA, 13 nt, Human
cucuugaugccug

SEQ ID NO: 1229796 - RNA, 15 nt, Human
cucuugaugccuggc

SEQ ID NO: 1229797 - RNA, 16 nt, Human
cucuugaugccuggcg

SEQ ID NO: 1229798 - RNA, 21 nt, Human
cucuugaugccuggcggggug

SEQ ID NO: 1229799 - RNA, 21 nt, Human
cugaggaaauugcuuuguauu

SEQ ID NO: 1229800 - RNA, 14 nt, Human
cguaaaauuaagaa

SEQ ID NO: 1229801 - RNA, 13 nt, Human
cgugauccacccg

SEQ ID NO: 1229802 - RNA, 17 nt, Human
cgugauccacccgccuc

SEQ ID NO: 1229803 - RNA, 24 nt, Human
cgugauccacccgccucagccucc

SEQ ID NO: 1229804 - RNA, 14 nt, Human
cgugaucucagcuc

SEQ ID NO: 1229805 - RNA, 15 nt, Human
cgugaucucagcuca

SEQ ID NO: 1229806 - RNA, 19 nt, Human
cggaggaaggaggacccag

SEQ ID NO: 1229807 - RNA, 20 nt, Human
cggaggaaggaggacccagg

SEQ ID NO: 1229808 - RNA, 21 nt, Human
cggaggaaggaggacccagga

SEQ ID NO: 1229809 - RNA, 23 nt, Human
cggaggaaggaggacccaggaca

SEQ ID NO: 1229810 - RNA, 16 nt, Human
cgccuccaacccuagc

SEQ ID NO: 1229811 - RNA, 17 nt, Human
cgccuccaacccuagca

SEQ ID NO: 1229812 - RNA, 18 nt, Human
cgacugaaaauauuguuu

SEQ ID NO: 1229813 - RNA, 17 nt, Human
cgacugaaaauauuguu

SEQ ID NO: 1229814 - RNA, 16 nt, Human
ccuuuuuuaaauaaau

SEQ ID NO: 1229815 - RNA, 15 nt, Human
ccuuuuucauuauuu

SEQ ID NO: 1229816 - RNA, 19 nt, Human
cucaauucuucccuaucuu

SEQ ID NO: 1229817 - RNA, 16 nt, Human
cucaauauucaauaaa

SEQ ID NO: 1229818 - RNA, 17 nt, Human
cucaauauucaauaaag

SEQ ID NO: 1229819 - RNA, 18 nt, Human
cucaauauucaauaaagc

SEQ ID NO: 1229820 - RNA, 19 nt, Human
cucaauauucaauaaagcu

SEQ ID NO: 1229821 - RNA, 18 nt, Human
cucaaaccaaaucacuga

SEQ ID NO: 1229822 - RNA, 19 nt, Human
cucaaaccaaaucacugaa

SEQ ID NO: 1229823 - RNA, 22 nt, Human
cucaaaccaaaucacugaacuu

SEQ ID NO: 1229824 - RNA, 18 nt, Human
cuaucguaaaauuaagaa

SEQ ID NO: 1229825 - RNA, 23 nt, Human
cuagaauuugauaugugaacagu

SEQ ID NO: 1229826 - RNA, 14 nt, Human
cuaauucuaaugug

SEQ ID NO: 1229827 - RNA, 11 nt, Human
ccugaguccca

SEQ ID NO: 1229828 - RNA, 16 nt, Human
ccugagucccaucccu

SEQ ID NO: 1229829 - RNA, 16 nt, Human
ccugccuccccugccu

SEQ ID NO: 1229830 - RNA, 16 nt, Human
ccugccucccuucaug

SEQ ID NO: 1229831 - RNA, 20 nt, Human
ccugucugucugucuguccc

SEQ ID NO: 1229832 - RNA, 21 nt, Human
ccugucugucugucuguccca

SEQ ID NO: 1229833 - RNA, 22 nt, Human
ccugucugucugucugucccaa

SEQ ID NO: 1229834 - RNA, 17 nt, Human
ccugucuugccuuuuuc

SEQ ID NO: 1229835 - RNA, 19 nt, Human
ccugucuugccuuuuucau

SEQ ID NO: 1229836 - RNA, 20 nt, Human
ccugucuugccuuuuucauu

SEQ ID NO: 1229837 - RNA, 19 nt, Human
ccuccaacccuagcaaaag

SEQ ID NO: 1229838 - RNA, 18 nt, Human
ccuccaacccuagcaaaa

SEQ ID NO: 1229839 - RNA, 18 nt, Human
ccucccauguucaagcga

SEQ ID NO: 1229840 - RNA, 23 nt, Human
ccucauggaauuggagcucgugg

SEQ ID NO: 1229841 - RNA, 14 nt, Human
cccuaucuuugcca

SEQ ID NO: 1229842 - RNA, 16 nt, Human
cccuaucuuugccacc

SEQ ID NO: 1229843 - RNA, 19 nt, Human
cccuaucuuugccacccuc

SEQ ID NO: 1229844 - RNA, 21 nt, Human
cccuaucuuugccacccucau

SEQ ID NO: 1229845 - RNA, 10 nt, Human
cccucacacu

SEQ ID NO: 1229846 - RNA, 12 nt, Human
cccucacacugg

SEQ ID NO: 1229847 - RNA, 13 nt, Human
cccucacacuggg

SEQ ID NO: 1229848 - RNA, 14 nt, Human
cccucacacuggga

SEQ ID NO: 1229849 - RNA, 18 nt, Human
cccaggaauggagccugc

SEQ ID NO: 1229850 - RNA, 19 nt, Human
cccaggaauggagccugca

SEQ ID NO: 1229851 - RNA, 20 nt, Human
cccaggaauggagccugcac

SEQ ID NO: 1229852 - RNA, 22 nt, Human
cccaggaauggagccugcacgg

SEQ ID NO: 1229853 - RNA, 16 nt, Human
ccagcagauuauucac

SEQ ID NO: 1229854 - RNA, 15 nt, Human
ccagcagauuauuca

SEQ ID NO: 1229855 - RNA, 15 nt, Human
ccagcuaauuuuugu

SEQ ID NO: 1229856 - RNA, 15 nt, Human
ccagggggcaagagg

SEQ ID NO: 1229857 - RNA, 22 nt, Human
ccaguauuguacaaaguauuaa

SEQ ID NO: 1229858 - RNA, 14 nt, Human
ccauacauuugugu

SEQ ID NO: 1229859 - RNA, 13 nt, Human
ccauacauuugug

SEQ ID NO: 1229860 - RNA, 16 nt, Human
ccaguuuuguuuggac

SEQ ID NO: 1229861 - RNA, 19 nt, Human
ccaguuuuguuuggaccaa

SEQ ID NO: 1229862 - RNA, 12 nt, Human
ccaucccugcgu

SEQ ID NO: 1229863 - RNA, 20 nt, Human
caauucuucccuaucuuugc

SEQ ID NO: 1229864 - RNA, 17 nt, Human
caauucuucccuaucuu

SEQ ID NO: 1229865 - RNA, 15 nt, Human
caaugcuguauuuua

SEQ ID NO: 1229866 - RNA, 14 nt, Human
caaugcuguauuuu

SEQ ID NO: 1229867 - RNA, 21 nt, Human
caauauuucagauaaucacaa

SEQ ID NO: 1229868 - RNA, 20 nt, Human
caauauuucagauaaucaca

SEQ ID NO: 1229869 - RNA, 12 nt, Human
caauauuucaga

SEQ ID NO: 1229870 - RNA, 18 nt, Human
cacaagacugcacaucaa

SEQ ID NO: 1229871 - RNA, 16 nt, Human
cacaagacugcacauc

SEQ ID NO: 1229872 - RNA, 20 nt, Human
caaguauuagaauaccacag

SEQ ID NO: 1229873 - RNA, 14 nt, Human
caaguauuagaaua

SEQ ID NO: 1229874 - RNA, 13 nt, Human
caauaaaaaauua

SEQ ID NO: 1229875 - RNA, 16 nt, Human
caauaaaaaauuauga

SEQ ID NO: 1229876 - RNA, 17 nt, Human
caauaaaaaauuaugac

SEQ ID NO: 1229877 - RNA, 21 nt, Human
cacagggccuuuggcaggugc

SEQ ID NO: 1229878 - RNA, 14 nt, Human
cacuacacccagca

SEQ ID NO: 1229879 - RNA, 15 nt, Human
cacuacacccagcaa

SEQ ID NO: 1229880 - RNA, 16 nt, Human
cacuacacccagcaau

SEQ ID NO: 1229881 - RNA, 17 nt, Human
cacuacacccagcaaua

SEQ ID NO: 1229882 - RNA, 18 nt, Human
cacuacacccagcaauag

SEQ ID NO: 1229883 - RNA, 23 nt, Human
cacuacgccuggcugauuuuugu

SEQ ID NO: 1229884 - RNA, 20 nt, Human
cacggcagccacagcuuggg

SEQ ID NO: 1229885 - RNA, 14 nt, Human
cacuacaaccuccg

SEQ ID NO: 1229886 - RNA, 13 nt, Human
cacuacaaccucc

SEQ ID NO: 1229887 - RNA, 12 nt, Human
cacuacacccag

SEQ ID NO: 1229888 - RNA, 13 nt, Human
cacggcagccaca

SEQ ID NO: 1229889 - RNA, 17 nt, Human
cacucuugaaaaaugca

SEQ ID NO: 1229890 - RNA, 11 nt, Human
cacugaagaag

SEQ ID NO: 1229891 - RNA, 20 nt, Human
cacugaacuuugcugagccu

SEQ ID NO: 1229892 - RNA, 17 nt, Human
auuuuauagcuacuaau

SEQ ID NO: 1229893 - RNA, 22 nt, Human
caaaagcccauucauuccauuc

SEQ ID NO: 1229894 - RNA, 20 nt, Human
caaaccacuuuuugcagcuu

SEQ ID NO: 1229895 - RNA, 19 nt, Human
caaaccacuuuuugcagcu

SEQ ID NO: 1229896 - RNA, 17 nt, Human
caaaccacuuuuugcag

SEQ ID NO: 1229897 - RNA, 23 nt, Human
caagaauuucuaggacugaauua

SEQ ID NO: 1229898 - RNA, 15 nt, Human
caaaguauuaagcau

SEQ ID NO: 1229899 - RNA, 16 nt, Human
caaaguauuaagcaua

SEQ ID NO: 1229900 - RNA, 17 nt, Human
caaaguauuaagcauau

SEQ ID NO: 1229901 - RNA, 19 nt, Human
caaaguauuaagcauauau

SEQ ID NO: 1229902 - RNA, 21 nt, Human
caaaguauuaagcauauauuu

SEQ ID NO: 1229903 - RNA, 22 nt, Human
caaauccagccugcugccugcu

SEQ ID NO: 1229904 - RNA, 16 nt, Human
auuucagcagcugcag

SEQ ID NO: 1229905 - RNA, 20 nt, Human
auuucuaugaaauauuaugu

SEQ ID NO: 1229906 - RNA, 18 nt, Human
auuucuaugaaauauuau

SEQ ID NO: 1229907 - RNA, 15 nt, Human
auuucuaugaaauau

SEQ ID NO: 1229908 - RNA, 23 nt, Human
auuguaauaggcguaacuaauuu

SEQ ID NO: 1229909 - RNA, 18 nt, Human
auugaugggauuugguca

SEQ ID NO: 1229910 - RNA, 18 nt, Human
auugauccagaaagaaaa

SEQ ID NO: 1229911 - RNA, 19 nt, Human
auugauccagaaagaaaac

SEQ ID NO: 1229912 - RNA, 22 nt, Human
auugauccagaaagaaaacuug

SEQ ID NO: 1229913 - RNA, 23 nt, Human
auuguacaaaguauuaagcauau

SEQ ID NO: 1229914 - RNA, 22 nt, Human
auuguacaaaguauuaagcaua

SEQ ID NO: 1229915 - RNA, 15 nt, Human
auuauguguguuuua

SEQ ID NO: 1229916 - RNA, 20 nt, Human
auuauguguguuuuaaaaug

SEQ ID NO: 1229917 - RNA, 21 nt, Human
auuauguguguuuuaaaauga

SEQ ID NO: 1229918 - RNA, 21 nt, Human
auuauguuaaaacugggacag

SEQ ID NO: 1229919 - RNA, 13 nt, Human
auuccugaacagg

SEQ ID NO: 1229920 - RNA, 20 nt, Human
auugagaaaaauauauacua

SEQ ID NO: 1229921 - RNA, 16 nt, Human
auugauccagaaagaa

SEQ ID NO: 1229922 - RNA, 17 nt, Human
auugauccagaaagaaa

SEQ ID NO: 1229923 - RNA, 20 nt, Human
cauuuguguugaagagguuu

SEQ ID NO: 1229924 - RNA, 18 nt, Human
cauuuuuugggcagcaau

SEQ ID NO: 1229925 - RNA, 19 nt, Human
cauuuuuugggcagcaauu

SEQ ID NO: 1229926 - RNA, 22 nt, Human
cauuuuuugggcagcaauuuaa

SEQ ID NO: 1229927 - RNA, 16 nt, Human
cauuuguguugaagag

SEQ ID NO: 1229928 - RNA, 20 nt, Human
cauuuguauaaaauaauuuu

SEQ ID NO: 1229929 - RNA, 19 nt, Human
cauuuguauaaaauaauuu

SEQ ID NO: 1229930 - RNA, 14 nt, Human
ccacagcugccucu

SEQ ID NO: 1229931 - RNA, 15 nt, Human
ccaccgcagaaggaa

SEQ ID NO: 1229932 - RNA, 16 nt, Human
ccaccgcagaaggaag

SEQ ID NO: 1229933 - RNA, 12 nt, Human
cauccuggaaua

SEQ ID NO: 1229934 - RNA, 12 nt, Human
caucuggaacca

SEQ ID NO: 1229935 - RNA, 17 nt, Human
caucuggaaccaucaga

SEQ ID NO: 1229936 - RNA, 19 nt, Human
caucuggaaccaucagaaa

SEQ ID NO: 1229937 - RNA, 19 nt, Human
cauuauauuuauuacugua

SEQ ID NO: 1229938 - RNA, 13 nt, Human
cauuauaaaaaga

SEQ ID NO: 1229939 - RNA, 14 nt, Human
caugauguuuagaa

SEQ ID NO: 1229940 - RNA, 20 nt, Human
caugcucuccaaaccacuuu

SEQ ID NO: 1229941 - RNA, 13 nt, Human
cagcauaauacuu

SEQ ID NO: 1229942 - RNA, 21 nt, Human
cagaguaauccaagcaaaugu

SEQ ID NO: 1229943 - RNA, 12 nt, Human
cagauccuggaa

SEQ ID NO: 1229944 - RNA, 13 nt, Human
cagauccuggaaa

SEQ ID NO: 1229945 - RNA, 23 nt, Human
caguaaagaacaucccuccuggg

SEQ ID NO: 1229946 - RNA, 19 nt, Human
cagucaccucauggaauug

SEQ ID NO: 1229947 - RNA, 16 nt, Human
cagucaccucauggaa

SEQ ID NO: 1229948 - RNA, 21 nt, Human
cagugggaggugagaccaccu

SEQ ID NO: 1229949 - RNA, 14 nt, Human
caguggggaaugaa

SEQ ID NO: 1229950 - RNA, 22 nt, Human
cagugggaggugagaccaccuc

SEQ ID NO: 1229951 - RNA, 20 nt, Human
cagucugacuguuuccauca

SEQ ID NO: 1229952 - RNA, 16 nt, Human
caggcacacaccacca

SEQ ID NO: 1229953 - RNA, 11 nt, Human
aaauguauacu

SEQ ID NO: 1229954 - RNA, 16 nt, Human
aaaucauucauuuucu

SEQ ID NO: 1229955 - RNA, 23 nt, Human
guauuguacaaaguauuaagcau

SEQ ID NO: 1229956 - RNA, 21 nt, Human
guauuguacaaaguauuaagc

SEQ ID NO: 1229957 - RNA, 22 nt, Human
guauuguacaaaguauuaagca

SEQ ID NO: 1229958 - RNA, 19 nt, Human
guauuguacaaaguauuaa

SEQ ID NO: 1229959 - RNA, 17 nt, Human
aaauuccaagugauuga

SEQ ID NO: 1229960 - RNA, 17 nt, Human
aaauuguauuacaaauc

SEQ ID NO: 1229961 - RNA, 12 nt, Human
aaauuacaacua

SEQ ID NO: 1229962 - RNA, 13 nt, Human
aaauuacaacuaa

SEQ ID NO: 1229963 - RNA, 16 nt, Human
aaauuaucuauagcua

SEQ ID NO: 1229964 - RNA, 17 nt, Human
aaauuaugugacauuuu

SEQ ID NO: 1229965 - RNA, 20 nt, Human
aaauuaugugacauuuuaca

SEQ ID NO: 1229966 - RNA, 22 nt, Human
aaauuaugugacauuuuacauu

SEQ ID NO: 1229967 - RNA, 23 nt, Human
aaauuaugugccagauuuaugca

SEQ ID NO: 1229968 - RNA, 14 nt, Human
gucaggaaagagaa

SEQ ID NO: 1229969 - RNA, 18 nt, Human
gucacauuccugaacagg

SEQ ID NO: 1229970 - RNA, 15 nt, Human
guccgugcuaaggac

SEQ ID NO: 1229971 - RNA, 16 nt, Human
guccgugcuaaggacu

SEQ ID NO: 1229972 - RNA, 17 nt, Human
guccgugcuaaggacuu

SEQ ID NO: 1229973 - RNA, 12 nt, Human
aacauauauaac

SEQ ID NO: 1229974 - RNA, 15 nt, Human
aacauaaaaaggaca

SEQ ID NO: 1229975 - RNA, 19 nt, Human
aacauaaaaaggacaucag

SEQ ID NO: 1229976 - RNA, 20 nt, Human
aacauaaaaaggacaucagc

SEQ ID NO: 1229977 - RNA, 22 nt, Human
aacauaaaaaggacaucagcaa

SEQ ID NO: 1229978 - RNA, 16 nt, Human
aacauauauaacaaug

SEQ ID NO: 1229979 - RNA, 14 nt, Human
aacauguuaaacca

SEQ ID NO: 1229980 - RNA, 15 nt, Human
aacauguuaaaccau

SEQ ID NO: 1229981 - RNA, 16 nt, Human
aacauguuaaaccaug

SEQ ID NO: 1229982 - RNA, 10 nt, Human
aacauuccau

SEQ ID NO: 1229983 - RNA, 13 nt, Human
aacauuccauccu

SEQ ID NO: 1229984 - RNA, 14 nt, Human
aacauuccauccuu

SEQ ID NO: 1229985 - RNA, 23 nt, Human
aacauuccauccuugagucaaaa

SEQ ID NO: 1229986 - RNA, 20 nt, Human
gucuauuuacggaacucaaa

SEQ ID NO: 1229987 - RNA, 12 nt, Human
aaauuugaauuu

SEQ ID NO: 1229988 - RNA, 15 nt, Human
aaauuugaauuuugu

SEQ ID NO: 1229989 - RNA, 22 nt, Human
aaauuugaauuuuguguuagag

SEQ ID NO: 1229990 - RNA, 12 nt, Human
aacacucaccau

SEQ ID NO: 1229991 - RNA, 21 nt, Human
aacacugggagaaaugaaaaa

SEQ ID NO: 1229992 - RNA, 15 nt, Human
gucccuaauaaagcu

SEQ ID NO: 1229993 - RNA, 12 nt, Human
gucccuaauaaa

SEQ ID NO: 1229994 - RNA, 12 nt, Human
gugacuuuggau

SEQ ID NO: 1229995 - RNA, 15 nt, Human
gugacuuuggauaau

SEQ ID NO: 1229996 - RNA, 18 nt, Human
gugacuuuggcugcaugc

SEQ ID NO: 1229997 - RNA, 20 nt, Human
gugacuuuggcugcaugcga

SEQ ID NO: 1229998 - RNA, 13 nt, Human
gugagaccaccuc

SEQ ID NO: 1229999 - RNA, 14 nt, Human
gugagaccaccucu

SEQ ID NO: 1230000 - RNA, 20 nt, Human
gugagaccaccucucaauau

SEQ ID NO: 1230001 - RNA, 21 nt, Human
aacuaggugcauauuuauaaa

SEQ ID NO: 1230002 - RNA, 12 nt, Human
aacuauggccug

SEQ ID NO: 1230003 - RNA, 15 nt, Human
aacuauugcauuuau

SEQ ID NO: 1230004 - RNA, 15 nt, Human
aacgucuuaaauauu

SEQ ID NO: 1230005 - RNA, 14 nt, Human
aacgucuuaaauau

SEQ ID NO: 1230006 - RNA, 12 nt, Human
aacgucuuaaau

SEQ ID NO: 1230007 - RNA, 13 nt, Human
aaccuuccaccca

SEQ ID NO: 1230008 - RNA, 15 nt, Human
aaccuuccacccagu

SEQ ID NO: 1230009 - RNA, 23 nt, Human
gucuugucucagauuuuauuaug

SEQ ID NO: 1230010 - RNA, 19 nt, Human
gugccagauuuaugcauau

SEQ ID NO: 1230011 - RNA, 11 nt, Human
aagaaacauuu

SEQ ID NO: 1230012 - RNA, 14 nt, Human
aagaaagaacggaa

SEQ ID NO: 1230013 - RNA, 22 nt, Human
aagaagcaccaaucaugaauua

SEQ ID NO: 1230014 - RNA, 18 nt, Human
gugcucaggagcccuggg

SEQ ID NO: 1230015 - RNA, 19 nt, Human
gugcucaggagcccuggga

SEQ ID NO: 1230016 - RNA, 16 nt, Human
gugcucauuucaggau

SEQ ID NO: 1230017 - RNA, 21 nt, Human
aacuucagcgguuuauauaag

SEQ ID NO: 1230018 - RNA, 18 nt, Human
aacuucagcgguuuauau

SEQ ID NO: 1230019 - RNA, 12 nt, Human
aacuugaaauuu

SEQ ID NO: 1230020 - RNA, 13 nt, Human
aacuugaaauuug

SEQ ID NO: 1230021 - RNA, 18 nt, Human
aacuugaaauuugaauuu

SEQ ID NO: 1230022 - RNA, 19 nt, Human
aacuugaaauuugaauuuu

SEQ ID NO: 1230023 - RNA, 12 nt, Human
aacuugaggaca

SEQ ID NO: 1230024 - RNA, 13 nt, Human
aacuugaggacac

SEQ ID NO: 1230025 - RNA, 14 nt, Human
aacuugaggacaca

SEQ ID NO: 1230026 - RNA, 15 nt, Human
aacuugaggacacau

SEQ ID NO: 1230027 - RNA, 16 nt, Human
aacuugaggacacaug

SEQ ID NO: 1230028 - RNA, 17 nt, Human
aacuugaggacacaugu

SEQ ID NO: 1230029 - RNA, 18 nt, Human
aacuugaggacacauguc

SEQ ID NO: 1230030 - RNA, 19 nt, Human
aacuugaggacacaugucc

SEQ ID NO: 1230031 - RNA, 20 nt, Human
aacuugaggacacaugucca

SEQ ID NO: 1230032 - RNA, 13 nt, Human
gugcaccugcccc

SEQ ID NO: 1230033 - RNA, 14 nt, Human
gugaucucagcuca

SEQ ID NO: 1230034 - RNA, 14 nt, Human
uaaaaaaaaaauug

SEQ ID NO: 1230035 - RNA, 18 nt, Human
uaaaaaaaaaauugggga

SEQ ID NO: 1230036 - RNA, 23 nt, Human
aagucagaucugccuaaggacuu

SEQ ID NO: 1230037 - RNA, 11 nt, Human
uaaaaaggaca

SEQ ID NO: 1230038 - RNA, 18 nt, Human
uaaaaaggacaucagcaa

SEQ ID NO: 1230039 - RNA, 19 nt, Human
uaaaaaggacaucagcaaa

SEQ ID NO: 1230040 - RNA, 21 nt, Human
uaaaaaggacaucagcaaaca

SEQ ID NO: 1230041 - RNA, 17 nt, Human
uaaaaaggcuaaaugga

SEQ ID NO: 1230042 - RNA, 18 nt, Human
uaaaauagucucuuuaaa

SEQ ID NO: 1230043 - RNA, 16 nt, Human
uaaaagaaacccugca

SEQ ID NO: 1230044 - RNA, 17 nt, Human
uaaaagaaacccugcac

SEQ ID NO: 1230045 - RNA, 22 nt, Human
uaaaauaauuuuuauauuugaa

SEQ ID NO: 1230046 - RNA, 19 nt, Human
aaguuauuuuuaauuuggu

SEQ ID NO: 1230047 - RNA, 21 nt, Human
aaguucaccagacucuauaaa

SEQ ID NO: 1230048 - RNA, 20 nt, Human
aaguuccuuggccaugcaga

SEQ ID NO: 1230049 - RNA, 16 nt, Human
aaguuuccaucaucua

SEQ ID NO: 1230050 - RNA, 12 nt, Human
aaguguguguuu

SEQ ID NO: 1230051 - RNA, 16 nt, Human
aaguguguguuuuuca

SEQ ID NO: 1230052 - RNA, 21 nt, Human
aaguguguguuuuucauaaag

SEQ ID NO: 1230053 - RNA, 12 nt, Human
aaggaaaaguuu

SEQ ID NO: 1230054 - RNA, 12 nt, Human
aaggaaagaaaa

SEQ ID NO: 1230055 - RNA, 12 nt, Human
guuguuuguuua

SEQ ID NO: 1230056 - RNA, 19 nt, Human
guuuaauauuaaagccaug

SEQ ID NO: 1230057 - RNA, 13 nt, Human
guuuaauauuaaa

SEQ ID NO: 1230058 - RNA, 14 nt, Human
guuuaauauuaaag

SEQ ID NO: 1230059 - RNA, 15 nt, Human
guuuaauauuaaagc

SEQ ID NO: 1230060 - RNA, 18 nt, Human
guuuaauauuaaagccau

SEQ ID NO: 1230061 - RNA, 13 nt, Human
guuuauuacagua

SEQ ID NO: 1230062 - RNA, 17 nt, Human
guuuauuacaguauaau

SEQ ID NO: 1230063 - RNA, 17 nt, Human
aagggcuguuauaaucu

SEQ ID NO: 1230064 - RNA, 15 nt, Human
aagggcuguuauaau

SEQ ID NO: 1230065 - RNA, 23 nt, Human
aaguaacugggauuacaggcaug

SEQ ID NO: 1230066 - RNA, 15 nt, Human
guuuuaaagcuucca

SEQ ID NO: 1230067 - RNA, 19 nt, Human
guuuggacaaaauggaaua

SEQ ID NO: 1230068 - RNA, 18 nt, Human
guuuggaccaaaaaccag

SEQ ID NO: 1230069 - RNA, 19 nt, Human
aaguacacaauaagcaaaa

SEQ ID NO: 1230070 - RNA, 16 nt, Human
aaguacacaauaagca

SEQ ID NO: 1230071 - RNA, 17 nt, Human
aaguacacaauaagcaa

SEQ ID NO: 1230072 - RNA, 18 nt, Human
aaguacacaauaagcaaa

SEQ ID NO: 1230073 - RNA, 21 nt, Human
aaguauguuagugcaaauugu

SEQ ID NO: 1230074 - RNA, 19 nt, Human
aaguauguuagugcaaauu

SEQ ID NO: 1230075 - RNA, 18 nt, Human
aaguauguuagugcaaau

SEQ ID NO: 1230076 - RNA, 18 nt, Human
aagucagaucugccuaag

SEQ ID NO: 1230077 - RNA, 21 nt, Human
aagucagaucugccuaaggac

SEQ ID NO: 1230078 - RNA, 22 nt, Human
aagucagaucugccuaaggacu

SEQ ID NO: 1230079 - RNA, 19 nt, Human
guugacuuauaguacauga

SEQ ID NO: 1230080 - RNA, 24 nt, Human
guugacuuauaguacaugauaaau

SEQ ID NO: 1230081 - RNA, 18 nt, Human
guucccuugaugaagaag

SEQ ID NO: 1230082 - RNA, 19 nt, Human
aagcuuuuaugugaaacau

SEQ ID NO: 1230083 - RNA, 21 nt, Human
aagcuuuuaugugaaacaugu

SEQ ID NO: 1230084 - RNA, 23 nt, Human
aagcuuguauuccuuuuucucuc

SEQ ID NO: 1230085 - RNA, 18 nt, Human
aagcuuaugcuuaaauuc

SEQ ID NO: 1230086 - RNA, 20 nt, Human
aagccauguuuauuacagua

SEQ ID NO: 1230087 - RNA, 21 nt, Human
aagccauguuuauuacaguau

SEQ ID NO: 1230088 - RNA, 22 nt, Human
aagccauguuuauuacaguaua

SEQ ID NO: 1230089 - RNA, 23 nt, Human
aagccauguuuauuacaguauaa

SEQ ID NO: 1230090 - RNA, 22 nt, Human
aagccauucuccugccucagcc

SEQ ID NO: 1230091 - RNA, 18 nt, Human
guuagagauuuuuuuguu

SEQ ID NO: 1230092 - RNA, 19 nt, Human
guuauuauauuuacaaaug

SEQ ID NO: 1230093 - RNA, 20 nt, Human
guuauuauauuuacaaaugg

SEQ ID NO: 1230094 - RNA, 15 nt, Human
aagccuguuuaagag

SEQ ID NO: 1230095 - RNA, 18 nt, Human
aagccuguuuaagagaca

SEQ ID NO: 1230096 - RNA, 21 nt, Human
aagccuuggggcugaugcagu

SEQ ID NO: 1230097 - RNA, 23 nt, Human
aagcaugcacaaauucugucucu

SEQ ID NO: 1230098 - RNA, 23 nt, Human
aagcauauauuuuuauauuuacu

SEQ ID NO: 1230099 - RNA, 15 nt, Human
aagccauguuuauua

SEQ ID NO: 1230100 - RNA, 16 nt, Human
aagccauguuuauuac

SEQ ID NO: 1230101 - RNA, 17 nt, Human
aagccauguuuauuaca

SEQ ID NO: 1230102 - RNA, 16 nt, Human
aagcacuaaacaaaga

SEQ ID NO: 1230103 - RNA, 12 nt, Human
guguuugaagca

SEQ ID NO: 1230104 - RNA, 18 nt, Human
guguaaauacaauuuugu

SEQ ID NO: 1230105 - RNA, 21 nt, Human
guguaaauacaauuuuguuuc

SEQ ID NO: 1230106 - RNA, 22 nt, Human
guguaaauacaauuuuguuucu

SEQ ID NO: 1230107 - RNA, 15 nt, Human
uagaugcaguucuga

SEQ ID NO: 1230108 - RNA, 16 nt, Human
uagaugcaguucugaa

SEQ ID NO: 1230109 - RNA, 18 nt, Human
uagcaugucgucaaagcu

SEQ ID NO: 1230110 - RNA, 14 nt, Human
uagccaagugcagg

SEQ ID NO: 1230111 - RNA, 18 nt, Human
acaaaaggauaaugaaua

SEQ ID NO: 1230112 - RNA, 21 nt, Human
aauuguguuuauaauuuuaaa

SEQ ID NO: 1230113 - RNA, 16 nt, Human
aauuguuacaaauugu

SEQ ID NO: 1230114 - RNA, 20 nt, Human
uagauaucaugcaaauuuca

SEQ ID NO: 1230115 - RNA, 23 nt, Human
uagagauuuuuuuguuguuuguu

SEQ ID NO: 1230116 - RNA, 15 nt, Human
uagcuaaguacacaa

SEQ ID NO: 1230117 - RNA, 22 nt, Human
uagcuaaguacacaauaagcaa

SEQ ID NO: 1230118 - RNA, 21 nt, Human
uagcuagacuggugacugauu

SEQ ID NO: 1230119 - RNA, 22 nt, Human
uagcuagacuggugacugauuc

SEQ ID NO: 1230120 - RNA, 23 nt, Human
acaauacaucccuuaccugggaa

SEQ ID NO: 1230121 - RNA, 13 nt, Human
acaauaaauagac

SEQ ID NO: 1230122 - RNA, 15 nt, Human
acaauaagcaaaaac

SEQ ID NO: 1230123 - RNA, 16 nt, Human
acaauaagcaaaaaca

SEQ ID NO: 1230124 - RNA, 14 nt, Human
acaagacugcacau

SEQ ID NO: 1230125 - RNA, 13 nt, Human
acaagacugcaca

SEQ ID NO: 1230126 - RNA, 18 nt, Human
uaggaaauauuuauuuua

SEQ ID NO: 1230127 - RNA, 19 nt, Human
uaggaaauauuuauuuuaa

SEQ ID NO: 1230128 - RNA, 23 nt, Human
uaguguuggagaagaacugaaau

SEQ ID NO: 1230129 - RNA, 22 nt, Human
uagugaaacucguuaauuugua

SEQ ID NO: 1230130 - RNA, 22 nt, Human
acaaugcuguauuuuaaaagaa

SEQ ID NO: 1230131 - RNA, 19 nt, Human
acaauggauaggcacagga

SEQ ID NO: 1230132 - RNA, 22 nt, Human
acaauguccuaacugaaagaug

SEQ ID NO: 1230133 - RNA, 17 nt, Human
acacaccaccacgccug

SEQ ID NO: 1230134 - RNA, 20 nt, Human
acacaccaccacgccuggcu

SEQ ID NO: 1230135 - RNA, 19 nt, Human
uauaaaaauaaaaaacacu

SEQ ID NO: 1230136 - RNA, 20 nt, Human
uauaaaagccuguuuaagag

SEQ ID NO: 1230137 - RNA, 20 nt, Human
uauaaaaauaaaaaacacug

SEQ ID NO: 1230138 - RNA, 22 nt, Human
uauaaaagggacugagaaauuu

SEQ ID NO: 1230139 - RNA, 17 nt, Human
acaccauuaugugcgcu

SEQ ID NO: 1230140 - RNA, 21 nt, Human
acaccauuaugugcgcugaua

SEQ ID NO: 1230141 - RNA, 16 nt, Human
acacccucacacuggg

SEQ ID NO: 1230142 - RNA, 13 nt, Human
acacccucacacu

SEQ ID NO: 1230143 - RNA, 14 nt, Human
acacuaagagagaa

SEQ ID NO: 1230144 - RNA, 13 nt, Human
acacuaagagaga

SEQ ID NO: 1230145 - RNA, 15 nt, Human
uauaaguguguguuu

SEQ ID NO: 1230146 - RNA, 14 nt, Human
uauuacuguaagaa

SEQ ID NO: 1230147 - RNA, 15 nt, Human
uauuagaauaccaca

SEQ ID NO: 1230148 - RNA, 23 nt, Human
uauucaaaaauuaucuauagcua

SEQ ID NO: 1230149 - RNA, 14 nt, Human
uauucauaauuauu

SEQ ID NO: 1230150 - RNA, 12 nt, Human
uauucaaaguug

SEQ ID NO: 1230151 - RNA, 13 nt, Human
uauucaaaguugc

SEQ ID NO: 1230152 - RNA, 16 nt, Human
uauucaaaguugccua

SEQ ID NO: 1230153 - RNA, 12 nt, Human
uauucaauaaag

SEQ ID NO: 1230154 - RNA, 13 nt, Human
uauucaauaaagc

SEQ ID NO: 1230155 - RNA, 14 nt, Human
uauucaauaaagcu

SEQ ID NO: 1230156 - RNA, 16 nt, Human
uauucaauucuuuuaa

SEQ ID NO: 1230157 - RNA, 21 nt, Human
uauucagcucauggacuucug

SEQ ID NO: 1230158 - RNA, 18 nt, Human
acagucaccucauggaau

SEQ ID NO: 1230159 - RNA, 17 nt, Human
acagucaccucauggaa

SEQ ID NO: 1230160 - RNA, 16 nt, Human
acagucaccucaugga

SEQ ID NO: 1230161 - RNA, 15 nt, Human
acaguauaauuaaca

SEQ ID NO: 1230162 - RNA, 20 nt, Human
acaguauaauuaacauguua

SEQ ID NO: 1230163 - RNA, 13 nt, Human
acaguauaauuaa

SEQ ID NO: 1230164 - RNA, 16 nt, Human
acaggcaugugucacc

SEQ ID NO: 1230165 - RNA, 19 nt, Human
acaggcaugugucaccaug

SEQ ID NO: 1230166 - RNA, 14 nt, Human
uaugugaaacaugu

SEQ ID NO: 1230167 - RNA, 21 nt, Human
uaugugacauuuuacauuaaa

SEQ ID NO: 1230168 - RNA, 19 nt, Human
uaugugacauuuuacauua

SEQ ID NO: 1230169 - RNA, 22 nt, Human
uaugugaacaguuguguuugaa

SEQ ID NO: 1230170 - RNA, 12 nt, Human
uaugugaacagu

SEQ ID NO: 1230171 - RNA, 17 nt, Human
uaugugaaacauguuuc

SEQ ID NO: 1230172 - RNA, 14 nt, Human
uaugugacauuuua

SEQ ID NO: 1230173 - RNA, 18 nt, Human
uaugugacauuuuacauu

SEQ ID NO: 1230174 - RNA, 20 nt, Human
uauguguaugcacaguaaaa

SEQ ID NO: 1230175 - RNA, 12 nt, Human
uaugugugaagu

SEQ ID NO: 1230176 - RNA, 14 nt, Human
uaugugugaaguga

SEQ ID NO: 1230177 - RNA, 12 nt, Human
uauauuacaaug

SEQ ID NO: 1230178 - RNA, 13 nt, Human
uauauuacaauga

SEQ ID NO: 1230179 - RNA, 17 nt, Human
uauauuacaaugaucac

SEQ ID NO: 1230180 - RNA, 15 nt, Human
uauauuguuugcuaa

SEQ ID NO: 1230181 - RNA, 20 nt, Human
uauauuuacuaaaauggacu

SEQ ID NO: 1230182 - RNA, 21 nt, Human
uauauuuacuaaaauggacug

SEQ ID NO: 1230183 - RNA, 16 nt, Human
uauauuuaguaucuuu

SEQ ID NO: 1230184 - RNA, 17 nt, Human
uauaaguguguguuuuu

SEQ ID NO: 1230185 - RNA, 23 nt, Human
uauaaguguguguuuuucauaaa

SEQ ID NO: 1230186 - RNA, 23 nt, Human
uaucuauauuuuacauaaauuua

SEQ ID NO: 1230187 - RNA, 11 nt, Human
uaucuuugcca

SEQ ID NO: 1230188 - RNA, 14 nt, Human
uaucuuugccaccc

SEQ ID NO: 1230189 - RNA, 16 nt, Human
uaucuuugccacccuc

SEQ ID NO: 1230190 - RNA, 22 nt, Human
uaucuuugccacccucaugcug

SEQ ID NO: 1230191 - RNA, 21 nt, Human
uaugauuaaguaaugauaacu

SEQ ID NO: 1230192 - RNA, 20 nt, Human
uaugauuaaguaaugauaac

SEQ ID NO: 1230193 - RNA, 16 nt, Human
uaugauuaaguaauga

SEQ ID NO: 1230194 - RNA, 16 nt, Human
uaugaacuugaggaca

SEQ ID NO: 1230195 - RNA, 18 nt, Human
uaugaacuugaggacaca

SEQ ID NO: 1230196 - RNA, 19 nt, Human
uaugaacuugaggacacau

SEQ ID NO: 1230197 - RNA, 16 nt, Human
uaugccuuguuucaua

SEQ ID NO: 1230198 - RNA, 19 nt, Human
uaugccccauucaacaucu

SEQ ID NO: 1230199 - RNA, 16 nt, Human
acagccucuuagaugc

SEQ ID NO: 1230200 - RNA, 12 nt, Human
uacuauaguacc

SEQ ID NO: 1230201 - RNA, 13 nt, Human
uacuauaguacca

SEQ ID NO: 1230202 - RNA, 16 nt, Human
uacuauaguaccagua

SEQ ID NO: 1230203 - RNA, 14 nt, Human
uacuggauuguacu

SEQ ID NO: 1230204 - RNA, 19 nt, Human
uacuguaaggcaaucaugg

SEQ ID NO: 1230205 - RNA, 14 nt, Human
uacuguaagaaaau

SEQ ID NO: 1230206 - RNA, 18 nt, Human
uacuguaaggcaaucaug

SEQ ID NO: 1230207 - RNA, 19 nt, Human
aauugaugggauuugguca

SEQ ID NO: 1230208 - RNA, 18 nt, Human
aauuccaagugauugaaa

SEQ ID NO: 1230209 - RNA, 16 nt, Human
aauuauuauuuggccc

SEQ ID NO: 1230210 - RNA, 14 nt, Human
aauuacaacuaagu

SEQ ID NO: 1230211 - RNA, 16 nt, Human
aauuacaacuaaguga

SEQ ID NO: 1230212 - RNA, 18 nt, Human
aauuacaacggagucaaa

SEQ ID NO: 1230213 - RNA, 14 nt, Human
aauuacgugcucug

SEQ ID NO: 1230214 - RNA, 16 nt, Human
aaugcuguauuuuaaa

SEQ ID NO: 1230215 - RNA, 20 nt, Human
aaugcuguauuuuaaaagaa

SEQ ID NO: 1230216 - RNA, 16 nt, Human
aaugcuucaucccuuu

SEQ ID NO: 1230217 - RNA, 16 nt, Human
aaugccaucaauaaaa

SEQ ID NO: 1230218 - RNA, 21 nt, Human
aaugccaucaauaaaaaauua

SEQ ID NO: 1230219 - RNA, 23 nt, Human
aaugccaucaauaaaaaauuaug

SEQ ID NO: 1230220 - RNA, 16 nt, Human
aauggacuguggugac

SEQ ID NO: 1230221 - RNA, 18 nt, Human
uacacuaagagagaauga

SEQ ID NO: 1230222 - RNA, 14 nt, Human
uacacuaagagaga

SEQ ID NO: 1230223 - RNA, 20 nt, Human
aauuaacauguuaaaccaug

SEQ ID NO: 1230224 - RNA, 15 nt, Human
aauuaagagagucua

SEQ ID NO: 1230225 - RNA, 21 nt, Human
aauuaagaaaggauaaaguug

SEQ ID NO: 1230226 - RNA, 17 nt, Human
aauuaauuccuucagca

SEQ ID NO: 1230227 - RNA, 20 nt, Human
uacaucccuuaccugggaaa

SEQ ID NO: 1230228 - RNA, 22 nt, Human
aauguauuacaguggggaauga

SEQ ID NO: 1230229 - RNA, 19 nt, Human
aauguauacuauaguacca

SEQ ID NO: 1230230 - RNA, 17 nt, Human
aaucaugaauuaguuuu

SEQ ID NO: 1230231 - RNA, 12 nt, Human
aauccgcccauc

SEQ ID NO: 1230232 - RNA, 19 nt, Human
aaucuuauaauuuaaaaua

SEQ ID NO: 1230233 - RNA, 22 nt, Human
aaucugugaacuugaaauuuga

SEQ ID NO: 1230234 - RNA, 20 nt, Human
aaucugugaacuugaaauuu

SEQ ID NO: 1230235 - RNA, 21 nt, Human
aaucugugaacuugaaauuug

SEQ ID NO: 1230236 - RNA, 19 nt, Human
uaaguaaugauaacuggaa

SEQ ID NO: 1230237 - RNA, 16 nt, Human
uaaggaaaaguuuaau

SEQ ID NO: 1230238 - RNA, 16 nt, Human
uaagcuuguauuccuu

SEQ ID NO: 1230239 - RNA, 15 nt, Human
uaagcuuaugcuuaa

SEQ ID NO: 1230240 - RNA, 15 nt, Human
aaucaugaauuaguu

SEQ ID NO: 1230241 - RNA, 12 nt, Human
aaucaugaauua

SEQ ID NO: 1230242 - RNA, 12 nt, Human
uaauaaacacuc

SEQ ID NO: 1230243 - RNA, 18 nt, Human
uaauaaacacucuugaaa

SEQ ID NO: 1230244 - RNA, 12 nt, Human
uaauccaguaaa

SEQ ID NO: 1230245 - RNA, 15 nt, Human
aaucuuuaauuuuac

SEQ ID NO: 1230246 - RNA, 16 nt, Human
aaucuuuaauuuuaca

SEQ ID NO: 1230247 - RNA, 23 nt, Human
uaagcaaaaacaaaaagaaaaga

SEQ ID NO: 1230248 - RNA, 16 nt, Human
uaagcuggagugcagu

SEQ ID NO: 1230249 - RNA, 21 nt, Human
aaucaggguuaguauugucca

SEQ ID NO: 1230250 - RNA, 22 nt, Human
aaucaggguuaguauuguccag

SEQ ID NO: 1230251 - RNA, 24 nt, Human
aauaugccccauucaacaucuagu

SEQ ID NO: 1230252 - RNA, 21 nt, Human
aauaugccccauucaacaucu

SEQ ID NO: 1230253 - RNA, 14 nt, Human
aauauuucagauaa

SEQ ID NO: 1230254 - RNA, 19 nt, Human
aauauuuauuuuaauaaug

SEQ ID NO: 1230255 - RNA, 18 nt, Human
aauauuuauuuuaauaau

SEQ ID NO: 1230256 - RNA, 12 nt, Human
aauauuuagugu

SEQ ID NO: 1230257 - RNA, 14 nt, Human
aauauauuuuaaga

SEQ ID NO: 1230258 - RNA, 15 nt, Human
aauauauuuuaagac

SEQ ID NO: 1230259 - RNA, 19 nt, Human
aauagucaaauugugugaa

SEQ ID NO: 1230260 - RNA, 16 nt, Human
aauagucaaauugugu

SEQ ID NO: 1230261 - RNA, 14 nt, Human
uaacaugaauauuu

SEQ ID NO: 1230262 - RNA, 12 nt, Human
uaacauaaaucu

SEQ ID NO: 1230263 - RNA, 14 nt, Human
uaacauaaaucugu

SEQ ID NO: 1230264 - RNA, 22 nt, Human
aauaucacuugucaauaaaauc

SEQ ID NO: 1230265 - RNA, 18 nt, Human
aauauauuuuaagacgaa

SEQ ID NO: 1230266 - RNA, 20 nt, Human
uaacgauaaaagacagugaa

SEQ ID NO: 1230267 - RNA, 15 nt, Human
ucauauuuucaugcu

SEQ ID NO: 1230268 - RNA, 12 nt, Human
accgcagaagga

SEQ ID NO: 1230269 - RNA, 13 nt, Human
accgcagaaggaa

SEQ ID NO: 1230270 - RNA, 14 nt, Human
accgcagaaggaag

SEQ ID NO: 1230271 - RNA, 17 nt, Human
ucaguuuuugugaaaag

SEQ ID NO: 1230272 - RNA, 15 nt, Human
ucaguuuuugugaaa

SEQ ID NO: 1230273 - RNA, 13 nt, Human
ucaucuaggauuu

SEQ ID NO: 1230274 - RNA, 17 nt, Human
ucaugaaagauucaaug

SEQ ID NO: 1230275 - RNA, 16 nt, Human
ucaugaaagauucaau

SEQ ID NO: 1230276 - RNA, 14 nt, Human
ucaucuaggauuuu

SEQ ID NO: 1230277 - RNA, 14 nt, Human
ucaugcaaacuuua

SEQ ID NO: 1230278 - RNA, 14 nt, Human
ucaugcauggaaau

SEQ ID NO: 1230279 - RNA, 17 nt, Human
ucaugugaaaucauuca

SEQ ID NO: 1230280 - RNA, 23 nt, Human
ucaugcaaacuuuauuuuguguu

SEQ ID NO: 1230281 - RNA, 17 nt, Human
accucccucaaccucau

SEQ ID NO: 1230282 - RNA, 15 nt, Human
accgcagaaggaagg

SEQ ID NO: 1230283 - RNA, 16 nt, Human
accuagggugauauua

SEQ ID NO: 1230284 - RNA, 16 nt, Human
accuauuuccagaaau

SEQ ID NO: 1230285 - RNA, 17 nt, Human
accuauuuccagaaaua

SEQ ID NO: 1230286 - RNA, 19 nt, Human
accuauuuccagaaauaca

SEQ ID NO: 1230287 - RNA, 15 nt, Human
acccucguggacacc

SEQ ID NO: 1230288 - RNA, 17 nt, Human
acccucguggacaccug

SEQ ID NO: 1230289 - RNA, 18 nt, Human
acccucguggacaccugc

SEQ ID NO: 1230290 - RNA, 19 nt, Human
acccucguggacaccugcc

SEQ ID NO: 1230291 - RNA, 20 nt, Human
acccucguggacaccugccc

SEQ ID NO: 1230292 - RNA, 22 nt, Human
acccucguggacaccugcccug

SEQ ID NO: 1230293 - RNA, 23 nt, Human
acccucguggacaccugcccugc

SEQ ID NO: 1230294 - RNA, 16 nt, Human
ucagauuucugaggaa

SEQ ID NO: 1230295 - RNA, 15 nt, Human
ucagcaaacaggauc

SEQ ID NO: 1230296 - RNA, 23 nt, Human
ucagauuuuauuauguaaauccc

SEQ ID NO: 1230297 - RNA, 19 nt, Human
ucagcaaaaauauuuuaug

SEQ ID NO: 1230298 - RNA, 20 nt, Human
ucagcaaaaauauuuuauga

SEQ ID NO: 1230299 - RNA, 15 nt, Human
ucaauauucaauaaa

SEQ ID NO: 1230300 - RNA, 16 nt, Human
ucaauauucaauaaag

SEQ ID NO: 1230301 - RNA, 17 nt, Human
ucaauauucaauaaagc

SEQ ID NO: 1230302 - RNA, 23 nt, Human
ucaauauuucagauaaucacaau

SEQ ID NO: 1230303 - RNA, 19 nt, Human
ucaauauuucagauaauca

SEQ ID NO: 1230304 - RNA, 15 nt, Human
ucaauauuucagaua

SEQ ID NO: 1230305 - RNA, 20 nt, Human
acaugaauauuuaguguuca

SEQ ID NO: 1230306 - RNA, 13 nt, Human
acaugcuucccuu

SEQ ID NO: 1230307 - RNA, 16 nt, Human
acaugcuucccuuucc

SEQ ID NO: 1230308 - RNA, 18 nt, Human
acaugcuucccuuuccug

SEQ ID NO: 1230309 - RNA, 19 nt, Human
acaugcuucccuuuccuga

SEQ ID NO: 1230310 - RNA, 14 nt, Human
acaugggacauuug

SEQ ID NO: 1230311 - RNA, 11 nt, Human
acaugggacau

SEQ ID NO: 1230312 - RNA, 21 nt, Human
acaugggacauuugcucaugg

SEQ ID NO: 1230313 - RNA, 20 nt, Human
acaugggacauuugcucaug

SEQ ID NO: 1230314 - RNA, 15 nt, Human
acaugggacauuugc

SEQ ID NO: 1230315 - RNA, 15 nt, Human
acauuccugaacagg

SEQ ID NO: 1230316 - RNA, 14 nt, Human
acauuccugaacag

SEQ ID NO: 1230317 - RNA, 18 nt, Human
ucaaauugugugaaaggu

SEQ ID NO: 1230318 - RNA, 20 nt, Human
accaguaggggcuuauaaua

SEQ ID NO: 1230319 - RNA, 14 nt, Human
accaguauuguaca

SEQ ID NO: 1230320 - RNA, 15 nt, Human
accaguauuguacaa

SEQ ID NO: 1230321 - RNA, 20 nt, Human
accaguauuguacaaaguau

SEQ ID NO: 1230322 - RNA, 22 nt, Human
accaguauuguacaaaguauua

SEQ ID NO: 1230323 - RNA, 14 nt, Human
accagucugacugu

SEQ ID NO: 1230324 - RNA, 23 nt, Human
accaguauuguacaaaguauuaa

SEQ ID NO: 1230325 - RNA, 14 nt, Human
ucaccucauggaau

SEQ ID NO: 1230326 - RNA, 13 nt, Human
ucaccucauggaa

SEQ ID NO: 1230327 - RNA, 12 nt, Human
ucaccucaugga

SEQ ID NO: 1230328 - RNA, 19 nt, Human
ucaccugucuugccuuuuu

SEQ ID NO: 1230329 - RNA, 20 nt, Human
ucaccugucuugccuuuuuc

SEQ ID NO: 1230330 - RNA, 21 nt, Human
ucacguuuggugcuucucaga

SEQ ID NO: 1230331 - RNA, 17 nt, Human
ucacguuuggugcuucu

SEQ ID NO: 1230332 - RNA, 24 nt, Human
accacauuggagauguuuaguaau

SEQ ID NO: 1230333 - RNA, 16 nt, Human
accaccacgccuggcu

SEQ ID NO: 1230334 - RNA, 13 nt, Human
ucaauuuuaacaa

SEQ ID NO: 1230335 - RNA, 16 nt, Human
ucaauucuugccaaau

SEQ ID NO: 1230336 - RNA, 11 nt, Human
ucacacuggga

SEQ ID NO: 1230337 - RNA, 22 nt, Human
acuauauuguuugcuaagcauu

SEQ ID NO: 1230338 - RNA, 22 nt, Human
acuauaggcaugcgccaccaug

SEQ ID NO: 1230339 - RNA, 20 nt, Human
acuauaggcaugcgccacca

SEQ ID NO: 1230340 - RNA, 15 nt, Human
acuaucucauuucca

SEQ ID NO: 1230341 - RNA, 17 nt, Human
acuaucucauuuccaag

SEQ ID NO: 1230342 - RNA, 16 nt, Human
acuaucucauuuccaa

SEQ ID NO: 1230343 - RNA, 12 nt, Human
acucaauuuuaa

SEQ ID NO: 1230344 - RNA, 15 nt, Human
acucaauuuuaacaa

SEQ ID NO: 1230345 - RNA, 15 nt, Human
acuaauuuuaaaaug

SEQ ID NO: 1230346 - RNA, 13 nt, Human
acuacacccagca

SEQ ID NO: 1230347 - RNA, 14 nt, Human
acuacacccagcaa

SEQ ID NO: 1230348 - RNA, 16 nt, Human
acuacacccagcaaua

SEQ ID NO: 1230349 - RNA, 15 nt, Human
acuacacccagcaau

SEQ ID NO: 1230350 - RNA, 19 nt, Human
acggugaauggcuuuguau

SEQ ID NO: 1230351 - RNA, 20 nt, Human
acggugaauggcuuuguaua

SEQ ID NO: 1230352 - RNA, 16 nt, Human
acggugaauggcuuug

SEQ ID NO: 1230353 - RNA, 21 nt, Human
acggagucucacucugucacc

SEQ ID NO: 1230354 - RNA, 23 nt, Human
acgcgccucgccggaucugaggg

SEQ ID NO: 1230355 - RNA, 13 nt, Human
acggaugauuucu

SEQ ID NO: 1230356 - RNA, 14 nt, Human
acggaugauuucua

SEQ ID NO: 1230357 - RNA, 23 nt, Human
uccagugggaggugagaccaccu

SEQ ID NO: 1230358 - RNA, 16 nt, Human
uccacucguguguuuc

SEQ ID NO: 1230359 - RNA, 18 nt, Human
uccacucguguguuucua

SEQ ID NO: 1230360 - RNA, 14 nt, Human
uccacucguguguu

SEQ ID NO: 1230361 - RNA, 15 nt, Human
uccacucguguguuu

SEQ ID NO: 1230362 - RNA, 12 nt, Human
ucauuccuccag

SEQ ID NO: 1230363 - RNA, 13 nt, Human
ucauuccuccagg

SEQ ID NO: 1230364 - RNA, 14 nt, Human
ucauuccuccaggu

SEQ ID NO: 1230365 - RNA, 17 nt, Human
accuuugacaaagguaa

SEQ ID NO: 1230366 - RNA, 18 nt, Human
accuuugacaaagguaaa

SEQ ID NO: 1230367 - RNA, 22 nt, Human
accuuuguuugcaucugaaaau

SEQ ID NO: 1230368 - RNA, 14 nt, Human
uccagccucagcuc

SEQ ID NO: 1230369 - RNA, 20 nt, Human
uccagccugcugccugcuuu

SEQ ID NO: 1230370 - RNA, 19 nt, Human
acucuuauaucuauauuuu

SEQ ID NO: 1230371 - RNA, 22 nt, Human
acucuuauaucuauauuuuaca

SEQ ID NO: 1230372 - RNA, 18 nt, Human
acucuuauaucuauauuu

SEQ ID NO: 1230373 - RNA, 17 nt, Human
acucuuauaucuauauu

SEQ ID NO: 1230374 - RNA, 16 nt, Human
acucuuauaucuauau

SEQ ID NO: 1230375 - RNA, 21 nt, Human
acucuuaagaagacugcauua

SEQ ID NO: 1230376 - RNA, 16 nt, Human
ucccuuuuuuuaagua

SEQ ID NO: 1230377 - RNA, 21 nt, Human
ucccuuuuuuuaaguaaggaa

SEQ ID NO: 1230378 - RNA, 13 nt, Human
ucccuuuuuuuaa

SEQ ID NO: 1230379 - RNA, 15 nt, Human
acucuuguuuccuua

SEQ ID NO: 1230380 - RNA, 16 nt, Human
acugaacuuugcugag

SEQ ID NO: 1230381 - RNA, 19 nt, Human
acugaacuuugcugagccu

SEQ ID NO: 1230382 - RNA, 12 nt, Human
acugagaaauuu

SEQ ID NO: 1230383 - RNA, 17 nt, Human
acugagaaauuuauaaa

SEQ ID NO: 1230384 - RNA, 21 nt, Human
acugagaaauuuauaaacuuu

SEQ ID NO: 1230385 - RNA, 20 nt, Human
acugacucuuaagaagacug

SEQ ID NO: 1230386 - RNA, 18 nt, Human
acugacucuuaagaagac

SEQ ID NO: 1230387 - RNA, 17 nt, Human
acugacucuuaagaaga

SEQ ID NO: 1230388 - RNA, 16 nt, Human
acugacucuuaagaag

SEQ ID NO: 1230389 - RNA, 15 nt, Human
acugacucuuaagaa

SEQ ID NO: 1230390 - RNA, 14 nt, Human
acugacucuuaaga

SEQ ID NO: 1230391 - RNA, 13 nt, Human
acugacucuuaag

SEQ ID NO: 1230392 - RNA, 12 nt, Human
acugaagaagca

SEQ ID NO: 1230393 - RNA, 21 nt, Human
acugaacuuugcugagccugu

SEQ ID NO: 1230394 - RNA, 15 nt, Human
uccugggagcuuuug

SEQ ID NO: 1230395 - RNA, 16 nt, Human
uccuggaaaucagggu

SEQ ID NO: 1230396 - RNA, 22 nt, Human
uccuggaauaucuccgucaacu

SEQ ID NO: 1230397 - RNA, 23 nt, Human
uccuggaagugcuaauuuugaaa

SEQ ID NO: 1230398 - RNA, 15 nt, Human
ucucauuuccaagca

SEQ ID NO: 1230399 - RNA, 22 nt, Human
ucucagauuuuauuauguaaau

SEQ ID NO: 1230400 - RNA, 23 nt, Human
ucucagauuuuauuauguaaauc

SEQ ID NO: 1230401 - RNA, 23 nt, Human
acuugcaaaaagggucaguaugg

SEQ ID NO: 1230402 - RNA, 17 nt, Human
acuugcaaaaaggguca

SEQ ID NO: 1230403 - RNA, 16 nt, Human
acuugcucuugaugcc

SEQ ID NO: 1230404 - RNA, 17 nt, Human
acuugcucuugaugccu

SEQ ID NO: 1230405 - RNA, 18 nt, Human
acuugcucuugaugccug

SEQ ID NO: 1230406 - RNA, 20 nt, Human
acuugcucuugaugccuggc

SEQ ID NO: 1230407 - RNA, 16 nt, Human
acuugucaauaaaauc

SEQ ID NO: 1230408 - RNA, 13 nt, Human
acuuguguaaaua

SEQ ID NO: 1230409 - RNA, 15 nt, Human
acuugucaauaaaau

SEQ ID NO: 1230410 - RNA, 18 nt, Human
acuuguauuauguguguu

SEQ ID NO: 1230411 - RNA, 19 nt, Human
acuuguauuauguguguuu

SEQ ID NO: 1230412 - RNA, 14 nt, Human
acuugcuuuuaaaa

SEQ ID NO: 1230413 - RNA, 12 nt, Human
acuuuggauaau

SEQ ID NO: 1230414 - RNA, 17 nt, Human
acuuuggauaauaagga

SEQ ID NO: 1230415 - RNA, 19 nt, Human
acuuuggauaauaaggaaa

SEQ ID NO: 1230416 - RNA, 13 nt, Human
acuuuggcugcau

SEQ ID NO: 1230417 - RNA, 19 nt, Human
acuuuguauaaaagggacu

SEQ ID NO: 1230418 - RNA, 22 nt, Human
acuuuuuauggcacuaguauuu

SEQ ID NO: 1230419 - RNA, 13 nt, Human
acuuaaauuuuag

SEQ ID NO: 1230420 - RNA, 14 nt, Human
ucuauaccaauaaa

SEQ ID NO: 1230421 - RNA, 15 nt, Human
ucuauaccaauaaag

SEQ ID NO: 1230422 - RNA, 16 nt, Human
ucuauaccaauaaagu

SEQ ID NO: 1230423 - RNA, 17 nt, Human
ucuauaccaauaaagug

SEQ ID NO: 1230424 - RNA, 18 nt, Human
ucuauaccaauaaaguga

SEQ ID NO: 1230425 - RNA, 15 nt, Human
ucuauacccacccag

SEQ ID NO: 1230426 - RNA, 17 nt, Human
ucuauacccacccagaa

SEQ ID NO: 1230427 - RNA, 16 nt, Human
ucuauacccacccaga

SEQ ID NO: 1230428 - RNA, 16 nt, Human
ucuaggaaauauuuau

SEQ ID NO: 1230429 - RNA, 17 nt, Human
ucuaggaaauauuuauu

SEQ ID NO: 1230430 - RNA, 10 nt, Human
ucugaauuau

SEQ ID NO: 1230431 - RNA, 15 nt, Human
ucugaauuauuuucu

SEQ ID NO: 1230432 - RNA, 11 nt, Human
ucugauccagu

SEQ ID NO: 1230433 - RNA, 14 nt, Human
ucugauccaguuuu

SEQ ID NO: 1230434 - RNA, 21 nt, Human
ucugauccaguuuuguuugga

SEQ ID NO: 1230435 - RNA, 21 nt, Human
ucugacuguuuccaucaaggg

SEQ ID NO: 1230436 - RNA, 11 nt, Human
ucugcaggucc

SEQ ID NO: 1230437 - RNA, 12 nt, Human
ucugcagguccc

SEQ ID NO: 1230438 - RNA, 13 nt, Human
ucugcaggucccu

SEQ ID NO: 1230439 - RNA, 14 nt, Human
ucugcaggucccua

SEQ ID NO: 1230440 - RNA, 14 nt, Human
agaagaacugaaau

SEQ ID NO: 1230441 - RNA, 13 nt, Human
agaagaacugaaa

SEQ ID NO: 1230442 - RNA, 18 nt, Human
agaagaugguaccaccag

SEQ ID NO: 1230443 - RNA, 12 nt, Human
agaagacaaaau

SEQ ID NO: 1230444 - RNA, 15 nt, Human
agacacacaugaagu

SEQ ID NO: 1230445 - RNA, 12 nt, Human
agacacacauga

SEQ ID NO: 1230446 - RNA, 22 nt, Human
agaauuugauaugugaacaguu

SEQ ID NO: 1230447 - RNA, 14 nt, Human
agaauucuguauag

SEQ ID NO: 1230448 - RNA, 18 nt, Human
ucugugaacuugaaauuu

SEQ ID NO: 1230449 - RNA, 14 nt, Human
ucugugaacuugaa

SEQ ID NO: 1230450 - RNA, 17 nt, Human
ucugugaacuugaaauu

SEQ ID NO: 1230451 - RNA, 12 nt, Human
agaauaugccuu

SEQ ID NO: 1230452 - RNA, 12 nt, Human
agaauaaaauuu

SEQ ID NO: 1230453 - RNA, 14 nt, Human
agaauaaaauuuuu

SEQ ID NO: 1230454 - RNA, 17 nt, Human
agaauaaaauuuuuaau

SEQ ID NO: 1230455 - RNA, 21 nt, Human
agaaugguccgugcuaaggac

SEQ ID NO: 1230456 - RNA, 23 nt, Human
agaaugguccgugcuaaggacuu

SEQ ID NO: 1230457 - RNA, 20 nt, Human
ugaagauuuaccacuugugu

SEQ ID NO: 1230458 - RNA, 17 nt, Human
ugaagauuuaccacuug

SEQ ID NO: 1230459 - RNA, 23 nt, Human
ugaauaauguaagacaaauaugu

SEQ ID NO: 1230460 - RNA, 15 nt, Human
ugaauacauuuccaa

SEQ ID NO: 1230461 - RNA, 23 nt, Human
agaggccaggcaggagcccuucu

SEQ ID NO: 1230462 - RNA, 18 nt, Human
agaguaauccaagcaaau

SEQ ID NO: 1230463 - RNA, 20 nt, Human
agaguaauccaagcaaaugu

SEQ ID NO: 1230464 - RNA, 22 nt, Human
agaguaauccaagcaaauguga

SEQ ID NO: 1230465 - RNA, 12 nt, Human
ugaaccaccgcg

SEQ ID NO: 1230466 - RNA, 23 nt, Human
ugaacuagaguuuagcuggaaaa

SEQ ID NO: 1230467 - RNA, 23 nt, Human
ugaaauaaacgucuuaaauauuc

SEQ ID NO: 1230468 - RNA, 22 nt, Human
ugaaauaaacgucuuaaauauu

SEQ ID NO: 1230469 - RNA, 18 nt, Human
ugaaauaaacgucuuaaa

SEQ ID NO: 1230470 - RNA, 13 nt, Human
ugaaauaaacguc

SEQ ID NO: 1230471 - RNA, 23 nt, Human
ugaaauuuccugggagcuuuugu

SEQ ID NO: 1230472 - RNA, 21 nt, Human
ugaaauuuccugggagcuuuu

SEQ ID NO: 1230473 - RNA, 15 nt, Human
ugaaauuuccuggga

SEQ ID NO: 1230474 - RNA, 13 nt, Human
ugaaauuguaauu

SEQ ID NO: 1230475 - RNA, 14 nt, Human
ugaaauuguaauua

SEQ ID NO: 1230476 - RNA, 15 nt, Human
ugaaauuguaauuau

SEQ ID NO: 1230477 - RNA, 16 nt, Human
ugaaauuguaauuaua

SEQ ID NO: 1230478 - RNA, 19 nt, Human
ugaaauuguaauuauaucu

SEQ ID NO: 1230479 - RNA, 20 nt, Human
ugaaauuguaauuauaucug

SEQ ID NO: 1230480 - RNA, 15 nt, Human
agagaguguugaaac

SEQ ID NO: 1230481 - RNA, 16 nt, Human
agagaguguugaaacg

SEQ ID NO: 1230482 - RNA, 13 nt, Human
ugaaagaaaauaa

SEQ ID NO: 1230483 - RNA, 14 nt, Human
ugaaaauuaacaug

SEQ ID NO: 1230484 - RNA, 20 nt, Human
agacuggugacugauucuuc

SEQ ID NO: 1230485 - RNA, 21 nt, Human
agacuggugacugauucuuca

SEQ ID NO: 1230486 - RNA, 12 nt, Human
agacuuuuauga

SEQ ID NO: 1230487 - RNA, 15 nt, Human
agacuuuuaugauac

SEQ ID NO: 1230488 - RNA, 16 nt, Human
agagacacacugaaga

SEQ ID NO: 1230489 - RNA, 17 nt, Human
ucuuugucuacaccauu

SEQ ID NO: 1230490 - RNA, 21 nt, Human
ucuuuuuucuaaaguaaaaac

SEQ ID NO: 1230491 - RNA, 22 nt, Human
ucuuuuuucuaaaguaaaaaca

SEQ ID NO: 1230492 - RNA, 17 nt, Human
ucuuuuuucaaaagaaa

SEQ ID NO: 1230493 - RNA, 13 nt, Human
ugacuauguaaac

SEQ ID NO: 1230494 - RNA, 12 nt, Human
ugacuauguaaa

SEQ ID NO: 1230495 - RNA, 17 nt, Human
ugaccugccucccuuca

SEQ ID NO: 1230496 - RNA, 19 nt, Human
ugaccugccucccuucaug

SEQ ID NO: 1230497 - RNA, 23 nt, Human
ugaccugccucccuucaugcaug

SEQ ID NO: 1230498 - RNA, 21 nt, Human
ugaccugccucccuucaugca

SEQ ID NO: 1230499 - RNA, 22 nt, Human
agauguauguacuucaugcugu

SEQ ID NO: 1230500 - RNA, 16 nt, Human
ugaccugccucccuuc

SEQ ID NO: 1230501 - RNA, 22 nt, Human
agauuagaauucuguauagauu

SEQ ID NO: 1230502 - RNA, 23 nt, Human
agauuagaauucuguauagauua

SEQ ID NO: 1230503 - RNA, 21 nt, Human
agauuagagaguguugaaacg

SEQ ID NO: 1230504 - RNA, 13 nt, Human
ugacuuauaguac

SEQ ID NO: 1230505 - RNA, 14 nt, Human
ugacuuauaguaca

SEQ ID NO: 1230506 - RNA, 15 nt, Human
ugacuuauaguacau

SEQ ID NO: 1230507 - RNA, 17 nt, Human
ugacuuauaguacauga

SEQ ID NO: 1230508 - RNA, 19 nt, Human
ugacuuauaguacaugaua

SEQ ID NO: 1230509 - RNA, 15 nt, Human
agauuagaauucugu

SEQ ID NO: 1230510 - RNA, 16 nt, Human
agauuagaauucugua

SEQ ID NO: 1230511 - RNA, 14 nt, Human
agauccuggaaauc

SEQ ID NO: 1230512 - RNA, 13 nt, Human
agauccuggaaau

SEQ ID NO: 1230513 - RNA, 13 nt, Human
agaucccccagaa

SEQ ID NO: 1230514 - RNA, 19 nt, Human
agaucccccagaaaagaaa

SEQ ID NO: 1230515 - RNA, 15 nt, Human
agaucccccagaaaa

SEQ ID NO: 1230516 - RNA, 22 nt, Human
agauguagccccucuccuggaa

SEQ ID NO: 1230517 - RNA, 21 nt, Human
agaugcaguucugaagaagau

SEQ ID NO: 1230518 - RNA, 18 nt, Human
agcaaguaaaaaggcuaa

SEQ ID NO: 1230519 - RNA, 13 nt, Human
agcaaguaaaaag

SEQ ID NO: 1230520 - RNA, 15 nt, Human
agcaagucagaauag

SEQ ID NO: 1230521 - RNA, 15 nt, Human
agcaauccucccacu

SEQ ID NO: 1230522 - RNA, 16 nt, Human
agauuuuccugaaaac

SEQ ID NO: 1230523 - RNA, 15 nt, Human
agauuuuccugaaaa

SEQ ID NO: 1230524 - RNA, 20 nt, Human
ugagagacacacugaagaag

SEQ ID NO: 1230525 - RNA, 19 nt, Human
ugagagacacacugaagaa

SEQ ID NO: 1230526 - RNA, 17 nt, Human
ugagagacacacugaag

SEQ ID NO: 1230527 - RNA, 16 nt, Human
ugagagacacacugaa

SEQ ID NO: 1230528 - RNA, 19 nt, Human
ugagacagaaucucagucu

SEQ ID NO: 1230529 - RNA, 23 nt, Human
ugagauguagccccucuccugga

SEQ ID NO: 1230530 - RNA, 14 nt, Human
ugagauguguucac

SEQ ID NO: 1230531 - RNA, 22 nt, Human
ugagagacacacugaagaagca

SEQ ID NO: 1230532 - RNA, 21 nt, Human
ugagagacacacugaagaagc

SEQ ID NO: 1230533 - RNA, 11 nt, Human
aggaauuuaaa

SEQ ID NO: 1230534 - RNA, 18 nt, Human
aggaaggaggacccagga

SEQ ID NO: 1230535 - RNA, 21 nt, Human
aggaaggaggacccaggacag

SEQ ID NO: 1230536 - RNA, 23 nt, Human
aggaauuguguuuauaauuuuaa

SEQ ID NO: 1230537 - RNA, 19 nt, Human
aggaaggaggacccaggac

SEQ ID NO: 1230538 - RNA, 20 nt, Human
aggaaggaggacccaggaca

SEQ ID NO: 1230539 - RNA, 15 nt, Human
agcuggagugcagug

SEQ ID NO: 1230540 - RNA, 19 nt, Human
agcuggagugcaguggcau

SEQ ID NO: 1230541 - RNA, 12 nt, Human
ugcuauuucuau

SEQ ID NO: 1230542 - RNA, 13 nt, Human
ugcuauuucuaua

SEQ ID NO: 1230543 - RNA, 14 nt, Human
ugcuauuucuauau

SEQ ID NO: 1230544 - RNA, 20 nt, Human
ugcuauuucuauauuuucau

SEQ ID NO: 1230545 - RNA, 21 nt, Human
ugcuauuucuauauuuucauu

SEQ ID NO: 1230546 - RNA, 14 nt, Human
aggacaggauccag

SEQ ID NO: 1230547 - RNA, 20 nt, Human
aggacaggauccaggccggc

SEQ ID NO: 1230548 - RNA, 17 nt, Human
aggacacugauaugggu

SEQ ID NO: 1230549 - RNA, 12 nt, Human
aggacaucagca

SEQ ID NO: 1230550 - RNA, 13 nt, Human
aggacaucagcaa

SEQ ID NO: 1230551 - RNA, 14 nt, Human
aggacaucagcaaa

SEQ ID NO: 1230552 - RNA, 15 nt, Human
aggacaucagcaaac

SEQ ID NO: 1230553 - RNA, 16 nt, Human
aggacaucagcaaaca

SEQ ID NO: 1230554 - RNA, 22 nt, Human
aggacaucagcaaacaggauca

SEQ ID NO: 1230555 - RNA, 14 nt, Human
aggacacugauaug

SEQ ID NO: 1230556 - RNA, 14 nt, Human
ugcuucaucccuuu

SEQ ID NO: 1230557 - RNA, 20 nt, Human
aggaauuuuauuuuuuucug

SEQ ID NO: 1230558 - RNA, 12 nt, Human
ugcuuuguauug

SEQ ID NO: 1230559 - RNA, 14 nt, Human
ugcuuuucauccuu

SEQ ID NO: 1230560 - RNA, 13 nt, Human
uggaaaggcagcu

SEQ ID NO: 1230561 - RNA, 19 nt, Human
aggagcccugggaggcucu

SEQ ID NO: 1230562 - RNA, 23 nt, Human
aggagcccugggaggcucuggag

SEQ ID NO: 1230563 - RNA, 17 nt, Human
aggacuuguuagaucua

SEQ ID NO: 1230564 - RNA, 18 nt, Human
aggagcccugggaggcuc

SEQ ID NO: 1230565 - RNA, 20 nt, Human
aggacugaauuaugaaacuu

SEQ ID NO: 1230566 - RNA, 19 nt, Human
aggacugaauuaugaaacu

SEQ ID NO: 1230567 - RNA, 14 nt, Human
aggacuuguuagau

SEQ ID NO: 1230568 - RNA, 16 nt, Human
aggacuuguuagaucu

SEQ ID NO: 1230569 - RNA, 17 nt, Human
uggaaauucccuucauc

SEQ ID NO: 1230570 - RNA, 22 nt, Human
uggaaauucccuucaucuggaa

SEQ ID NO: 1230571 - RNA, 18 nt, Human
uggaaauucccuucaucu

SEQ ID NO: 1230572 - RNA, 14 nt, Human
aggaggcagagaag

SEQ ID NO: 1230573 - RNA, 18 nt, Human
uggaauuggagcucgugg

SEQ ID NO: 1230574 - RNA, 20 nt, Human
uggccaggcuugucucgaac

SEQ ID NO: 1230575 - RNA, 20 nt, Human
uggccagucuggucucgaac

SEQ ID NO: 1230576 - RNA, 16 nt, Human
aggccagaccauggac

SEQ ID NO: 1230577 - RNA, 17 nt, Human
aggccagaccauggaca

SEQ ID NO: 1230578 - RNA, 18 nt, Human
aggccagaccauggacac

SEQ ID NO: 1230579 - RNA, 18 nt, Human
uggacgagaaaacaauaa

SEQ ID NO: 1230580 - RNA, 17 nt, Human
aggccugguguuucuug

SEQ ID NO: 1230581 - RNA, 13 nt, Human
aggcucuggagcc

SEQ ID NO: 1230582 - RNA, 14 nt, Human
aggcucuggagccc

SEQ ID NO: 1230583 - RNA, 15 nt, Human
aggcucuggagccca

SEQ ID NO: 1230584 - RNA, 18 nt, Human
aggcucuggagcccacug

SEQ ID NO: 1230585 - RNA, 19 nt, Human
aggcucuggagcccacugu

SEQ ID NO: 1230586 - RNA, 22 nt, Human
aggcugggaauggaggggcaga

SEQ ID NO: 1230587 - RNA, 12 nt, Human
uggcugcaugcg

SEQ ID NO: 1230588 - RNA, 18 nt, Human
ugauuaaguaaugauaac

SEQ ID NO: 1230589 - RNA, 23 nt, Human
ugauuaaguaaugauaacuggaa

SEQ ID NO: 1230590 - RNA, 12 nt, Human
ugaugaagaagu

SEQ ID NO: 1230591 - RNA, 11 nt, Human
ugaugaagaag

SEQ ID NO: 1230592 - RNA, 12 nt, Human
ugauggagaagg

SEQ ID NO: 1230593 - RNA, 13 nt, Human
ugauggagaagga

SEQ ID NO: 1230594 - RNA, 14 nt, Human
ugauggagaaggaa

SEQ ID NO: 1230595 - RNA, 15 nt, Human
ugauggagaaggaag

SEQ ID NO: 1230596 - RNA, 16 nt, Human
ugauggagaaggaagg

SEQ ID NO: 1230597 - RNA, 14 nt, Human
ugaugggauuuggu

SEQ ID NO: 1230598 - RNA, 17 nt, Human
ugauggagaaggaaggc

SEQ ID NO: 1230599 - RNA, 12 nt, Human
ugauuucuaugc

SEQ ID NO: 1230600 - RNA, 15 nt, Human
ugauuucuaugcuga

SEQ ID NO: 1230601 - RNA, 16 nt, Human
ugauuucuaugcugag

SEQ ID NO: 1230602 - RNA, 14 nt, Human
agcccacuguacuu

SEQ ID NO: 1230603 - RNA, 16 nt, Human
agcccacuguacuugc

SEQ ID NO: 1230604 - RNA, 20 nt, Human
agcccugcugcugccugccu

SEQ ID NO: 1230605 - RNA, 18 nt, Human
agcccugcugcugccugc

SEQ ID NO: 1230606 - RNA, 19 nt, Human
agcccugcugcugccugcc

SEQ ID NO: 1230607 - RNA, 17 nt, Human
agcccugggaggcucug

SEQ ID NO: 1230608 - RNA, 14 nt, Human
agcccauucauucc

SEQ ID NO: 1230609 - RNA, 17 nt, Human
agcccauucauuccauu

SEQ ID NO: 1230610 - RNA, 22 nt, Human
agcccauucauuccauucugga

SEQ ID NO: 1230611 - RNA, 23 nt, Human
agcccauucauuccauucuggaa

SEQ ID NO: 1230612 - RNA, 23 nt, Human
agccucagcucucaguugcagcc

SEQ ID NO: 1230613 - RNA, 16 nt, Human
ugccccauucaacauc

SEQ ID NO: 1230614 - RNA, 17 nt, Human
agcuaucguaaaauuaa

SEQ ID NO: 1230615 - RNA, 18 nt, Human
agcuccaagaauuucuag

SEQ ID NO: 1230616 - RNA, 15 nt, Human
agcuccaagaauuuc

SEQ ID NO: 1230617 - RNA, 13 nt, Human
ugcauuuauaugu

SEQ ID NO: 1230618 - RNA, 14 nt, Human
ugcauuuauaugua

SEQ ID NO: 1230619 - RNA, 16 nt, Human
ugcauuuauauguacc

SEQ ID NO: 1230620 - RNA, 14 nt, Human
ugcccugccaccug

SEQ ID NO: 1230621 - RNA, 15 nt, Human
ugcccugccaccugu

SEQ ID NO: 1230622 - RNA, 16 nt, Human
ugcccugccaccuguc

SEQ ID NO: 1230623 - RNA, 17 nt, Human
ugcccugccaccugucu

SEQ ID NO: 1230624 - RNA, 19 nt, Human
ugcccugccaccugucugu

SEQ ID NO: 1230625 - RNA, 20 nt, Human
ugcccugccaccugucuguc

SEQ ID NO: 1230626 - RNA, 21 nt, Human
ugcccugccaccugucugucu

SEQ ID NO: 1230627 - RNA, 22 nt, Human
ugcccugccaccugucugucug

SEQ ID NO: 1230628 - RNA, 18 nt, Human
ugccucagaaaacaagga

SEQ ID NO: 1230629 - RNA, 11 nt, Human
ugccucucugc

SEQ ID NO: 1230630 - RNA, 12 nt, Human
ugccucucugca

SEQ ID NO: 1230631 - RNA, 15 nt, Human
ugccucucugcaggu

SEQ ID NO: 1230632 - RNA, 23 nt, Human
ugccucucugcaggucccuaaua

SEQ ID NO: 1230633 - RNA, 13 nt, Human
agcuggaaaagua

SEQ ID NO: 1230634 - RNA, 18 nt, Human
agcuggagaugaggccag

SEQ ID NO: 1230635 - RNA, 14 nt, Human
agcuggagugcagu

SEQ ID NO: 1230636 - RNA, 19 nt, Human
agcuggagaugaggccaga

SEQ ID NO: 1230637 - RNA, 20 nt, Human
agcuggagaugaggccagac

SEQ ID NO: 1230638 - RNA, 21 nt, Human
agcuggagaugaggccagacc

SEQ ID NO: 1230639 - RNA, 22 nt, Human
agcuggagaugaggccagacca

SEQ ID NO: 1230640 - RNA, 23 nt, Human
agcuggagaugaggccagaccau

SEQ ID NO: 1230641 - RNA, 18 nt, Human
agucccaucccugcguga

SEQ ID NO: 1230642 - RNA, 21 nt, Human
agucagucauucagauaugau

SEQ ID NO: 1230643 - RNA, 15 nt, Human
agucagucauucaga

SEQ ID NO: 1230644 - RNA, 23 nt, Human
agucagaucugccuaaggacuuc

SEQ ID NO: 1230645 - RNA, 20 nt, Human
agucagaucugccuaaggac

SEQ ID NO: 1230646 - RNA, 21 nt, Human
agucagaucugccuaaggacu

SEQ ID NO: 1230647 - RNA, 22 nt, Human
agucagaucugccuaaggacuu

SEQ ID NO: 1230648 - RNA, 11 nt, Human
aguauuguaca

SEQ ID NO: 1230649 - RNA, 15 nt, Human
aguauuguacaaagu

SEQ ID NO: 1230650 - RNA, 20 nt, Human
aguauuguacaaaguauuaa

SEQ ID NO: 1230651 - RNA, 22 nt, Human
aguauuguacaaaguauuaagc

SEQ ID NO: 1230652 - RNA, 23 nt, Human
aguauuguacaaaguauuaagca

SEQ ID NO: 1230653 - RNA, 21 nt, Human
aguauguuagugcaaauuguc

SEQ ID NO: 1230654 - RNA, 18 nt, Human
aguauguuagugcaaauu

SEQ ID NO: 1230655 - RNA, 18 nt, Human
agucacauuccugaacag

SEQ ID NO: 1230656 - RNA, 16 nt, Human
aguauuguccaggucu

SEQ ID NO: 1230657 - RNA, 15 nt, Human
aguauuguccagguc

SEQ ID NO: 1230658 - RNA, 21 nt, Human
aguauuuaauucauguugccu

SEQ ID NO: 1230659 - RNA, 11 nt, Human
uguauuaugug

SEQ ID NO: 1230660 - RNA, 21 nt, Human
aguagcguuuuuuaaauguau

SEQ ID NO: 1230661 - RNA, 22 nt, Human
aguagcguuuuuuaaauguaua

SEQ ID NO: 1230662 - RNA, 12 nt, Human
uguaugugugaa

SEQ ID NO: 1230663 - RNA, 13 nt, Human
uguaugugugaag

SEQ ID NO: 1230664 - RNA, 23 nt, Human
agguuuggacaaaauggaauacu

SEQ ID NO: 1230665 - RNA, 15 nt, Human
ugucuugccuuuuuc

SEQ ID NO: 1230666 - RNA, 16 nt, Human
ugucuugccuuuuuca

SEQ ID NO: 1230667 - RNA, 17 nt, Human
ugucuugccuuuuucau

SEQ ID NO: 1230668 - RNA, 21 nt, Human
ugucuugccuuuuucauuauu

SEQ ID NO: 1230669 - RNA, 22 nt, Human
ugucucuggauuauauuaugaa

SEQ ID NO: 1230670 - RNA, 14 nt, Human
ugugaagcaaaauu

SEQ ID NO: 1230671 - RNA, 16 nt, Human
agucucugaggggcua

SEQ ID NO: 1230672 - RNA, 22 nt, Human
agucucugaggggcuaccagga

SEQ ID NO: 1230673 - RNA, 23 nt, Human
agucucugaggggcuaccaggaa

SEQ ID NO: 1230674 - RNA, 19 nt, Human
agucuccaaagucucugga

SEQ ID NO: 1230675 - RNA, 18 nt, Human
agucuuacucuguugcca

SEQ ID NO: 1230676 - RNA, 20 nt, Human
agugaaacucguuaauuugu

SEQ ID NO: 1230677 - RNA, 21 nt, Human
agugagcagucaggaaagaga

SEQ ID NO: 1230678 - RNA, 18 nt, Human
uguaagaaaauaucacuu

SEQ ID NO: 1230679 - RNA, 15 nt, Human
uguaaggcaaucaug

SEQ ID NO: 1230680 - RNA, 13 nt, Human
uguacaaaguauu

SEQ ID NO: 1230681 - RNA, 14 nt, Human
uguacaaaguauua

SEQ ID NO: 1230682 - RNA, 21 nt, Human
uguagaagucacauuccugaa

SEQ ID NO: 1230683 - RNA, 15 nt, Human
uguacuugcucuuga

SEQ ID NO: 1230684 - RNA, 19 nt, Human
uguacuugcucuugaugcc

SEQ ID NO: 1230685 - RNA, 10 nt, Human
uguaaauccc

SEQ ID NO: 1230686 - RNA, 21 nt, Human
uguaaauacaauuuuguuucu

SEQ ID NO: 1230687 - RNA, 16 nt, Human
uguaaaggaauuuaaa

SEQ ID NO: 1230688 - RNA, 16 nt, Human
uguaaauacaauuuug

SEQ ID NO: 1230689 - RNA, 17 nt, Human
uguaaauacaauuuugu

SEQ ID NO: 1230690 - RNA, 18 nt, Human
uguaaauacaauuuuguu

SEQ ID NO: 1230691 - RNA, 19 nt, Human
uguaaauacaauuuuguuu

SEQ ID NO: 1230692 - RNA, 18 nt, Human
ugguuuuaguugcaacuu

SEQ ID NO: 1230693 - RNA, 15 nt, Human
aggucagugcaaaua

SEQ ID NO: 1230694 - RNA, 22 nt, Human
ugguccaugggccauaugaaaa

SEQ ID NO: 1230695 - RNA, 19 nt, Human
uggucacguuuggugcuuc

SEQ ID NO: 1230696 - RNA, 21 nt, Human
aggggcuuauaauaaaggacu

SEQ ID NO: 1230697 - RNA, 21 nt, Human
auaauuauaugcuauuucuau

SEQ ID NO: 1230698 - RNA, 23 nt, Human
auaauuauaugcuauuucuauau

SEQ ID NO: 1230699 - RNA, 17 nt, Human
auaauuauaugcuauuu

SEQ ID NO: 1230700 - RNA, 19 nt, Human
auaauuauaugcuauuucu

SEQ ID NO: 1230701 - RNA, 14 nt, Human
auaaugaauacuuu

SEQ ID NO: 1230702 - RNA, 17 nt, Human
auaauccaguaaaauaa

SEQ ID NO: 1230703 - RNA, 23 nt, Human
uuagaugcaguucugaagaagau

SEQ ID NO: 1230704 - RNA, 12 nt, Human
uuaccugggaaa

SEQ ID NO: 1230705 - RNA, 20 nt, Human
auaagcaaaaacaaaaagaa

SEQ ID NO: 1230706 - RNA, 14 nt, Human
auaauaauuaguaa

SEQ ID NO: 1230707 - RNA, 17 nt, Human
auaauaaggaaaaguuu

SEQ ID NO: 1230708 - RNA, 18 nt, Human
auaauaaggaaaaguuua

SEQ ID NO: 1230709 - RNA, 19 nt, Human
auaauaaggaaaaguuuaa

SEQ ID NO: 1230710 - RNA, 22 nt, Human
auaauaaggaaaaguuuaauau

SEQ ID NO: 1230711 - RNA, 16 nt, Human
auaauaaggaaaaguu

SEQ ID NO: 1230712 - RNA, 12 nt, Human
auaacuggaaac

SEQ ID NO: 1230713 - RNA, 13 nt, Human
auaaauaaaguuu

SEQ ID NO: 1230714 - RNA, 19 nt, Human
auaaauaaaguuuguugaa

SEQ ID NO: 1230715 - RNA, 18 nt, Human
auaaagugacccugcucu

SEQ ID NO: 1230716 - RNA, 20 nt, Human
auaaagugacccugcucuca

SEQ ID NO: 1230717 - RNA, 18 nt, Human
auaaacgucuuaaauauu

SEQ ID NO: 1230718 - RNA, 16 nt, Human
auaaacgucuuaaaua

SEQ ID NO: 1230719 - RNA, 15 nt, Human
auaaacgucuuaaau

SEQ ID NO: 1230720 - RNA, 16 nt, Human
auaaaccgaacugaug

SEQ ID NO: 1230721 - RNA, 23 nt, Human
auaaacacucuugaaaaaugcau

SEQ ID NO: 1230722 - RNA, 22 nt, Human
auaauuuuuauauuugaaauau

SEQ ID NO: 1230723 - RNA, 21 nt, Human
auaauuuuuauauuugaaaua

SEQ ID NO: 1230724 - RNA, 19 nt, Human
auaauuuuuauauuugaaa

SEQ ID NO: 1230725 - RNA, 16 nt, Human
auaauuuuuauauuug

SEQ ID NO: 1230726 - RNA, 14 nt, Human
auaauuuuuauauu

SEQ ID NO: 1230727 - RNA, 20 nt, Human
auaauuuugugaagcaaaau

SEQ ID NO: 1230728 - RNA, 15 nt, Human
auaauuuugugaagc

SEQ ID NO: 1230729 - RNA, 14 nt, Human
auaauuuugugaag

SEQ ID NO: 1230730 - RNA, 13 nt, Human
auaauuuugugaa

SEQ ID NO: 1230731 - RNA, 22 nt, Human
uuauauauauuuuuuucugaaa

SEQ ID NO: 1230732 - RNA, 18 nt, Human
uuauauaagcuuguauuc

SEQ ID NO: 1230733 - RNA, 13 nt, Human
uuauaguacauga

SEQ ID NO: 1230734 - RNA, 16 nt, Human
uuauaguacaugauaa

SEQ ID NO: 1230735 - RNA, 17 nt, Human
uuauaguacaugauaaa

SEQ ID NO: 1230736 - RNA, 12 nt, Human
auaccaauaaag

SEQ ID NO: 1230737 - RNA, 13 nt, Human
auaccaauaaagu

SEQ ID NO: 1230738 - RNA, 20 nt, Human
auacauuguauauaugugua

SEQ ID NO: 1230739 - RNA, 20 nt, Human
auacaucccuuaccugggaa

SEQ ID NO: 1230740 - RNA, 22 nt, Human
auaccacaggaaccacaagacu

SEQ ID NO: 1230741 - RNA, 14 nt, Human
auaccaauaaagug

SEQ ID NO: 1230742 - RNA, 15 nt, Human
auaccaauaaaguga

SEQ ID NO: 1230743 - RNA, 21 nt, Human
auaccaauaaagugacccugc

SEQ ID NO: 1230744 - RNA, 17 nt, Human
uuaucaugugaaaucau

SEQ ID NO: 1230745 - RNA, 18 nt, Human
uuaucaugugaaaucauu

SEQ ID NO: 1230746 - RNA, 20 nt, Human
uuaucaugugaaaucauuca

SEQ ID NO: 1230747 - RNA, 22 nt, Human
uuaucaugugaaaucauucauu

SEQ ID NO: 1230748 - RNA, 18 nt, Human
uuaaaaaagaaacauuug

SEQ ID NO: 1230749 - RNA, 15 nt, Human
uuaaaaaagaaacau

SEQ ID NO: 1230750 - RNA, 19 nt, Human
uuaaaaaagaaacauuugg

SEQ ID NO: 1230751 - RNA, 15 nt, Human
aguuucguuuucaaa

SEQ ID NO: 1230752 - RNA, 16 nt, Human
aguuucguuuucaaaa

SEQ ID NO: 1230753 - RNA, 19 nt, Human
aguuugugcugguguaugu

SEQ ID NO: 1230754 - RNA, 16 nt, Human
aguucugaagaagaug

SEQ ID NO: 1230755 - RNA, 15 nt, Human
aguucugaagaagau

SEQ ID NO: 1230756 - RNA, 14 nt, Human
aguucugaagaaga

SEQ ID NO: 1230757 - RNA, 13 nt, Human
aguucugaagaag

SEQ ID NO: 1230758 - RNA, 21 nt, Human
aguugauaugccuuuucccaa

SEQ ID NO: 1230759 - RNA, 19 nt, Human
aguugcaacuuuguauaaa

SEQ ID NO: 1230760 - RNA, 15 nt, Human
uguuugcaucugaaa

SEQ ID NO: 1230761 - RNA, 15 nt, Human
uguuugcuaagcauu

SEQ ID NO: 1230762 - RNA, 13 nt, Human
uguuuuacaauag

SEQ ID NO: 1230763 - RNA, 17 nt, Human
uguuuuacaauaguucu

SEQ ID NO: 1230764 - RNA, 22 nt, Human
uguuuuacaauaguucuguggg

SEQ ID NO: 1230765 - RNA, 21 nt, Human
uguuuuacaauaguucugugg

SEQ ID NO: 1230766 - RNA, 19 nt, Human
uguuugcuaagcauuccaa

SEQ ID NO: 1230767 - RNA, 20 nt, Human
uguuuuauaauuuugugaag

SEQ ID NO: 1230768 - RNA, 13 nt, Human
uguuuuauaauuu

SEQ ID NO: 1230769 - RNA, 14 nt, Human
uguuauuaaacaaa

SEQ ID NO: 1230770 - RNA, 15 nt, Human
aguggcaucaucuca

SEQ ID NO: 1230771 - RNA, 18 nt, Human
aguuacccaaauuaagag

SEQ ID NO: 1230772 - RNA, 17 nt, Human
aguuacccaaauuaaga

SEQ ID NO: 1230773 - RNA, 20 nt, Human
aguuauuauauuuacaaaug

SEQ ID NO: 1230774 - RNA, 21 nt, Human
uguuguacucaauuuuaacaa

SEQ ID NO: 1230775 - RNA, 17 nt, Human
uugacauagucuggcug

SEQ ID NO: 1230776 - RNA, 14 nt, Human
uugacauagucugg

SEQ ID NO: 1230777 - RNA, 12 nt, Human
aucguaaaauua

SEQ ID NO: 1230778 - RNA, 13 nt, Human
aucguaaaauuaa

SEQ ID NO: 1230779 - RNA, 14 nt, Human
aucguaaaauuaag

SEQ ID NO: 1230780 - RNA, 17 nt, Human
aucguaaaauuaagaaa

SEQ ID NO: 1230781 - RNA, 17 nt, Human
uucuguuuuauaauuuu

SEQ ID NO: 1230782 - RNA, 16 nt, Human
uucuguuuuauaauuu

SEQ ID NO: 1230783 - RNA, 13 nt, Human
uucuuaaaguuga

SEQ ID NO: 1230784 - RNA, 22 nt, Human
uucuuaaccagaucauugugaa

SEQ ID NO: 1230785 - RNA, 23 nt, Human
uucuuaaccagaucauugugaaa

SEQ ID NO: 1230786 - RNA, 14 nt, Human
uucuuacugcuuaa

SEQ ID NO: 1230787 - RNA, 15 nt, Human
auccaguaaaauaau

SEQ ID NO: 1230788 - RNA, 18 nt, Human
auccaagcaaaugugaau

SEQ ID NO: 1230789 - RNA, 16 nt, Human
auccaagcaaauguga

SEQ ID NO: 1230790 - RNA, 14 nt, Human
uucugaauaaagca

SEQ ID NO: 1230791 - RNA, 15 nt, Human
uucugaauaaagcaa

SEQ ID NO: 1230792 - RNA, 16 nt, Human
uucugaauaaagcaau

SEQ ID NO: 1230793 - RNA, 17 nt, Human
uucugaauaaagcaauu

SEQ ID NO: 1230794 - RNA, 13 nt, Human
aucauugugaaau

SEQ ID NO: 1230795 - RNA, 15 nt, Human
aucauugugaaauua

SEQ ID NO: 1230796 - RNA, 19 nt, Human
aucauugugaaauuauuca

SEQ ID NO: 1230797 - RNA, 12 nt, Human
aucaguuaacua

SEQ ID NO: 1230798 - RNA, 18 nt, Human
aucaguuaacuauugcau

SEQ ID NO: 1230799 - RNA, 21 nt, Human
aucacucuguucauuccucca

SEQ ID NO: 1230800 - RNA, 22 nt, Human
aucacucuguucauuccuccag

SEQ ID NO: 1230801 - RNA, 23 nt, Human
aucacucuguucauuccuccagg

SEQ ID NO: 1230802 - RNA, 14 nt, Human
aucacugaacuuug

SEQ ID NO: 1230803 - RNA, 21 nt, Human
aucacugaacuuugcugagcc

SEQ ID NO: 1230804 - RNA, 18 nt, Human
uuccuuacagaacuacuu

SEQ ID NO: 1230805 - RNA, 19 nt, Human
aucacucuguucauuccuc

SEQ ID NO: 1230806 - RNA, 21 nt, Human
aucaaggguacacugccuucu

SEQ ID NO: 1230807 - RNA, 14 nt, Human
uuccugaacaggau

SEQ ID NO: 1230808 - RNA, 12 nt, Human
uuccugaacagg

SEQ ID NO: 1230809 - RNA, 21 nt, Human
uuccuaaauauauuuuaagac

SEQ ID NO: 1230810 - RNA, 15 nt, Human
uucccuuuuuuuaag

SEQ ID NO: 1230811 - RNA, 16 nt, Human
auauguucugacauaa

SEQ ID NO: 1230812 - RNA, 13 nt, Human
auauuacaaugau

SEQ ID NO: 1230813 - RNA, 15 nt, Human
auauuacaaugauca

SEQ ID NO: 1230814 - RNA, 16 nt, Human
auauuacaaugaucac

SEQ ID NO: 1230815 - RNA, 12 nt, Human
auauuaaagcca

SEQ ID NO: 1230816 - RNA, 14 nt, Human
auauuaaagccaug

SEQ ID NO: 1230817 - RNA, 12 nt, Human
auauuacaauga

SEQ ID NO: 1230818 - RNA, 14 nt, Human
auauuguuugcuaa

SEQ ID NO: 1230819 - RNA, 13 nt, Human
auauuuacaaaug

SEQ ID NO: 1230820 - RNA, 19 nt, Human
auauuguuuuacaauaguu

SEQ ID NO: 1230821 - RNA, 15 nt, Human
auauugauccagaaa

SEQ ID NO: 1230822 - RNA, 21 nt, Human
auauucucacagcuccaagaa

SEQ ID NO: 1230823 - RNA, 18 nt, Human
auauucucacagcuccaa

SEQ ID NO: 1230824 - RNA, 22 nt, Human
uucauuauuuuauuaugaaacu

SEQ ID NO: 1230825 - RNA, 22 nt, Human
uucaugcuguucaugaaagauu

SEQ ID NO: 1230826 - RNA, 19 nt, Human
uucauggaacgcguugaaa

SEQ ID NO: 1230827 - RNA, 20 nt, Human
uucauggaacgcguugaaau

SEQ ID NO: 1230828 - RNA, 22 nt, Human
auauguguaugcacaguaaaaa

SEQ ID NO: 1230829 - RNA, 21 nt, Human
uucauggaacgcguugaaauu

SEQ ID NO: 1230830 - RNA, 22 nt, Human
uucauggaacgcguugaaauug

SEQ ID NO: 1230831 - RNA, 13 nt, Human
auauauuuuuaua

SEQ ID NO: 1230832 - RNA, 18 nt, Human
uucagucucuauaccaau

SEQ ID NO: 1230833 - RNA, 21 nt, Human
uucagucucuauaccaauaaa

SEQ ID NO: 1230834 - RNA, 22 nt, Human
uucagucucuauaccaauaaag

SEQ ID NO: 1230835 - RNA, 23 nt, Human
uucagucucuauaccaauaaagu

SEQ ID NO: 1230836 - RNA, 24 nt, Human
uucagucucuauaccaauaaagug

SEQ ID NO: 1230837 - RNA, 21 nt, Human
uucauauuuuucauagcuaaa

SEQ ID NO: 1230838 - RNA, 13 nt, Human
auauaugcuaagu

SEQ ID NO: 1230839 - RNA, 17 nt, Human
uucagcgguuuauauaa

SEQ ID NO: 1230840 - RNA, 19 nt, Human
uucagcaaaaauauuuuau

SEQ ID NO: 1230841 - RNA, 22 nt, Human
uucagcacuuuagaauaugccu

SEQ ID NO: 1230842 - RNA, 23 nt, Human
uucagcacuuuagaauaugccuu

SEQ ID NO: 1230843 - RNA, 17 nt, Human
uucagcaaaaauauuuu

SEQ ID NO: 1230844 - RNA, 19 nt, Human
uucagauaugauucaaaug

SEQ ID NO: 1230845 - RNA, 18 nt, Human
uucagauaugauucaaau

SEQ ID NO: 1230846 - RNA, 17 nt, Human
uucagauaugauucaaa

SEQ ID NO: 1230847 - RNA, 16 nt, Human
uucagauaugauucaa

SEQ ID NO: 1230848 - RNA, 22 nt, Human
augggacauuugcucauggaau

SEQ ID NO: 1230849 - RNA, 13 nt, Human
uuugaaaagcaga

SEQ ID NO: 1230850 - RNA, 16 nt, Human
uuugaaaagcagacau

SEQ ID NO: 1230851 - RNA, 18 nt, Human
uuugaaaagcagacauuu

SEQ ID NO: 1230852 - RNA, 15 nt, Human
uuugaaauauugacu

SEQ ID NO: 1230853 - RNA, 14 nt, Human
uuugaaauauugac

SEQ ID NO: 1230854 - RNA, 17 nt, Human
uuugaaacacuuugcau

SEQ ID NO: 1230855 - RNA, 19 nt, Human
uuugaaacacuuugcauaa

SEQ ID NO: 1230856 - RNA, 21 nt, Human
uuucuaugcugaguuugugcu

SEQ ID NO: 1230857 - RNA, 20 nt, Human
uuucuaugaaauauuauguu

SEQ ID NO: 1230858 - RNA, 14 nt, Human
uuucuaugaaauau

SEQ ID NO: 1230859 - RNA, 13 nt, Human
uuucuaugaaaua

SEQ ID NO: 1230860 - RNA, 22 nt, Human
uuucuaggacugaauuaugaaa

SEQ ID NO: 1230861 - RNA, 21 nt, Human
uuucuaggacugaauuaugaa

SEQ ID NO: 1230862 - RNA, 13 nt, Human
uuucuauauuuuc

SEQ ID NO: 1230863 - RNA, 15 nt, Human
uuucuauauuuucau

SEQ ID NO: 1230864 - RNA, 18 nt, Human
uuucuauauuuucauucu

SEQ ID NO: 1230865 - RNA, 19 nt, Human
augcuguauuuuaaaagaa

SEQ ID NO: 1230866 - RNA, 14 nt, Human
augcuguauuuuaa

SEQ ID NO: 1230867 - RNA, 21 nt, Human
uuuauuaugaaacuuguguaa

SEQ ID NO: 1230868 - RNA, 19 nt, Human
uuuauuacuguaagaaaau

SEQ ID NO: 1230869 - RNA, 13 nt, Human
uuuauuaugaaac

SEQ ID NO: 1230870 - RNA, 16 nt, Human
uuuauuuuaauaaugu

SEQ ID NO: 1230871 - RNA, 16 nt, Human
uuuauuuuguguuuag

SEQ ID NO: 1230872 - RNA, 17 nt, Human
uuuauuuuuuucugaau

SEQ ID NO: 1230873 - RNA, 16 nt, Human
uuucaccuagauuuuu

SEQ ID NO: 1230874 - RNA, 12 nt, Human
uuucauaaagca

SEQ ID NO: 1230875 - RNA, 14 nt, Human
uuucauagcuaaaa

SEQ ID NO: 1230876 - RNA, 15 nt, Human
uuucauagcuaaaaa

SEQ ID NO: 1230877 - RNA, 18 nt, Human
uuucauauaaauggaauu

SEQ ID NO: 1230878 - RNA, 21 nt, Human
uuucaguuuauuugaaccaau

SEQ ID NO: 1230879 - RNA, 23 nt, Human
auggaauuggagcucgugggaca

SEQ ID NO: 1230880 - RNA, 20 nt, Human
uuuagcuggaaaaguauguu

SEQ ID NO: 1230881 - RNA, 14 nt, Human
uuuaugugaaacau

SEQ ID NO: 1230882 - RNA, 15 nt, Human
uuuaugugaaacaug

SEQ ID NO: 1230883 - RNA, 19 nt, Human
uuuauaugcuucuguuuua

SEQ ID NO: 1230884 - RNA, 17 nt, Human
uuuauaugcuucuguuu

SEQ ID NO: 1230885 - RNA, 18 nt, Human
augcuacaggauuugaaa

SEQ ID NO: 1230886 - RNA, 15 nt, Human
uuuacuaaaauggac

SEQ ID NO: 1230887 - RNA, 17 nt, Human
uuuacuaaaauggacug

SEQ ID NO: 1230888 - RNA, 16 nt, Human
uuuaaagcuuccauug

SEQ ID NO: 1230889 - RNA, 14 nt, Human
augauaacuggaaa

SEQ ID NO: 1230890 - RNA, 17 nt, Human
uuuaaaaaaaaaauugg

SEQ ID NO: 1230891 - RNA, 19 nt, Human
uuuaaaaaauagcagcuuu

SEQ ID NO: 1230892 - RNA, 16 nt, Human
uuuaaaaaauggucac

SEQ ID NO: 1230893 - RNA, 22 nt, Human
augcaaacuuuauuuuguguuu

SEQ ID NO: 1230894 - RNA, 18 nt, Human
augaucaccgacugaaaa

SEQ ID NO: 1230895 - RNA, 18 nt, Human
uugugaagcaaaauuuuu

SEQ ID NO: 1230896 - RNA, 17 nt, Human
uugugaagguggaaaua

SEQ ID NO: 1230897 - RNA, 18 nt, Human
uugugaagguggaaauaa

SEQ ID NO: 1230898 - RNA, 22 nt, Human
augaauuacauuuguauaaaau

SEQ ID NO: 1230899 - RNA, 19 nt, Human
augaauuacauuuguauaa

SEQ ID NO: 1230900 - RNA, 18 nt, Human
augaauuacauuuguaua

SEQ ID NO: 1230901 - RNA, 18 nt, Human
uugggcagcaauuuaaau

SEQ ID NO: 1230902 - RNA, 19 nt, Human
uugggcagcaauuuaaaug

SEQ ID NO: 1230903 - RNA, 23 nt, Human
augaauuaguuuuauaugcuucu

SEQ ID NO: 1230904 - RNA, 21 nt, Human
augaauuaguuuuauaugcuu

SEQ ID NO: 1230905 - RNA, 13 nt, Human
uuguauauuacaa

SEQ ID NO: 1230906 - RNA, 14 nt, Human
uuguauauuacaau

SEQ ID NO: 1230907 - RNA, 15 nt, Human
uuguauauuacaaug

SEQ ID NO: 1230908 - RNA, 16 nt, Human
uuguauauuacaauga

SEQ ID NO: 1230909 - RNA, 13 nt, Human
uuguaaugaaaac

SEQ ID NO: 1230910 - RNA, 15 nt, Human
uuguaauuauaucug

SEQ ID NO: 1230911 - RNA, 15 nt, Human
uuguauaaaauaauu

SEQ ID NO: 1230912 - RNA, 13 nt, Human
uuguauaaaauaa

SEQ ID NO: 1230913 - RNA, 21 nt, Human
augaaauauuauguuaaaacu

SEQ ID NO: 1230914 - RNA, 11 nt, Human
uugcugagccu

SEQ ID NO: 1230915 - RNA, 12 nt, Human
uugcucauggaa

SEQ ID NO: 1230916 - RNA, 11 nt, Human
uugcucaugga

SEQ ID NO: 1230917 - RNA, 21 nt, Human
auucuccuaucaccugucuug

SEQ ID NO: 1230918 - RNA, 20 nt, Human
auucuccugccucagccucc

SEQ ID NO: 1230919 - RNA, 11 nt, Human
auuccauccuu

SEQ ID NO: 1230920 - RNA, 17 nt, Human
auucagaguugaugguu

SEQ ID NO: 1230921 - RNA, 18 nt, Human
auucagauaugauucaaa

SEQ ID NO: 1230922 - RNA, 20 nt, Human
auucagauaugauucaaaug

SEQ ID NO: 1230923 - RNA, 12 nt, Human
auuagaauucug

SEQ ID NO: 1230924 - RNA, 13 nt, Human
auuagaauucugu

SEQ ID NO: 1230925 - RNA, 14 nt, Human
auuagaauucugua

SEQ ID NO: 1230926 - RNA, 15 nt, Human
auuagaauucuguau

SEQ ID NO: 1230927 - RNA, 16 nt, Human
auuagaauucuguaua

SEQ ID NO: 1230928 - RNA, 17 nt, Human
auuagaauucuguauag

SEQ ID NO: 1230929 - RNA, 18 nt, Human
auuagaauucuguauaga

SEQ ID NO: 1230930 - RNA, 21 nt, Human
auuagaauucuguauagauua

SEQ ID NO: 1230931 - RNA, 13 nt, Human
auuacgugcucug

SEQ ID NO: 1230932 - RNA, 19 nt, Human
uuuuugugaaaagcuccau

SEQ ID NO: 1230933 - RNA, 23 nt, Human
auuaaguaaugauaacuggaaac

SEQ ID NO: 1230934 - RNA, 16 nt, Human
uuuuuguuauuaaaca

SEQ ID NO: 1230935 - RNA, 21 nt, Human
auuacaguggggaaugaagau

SEQ ID NO: 1230936 - RNA, 20 nt, Human
auuacauuuguauaaaauaa

SEQ ID NO: 1230937 - RNA, 18 nt, Human
auuacauuuguauaaaau

SEQ ID NO: 1230938 - RNA, 17 nt, Human
auuacauuuguauaaaa

SEQ ID NO: 1230939 - RNA, 11 nt, Human
auuaaagccau

SEQ ID NO: 1230940 - RNA, 14 nt, Human
auuaagcauauauu

SEQ ID NO: 1230941 - RNA, 15 nt, Human
auuaagcauauauuu

SEQ ID NO: 1230942 - RNA, 21 nt, Human
auuaagcauauauuuuuauau

SEQ ID NO: 1230943 - RNA, 12 nt, Human
uuuugcagcuuu

SEQ ID NO: 1230944 - RNA, 23 nt, Human
uuuuguuuggaccaaaaaccagu

SEQ ID NO: 1230945 - RNA, 19 nt, Human
uuuuuauauuugaaauauu

SEQ ID NO: 1230946 - RNA, 12 nt, Human
uuuuuaucaugu

SEQ ID NO: 1230947 - RNA, 15 nt, Human
uuuuguuauuaaaca

SEQ ID NO: 1230948 - RNA, 18 nt, Human
uuuuguuguuuguuuagu

SEQ ID NO: 1230949 - RNA, 12 nt, Human
uuuuguuucugu

SEQ ID NO: 1230950 - RNA, 13 nt, Human
uuuuguuucugua

SEQ ID NO: 1230951 - RNA, 12 nt, Human
uuuuguuuggac

SEQ ID NO: 1230952 - RNA, 22 nt, Human
uuuuguuuggaccaaaaaccag

SEQ ID NO: 1230953 - RNA, 17 nt, Human
auuaaaccggaccaucu

SEQ ID NO: 1230954 - RNA, 21 nt, Human
auguuuucaggcuagauguau

SEQ ID NO: 1230955 - RNA, 17 nt, Human
auguuuucaggcuagau

SEQ ID NO: 1230956 - RNA, 22 nt, Human
uuuucaguuuauuugaaccaau

SEQ ID NO: 1230957 - RNA, 21 nt, Human
uuuuauuaugaaacuugugua

SEQ ID NO: 1230958 - RNA, 22 nt, Human
uuuuauuaugaaacuuguguaa

SEQ ID NO: 1230959 - RNA, 12 nt, Human
uuuuauuaugaa

SEQ ID NO: 1230960 - RNA, 16 nt, Human
uuuucucuaggaaaua

SEQ ID NO: 1230961 - RNA, 14 nt, Human
uuuucucuaggaaa

SEQ ID NO: 1230962 - RNA, 15 nt, Human
uuuucugauccaguu

SEQ ID NO: 1230963 - RNA, 19 nt, Human
uuuucugauccaguuuugu

SEQ ID NO: 1230964 - RNA, 17 nt, Human
auguugcauagaauaaa

SEQ ID NO: 1230965 - RNA, 18 nt, Human
auguugcauagaauaaaa

SEQ ID NO: 1230966 - RNA, 20 nt, Human
auguugcccuguugcugccu

SEQ ID NO: 1230967 - RNA, 12 nt, Human
auguuaaaccau

SEQ ID NO: 1230968 - RNA, 13 nt, Human
auguuaaaccaug

SEQ ID NO: 1230969 - RNA, 20 nt, Human
auguuaaaccaugggauaaa

SEQ ID NO: 1230970 - RNA, 16 nt, Human
auguucagauuauugg

SEQ ID NO: 1230971 - RNA, 14 nt, Human
uuuuaauaaacacu

SEQ ID NO: 1230972 - RNA, 14 nt, Human
uuuuaauaauguuu

SEQ ID NO: 1230973 - RNA, 13 nt, Human
uuuuaauaauguu

SEQ ID NO: 1230974 - RNA, 12 nt, Human
uuuuaauaaugu

SEQ ID NO: 1230975 - RNA, 16 nt, Human
uuuuaauaauguuuca

SEQ ID NO: 1230976 - RNA, 20 nt, Human
uuuuaauaauguuucaaaca

SEQ ID NO: 1230977 - RNA, 19 nt, Human
augugcuaguaauuggaaa

SEQ ID NO: 1230978 - RNA, 18 nt, Human
auguggaccuuagaauac

SEQ ID NO: 1230979 - RNA, 20 nt, Human
augugcuaguaauuggaaag

SEQ ID NO: 1230980 - RNA, 23 nt, Human
auguguguuuuaaaaugagaaau

SEQ ID NO: 1230981 - RNA, 17 nt, Human
auuuuaaaagaaugauu

SEQ ID NO: 1230982 - RNA, 21 nt, Human
auuuguauaaaauaauuuuua

SEQ ID NO: 1230983 - RNA, 19 nt, Human
auuuguauaaaauaauuuu

SEQ ID NO: 1230984 - RNA, 18 nt, Human
auuuguauaaaauaauuu

SEQ ID NO: 1230985 - RNA, 17 nt, Human
auuuuacauaaauuuag

SEQ ID NO: 1230986 - RNA, 16 nt, Human
auuuuacauaaauuua

SEQ ID NO: 1230987 - RNA, 12 nt, Human
auuuuacauuaa

SEQ ID NO: 1230988 - RNA, 15 nt, Human
auuuuacauuaaauu

SEQ ID NO: 1230989 - RNA, 17 nt, Human
auuuuaccuuugacaaa

SEQ ID NO: 1230990 - RNA, 22 nt, Human
auuuuaaaagaaugauuaugaa

SEQ ID NO: 1230991 - RNA, 18 nt, Human
auuuuaaaagaaugauua

SEQ ID NO: 1230992 - RNA, 16 nt, Human
auuuuaaaaaaugguc

SEQ ID NO: 1230993 - RNA, 17 nt, Human
auuuuaaaaaaugguca

SEQ ID NO: 1230994 - RNA, 22 nt, Human
auuuucaguuauuauauuuaca

SEQ ID NO: 1230995 - RNA, 13 nt, Human
auuuuccuccuuu

SEQ ID NO: 1230996 - RNA, 17 nt, Human
auuuuccuccuuucucu

SEQ ID NO: 1230997 - RNA, 16 nt, Human
auuuuauuauguaaau

SEQ ID NO: 1230998 - RNA, 17 nt, Human
auuuuauuauguaaauc

SEQ ID NO: 1230999 - RNA, 18 nt, Human
auuuuauuauguaaaucc

SEQ ID NO: 1231000 - RNA, 19 nt, Human
auuuuauuauguaaauccc

SEQ ID NO: 1231001 - RNA, 20 nt, Human
auuuuauuauguaaauccca

SEQ ID NO: 1231002 - RNA, 21 nt, Human
auuuuauuauguaaaucccau

SEQ ID NO: 1231003 - RNA, 21 nt, Human
auuuuauuuuuuucugaauua

SEQ ID NO: 1231004 - RNA, 18 nt, Human
auuuaguauuuuguuuca

SEQ ID NO: 1231005 - RNA, 20 nt, Human
auuuaguaucuuuuuauuca

SEQ ID NO: 1231006 - RNA, 13 nt, Human
auuuaguguucau

SEQ ID NO: 1231007 - RNA, 13 nt, Human
auuuagauguaua

SEQ ID NO: 1231008 - RNA, 17 nt, Human
auuuauaaaaauaaaaa

SEQ ID NO: 1231009 - RNA, 22 nt, Human
auuuauaaaaauaaaaaacacu

SEQ ID NO: 1231010 - RNA, 23 nt, Human
auuuauaaaaauaaaaaacacug

SEQ ID NO: 1231011 - RNA, 21 nt, Human
auuuauuuuaauaauguuuca

SEQ ID NO: 1231012 - RNA, 20 nt, Human
auuuauuuuaauaauguuuc

SEQ ID NO: 1231013 - RNA, 19 nt, Human
auuuauuuuaauaauguuu

SEQ ID NO: 1231014 - RNA, 14 nt, Human
auuugaaauauuga

SEQ ID NO: 1231015 - RNA, 14 nt, Human
auuugaaccaauaa

SEQ ID NO: 1231016 - RNA, 15 nt, Human
auucuucagcaaaaa

SEQ ID NO: 1231017 - RNA, 23 nt, Human
auucuucagcaaaaauauuuuau

SEQ ID NO: 1231018 - RNA, 18 nt, Human
auucuuaaaguugaauuu

SEQ ID NO: 1231019 - RNA, 21 nt, Human
auucuguauagauuagaauuc

SEQ ID NO: 1231020 - RNA, 24 nt, Human
auucugucucuggauuauauuaug

SEQ ID NO: 1231021 - RNA, 13 nt, Human
auucuuaaaguug

SEQ ID NO: 1231022 - RNA, 14 nt, Human
auucuuaaaguuga

SEQ ID NO: 1231023 - RNA, 15 nt, Human
auucuuaaaguugaa

SEQ ID NO: 1231024 - RNA, 16 nt, Human
auucuuaaaguugaau

SEQ ID NO: 1231025 - RNA, 13 nt, Human
auuguauucagag

SEQ ID NO: 1231026 - RNA, 14 nt, Human
auugguguuguacu

SEQ ID NO: 1231027 - RNA, 22 nt, Human
auugguguuguacucaauuuua

SEQ ID NO: 1231028 - RNA, 23 nt, Human
auugguguuguacucaauuuuaa

SEQ ID NO: 1231029 - RNA, 16 nt, Human
aaaaaccaguauugua

SEQ ID NO: 1231030 - RNA, 18 nt, Human
aaaaaccaguauuguaca

SEQ ID NO: 1231031 - RNA, 20 nt, Human
aaaaaccaguauuguacaaa

SEQ ID NO: 1231032 - RNA, 17 nt, Human
aaaaagaaugaagccuc

SEQ ID NO: 1231033 - RNA, 17 nt, Human
aaaaauuggggauucuu

SEQ ID NO: 1231034 - RNA, 18 nt, Human
aaaaauuggggauucuua

SEQ ID NO: 1231035 - RNA, 19 nt, Human
aaaaauuggggauucuuaa

SEQ ID NO: 1231036 - RNA, 20 nt, Human
aaaaauuggggauucuuaaa

SEQ ID NO: 1231037 - RNA, 17 nt, Human
aaaacaaggaugaauua

SEQ ID NO: 1231038 - RNA, 14 nt, Human
aaaacaaggaugaa

SEQ ID NO: 1231039 - RNA, 15 nt, Human
acagaagaaacuggg

SEQ ID NO: 1231040 - RNA, 14 nt, Human
acaauuuuguuucu

SEQ ID NO: 1231041 - RNA, 15 nt, Human
acaauuuuguuucug

SEQ ID NO: 1231042 - RNA, 17 nt, Human
acaauuuuguuucugua

SEQ ID NO: 1231043 - RNA, 18 nt, Human
acaauuuuguuucuguac

SEQ ID NO: 1231044 - RNA, 13 nt, Human
acaacuauauugu

SEQ ID NO: 1231045 - RNA, 20 nt, Human
acaaaauggaauacucuuau

SEQ ID NO: 1231046 - RNA, 19 nt, Human
acaaaauggaauacucuua

SEQ ID NO: 1231047 - RNA, 13 nt, Human
aauuuugaaaaac

SEQ ID NO: 1231048 - RNA, 20 nt, Human
acaagucagucauucagaua

SEQ ID NO: 1231049 - RNA, 13 nt, Human
accacgccuggcu

SEQ ID NO: 1231050 - RNA, 20 nt, Human
accacgccuggcuaauuuuu

SEQ ID NO: 1231051 - RNA, 14 nt, Human
acauuuguauaaaa

SEQ ID NO: 1231052 - RNA, 18 nt, Human
acauuugcucauggaauu

SEQ ID NO: 1231053 - RNA, 20 nt, Human
acauaaauuuaguauuuugu

SEQ ID NO: 1231054 - RNA, 15 nt, Human
acauaaaucugugaa

SEQ ID NO: 1231055 - RNA, 18 nt, Human
acauaaaucugugaacuu

SEQ ID NO: 1231056 - RNA, 14 nt, Human
acauaaaucuguga

SEQ ID NO: 1231057 - RNA, 12 nt, Human
acauccagcaga

SEQ ID NO: 1231058 - RNA, 20 nt, Human
acauaaaaaggacaucagca

SEQ ID NO: 1231059 - RNA, 21 nt, Human
acauaaaaaggacaucagcaa

SEQ ID NO: 1231060 - RNA, 22 nt, Human
acauaaaaaggacaucagcaaa

SEQ ID NO: 1231061 - RNA, 15 nt, Human
acauaaaaaggacau

SEQ ID NO: 1231062 - RNA, 12 nt, Human
accccuaggacu

SEQ ID NO: 1231063 - RNA, 21 nt, Human
accccuaaaagaaacccugca

SEQ ID NO: 1231064 - RNA, 22 nt, Human
accccuaaaagaaacccugcac

SEQ ID NO: 1231065 - RNA, 16 nt, Human
agaaaggauaaaguug

SEQ ID NO: 1231066 - RNA, 23 nt, Human
acuuuagggaaguacuuuuggca

SEQ ID NO: 1231067 - RNA, 19 nt, Human
acuuuagggggugggauuc

SEQ ID NO: 1231068 - RNA, 14 nt, Human
agaaaauaacaaua

SEQ ID NO: 1231069 - RNA, 16 nt, Human
agaaaauuuuuguagu

SEQ ID NO: 1231070 - RNA, 20 nt, Human
agaaaauuuuuguaguagcg

SEQ ID NO: 1231071 - RNA, 22 nt, Human
agaaaauuuuuguaguagcguu

SEQ ID NO: 1231072 - RNA, 12 nt, Human
acuuuucugaua

SEQ ID NO: 1231073 - RNA, 21 nt, Human
agaaaaguugaauuuuacaug

SEQ ID NO: 1231074 - RNA, 18 nt, Human
agaaaaguugaauuuuac

SEQ ID NO: 1231075 - RNA, 18 nt, Human
acugguaggaaacuaggu

SEQ ID NO: 1231076 - RNA, 15 nt, Human
acuggguaggaaaga

SEQ ID NO: 1231077 - RNA, 22 nt, Human
acuucugccagcauaauacuug

SEQ ID NO: 1231078 - RNA, 21 nt, Human
acuucuuuaauuuuggaauuu

SEQ ID NO: 1231079 - RNA, 19 nt, Human
acuuguaaaggaauuuaaa

SEQ ID NO: 1231080 - RNA, 20 nt, Human
acuuguaaaggaauuuaaaa

SEQ ID NO: 1231081 - RNA, 23 nt, Human
acuuauuguagcauccuggaaua

SEQ ID NO: 1231082 - RNA, 20 nt, Human
acuuauuguagcauccugga

SEQ ID NO: 1231083 - RNA, 16 nt, Human
acuaagagagaaugag

SEQ ID NO: 1231084 - RNA, 21 nt, Human
acucuguucauuccuccaggu

SEQ ID NO: 1231085 - RNA, 19 nt, Human
acucaaaccaaaucacuga

SEQ ID NO: 1231086 - RNA, 20 nt, Human
acucaaaccaaaucacugaa

SEQ ID NO: 1231087 - RNA, 12 nt, Human
acuccccuccuu

SEQ ID NO: 1231088 - RNA, 14 nt, Human
acuagcuauggugu

SEQ ID NO: 1231089 - RNA, 18 nt, Human
aaauugcuuuguauugua

SEQ ID NO: 1231090 - RNA, 16 nt, Human
aaauuggggauucuua

SEQ ID NO: 1231091 - RNA, 17 nt, Human
aaauuggggauucuuaa

SEQ ID NO: 1231092 - RNA, 15 nt, Human
aacaaagaaauuaug

SEQ ID NO: 1231093 - RNA, 17 nt, Human
aacaaagaaauuaugug

SEQ ID NO: 1231094 - RNA, 13 nt, Human
aacaugauuuggg

SEQ ID NO: 1231095 - RNA, 17 nt, Human
aacagcuggugcccugc

SEQ ID NO: 1231096 - RNA, 22 nt, Human
aaccacuggaaaguuuaugguu

SEQ ID NO: 1231097 - RNA, 14 nt, Human
aaccagaucauugu

SEQ ID NO: 1231098 - RNA, 21 nt, Human
aaccaguauuguacaaaguau

SEQ ID NO: 1231099 - RNA, 22 nt, Human
aaccaguauuguacaaaguauu

SEQ ID NO: 1231100 - RNA, 20 nt, Human
aaccaguauuguacaaagua

SEQ ID NO: 1231101 - RNA, 17 nt, Human
aacugauccagcaauua

SEQ ID NO: 1231102 - RNA, 12 nt, Human
aacuuuucugau

SEQ ID NO: 1231103 - RNA, 13 nt, Human
aacuuuucugaua

SEQ ID NO: 1231104 - RNA, 14 nt, Human
aacuuuucugauag

SEQ ID NO: 1231105 - RNA, 15 nt, Human
aacuuugcugagccu

SEQ ID NO: 1231106 - RNA, 17 nt, Human
aaagaguacucuuguuu

SEQ ID NO: 1231107 - RNA, 12 nt, Human
aaagaguacucu

SEQ ID NO: 1231108 - RNA, 13 nt, Human
aaagaaauuaugu

SEQ ID NO: 1231109 - RNA, 15 nt, Human
aaagaaauuaugugc

SEQ ID NO: 1231110 - RNA, 15 nt, Human
aaagaaauauaccua

SEQ ID NO: 1231111 - RNA, 11 nt, Human
aaagaacaucc

SEQ ID NO: 1231112 - RNA, 17 nt, Human
aaacugacucuuaagaa

SEQ ID NO: 1231113 - RNA, 16 nt, Human
aaacugacucuuaaga

SEQ ID NO: 1231114 - RNA, 16 nt, Human
aaagaaaagaaaauuu

SEQ ID NO: 1231115 - RNA, 12 nt, Human
aaagaaaacuug

SEQ ID NO: 1231116 - RNA, 20 nt, Human
aaagaaaacuuguauuaugu

SEQ ID NO: 1231117 - RNA, 14 nt, Human
aaacacucuugaaa

SEQ ID NO: 1231118 - RNA, 17 nt, Human
aaacacucuugaaaaau

SEQ ID NO: 1231119 - RNA, 17 nt, Human
aaaauuggggauucuua

SEQ ID NO: 1231120 - RNA, 18 nt, Human
aaaauuggggauucuuaa

SEQ ID NO: 1231121 - RNA, 19 nt, Human
aaaauuggggauucuuaaa

SEQ ID NO: 1231122 - RNA, 13 nt, Human
aaacacucuugaa

SEQ ID NO: 1231123 - RNA, 23 nt, Human
aaauagucucuuuaaaaggaaag

SEQ ID NO: 1231124 - RNA, 14 nt, Human
aaauauuuuaugau

SEQ ID NO: 1231125 - RNA, 18 nt, Human
aaauauuuuaugauccag

SEQ ID NO: 1231126 - RNA, 19 nt, Human
aaauauuuuaugauccagc

SEQ ID NO: 1231127 - RNA, 16 nt, Human
aaauagaagagagagg

SEQ ID NO: 1231128 - RNA, 13 nt, Human
aaauggaaacuau

SEQ ID NO: 1231129 - RNA, 17 nt, Human
aaauggaauacucuuau

SEQ ID NO: 1231130 - RNA, 18 nt, Human
aaauggcuuccuggcaau

SEQ ID NO: 1231131 - RNA, 20 nt, Human
aaauggacuguggugacuuu

SEQ ID NO: 1231132 - RNA, 19 nt, Human
aaauggacuguggugacuu

SEQ ID NO: 1231133 - RNA, 14 nt, Human
aaagugacccuguu

SEQ ID NO: 1231134 - RNA, 12 nt, Human
aaauaacaauga

SEQ ID NO: 1231135 - RNA, 20 nt, Human
aaagggacugagaaauuuau

SEQ ID NO: 1231136 - RNA, 16 nt, Human
aaagggacugagaaau

SEQ ID NO: 1231137 - RNA, 19 nt, Human
aaagucucuggaauuugaa

SEQ ID NO: 1231138 - RNA, 20 nt, Human
aaagucucuggaauuugaaa

SEQ ID NO: 1231139 - RNA, 22 nt, Human
aaagucucuggaauuugaaaca

SEQ ID NO: 1231140 - RNA, 16 nt, Human
aagcagacauuuuaaa

SEQ ID NO: 1231141 - RNA, 19 nt, Human
aagccagauuuuccugaaa

SEQ ID NO: 1231142 - RNA, 13 nt, Human
aagccagauuuuc

SEQ ID NO: 1231143 - RNA, 16 nt, Human
aagauuuaccacuugu

SEQ ID NO: 1231144 - RNA, 19 nt, Human
aagauugcuuaauaaauug

SEQ ID NO: 1231145 - RNA, 13 nt, Human
aagaaauuaugug

SEQ ID NO: 1231146 - RNA, 22 nt, Human
aagaaauuaugugccagauuua

SEQ ID NO: 1231147 - RNA, 13 nt, Human
aagccauguuuau

SEQ ID NO: 1231148 - RNA, 14 nt, Human
aaggacuguaaucu

SEQ ID NO: 1231149 - RNA, 19 nt, Human
aagucucuggaauuugaaa

SEQ ID NO: 1231150 - RNA, 14 nt, Human
aaguacuuuuggca

SEQ ID NO: 1231151 - RNA, 15 nt, Human
aaguacuuuuggcau

SEQ ID NO: 1231152 - RNA, 23 nt, Human
aaguccaggcuuuuuuaucaugu

SEQ ID NO: 1231153 - RNA, 20 nt, Human
aaguccaguguuucuuuuuu

SEQ ID NO: 1231154 - RNA, 12 nt, Human
aauaauguaaga

SEQ ID NO: 1231155 - RNA, 19 nt, Human
aauaauguaagacaaauau

SEQ ID NO: 1231156 - RNA, 21 nt, Human
aauaauccuaaacauaugaau

SEQ ID NO: 1231157 - RNA, 19 nt, Human
aauaaacuauuuguaaagu

SEQ ID NO: 1231158 - RNA, 17 nt, Human
aauaaacgucuuaaaua

SEQ ID NO: 1231159 - RNA, 16 nt, Human
aauauuauguuaaaac

SEQ ID NO: 1231160 - RNA, 14 nt, Human
aauauucaauaaag

SEQ ID NO: 1231161 - RNA, 15 nt, Human
aauauucaauaaagc

SEQ ID NO: 1231162 - RNA, 16 nt, Human
aauauucaauaaagcu

SEQ ID NO: 1231163 - RNA, 13 nt, Human
aaucacaauacau

SEQ ID NO: 1231164 - RNA, 14 nt, Human
aauccauuuggaaa

SEQ ID NO: 1231165 - RNA, 15 nt, Human
aauccauuuggaaau

SEQ ID NO: 1231166 - RNA, 17 nt, Human
aauccauuuggaaaucu

SEQ ID NO: 1231167 - RNA, 18 nt, Human
aauccauuuggaaaucuu

SEQ ID NO: 1231168 - RNA, 22 nt, Human
aauccauuuggaaaucuuuaaa

SEQ ID NO: 1231169 - RNA, 14 nt, Human
aauccauacauuug

SEQ ID NO: 1231170 - RNA, 13 nt, Human
aauccauacauuu

SEQ ID NO: 1231171 - RNA, 17 nt, Human
aaugaagauacugaaau

SEQ ID NO: 1231172 - RNA, 20 nt, Human
aaugauaacuggaaacuuca

SEQ ID NO: 1231173 - RNA, 12 nt, Human
aaugaagauacu

SEQ ID NO: 1231174 - RNA, 20 nt, Human
aauuaguuuuauaugcuucu

SEQ ID NO: 1231175 - RNA, 17 nt, Human
aauuaguuuuauaugcu

SEQ ID NO: 1231176 - RNA, 14 nt, Human
aauuaguuuuauau

SEQ ID NO: 1231177 - RNA, 13 nt, Human
aauggcuuuguau

SEQ ID NO: 1231178 - RNA, 15 nt, Human
aauggcuuuguauag

SEQ ID NO: 1231179 - RNA, 16 nt, Human
aauggcuuuguauaga

SEQ ID NO: 1231180 - RNA, 18 nt, Human
aauggcuuuguauagaac

SEQ ID NO: 1231181 - RNA, 22 nt, Human
agaugaggccagaccauggaca

SEQ ID NO: 1231182 - RNA, 13 nt, Human
agaugaggccaga

SEQ ID NO: 1231183 - RNA, 14 nt, Human
agaugaggccagac

SEQ ID NO: 1231184 - RNA, 16 nt, Human
agaugaggccagacca

SEQ ID NO: 1231185 - RNA, 21 nt, Human
agaugaggccagaccauggac

SEQ ID NO: 1231186 - RNA, 21 nt, Human
agauaggucagugcaaauacu

SEQ ID NO: 1231187 - RNA, 14 nt, Human
agaguguugaaacg

SEQ ID NO: 1231188 - RNA, 21 nt, Human
agacugcauuauauuuauuac

SEQ ID NO: 1231189 - RNA, 17 nt, Human
agacugcauuauauuua

SEQ ID NO: 1231190 - RNA, 15 nt, Human
agagaagcaaguaaa

SEQ ID NO: 1231191 - RNA, 13 nt, Human
agagaaggagcag

SEQ ID NO: 1231192 - RNA, 23 nt, Human
agacuacaggcacacaccaccac

SEQ ID NO: 1231193 - RNA, 12 nt, Human
agcacugcucca

SEQ ID NO: 1231194 - RNA, 14 nt, Human
agcaugcacaaauu

SEQ ID NO: 1231195 - RNA, 19 nt, Human
agccagauuuuccugaaaa

SEQ ID NO: 1231196 - RNA, 15 nt, Human
agccagauuuuccug

SEQ ID NO: 1231197 - RNA, 22 nt, Human
agccauguuuauuacaguauaa

SEQ ID NO: 1231198 - RNA, 13 nt, Human
agguaaguuuuuu

SEQ ID NO: 1231199 - RNA, 23 nt, Human
aggucccuaauaaagcugugugg

SEQ ID NO: 1231200 - RNA, 20 nt, Human
aggucccuaauaaagcugug

SEQ ID NO: 1231201 - RNA, 18 nt, Human
aggucccuaauaaagcug

SEQ ID NO: 1231202 - RNA, 19 nt, Human
aggucccuaauaaagcugu

SEQ ID NO: 1231203 - RNA, 17 nt, Human
aggucccuaauaaagcu

SEQ ID NO: 1231204 - RNA, 19 nt, Human
agguucaagcaauccuccc

SEQ ID NO: 1231205 - RNA, 17 nt, Human
agguucaugcaaacuuu

SEQ ID NO: 1231206 - RNA, 15 nt, Human
agguggaaauaaacu

SEQ ID NO: 1231207 - RNA, 19 nt, Human
agggcaauuaauuccuuca

SEQ ID NO: 1231208 - RNA, 22 nt, Human
agggcaauuaauuccuucagca

SEQ ID NO: 1231209 - RNA, 18 nt, Human
agggcaauuaauuccuuc

SEQ ID NO: 1231210 - RNA, 13 nt, Human
aggggcagagcca

SEQ ID NO: 1231211 - RNA, 14 nt, Human
aggggcagagccag

SEQ ID NO: 1231212 - RNA, 15 nt, Human
aggggcagagccagg

SEQ ID NO: 1231213 - RNA, 16 nt, Human
aggggcagagccagga

SEQ ID NO: 1231214 - RNA, 17 nt, Human
aggggcagagccaggaa

SEQ ID NO: 1231215 - RNA, 14 nt, Human
agcuggugcccugc

SEQ ID NO: 1231216 - RNA, 21 nt, Human
agcuuuucccuuuuuuuaagu

SEQ ID NO: 1231217 - RNA, 15 nt, Human
agcuuuucccuuuuu

SEQ ID NO: 1231218 - RNA, 18 nt, Human
agcuuuucccaaaagccc

SEQ ID NO: 1231219 - RNA, 14 nt, Human
agcuguaugauucc

SEQ ID NO: 1231220 - RNA, 15 nt, Human
aggaacuacugagga

SEQ ID NO: 1231221 - RNA, 12 nt, Human
aucccucaccca

SEQ ID NO: 1231222 - RNA, 19 nt, Human
aucccucacccauccuaga

SEQ ID NO: 1231223 - RNA, 20 nt, Human
auccacccgccucagccucc

SEQ ID NO: 1231224 - RNA, 12 nt, Human
aucaccugucuu

SEQ ID NO: 1231225 - RNA, 21 nt, Human
aucaccugucuugccuuuuuc

SEQ ID NO: 1231226 - RNA, 22 nt, Human
aucaccugucuugccuuuuuca

SEQ ID NO: 1231227 - RNA, 15 nt, Human
aucaucuauagaaag

SEQ ID NO: 1231228 - RNA, 19 nt, Human
aucaucuauagaaagcuau

SEQ ID NO: 1231229 - RNA, 13 nt, Human
aucaucucagcuc

SEQ ID NO: 1231230 - RNA, 14 nt, Human
aucaucucagcuca

SEQ ID NO: 1231231 - RNA, 19 nt, Human
aucaucucagcucacugca

SEQ ID NO: 1231232 - RNA, 22 nt, Human
aucuuauaauuuaaaauaugcu

SEQ ID NO: 1231233 - RNA, 18 nt, Human
augaagcuuuuaugugaa

SEQ ID NO: 1231234 - RNA, 19 nt, Human
augaagcuuuuaugugaaa

SEQ ID NO: 1231235 - RNA, 20 nt, Human
augaagcuuuuaugugaaac

SEQ ID NO: 1231236 - RNA, 21 nt, Human
augaagcuuuuaugugaaaca

SEQ ID NO: 1231237 - RNA, 15 nt, Human
augacuauguaaacu

SEQ ID NO: 1231238 - RNA, 16 nt, Human
augacuauguaaacua

SEQ ID NO: 1231239 - RNA, 14 nt, Human
augaaaaaauauau

SEQ ID NO: 1231240 - RNA, 17 nt, Human
augaaaaaauauauauc

SEQ ID NO: 1231241 - RNA, 22 nt, Human
augaaaaaauauauaucaaaua

SEQ ID NO: 1231242 - RNA, 23 nt, Human
augaaaaaauauauaucaaauau

SEQ ID NO: 1231243 - RNA, 17 nt, Human
augcacaguaaaaaugg

SEQ ID NO: 1231244 - RNA, 12 nt, Human
augcauggaaau

SEQ ID NO: 1231245 - RNA, 16 nt, Human
augcauggaaauuccc

SEQ ID NO: 1231246 - RNA, 14 nt, Human
augccuuuucccaa

SEQ ID NO: 1231247 - RNA, 21 nt, Human
augccuuuguacuuuagggaa

SEQ ID NO: 1231248 - RNA, 20 nt, Human
auggaaauucccuucaucug

SEQ ID NO: 1231249 - RNA, 18 nt, Human
auggagccugcacgguga

SEQ ID NO: 1231250 - RNA, 22 nt, Human
auggagccugcacggugaaugg

SEQ ID NO: 1231251 - RNA, 18 nt, Human
auggcuggagcuagaauu

SEQ ID NO: 1231252 - RNA, 16 nt, Human
augucaaucagccuag

SEQ ID NO: 1231253 - RNA, 17 nt, Human
auguacauguacugauu

SEQ ID NO: 1231254 - RNA, 16 nt, Human
auguaaguaaacgguc

SEQ ID NO: 1231255 - RNA, 13 nt, Human
augugugaaguga

SEQ ID NO: 1231256 - RNA, 18 nt, Human
auguuucuuuguaaugaa

SEQ ID NO: 1231257 - RNA, 19 nt, Human
auacaauuuuguuucugua

SEQ ID NO: 1231258 - RNA, 20 nt, Human
auacaauuuuguuucuguac

SEQ ID NO: 1231259 - RNA, 14 nt, Human
auacccucccuccc

SEQ ID NO: 1231260 - RNA, 16 nt, Human
auacccucccucccua

SEQ ID NO: 1231261 - RNA, 22 nt, Human
auacccucccucccuacccuaa

SEQ ID NO: 1231262 - RNA, 19 nt, Human
auaaguguguguuuuucau

SEQ ID NO: 1231263 - RNA, 22 nt, Human
auaaguguguguuuuucauaaa

SEQ ID NO: 1231264 - RNA, 20 nt, Human
auaauuaacauguuaaacca

SEQ ID NO: 1231265 - RNA, 21 nt, Human
auaauuaacauguuaaaccau

SEQ ID NO: 1231266 - RNA, 22 nt, Human
auaauuaacauguuaaaccaug

SEQ ID NO: 1231267 - RNA, 19 nt, Human
auaaguauuuaauucaugu

SEQ ID NO: 1231268 - RNA, 19 nt, Human
auacuugaaaauuaacaug

SEQ ID NO: 1231269 - RNA, 15 nt, Human
auacuugaaaauuaa

SEQ ID NO: 1231270 - RNA, 16 nt, Human
auacuugaaaauuaac

SEQ ID NO: 1231271 - RNA, 15 nt, Human
auauaagugauugcu

SEQ ID NO: 1231272 - RNA, 15 nt, Human
auauaaguguguguu

SEQ ID NO: 1231273 - RNA, 12 nt, Human
auauaauucuua

SEQ ID NO: 1231274 - RNA, 22 nt, Human
auauuuauuacuguaagaaaau

SEQ ID NO: 1231275 - RNA, 18 nt, Human
auauuuauuuuaauaaug

SEQ ID NO: 1231276 - RNA, 19 nt, Human
auauuuauuacuguaagaa

SEQ ID NO: 1231277 - RNA, 14 nt, Human
auauuuauuacugu

SEQ ID NO: 1231278 - RNA, 18 nt, Human
auauuuaguguucauaaa

SEQ ID NO: 1231279 - RNA, 16 nt, Human
auauuuauaaaaauaa

SEQ ID NO: 1231280 - RNA, 23 nt, Human
auauuucagauaaucacaauaca

SEQ ID NO: 1231281 - RNA, 14 nt, Human
auaugcuauuucua

SEQ ID NO: 1231282 - RNA, 15 nt, Human
auaugcuauuucuau

SEQ ID NO: 1231283 - RNA, 18 nt, Human
auaucacuugucaauaaa

SEQ ID NO: 1231284 - RNA, 14 nt, Human
agugaucaaacuac

SEQ ID NO: 1231285 - RNA, 17 nt, Human
agucaaauugugugaaa

SEQ ID NO: 1231286 - RNA, 15 nt, Human
agucaaauuguguga

SEQ ID NO: 1231287 - RNA, 19 nt, Human
agucaaauugugugaaagg

SEQ ID NO: 1231288 - RNA, 23 nt, Human
agucauucagauaugauucaaau

SEQ ID NO: 1231289 - RNA, 20 nt, Human
agucauucagauaugauuca

SEQ ID NO: 1231290 - RNA, 15 nt, Human
agucauucagauaug

SEQ ID NO: 1231291 - RNA, 21 nt, Human
aguccaagcauuuagauguau

SEQ ID NO: 1231292 - RNA, 16 nt, Human
aguccaagcauuuaga

SEQ ID NO: 1231293 - RNA, 11 nt, Human
aguugaauuua

SEQ ID NO: 1231294 - RNA, 13 nt, Human
aguugaauuuauu

SEQ ID NO: 1231295 - RNA, 17 nt, Human
aguugaauuuauuggcu

SEQ ID NO: 1231296 - RNA, 19 nt, Human
aguugaauuuauuggcuuu

SEQ ID NO: 1231297 - RNA, 15 nt, Human
aguugaauuuuacau

SEQ ID NO: 1231298 - RNA, 20 nt, Human
aguugaauuuauuggcuuuu

SEQ ID NO: 1231299 - RNA, 19 nt, Human
cacagugaucaaguuauuu

SEQ ID NO: 1231300 - RNA, 14 nt, Human
auuuuccugaaaac

SEQ ID NO: 1231301 - RNA, 13 nt, Human
auuuuccugaaaa

SEQ ID NO: 1231302 - RNA, 14 nt, Human
caaaaacaaaaaga

SEQ ID NO: 1231303 - RNA, 18 nt, Human
caaaaaccaguauuguac

SEQ ID NO: 1231304 - RNA, 19 nt, Human
caaaaaccaguauuguaca

SEQ ID NO: 1231305 - RNA, 20 nt, Human
caaaaaccaguauuguacaa

SEQ ID NO: 1231306 - RNA, 20 nt, Human
caaaaagaaaagaaaauuuu

SEQ ID NO: 1231307 - RNA, 19 nt, Human
caaaaauuaucuauagcua

SEQ ID NO: 1231308 - RNA, 19 nt, Human
caaaaaucucaauauuuca

SEQ ID NO: 1231309 - RNA, 22 nt, Human
caaaaauauuuuaugauccagc

SEQ ID NO: 1231310 - RNA, 23 nt, Human
caaaaauauuuuaugauccagca

SEQ ID NO: 1231311 - RNA, 14 nt, Human
caaaaauauuuuau

SEQ ID NO: 1231312 - RNA, 15 nt, Human
caaaaauauuuuaug

SEQ ID NO: 1231313 - RNA, 17 nt, Human
caaaaauauuuuaugau

SEQ ID NO: 1231314 - RNA, 21 nt, Human
caaaaauauuuuaugauccag

SEQ ID NO: 1231315 - RNA, 16 nt, Human
caaaauuguuacaaau

SEQ ID NO: 1231316 - RNA, 22 nt, Human
caaaauuuuuucucuaggaaau

SEQ ID NO: 1231317 - RNA, 21 nt, Human
caaaauuuuuucucuaggaaa

SEQ ID NO: 1231318 - RNA, 16 nt, Human
caaaauuuuuucucua

SEQ ID NO: 1231319 - RNA, 21 nt, Human
caaaggcauuauaaaaagaau

SEQ ID NO: 1231320 - RNA, 15 nt, Human
caaauugugugaaag

SEQ ID NO: 1231321 - RNA, 21 nt, Human
caaauuguaagcaugcacaaa

SEQ ID NO: 1231322 - RNA, 14 nt, Human
caaaugucuauaaa

SEQ ID NO: 1231323 - RNA, 15 nt, Human
caaaugucuauaaac

SEQ ID NO: 1231324 - RNA, 22 nt, Human
caaauacgugggcauucaaaug

SEQ ID NO: 1231325 - RNA, 21 nt, Human
caaauacgugggcauucaaau

SEQ ID NO: 1231326 - RNA, 17 nt, Human
caaaaauuaucuauagc

SEQ ID NO: 1231327 - RNA, 23 nt, Human
caauacaucccuuaccugggaaa

SEQ ID NO: 1231328 - RNA, 18 nt, Human
caaucuguaaaacuaaga

SEQ ID NO: 1231329 - RNA, 19 nt, Human
caauuacaacggagucaaa

SEQ ID NO: 1231330 - RNA, 18 nt, Human
caauuaauuccuucagca

SEQ ID NO: 1231331 - RNA, 15 nt, Human
caauuaauuccuuca

SEQ ID NO: 1231332 - RNA, 14 nt, Human
caauuaauuuuaga

SEQ ID NO: 1231333 - RNA, 14 nt, Human
caaggucugcuuuu

SEQ ID NO: 1231334 - RNA, 13 nt, Human
caaggucugcuuu

SEQ ID NO: 1231335 - RNA, 21 nt, Human
caagccagauuuuccugaaaa

SEQ ID NO: 1231336 - RNA, 20 nt, Human
caagaacacagcccugcuuc

SEQ ID NO: 1231337 - RNA, 19 nt, Human
caagacugcacaucaaaau

SEQ ID NO: 1231338 - RNA, 17 nt, Human
caaauuucaugaccagu

SEQ ID NO: 1231339 - RNA, 13 nt, Human
caacggagucaaa

SEQ ID NO: 1231340 - RNA, 20 nt, Human
caaccucugccucccagguu

SEQ ID NO: 1231341 - RNA, 12 nt, Human
caccccuaggac

SEQ ID NO: 1231342 - RNA, 12 nt, Human
cacccucacacu

SEQ ID NO: 1231343 - RNA, 15 nt, Human
caccgacugaaaaua

SEQ ID NO: 1231344 - RNA, 13 nt, Human
caccgcagaagga

SEQ ID NO: 1231345 - RNA, 20 nt, Human
caccugggauuacaagcaug

SEQ ID NO: 1231346 - RNA, 11 nt, Human
caccugucugu

SEQ ID NO: 1231347 - RNA, 12 nt, Human
caccugucuguc

SEQ ID NO: 1231348 - RNA, 13 nt, Human
caccugucugucu

SEQ ID NO: 1231349 - RNA, 14 nt, Human
caccugucugucug

SEQ ID NO: 1231350 - RNA, 13 nt, Human
caccuccugccuc

SEQ ID NO: 1231351 - RNA, 15 nt, Human
caccuccugccucag

SEQ ID NO: 1231352 - RNA, 21 nt, Human
caccucccucaaccucauccu

SEQ ID NO: 1231353 - RNA, 19 nt, Human
caccucgcagguucaagca

SEQ ID NO: 1231354 - RNA, 21 nt, Human
caccucucaauauucaauaaa

SEQ ID NO: 1231355 - RNA, 22 nt, Human
caccucucaauauucaauaaag

SEQ ID NO: 1231356 - RNA, 23 nt, Human
caccucucaauauucaauaaagc

SEQ ID NO: 1231357 - RNA, 14 nt, Human
caccucauggaauu

SEQ ID NO: 1231358 - RNA, 12 nt, Human
caccucauggaa

SEQ ID NO: 1231359 - RNA, 11 nt, Human
caccucaugga

SEQ ID NO: 1231360 - RNA, 15 nt, Human
caccucccucaaccu

SEQ ID NO: 1231361 - RNA, 17 nt, Human
caccucccucaaccuca

SEQ ID NO: 1231362 - RNA, 19 nt, Human
caccucccucaaccucauc

SEQ ID NO: 1231363 - RNA, 14 nt, Human
caccgcagaaggaa

SEQ ID NO: 1231364 - RNA, 15 nt, Human
caccgcagaaggaag

SEQ ID NO: 1231365 - RNA, 13 nt, Human
caccucucaauau

SEQ ID NO: 1231366 - RNA, 19 nt, Human
cacuguggguagacacaca

SEQ ID NO: 1231367 - RNA, 24 nt, Human
cacuguggguagacacacaugaag

SEQ ID NO: 1231368 - RNA, 22 nt, Human
cacuguggguagacacacauga

SEQ ID NO: 1231369 - RNA, 13 nt, Human
cacuggccccacc

SEQ ID NO: 1231370 - RNA, 14 nt, Human
cacuggccccaccc

SEQ ID NO: 1231371 - RNA, 16 nt, Human
cacuggccccacccuc

SEQ ID NO: 1231372 - RNA, 13 nt, Human
cacuggcgaggag

SEQ ID NO: 1231373 - RNA, 15 nt, Human
cacuguacuugcucu

SEQ ID NO: 1231374 - RNA, 18 nt, Human
cacuguacuugcucuuga

SEQ ID NO: 1231375 - RNA, 19 nt, Human
cacuguacuugcucuugau

SEQ ID NO: 1231376 - RNA, 12 nt, Human
cacugccuuuga

SEQ ID NO: 1231377 - RNA, 20 nt, Human
cacugccuucucaacuccaa

SEQ ID NO: 1231378 - RNA, 13 nt, Human
cacugcaaccucc

SEQ ID NO: 1231379 - RNA, 21 nt, Human
cacugauuugacauagucugg

SEQ ID NO: 1231380 - RNA, 23 nt, Human
cacugauuugacauagucuggcu

SEQ ID NO: 1231381 - RNA, 14 nt, Human
cacugcaaccuccg

SEQ ID NO: 1231382 - RNA, 14 nt, Human
cacugcaaccucca

SEQ ID NO: 1231383 - RNA, 17 nt, Human
cacugcaaccuccaccu

SEQ ID NO: 1231384 - RNA, 19 nt, Human
cacugcaaccuccaccucg

SEQ ID NO: 1231385 - RNA, 14 nt, Human
cacugcaaccucug

SEQ ID NO: 1231386 - RNA, 16 nt, Human
caccugucugucuguc

SEQ ID NO: 1231387 - RNA, 22 nt, Human
caccugucugucugucuguccc

SEQ ID NO: 1231388 - RNA, 17 nt, Human
caccugucuugccuuuu

SEQ ID NO: 1231389 - RNA, 20 nt, Human
caccugucuugccuuuuuca

SEQ ID NO: 1231390 - RNA, 22 nt, Human
caccuguggaacauaaaaagga

SEQ ID NO: 1231391 - RNA, 13 nt, Human
cacgcacggcagc

SEQ ID NO: 1231392 - RNA, 16 nt, Human
cacgccuggcuaauuu

SEQ ID NO: 1231393 - RNA, 20 nt, Human
cacggugaauggcuuuguau

SEQ ID NO: 1231394 - RNA, 23 nt, Human
cacggugaauggcuuuguauaga

SEQ ID NO: 1231395 - RNA, 13 nt, Human
cacuaaacaaaga

SEQ ID NO: 1231396 - RNA, 19 nt, Human
cacuaguauuucuaugaaa

SEQ ID NO: 1231397 - RNA, 16 nt, Human
cacuaacaugauuugg

SEQ ID NO: 1231398 - RNA, 17 nt, Human
cacuaagagagaaugag

SEQ ID NO: 1231399 - RNA, 15 nt, Human
cacucuccauuuaau

SEQ ID NO: 1231400 - RNA, 17 nt, Human
cacucuccauuuaauaa

SEQ ID NO: 1231401 - RNA, 15 nt, Human
cacucguguguuucu

SEQ ID NO: 1231402 - RNA, 16 nt, Human
cacucguguguuucua

SEQ ID NO: 1231403 - RNA, 11 nt, Human
cagaaggaagg

SEQ ID NO: 1231404 - RNA, 15 nt, Human
cagaaggaaggcagg

SEQ ID NO: 1231405 - RNA, 20 nt, Human
cagaaggaaggcagggagga

SEQ ID NO: 1231406 - RNA, 22 nt, Human
cagaaggaaggcagggaggagg

SEQ ID NO: 1231407 - RNA, 13 nt, Human
cagaacuacuucu

SEQ ID NO: 1231408 - RNA, 14 nt, Human
cacuuuuugcagcu

SEQ ID NO: 1231409 - RNA, 18 nt, Human
cacuuuuugcagcuuucu

SEQ ID NO: 1231410 - RNA, 15 nt, Human
cacuuuuugcagcuu

SEQ ID NO: 1231411 - RNA, 12 nt, Human
cacuuugcauaa

SEQ ID NO: 1231412 - RNA, 22 nt, Human
cagaaaaguugaauuuuacaug

SEQ ID NO: 1231413 - RNA, 20 nt, Human
cagaaaaguugaauuuuaca

SEQ ID NO: 1231414 - RNA, 17 nt, Human
cagaaaaguugaauuuu

SEQ ID NO: 1231415 - RNA, 23 nt, Human
cagaaaagaaagcuacagaagaa

SEQ ID NO: 1231416 - RNA, 22 nt, Human
cagaaagcaucccucacccauc

SEQ ID NO: 1231417 - RNA, 18 nt, Human
cagaaacacccucacacu

SEQ ID NO: 1231418 - RNA, 20 nt, Human
cagaaacacccucacacugg

SEQ ID NO: 1231419 - RNA, 21 nt, Human
cagaaacacccucacacuggg

SEQ ID NO: 1231420 - RNA, 22 nt, Human
cagaaacacccucacacuggga

SEQ ID NO: 1231421 - RNA, 23 nt, Human
cagaaacacccucacacugggac

SEQ ID NO: 1231422 - RNA, 21 nt, Human
cagaaugagacauccagcaga

SEQ ID NO: 1231423 - RNA, 13 nt, Human
cagacauuuuaaa

SEQ ID NO: 1231424 - RNA, 14 nt, Human
cagaccauggacac

SEQ ID NO: 1231425 - RNA, 22 nt, Human
cagaccauggacacuacaccca

SEQ ID NO: 1231426 - RNA, 21 nt, Human
cagaccauggacacuacaccc

SEQ ID NO: 1231427 - RNA, 14 nt, Human
cagauccuggaaau

SEQ ID NO: 1231428 - RNA, 14 nt, Human
cagaucugccuaag

SEQ ID NO: 1231429 - RNA, 16 nt, Human
cagaucugccuaagga

SEQ ID NO: 1231430 - RNA, 17 nt, Human
cagaucugccuaaggac

SEQ ID NO: 1231431 - RNA, 19 nt, Human
cagaucugccuaaggacuu

SEQ ID NO: 1231432 - RNA, 20 nt, Human
cagaucugccuaaggacuuc

SEQ ID NO: 1231433 - RNA, 21 nt, Human
cagaucugccuaaggacuucu

SEQ ID NO: 1231434 - RNA, 23 nt, Human
cagaucugccuaaggacuucuuu

SEQ ID NO: 1231435 - RNA, 22 nt, Human
cagauaaagguucaugcaaacu

SEQ ID NO: 1231436 - RNA, 14 nt, Human
cagauaaucacaau

SEQ ID NO: 1231437 - RNA, 23 nt, Human
cagaggcgcaugaauuugugaag

SEQ ID NO: 1231438 - RNA, 17 nt, Human
cagagcaagaccccauc

SEQ ID NO: 1231439 - RNA, 13 nt, Human
cagagaagaaaga

SEQ ID NO: 1231440 - RNA, 14 nt, Human
cagagaagaaagaa

SEQ ID NO: 1231441 - RNA, 18 nt, Human
cagagaagaaagaacgga

SEQ ID NO: 1231442 - RNA, 19 nt, Human
cagagaagaaagaacggaa

SEQ ID NO: 1231443 - RNA, 13 nt, Human
cagagcacugcuc

SEQ ID NO: 1231444 - RNA, 15 nt, Human
cagagcacugcucca

SEQ ID NO: 1231445 - RNA, 14 nt, Human
cagagccaggaaga

SEQ ID NO: 1231446 - RNA, 15 nt, Human
cagagccaggaagau

SEQ ID NO: 1231447 - RNA, 17 nt, Human
cagagccaggaagaucc

SEQ ID NO: 1231448 - RNA, 21 nt, Human
cagagccaggaagauccccca

SEQ ID NO: 1231449 - RNA, 23 nt, Human
cagagccaggaagaucccccaga

SEQ ID NO: 1231450 - RNA, 13 nt, Human
cagagccaggaag

SEQ ID NO: 1231451 - RNA, 12 nt, Human
cagauuauucac

SEQ ID NO: 1231452 - RNA, 18 nt, Human
cagauuauucacugauuu

SEQ ID NO: 1231453 - RNA, 23 nt, Human
cagauuauucacugauuugacau

SEQ ID NO: 1231454 - RNA, 13 nt, Human
cagauuuuauuau

SEQ ID NO: 1231455 - RNA, 15 nt, Human
cagauuuuauuaugu

SEQ ID NO: 1231456 - RNA, 16 nt, Human
cagauuuuauuaugua

SEQ ID NO: 1231457 - RNA, 18 nt, Human
cagauuuuauuauguaaa

SEQ ID NO: 1231458 - RNA, 20 nt, Human
cagauuuuauuauguaaauc

SEQ ID NO: 1231459 - RNA, 21 nt, Human
cagauuuuauuauguaaaucc

SEQ ID NO: 1231460 - RNA, 22 nt, Human
cagauuuuauuauguaaauccc

SEQ ID NO: 1231461 - RNA, 15 nt, Human
cagauuuuccugaaa

SEQ ID NO: 1231462 - RNA, 14 nt, Human
cagauuuuccugaa

SEQ ID NO: 1231463 - RNA, 17 nt, Human
cagcaaaaauauuuuau

SEQ ID NO: 1231464 - RNA, 14 nt, Human
cagcaacaauaaau

SEQ ID NO: 1231465 - RNA, 19 nt, Human
cagcaacaauaaauagaca

SEQ ID NO: 1231466 - RNA, 20 nt, Human
cagcaacaauaaauagacac

SEQ ID NO: 1231467 - RNA, 17 nt, Human
cagcaauagagacggga

SEQ ID NO: 1231468 - RNA, 15 nt, Human
cagcaauagagacgg

SEQ ID NO: 1231469 - RNA, 22 nt, Human
cagcaauuacaacggagucaaa

SEQ ID NO: 1231470 - RNA, 14 nt, Human
cagcaauuuaaaug

SEQ ID NO: 1231471 - RNA, 15 nt, Human
cagcaauuuaaaugu

SEQ ID NO: 1231472 - RNA, 16 nt, Human
cagcaauuuaaauguu

SEQ ID NO: 1231473 - RNA, 14 nt, Human
cagcacuuuagaau

SEQ ID NO: 1231474 - RNA, 22 nt, Human
cagcacuuuagaauaugccuug

SEQ ID NO: 1231475 - RNA, 14 nt, Human
cagcagauuauuca

SEQ ID NO: 1231476 - RNA, 15 nt, Human
cagcagauuauucac

SEQ ID NO: 1231477 - RNA, 19 nt, Human
cagcagauuauucacugau

SEQ ID NO: 1231478 - RNA, 21 nt, Human
cagccacggggacucagcccu

SEQ ID NO: 1231479 - RNA, 23 nt, Human
cagccauccagggggcaagagga

SEQ ID NO: 1231480 - RNA, 18 nt, Human
cagccaacuauggccugu

SEQ ID NO: 1231481 - RNA, 20 nt, Human
cagcccugcugcugccugcc

SEQ ID NO: 1231482 - RNA, 16 nt, Human
cagccuaguugaucag

SEQ ID NO: 1231483 - RNA, 21 nt, Human
cagcgagauaccccaccuccc

SEQ ID NO: 1231484 - RNA, 13 nt, Human
cagcucacugcaa

SEQ ID NO: 1231485 - RNA, 15 nt, Human
cagcucacugcaacc

SEQ ID NO: 1231486 - RNA, 16 nt, Human
cagccuucuacugcuc

SEQ ID NO: 1231487 - RNA, 18 nt, Human
cagcuggggccaggcugg

SEQ ID NO: 1231488 - RNA, 19 nt, Human
cagcuggggccaggcuggg

SEQ ID NO: 1231489 - RNA, 20 nt, Human
cagcuggggccaggcugggu

SEQ ID NO: 1231490 - RNA, 18 nt, Human
cagcuguaugauucccag

SEQ ID NO: 1231491 - RNA, 18 nt, Human
cagcuggugcccugcuuu

SEQ ID NO: 1231492 - RNA, 19 nt, Human
cagcuggugcccugcuuuc

SEQ ID NO: 1231493 - RNA, 20 nt, Human
cagcuggugcccugcuuuca

SEQ ID NO: 1231494 - RNA, 21 nt, Human
cagcuggugcccugcuuucag

SEQ ID NO: 1231495 - RNA, 23 nt, Human
cagcuggugcccugcuuucagau

SEQ ID NO: 1231496 - RNA, 21 nt, Human
cagcuggggccaggcuggguc

SEQ ID NO: 1231497 - RNA, 22 nt, Human
cagcuggggccaggcugggucg

SEQ ID NO: 1231498 - RNA, 18 nt, Human
cagcucucaguugcagcc

SEQ ID NO: 1231499 - RNA, 21 nt, Human
cagcuuuauggagauauaauu

SEQ ID NO: 1231500 - RNA, 14 nt, Human
cagcuuuagccaag

SEQ ID NO: 1231501 - RNA, 18 nt, Human
caggaaccacaagacugc

SEQ ID NO: 1231502 - RNA, 18 nt, Human
cagcuuuucccaaaagcc

SEQ ID NO: 1231503 - RNA, 20 nt, Human
cagcuuuucccaaaagccca

SEQ ID NO: 1231504 - RNA, 19 nt, Human
cagcuguaugauucccagc

SEQ ID NO: 1231505 - RNA, 17 nt, Human
caggaauggagccugca

SEQ ID NO: 1231506 - RNA, 23 nt, Human
caggaauggagccugcacgguga

SEQ ID NO: 1231507 - RNA, 19 nt, Human
caggaagaucccccagaaa

SEQ ID NO: 1231508 - RNA, 14 nt, Human
caggaagagaagga

SEQ ID NO: 1231509 - RNA, 15 nt, Human
caggaagagaaggag

SEQ ID NO: 1231510 - RNA, 17 nt, Human
caggaagagaaggagca

SEQ ID NO: 1231511 - RNA, 17 nt, Human
caggaagaucccccaga

SEQ ID NO: 1231512 - RNA, 18 nt, Human
caggaagaucccccagaa

SEQ ID NO: 1231513 - RNA, 19 nt, Human
caggaguuucguuuucaaa

SEQ ID NO: 1231514 - RNA, 11 nt, Human
caggagcccug

SEQ ID NO: 1231515 - RNA, 14 nt, Human
caggagcccuggga

SEQ ID NO: 1231516 - RNA, 16 nt, Human
caggagcccugggagg

SEQ ID NO: 1231517 - RNA, 18 nt, Human
caggagcccugggaggcu

SEQ ID NO: 1231518 - RNA, 19 nt, Human
caggagcccugggaggcuc

SEQ ID NO: 1231519 - RNA, 21 nt, Human
caggagcccugggaggcucug

SEQ ID NO: 1231520 - RNA, 23 nt, Human
caggaugguucccuugaugaaga

SEQ ID NO: 1231521 - RNA, 21 nt, Human
caggaugguucccuugaugaa

SEQ ID NO: 1231522 - RNA, 18 nt, Human
caggauggucuccaucuc

SEQ ID NO: 1231523 - RNA, 22 nt, Human
caggaugaugacuauggaaaga

SEQ ID NO: 1231524 - RNA, 18 nt, Human
caggaugaugacuaugga

SEQ ID NO: 1231525 - RNA, 20 nt, Human
caggaugaugacuauggaaa

SEQ ID NO: 1231526 - RNA, 15 nt, Human
caggaucaguuaacu

SEQ ID NO: 1231527 - RNA, 21 nt, Human
caggauauucucacagcucca

SEQ ID NO: 1231528 - RNA, 17 nt, Human
caggaucaguuaacuau

SEQ ID NO: 1231529 - RNA, 13 nt, Human
caggauccaggcc

SEQ ID NO: 1231530 - RNA, 14 nt, Human
caggcaggagcccu

SEQ ID NO: 1231531 - RNA, 23 nt, Human
caggcuuuuuuaucaugugaaau

SEQ ID NO: 1231532 - RNA, 16 nt, Human
caggcuggagugcagu

SEQ ID NO: 1231533 - RNA, 23 nt, Human
caggcugggucgcccuggacugu

SEQ ID NO: 1231534 - RNA, 21 nt, Human
caggcugggucgcccuggacu

SEQ ID NO: 1231535 - RNA, 19 nt, Human
caggcuagauguauguacu

SEQ ID NO: 1231536 - RNA, 13 nt, Human
caggcuagaugua

SEQ ID NO: 1231537 - RNA, 23 nt, Human
cagggaccggcggaccccagcca

SEQ ID NO: 1231538 - RNA, 16 nt, Human
caggggacaggauggu

SEQ ID NO: 1231539 - RNA, 11 nt, Human
caggggacagg

SEQ ID NO: 1231540 - RNA, 15 nt, Human
cagggggcaagagga

SEQ ID NO: 1231541 - RNA, 16 nt, Human
cagugaaagaaaauaa

SEQ ID NO: 1231542 - RNA, 20 nt, Human
cagugaaagaaaauaacaau

SEQ ID NO: 1231543 - RNA, 13 nt, Human
cagucccuccaca

SEQ ID NO: 1231544 - RNA, 14 nt, Human
caguaucucuucag

SEQ ID NO: 1231545 - RNA, 15 nt, Human
caguaucucuucagu

SEQ ID NO: 1231546 - RNA, 16 nt, Human
caguaucucuucaguc

SEQ ID NO: 1231547 - RNA, 17 nt, Human
caguaucucuucagucu

SEQ ID NO: 1231548 - RNA, 19 nt, Human
caguaucucuucagucucu

SEQ ID NO: 1231549 - RNA, 22 nt, Human
caguaucucuucagucucuaua

SEQ ID NO: 1231550 - RNA, 19 nt, Human
caguaggggcuuauaauaa

SEQ ID NO: 1231551 - RNA, 22 nt, Human
caguaggggcuuauaauaaagg

SEQ ID NO: 1231552 - RNA, 14 nt, Human
caguauaauuaaca

SEQ ID NO: 1231553 - RNA, 15 nt, Human
caguauaauuaacau

SEQ ID NO: 1231554 - RNA, 17 nt, Human
caguauaauuaacaugu

SEQ ID NO: 1231555 - RNA, 21 nt, Human
caguauaauuaacauguuaaa

SEQ ID NO: 1231556 - RNA, 20 nt, Human
cagucauucagauaugauuc

SEQ ID NO: 1231557 - RNA, 17 nt, Human
cagucauucagauauga

SEQ ID NO: 1231558 - RNA, 23 nt, Human
caguauggguuagggaaaacauu

SEQ ID NO: 1231559 - RNA, 16 nt, Human
caguauggguuaggga

SEQ ID NO: 1231560 - RNA, 21 nt, Human
caguauggguuagggaaaaca

SEQ ID NO: 1231561 - RNA, 22 nt, Human
cagucaggaaagagaacuucca

SEQ ID NO: 1231562 - RNA, 18 nt, Human
cagucaggaaagagaacu

SEQ ID NO: 1231563 - RNA, 15 nt, Human
cagucaggaaagaga

SEQ ID NO: 1231564 - RNA, 19 nt, Human
caggucccuaauaaagcug

SEQ ID NO: 1231565 - RNA, 20 nt, Human
caggucccuaauaaagcugu

SEQ ID NO: 1231566 - RNA, 21 nt, Human
caggucccuaauaaagcugug

SEQ ID NO: 1231567 - RNA, 22 nt, Human
caggucccuaauaaagcugugu

SEQ ID NO: 1231568 - RNA, 11 nt, Human
caggucccuaa

SEQ ID NO: 1231569 - RNA, 12 nt, Human
caggucccuaau

SEQ ID NO: 1231570 - RNA, 13 nt, Human
caggucccuaaua

SEQ ID NO: 1231571 - RNA, 14 nt, Human
caggucccuaauaa

SEQ ID NO: 1231572 - RNA, 15 nt, Human
caggucccuaauaaa

SEQ ID NO: 1231573 - RNA, 16 nt, Human
caggucccuaauaaag

SEQ ID NO: 1231574 - RNA, 17 nt, Human
caggucccuaauaaagc

SEQ ID NO: 1231575 - RNA, 18 nt, Human
caggucccuaauaaagcu

SEQ ID NO: 1231576 - RNA, 16 nt, Human
cauauaagugauugcu

SEQ ID NO: 1231577 - RNA, 13 nt, Human
cauauauaacaau

SEQ ID NO: 1231578 - RNA, 19 nt, Human
cauagucuggcuguaccca

SEQ ID NO: 1231579 - RNA, 20 nt, Human
cauauauaacaaugcuguau

SEQ ID NO: 1231580 - RNA, 15 nt, Human
cauauauaacaaugc

SEQ ID NO: 1231581 - RNA, 18 nt, Human
cauauauuuuuauauuua

SEQ ID NO: 1231582 - RNA, 20 nt, Human
cauauauuuuuauauuuacu

SEQ ID NO: 1231583 - RNA, 21 nt, Human
cauauauuuuuauauuuacua

SEQ ID NO: 1231584 - RNA, 22 nt, Human
cauauauuuuuauauuuacuaa

SEQ ID NO: 1231585 - RNA, 13 nt, Human
cauauuguuacug

SEQ ID NO: 1231586 - RNA, 19 nt, Human
cauauuguuacugguacca

SEQ ID NO: 1231587 - RNA, 13 nt, Human
caucccuccuggg

SEQ ID NO: 1231588 - RNA, 18 nt, Human
caucccuuaccugggaaa

SEQ ID NO: 1231589 - RNA, 14 nt, Human
caucaucucagcuc

SEQ ID NO: 1231590 - RNA, 15 nt, Human
caucaucucagcuca

SEQ ID NO: 1231591 - RNA, 10 nt, Human
caucuuuaag

SEQ ID NO: 1231592 - RNA, 14 nt, Human
caugaaagauucaa

SEQ ID NO: 1231593 - RNA, 18 nt, Human
caugagucacuacgccug

SEQ ID NO: 1231594 - RNA, 13 nt, Human
caugauaaaugau

SEQ ID NO: 1231595 - RNA, 16 nt, Human
caugggauaaaugcca

SEQ ID NO: 1231596 - RNA, 17 nt, Human
caugggauaaaugccau

SEQ ID NO: 1231597 - RNA, 18 nt, Human
caugggauaaaugccauc

SEQ ID NO: 1231598 - RNA, 23 nt, Human
caugggauaaaugccaucaauaa

SEQ ID NO: 1231599 - RNA, 22 nt, Human
cauggacuucugccagcauaau

SEQ ID NO: 1231600 - RNA, 16 nt, Human
cauggacacuacaccc

SEQ ID NO: 1231601 - RNA, 17 nt, Human
cauggacacuacaccca

SEQ ID NO: 1231602 - RNA, 18 nt, Human
cauggacacuacacccag

SEQ ID NO: 1231603 - RNA, 19 nt, Human
cauggacacuacacccagc

SEQ ID NO: 1231604 - RNA, 20 nt, Human
cauggacacuacacccagca

SEQ ID NO: 1231605 - RNA, 21 nt, Human
cauggacacuacacccagcaa

SEQ ID NO: 1231606 - RNA, 20 nt, Human
caugcuguucaugaaagauu

SEQ ID NO: 1231607 - RNA, 22 nt, Human
caugcugugugacucaaaccaa

SEQ ID NO: 1231608 - RNA, 18 nt, Human
caugcuguucaugaaaga

SEQ ID NO: 1231609 - RNA, 16 nt, Human
caugcuguucaugaaa

SEQ ID NO: 1231610 - RNA, 20 nt, Human
cauggaauuggagcucgugg

SEQ ID NO: 1231611 - RNA, 21 nt, Human
cauggaaauucccuucaucug

SEQ ID NO: 1231612 - RNA, 14 nt, Human
caugcugugugacu

SEQ ID NO: 1231613 - RNA, 15 nt, Human
caugcuguucaugaa

SEQ ID NO: 1231614 - RNA, 17 nt, Human
caugcugugugacucaa

SEQ ID NO: 1231615 - RNA, 21 nt, Human
caugcugugugacucaaacca

SEQ ID NO: 1231616 - RNA, 14 nt, Human
caugcagaaagcau

SEQ ID NO: 1231617 - RNA, 20 nt, Human
cauguuucuuuguaaugaaa

SEQ ID NO: 1231618 - RNA, 20 nt, Human
caugugcuaguaauuggaaa

SEQ ID NO: 1231619 - RNA, 13 nt, Human
cauguuaaaccau

SEQ ID NO: 1231620 - RNA, 22 nt, Human
cauguuaaaccaugggauaaau

SEQ ID NO: 1231621 - RNA, 23 nt, Human
cauguuuauuacaguauaauuaa

SEQ ID NO: 1231622 - RNA, 21 nt, Human
cauguuaaccccuccacucuu

SEQ ID NO: 1231623 - RNA, 18 nt, Human
cauuuuacauuaaauuuu

SEQ ID NO: 1231624 - RNA, 11 nt, Human
cauuuggaaau

SEQ ID NO: 1231625 - RNA, 17 nt, Human
cauuuggaaaucuuuaa

SEQ ID NO: 1231626 - RNA, 18 nt, Human
cauuuggaaaucuuuaaa

SEQ ID NO: 1231627 - RNA, 22 nt, Human
cauuuggaaaucuuuaaaaaaa

SEQ ID NO: 1231628 - RNA, 23 nt, Human
cauuuuaccuuugacaaagguaa

SEQ ID NO: 1231629 - RNA, 13 nt, Human
cauucuggaauaa

SEQ ID NO: 1231630 - RNA, 12 nt, Human
cauucuggaagu

SEQ ID NO: 1231631 - RNA, 16 nt, Human
cauucuggaagugacu

SEQ ID NO: 1231632 - RNA, 14 nt, Human
cauuccugaacagg

SEQ ID NO: 1231633 - RNA, 12 nt, Human
cauuccuccagg

SEQ ID NO: 1231634 - RNA, 13 nt, Human
cauuccuccaggu

SEQ ID NO: 1231635 - RNA, 15 nt, Human
cauuccauucuggaa

SEQ ID NO: 1231636 - RNA, 14 nt, Human
cauuccauucugga

SEQ ID NO: 1231637 - RNA, 12 nt, Human
cauuccauccuu

SEQ ID NO: 1231638 - RNA, 14 nt, Human
cauuccauccuuga

SEQ ID NO: 1231639 - RNA, 22 nt, Human
cauuccaacuaucucauuucca

SEQ ID NO: 1231640 - RNA, 15 nt, Human
cauucauuccauucu

SEQ ID NO: 1231641 - RNA, 16 nt, Human
cauucauuccauucug

SEQ ID NO: 1231642 - RNA, 17 nt, Human
cauucauuccauucugg

SEQ ID NO: 1231643 - RNA, 19 nt, Human
cauucauuuucuggguguu

SEQ ID NO: 1231644 - RNA, 21 nt, Human
cauucagauaugauucaaaug

SEQ ID NO: 1231645 - RNA, 20 nt, Human
cauucaaauguauuacagug

SEQ ID NO: 1231646 - RNA, 18 nt, Human
cauuauucaaaguugccu

SEQ ID NO: 1231647 - RNA, 21 nt, Human
cauuauucaaaguugccuaaa

SEQ ID NO: 1231648 - RNA, 22 nt, Human
cauuauucaaaguugccuaaau

SEQ ID NO: 1231649 - RNA, 11 nt, Human
ccaaaccacuu

SEQ ID NO: 1231650 - RNA, 14 nt, Human
ccaaaccacuuuuu

SEQ ID NO: 1231651 - RNA, 22 nt, Human
ccaaaccacuuuuugcagcuuu

SEQ ID NO: 1231652 - RNA, 22 nt, Human
ccacccagaaugagacauccag

SEQ ID NO: 1231653 - RNA, 21 nt, Human
ccacccucguggacaccugcc

SEQ ID NO: 1231654 - RNA, 22 nt, Human
ccacccucguggacaccugccc

SEQ ID NO: 1231655 - RNA, 18 nt, Human
ccaccucccucaaccuca

SEQ ID NO: 1231656 - RNA, 20 nt, Human
ccaccucccucaaccucauc

SEQ ID NO: 1231657 - RNA, 14 nt, Human
ccacugccuuugac

SEQ ID NO: 1231658 - RNA, 22 nt, Human
ccacugccuuugaccugccucc

SEQ ID NO: 1231659 - RNA, 13 nt, Human
ccagauuuaugca

SEQ ID NO: 1231660 - RNA, 22 nt, Human
ccagauuuaugcauauuauuuu

SEQ ID NO: 1231661 - RNA, 16 nt, Human
ccagagcacugcucca

SEQ ID NO: 1231662 - RNA, 20 nt, Human
ccacuguacuugcucuugau

SEQ ID NO: 1231663 - RNA, 17 nt, Human
ccacuguacuugcucuu

SEQ ID NO: 1231664 - RNA, 18 nt, Human
ccacuguacuugcucuug

SEQ ID NO: 1231665 - RNA, 19 nt, Human
ccacuguacuugcucuuga

SEQ ID NO: 1231666 - RNA, 15 nt, Human
ccagaccauggacac

SEQ ID NO: 1231667 - RNA, 23 nt, Human
ccagcaauuacaacggagucaaa

SEQ ID NO: 1231668 - RNA, 14 nt, Human
ccagccucagcucu

SEQ ID NO: 1231669 - RNA, 23 nt, Human
ccagcauaauacuugcuuuggaa

SEQ ID NO: 1231670 - RNA, 18 nt, Human
ccagguuggagugcagug

SEQ ID NO: 1231671 - RNA, 13 nt, Human
ccauucauuccau

SEQ ID NO: 1231672 - RNA, 14 nt, Human
ccauucauuccauu

SEQ ID NO: 1231673 - RNA, 17 nt, Human
ccaugggauaaaugcca

SEQ ID NO: 1231674 - RNA, 13 nt, Human
ccaugggauaaau

SEQ ID NO: 1231675 - RNA, 13 nt, Human
ccauguuuauuac

SEQ ID NO: 1231676 - RNA, 20 nt, Human
ccauguuuauuacaguauaa

SEQ ID NO: 1231677 - RNA, 14 nt, Human
ccauuauucaaagu

SEQ ID NO: 1231678 - RNA, 17 nt, Human
ccauuauucaaaguugc

SEQ ID NO: 1231679 - RNA, 22 nt, Human
ccauuauucaaaguugccuaaa

SEQ ID NO: 1231680 - RNA, 18 nt, Human
ccauucauuccauucugg

SEQ ID NO: 1231681 - RNA, 14 nt, Human
ccauauuggccagu

SEQ ID NO: 1231682 - RNA, 13 nt, Human
ccauggcccugcc

SEQ ID NO: 1231683 - RNA, 13 nt, Human
cccagaaaagaaa

SEQ ID NO: 1231684 - RNA, 20 nt, Human
cccagaaaagaaagcuacag

SEQ ID NO: 1231685 - RNA, 13 nt, Human
cccgccucagccu

SEQ ID NO: 1231686 - RNA, 18 nt, Human
cccuggucccucugcagu

SEQ ID NO: 1231687 - RNA, 21 nt, Human
cccuggacugugugcucagga

SEQ ID NO: 1231688 - RNA, 15 nt, Human
cccuggacugugugc

SEQ ID NO: 1231689 - RNA, 15 nt, Human
cccugggaggcucug

SEQ ID NO: 1231690 - RNA, 17 nt, Human
cccugcuuucagauacu

SEQ ID NO: 1231691 - RNA, 20 nt, Human
cccugccaccuccugccuca

SEQ ID NO: 1231692 - RNA, 13 nt, Human
cccugccaccugu

SEQ ID NO: 1231693 - RNA, 14 nt, Human
cccugccaccuguc

SEQ ID NO: 1231694 - RNA, 15 nt, Human
cccugccaccugucu

SEQ ID NO: 1231695 - RNA, 16 nt, Human
cccugccaccugucug

SEQ ID NO: 1231696 - RNA, 17 nt, Human
cccugccaccugucugu

SEQ ID NO: 1231697 - RNA, 18 nt, Human
cccugccaccugucuguc

SEQ ID NO: 1231698 - RNA, 19 nt, Human
cccuccaccgcagaaggaa

SEQ ID NO: 1231699 - RNA, 23 nt, Human
cccuccacauuucccccuagccu

SEQ ID NO: 1231700 - RNA, 21 nt, Human
cccuccaccgcagaaggaagg

SEQ ID NO: 1231701 - RNA, 18 nt, Human
cccuccaccgcagaagga

SEQ ID NO: 1231702 - RNA, 18 nt, Human
cccucucucauacccucc

SEQ ID NO: 1231703 - RNA, 22 nt, Human
cccucucucauacccucccucc

SEQ ID NO: 1231704 - RNA, 21 nt, Human
cccaccucccucaaccucauc

SEQ ID NO: 1231705 - RNA, 16 nt, Human
ccuaaauauauuuuaa

SEQ ID NO: 1231706 - RNA, 18 nt, Human
ccuaaauauauuuuaaga

SEQ ID NO: 1231707 - RNA, 12 nt, Human
ccuaaauccauu

SEQ ID NO: 1231708 - RNA, 19 nt, Human
ccuaaauaauaaaaauaaa

SEQ ID NO: 1231709 - RNA, 17 nt, Human
ccuaaauccauuuggaa

SEQ ID NO: 1231710 - RNA, 18 nt, Human
ccuaaauccauuuggaaa

SEQ ID NO: 1231711 - RNA, 19 nt, Human
ccuaaaagaaacccugcac

SEQ ID NO: 1231712 - RNA, 15 nt, Human
ccgugcuaaggacuu

SEQ ID NO: 1231713 - RNA, 16 nt, Human
ccgugcuaaggacuug

SEQ ID NO: 1231714 - RNA, 17 nt, Human
ccggcuugccacacccc

SEQ ID NO: 1231715 - RNA, 21 nt, Human
ccucaucuccccaucauuggu

SEQ ID NO: 1231716 - RNA, 18 nt, Human
ccuccaccgcagaaggaa

SEQ ID NO: 1231717 - RNA, 12 nt, Human
ccuccaccucaa

SEQ ID NO: 1231718 - RNA, 22 nt, Human
ccucucaauauucaauaaagcu

SEQ ID NO: 1231719 - RNA, 18 nt, Human
ccucucaauauucaauaa

SEQ ID NO: 1231720 - RNA, 20 nt, Human
ccucucaauauucaauaaag

SEQ ID NO: 1231721 - RNA, 19 nt, Human
ccugcugugaaagaaguaa

SEQ ID NO: 1231722 - RNA, 23 nt, Human
ccuggaaaucaggguuaguauug

SEQ ID NO: 1231723 - RNA, 20 nt, Human
ccugcuuuuuauggccugug

SEQ ID NO: 1231724 - RNA, 22 nt, Human
ccugccucaccagcccuggcaa

SEQ ID NO: 1231725 - RNA, 17 nt, Human
ccuggugcacuggcccc

SEQ ID NO: 1231726 - RNA, 19 nt, Human
ccuggugcacuggccccac

SEQ ID NO: 1231727 - RNA, 20 nt, Human
ccuggugcacuggccccacc

SEQ ID NO: 1231728 - RNA, 20 nt, Human
ccugcacggugaauggcuuu

SEQ ID NO: 1231729 - RNA, 21 nt, Human
ccugcacggugaauggcuuug

SEQ ID NO: 1231730 - RNA, 12 nt, Human
ccuguuuaagag

SEQ ID NO: 1231731 - RNA, 15 nt, Human
ccuguuuaagagaca

SEQ ID NO: 1231732 - RNA, 16 nt, Human
ccuuaacugcauccag

SEQ ID NO: 1231733 - RNA, 17 nt, Human
ccuuaagagucauccag

SEQ ID NO: 1231734 - RNA, 20 nt, Human
ccuucagcacuuuagaauau

SEQ ID NO: 1231735 - RNA, 18 nt, Human
ccuucuauacccacccag

SEQ ID NO: 1231736 - RNA, 20 nt, Human
ccuucuauacccacccagaa

SEQ ID NO: 1231737 - RNA, 19 nt, Human
ccuucuauacccacccaga

SEQ ID NO: 1231738 - RNA, 13 nt, Human
ccuugaacuagga

SEQ ID NO: 1231739 - RNA, 19 nt, Human
ccuuggggcugaugcaguu

SEQ ID NO: 1231740 - RNA, 16 nt, Human
ccuuugaccugccucc

SEQ ID NO: 1231741 - RNA, 21 nt, Human
ccuuguuucucuuccuuucuu

SEQ ID NO: 1231742 - RNA, 21 nt, Human
ccuuugaccugccucccuuca

SEQ ID NO: 1231743 - RNA, 22 nt, Human
ccuuugaccugccucccuucau

SEQ ID NO: 1231744 - RNA, 13 nt, Human
cgagauaccccac

SEQ ID NO: 1231745 - RNA, 20 nt, Human
cgagauaccccaccucccuc

SEQ ID NO: 1231746 - RNA, 17 nt, Human
cucauacccucccuccc

SEQ ID NO: 1231747 - RNA, 16 nt, Human
cucauacccucccucc

SEQ ID NO: 1231748 - RNA, 21 nt, Human
cuccaaacugacucuuaagaa

SEQ ID NO: 1231749 - RNA, 16 nt, Human
cuccccuuuuuuuccc

SEQ ID NO: 1231750 - RNA, 17 nt, Human
cuccugccucagccucc

SEQ ID NO: 1231751 - RNA, 18 nt, Human
cucgccggaucugaggga

SEQ ID NO: 1231752 - RNA, 17 nt, Human
cucgccggaucugaggg

SEQ ID NO: 1231753 - RNA, 22 nt, Human
cuagguaaauuacaguuccuag

SEQ ID NO: 1231754 - RNA, 21 nt, Human
cuagugagcagucaggaaaga

SEQ ID NO: 1231755 - RNA, 20 nt, Human
cuagugaaacucguuaauuu

SEQ ID NO: 1231756 - RNA, 16 nt, Human
cuaguaauuggaaagg

SEQ ID NO: 1231757 - RNA, 14 nt, Human
cuagucaccagaga

SEQ ID NO: 1231758 - RNA, 13 nt, Human
cuauaccaauaaa

SEQ ID NO: 1231759 - RNA, 14 nt, Human
cuauaccaauaaag

SEQ ID NO: 1231760 - RNA, 18 nt, Human
cuauauuguuugcuaagc

SEQ ID NO: 1231761 - RNA, 17 nt, Human
cuauauuuuacauaaau

SEQ ID NO: 1231762 - RNA, 15 nt, Human
cuauauuuucauucu

SEQ ID NO: 1231763 - RNA, 19 nt, Human
cuauauuuucauucuccua

SEQ ID NO: 1231764 - RNA, 13 nt, Human
cuauguaaacuac

SEQ ID NO: 1231765 - RNA, 13 nt, Human
cuauggccugugg

SEQ ID NO: 1231766 - RNA, 16 nt, Human
cucagauuucugagga

SEQ ID NO: 1231767 - RNA, 17 nt, Human
cucagauuucugaggaa

SEQ ID NO: 1231768 - RNA, 13 nt, Human
cucagauuuuauu

SEQ ID NO: 1231769 - RNA, 15 nt, Human
cucagauuuuauuau

SEQ ID NO: 1231770 - RNA, 17 nt, Human
cucagauuuuauuaugu

SEQ ID NO: 1231771 - RNA, 18 nt, Human
cucagauuuuauuaugua

SEQ ID NO: 1231772 - RNA, 22 nt, Human
cucagauuuuauuauguaaauc

SEQ ID NO: 1231773 - RNA, 12 nt, Human
cucaaccucauc

SEQ ID NO: 1231774 - RNA, 13 nt, Human
cucaaccucaucc

SEQ ID NO: 1231775 - RNA, 14 nt, Human
cuauuucuauauuu

SEQ ID NO: 1231776 - RNA, 16 nt, Human
cuauuucuauauuuuc

SEQ ID NO: 1231777 - RNA, 18 nt, Human
cuauuucuauauuuucau

SEQ ID NO: 1231778 - RNA, 19 nt, Human
cucuggauuauauuaugaa

SEQ ID NO: 1231779 - RNA, 20 nt, Human
cucuggauuauauuaugaag

SEQ ID NO: 1231780 - RNA, 15 nt, Human
cucuuccuucccugc

SEQ ID NO: 1231781 - RNA, 19 nt, Human
cucuuccuucccugcugug

SEQ ID NO: 1231782 - RNA, 13 nt, Human
cucuuccuuucuu

SEQ ID NO: 1231783 - RNA, 14 nt, Human
cucuucccucuucc

SEQ ID NO: 1231784 - RNA, 19 nt, Human
cucuuaagaagacugcauu

SEQ ID NO: 1231785 - RNA, 19 nt, Human
cucugaaggguaauuauau

SEQ ID NO: 1231786 - RNA, 21 nt, Human
cucugcaggucccuaauaaag

SEQ ID NO: 1231787 - RNA, 22 nt, Human
cucugcaggucccuaauaaagc

SEQ ID NO: 1231788 - RNA, 19 nt, Human
cucugcaggucccuaauaa

SEQ ID NO: 1231789 - RNA, 20 nt, Human
cucugcaggucccuaauaaa

SEQ ID NO: 1231790 - RNA, 15 nt, Human
cucugauacagaaaa

SEQ ID NO: 1231791 - RNA, 10 nt, Human
cucuucugaa

SEQ ID NO: 1231792 - RNA, 16 nt, Human
cucuucugaauaaagc

SEQ ID NO: 1231793 - RNA, 19 nt, Human
cucuucugaauaaagcaau

SEQ ID NO: 1231794 - RNA, 20 nt, Human
cucuucugaauaaagcaauu

SEQ ID NO: 1231795 - RNA, 23 nt, Human
cucuuugucuacaccauuaugug

SEQ ID NO: 1231796 - RNA, 20 nt, Human
cugaaauaaacgucuuaaau

SEQ ID NO: 1231797 - RNA, 12 nt, Human
cugaacuuugcu

SEQ ID NO: 1231798 - RNA, 13 nt, Human
cugaacuuugcug

SEQ ID NO: 1231799 - RNA, 14 nt, Human
cugaacuuugcuga

SEQ ID NO: 1231800 - RNA, 21 nt, Human
cugaacuuugcugagccugua

SEQ ID NO: 1231801 - RNA, 14 nt, Human
cugaagaagauggu

SEQ ID NO: 1231802 - RNA, 13 nt, Human
cugaauaaagcaa

SEQ ID NO: 1231803 - RNA, 14 nt, Human
cugaauaaagcaau

SEQ ID NO: 1231804 - RNA, 15 nt, Human
cugaauaaagcaauu

SEQ ID NO: 1231805 - RNA, 12 nt, Human
cugaauuauuuu

SEQ ID NO: 1231806 - RNA, 15 nt, Human
cugaauuaugaaacu

SEQ ID NO: 1231807 - RNA, 14 nt, Human
cugaauuaugaaac

SEQ ID NO: 1231808 - RNA, 13 nt, Human
cugaauuaugaaa

SEQ ID NO: 1231809 - RNA, 16 nt, Human
cugaauuaugaaacuu

SEQ ID NO: 1231810 - RNA, 13 nt, Human
cugcauccagccu

SEQ ID NO: 1231811 - RNA, 23 nt, Human
cugcaugcgagugcucauuucag

SEQ ID NO: 1231812 - RNA, 14 nt, Human
cugccaccuccugc

SEQ ID NO: 1231813 - RNA, 16 nt, Human
cugccaccuccugccu

SEQ ID NO: 1231814 - RNA, 19 nt, Human
cugccaccuccugccucag

SEQ ID NO: 1231815 - RNA, 17 nt, Human
cugccaccugucugucu

SEQ ID NO: 1231816 - RNA, 11 nt, Human
cugccaccugu

SEQ ID NO: 1231817 - RNA, 12 nt, Human
cugccaccuguc

SEQ ID NO: 1231818 - RNA, 13 nt, Human
cugccaccugucu

SEQ ID NO: 1231819 - RNA, 14 nt, Human
cugccaccugucug

SEQ ID NO: 1231820 - RNA, 15 nt, Human
cugccaccugucugu

SEQ ID NO: 1231821 - RNA, 16 nt, Human
cugccaccugucuguc

SEQ ID NO: 1231822 - RNA, 18 nt, Human
cugccaccugucugucug

SEQ ID NO: 1231823 - RNA, 13 nt, Human
cugccuauuuuaa

SEQ ID NO: 1231824 - RNA, 15 nt, Human
cugccucucugcagg

SEQ ID NO: 1231825 - RNA, 16 nt, Human
cugccucucugcaggu

SEQ ID NO: 1231826 - RNA, 17 nt, Human
cugccucucugcagguc

SEQ ID NO: 1231827 - RNA, 18 nt, Human
cugccucucugcaggucc

SEQ ID NO: 1231828 - RNA, 23 nt, Human
cugcggaggaaggaggacccagg

SEQ ID NO: 1231829 - RNA, 19 nt, Human
cugccucucugcagguccc

SEQ ID NO: 1231830 - RNA, 22 nt, Human
cugccuggacuuggccccugcc

SEQ ID NO: 1231831 - RNA, 23 nt, Human
cugccuggacuuggccccugcca

SEQ ID NO: 1231832 - RNA, 12 nt, Human
cugaggcugagg

SEQ ID NO: 1231833 - RNA, 14 nt, Human
cugaggcugaggca

SEQ ID NO: 1231834 - RNA, 22 nt, Human
cugauacagaaaaguugaauuu

SEQ ID NO: 1231835 - RNA, 13 nt, Human
cugaguuugugcu

SEQ ID NO: 1231836 - RNA, 18 nt, Human
cugaguuugugcuggugu

SEQ ID NO: 1231837 - RNA, 21 nt, Human
cugauuugacauagucuggcu

SEQ ID NO: 1231838 - RNA, 22 nt, Human
cugauuugacauagucuggcug

SEQ ID NO: 1231839 - RNA, 23 nt, Human
cugauuugacauagucuggcugu

SEQ ID NO: 1231840 - RNA, 20 nt, Human
cugggccccugccucucugc

SEQ ID NO: 1231841 - RNA, 23 nt, Human
cugggccccugccucucugcagg

SEQ ID NO: 1231842 - RNA, 13 nt, Human
cugggucgcccug

SEQ ID NO: 1231843 - RNA, 14 nt, Human
cugggguuaucuga

SEQ ID NO: 1231844 - RNA, 15 nt, Human
cugggucgcccugga

SEQ ID NO: 1231845 - RNA, 16 nt, Human
cugggucgcccuggac

SEQ ID NO: 1231846 - RNA, 18 nt, Human
cugguaugaacuugagga

SEQ ID NO: 1231847 - RNA, 20 nt, Human
cugguaugaacuugaggaca

SEQ ID NO: 1231848 - RNA, 21 nt, Human
cugguaugaacuugaggacac

SEQ ID NO: 1231849 - RNA, 22 nt, Human
cugguaugaacuugaggacaca

SEQ ID NO: 1231850 - RNA, 16 nt, Human
cugggggccucuucug

SEQ ID NO: 1231851 - RNA, 23 nt, Human
cugguaugaacuugaggacacau

SEQ ID NO: 1231852 - RNA, 15 nt, Human
cugguguauguguga

SEQ ID NO: 1231853 - RNA, 14 nt, Human
cugucugucugucc

SEQ ID NO: 1231854 - RNA, 15 nt, Human
cugucugucuguccc

SEQ ID NO: 1231855 - RNA, 16 nt, Human
cugucugucuguccca

SEQ ID NO: 1231856 - RNA, 17 nt, Human
cugucugucugucccaa

SEQ ID NO: 1231857 - RNA, 14 nt, Human
cugucugucugucu

SEQ ID NO: 1231858 - RNA, 15 nt, Human
cugucugucugucug

SEQ ID NO: 1231859 - RNA, 21 nt, Human
cugucuuuuuucuaaaguaaa

SEQ ID NO: 1231860 - RNA, 21 nt, Human
cugucuugccuuuuucauuau

SEQ ID NO: 1231861 - RNA, 23 nt, Human
cugucuugccuuuuucauuauuu

SEQ ID NO: 1231862 - RNA, 12 nt, Human
cuguggugacuu

SEQ ID NO: 1231863 - RNA, 13 nt, Human
cuguggugacuuu

SEQ ID NO: 1231864 - RNA, 14 nt, Human
cuguggugacuuug

SEQ ID NO: 1231865 - RNA, 15 nt, Human
cuguggugacuuugg

SEQ ID NO: 1231866 - RNA, 17 nt, Human
cuguggugacuuuggau

SEQ ID NO: 1231867 - RNA, 18 nt, Human
cuguggugacuuuggaua

SEQ ID NO: 1231868 - RNA, 20 nt, Human
cuguggugacuuuggauaau

SEQ ID NO: 1231869 - RNA, 23 nt, Human
cuguggugacuuuggauaauaag

SEQ ID NO: 1231870 - RNA, 14 nt, Human
cuguggaucaaauc

SEQ ID NO: 1231871 - RNA, 24 nt, Human
cuguggaucaaauccagccugcug

SEQ ID NO: 1231872 - RNA, 18 nt, Human
cuguggaacauaaaaagg

SEQ ID NO: 1231873 - RNA, 21 nt, Human
cuguggaacauaaaaaggaca

SEQ ID NO: 1231874 - RNA, 18 nt, Human
cugugugacucaaaccaa

SEQ ID NO: 1231875 - RNA, 14 nt, Human
cugugugcucagga

SEQ ID NO: 1231876 - RNA, 16 nt, Human
cugugugcucaggagc

SEQ ID NO: 1231877 - RNA, 15 nt, Human
cuguuuuauaauuuu

SEQ ID NO: 1231878 - RNA, 14 nt, Human
cuguuuuauaauuu

SEQ ID NO: 1231879 - RNA, 21 nt, Human
cuguugccaggcuggagugca

SEQ ID NO: 1231880 - RNA, 16 nt, Human
cuuagaauacaguuuu

SEQ ID NO: 1231881 - RNA, 13 nt, Human
cuuaauucaaaua

SEQ ID NO: 1231882 - RNA, 20 nt, Human
cuuaauaaauuguguuuccu

SEQ ID NO: 1231883 - RNA, 23 nt, Human
cuuaagaagacugcauuauauuu

SEQ ID NO: 1231884 - RNA, 17 nt, Human
cuuaaccagaucauugu

SEQ ID NO: 1231885 - RNA, 19 nt, Human
cuuccagauccuggaaauc

SEQ ID NO: 1231886 - RNA, 16 nt, Human
cuucccuaucuuugcc

SEQ ID NO: 1231887 - RNA, 17 nt, Human
cuucccuaucuuugcca

SEQ ID NO: 1231888 - RNA, 18 nt, Human
cuucccuaucuuugccac

SEQ ID NO: 1231889 - RNA, 22 nt, Human
cuucccuaucuuugccacccuc

SEQ ID NO: 1231890 - RNA, 23 nt, Human
cuucccuaucuuugccacccuca

SEQ ID NO: 1231891 - RNA, 19 nt, Human
cuucccugcugugaaagaa

SEQ ID NO: 1231892 - RNA, 23 nt, Human
cuucccuggaaaccuuccaccca

SEQ ID NO: 1231893 - RNA, 22 nt, Human
cuucccuggaaaccuuccaccc

SEQ ID NO: 1231894 - RNA, 15 nt, Human
cuuccuucccugcug

SEQ ID NO: 1231895 - RNA, 17 nt, Human
cuucaaauccuugaaga

SEQ ID NO: 1231896 - RNA, 17 nt, Human
cuucagcaaaaauauuu

SEQ ID NO: 1231897 - RNA, 20 nt, Human
cuucagcaaaaauauuuuau

SEQ ID NO: 1231898 - RNA, 23 nt, Human
cuucagcaaaaauauuuuaugau

SEQ ID NO: 1231899 - RNA, 14 nt, Human
cuucagcacuuuag

SEQ ID NO: 1231900 - RNA, 15 nt, Human
cuucagcacuuuaga

SEQ ID NO: 1231901 - RNA, 16 nt, Human
cuucagcacuuuagaa

SEQ ID NO: 1231902 - RNA, 16 nt, Human
cuucagcgguuuauau

SEQ ID NO: 1231903 - RNA, 13 nt, Human
cuucagucucuau

SEQ ID NO: 1231904 - RNA, 17 nt, Human
cuucagucucuauacca

SEQ ID NO: 1231905 - RNA, 21 nt, Human
cuucagucucuauaccaauaa

SEQ ID NO: 1231906 - RNA, 23 nt, Human
cuucagucucuauaccaauaaag

SEQ ID NO: 1231907 - RNA, 22 nt, Human
cuucagucucuauaccaauaaa

SEQ ID NO: 1231908 - RNA, 18 nt, Human
cuuugcugagccuguaaa

SEQ ID NO: 1231909 - RNA, 20 nt, Human
cuuuuacguccaucucuugu

SEQ ID NO: 1231910 - RNA, 14 nt, Human
cuuuucugauagag

SEQ ID NO: 1231911 - RNA, 11 nt, Human
cuuuucugaua

SEQ ID NO: 1231912 - RNA, 16 nt, Human
gaaacacuuugcauaa

SEQ ID NO: 1231913 - RNA, 20 nt, Human
gaaaaucuuauaauuuaaaa

SEQ ID NO: 1231914 - RNA, 18 nt, Human
gaaacacccucacacugg

SEQ ID NO: 1231915 - RNA, 19 nt, Human
gaaacacccucacacuggg

SEQ ID NO: 1231916 - RNA, 22 nt, Human
gaaacacccucacacugggacu

SEQ ID NO: 1231917 - RNA, 19 nt, Human
gaaaaucuuauaauuuaaa

SEQ ID NO: 1231918 - RNA, 12 nt, Human
gaaaauaucacu

SEQ ID NO: 1231919 - RNA, 19 nt, Human
gaaaauaacgauaaaagac

SEQ ID NO: 1231920 - RNA, 22 nt, Human
gaaaacaauaacgauaaaagac

SEQ ID NO: 1231921 - RNA, 22 nt, Human
cuuuuuucucugauacagaaaa

SEQ ID NO: 1231922 - RNA, 20 nt, Human
cuuuuuucucugauacagaa

SEQ ID NO: 1231923 - RNA, 14 nt, Human
cuuuuuucuaaagu

SEQ ID NO: 1231924 - RNA, 19 nt, Human
cuuguaaaggaauuuaaaa

SEQ ID NO: 1231925 - RNA, 17 nt, Human
cuuuaaaaaaaaaauug

SEQ ID NO: 1231926 - RNA, 16 nt, Human
cuuuagaauaugccuu

SEQ ID NO: 1231927 - RNA, 21 nt, Human
cuuuauuuucuauaauuuaaa

SEQ ID NO: 1231928 - RNA, 13 nt, Human
cuuuccacagaag

SEQ ID NO: 1231929 - RNA, 21 nt, Human
gaagccuuggggcugaugcag

SEQ ID NO: 1231930 - RNA, 18 nt, Human
gaagcuuuuaugugaaac

SEQ ID NO: 1231931 - RNA, 19 nt, Human
gaagccuccuuagaaaaaa

SEQ ID NO: 1231932 - RNA, 17 nt, Human
gaagacugcauuauauu

SEQ ID NO: 1231933 - RNA, 22 nt, Human
gaagccacgguguucugugaua

SEQ ID NO: 1231934 - RNA, 14 nt, Human
gaaggcagggagga

SEQ ID NO: 1231935 - RNA, 16 nt, Human
gaaggcagggaggagg

SEQ ID NO: 1231936 - RNA, 17 nt, Human
gaaggcagggaggaggc

SEQ ID NO: 1231937 - RNA, 18 nt, Human
gaaggcagggaggaggca

SEQ ID NO: 1231938 - RNA, 20 nt, Human
gaaggcagggaggaggcaga

SEQ ID NO: 1231939 - RNA, 12 nt, Human
gaauaaaauuuu

SEQ ID NO: 1231940 - RNA, 11 nt, Human
gaauaaagcaa

SEQ ID NO: 1231941 - RNA, 13 nt, Human
gaauaaagcaauu

SEQ ID NO: 1231942 - RNA, 14 nt, Human
gaauacuuuauaaa

SEQ ID NO: 1231943 - RNA, 11 nt, Human
gaaacauuugg

SEQ ID NO: 1231944 - RNA, 18 nt, Human
gaaauugcuuuguauugu

SEQ ID NO: 1231945 - RNA, 17 nt, Human
gaaauuguaauuauauc

SEQ ID NO: 1231946 - RNA, 16 nt, Human
gaaauauuauguuaaa

SEQ ID NO: 1231947 - RNA, 13 nt, Human
gaaauauuauguu

SEQ ID NO: 1231948 - RNA, 21 nt, Human
gaacuuguaaaggaauuuaaa

SEQ ID NO: 1231949 - RNA, 21 nt, Human
gaagaagcaccaaucaugaau

SEQ ID NO: 1231950 - RNA, 16 nt, Human
gaagaaagaacggaag

SEQ ID NO: 1231951 - RNA, 19 nt, Human
gaagaaagaacggaagaag

SEQ ID NO: 1231952 - RNA, 20 nt, Human
gaagaaagaacggaagaaga

SEQ ID NO: 1231953 - RNA, 22 nt, Human
gaacuuguaaaggaauuuaaaa

SEQ ID NO: 1231954 - RNA, 22 nt, Human
gaacuuccagauccuggaaauc

SEQ ID NO: 1231955 - RNA, 13 nt, Human
gaacuugaggaca

SEQ ID NO: 1231956 - RNA, 14 nt, Human
gaacuugaggacac

SEQ ID NO: 1231957 - RNA, 15 nt, Human
gaacuugaggacaca

SEQ ID NO: 1231958 - RNA, 16 nt, Human
gaacuugaggacacau

SEQ ID NO: 1231959 - RNA, 17 nt, Human
gaacuugaggacacaug

SEQ ID NO: 1231960 - RNA, 18 nt, Human
gaacuugaggacacaugu

SEQ ID NO: 1231961 - RNA, 19 nt, Human
gaacuugaggacacauguc

SEQ ID NO: 1231962 - RNA, 21 nt, Human
gaacuugaggacacaugucca

SEQ ID NO: 1231963 - RNA, 22 nt, Human
gaacuagaguuuagcuggaaaa

SEQ ID NO: 1231964 - RNA, 16 nt, Human
gaacgcguugaaauug

SEQ ID NO: 1231965 - RNA, 13 nt, Human
gagaucaggaaga

SEQ ID NO: 1231966 - RNA, 20 nt, Human
gagaucaggaagagaaggag

SEQ ID NO: 1231967 - RNA, 12 nt, Human
gagcuacaaaug

SEQ ID NO: 1231968 - RNA, 13 nt, Human
gagcuacaaaugc

SEQ ID NO: 1231969 - RNA, 17 nt, Human
gagccugcacggugaau

SEQ ID NO: 1231970 - RNA, 22 nt, Human
gagccugcacggugaauggcuu

SEQ ID NO: 1231971 - RNA, 23 nt, Human
gagccugcacggugaauggcuuu

SEQ ID NO: 1231972 - RNA, 19 nt, Human
gagcugauggagaaggaag

SEQ ID NO: 1231973 - RNA, 14 nt, Human
gagcuacaaaugca

SEQ ID NO: 1231974 - RNA, 18 nt, Human
gaggcuacuguaaggcaa

SEQ ID NO: 1231975 - RNA, 16 nt, Human
gagggagaacaagacc

SEQ ID NO: 1231976 - RNA, 22 nt, Human
gagcuugaaacccguggcgcuu

SEQ ID NO: 1231977 - RNA, 16 nt, Human
gaggaaggaggaccca

SEQ ID NO: 1231978 - RNA, 18 nt, Human
gaggaaggaggacccagg

SEQ ID NO: 1231979 - RNA, 21 nt, Human
gaggaaggaggacccaggaca

SEQ ID NO: 1231980 - RNA, 14 nt, Human
gaggaauucuguau

SEQ ID NO: 1231981 - RNA, 16 nt, Human
gaggaauucuguauag

SEQ ID NO: 1231982 - RNA, 17 nt, Human
gaggaauucuguauaga

SEQ ID NO: 1231983 - RNA, 11 nt, Human
gaggacacaug

SEQ ID NO: 1231984 - RNA, 12 nt, Human
gaggacacaugu

SEQ ID NO: 1231985 - RNA, 13 nt, Human
gaggacacauguc

SEQ ID NO: 1231986 - RNA, 14 nt, Human
gaggacacaugucc

SEQ ID NO: 1231987 - RNA, 16 nt, Human
gaggaggcagagaaga

SEQ ID NO: 1231988 - RNA, 20 nt, Human
gaggaggcagagaagaaaga

SEQ ID NO: 1231989 - RNA, 23 nt, Human
gauagauaggucagugcaaauac

SEQ ID NO: 1231990 - RNA, 21 nt, Human
gauauaaguguguguuuuuca

SEQ ID NO: 1231991 - RNA, 14 nt, Human
gauagaggaagccu

SEQ ID NO: 1231992 - RNA, 15 nt, Human
gauagaggaagccug

SEQ ID NO: 1231993 - RNA, 21 nt, Human
gauagaggaagccugauuaaa

SEQ ID NO: 1231994 - RNA, 22 nt, Human
gauagaggaagccugauuaaag

SEQ ID NO: 1231995 - RNA, 21 nt, Human
gaguugaaaaucuuauaauuu

SEQ ID NO: 1231996 - RNA, 15 nt, Human
gagucaaaaauuaaa

SEQ ID NO: 1231997 - RNA, 16 nt, Human
gagucucugaggggcu

SEQ ID NO: 1231998 - RNA, 21 nt, Human
gaugccuggcgggguggggug

SEQ ID NO: 1231999 - RNA, 14 nt, Human
gaugacuauggaaa

SEQ ID NO: 1232000 - RNA, 21 nt, Human
gauuaacagguaugaaccacc

SEQ ID NO: 1232001 - RNA, 13 nt, Human
gcagauuauucac

SEQ ID NO: 1232002 - RNA, 16 nt, Human
gcagauuauucacuga

SEQ ID NO: 1232003 - RNA, 15 nt, Human
gcacuggccccaccc

SEQ ID NO: 1232004 - RNA, 15 nt, Human
gcacuggcgaggaga

SEQ ID NO: 1232005 - RNA, 16 nt, Human
gcacuggcgaggagag

SEQ ID NO: 1232006 - RNA, 18 nt, Human
gcacagccucuuagaugc

SEQ ID NO: 1232007 - RNA, 15 nt, Human
gcacagccucuuaga

SEQ ID NO: 1232008 - RNA, 15 nt, Human
gcaucaucucagcuc

SEQ ID NO: 1232009 - RNA, 23 nt, Human
gcaggucccuaauaaagcugugu

SEQ ID NO: 1232010 - RNA, 20 nt, Human
gcaggucccuaauaaagcug

SEQ ID NO: 1232011 - RNA, 21 nt, Human
gcaggucccuaauaaagcugu

SEQ ID NO: 1232012 - RNA, 16 nt, Human
gcaggucccuaauaaa

SEQ ID NO: 1232013 - RNA, 17 nt, Human
gcaggucccuaauaaag

SEQ ID NO: 1232014 - RNA, 18 nt, Human
gcaggucccuaauaaagc

SEQ ID NO: 1232015 - RNA, 19 nt, Human
gcaggucccuaauaaagcu

SEQ ID NO: 1232016 - RNA, 14 nt, Human
gcaggucccuaaua

SEQ ID NO: 1232017 - RNA, 15 nt, Human
gcaggucccuaauaa

SEQ ID NO: 1232018 - RNA, 19 nt, Human
gccagauuuuccugaaaac

SEQ ID NO: 1232019 - RNA, 16 nt, Human
gccaggcuggagugca

SEQ ID NO: 1232020 - RNA, 13 nt, Human
gccaggcuggguc

SEQ ID NO: 1232021 - RNA, 18 nt, Human
gccaggcuggagugcagu

SEQ ID NO: 1232022 - RNA, 19 nt, Human
gccaggcuggagugcagug

SEQ ID NO: 1232023 - RNA, 14 nt, Human
gccagggagcgagu

SEQ ID NO: 1232024 - RNA, 19 nt, Human
gccaugggcacugugggua

SEQ ID NO: 1232025 - RNA, 18 nt, Human
gccacggggacucagccc

SEQ ID NO: 1232026 - RNA, 14 nt, Human
gccaccugucuguc

SEQ ID NO: 1232027 - RNA, 15 nt, Human
gccaccugucugucu

SEQ ID NO: 1232028 - RNA, 10 nt, Human
gccaccuguc

SEQ ID NO: 1232029 - RNA, 12 nt, Human
gccaccugucug

SEQ ID NO: 1232030 - RNA, 13 nt, Human
gccaccugucugu

SEQ ID NO: 1232031 - RNA, 21 nt, Human
gcgccucgccggaucugaggg

SEQ ID NO: 1232032 - RNA, 22 nt, Human
gcgcccuuaacugcauccagcc

SEQ ID NO: 1232033 - RNA, 13 nt, Human
gcuagauguaugu

SEQ ID NO: 1232034 - RNA, 16 nt, Human
gcuagauguauguacu

SEQ ID NO: 1232035 - RNA, 14 nt, Human
gcuagauguaugua

SEQ ID NO: 1232036 - RNA, 17 nt, Human
gcuauauaagacaagaa

SEQ ID NO: 1232037 - RNA, 12 nt, Human
gcuauccaccaa

SEQ ID NO: 1232038 - RNA, 17 nt, Human
gcuaucguaaaauuaag

SEQ ID NO: 1232039 - RNA, 15 nt, Human
gcuaucguaaaauua

SEQ ID NO: 1232040 - RNA, 16 nt, Human
gcuaucguaaaauuaa

SEQ ID NO: 1232041 - RNA, 18 nt, Human
gcucauggacuucugcca

SEQ ID NO: 1232042 - RNA, 14 nt, Human
gcucauuucaggau

SEQ ID NO: 1232043 - RNA, 21 nt, Human
gcuccuauucaacacacacau

SEQ ID NO: 1232044 - RNA, 21 nt, Human
gcuccuccaggguggcagcaa

SEQ ID NO: 1232045 - RNA, 22 nt, Human
gcuccuccaggguggcagcaac

SEQ ID NO: 1232046 - RNA, 21 nt, Human
gcuucucagauuucugaggaa

SEQ ID NO: 1232047 - RNA, 22 nt, Human
gcuucucagauuucugaggaaa

SEQ ID NO: 1232048 - RNA, 19 nt, Human
gcuucuguuuuauaauuuu

SEQ ID NO: 1232049 - RNA, 12 nt, Human
gcuuuguauaga

SEQ ID NO: 1232050 - RNA, 13 nt, Human
gcuuuguauagaa

SEQ ID NO: 1232051 - RNA, 14 nt, Human
gcuuuguauagaac

SEQ ID NO: 1232052 - RNA, 20 nt, Human
gcuuuguauagaaccucuuu

SEQ ID NO: 1232053 - RNA, 13 nt, Human
gcuuuuaugugaa

SEQ ID NO: 1232054 - RNA, 15 nt, Human
gcuuuuaugugaaac

SEQ ID NO: 1232055 - RNA, 22 nt, Human
gcuggugcccugcuuucagaua

SEQ ID NO: 1232056 - RNA, 21 nt, Human
gcugguguaugugugaaguga

SEQ ID NO: 1232057 - RNA, 16 nt, Human
gcuguguggcagucug

SEQ ID NO: 1232058 - RNA, 23 nt, Human
gcuggaaaaguauguuagugcaa

SEQ ID NO: 1232059 - RNA, 21 nt, Human
gcuggaaaaguauguuagugc

SEQ ID NO: 1232060 - RNA, 16 nt, Human
gcuggcauuacaggug

SEQ ID NO: 1232061 - RNA, 16 nt, Human
gcucuccaaaccacuu

SEQ ID NO: 1232062 - RNA, 17 nt, Human
gcucuccaaaccacuuu

SEQ ID NO: 1232063 - RNA, 22 nt, Human
gcucuccaaaccacuuuuugca

SEQ ID NO: 1232064 - RNA, 19 nt, Human
gcucuugaugccuggcggg

SEQ ID NO: 1232065 - RNA, 13 nt, Human
ggauucuuaaagu

SEQ ID NO: 1232066 - RNA, 12 nt, Human
ggcagagccagg

SEQ ID NO: 1232067 - RNA, 13 nt, Human
ggcagagccagga

SEQ ID NO: 1232068 - RNA, 14 nt, Human
ggcagagccaggaa

SEQ ID NO: 1232069 - RNA, 16 nt, Human
ggcagagccaggaaga

SEQ ID NO: 1232070 - RNA, 17 nt, Human
ggcagagccaggaagau

SEQ ID NO: 1232071 - RNA, 18 nt, Human
ggaugaugacuauggaaa

SEQ ID NO: 1232072 - RNA, 12 nt, Human
ggauuauauuau

SEQ ID NO: 1232073 - RNA, 22 nt, Human
ggauuccacucguguguuucua

SEQ ID NO: 1232074 - RNA, 19 nt, Human
gcuuuuaugugaaacaugu

SEQ ID NO: 1232075 - RNA, 20 nt, Human
gcuuuuaugugaaacauguu

SEQ ID NO: 1232076 - RNA, 21 nt, Human
gcuuuuaugugaaacauguuu

SEQ ID NO: 1232077 - RNA, 20 nt, Human
ggacauuugcucauggaauu

SEQ ID NO: 1232078 - RNA, 14 nt, Human
ggaccaaaaaccag

SEQ ID NO: 1232079 - RNA, 17 nt, Human
ggacauuugcucaugga

SEQ ID NO: 1232080 - RNA, 19 nt, Human
ggacugaauuaugaaacuu

SEQ ID NO: 1232081 - RNA, 17 nt, Human
ggacugaauuaugaaac

SEQ ID NO: 1232082 - RNA, 14 nt, Human
ggacugagaaauuu

SEQ ID NO: 1232083 - RNA, 12 nt, Human
ggagaaggaagg

SEQ ID NO: 1232084 - RNA, 14 nt, Human
ggagaagaacugaa

SEQ ID NO: 1232085 - RNA, 11 nt, Human
ggagaagaacu

SEQ ID NO: 1232086 - RNA, 18 nt, Human
ggacugagaaauuuauaa

SEQ ID NO: 1232087 - RNA, 16 nt, Human
ggagucaaaaauuaaa

SEQ ID NO: 1232088 - RNA, 12 nt, Human
ggaggggcagag

SEQ ID NO: 1232089 - RNA, 13 nt, Human
ggaggggcagagc

SEQ ID NO: 1232090 - RNA, 15 nt, Human
ggaggggcagagcca

SEQ ID NO: 1232091 - RNA, 16 nt, Human
ggaggggcagagccag

SEQ ID NO: 1232092 - RNA, 15 nt, Human
ggaggacccaggaca

SEQ ID NO: 1232093 - RNA, 16 nt, Human
ggaggacccaggacag

SEQ ID NO: 1232094 - RNA, 14 nt, Human
ggaggcagagaaga

SEQ ID NO: 1232095 - RNA, 15 nt, Human
ggaggcagagaagaa

SEQ ID NO: 1232096 - RNA, 17 nt, Human
ggaggcaggaguuucgu

SEQ ID NO: 1232097 - RNA, 19 nt, Human
ggaggcagagaagaaagaa

SEQ ID NO: 1232098 - RNA, 16 nt, Human
ggagcccugggaggcu

SEQ ID NO: 1232099 - RNA, 19 nt, Human
ggagcccugggaggcucug

SEQ ID NO: 1232100 - RNA, 20 nt, Human
ggagcccugggaggcucugg

SEQ ID NO: 1232101 - RNA, 14 nt, Human
ggagcuagaauuug

SEQ ID NO: 1232102 - RNA, 17 nt, Human
ggcucuggagcccacug

SEQ ID NO: 1232103 - RNA, 19 nt, Human
ggcucuggagcccacugua

SEQ ID NO: 1232104 - RNA, 19 nt, Human
ggccggcuugccacacccc

SEQ ID NO: 1232105 - RNA, 23 nt, Human
ggcucuggagcccacuguacuug

SEQ ID NO: 1232106 - RNA, 18 nt, Human
ggcuggagcuagaauuug

SEQ ID NO: 1232107 - RNA, 20 nt, Human
ggcuggagugcaguggcgcg

SEQ ID NO: 1232108 - RNA, 14 nt, Human
ggcuugccacaccc

SEQ ID NO: 1232109 - RNA, 15 nt, Human
ggcuugccacacccc

SEQ ID NO: 1232110 - RNA, 14 nt, Human
gggaauugaggaca

SEQ ID NO: 1232111 - RNA, 15 nt, Human
ggcuuuguauagaac

SEQ ID NO: 1232112 - RNA, 15 nt, Human
gggaggaggcagaga

SEQ ID NO: 1232113 - RNA, 17 nt, Human
ucaggcuagauguaugu

SEQ ID NO: 1232114 - RNA, 19 nt, Human
ucaggagcccugggaggcu

SEQ ID NO: 1232115 - RNA, 20 nt, Human
ucaggagcccugggaggcuc

SEQ ID NO: 1232116 - RNA, 23 nt, Human
ucaggagcccugggaggcucugg

SEQ ID NO: 1232117 - RNA, 20 nt, Human
ucagccucccgaguagcugg

SEQ ID NO: 1232118 - RNA, 16 nt, Human
ucagauaugauucaaa

SEQ ID NO: 1232119 - RNA, 15 nt, Human
ucagauaugauucaa

SEQ ID NO: 1232120 - RNA, 23 nt, Human
ucaccccuaaaagaaacccugca

SEQ ID NO: 1232121 - RNA, 20 nt, Human
ucacucuguucauuccucca

SEQ ID NO: 1232122 - RNA, 21 nt, Human
ucacucuguucauuccuccag

SEQ ID NO: 1232123 - RNA, 22 nt, Human
ucacucuguucauuccuccagg

SEQ ID NO: 1232124 - RNA, 20 nt, Human
ucacuuguuuuauuuaaccu

SEQ ID NO: 1232125 - RNA, 19 nt, Human
ucagaaacacccucacacu

SEQ ID NO: 1232126 - RNA, 21 nt, Human
ucagaaacacccucacacugg

SEQ ID NO: 1232127 - RNA, 22 nt, Human
ucagaaacacccucacacuggg

SEQ ID NO: 1232128 - RNA, 21 nt, Human
ucagaguaauccaagcaaaug

SEQ ID NO: 1232129 - RNA, 22 nt, Human
ucagaguaauccaagcaaaugu

SEQ ID NO: 1232130 - RNA, 19 nt, Human
uccacagaagcuccaggua

SEQ ID NO: 1232131 - RNA, 14 nt, Human
uccaggguggcagc

SEQ ID NO: 1232132 - RNA, 15 nt, Human
uccaggguggcagca

SEQ ID NO: 1232133 - RNA, 18 nt, Human
uccaggguggcagcaaca

SEQ ID NO: 1232134 - RNA, 20 nt, Human
uccaggguggcagcaacaau

SEQ ID NO: 1232135 - RNA, 14 nt, Human
ucauagcuaaaaaa

SEQ ID NO: 1232136 - RNA, 16 nt, Human
ucauuuccaagcaagu

SEQ ID NO: 1232137 - RNA, 13 nt, Human
ucauuuccaagca

SEQ ID NO: 1232138 - RNA, 12 nt, Human
ucauugugaaau

SEQ ID NO: 1232139 - RNA, 15 nt, Human
ucauugugaaauuau

SEQ ID NO: 1232140 - RNA, 17 nt, Human
ucauugugaaauuauuc

SEQ ID NO: 1232141 - RNA, 18 nt, Human
ucauugugaaauuauuca

SEQ ID NO: 1232142 - RNA, 16 nt, Human
ucauuccauucuggaa

SEQ ID NO: 1232143 - RNA, 19 nt, Human
ucauuccauucuggaagug

SEQ ID NO: 1232144 - RNA, 12 nt, Human
ucauuucaggau

SEQ ID NO: 1232145 - RNA, 23 nt, Human
ucauuauuuuauuaugaaacuug

SEQ ID NO: 1232146 - RNA, 14 nt, Human
ucauuccauucugg

SEQ ID NO: 1232147 - RNA, 15 nt, Human
ucauuccauucugga

SEQ ID NO: 1232148 - RNA, 21 nt, Human
ucaauaaaauccauacauuug

SEQ ID NO: 1232149 - RNA, 22 nt, Human
ucaaugccccugaauuuaaaua

SEQ ID NO: 1232150 - RNA, 20 nt, Human
ucaaugccccugaauuuaaa

SEQ ID NO: 1232151 - RNA, 18 nt, Human
ucaaugccccugaauuua

SEQ ID NO: 1232152 - RNA, 17 nt, Human
ucaaugccccugaauuu

SEQ ID NO: 1232153 - RNA, 15 nt, Human
uauuuucauucuccu

SEQ ID NO: 1232154 - RNA, 13 nt, Human
uauuuuauuauga

SEQ ID NO: 1232155 - RNA, 18 nt, Human
uauuuuauuaugaaacuu

SEQ ID NO: 1232156 - RNA, 23 nt, Human
uauuuuauuaugaaacuugugua

SEQ ID NO: 1232157 - RNA, 13 nt, Human
uauuuuuugaaaa

SEQ ID NO: 1232158 - RNA, 15 nt, Human
ucaaauugugugaaa

SEQ ID NO: 1232159 - RNA, 14 nt, Human
ucaaauugugugaa

SEQ ID NO: 1232160 - RNA, 17 nt, Human
ucaaauuguaagcaugc

SEQ ID NO: 1232161 - RNA, 20 nt, Human
ucaaauuguaagcaugcaca

SEQ ID NO: 1232162 - RNA, 15 nt, Human
ucaaauccuugaaga

SEQ ID NO: 1232163 - RNA, 12 nt, Human
ucaaaaauuaaa

SEQ ID NO: 1232164 - RNA, 20 nt, Human
ucaaaaauuaucuauagcua

SEQ ID NO: 1232165 - RNA, 23 nt, Human
ucaaaaauuaaaccggaccaucu

SEQ ID NO: 1232166 - RNA, 22 nt, Human
ucaaauauauucagccuggcuu

SEQ ID NO: 1232167 - RNA, 23 nt, Human
ucaaauauauucagccuggcuuc

SEQ ID NO: 1232168 - RNA, 20 nt, Human
ucaaaucaaucuguaaaacu

SEQ ID NO: 1232169 - RNA, 16 nt, Human
uauguugcauagaaua

SEQ ID NO: 1232170 - RNA, 12 nt, Human
uauguugcauag

SEQ ID NO: 1232171 - RNA, 12 nt, Human
uauguaaauccc

SEQ ID NO: 1232172 - RNA, 15 nt, Human
uauguaaaucccauu

SEQ ID NO: 1232173 - RNA, 19 nt, Human
uauguaaaucccauuauuc

SEQ ID NO: 1232174 - RNA, 20 nt, Human
uauguaaaucccauuauuca

SEQ ID NO: 1232175 - RNA, 21 nt, Human
uauguaaaucccauuauucaa

SEQ ID NO: 1232176 - RNA, 23 nt, Human
uauguaaaucccauuauucaaag

SEQ ID NO: 1232177 - RNA, 17 nt, Human
uauguacuucaugcugu

SEQ ID NO: 1232178 - RNA, 13 nt, Human
uauguacuucaug

SEQ ID NO: 1232179 - RNA, 14 nt, Human
uauuguuuuacaau

SEQ ID NO: 1232180 - RNA, 15 nt, Human
uauuguuuuacaaua

SEQ ID NO: 1232181 - RNA, 17 nt, Human
uauuguuuuacaauagu

SEQ ID NO: 1232182 - RNA, 20 nt, Human
uauuguuuuacaauaguucu

SEQ ID NO: 1232183 - RNA, 22 nt, Human
uauuguuuuacaauaguucugu

SEQ ID NO: 1232184 - RNA, 24 nt, Human
uauuuauaaaaauaaaaaacacug

SEQ ID NO: 1232185 - RNA, 22 nt, Human
uauuuaguuguaaaccaaguga

SEQ ID NO: 1232186 - RNA, 14 nt, Human
uauuacaaugauca

SEQ ID NO: 1232187 - RNA, 15 nt, Human
uauuacaaugaucac

SEQ ID NO: 1232188 - RNA, 12 nt, Human
uauuacaguaua

SEQ ID NO: 1232189 - RNA, 13 nt, Human
uauuacaguauaa

SEQ ID NO: 1232190 - RNA, 14 nt, Human
uauuacaguauaau

SEQ ID NO: 1232191 - RNA, 17 nt, Human
uauucguuaucuaauag

SEQ ID NO: 1232192 - RNA, 16 nt, Human
ucccucucucauaccc

SEQ ID NO: 1232193 - RNA, 20 nt, Human
ucccuggaaaccuuccaccc

SEQ ID NO: 1232194 - RNA, 22 nt, Human
ucccuggaaaccuuccacccag

SEQ ID NO: 1232195 - RNA, 23 nt, Human
ucccuggaaaccuuccacccagu

SEQ ID NO: 1232196 - RNA, 17 nt, Human
ucccuucaugcauggaa

SEQ ID NO: 1232197 - RNA, 18 nt, Human
ucccuucaugcauggaaa

SEQ ID NO: 1232198 - RNA, 16 nt, Human
ucccuugaugaagaag

SEQ ID NO: 1232199 - RNA, 15 nt, Human
ucccuugaugaagaa

SEQ ID NO: 1232200 - RNA, 15 nt, Human
ucccuaauaaagcug

SEQ ID NO: 1232201 - RNA, 19 nt, Human
ucccuaucuuugccacccu

SEQ ID NO: 1232202 - RNA, 16 nt, Human
ucccuaauaaagcugu

SEQ ID NO: 1232203 - RNA, 11 nt, Human
ucccuccuggg

SEQ ID NO: 1232204 - RNA, 19 nt, Human
ucccuccugggaaugaagc

SEQ ID NO: 1232205 - RNA, 14 nt, Human
uccugccucagccu

SEQ ID NO: 1232206 - RNA, 17 nt, Human
uccugccucagccuccc

SEQ ID NO: 1232207 - RNA, 17 nt, Human
uccuuggccaugcagaa

SEQ ID NO: 1232208 - RNA, 16 nt, Human
uccuuggccaugcaga

SEQ ID NO: 1232209 - RNA, 18 nt, Human
ucuaugaaauauuauguu

SEQ ID NO: 1232210 - RNA, 17 nt, Human
ucuaugaaauauuaugu

SEQ ID NO: 1232211 - RNA, 14 nt, Human
ucuaugaaauauua

SEQ ID NO: 1232212 - RNA, 16 nt, Human
ucuaugcugaguuugu

SEQ ID NO: 1232213 - RNA, 20 nt, Human
ucuaugcugaguuugugcug

SEQ ID NO: 1232214 - RNA, 19 nt, Human
ucuagugagcagucaggaa

SEQ ID NO: 1232215 - RNA, 22 nt, Human
ucuagugagcagucaggaaaga

SEQ ID NO: 1232216 - RNA, 16 nt, Human
ucuaggacugaauuau

SEQ ID NO: 1232217 - RNA, 23 nt, Human
ucuaggacugaauuaugaaacuu

SEQ ID NO: 1232218 - RNA, 22 nt, Human
ucgugggacagucaccucaugg

SEQ ID NO: 1232219 - RNA, 21 nt, Human
ucguggaacaguuaccucugc

SEQ ID NO: 1232220 - RNA, 16 nt, Human
ucuaauagggcaauua

SEQ ID NO: 1232221 - RNA, 22 nt, Human
ucuaauagggcaauuaauuccu

SEQ ID NO: 1232222 - RNA, 13 nt, Human
ucguuaauuugua

SEQ ID NO: 1232223 - RNA, 21 nt, Human
ucguguguuucuauuuuuuga

SEQ ID NO: 1232224 - RNA, 14 nt, Human
ucugaaaauugaug

SEQ ID NO: 1232225 - RNA, 22 nt, Human
ucugaaaauugaugggauuugg

SEQ ID NO: 1232226 - RNA, 15 nt, Human
ucugacauaaguauu

SEQ ID NO: 1232227 - RNA, 13 nt, Human
ucugacauaaucc

SEQ ID NO: 1232228 - RNA, 19 nt, Human
ucugacauaauccaguaaa

SEQ ID NO: 1232229 - RNA, 23 nt, Human
ucugacauaauccaguaaaauaa

SEQ ID NO: 1232230 - RNA, 20 nt, Human
ucugaaauuuccugggagcu

SEQ ID NO: 1232231 - RNA, 18 nt, Human
ucugaaauuuccugggag

SEQ ID NO: 1232232 - RNA, 17 nt, Human
ucugaaauuuccuggga

SEQ ID NO: 1232233 - RNA, 14 nt, Human
ucugaggaauucug

SEQ ID NO: 1232234 - RNA, 15 nt, Human
ucugaggaauucugu

SEQ ID NO: 1232235 - RNA, 16 nt, Human
ucugaggaauucugua

SEQ ID NO: 1232236 - RNA, 17 nt, Human
ucugaggaauucuguau

SEQ ID NO: 1232237 - RNA, 18 nt, Human
ucugaggaauucuguaua

SEQ ID NO: 1232238 - RNA, 19 nt, Human
ucugaggaauucuguauag

SEQ ID NO: 1232239 - RNA, 15 nt, Human
ucugcaacucugaag

SEQ ID NO: 1232240 - RNA, 14 nt, Human
ucugcaacucugaa

SEQ ID NO: 1232241 - RNA, 19 nt, Human
ucuccugccucagccuccc

SEQ ID NO: 1232242 - RNA, 21 nt, Human
ucuccuggaagugcuaauuuu

SEQ ID NO: 1232243 - RNA, 18 nt, Human
ucucaauauucaauaaag

SEQ ID NO: 1232244 - RNA, 17 nt, Human
ucucaauauucaauaaa

SEQ ID NO: 1232245 - RNA, 20 nt, Human
ucucaauauucaauaaagcu

SEQ ID NO: 1232246 - RNA, 15 nt, Human
ucucugauacagaaa

SEQ ID NO: 1232247 - RNA, 21 nt, Human
ucucugaggggcuaccaggaa

SEQ ID NO: 1232248 - RNA, 22 nt, Human
ucucugaggggcuaccaggaaa

SEQ ID NO: 1232249 - RNA, 13 nt, Human
ucucugcaggucc

SEQ ID NO: 1232250 - RNA, 14 nt, Human
ucucugcagguccc

SEQ ID NO: 1232251 - RNA, 15 nt, Human
ucucugcaggucccu

SEQ ID NO: 1232252 - RNA, 16 nt, Human
ucucugcaggucccua

SEQ ID NO: 1232253 - RNA, 18 nt, Human
ucucugcaggucccuaau

SEQ ID NO: 1232254 - RNA, 23 nt, Human
ucucugaggggcuaccaggaaag

SEQ ID NO: 1232255 - RNA, 22 nt, Human
ucuuaggguuaugauuaaguaa

SEQ ID NO: 1232256 - RNA, 21 nt, Human
ucuucagcaaaaauauuuuau

SEQ ID NO: 1232257 - RNA, 22 nt, Human
ucuucagcaaaaauauuuuaug

SEQ ID NO: 1232258 - RNA, 23 nt, Human
ucuucagcaaaaauauuuuauga

SEQ ID NO: 1232259 - RNA, 13 nt, Human
ucuugaaaaaugc

SEQ ID NO: 1232260 - RNA, 14 nt, Human
ucuuccuucccugc

SEQ ID NO: 1232261 - RNA, 15 nt, Human
ucuuccuucccugcu

SEQ ID NO: 1232262 - RNA, 17 nt, Human
ucuuccuucccugcugu

SEQ ID NO: 1232263 - RNA, 12 nt, Human
ucuuaaaguuga

SEQ ID NO: 1232264 - RNA, 13 nt, Human
ucuuaaaguugaa

SEQ ID NO: 1232265 - RNA, 14 nt, Human
ucuuaaaguugaau

SEQ ID NO: 1232266 - RNA, 14 nt, Human
ucugucugucccaa

SEQ ID NO: 1232267 - RNA, 15 nt, Human
ucugucugucccaaa

SEQ ID NO: 1232268 - RNA, 16 nt, Human
ucugucugucccaaag

SEQ ID NO: 1232269 - RNA, 15 nt, Human
ucugucugucugucc

SEQ ID NO: 1232270 - RNA, 18 nt, Human
ucugucugucugucccaa

SEQ ID NO: 1232271 - RNA, 16 nt, Human
ucuuaaccagaucauu

SEQ ID NO: 1232272 - RNA, 17 nt, Human
ucuuaaccagaucauug

SEQ ID NO: 1232273 - RNA, 16 nt, Human
ucuuaaaguugaauuu

SEQ ID NO: 1232274 - RNA, 19 nt, Human
ucuuaaaguugaauuuauu

SEQ ID NO: 1232275 - RNA, 20 nt, Human
ucuuaaaguugaauuuauug

SEQ ID NO: 1232276 - RNA, 21 nt, Human
ucuuaaaguugaauuuauugg

SEQ ID NO: 1232277 - RNA, 22 nt, Human
ucuuaaaguugaauuuauuggc

SEQ ID NO: 1232278 - RNA, 18 nt, Human
ucuuaagaagacugcauu

SEQ ID NO: 1232279 - RNA, 12 nt, Human
ucuuaagaagac

SEQ ID NO: 1232280 - RNA, 22 nt, Human
ucuuaaccagaucauugugaaa

SEQ ID NO: 1232281 - RNA, 22 nt, Human
ucugucucuggauuauauuaug

SEQ ID NO: 1232282 - RNA, 14 nt, Human
ugcacaguaaaaau

SEQ ID NO: 1232283 - RNA, 13 nt, Human
ugcaaccuccacc

SEQ ID NO: 1232284 - RNA, 15 nt, Human
ugcaaccuccaccuc

SEQ ID NO: 1232285 - RNA, 14 nt, Human
ugcaaccucugccu

SEQ ID NO: 1232286 - RNA, 22 nt, Human
ugcaacucugaaggguaauuau

SEQ ID NO: 1232287 - RNA, 18 nt, Human
ugcaacuuuguauaaaag

SEQ ID NO: 1232288 - RNA, 14 nt, Human
ugcaaaaaggguca

SEQ ID NO: 1232289 - RNA, 12 nt, Human
ugccuaaggacu

SEQ ID NO: 1232290 - RNA, 13 nt, Human
ugccuaaggacuu

SEQ ID NO: 1232291 - RNA, 14 nt, Human
ugccuaaggacuuc

SEQ ID NO: 1232292 - RNA, 15 nt, Human
ugccuaaggacuucu

SEQ ID NO: 1232293 - RNA, 16 nt, Human
ugccuaaggacuucuu

SEQ ID NO: 1232294 - RNA, 20 nt, Human
ugccuaaggacuucuuuaau

SEQ ID NO: 1232295 - RNA, 21 nt, Human
ugccuaaggacuucuuuaauu

SEQ ID NO: 1232296 - RNA, 16 nt, Human
ugccucccuucaugca

SEQ ID NO: 1232297 - RNA, 14 nt, Human
ugccucuucccucu

SEQ ID NO: 1232298 - RNA, 16 nt, Human
ugcccugcuuucagau

SEQ ID NO: 1232299 - RNA, 17 nt, Human
ugcccugcuuucagaua

SEQ ID NO: 1232300 - RNA, 12 nt, Human
ugcccugcuuuc

SEQ ID NO: 1232301 - RNA, 14 nt, Human
ugcccugcccugcc

SEQ ID NO: 1232302 - RNA, 15 nt, Human
ugcccugcccugcca

SEQ ID NO: 1232303 - RNA, 18 nt, Human
ugcccugcccugccaccu

SEQ ID NO: 1232304 - RNA, 14 nt, Human
ugcauuauauuuau

SEQ ID NO: 1232305 - RNA, 18 nt, Human
ugaccucgugauccaccc

SEQ ID NO: 1232306 - RNA, 22 nt, Human
ugacccuccaccgcagaaggaa

SEQ ID NO: 1232307 - RNA, 23 nt, Human
ugacccuccaccgcagaaggaag

SEQ ID NO: 1232308 - RNA, 20 nt, Human
ugaccucaagugaucugccc

SEQ ID NO: 1232309 - RNA, 16 nt, Human
ucuugaauaauguaag

SEQ ID NO: 1232310 - RNA, 12 nt, Human
ugacucuuaaga

SEQ ID NO: 1232311 - RNA, 13 nt, Human
ugacucuuaagaa

SEQ ID NO: 1232312 - RNA, 13 nt, Human
ugacugauucuuc

SEQ ID NO: 1232313 - RNA, 14 nt, Human
ugacugauucuuca

SEQ ID NO: 1232314 - RNA, 15 nt, Human
ugacugauucuucag

SEQ ID NO: 1232315 - RNA, 16 nt, Human
ugacugauucuucagc

SEQ ID NO: 1232316 - RNA, 17 nt, Human
ugacugauucuucagca

SEQ ID NO: 1232317 - RNA, 17 nt, Human
ugagaaaucuaaaaaac

SEQ ID NO: 1232318 - RNA, 19 nt, Human
ugagaggcugggaauggag

SEQ ID NO: 1232319 - RNA, 20 nt, Human
ugagcagucaggaaagagaa

SEQ ID NO: 1232320 - RNA, 17 nt, Human
ugagcagucaggaaaga

SEQ ID NO: 1232321 - RNA, 19 nt, Human
ugaucucagcucacugcaa

SEQ ID NO: 1232322 - RNA, 18 nt, Human
ugaucucagcucacugca

SEQ ID NO: 1232323 - RNA, 17 nt, Human
ugauauaaguguguguu

SEQ ID NO: 1232324 - RNA, 23 nt, Human
ugauauaaguguguguuuuucau

SEQ ID NO: 1232325 - RNA, 13 nt, Human
ugauguacaugua

SEQ ID NO: 1232326 - RNA, 15 nt, Human
uggaccaaaaaccag

SEQ ID NO: 1232327 - RNA, 17 nt, Human
uggaccaaaaaccagua

SEQ ID NO: 1232328 - RNA, 23 nt, Human
uggaggggcagagccaggaagau

SEQ ID NO: 1232329 - RNA, 13 nt, Human
uggaggggcagag

SEQ ID NO: 1232330 - RNA, 14 nt, Human
uggaggggcagagc

SEQ ID NO: 1232331 - RNA, 16 nt, Human
uggaggggcagagcca

SEQ ID NO: 1232332 - RNA, 18 nt, Human
uggaggggcagagccagg

SEQ ID NO: 1232333 - RNA, 21 nt, Human
uggaggggcagagccaggaag

SEQ ID NO: 1232334 - RNA, 14 nt, Human
uggagaugaggcca

SEQ ID NO: 1232335 - RNA, 15 nt, Human
uggagaugaggccag

SEQ ID NO: 1232336 - RNA, 16 nt, Human
uggagaugaggccaga

SEQ ID NO: 1232337 - RNA, 17 nt, Human
uggagaugaggccagac

SEQ ID NO: 1232338 - RNA, 18 nt, Human
uggagaugaggccagacc

SEQ ID NO: 1232339 - RNA, 19 nt, Human
uggaucaaauccagccugc

SEQ ID NO: 1232340 - RNA, 15 nt, Human
ugcuuaauaaauugu

SEQ ID NO: 1232341 - RNA, 16 nt, Human
ugcuuaauucaaauaa

SEQ ID NO: 1232342 - RNA, 17 nt, Human
ugcuuaauucaaauaau

SEQ ID NO: 1232343 - RNA, 18 nt, Human
ugcuuaauucaaauaaua

SEQ ID NO: 1232344 - RNA, 20 nt, Human
ugcuuaauucaaauaauaau

SEQ ID NO: 1232345 - RNA, 16 nt, Human
ugcuucccuuuccuga

SEQ ID NO: 1232346 - RNA, 21 nt, Human
ugcuucucagauuucugagga

SEQ ID NO: 1232347 - RNA, 22 nt, Human
ugcuucucagauuucugaggaa

SEQ ID NO: 1232348 - RNA, 13 nt, Human
ugcuucuccagcc

SEQ ID NO: 1232349 - RNA, 19 nt, Human
uggaaaccuuccacccagu

SEQ ID NO: 1232350 - RNA, 16 nt, Human
uggaaaccuuccaccc

SEQ ID NO: 1232351 - RNA, 22 nt, Human
uggaaaaguauguuagugcaaa

SEQ ID NO: 1232352 - RNA, 18 nt, Human
uggaacauaaaaaggaca

SEQ ID NO: 1232353 - RNA, 20 nt, Human
uggaacauaaaaaggacauc

SEQ ID NO: 1232354 - RNA, 14 nt, Human
uggaacgcguugaa

SEQ ID NO: 1232355 - RNA, 15 nt, Human
uggaacgcguugaaa

SEQ ID NO: 1232356 - RNA, 16 nt, Human
uggaacgcguugaaau

SEQ ID NO: 1232357 - RNA, 17 nt, Human
uggaacgcguugaaauu

SEQ ID NO: 1232358 - RNA, 22 nt, Human
ugcuucuguuuuauaauuuugu

SEQ ID NO: 1232359 - RNA, 17 nt, Human
ugcuuuggaaaacccag

SEQ ID NO: 1232360 - RNA, 14 nt, Human
ugggaaugaagcaa

SEQ ID NO: 1232361 - RNA, 13 nt, Human
uggcuuuucugau

SEQ ID NO: 1232362 - RNA, 17 nt, Human
uggggccaggcuggguc

SEQ ID NO: 1232363 - RNA, 20 nt, Human
uggggccaggcugggucgcc

SEQ ID NO: 1232364 - RNA, 13 nt, Human
uggggggggugcu

SEQ ID NO: 1232365 - RNA, 23 nt, Human
ugggguuaucugaagucagaucu

SEQ ID NO: 1232366 - RNA, 17 nt, Human
ugggcagcaauuuaaau

SEQ ID NO: 1232367 - RNA, 18 nt, Human
ugggcagcaauuuaaaug

SEQ ID NO: 1232368 - RNA, 19 nt, Human
ugggcagcaauuuaaaugu

SEQ ID NO: 1232369 - RNA, 21 nt, Human
ugggcagcaauuuaaauguua

SEQ ID NO: 1232370 - RNA, 12 nt, Human
ugggauaaaugc

SEQ ID NO: 1232371 - RNA, 13 nt, Human
ugggauaaaugcc

SEQ ID NO: 1232372 - RNA, 14 nt, Human
ugggauaaaugcca

SEQ ID NO: 1232373 - RNA, 23 nt, Human
uguauagaaccucuuugucuaca

SEQ ID NO: 1232374 - RNA, 15 nt, Human
uguauagauuagaau

SEQ ID NO: 1232375 - RNA, 21 nt, Human
uguauagauuagaauucugua

SEQ ID NO: 1232376 - RNA, 23 nt, Human
uguauagauuagagaguguugaa

SEQ ID NO: 1232377 - RNA, 22 nt, Human
uguaguguuggagaagaacuga

SEQ ID NO: 1232378 - RNA, 13 nt, Human
uguauaaaauaau

SEQ ID NO: 1232379 - RNA, 14 nt, Human
uguauaaaauaauu

SEQ ID NO: 1232380 - RNA, 21 nt, Human
uguaguguuggagaagaacug

SEQ ID NO: 1232381 - RNA, 20 nt, Human
uguaguguuggagaagaacu

SEQ ID NO: 1232382 - RNA, 19 nt, Human
uguauuuuaaaagaaugau

SEQ ID NO: 1232383 - RNA, 18 nt, Human
uguauuuuaaaagaauga

SEQ ID NO: 1232384 - RNA, 16 nt, Human
ugucucagauuuuauu

SEQ ID NO: 1232385 - RNA, 20 nt, Human
ugucucagauuuuauuaugu

SEQ ID NO: 1232386 - RNA, 22 nt, Human
ugucucagauuuuauuauguaa

SEQ ID NO: 1232387 - RNA, 20 nt, Human
ugucuauggauuugccuucu

SEQ ID NO: 1232388 - RNA, 20 nt, Human
ugucugagacagaaucucag

SEQ ID NO: 1232389 - RNA, 14 nt, Human
ugucugucuguccc

SEQ ID NO: 1232390 - RNA, 15 nt, Human
ugucugucuguccca

SEQ ID NO: 1232391 - RNA, 15 nt, Human
ugucugucugucugu

SEQ ID NO: 1232392 - RNA, 16 nt, Human
ugucugucugucuguc

SEQ ID NO: 1232393 - RNA, 22 nt, Human
ugucuacacuaagagagaauga

SEQ ID NO: 1232394 - RNA, 18 nt, Human
ugucuacaccauuaugug

SEQ ID NO: 1232395 - RNA, 17 nt, Human
ugucuacacuaagagag

SEQ ID NO: 1232396 - RNA, 17 nt, Human
ugucuacaccauuaugu

SEQ ID NO: 1232397 - RNA, 16 nt, Human
uggguagacacacaug

SEQ ID NO: 1232398 - RNA, 14 nt, Human
uggguagacacaca

SEQ ID NO: 1232399 - RNA, 16 nt, Human
uggugacuuuggauaa

SEQ ID NO: 1232400 - RNA, 18 nt, Human
uggugacuuuggauaaua

SEQ ID NO: 1232401 - RNA, 19 nt, Human
uggugacuuuggauaauaa

SEQ ID NO: 1232402 - RNA, 23 nt, Human
uggugacuuuggauaauaaggaa

SEQ ID NO: 1232403 - RNA, 14 nt, Human
uggugguagagaag

SEQ ID NO: 1232404 - RNA, 20 nt, Human
ugguucccuugaugaagaag

SEQ ID NO: 1232405 - RNA, 17 nt, Human
ugguucccuugaugaag

SEQ ID NO: 1232406 - RNA, 16 nt, Human
ugguucccuugaugaa

SEQ ID NO: 1232407 - RNA, 20 nt, Human
ugguuguacauauaagugau

SEQ ID NO: 1232408 - RNA, 21 nt, Human
uguacaaaguauuaagcauau

SEQ ID NO: 1232409 - RNA, 12 nt, Human
uguaaugaaaac

SEQ ID NO: 1232410 - RNA, 13 nt, Human
uguaaugaaaacc

SEQ ID NO: 1232411 - RNA, 17 nt, Human
uguaaugaaaaccacau

SEQ ID NO: 1232412 - RNA, 15 nt, Human
uguacaaaguauuaa

SEQ ID NO: 1232413 - RNA, 17 nt, Human
uguacaaaguauuaagc

SEQ ID NO: 1232414 - RNA, 18 nt, Human
uguacaaaguauuaagca

SEQ ID NO: 1232415 - RNA, 19 nt, Human
uguacaaaguauuaagcau

SEQ ID NO: 1232416 - RNA, 20 nt, Human
uguacaaaguauuaagcaua

SEQ ID NO: 1232417 - RNA, 13 nt, Human
uuggguguauugu

SEQ ID NO: 1232418 - RNA, 15 nt, Human
uuggguguauugugc

SEQ ID NO: 1232419 - RNA, 16 nt, Human
uuggguguauugugcg

SEQ ID NO: 1232420 - RNA, 22 nt, Human
uugucucagauuuuauuaugua

SEQ ID NO: 1232421 - RNA, 15 nt, Human
uugucuagugaaacu

SEQ ID NO: 1232422 - RNA, 20 nt, Human
uugucuacaccauuaugugc

SEQ ID NO: 1232423 - RNA, 13 nt, Human
uugucucagauuu

SEQ ID NO: 1232424 - RNA, 16 nt, Human
uugucucagauuuuau

SEQ ID NO: 1232425 - RNA, 20 nt, Human
uugucucagauuuuauuaug

SEQ ID NO: 1232426 - RNA, 13 nt, Human
uugugaaauuauu

SEQ ID NO: 1232427 - RNA, 14 nt, Human
uuguauuacaaauc

SEQ ID NO: 1232428 - RNA, 19 nt, Human
uugucuacaccauuaugug

SEQ ID NO: 1232429 - RNA, 14 nt, Human
uuguacucaauuuu

SEQ ID NO: 1232430 - RNA, 15 nt, Human
uuguacucaauuuua

SEQ ID NO: 1232431 - RNA, 17 nt, Human
uuguuguuuguuuaguc

SEQ ID NO: 1232432 - RNA, 17 nt, Human
uuguuagaucuaguuca

SEQ ID NO: 1232433 - RNA, 18 nt, Human
uuguguuuugcaagccag

SEQ ID NO: 1232434 - RNA, 18 nt, Human
uuguuaaucuucaauagu

SEQ ID NO: 1232435 - RNA, 22 nt, Human
uugugcgcuaaacuuuucugau

SEQ ID NO: 1232436 - RNA, 23 nt, Human
uugugcgcuaaacuuuucugaua

SEQ ID NO: 1232437 - RNA, 19 nt, Human
uugugcugggguuaucuga

SEQ ID NO: 1232438 - RNA, 20 nt, Human
uuguguugaagagguuuuaa

SEQ ID NO: 1232439 - RNA, 13 nt, Human
uuuaauaauguuu

SEQ ID NO: 1232440 - RNA, 14 nt, Human
uuuaauaaacacuc

SEQ ID NO: 1232441 - RNA, 20 nt, Human
uuuaagacgaaacauuuguu

SEQ ID NO: 1232442 - RNA, 19 nt, Human
uuuaacucuauaauguguu

SEQ ID NO: 1232443 - RNA, 21 nt, Human
uuguuuggaccaaaaaccagu

SEQ ID NO: 1232444 - RNA, 16 nt, Human
uuuaacaacagcuggu

SEQ ID NO: 1232445 - RNA, 21 nt, Human
uuuauaaaaauaaaaaacacu

SEQ ID NO: 1232446 - RNA, 23 nt, Human
uuuauaaaaauaaaaaacacugg

SEQ ID NO: 1232447 - RNA, 21 nt, Human
uuuaauagguuuggacaaaau

SEQ ID NO: 1232448 - RNA, 14 nt, Human
uuuaauaauguuuc

SEQ ID NO: 1232449 - RNA, 18 nt, Human
uuuaauaauuauaugcua

SEQ ID NO: 1232450 - RNA, 21 nt, Human
uuuaauaauuauaugcuauuu

SEQ ID NO: 1232451 - RNA, 13 nt, Human
uuuaccacuugug

SEQ ID NO: 1232452 - RNA, 14 nt, Human
uuuauuauguaaau

SEQ ID NO: 1232453 - RNA, 16 nt, Human
uuuauuauguaaaucc

SEQ ID NO: 1232454 - RNA, 17 nt, Human
uuuauuauguaaauccc

SEQ ID NO: 1232455 - RNA, 22 nt, Human
uuuauaauuuugugaagcaaaa

SEQ ID NO: 1232456 - RNA, 13 nt, Human
uuucagauacugg

SEQ ID NO: 1232457 - RNA, 21 nt, Human
uuucagauacuggauuguacu

SEQ ID NO: 1232458 - RNA, 23 nt, Human
uucaguuauuauauuuacaaaug

SEQ ID NO: 1232459 - RNA, 20 nt, Human
uucauaaauaaaguuuguug

SEQ ID NO: 1232460 - RNA, 19 nt, Human
uuccagauccuggaaauca

SEQ ID NO: 1232461 - RNA, 18 nt, Human
uuccagauccuggaaauc

SEQ ID NO: 1232462 - RNA, 20 nt, Human
uucaugcuguucaugaaaga

SEQ ID NO: 1232463 - RNA, 12 nt, Human
uucaucuggaac

SEQ ID NO: 1232464 - RNA, 23 nt, Human
uucaucuggaaccaucagaaaca

SEQ ID NO: 1232465 - RNA, 17 nt, Human
uucaucuggaaccauca

SEQ ID NO: 1232466 - RNA, 15 nt, Human
uucaugcauggaaau

SEQ ID NO: 1232467 - RNA, 16 nt, Human
uucaugcauggaaauu

SEQ ID NO: 1232468 - RNA, 16 nt, Human
uucagauacuggauug

SEQ ID NO: 1232469 - RNA, 20 nt, Human
uucagauacuggauuguacu

SEQ ID NO: 1232470 - RNA, 20 nt, Human
uuauuuuaauaauguuucaa

SEQ ID NO: 1232471 - RNA, 15 nt, Human
uuauuuuauuaugaa

SEQ ID NO: 1232472 - RNA, 16 nt, Human
uuauuuuauuaugaaa

SEQ ID NO: 1232473 - RNA, 19 nt, Human
uuauuuuaauaauguuuca

SEQ ID NO: 1232474 - RNA, 20 nt, Human
uuauuuuauuaugaaacuug

SEQ ID NO: 1232475 - RNA, 18 nt, Human
uucaaauguauuacagug

SEQ ID NO: 1232476 - RNA, 23 nt, Human
uucaaauuguaagcaugcacaaa

SEQ ID NO: 1232477 - RNA, 18 nt, Human
uuaucuauagcuaaguac

SEQ ID NO: 1232478 - RNA, 20 nt, Human
uuaucuugaauaauguaaga

SEQ ID NO: 1232479 - RNA, 16 nt, Human
uuaucuugaauaaugu

SEQ ID NO: 1232480 - RNA, 14 nt, Human
uuaucuugaauaau

SEQ ID NO: 1232481 - RNA, 15 nt, Human
uuauauuugaaauau

SEQ ID NO: 1232482 - RNA, 13 nt, Human
uuauauuugaaau

SEQ ID NO: 1232483 - RNA, 12 nt, Human
uuauauuugaaa

SEQ ID NO: 1232484 - RNA, 20 nt, Human
uuauauuuauuacuguaaga

SEQ ID NO: 1232485 - RNA, 16 nt, Human
uuauauuuacaaaugg

SEQ ID NO: 1232486 - RNA, 16 nt, Human
uuauuacuguaagaaa

SEQ ID NO: 1232487 - RNA, 16 nt, Human
uuauuacaguauaauu

SEQ ID NO: 1232488 - RNA, 18 nt, Human
uuauaauaaaggacugua

SEQ ID NO: 1232489 - RNA, 19 nt, Human
uuauaauaaaggacuguaa

SEQ ID NO: 1232490 - RNA, 21 nt, Human
uuauaauaaaggacuguaauc

SEQ ID NO: 1232491 - RNA, 11 nt, Human
uuauaaucuuu

SEQ ID NO: 1232492 - RNA, 15 nt, Human
uuauaauuuugugaa

SEQ ID NO: 1232493 - RNA, 14 nt, Human
uuauaauuuuguga

SEQ ID NO: 1232494 - RNA, 17 nt, Human
uuauaauuuuaaauguu

SEQ ID NO: 1232495 - RNA, 21 nt, Human
uuauaauuuuaaauguuuuuu

SEQ ID NO: 1232496 - RNA, 12 nt, Human
uuauaauuuaaa

SEQ ID NO: 1232497 - RNA, 12 nt, Human
uuauaauuuuaa

SEQ ID NO: 1232498 - RNA, 23 nt, Human
uuauaucuauauuuuacauaaau

SEQ ID NO: 1232499 - RNA, 19 nt, Human
uuauaucuauauuuuacau

SEQ ID NO: 1232500 - RNA, 18 nt, Human
uuauaauuuugugaagca

SEQ ID NO: 1232501 - RNA, 17 nt, Human
uuauaauuuugugaagc

SEQ ID NO: 1232502 - RNA, 16 nt, Human
uuauaauuuugugaag

SEQ ID NO: 1232503 - RNA, 14 nt, Human
uuauaucugaggaa

SEQ ID NO: 1232504 - RNA, 20 nt, Human
uuauaucugaggaauucugu

SEQ ID NO: 1232505 - RNA, 21 nt, Human
uuauaucugaggaauucugua

SEQ ID NO: 1232506 - RNA, 22 nt, Human
uuauaucugaggaauucuguau

SEQ ID NO: 1232507 - RNA, 23 nt, Human
uuauaucugaggaauucuguaua

SEQ ID NO: 1232508 - RNA, 16 nt, Human
uuauaugcuauuucua

SEQ ID NO: 1232509 - RNA, 18 nt, Human
uuauaugcuauuucuaua

SEQ ID NO: 1232510 - RNA, 14 nt, Human
uuauauguaccgua

SEQ ID NO: 1232511 - RNA, 16 nt, Human
uuauauguaccguagg

SEQ ID NO: 1232512 - RNA, 16 nt, Human
uuauauuaugaagcuu

SEQ ID NO: 1232513 - RNA, 23 nt, Human
uugaugaagaaguugauaugccu

SEQ ID NO: 1232514 - RNA, 14 nt, Human
uugaugaagaaguu

SEQ ID NO: 1232515 - RNA, 15 nt, Human
uugaauuuauuggcu

SEQ ID NO: 1232516 - RNA, 18 nt, Human
uugaauuuauuggcuuuu

SEQ ID NO: 1232517 - RNA, 22 nt, Human
uugaauuuauuggcuuuucuga

SEQ ID NO: 1232518 - RNA, 12 nt, Human
uugaauuuuaca

SEQ ID NO: 1232519 - RNA, 17 nt, Human
uugaauuuuguguuaga

SEQ ID NO: 1232520 - RNA, 21 nt, Human
uugaauuuuguguuagagauu

SEQ ID NO: 1232521 - RNA, 15 nt, Human
uucuuuaaaauuaca

SEQ ID NO: 1232522 - RNA, 18 nt, Human
uucuuuccacagaagcuc

SEQ ID NO: 1232523 - RNA, 15 nt, Human
uugaaaaaugcaugu

SEQ ID NO: 1232524 - RNA, 17 nt, Human
uugaaaagcagacauuu

SEQ ID NO: 1232525 - RNA, 15 nt, Human
uugaaaagcagacau

SEQ ID NO: 1232526 - RNA, 21 nt, Human
uucuaugaaauauuauguuaa

SEQ ID NO: 1232527 - RNA, 14 nt, Human
uucuaugaaauauu

SEQ ID NO: 1232528 - RNA, 19 nt, Human
uucuccagccucagccucc

SEQ ID NO: 1232529 - RNA, 13 nt, Human
uucugauagagga

SEQ ID NO: 1232530 - RNA, 21 nt, Human
uucugauagaggaagccugau

SEQ ID NO: 1232531 - RNA, 19 nt, Human
uucuaccaaggucuucuua

SEQ ID NO: 1232532 - RNA, 13 nt, Human
uucguuaucuaau

SEQ ID NO: 1232533 - RNA, 20 nt, Human
uucuacugcucuccuccacc

SEQ ID NO: 1232534 - RNA, 13 nt, Human
uucuacugcucuc

SEQ ID NO: 1232535 - RNA, 14 nt, Human
uucuauagcuuuuc

SEQ ID NO: 1232536 - RNA, 18 nt, Human
uucggugagcuacaaaug

SEQ ID NO: 1232537 - RNA, 22 nt, Human
uuccugagucccaucccugcgu

SEQ ID NO: 1232538 - RNA, 14 nt, Human
uuuuuuuguuauua

SEQ ID NO: 1232539 - RNA, 12 nt, Human
uuuuuuuacauu

SEQ ID NO: 1232540 - RNA, 11 nt, Human
uuuuuuacauu

SEQ ID NO: 1232541 - RNA, 12 nt, Human
uuuuuuacauuu

SEQ ID NO: 1232542 - RNA, 15 nt, Human
uuuuuaaauguauac

SEQ ID NO: 1232543 - RNA, 23 nt, Human
uuuuuaaauguauacuauaguac

SEQ ID NO: 1232544 - RNA, 13 nt, Human
uuuuuaaucuuua

SEQ ID NO: 1232545 - RNA, 13 nt, Human
uuuuucauuauuu

SEQ ID NO: 1232546 - RNA, 22 nt, Human
uuuuucauuauuuuauuaugaa

SEQ ID NO: 1232547 - RNA, 17 nt, Human
uuuguauaaaauaauuu

SEQ ID NO: 1232548 - RNA, 19 nt, Human
uuuguauaaaauaauuuuu

SEQ ID NO: 1232549 - RNA, 18 nt, Human
uuuguauaaaauaauuuu

SEQ ID NO: 1232550 - RNA, 24 nt, Human
uuuggaccaaaaaccaguauugua

SEQ ID NO: 1232551 - RNA, 15 nt, Human
uuuggucaacacuaa

SEQ ID NO: 1232552 - RNA, 14 nt, Human
uuuguauuguauau

SEQ ID NO: 1232553 - RNA, 14 nt, Human
uuuuaaaauccacu

SEQ ID NO: 1232554 - RNA, 23 nt, Human
uuuuaaaauccacuuuaucuuga

SEQ ID NO: 1232555 - RNA, 20 nt, Human
uuuccuaaauauauuuuaag

SEQ ID NO: 1232556 - RNA, 15 nt, Human
uuuccacagaagcuc

SEQ ID NO: 1232557 - RNA, 21 nt, Human
uuuggaccaaaaaccaguauu

SEQ ID NO: 1232558 - RNA, 22 nt, Human
uuuggaccaaaaaccaguauug

SEQ ID NO: 1232559 - RNA, 15 nt, Human
uuuggaaaucuuuaa

SEQ ID NO: 1232560 - RNA, 18 nt, Human
uuuggaccaaaaaccagu

SEQ ID NO: 1232561 - RNA, 18 nt, Human
uuugcauaacguauaaaa

SEQ ID NO: 1232562 - RNA, 20 nt, Human
uuuugaaauuaugugacauu

SEQ ID NO: 1232563 - RNA, 16 nt, Human
uuuucacauuggaaac

SEQ ID NO: 1232564 - RNA, 21 nt, Human
uuuucaaaauuguuacaaauu

SEQ ID NO: 1232565 - RNA, 23 nt, Human
uuuuauaauuuugugaagcaaaa

SEQ ID NO: 1232566 - RNA, 19 nt, Human
uuuuacguccaucucuugu

SEQ ID NO: 1232567 - RNA, 21 nt, Human
uuuuaaaguaacccuacaaaa

SEQ ID NO: 1232568 - RNA, 18 nt, Human
uuuuauauuugaaauauu

SEQ ID NO: 1232569 - RNA, 13 nt, Human
uuuuauauuugaa

SEQ ID NO: 1232570 - RNA, 13 nt, Human
uuuuauauuuacu

SEQ ID NO: 1232571 - RNA, 14 nt, Human
uuuucaaaagaaag

SEQ ID NO: 1232572 - RNA, 17 nt, Human
aaaaccaguauuguaca

SEQ ID NO: 1232573 - RNA, 19 nt, Human
gggacauuugcucauggaa

SEQ ID NO: 1232574 - RNA, 14 nt, Human
aaaaggaaagaaaa

SEQ ID NO: 1232575 - RNA, 13 nt, Human
aaaaggaaagaaa

SEQ ID NO: 1232576 - RNA, 14 nt, Human
aaaaauaacaauga

SEQ ID NO: 1232577 - RNA, 14 nt, Human
ggcugggucgcccu

SEQ ID NO: 1232578 - RNA, 17 nt, Human
ggcugggucgcccugga

SEQ ID NO: 1232579 - RNA, 20 nt, Human
ggcugggucgcccuggacug

SEQ ID NO: 1232580 - RNA, 15 nt, Human
ggcuguacccaggaa

SEQ ID NO: 1232581 - RNA, 22 nt, Human
gggacagucaccucauggaauu

SEQ ID NO: 1232582 - RNA, 21 nt, Human
gggacagucaccucauggaau

SEQ ID NO: 1232583 - RNA, 20 nt, Human
gggacagucaccucauggaa

SEQ ID NO: 1232584 - RNA, 16 nt, Human
ggcauaacauaaaucu

SEQ ID NO: 1232585 - RNA, 17 nt, Human
ggcauaacauaaaucug

SEQ ID NO: 1232586 - RNA, 15 nt, Human
aaaauuuuuaaucuu

SEQ ID NO: 1232587 - RNA, 19 nt, Human
ggggaauugaggacacuga

SEQ ID NO: 1232588 - RNA, 13 nt, Human
ggguggcagcaac

SEQ ID NO: 1232589 - RNA, 15 nt, Human
aaacgucuuaaauau

SEQ ID NO: 1232590 - RNA, 14 nt, Human
aaacgucuuaaaua

SEQ ID NO: 1232591 - RNA, 18 nt, Human
aaacuaggugcauauuua

SEQ ID NO: 1232592 - RNA, 13 nt, Human
aaacgucuuaaau

SEQ ID NO: 1232593 - RNA, 22 nt, Human
aaacuaggugcauauuuauaaa

SEQ ID NO: 1232594 - RNA, 15 nt, Human
aaacucguuaauuug

SEQ ID NO: 1232595 - RNA, 18 nt, Human
aaaccuuuguuugcaucu

SEQ ID NO: 1232596 - RNA, 18 nt, Human
aaaccuuuuauauuuagu

SEQ ID NO: 1232597 - RNA, 19 nt, Human
gggggugcugggccccugc

SEQ ID NO: 1232598 - RNA, 13 nt, Human
gggucgcccugga

SEQ ID NO: 1232599 - RNA, 15 nt, Human
gggucgcccuggacu

SEQ ID NO: 1232600 - RNA, 15 nt, Human
ggguggggggggugc

SEQ ID NO: 1232601 - RNA, 23 nt, Human
aaacuucagcgguuuauauaagc

SEQ ID NO: 1232602 - RNA, 16 nt, Human
aaacuuguauuaugug

SEQ ID NO: 1232603 - RNA, 15 nt, Human
aaacuuguguaaaua

SEQ ID NO: 1232604 - RNA, 13 nt, Human
aaagacagugaaa

SEQ ID NO: 1232605 - RNA, 11 nt, Human
aaacuuuucug

SEQ ID NO: 1232606 - RNA, 12 nt, Human
aaacuuuucuga

SEQ ID NO: 1232607 - RNA, 23 nt, Human
aaagcugcugagaaucuagccuc

SEQ ID NO: 1232608 - RNA, 14 nt, Human
aaagguacuucaaa

SEQ ID NO: 1232609 - RNA, 14 nt, Human
aaagguaaaucaga

SEQ ID NO: 1232610 - RNA, 14 nt, Human
ggucgcccuggacu

SEQ ID NO: 1232611 - RNA, 20 nt, Human
ggucgcccuggacugugugc

SEQ ID NO: 1232612 - RNA, 21 nt, Human
ggugcauauuuauaaaaauaa

SEQ ID NO: 1232613 - RNA, 11 nt, Human
ggugcugggcc

SEQ ID NO: 1232614 - RNA, 13 nt, Human
ggugcugggcccc

SEQ ID NO: 1232615 - RNA, 15 nt, Human
ggugcugggccccug

SEQ ID NO: 1232616 - RNA, 16 nt, Human
ggugcugggccccugc

SEQ ID NO: 1232617 - RNA, 19 nt, Human
ggugcugggccccugccuc

SEQ ID NO: 1232618 - RNA, 18 nt, Human
aaaguauguuagugcaaa

SEQ ID NO: 1232619 - RNA, 12 nt, Human
aaaguugaauuu

SEQ ID NO: 1232620 - RNA, 13 nt, Human
aaaguugccuaaa

SEQ ID NO: 1232621 - RNA, 14 nt, Human
aaaguugccuaaau

SEQ ID NO: 1232622 - RNA, 13 nt, Human
aaaguauuaagca

SEQ ID NO: 1232623 - RNA, 18 nt, Human
aaaguauuaagcauauau

SEQ ID NO: 1232624 - RNA, 19 nt, Human
aaaguauuaagcauauauu

SEQ ID NO: 1232625 - RNA, 20 nt, Human
aaaguauuaagcauauauuu

SEQ ID NO: 1232626 - RNA, 15 nt, Human
aaauaauuuuuauau

SEQ ID NO: 1232627 - RNA, 19 nt, Human
aaauaauuuuaucucuuuc

SEQ ID NO: 1232628 - RNA, 13 nt, Human
guaaaccuuuuau

SEQ ID NO: 1232629 - RNA, 13 nt, Human
aaauaauaauuuu

SEQ ID NO: 1232630 - RNA, 12 nt, Human
aaaguuuaauau

SEQ ID NO: 1232631 - RNA, 14 nt, Human
aaaguuuaauauua

SEQ ID NO: 1232632 - RNA, 16 nt, Human
aaaguugccuaaaucc

SEQ ID NO: 1232633 - RNA, 17 nt, Human
aaaguugccuaaaucca

SEQ ID NO: 1232634 - RNA, 16 nt, Human
aaaguugguaaaccuu

SEQ ID NO: 1232635 - RNA, 17 nt, Human
aaaguugguaaaccuuu

SEQ ID NO: 1232636 - RNA, 23 nt, Human
aaaguugccuaaauccauuugga

SEQ ID NO: 1232637 - RNA, 23 nt, Human
guacacugccuucucaacuccaa

SEQ ID NO: 1232638 - RNA, 23 nt, Human
aaauaauuuuuauauuugaaaua

SEQ ID NO: 1232639 - RNA, 22 nt, Human
aaauaauuuuuauauuugaaau

SEQ ID NO: 1232640 - RNA, 13 nt, Human
aaauacaauuuug

SEQ ID NO: 1232641 - RNA, 14 nt, Human
aaauacaauuuugu

SEQ ID NO: 1232642 - RNA, 17 nt, Human
aaauacaauuuuguuuc

SEQ ID NO: 1232643 - RNA, 18 nt, Human
aaauacaauuuuguuucu

SEQ ID NO: 1232644 - RNA, 20 nt, Human
aaauacaauuuuguuucugu

SEQ ID NO: 1232645 - RNA, 21 nt, Human
aaauacaauuuuguuucugua

SEQ ID NO: 1232646 - RNA, 22 nt, Human
aaauacaauuuuguuucuguac

SEQ ID NO: 1232647 - RNA, 18 nt, Human
aaauacauuguauauaug

SEQ ID NO: 1232648 - RNA, 21 nt, Human
guaauccaagcaaaugugaau

SEQ ID NO: 1232649 - RNA, 20 nt, Human
guaauaggcguaacuaauuu

SEQ ID NO: 1232650 - RNA, 15 nt, Human
aaauccacuuuaucu

SEQ ID NO: 1232651 - RNA, 17 nt, Human
aaauauuauguuaaaac

SEQ ID NO: 1232652 - RNA, 14 nt, Human
aaaucagacuauga

SEQ ID NO: 1232653 - RNA, 21 nt, Human
aaaucagacuaugaaguuuuu

SEQ ID NO: 1232654 - RNA, 20 nt, Human
guaccaagacuacuagggaa

SEQ ID NO: 1232655 - RNA, 23 nt, Human
guaccaagacuacuagggaaaug

SEQ ID NO: 1232656 - RNA, 18 nt, Human
aaauccauacauuugugu

SEQ ID NO: 1232657 - RNA, 15 nt, Human
aaauccauacauuug

SEQ ID NO: 1232658 - RNA, 15 nt, Human
guacuucaugcuguc

SEQ ID NO: 1232659 - RNA, 22 nt, Human
guacuucaaauccuugaagauu

SEQ ID NO: 1232660 - RNA, 21 nt, Human
guacuucaaauccuugaagau

SEQ ID NO: 1232661 - RNA, 14 nt, Human
gcugggguuaucug

SEQ ID NO: 1232662 - RNA, 22 nt, Human
gcugggguuaucugaagucaga

SEQ ID NO: 1232663 - RNA, 23 nt, Human
gcugggguuaucugaagucagau

SEQ ID NO: 1232664 - RNA, 12 nt, Human
gcugggucgccc

SEQ ID NO: 1232665 - RNA, 21 nt, Human
gcugggccccugccucucugc

SEQ ID NO: 1232666 - RNA, 22 nt, Human
gcugggccccugccucucugca

SEQ ID NO: 1232667 - RNA, 23 nt, Human
gcugggccccugccucucugcag

SEQ ID NO: 1232668 - RNA, 15 nt, Human
gcuggagugcagugg

SEQ ID NO: 1232669 - RNA, 15 nt, Human
ggacaggauccaggc

SEQ ID NO: 1232670 - RNA, 15 nt, Human
ggacuuguuagaucu

SEQ ID NO: 1232671 - RNA, 19 nt, Human
ggacuugcaaaaaggguca

SEQ ID NO: 1232672 - RNA, 21 nt, Human
ggacuucuuuaauuuuggaau

SEQ ID NO: 1232673 - RNA, 22 nt, Human
ggacuucuuuaauuuuggaauu

SEQ ID NO: 1232674 - RNA, 18 nt, Human
ggagaaaugaaaaaauau

SEQ ID NO: 1232675 - RNA, 17 nt, Human
ggacaccugcccugccc

SEQ ID NO: 1232676 - RNA, 19 nt, Human
ggaaugaagauacugaaau

SEQ ID NO: 1232677 - RNA, 18 nt, Human
ggaaugaagcaaugcuuc

SEQ ID NO: 1232678 - RNA, 18 nt, Human
ggaaguugacuuauagua

SEQ ID NO: 1232679 - RNA, 12 nt, Human
ggaagagaagga

SEQ ID NO: 1232680 - RNA, 17 nt, Human
ggaagagaaggagcaga

SEQ ID NO: 1232681 - RNA, 13 nt, Human
gccucuucccucu

SEQ ID NO: 1232682 - RNA, 15 nt, Human
gccucuuagaugcag

SEQ ID NO: 1232683 - RNA, 19 nt, Human
gccuccuuagaaaaaaaau

SEQ ID NO: 1232684 - RNA, 14 nt, Human
gcgaucucagcuca

SEQ ID NO: 1232685 - RNA, 20 nt, Human
gccccugccucucugcaggu

SEQ ID NO: 1232686 - RNA, 23 nt, Human
gccccugccucucugcagguccc

SEQ ID NO: 1232687 - RNA, 23 nt, Human
gccccugccaccuccugccucag

SEQ ID NO: 1232688 - RNA, 19 nt, Human
gcccccacugccuuugacc

SEQ ID NO: 1232689 - RNA, 13 nt, Human
gcccugcccugcc

SEQ ID NO: 1232690 - RNA, 17 nt, Human
gcccugcccugccaccu

SEQ ID NO: 1232691 - RNA, 18 nt, Human
gcccugccaccugucugu

SEQ ID NO: 1232692 - RNA, 13 nt, Human
gcccugccaccug

SEQ ID NO: 1232693 - RNA, 14 nt, Human
gcccugccaccugu

SEQ ID NO: 1232694 - RNA, 15 nt, Human
gcccugccaccuguc

SEQ ID NO: 1232695 - RNA, 16 nt, Human
gcccugccaccugucu

SEQ ID NO: 1232696 - RNA, 17 nt, Human
gcccugccaccugucug

SEQ ID NO: 1232697 - RNA, 20 nt, Human
gcucacugcaaccucugccu

SEQ ID NO: 1232698 - RNA, 19 nt, Human
gcguuuuuuaaauguauac

SEQ ID NO: 1232699 - RNA, 15 nt, Human
cugccucccuucaug

SEQ ID NO: 1232700 - RNA, 17 nt, Human
cugccucccuucaugca

SEQ ID NO: 1232701 - RNA, 18 nt, Human
cugccucccuucaugcau

SEQ ID NO: 1232702 - RNA, 19 nt, Human
cugccucccuucaugcaug

SEQ ID NO: 1232703 - RNA, 21 nt, Human
cugccucccuucaugcaugga

SEQ ID NO: 1232704 - RNA, 23 nt, Human
cugccucccuucaugcauggaaa

SEQ ID NO: 1232705 - RNA, 14 nt, Human
cugccucccuucau

SEQ ID NO: 1232706 - RNA, 17 nt, Human
cuggacuuggccccugc

SEQ ID NO: 1232707 - RNA, 18 nt, Human
cuggacuuggccccugcc

SEQ ID NO: 1232708 - RNA, 19 nt, Human
cuggacuuggccccugcca

SEQ ID NO: 1232709 - RNA, 15 nt, Human
cuggggccaggcugg

SEQ ID NO: 1232710 - RNA, 18 nt, Human
cuggggccaggcuggguc

SEQ ID NO: 1232711 - RNA, 20 nt, Human
cuggggcugaggcugaggca

SEQ ID NO: 1232712 - RNA, 13 nt, Human
cugggaauggagg

SEQ ID NO: 1232713 - RNA, 20 nt, Human
cugggaauggaggggcagag

SEQ ID NO: 1232714 - RNA, 23 nt, Human
cugggaauggaggggcagagcca

SEQ ID NO: 1232715 - RNA, 23 nt, Human
cugggacuauaggcaugcgccac

SEQ ID NO: 1232716 - RNA, 18 nt, Human
cugggacuugcaaaaagg

SEQ ID NO: 1232717 - RNA, 19 nt, Human
cuguuauaaucuuucacag

SEQ ID NO: 1232718 - RNA, 13 nt, Human
cuguuauaaucuu

SEQ ID NO: 1232719 - RNA, 15 nt, Human
cuuaaaguugaauuu

SEQ ID NO: 1232720 - RNA, 18 nt, Human
cuuaaaguugaauuuauu

SEQ ID NO: 1232721 - RNA, 22 nt, Human
cuuaaaguugaauuuauuggcu

SEQ ID NO: 1232722 - RNA, 15 nt, Human
cuguuguagaagaca

SEQ ID NO: 1232723 - RNA, 12 nt, Human
cuguuuaagaga

SEQ ID NO: 1232724 - RNA, 14 nt, Human
cuguuuaagagaca

SEQ ID NO: 1232725 - RNA, 23 nt, Human
cuuugaccugccucccuucaugc

SEQ ID NO: 1232726 - RNA, 20 nt, Human
cuuugaccugccucccuuca

SEQ ID NO: 1232727 - RNA, 16 nt, Human
cuuuguaaugaaaacc

SEQ ID NO: 1232728 - RNA, 14 nt, Human
cuuuguaaugaaaa

SEQ ID NO: 1232729 - RNA, 15 nt, Human
cuuuguaaugaaaac

SEQ ID NO: 1232730 - RNA, 13 nt, Human
cuuuguauucaaa

SEQ ID NO: 1232731 - RNA, 22 nt, Human
cuuuguauuguauauuacaaug

SEQ ID NO: 1232732 - RNA, 13 nt, Human
cuugucucagauu

SEQ ID NO: 1232733 - RNA, 14 nt, Human
cuugucucagauuu

SEQ ID NO: 1232734 - RNA, 17 nt, Human
cuugucucagauuuuau

SEQ ID NO: 1232735 - RNA, 18 nt, Human
cuugucucagauuuuauu

SEQ ID NO: 1232736 - RNA, 21 nt, Human
cuugucucagauuuuauuaug

SEQ ID NO: 1232737 - RNA, 14 nt, Human
cuuucagauacugg

SEQ ID NO: 1232738 - RNA, 15 nt, Human
cuuucagauacugga

SEQ ID NO: 1232739 - RNA, 17 nt, Human
cuuucagauacuggauu

SEQ ID NO: 1232740 - RNA, 22 nt, Human
cuuucagauacuggauuguacu

SEQ ID NO: 1232741 - RNA, 13 nt, Human
cuucucacauuua

SEQ ID NO: 1232742 - RNA, 20 nt, Human
cuucucacauuuauauuuuu

SEQ ID NO: 1232743 - RNA, 16 nt, Human
cuucucuuguuaggua

SEQ ID NO: 1232744 - RNA, 15 nt, Human
cuucugaauaaagca

SEQ ID NO: 1232745 - RNA, 16 nt, Human
cuucugaauaaagcaa

SEQ ID NO: 1232746 - RNA, 18 nt, Human
cuucugaauaaagcaauu

SEQ ID NO: 1232747 - RNA, 22 nt, Human
cuucugaauaaagcaauuagca

SEQ ID NO: 1232748 - RNA, 19 nt, Human
cuucugacauaauccagua

SEQ ID NO: 1232749 - RNA, 16 nt, Human
cuugcaaaaaggguca

SEQ ID NO: 1232750 - RNA, 15 nt, Human
cuugcaaaaaggguc

SEQ ID NO: 1232751 - RNA, 21 nt, Human
gaaaagaaaauuuuuguagua

SEQ ID NO: 1232752 - RNA, 15 nt, Human
gaaaagaaagcuaca

SEQ ID NO: 1232753 - RNA, 19 nt, Human
gaaaacuuguauuaugugu

SEQ ID NO: 1232754 - RNA, 22 nt, Human
gaaaacuuguauuauguguguu

SEQ ID NO: 1232755 - RNA, 21 nt, Human
gaaacaagucagucauucaga

SEQ ID NO: 1232756 - RNA, 12 nt, Human
gaaaucuuuaaa

SEQ ID NO: 1232757 - RNA, 15 nt, Human
gaaaucuuuaaaaaa

SEQ ID NO: 1232758 - RNA, 11 nt, Human
gaaaugaaaaa

SEQ ID NO: 1232759 - RNA, 16 nt, Human
gaaagaacggaagaag

SEQ ID NO: 1232760 - RNA, 17 nt, Human
gaacugauguaaguaaa

SEQ ID NO: 1232761 - RNA, 13 nt, Human
gaacugaaaucau

SEQ ID NO: 1232762 - RNA, 12 nt, Human
gaaccaucagaa

SEQ ID NO: 1232763 - RNA, 17 nt, Human
gaagcacagugaucaag

SEQ ID NO: 1232764 - RNA, 19 nt, Human
gacccuccaccgcagaagg

SEQ ID NO: 1232765 - RNA, 21 nt, Human
gacccuccaccgcagaaggaa

SEQ ID NO: 1232766 - RNA, 22 nt, Human
gacccuccaccgcagaaggaag

SEQ ID NO: 1232767 - RNA, 14 nt, Human
gacugugugcucag

SEQ ID NO: 1232768 - RNA, 16 nt, Human
gacugugugcucagga

SEQ ID NO: 1232769 - RNA, 17 nt, Human
gacugugugcucaggag

SEQ ID NO: 1232770 - RNA, 20 nt, Human
gacugugugcucaggagccc

SEQ ID NO: 1232771 - RNA, 19 nt, Human
gacuuuggcugcaugcgag

SEQ ID NO: 1232772 - RNA, 19 nt, Human
gacuuuggauaauaaggaa

SEQ ID NO: 1232773 - RNA, 16 nt, Human
gacuuuggcugcaugc

SEQ ID NO: 1232774 - RNA, 21 nt, Human
gacagcccuucuuuccacaga

SEQ ID NO: 1232775 - RNA, 23 nt, Human
gaccauggacacuacacccagca

SEQ ID NO: 1232776 - RNA, 16 nt, Human
gaccauggacacuaca

SEQ ID NO: 1232777 - RNA, 21 nt, Human
gaccauggacacuacacccag

SEQ ID NO: 1232778 - RNA, 14 nt, Human
gaggcucuggagcc

SEQ ID NO: 1232779 - RNA, 19 nt, Human
gaggcucuggagcccacug

SEQ ID NO: 1232780 - RNA, 20 nt, Human
gaggcucuggagcccacugu

SEQ ID NO: 1232781 - RNA, 14 nt, Human
gccaacuauggccu

SEQ ID NO: 1232782 - RNA, 15 nt, Human
gccaacuauggccug

SEQ ID NO: 1232783 - RNA, 19 nt, Human
gccaacuauggccugugga

SEQ ID NO: 1232784 - RNA, 13 nt, Human
gcauaacauaaau

SEQ ID NO: 1232785 - RNA, 15 nt, Human
gcauaacauaaaucu

SEQ ID NO: 1232786 - RNA, 14 nt, Human
gaugaugacuaugg

SEQ ID NO: 1232787 - RNA, 13 nt, Human
gaugaggccagac

SEQ ID NO: 1232788 - RNA, 15 nt, Human
gaugaggccagacca

SEQ ID NO: 1232789 - RNA, 22 nt, Human
gaugaggccagaccauggacac

SEQ ID NO: 1232790 - RNA, 16 nt, Human
gcaaaaauauuuuaug

SEQ ID NO: 1232791 - RNA, 17 nt, Human
gcaaaaauauuuuauga

SEQ ID NO: 1232792 - RNA, 22 nt, Human
gcaaaaauauuuuaugauccag

SEQ ID NO: 1232793 - RNA, 23 nt, Human
gcaaaaauauuuuaugauccagc

SEQ ID NO: 1232794 - RNA, 16 nt, Human
gauucuuaaaguugaa

SEQ ID NO: 1232795 - RNA, 17 nt, Human
gauucuuaaaguugaau

SEQ ID NO: 1232796 - RNA, 21 nt, Human
gauucuuaaaguugaauuuau

SEQ ID NO: 1232797 - RNA, 15 nt, Human
gauucuuaaaguuga

SEQ ID NO: 1232798 - RNA, 13 nt, Human
gcaaccuccaccu

SEQ ID NO: 1232799 - RNA, 18 nt, Human
gcaaguuuccaucaucua

SEQ ID NO: 1232800 - RNA, 18 nt, Human
gcaauagucaaauugugu

SEQ ID NO: 1232801 - RNA, 22 nt, Human
gcaauagucaaauugugugaaa

SEQ ID NO: 1232802 - RNA, 22 nt, Human
gcacacaccaccacgccuggcu

SEQ ID NO: 1232803 - RNA, 11 nt, Human
gcaauagagac

SEQ ID NO: 1232804 - RNA, 19 nt, Human
cagauaugauucaaauguc

SEQ ID NO: 1232805 - RNA, 17 nt, Human
cagauaugauucaaaug

SEQ ID NO: 1232806 - RNA, 16 nt, Human
cagauaugauucaaau

SEQ ID NO: 1232807 - RNA, 22 nt, Human
cagcacagccucuuagaugcag

SEQ ID NO: 1232808 - RNA, 20 nt, Human
cagcccuucuuuccacagaa

SEQ ID NO: 1232809 - RNA, 19 nt, Human
cagcccuucuuuccacaga

SEQ ID NO: 1232810 - RNA, 15 nt, Human
cagcccuucuuucca

SEQ ID NO: 1232811 - RNA, 20 nt, Human
caggaaagcgccuccaaccc

SEQ ID NO: 1232812 - RNA, 19 nt, Human
caggaaagcgccuccaacc

SEQ ID NO: 1232813 - RNA, 19 nt, Human
cagcugccucuucccucuu

SEQ ID NO: 1232814 - RNA, 19 nt, Human
cagcuccaagaauuucuag

SEQ ID NO: 1232815 - RNA, 16 nt, Human
cagcuccaagaauuuc

SEQ ID NO: 1232816 - RNA, 18 nt, Human
caggugcagcccccacug

SEQ ID NO: 1232817 - RNA, 20 nt, Human
caggugcagcccccacugcc

SEQ ID NO: 1232818 - RNA, 23 nt, Human
caggugcagcccccacugccuuu

SEQ ID NO: 1232819 - RNA, 15 nt, Human
cagucaccucaugga

SEQ ID NO: 1232820 - RNA, 21 nt, Human
caguauuguacaaaguauuaa

SEQ ID NO: 1232821 - RNA, 22 nt, Human
caguauuguacaaaguauuaag

SEQ ID NO: 1232822 - RNA, 12 nt, Human
caguauuguaca

SEQ ID NO: 1232823 - RNA, 13 nt, Human
caguauuguacaa

SEQ ID NO: 1232824 - RNA, 16 nt, Human
caguauuguacaaagu

SEQ ID NO: 1232825 - RNA, 17 nt, Human
caguauuguacaaagua

SEQ ID NO: 1232826 - RNA, 18 nt, Human
caguauuguacaaaguau

SEQ ID NO: 1232827 - RNA, 19 nt, Human
caguauuguacaaaguauu

SEQ ID NO: 1232828 - RNA, 22 nt, Human
cagugcacuaauguguaagaca

SEQ ID NO: 1232829 - RNA, 18 nt, Human
ccacagaagcuccaggua

SEQ ID NO: 1232830 - RNA, 18 nt, Human
ccaccagucugacuguuu

SEQ ID NO: 1232831 - RNA, 16 nt, Human
ccacagaagcuccagg

SEQ ID NO: 1232832 - RNA, 13 nt, Human
cauuuauauguac

SEQ ID NO: 1232833 - RNA, 16 nt, Human
cauggccagcuaauuu

SEQ ID NO: 1232834 - RNA, 12 nt, Human
caugcacaaauu

SEQ ID NO: 1232835 - RNA, 23 nt, Human
cauccuucaucuggauuccagag

SEQ ID NO: 1232836 - RNA, 17 nt, Human
caaaccaaaucacugaa

SEQ ID NO: 1232837 - RNA, 17 nt, Human
caaacauauauaacaau

SEQ ID NO: 1232838 - RNA, 21 nt, Human
caaaaggauaaugaauacuuu

SEQ ID NO: 1232839 - RNA, 13 nt, Human
auuuuuuuguugu

SEQ ID NO: 1232840 - RNA, 16 nt, Human
auuuuuauauuugaaa

SEQ ID NO: 1232841 - RNA, 15 nt, Human
auuuuuauauuugaa

SEQ ID NO: 1232842 - RNA, 15 nt, Human
auuuuuauauuuacu

SEQ ID NO: 1232843 - RNA, 16 nt, Human
auuuuuauauuuacua

SEQ ID NO: 1232844 - RNA, 18 nt, Human
auuuuuuuguuguuuguu

SEQ ID NO: 1232845 - RNA, 19 nt, Human
auuuuagggguagcauuug

SEQ ID NO: 1232846 - RNA, 14 nt, Human
auuuuauguugcau

SEQ ID NO: 1232847 - RNA, 19 nt, Human
caaaguccugggauuacag

SEQ ID NO: 1232848 - RNA, 14 nt, Human
caaaguauuaagca

SEQ ID NO: 1232849 - RNA, 14 nt, Human
caaagguaaaucag

SEQ ID NO: 1232850 - RNA, 22 nt, Human
caaagguaaaucagacuaugaa

SEQ ID NO: 1232851 - RNA, 15 nt, Human
caacacacacaugcu

SEQ ID NO: 1232852 - RNA, 23 nt, Human
caacacacacaugcuucccuuuc

SEQ ID NO: 1232853 - RNA, 18 nt, Human
caacacacacaugcuucc

SEQ ID NO: 1232854 - RNA, 20 nt, Human
caagaauuucuaggacugaa

SEQ ID NO: 1232855 - RNA, 22 nt, Human
caagauggggagugagaggcug

SEQ ID NO: 1232856 - RNA, 17 nt, Human
caacucauauuuucaug

SEQ ID NO: 1232857 - RNA, 13 nt, Human
auuuaauaauuau

SEQ ID NO: 1232858 - RNA, 16 nt, Human
auuuaugcauauuauu

SEQ ID NO: 1232859 - RNA, 22 nt, Human
auuuaugcauauuauuuuaugu

SEQ ID NO: 1232860 - RNA, 14 nt, Human
auuucuaugaaaua

SEQ ID NO: 1232861 - RNA, 17 nt, Human
auuucuauauuuucauu

SEQ ID NO: 1232862 - RNA, 18 nt, Human
auuucuauauuuucauuc

SEQ ID NO: 1232863 - RNA, 15 nt, Human
auuucuauauuuuca

SEQ ID NO: 1232864 - RNA, 16 nt, Human
auuucuauauuuucau

SEQ ID NO: 1232865 - RNA, 19 nt, Human
auuucuauauuuucauucu

SEQ ID NO: 1232866 - RNA, 19 nt, Human
auuucuaugcugaguuugu

SEQ ID NO: 1232867 - RNA, 21 nt, Human
auuucuaugcugaguuugugc

SEQ ID NO: 1232868 - RNA, 22 nt, Human
auuucuaugcugaguuugugcu

SEQ ID NO: 1232869 - RNA, 18 nt, Human
auuguaagcaugcacaaa

SEQ ID NO: 1232870 - RNA, 15 nt, Human
auuguaauuauaucu

SEQ ID NO: 1232871 - RNA, 16 nt, Human
auuguaauuauaucug

SEQ ID NO: 1232872 - RNA, 17 nt, Human
auuguaauuauaucuga

SEQ ID NO: 1232873 - RNA, 21 nt, Human
auuguaauuauaucugaggaa

SEQ ID NO: 1232874 - RNA, 16 nt, Human
auuguacaaaguauua

SEQ ID NO: 1232875 - RNA, 17 nt, Human
auuguacaaaguauuaa

SEQ ID NO: 1232876 - RNA, 19 nt, Human
auuguacaaaguauuaagc

SEQ ID NO: 1232877 - RNA, 20 nt, Human
auuguacaaaguauuaagca

SEQ ID NO: 1232878 - RNA, 11 nt, Human
auuccuccagg

SEQ ID NO: 1232879 - RNA, 15 nt, Human
auuccuucagcacuu

SEQ ID NO: 1232880 - RNA, 17 nt, Human
auuccuucagcacuuua

SEQ ID NO: 1232881 - RNA, 17 nt, Human
auucuugccaaauauaa

SEQ ID NO: 1232882 - RNA, 22 nt, Human
auuaugaauuacauuuguauaa

SEQ ID NO: 1232883 - RNA, 20 nt, Human
auuaugaauuacauuuguau

SEQ ID NO: 1232884 - RNA, 19 nt, Human
auuaugaauuacauuugua

SEQ ID NO: 1232885 - RNA, 18 nt, Human
auuaguaagcuagcaaau

SEQ ID NO: 1232886 - RNA, 20 nt, Human
auuaguacuccccuccuuga

SEQ ID NO: 1232887 - RNA, 16 nt, Human
auucaaaugucuauaa

SEQ ID NO: 1232888 - RNA, 12 nt, Human
auuauguaaauc

SEQ ID NO: 1232889 - RNA, 14 nt, Human
caauugagaaaaau

SEQ ID NO: 1232890 - RNA, 23 nt, Human
caauugagaaaaauauauacuaa

SEQ ID NO: 1232891 - RNA, 21 nt, Human
caagucagucauucagauaug

SEQ ID NO: 1232892 - RNA, 22 nt, Human
caaggccugguguuucuugaua

SEQ ID NO: 1232893 - RNA, 21 nt, Human
caaggccugguguuucuugau

SEQ ID NO: 1232894 - RNA, 23 nt, Human
caauaaaauccauacauuugugu

SEQ ID NO: 1232895 - RNA, 20 nt, Human
caauaaaauccauacauuug

SEQ ID NO: 1232896 - RNA, 14 nt, Human
cagaaauacaauuu

SEQ ID NO: 1232897 - RNA, 19 nt, Human
cacugggagaaaugaaaaa

SEQ ID NO: 1232898 - RNA, 17 nt, Human
cacuuguguuuugcaag

SEQ ID NO: 1232899 - RNA, 18 nt, Human
cacuuuagaauaugccuu

SEQ ID NO: 1232900 - RNA, 22 nt, Human
cacucuguucauuccuccaggu

SEQ ID NO: 1232901 - RNA, 21 nt, Human
cacuacacccagcaauagaga

SEQ ID NO: 1232902 - RNA, 17 nt, Human
cacucuguucauuccuc

SEQ ID NO: 1232903 - RNA, 18 nt, Human
cacucuguucauuccucc

SEQ ID NO: 1232904 - RNA, 19 nt, Human
cacucuguucauuccucca

SEQ ID NO: 1232905 - RNA, 20 nt, Human
cacucuguucauuccuccag

SEQ ID NO: 1232906 - RNA, 21 nt, Human
cacucuguucauuccuccagg

SEQ ID NO: 1232907 - RNA, 20 nt, Human
cccagcuggggccaggcugg

SEQ ID NO: 1232908 - RNA, 13 nt, Human
cccagccauccag

SEQ ID NO: 1232909 - RNA, 18 nt, Human
cccacuguacuugcucuu

SEQ ID NO: 1232910 - RNA, 18 nt, Human
cccucaaccucauccucu

SEQ ID NO: 1232911 - RNA, 15 nt, Human
ccccugccaccuccu

SEQ ID NO: 1232912 - RNA, 17 nt, Human
ccccugccaccuccugc

SEQ ID NO: 1232913 - RNA, 13 nt, Human
ccccugaauuuaa

SEQ ID NO: 1232914 - RNA, 17 nt, Human
ccccugaauuuaaauag

SEQ ID NO: 1232915 - RNA, 13 nt, Human
ccagcuuuuccca

SEQ ID NO: 1232916 - RNA, 23 nt, Human
ccagcuuuucccaaaagcccauu

SEQ ID NO: 1232917 - RNA, 17 nt, Human
ccaggcuggagugcagu

SEQ ID NO: 1232918 - RNA, 18 nt, Human
ccaggcuggagugcagug

SEQ ID NO: 1232919 - RNA, 13 nt, Human
cccaacuccagaa

SEQ ID NO: 1232920 - RNA, 20 nt, Human
cccaagcaccugggauuaca

SEQ ID NO: 1232921 - RNA, 13 nt, Human
cccuucuauaccc

SEQ ID NO: 1232922 - RNA, 18 nt, Human
cccuucuauacccaccca

SEQ ID NO: 1232923 - RNA, 19 nt, Human
cccuucuauacccacccag

SEQ ID NO: 1232924 - RNA, 20 nt, Human
cccuucuauacccacccaga

SEQ ID NO: 1232925 - RNA, 21 nt, Human
cccuucuauacccacccagaa

SEQ ID NO: 1232926 - RNA, 21 nt, Human
cccuucuccauggcccugcca

SEQ ID NO: 1232927 - RNA, 12 nt, Human
ccuaauaaagcu

SEQ ID NO: 1232928 - RNA, 13 nt, Human
ccuaauaaagcug

SEQ ID NO: 1232929 - RNA, 17 nt, Human
ccucagcucucaguugc

SEQ ID NO: 1232930 - RNA, 13 nt, Human
ccucaaccucauc

SEQ ID NO: 1232931 - RNA, 14 nt, Human
ccucaaccucaucc

SEQ ID NO: 1232932 - RNA, 23 nt, Human
ccugaccccaaguuauccaccug

SEQ ID NO: 1232933 - RNA, 16 nt, Human
ccugccucagccuccc

SEQ ID NO: 1232934 - RNA, 13 nt, Human
ccugccucucugc

SEQ ID NO: 1232935 - RNA, 17 nt, Human
ccugccucucugcaggu

SEQ ID NO: 1232936 - RNA, 14 nt, Human
ccugccucucugca

SEQ ID NO: 1232937 - RNA, 15 nt, Human
ccugccucucugcag

SEQ ID NO: 1232938 - RNA, 23 nt, Human
cucaaauacgugggcauucaaau

SEQ ID NO: 1232939 - RNA, 18 nt, Human
cucacuuguuuuauuuaa

SEQ ID NO: 1232940 - RNA, 23 nt, Human
cucagaaaacaaggaugaauuaa

SEQ ID NO: 1232941 - RNA, 19 nt, Human
cucagaaaacaaggaugaa

SEQ ID NO: 1232942 - RNA, 20 nt, Human
cuacuagggaaaugccuuug

SEQ ID NO: 1232943 - RNA, 15 nt, Human
cgguuuauauaagcu

SEQ ID NO: 1232944 - RNA, 16 nt, Human
cuaaacuuuucugaua

SEQ ID NO: 1232945 - RNA, 15 nt, Human
cugaggaauucugua

SEQ ID NO: 1232946 - RNA, 16 nt, Human
cugaggaauucuguau

SEQ ID NO: 1232947 - RNA, 18 nt, Human
cugaggaauucuguauag

SEQ ID NO: 1232948 - RNA, 19 nt, Human
cugaggaauucuguauaga

SEQ ID NO: 1232949 - RNA, 17 nt, Human
cugaggggcuaccagga

SEQ ID NO: 1232950 - RNA, 20 nt, Human
cugaggggcuaccaggaaag

SEQ ID NO: 1232951 - RNA, 18 nt, Human
cugaggggcuaccaggaa

SEQ ID NO: 1232952 - RNA, 18 nt, Human
cugacccuccaccgcaga

SEQ ID NO: 1232953 - RNA, 23 nt, Human
cugacccuccaccgcagaaggaa

SEQ ID NO: 1232954 - RNA, 17 nt, Human
cugaaaauauuguuuua

SEQ ID NO: 1232955 - RNA, 20 nt, Human
cugaaaauauuguuuuacaa

SEQ ID NO: 1232956 - RNA, 22 nt, Human
cugaaaauauuguuuuacaaua

SEQ ID NO: 1232957 - RNA, 24 nt, Human
cugaaaauauuguuuuacaauagu

SEQ ID NO: 1232958 - RNA, 19 nt, Human
cuccccaugauguuuagaa

SEQ ID NO: 1232959 - RNA, 14 nt, Human
cuccgucaacucau

SEQ ID NO: 1232960 - RNA, 13 nt, Human
cuccuuucucuuu

SEQ ID NO: 1232961 - RNA, 17 nt, Human
cucguggacaccugccc

SEQ ID NO: 1232962 - RNA, 19 nt, Human
cucguggacaccugcccug

SEQ ID NO: 1232963 - RNA, 20 nt, Human
cucguggacaccugcccugc

SEQ ID NO: 1232964 - RNA, 21 nt, Human
cucguggacaccugcccugcc

SEQ ID NO: 1232965 - RNA, 22 nt, Human
gucucuuuaaaaggaaagaaaa

SEQ ID NO: 1232966 - RNA, 15 nt, Human
aacuaagaaacuuaa

SEQ ID NO: 1232967 - RNA, 19 nt, Human
aacuaagaaacuuaaauuu

SEQ ID NO: 1232968 - RNA, 22 nt, Human
aacuacuucucuuguuagguaa

SEQ ID NO: 1232969 - RNA, 23 nt, Human
aacuaucucauuuccaagcaagu

SEQ ID NO: 1232970 - RNA, 20 nt, Human
aacuaucucauuuccaagca

SEQ ID NO: 1232971 - RNA, 13 nt, Human
aacuauauuguuu

SEQ ID NO: 1232972 - RNA, 17 nt, Human
gugacauuuuacauuaa

SEQ ID NO: 1232973 - RNA, 19 nt, Human
gugacauuuuacauuaaau

SEQ ID NO: 1232974 - RNA, 20 nt, Human
gugacauuuuacauuaaauu

SEQ ID NO: 1232975 - RNA, 21 nt, Human
gugacauuuuacauuaaauuu

SEQ ID NO: 1232976 - RNA, 20 nt, Human
aacugaaaucauacuucuua

SEQ ID NO: 1232977 - RNA, 12 nt, Human
aacauaaaucug

SEQ ID NO: 1232978 - RNA, 14 nt, Human
aacauaaaucugug

SEQ ID NO: 1232979 - RNA, 15 nt, Human
aacauaaaucuguga

SEQ ID NO: 1232980 - RNA, 23 nt, Human
aacauguuaaaccaugggauaaa

SEQ ID NO: 1232981 - RNA, 13 nt, Human
guagcguuuuuua

SEQ ID NO: 1232982 - RNA, 17 nt, Human
guagcguuuuuuaaaug

SEQ ID NO: 1232983 - RNA, 18 nt, Human
guagcguuuuuuaaaugu

SEQ ID NO: 1232984 - RNA, 22 nt, Human
guagcguuuuuuaaauguauac

SEQ ID NO: 1232985 - RNA, 22 nt, Human
aaccaaaucacugaacuuugcu

SEQ ID NO: 1232986 - RNA, 14 nt, Human
gucgcccuggacug

SEQ ID NO: 1232987 - RNA, 18 nt, Human
gucgcccuggacugugug

SEQ ID NO: 1232988 - RNA, 14 nt, Human
aacuuguguaaaua

SEQ ID NO: 1232989 - RNA, 15 nt, Human
aacuuguguaaauac

SEQ ID NO: 1232990 - RNA, 20 nt, Human
aacuuguguaaauacaauuu

SEQ ID NO: 1232991 - RNA, 13 nt, Human
aagaaaacaucuu

SEQ ID NO: 1232992 - RNA, 17 nt, Human
aagaaaacaucuuuaag

SEQ ID NO: 1232993 - RNA, 13 nt, Human
aagaaaauaucac

SEQ ID NO: 1232994 - RNA, 16 nt, Human
aagaaagucagccaua

SEQ ID NO: 1232995 - RNA, 19 nt, Human
aagaaaauuuuuguaguag

SEQ ID NO: 1232996 - RNA, 22 nt, Human
aagaaaauuuuuguaguagcgu

SEQ ID NO: 1232997 - RNA, 15 nt, Human
aacuuguauuaugug

SEQ ID NO: 1232998 - RNA, 22 nt, Human
gugcacuaauguguaagacaaa

SEQ ID NO: 1232999 - RNA, 20 nt, Human
gugcacuaauguguaagaca

SEQ ID NO: 1233000 - RNA, 16 nt, Human
gugcugggccccugcc

SEQ ID NO: 1233001 - RNA, 19 nt, Human
gugcugggccccugccucu

SEQ ID NO: 1233002 - RNA, 22 nt, Human
gugcugggguuaucugaaguca

SEQ ID NO: 1233003 - RNA, 19 nt, Human
gugcugguguaugugugaa

SEQ ID NO: 1233004 - RNA, 11 nt, Human
guggacaccug

SEQ ID NO: 1233005 - RNA, 12 nt, Human
guggacaccugc

SEQ ID NO: 1233006 - RNA, 13 nt, Human
guggacaccugcc

SEQ ID NO: 1233007 - RNA, 14 nt, Human
guggacaccugccc

SEQ ID NO: 1233008 - RNA, 16 nt, Human
guggacaccugcccug

SEQ ID NO: 1233009 - RNA, 17 nt, Human
guggacaccugcccugc

SEQ ID NO: 1233010 - RNA, 18 nt, Human
guggacaccugcccugcc

SEQ ID NO: 1233011 - RNA, 19 nt, Human
guggacaccugcccugccc

SEQ ID NO: 1233012 - RNA, 13 nt, Human
guggcagcaacaa

SEQ ID NO: 1233013 - RNA, 16 nt, Human
aagacaaaaagcuacu

SEQ ID NO: 1233014 - RNA, 24 nt, Human
aagaauuucuaggacugaauuaug

SEQ ID NO: 1233015 - RNA, 18 nt, Human
guggggggggugcugggc

SEQ ID NO: 1233016 - RNA, 13 nt, Human
aagaugaucauuu

SEQ ID NO: 1233017 - RNA, 19 nt, Human
aagcaaaauuuuuucucua

SEQ ID NO: 1233018 - RNA, 13 nt, Human
aagcaaaugugaa

SEQ ID NO: 1233019 - RNA, 14 nt, Human
aagcaaaugugaau

SEQ ID NO: 1233020 - RNA, 20 nt, Human
aagcaaaugugaaucauuuu

SEQ ID NO: 1233021 - RNA, 16 nt, Human
aagcaaguauuagaau

SEQ ID NO: 1233022 - RNA, 20 nt, Human
aagcaaguaaaaaggcuaaa

SEQ ID NO: 1233023 - RNA, 19 nt, Human
aagcaaguaaaaaggcuaa

SEQ ID NO: 1233024 - RNA, 21 nt, Human
guguugaaacggaugauuucu

SEQ ID NO: 1233025 - RNA, 23 nt, Human
guguugaaacggaugauuucuau

SEQ ID NO: 1233026 - RNA, 17 nt, Human
guuuuuuuuuaaagacu

SEQ ID NO: 1233027 - RNA, 19 nt, Human
aaguuuaauauuaaagcca

SEQ ID NO: 1233028 - RNA, 20 nt, Human
aaguuuaauauuaaagccau

SEQ ID NO: 1233029 - RNA, 21 nt, Human
aaguuuaauauuaaagccaug

SEQ ID NO: 1233030 - RNA, 13 nt, Human
uaaaauuacaacu

SEQ ID NO: 1233031 - RNA, 15 nt, Human
uaaaauuacaacuaa

SEQ ID NO: 1233032 - RNA, 17 nt, Human
uaaaauuacaacuaagu

SEQ ID NO: 1233033 - RNA, 19 nt, Human
uaaaauuacaacuaaguga

SEQ ID NO: 1233034 - RNA, 17 nt, Human
uaaaauuuuuaaucuuu

SEQ ID NO: 1233035 - RNA, 19 nt, Human
uaaaauuuuuaaucuuuaa

SEQ ID NO: 1233036 - RNA, 22 nt, Human
aaguuuaguuugaggaauucuu

SEQ ID NO: 1233037 - RNA, 16 nt, Human
uaaagacuuuuaugau

SEQ ID NO: 1233038 - RNA, 16 nt, Human
uaaaccggaccaucuc

SEQ ID NO: 1233039 - RNA, 18 nt, Human
uaaaccaugggauaaaug

SEQ ID NO: 1233040 - RNA, 20 nt, Human
uaaaccaugggauaaaugcc

SEQ ID NO: 1233041 - RNA, 21 nt, Human
uaaaccaugggauaaaugcca

SEQ ID NO: 1233042 - RNA, 22 nt, Human
uaaaccaugggauaaaugccau

SEQ ID NO: 1233043 - RNA, 17 nt, Human
uaaacgucuuaaauauu

SEQ ID NO: 1233044 - RNA, 13 nt, Human
uaaacgucuuaaa

SEQ ID NO: 1233045 - RNA, 17 nt, Human
uaacaaugcuguauuuu

SEQ ID NO: 1233046 - RNA, 15 nt, Human
uaacaaugcuguauu

SEQ ID NO: 1233047 - RNA, 16 nt, Human
uaacaacagcuggugc

SEQ ID NO: 1233048 - RNA, 20 nt, Human
uaaauguuuuuuuuuaaaga

SEQ ID NO: 1233049 - RNA, 23 nt, Human
uaaauguuuuuuuuuaaagacuu

SEQ ID NO: 1233050 - RNA, 22 nt, Human
aauacaauuuuguuucuguacu

SEQ ID NO: 1233051 - RNA, 23 nt, Human
aauacaauuuuguuucuguacuu

SEQ ID NO: 1233052 - RNA, 12 nt, Human
aauacaauuuug

SEQ ID NO: 1233053 - RNA, 13 nt, Human
aauacaauuuugu

SEQ ID NO: 1233054 - RNA, 15 nt, Human
aauacaauuuuguuu

SEQ ID NO: 1233055 - RNA, 17 nt, Human
aauacaauuuuguuucu

SEQ ID NO: 1233056 - RNA, 18 nt, Human
aauacaauuuuguuucug

SEQ ID NO: 1233057 - RNA, 20 nt, Human
aauacaauuuuguuucugua

SEQ ID NO: 1233058 - RNA, 23 nt, Human
uaaaucccauuauucaaaguugc

SEQ ID NO: 1233059 - RNA, 12 nt, Human
uaaauagcuuuu

SEQ ID NO: 1233060 - RNA, 23 nt, Human
uaaauagcuagacuggugacuga

SEQ ID NO: 1233061 - RNA, 13 nt, Human
uaaauacaauuuu

SEQ ID NO: 1233062 - RNA, 15 nt, Human
uaaauacaauuuugu

SEQ ID NO: 1233063 - RNA, 22 nt, Human
uaaauacaauuuuguuucugua

SEQ ID NO: 1233064 - RNA, 23 nt, Human
uaaauacaauuuuguuucuguac

SEQ ID NO: 1233065 - RNA, 22 nt, Human
aauaaaauccauacauuugugu

SEQ ID NO: 1233066 - RNA, 12 nt, Human
aauaaaaauaau

SEQ ID NO: 1233067 - RNA, 17 nt, Human
uaaagugacccugcucu

SEQ ID NO: 1233068 - RNA, 20 nt, Human
uaaagugacccugcucucac

SEQ ID NO: 1233069 - RNA, 14 nt, Human
aauaaaaaauuaug

SEQ ID NO: 1233070 - RNA, 15 nt, Human
aauaaaaaauuauga

SEQ ID NO: 1233071 - RNA, 16 nt, Human
aauaaaaaauuaugac

SEQ ID NO: 1233072 - RNA, 15 nt, Human
aauaacaauaaaaga

SEQ ID NO: 1233073 - RNA, 21 nt, Human
aauaaauagcuagacugguga

SEQ ID NO: 1233074 - RNA, 13 nt, Human
aauaaggaaaagu

SEQ ID NO: 1233075 - RNA, 15 nt, Human
aauaaggaaaaguuu

SEQ ID NO: 1233076 - RNA, 14 nt, Human
aauaauuauaugcu

SEQ ID NO: 1233077 - RNA, 15 nt, Human
aauaauuauaugcua

SEQ ID NO: 1233078 - RNA, 20 nt, Human
aauaauuauaugcuauuucu

SEQ ID NO: 1233079 - RNA, 21 nt, Human
aauaauuauaugcuauuucua

SEQ ID NO: 1233080 - RNA, 22 nt, Human
aauaauuauaugcuauuucuau

SEQ ID NO: 1233081 - RNA, 23 nt, Human
aauaauuauaugcuauuucuaua

SEQ ID NO: 1233082 - RNA, 16 nt, Human
aauaaggaaaaguuua

SEQ ID NO: 1233083 - RNA, 19 nt, Human
aauaaggaaaaguuuaaua

SEQ ID NO: 1233084 - RNA, 22 nt, Human
aauaaggaaaaguuuaauauua

SEQ ID NO: 1233085 - RNA, 16 nt, Human
guuguaaaccaaguga

SEQ ID NO: 1233086 - RNA, 10 nt, Human
guuucuguac

SEQ ID NO: 1233087 - RNA, 19 nt, Human
guuugcaucugaaaauuga

SEQ ID NO: 1233088 - RNA, 15 nt, Human
guuucuguacuuuuu

SEQ ID NO: 1233089 - RNA, 22 nt, Human
guuuuauaauuuugugaagcaa

SEQ ID NO: 1233090 - RNA, 15 nt, Human
guuuuauaauuuugu

SEQ ID NO: 1233091 - RNA, 22 nt, Human
aagucuuauauauuguagauaa

SEQ ID NO: 1233092 - RNA, 19 nt, Human
aagugacuuuggcugcaug

SEQ ID NO: 1233093 - RNA, 23 nt, Human
guuuuuuuuuaaaaaagaaacau

SEQ ID NO: 1233094 - RNA, 15 nt, Human
guuuuuuuuuaaaga

SEQ ID NO: 1233095 - RNA, 17 nt, Human
guuuuuuuguuauuaaa

SEQ ID NO: 1233096 - RNA, 23 nt, Human
aaguauguuagugcaaauuguca

SEQ ID NO: 1233097 - RNA, 13 nt, Human
aaguauuaagcau

SEQ ID NO: 1233098 - RNA, 14 nt, Human
aaguauuaagcaua

SEQ ID NO: 1233099 - RNA, 20 nt, Human
aagucacauuccugaacagg

SEQ ID NO: 1233100 - RNA, 23 nt, Human
aaggagcagagcugauggagaag

SEQ ID NO: 1233101 - RNA, 13 nt, Human
aaggaggacccag

SEQ ID NO: 1233102 - RNA, 14 nt, Human
aaggaggacccagg

SEQ ID NO: 1233103 - RNA, 15 nt, Human
aaggaggacccagga

SEQ ID NO: 1233104 - RNA, 17 nt, Human
aaggaggacccaggaca

SEQ ID NO: 1233105 - RNA, 18 nt, Human
aaggaggacccaggacag

SEQ ID NO: 1233106 - RNA, 21 nt, Human
aaggaggacccaggacaggau

SEQ ID NO: 1233107 - RNA, 22 nt, Human
aaggaggacccaggacaggauc

SEQ ID NO: 1233108 - RNA, 13 nt, Human
aaggauaaugaau

SEQ ID NO: 1233109 - RNA, 23 nt, Human
aaggauaaaguugguaaaccuuu

SEQ ID NO: 1233110 - RNA, 21 nt, Human
aaggauaaaguugguaaaccu

SEQ ID NO: 1233111 - RNA, 17 nt, Human
aaggaaggcagggagga

SEQ ID NO: 1233112 - RNA, 17 nt, Human
aaggaaggcuccaucuc

SEQ ID NO: 1233113 - RNA, 22 nt, Human
aaggagcaagucagaauagaaa

SEQ ID NO: 1233114 - RNA, 20 nt, Human
aaggccugguguuucuugau

SEQ ID NO: 1233115 - RNA, 13 nt, Human
guugacaugggac

SEQ ID NO: 1233116 - RNA, 13 nt, Human
guugaauuuuaca

SEQ ID NO: 1233117 - RNA, 16 nt, Human
aaggaaaaaauaacaa

SEQ ID NO: 1233118 - RNA, 19 nt, Human
aaggaaaaaauaacaauga

SEQ ID NO: 1233119 - RNA, 16 nt, Human
aagcuuuuaugugaaa

SEQ ID NO: 1233120 - RNA, 19 nt, Human
uaacaaugcuguauuuuaa

SEQ ID NO: 1233121 - RNA, 23 nt, Human
aauacaucccuuaccugggaaag

SEQ ID NO: 1233122 - RNA, 18 nt, Human
uaauacuugcuuuggaaa

SEQ ID NO: 1233123 - RNA, 13 nt, Human
uaaucuuucacag

SEQ ID NO: 1233124 - RNA, 17 nt, Human
uaaucuuuaauuuuaca

SEQ ID NO: 1233125 - RNA, 22 nt, Human
uaauccaagcaaaugugaauca

SEQ ID NO: 1233126 - RNA, 15 nt, Human
uaauguaagacaaau

SEQ ID NO: 1233127 - RNA, 13 nt, Human
uaauuauaucuga

SEQ ID NO: 1233128 - RNA, 17 nt, Human
uaauuauaucugaggaa

SEQ ID NO: 1233129 - RNA, 21 nt, Human
uaauuauaugcuauuucuaua

SEQ ID NO: 1233130 - RNA, 13 nt, Human
uaauucauguugc

SEQ ID NO: 1233131 - RNA, 13 nt, Human
aauguaagacaaa

SEQ ID NO: 1233132 - RNA, 20 nt, Human
uacaguggggaaugaagaua

SEQ ID NO: 1233133 - RNA, 18 nt, Human
aauuaacauguuaaacca

SEQ ID NO: 1233134 - RNA, 19 nt, Human
aauuaacauguuaaaccau

SEQ ID NO: 1233135 - RNA, 17 nt, Human
uacauguacugauuacu

SEQ ID NO: 1233136 - RNA, 15 nt, Human
uacauuguauauaug

SEQ ID NO: 1233137 - RNA, 20 nt, Human
aauuaagaaaggauaaaguu

SEQ ID NO: 1233138 - RNA, 19 nt, Human
aauuaacaugaauauuuag

SEQ ID NO: 1233139 - RNA, 13 nt, Human
aauuaacauguua

SEQ ID NO: 1233140 - RNA, 14 nt, Human
aauuaacauguuaa

SEQ ID NO: 1233141 - RNA, 18 nt, Human
aauguugacaugggacau

SEQ ID NO: 1233142 - RNA, 23 nt, Human
uaccccaccucccucaaccucau

SEQ ID NO: 1233143 - RNA, 14 nt, Human
acaaaaagaaaaga

SEQ ID NO: 1233144 - RNA, 18 nt, Human
acaaaaagaaaagaaaau

SEQ ID NO: 1233145 - RNA, 19 nt, Human
uagaugcaguucugaagaa

SEQ ID NO: 1233146 - RNA, 17 nt, Human
uagaugcaguucugaag

SEQ ID NO: 1233147 - RNA, 21 nt, Human
uagaggaagccugauuaaaga

SEQ ID NO: 1233148 - RNA, 20 nt, Human
uagaugcaguucugaagaag

SEQ ID NO: 1233149 - RNA, 21 nt, Human
uagcaugucgucaaagcugaa

SEQ ID NO: 1233150 - RNA, 18 nt, Human
acaagcacuaaacaaaga

SEQ ID NO: 1233151 - RNA, 18 nt, Human
acaaauucugucucugga

SEQ ID NO: 1233152 - RNA, 19 nt, Human
uagcauuuguguugaagag

SEQ ID NO: 1233153 - RNA, 20 nt, Human
aauuuuuuucaccuagauuu

SEQ ID NO: 1233154 - RNA, 19 nt, Human
acaaaaaaaaaauuugcca

SEQ ID NO: 1233155 - RNA, 22 nt, Human
aauuuuuucucuaggaaauauu

SEQ ID NO: 1233156 - RNA, 13 nt, Human
aauuuuuuucacc

SEQ ID NO: 1233157 - RNA, 19 nt, Human
aauuuuuucucuaggaaau

SEQ ID NO: 1233158 - RNA, 19 nt, Human
aauuuuuauauuugaaaua

SEQ ID NO: 1233159 - RNA, 15 nt, Human
uagacaauugaggua

SEQ ID NO: 1233160 - RNA, 18 nt, Human
uagacaauugagguaagu

SEQ ID NO: 1233161 - RNA, 19 nt, Human
uagaauuugauaugugaac

SEQ ID NO: 1233162 - RNA, 23 nt, Human
uagaagucacauuccugaacagg

SEQ ID NO: 1233163 - RNA, 14 nt, Human
uagaaccucuuugu

SEQ ID NO: 1233164 - RNA, 16 nt, Human
uacuucaugcugucua

SEQ ID NO: 1233165 - RNA, 21 nt, Human
uacuucaaauccuugaagauu

SEQ ID NO: 1233166 - RNA, 14 nt, Human
uagaagagagaggu

SEQ ID NO: 1233167 - RNA, 22 nt, Human
uagaagagagagguugaaaaac

SEQ ID NO: 1233168 - RNA, 20 nt, Human
aauuguguuuauaauuuuaa

SEQ ID NO: 1233169 - RNA, 13 nt, Human
uacuguaagaaaa

SEQ ID NO: 1233170 - RNA, 23 nt, Human
aauugugugaaagguacuucaaa

SEQ ID NO: 1233171 - RNA, 16 nt, Human
aauuuaaauagcuuuu

SEQ ID NO: 1233172 - RNA, 15 nt, Human
aauuuaaauagcuuu

SEQ ID NO: 1233173 - RNA, 18 nt, Human
aauuugauaugugaacag

SEQ ID NO: 1233174 - RNA, 16 nt, Human
aauuugauaugugaac

SEQ ID NO: 1233175 - RNA, 15 nt, Human
aauuugauaugugaa

SEQ ID NO: 1233176 - RNA, 19 nt, Human
aauuugauaugugaacagu

SEQ ID NO: 1233177 - RNA, 19 nt, Human
uacuucaaauccuugaaga

SEQ ID NO: 1233178 - RNA, 14 nt, Human
uacuucaaauccuu

SEQ ID NO: 1233179 - RNA, 20 nt, Human
aauuugaaacacuuugcaua

SEQ ID NO: 1233180 - RNA, 13 nt, Human
aauuugaauuuug

SEQ ID NO: 1233181 - RNA, 16 nt, Human
aauuugaauuuugugu

SEQ ID NO: 1233182 - RNA, 18 nt, Human
aauuugaauuuuguguua

SEQ ID NO: 1233183 - RNA, 18 nt, Human
uacgugcucugugggucu

SEQ ID NO: 1233184 - RNA, 20 nt, Human
uacuagucaccagagacuuu

SEQ ID NO: 1233185 - RNA, 21 nt, Human
uacuagucaccagagacuuua

SEQ ID NO: 1233186 - RNA, 22 nt, Human
uacuagucaccagagacuuuag

SEQ ID NO: 1233187 - RNA, 22 nt, Human
uacucuuauaucuauauuuuac

SEQ ID NO: 1233188 - RNA, 20 nt, Human
uacucuuauaucuauauuuu

SEQ ID NO: 1233189 - RNA, 12 nt, Human
uacucaauuuua

SEQ ID NO: 1233190 - RNA, 13 nt, Human
uacucaauuuuaa

SEQ ID NO: 1233191 - RNA, 14 nt, Human
uacucaauuuuaac

SEQ ID NO: 1233192 - RNA, 21 nt, Human
aauucuugccaaauauaaaua

SEQ ID NO: 1233193 - RNA, 11 nt, Human
aauucuucccu

SEQ ID NO: 1233194 - RNA, 21 nt, Human
aauucuucccuaucuuugcca

SEQ ID NO: 1233195 - RNA, 19 nt, Human
aauucuuaugccauauaau

SEQ ID NO: 1233196 - RNA, 14 nt, Human
aauucuuucauuuu

SEQ ID NO: 1233197 - RNA, 17 nt, Human
aauucuuuaaaauuaca

SEQ ID NO: 1233198 - RNA, 22 nt, Human
aauucuuuaaaauuacaacuaa

SEQ ID NO: 1233199 - RNA, 15 nt, Human
acacaugaaguccaa

SEQ ID NO: 1233200 - RNA, 23 nt, Human
uauaaaauaauuuuuauauuuga

SEQ ID NO: 1233201 - RNA, 19 nt, Human
uauaaaagccuguuuaaga

SEQ ID NO: 1233202 - RNA, 22 nt, Human
uauaaaauaauuuuuauauuug

SEQ ID NO: 1233203 - RNA, 21 nt, Human
uauaaaauaauuuuuauauuu

SEQ ID NO: 1233204 - RNA, 14 nt, Human
uauaaaagccuguu

SEQ ID NO: 1233205 - RNA, 17 nt, Human
uauaaaagccuguuuaa

SEQ ID NO: 1233206 - RNA, 12 nt, Human
uauaaaagccug

SEQ ID NO: 1233207 - RNA, 21 nt, Human
acaccuacuagucaccagaga

SEQ ID NO: 1233208 - RNA, 22 nt, Human
acaagcucacagaccuuugaac

SEQ ID NO: 1233209 - RNA, 22 nt, Human
uagugagcagucaggaaagaga

SEQ ID NO: 1233210 - RNA, 18 nt, Human
uagucucuuuaaaaggaa

SEQ ID NO: 1233211 - RNA, 16 nt, Human
uagucucuuuaaaagg

SEQ ID NO: 1233212 - RNA, 16 nt, Human
uaguuuuauaugcuuc

SEQ ID NO: 1233213 - RNA, 14 nt, Human
uauagcuaaguaca

SEQ ID NO: 1233214 - RNA, 23 nt, Human
uauauauuuuuuucugaaauuuc

SEQ ID NO: 1233215 - RNA, 22 nt, Human
uauauauuuuuuucugaaauuu

SEQ ID NO: 1233216 - RNA, 21 nt, Human
uauauauuuuuuucugaaauu

SEQ ID NO: 1233217 - RNA, 16 nt, Human
uauauauagcagcuuu

SEQ ID NO: 1233218 - RNA, 13 nt, Human
uauauaucaaaua

SEQ ID NO: 1233219 - RNA, 19 nt, Human
uauaauuuugugaagcaaa

SEQ ID NO: 1233220 - RNA, 12 nt, Human
uauaccaauaaa

SEQ ID NO: 1233221 - RNA, 13 nt, Human
uauaccaauaaag

SEQ ID NO: 1233222 - RNA, 15 nt, Human
uauaccaauaaagug

SEQ ID NO: 1233223 - RNA, 14 nt, Human
uauaccaauaaagu

SEQ ID NO: 1233224 - RNA, 14 nt, Human
uauacccacccaga

SEQ ID NO: 1233225 - RNA, 20 nt, Human
uauagauuagaauucuguau

SEQ ID NO: 1233226 - RNA, 19 nt, Human
uauagauuagagaguguug

SEQ ID NO: 1233227 - RNA, 22 nt, Human
uauagauuagagaguguugaaa

SEQ ID NO: 1233228 - RNA, 14 nt, Human
uauaauuuugugaa

SEQ ID NO: 1233229 - RNA, 15 nt, Human
uaucuugaauaaugu

SEQ ID NO: 1233230 - RNA, 10 nt, Human
uaugauccag

SEQ ID NO: 1233231 - RNA, 11 nt, Human
uaugauccagc

SEQ ID NO: 1233232 - RNA, 19 nt, Human
uaugauccagcagauuauu

SEQ ID NO: 1233233 - RNA, 20 nt, Human
uaugauccagcagauuauuc

SEQ ID NO: 1233234 - RNA, 21 nt, Human
uaugauccagcagauuauuca

SEQ ID NO: 1233235 - RNA, 22 nt, Human
uaugauccagcagauuauucac

SEQ ID NO: 1233236 - RNA, 15 nt, Human
uaugcugaguuugug

SEQ ID NO: 1233237 - RNA, 22 nt, Human
uauggccugugagcuaggaauu

SEQ ID NO: 1233238 - RNA, 14 nt, Human
uauggccuguggau

SEQ ID NO: 1233239 - RNA, 15 nt, Human
acagcuccaagaauu

SEQ ID NO: 1233240 - RNA, 19 nt, Human
uauauuuacuaaaauggac

SEQ ID NO: 1233241 - RNA, 15 nt, Human
uauauuuacaaaugg

SEQ ID NO: 1233242 - RNA, 14 nt, Human
uauauuuacaaaug

SEQ ID NO: 1233243 - RNA, 20 nt, Human
uaucaccugucuugccuuuu

SEQ ID NO: 1233244 - RNA, 16 nt, Human
uauauugauccagaaa

SEQ ID NO: 1233245 - RNA, 23 nt, Human
acaguucggugagcuacaaaugc

SEQ ID NO: 1233246 - RNA, 19 nt, Human
acaguucggugagcuacaa

SEQ ID NO: 1233247 - RNA, 22 nt, Human
acaguucggugagcuacaaaug

SEQ ID NO: 1233248 - RNA, 14 nt, Human
uauuggcuuuucug

SEQ ID NO: 1233249 - RNA, 15 nt, Human
uauuggcuuuucuga

SEQ ID NO: 1233250 - RNA, 16 nt, Human
uauuggcuuuucugau

SEQ ID NO: 1233251 - RNA, 17 nt, Human
uauuggcuuuucugauc

SEQ ID NO: 1233252 - RNA, 18 nt, Human
uauuggcuuuucugaucc

SEQ ID NO: 1233253 - RNA, 21 nt, Human
uauuggcuuuucugauccagu

SEQ ID NO: 1233254 - RNA, 22 nt, Human
uauuggcuuuucugauccaguu

SEQ ID NO: 1233255 - RNA, 18 nt, Human
uauuuacuaaaauggacu

SEQ ID NO: 1233256 - RNA, 14 nt, Human
uauuuaauucaugu

SEQ ID NO: 1233257 - RNA, 19 nt, Human
uauuuaguguucauaaaua

SEQ ID NO: 1233258 - RNA, 18 nt, Human
uauuuauuuuaauaaugu

SEQ ID NO: 1233259 - RNA, 16 nt, Human
uauuuauuuuaauaau

SEQ ID NO: 1233260 - RNA, 14 nt, Human
uauuuauuuuaaua

SEQ ID NO: 1233261 - RNA, 14 nt, Human
uauuuaauagguuu

SEQ ID NO: 1233262 - RNA, 18 nt, Human
uauuuaaccucuaaauuc

SEQ ID NO: 1233263 - RNA, 17 nt, Human
uauuuaaccucuaaauu

SEQ ID NO: 1233264 - RNA, 17 nt, Human
uauugucuagugaaacu

SEQ ID NO: 1233265 - RNA, 21 nt, Human
uauuguagcauccuggaauau

SEQ ID NO: 1233266 - RNA, 20 nt, Human
uauuguagcauccuggaaua

SEQ ID NO: 1233267 - RNA, 18 nt, Human
uauuguagcauccuggaa

SEQ ID NO: 1233268 - RNA, 17 nt, Human
uauuguagcauccugga

SEQ ID NO: 1233269 - RNA, 16 nt, Human
uauuguauauuacaau

SEQ ID NO: 1233270 - RNA, 17 nt, Human
uauuguauauuacaaug

SEQ ID NO: 1233271 - RNA, 19 nt, Human
uauuguauauuacaaugau

SEQ ID NO: 1233272 - RNA, 15 nt, Human
uauuguacaaaguau

SEQ ID NO: 1233273 - RNA, 16 nt, Human
uauuguacaaaguauu

SEQ ID NO: 1233274 - RNA, 21 nt, Human
uauuguacaaaguauuaagca

SEQ ID NO: 1233275 - RNA, 22 nt, Human
uauuguacaaaguauuaagcau

SEQ ID NO: 1233276 - RNA, 23 nt, Human
uauuguacaaaguauuaagcaua

SEQ ID NO: 1233277 - RNA, 23 nt, Human
acaguauaauuaacauguuaaac

SEQ ID NO: 1233278 - RNA, 21 nt, Human
acaguauaauuaacauguuaa

SEQ ID NO: 1233279 - RNA, 20 nt, Human
acagugaaagaaaauaacaa

SEQ ID NO: 1233280 - RNA, 21 nt, Human
acaguuaccucugccucagaa

SEQ ID NO: 1233281 - RNA, 18 nt, Human
uauucaaaguugccuaaa

SEQ ID NO: 1233282 - RNA, 21 nt, Human
uauucaaaguugccuaaaucc

SEQ ID NO: 1233283 - RNA, 22 nt, Human
uauucaaaguugccuaaaucca

SEQ ID NO: 1233284 - RNA, 23 nt, Human
uauucaaaguugccuaaauccau

SEQ ID NO: 1233285 - RNA, 11 nt, Human
uauucaauaaa

SEQ ID NO: 1233286 - RNA, 13 nt, Human
uauucacugauuu

SEQ ID NO: 1233287 - RNA, 19 nt, Human
uauucacugauuugacaua

SEQ ID NO: 1233288 - RNA, 22 nt, Human
uauucacugauuugacauaguc

SEQ ID NO: 1233289 - RNA, 15 nt, Human
uauucagcucaugga

SEQ ID NO: 1233290 - RNA, 22 nt, Human
uauuagcccuucuccauggccc

SEQ ID NO: 1233291 - RNA, 12 nt, Human
uauuaaagccau

SEQ ID NO: 1233292 - RNA, 13 nt, Human
uauuaaagccaug

SEQ ID NO: 1233293 - RNA, 14 nt, Human
uauuaaagccaugu

SEQ ID NO: 1233294 - RNA, 23 nt, Human
uauuacaguggggaaugaagaua

SEQ ID NO: 1233295 - RNA, 16 nt, Human
uauuacaguauaauua

SEQ ID NO: 1233296 - RNA, 18 nt, Human
uauuacaguauaauuaac

SEQ ID NO: 1233297 - RNA, 20 nt, Human
uauuacaguauaauuaacau

SEQ ID NO: 1233298 - RNA, 21 nt, Human
uauuacaguauaauuaacaug

SEQ ID NO: 1233299 - RNA, 17 nt, Human
uauuaaagccauguuua

SEQ ID NO: 1233300 - RNA, 18 nt, Human
uauuaaagccauguuuau

SEQ ID NO: 1233301 - RNA, 20 nt, Human
uauuaaagccauguuuauua

SEQ ID NO: 1233302 - RNA, 21 nt, Human
uauguuuucaggcuagaugua

SEQ ID NO: 1233303 - RNA, 17 nt, Human
acagcuggugcccugcu

SEQ ID NO: 1233304 - RNA, 20 nt, Human
acagcuggugcccugcuuuc

SEQ ID NO: 1233305 - RNA, 19 nt, Human
acccacuugcuuuuaaaau

SEQ ID NO: 1233306 - RNA, 18 nt, Human
acccagaaugagacaucc

SEQ ID NO: 1233307 - RNA, 20 nt, Human
acccagaaugagacauccag

SEQ ID NO: 1233308 - RNA, 19 nt, Human
acccagaaugagacaucca

SEQ ID NO: 1233309 - RNA, 23 nt, Human
accacuuguguuuugcaagccag

SEQ ID NO: 1233310 - RNA, 19 nt, Human
accacuuguguuuugcaag

SEQ ID NO: 1233311 - RNA, 19 nt, Human
ucagccuggcuucaaauug

SEQ ID NO: 1233312 - RNA, 13 nt, Human
ucagauuuuauua

SEQ ID NO: 1233313 - RNA, 14 nt, Human
ucagauuuuauuau

SEQ ID NO: 1233314 - RNA, 15 nt, Human
ucagauuuuauuaug

SEQ ID NO: 1233315 - RNA, 10 nt, Human
acccaggaca

SEQ ID NO: 1233316 - RNA, 11 nt, Human
acccaggacag

SEQ ID NO: 1233317 - RNA, 14 nt, Human
acccaggacaggau

SEQ ID NO: 1233318 - RNA, 19 nt, Human
acccagguuggagugcagu

SEQ ID NO: 1233319 - RNA, 20 nt, Human
acccagguuggagugcagug

SEQ ID NO: 1233320 - RNA, 16 nt, Human
ucagauuuuauuaugu

SEQ ID NO: 1233321 - RNA, 19 nt, Human
ucagauuuuauuauguaaa

SEQ ID NO: 1233322 - RNA, 20 nt, Human
ucagauuuuauuauguaaau

SEQ ID NO: 1233323 - RNA, 22 nt, Human
ucagauuuuauuauguaaaucc

SEQ ID NO: 1233324 - RNA, 18 nt, Human
acccuccaccgcagaagg

SEQ ID NO: 1233325 - RNA, 20 nt, Human
acccuccaccgcagaaggaa

SEQ ID NO: 1233326 - RNA, 21 nt, Human
acccuccaccgcagaaggaag

SEQ ID NO: 1233327 - RNA, 20 nt, Human
ucaggaagagaaggagcaga

SEQ ID NO: 1233328 - RNA, 15 nt, Human
ucaggaagagaagga

SEQ ID NO: 1233329 - RNA, 16 nt, Human
ucaggaagagaaggag

SEQ ID NO: 1233330 - RNA, 13 nt, Human
uccacucuuucuu

SEQ ID NO: 1233331 - RNA, 15 nt, Human
uccacucuuucuuuc

SEQ ID NO: 1233332 - RNA, 16 nt, Human
uccacucuuucuuuca

SEQ ID NO: 1233333 - RNA, 14 nt, Human
accuuagaauacag

SEQ ID NO: 1233334 - RNA, 12 nt, Human
accuuccaccca

SEQ ID NO: 1233335 - RNA, 14 nt, Human
accuuccacccagu

SEQ ID NO: 1233336 - RNA, 21 nt, Human
uccaacuaucucauuuccaag

SEQ ID NO: 1233337 - RNA, 23 nt, Human
uccaaagucucuggaauuugaaa

SEQ ID NO: 1233338 - RNA, 20 nt, Human
ucauuuuagggguagcauuu

SEQ ID NO: 1233339 - RNA, 13 nt, Human
accucaauguccc

SEQ ID NO: 1233340 - RNA, 12 nt, Human
accuagauuuuu

SEQ ID NO: 1233341 - RNA, 12 nt, Human
accggaccaucu

SEQ ID NO: 1233342 - RNA, 18 nt, Human
accucuaaauucuuucau

SEQ ID NO: 1233343 - RNA, 21 nt, Human
accucuaaauucuuucauuuu

SEQ ID NO: 1233344 - RNA, 12 nt, Human
accucucaauau

SEQ ID NO: 1233345 - RNA, 14 nt, Human
ucaugugaaaucau

SEQ ID NO: 1233346 - RNA, 16 nt, Human
ucaugugaaaucauuc

SEQ ID NO: 1233347 - RNA, 22 nt, Human
ucaugaauuaguuuuauaugcu

SEQ ID NO: 1233348 - RNA, 14 nt, Human
ucaugaccaguaaa

SEQ ID NO: 1233349 - RNA, 15 nt, Human
ucaugaccaguaaag

SEQ ID NO: 1233350 - RNA, 15 nt, Human
ucaugcauggaaauu

SEQ ID NO: 1233351 - RNA, 19 nt, Human
uccagccuggggcugaggc

SEQ ID NO: 1233352 - RNA, 22 nt, Human
acuaugaaguuuuuuuuauaca

SEQ ID NO: 1233353 - RNA, 17 nt, Human
acuauauuguuugcuaa

SEQ ID NO: 1233354 - RNA, 18 nt, Human
ucccucaaccucauccuc

SEQ ID NO: 1233355 - RNA, 19 nt, Human
ucccucaaccucauccucu

SEQ ID NO: 1233356 - RNA, 12 nt, Human
ucccucacccau

SEQ ID NO: 1233357 - RNA, 18 nt, Human
ucccucacccauccuaga

SEQ ID NO: 1233358 - RNA, 14 nt, Human
ucccucacccaucc

SEQ ID NO: 1233359 - RNA, 14 nt, Human
uccgugcuaaggac

SEQ ID NO: 1233360 - RNA, 15 nt, Human
uccgugcuaaggacu

SEQ ID NO: 1233361 - RNA, 16 nt, Human
uccgugcuaaggacuu

SEQ ID NO: 1233362 - RNA, 16 nt, Human
acucaucuagguaaau

SEQ ID NO: 1233363 - RNA, 18 nt, Human
acucaucuagguaaauua

SEQ ID NO: 1233364 - RNA, 21 nt, Human
acucaucuagguaaauuacag

SEQ ID NO: 1233365 - RNA, 18 nt, Human
acuccugaccucaaguga

SEQ ID NO: 1233366 - RNA, 22 nt, Human
acucuccauuuaauaauuauau

SEQ ID NO: 1233367 - RNA, 23 nt, Human
acucuuauaucuauauuuuacau

SEQ ID NO: 1233368 - RNA, 16 nt, Human
acugcaaccuccaccu

SEQ ID NO: 1233369 - RNA, 17 nt, Human
acugcaaccuccaccuc

SEQ ID NO: 1233370 - RNA, 20 nt, Human
acugcaaccuccaccucgca

SEQ ID NO: 1233371 - RNA, 14 nt, Human
acugaggaucagag

SEQ ID NO: 1233372 - RNA, 16 nt, Human
acugcaaccucugccu

SEQ ID NO: 1233373 - RNA, 13 nt, Human
acuggauuguacu

SEQ ID NO: 1233374 - RNA, 16 nt, Human
acuggauuguacuuug

SEQ ID NO: 1233375 - RNA, 22 nt, Human
acugccuucucaacuccaaacu

SEQ ID NO: 1233376 - RNA, 11 nt, Human
acugccuuuga

SEQ ID NO: 1233377 - RNA, 13 nt, Human
acugccuuugacc

SEQ ID NO: 1233378 - RNA, 23 nt, Human
acugcgcccuuaacugcauccag

SEQ ID NO: 1233379 - RNA, 21 nt, Human
acugcucuccuccaccucaac

SEQ ID NO: 1233380 - RNA, 18 nt, Human
uccuucagcacuuuagaa

SEQ ID NO: 1233381 - RNA, 15 nt, Human
uccuucagcacuuua

SEQ ID NO: 1233382 - RNA, 14 nt, Human
uccuucccugcugu

SEQ ID NO: 1233383 - RNA, 19 nt, Human
acuguaaucuuauuuagga

SEQ ID NO: 1233384 - RNA, 22 nt, Human
acuguaaucuuauuuaggaagu

SEQ ID NO: 1233385 - RNA, 16 nt, Human
acuguaaggcaaucau

SEQ ID NO: 1233386 - RNA, 20 nt, Human
agcacuuuagaauaugccuu

SEQ ID NO: 1233387 - RNA, 14 nt, Human
agcacuuuagaaua

SEQ ID NO: 1233388 - RNA, 21 nt, Human
agcacuuuagaauaugccuug

SEQ ID NO: 1233389 - RNA, 11 nt, Human
agcagacauuu

SEQ ID NO: 1233390 - RNA, 16 nt, Human
agcaccaaucaugaau

SEQ ID NO: 1233391 - RNA, 22 nt, Human
agcacagccucuuagaugcagu

SEQ ID NO: 1233392 - RNA, 15 nt, Human
agcacagugaucaag

SEQ ID NO: 1233393 - RNA, 14 nt, Human
ugaggaauucugua

SEQ ID NO: 1233394 - RNA, 15 nt, Human
ugaggaauucuguau

SEQ ID NO: 1233395 - RNA, 16 nt, Human
ugaggaauucuguaua

SEQ ID NO: 1233396 - RNA, 18 nt, Human
ugaggaauucuguauaga

SEQ ID NO: 1233397 - RNA, 19 nt, Human
ugaggaauucuguauagau

SEQ ID NO: 1233398 - RNA, 12 nt, Human
ugaggacacaug

SEQ ID NO: 1233399 - RNA, 13 nt, Human
ugaggacacaugu

SEQ ID NO: 1233400 - RNA, 14 nt, Human
ugaggacacauguc

SEQ ID NO: 1233401 - RNA, 15 nt, Human
ugaggacacaugucc

SEQ ID NO: 1233402 - RNA, 15 nt, Human
ugaggacacugauau

SEQ ID NO: 1233403 - RNA, 16 nt, Human
ugaggacacaugucca

SEQ ID NO: 1233404 - RNA, 13 nt, Human
ugaggccagacca

SEQ ID NO: 1233405 - RNA, 13 nt, Human
ugagcuacaaaug

SEQ ID NO: 1233406 - RNA, 14 nt, Human
ugagcuacaaaugc

SEQ ID NO: 1233407 - RNA, 16 nt, Human
ugagcuacaaaugcau

SEQ ID NO: 1233408 - RNA, 14 nt, Human
ugagcuaggaauug

SEQ ID NO: 1233409 - RNA, 16 nt, Human
ugaggggcuaccagga

SEQ ID NO: 1233410 - RNA, 17 nt, Human
ugaggggcuaccaggaa

SEQ ID NO: 1233411 - RNA, 19 nt, Human
ugaggggcuaccaggaaag

SEQ ID NO: 1233412 - RNA, 17 nt, Human
agcagagcugauggaga

SEQ ID NO: 1233413 - RNA, 19 nt, Human
agcagagcugauggagaag

SEQ ID NO: 1233414 - RNA, 21 nt, Human
agcagagcugauggagaagga

SEQ ID NO: 1233415 - RNA, 22 nt, Human
agcagagcugauggagaaggaa

SEQ ID NO: 1233416 - RNA, 23 nt, Human
agcagagcugauggagaaggaag

SEQ ID NO: 1233417 - RNA, 14 nt, Human
agcagauuauucac

SEQ ID NO: 1233418 - RNA, 15 nt, Human
agcagauuauucacu

SEQ ID NO: 1233419 - RNA, 16 nt, Human
agcagauuauucacug

SEQ ID NO: 1233420 - RNA, 19 nt, Human
agcagauuauucacugauu

SEQ ID NO: 1233421 - RNA, 20 nt, Human
agcagauuauucacugauuu

SEQ ID NO: 1233422 - RNA, 15 nt, Human
ugagguaaguuuuuu

SEQ ID NO: 1233423 - RNA, 16 nt, Human
agauuuaccacuugug

SEQ ID NO: 1233424 - RNA, 14 nt, Human
agauuuaugcauau

SEQ ID NO: 1233425 - RNA, 14 nt, Human
agauuuuccugaaa

SEQ ID NO: 1233426 - RNA, 21 nt, Human
agauuuuauuauguaaauccc

SEQ ID NO: 1233427 - RNA, 22 nt, Human
agauuuuauuauguaaauccca

SEQ ID NO: 1233428 - RNA, 15 nt, Human
agcaaaaauauuuua

SEQ ID NO: 1233429 - RNA, 17 nt, Human
agcaaaaauauuuuaug

SEQ ID NO: 1233430 - RNA, 18 nt, Human
agcaaaaauauuuuauga

SEQ ID NO: 1233431 - RNA, 19 nt, Human
agcaaaaauauuuuaugau

SEQ ID NO: 1233432 - RNA, 23 nt, Human
agcaaaaauauuuuaugauccag

SEQ ID NO: 1233433 - RNA, 15 nt, Human
ugacuguuuccauca

SEQ ID NO: 1233434 - RNA, 22 nt, Human
agauucaaugccccugaauuua

SEQ ID NO: 1233435 - RNA, 21 nt, Human
agauucaaugccccugaauuu

SEQ ID NO: 1233436 - RNA, 16 nt, Human
agauuauucacugauu

SEQ ID NO: 1233437 - RNA, 23 nt, Human
agauuauauauauuuuuuucuga

SEQ ID NO: 1233438 - RNA, 15 nt, Human
agauguguucacaau

SEQ ID NO: 1233439 - RNA, 18 nt, Human
agauguguucacaaugga

SEQ ID NO: 1233440 - RNA, 17 nt, Human
ugaauuuauuggcuuuu

SEQ ID NO: 1233441 - RNA, 12 nt, Human
ugaauuuauugg

SEQ ID NO: 1233442 - RNA, 15 nt, Human
ugaauuuauuggcuu

SEQ ID NO: 1233443 - RNA, 16 nt, Human
ugaauuuauuggcuuu

SEQ ID NO: 1233444 - RNA, 12 nt, Human
ugacauuuuaca

SEQ ID NO: 1233445 - RNA, 14 nt, Human
ugacauuuuacauu

SEQ ID NO: 1233446 - RNA, 15 nt, Human
ugacauuuuacauua

SEQ ID NO: 1233447 - RNA, 16 nt, Human
ugacauuuuacauuaa

SEQ ID NO: 1233448 - RNA, 21 nt, Human
agaucauugugaaauuauuca

SEQ ID NO: 1233449 - RNA, 11 nt, Human
ugaauggcuuu

SEQ ID NO: 1233450 - RNA, 18 nt, Human
agagucuauuuacggaac

SEQ ID NO: 1233451 - RNA, 16 nt, Human
ugaagcuuuuauguga

SEQ ID NO: 1233452 - RNA, 18 nt, Human
ugaagguggaaauaaacu

SEQ ID NO: 1233453 - RNA, 12 nt, Human
ucuuuguaauga

SEQ ID NO: 1233454 - RNA, 16 nt, Human
ucuuuguaaugaaaac

SEQ ID NO: 1233455 - RNA, 13 nt, Human
ucuuuguaaugaa

SEQ ID NO: 1233456 - RNA, 15 nt, Human
ucuuuguaaugaaaa

SEQ ID NO: 1233457 - RNA, 20 nt, Human
ugaagaagcaccaaucauga

SEQ ID NO: 1233458 - RNA, 14 nt, Human
ugaagaagauggua

SEQ ID NO: 1233459 - RNA, 22 nt, Human
ugaagaagcaccaaucaugaau

SEQ ID NO: 1233460 - RNA, 21 nt, Human
agaggcgcaugaauuugugaa

SEQ ID NO: 1233461 - RNA, 15 nt, Human
agagaaugagagaca

SEQ ID NO: 1233462 - RNA, 17 nt, Human
agagacacacugaagaa

SEQ ID NO: 1233463 - RNA, 20 nt, Human
agagacacacugaagaagca

SEQ ID NO: 1233464 - RNA, 18 nt, Human
agagacacacugaagaag

SEQ ID NO: 1233465 - RNA, 18 nt, Human
ucuuuaauuuuggaauuu

SEQ ID NO: 1233466 - RNA, 14 nt, Human
ucuuuaauuuugga

SEQ ID NO: 1233467 - RNA, 15 nt, Human
ucuuuaauuuuggaa

SEQ ID NO: 1233468 - RNA, 16 nt, Human
ucuuuaauuuuggaau

SEQ ID NO: 1233469 - RNA, 17 nt, Human
ucuuuaauuuuggaauu

SEQ ID NO: 1233470 - RNA, 15 nt, Human
ucuuuaaaauuacaa

SEQ ID NO: 1233471 - RNA, 20 nt, Human
ucuuuaaaauuacaacuaag

SEQ ID NO: 1233472 - RNA, 14 nt, Human
ucuugaugccuggc

SEQ ID NO: 1233473 - RNA, 20 nt, Human
ucuugaugccuggcggggug

SEQ ID NO: 1233474 - RNA, 21 nt, Human
ucuucccuggaaaccuuccac

SEQ ID NO: 1233475 - RNA, 22 nt, Human
ucuuagaugcaguucugaagaa

SEQ ID NO: 1233476 - RNA, 19 nt, Human
ucuuaauauguucuuuuaa

SEQ ID NO: 1233477 - RNA, 21 nt, Human
agaauuugauaugugaacagu

SEQ ID NO: 1233478 - RNA, 20 nt, Human
agaauuugauaugugaacag

SEQ ID NO: 1233479 - RNA, 19 nt, Human
agaauuugauaugugaaca

SEQ ID NO: 1233480 - RNA, 18 nt, Human
agaauuugauaugugaac

SEQ ID NO: 1233481 - RNA, 17 nt, Human
agaauuugauaugugaa

SEQ ID NO: 1233482 - RNA, 20 nt, Human
agacagaaucucagucuguc

SEQ ID NO: 1233483 - RNA, 11 nt, Human
agaaggaaggc

SEQ ID NO: 1233484 - RNA, 17 nt, Human
agaaggaaggcagggag

SEQ ID NO: 1233485 - RNA, 19 nt, Human
agaaggaaggcagggagga

SEQ ID NO: 1233486 - RNA, 20 nt, Human
agaaggaaggcagggaggag

SEQ ID NO: 1233487 - RNA, 21 nt, Human
agaaggaaggcagggaggagg

SEQ ID NO: 1233488 - RNA, 16 nt, Human
ucuguauagauuagag

SEQ ID NO: 1233489 - RNA, 14 nt, Human
ucuggucucgaacu

SEQ ID NO: 1233490 - RNA, 17 nt, Human
ucuguauagauuagaau

SEQ ID NO: 1233491 - RNA, 16 nt, Human
ucuguucauuccucca

SEQ ID NO: 1233492 - RNA, 17 nt, Human
ucuguucauuccuccag

SEQ ID NO: 1233493 - RNA, 21 nt, Human
agaauuucuaggacugaauua

SEQ ID NO: 1233494 - RNA, 13 nt, Human
agaauuucuagga

SEQ ID NO: 1233495 - RNA, 18 nt, Human
ucuguuuuauaauuuugu

SEQ ID NO: 1233496 - RNA, 20 nt, Human
ucuguuuuauaauuuuguga

SEQ ID NO: 1233497 - RNA, 17 nt, Human
agaaaaauauauacuaa

SEQ ID NO: 1233498 - RNA, 19 nt, Human
agaaaacaaggaugaauua

SEQ ID NO: 1233499 - RNA, 20 nt, Human
agaaagaacggaagaagaga

SEQ ID NO: 1233500 - RNA, 19 nt, Human
agaaaacuuguauuaugug

SEQ ID NO: 1233501 - RNA, 13 nt, Human
agaaacccugcac

SEQ ID NO: 1233502 - RNA, 18 nt, Human
ucucccaaaaaacuacuu

SEQ ID NO: 1233503 - RNA, 12 nt, Human
ucuccauuuaau

SEQ ID NO: 1233504 - RNA, 16 nt, Human
ucuccauuuaauaauu

SEQ ID NO: 1233505 - RNA, 19 nt, Human
ucuccauuuaauaauuaua

SEQ ID NO: 1233506 - RNA, 19 nt, Human
ucuccauugugccuaaguc

SEQ ID NO: 1233507 - RNA, 23 nt, Human
acuuguguaaauacaauuuuguu

SEQ ID NO: 1233508 - RNA, 21 nt, Human
acuuguguaaauacaauuuug

SEQ ID NO: 1233509 - RNA, 22 nt, Human
acuuguguaaauacaauuuugu

SEQ ID NO: 1233510 - RNA, 14 nt, Human
acuuuggcugcaug

SEQ ID NO: 1233511 - RNA, 17 nt, Human
acuuuggcugcaugcga

SEQ ID NO: 1233512 - RNA, 14 nt, Human
acuuuuggcauuuu

SEQ ID NO: 1233513 - RNA, 12 nt, Human
acuuuuugcagc

SEQ ID NO: 1233514 - RNA, 13 nt, Human
acuuuuugcagcu

SEQ ID NO: 1233515 - RNA, 15 nt, Human
acuuuuugcagcuuu

SEQ ID NO: 1233516 - RNA, 17 nt, Human
acuuuuugcagcuuucu

SEQ ID NO: 1233517 - RNA, 22 nt, Human
acuuuuuuuuuuuaagaguaaa

SEQ ID NO: 1233518 - RNA, 22 nt, Human
agaaccucuuugucuacaccau

SEQ ID NO: 1233519 - RNA, 17 nt, Human
ucugauacagaaaaguu

SEQ ID NO: 1233520 - RNA, 16 nt, Human
ucugauacagaaaagu

SEQ ID NO: 1233521 - RNA, 19 nt, Human
ucugaggggcuaccaggaa

SEQ ID NO: 1233522 - RNA, 20 nt, Human
ucugaggggcuaccaggaaa

SEQ ID NO: 1233523 - RNA, 21 nt, Human
ucugaggggcuaccaggaaag

SEQ ID NO: 1233524 - RNA, 13 nt, Human
ucugccuaaggac

SEQ ID NO: 1233525 - RNA, 14 nt, Human
ucugccuaaggacu

SEQ ID NO: 1233526 - RNA, 15 nt, Human
ucugccuaaggacuu

SEQ ID NO: 1233527 - RNA, 16 nt, Human
ucugccuaaggacuuc

SEQ ID NO: 1233528 - RNA, 16 nt, Human
agaagaaagaacggaa

SEQ ID NO: 1233529 - RNA, 18 nt, Human
agaagaaagaacggaaga

SEQ ID NO: 1233530 - RNA, 21 nt, Human
agaagaacugaaaucauacuu

SEQ ID NO: 1233531 - RNA, 12 nt, Human
ucuggauuauau

SEQ ID NO: 1233532 - RNA, 18 nt, Human
ucuggauuauauuaugaa

SEQ ID NO: 1233533 - RNA, 14 nt, Human
agaagcuccaggua

SEQ ID NO: 1233534 - RNA, 19 nt, Human
agcuauggugucauaggcu

SEQ ID NO: 1233535 - RNA, 11 nt, Human
agcuauauaag

SEQ ID NO: 1233536 - RNA, 17 nt, Human
agcuauauaagacaaga

SEQ ID NO: 1233537 - RNA, 21 nt, Human
ugccacaccccccaccccuag

SEQ ID NO: 1233538 - RNA, 23 nt, Human
ugccacaccccccaccccuagga

SEQ ID NO: 1233539 - RNA, 13 nt, Human
ugcagaaagcauc

SEQ ID NO: 1233540 - RNA, 20 nt, Human
ugcagaaagcaucccucacc

SEQ ID NO: 1233541 - RNA, 19 nt, Human
agcccuucuuuccacagaa

SEQ ID NO: 1233542 - RNA, 18 nt, Human
agcccuucuuuccacaga

SEQ ID NO: 1233543 - RNA, 14 nt, Human
agccugauuaaaga

SEQ ID NO: 1233544 - RNA, 16 nt, Human
agccugcacggugaau

SEQ ID NO: 1233545 - RNA, 18 nt, Human
agccugcacggugaaugg

SEQ ID NO: 1233546 - RNA, 21 nt, Human
ugcaggucccuaauaaagcug

SEQ ID NO: 1233547 - RNA, 18 nt, Human
ugcaggucccuaauaaag

SEQ ID NO: 1233548 - RNA, 19 nt, Human
ugcaggucccuaauaaagc

SEQ ID NO: 1233549 - RNA, 20 nt, Human
ugcaggucccuaauaaagcu

SEQ ID NO: 1233550 - RNA, 22 nt, Human
ugcauaacguauaaaagccugu

SEQ ID NO: 1233551 - RNA, 15 nt, Human
ugcauaauggucaga

SEQ ID NO: 1233552 - RNA, 17 nt, Human
aggaaagaggaagcaaa

SEQ ID NO: 1233553 - RNA, 16 nt, Human
ugcuaguaauuggaaa

SEQ ID NO: 1233554 - RNA, 19 nt, Human
aggaaagagaacuuccaga

SEQ ID NO: 1233555 - RNA, 13 nt, Human
aggaaagagaacu

SEQ ID NO: 1233556 - RNA, 12 nt, Human
aggaaagaaaac

SEQ ID NO: 1233557 - RNA, 13 nt, Human
aggaaagaaaaca

SEQ ID NO: 1233558 - RNA, 21 nt, Human
aggaaaaguuuaauauuaaag

SEQ ID NO: 1233559 - RNA, 23 nt, Human
aggaaaaguuuaauauuaaagcc

SEQ ID NO: 1233560 - RNA, 24 nt, Human
aggaaaaguuuaauauuaaagcca

SEQ ID NO: 1233561 - RNA, 21 nt, Human
agcuuauugucuagugaaacu

SEQ ID NO: 1233562 - RNA, 22 nt, Human
aggaauuuuauuuuuuucugaa

SEQ ID NO: 1233563 - RNA, 12 nt, Human
aggaagagaagg

SEQ ID NO: 1233564 - RNA, 14 nt, Human
aggaagagaaggag

SEQ ID NO: 1233565 - RNA, 16 nt, Human
aggaagagaaggagca

SEQ ID NO: 1233566 - RNA, 17 nt, Human
aggaagagaaggagcag

SEQ ID NO: 1233567 - RNA, 23 nt, Human
aggaauucuguauagauuagaau

SEQ ID NO: 1233568 - RNA, 16 nt, Human
aggaauucuguauaga

SEQ ID NO: 1233569 - RNA, 17 nt, Human
aggaauucuguauagau

SEQ ID NO: 1233570 - RNA, 22 nt, Human
aggaauucuguauagauuagaa

SEQ ID NO: 1233571 - RNA, 24 nt, Human
aggaaagcgccuccaacccuagca

SEQ ID NO: 1233572 - RNA, 18 nt, Human
aggaaauauuuauuuuaa

SEQ ID NO: 1233573 - RNA, 14 nt, Human
aggaaauauuuauu

SEQ ID NO: 1233574 - RNA, 17 nt, Human
agcucucaguugcagcc

SEQ ID NO: 1233575 - RNA, 21 nt, Human
agcucucaguugcagcccugc

SEQ ID NO: 1233576 - RNA, 14 nt, Human
agcugauggagaag

SEQ ID NO: 1233577 - RNA, 15 nt, Human
agcugauggagaagg

SEQ ID NO: 1233578 - RNA, 16 nt, Human
agcugauggagaagga

SEQ ID NO: 1233579 - RNA, 17 nt, Human
agcugauggagaaggaa

SEQ ID NO: 1233580 - RNA, 19 nt, Human
agcugauggagaaggaagg

SEQ ID NO: 1233581 - RNA, 16 nt, Human
ugccucucugcagguc

SEQ ID NO: 1233582 - RNA, 18 nt, Human
ugccucucugcagguccc

SEQ ID NO: 1233583 - RNA, 19 nt, Human
ugccucucugcaggucccu

SEQ ID NO: 1233584 - RNA, 20 nt, Human
ugccucucugcaggucccua

SEQ ID NO: 1233585 - RNA, 17 nt, Human
agcuggggccaggcugg

SEQ ID NO: 1233586 - RNA, 21 nt, Human
ugccucucugcaggucccuaa

SEQ ID NO: 1233587 - RNA, 15 nt, Human
agcugccucuucccu

SEQ ID NO: 1233588 - RNA, 19 nt, Human
agcugccucuucccucuuc

SEQ ID NO: 1233589 - RNA, 21 nt, Human
ugccuuuuucauuauuuuauu

SEQ ID NO: 1233590 - RNA, 14 nt, Human
ugccuuuuucauua

SEQ ID NO: 1233591 - RNA, 15 nt, Human
ugccuuuuucauuau

SEQ ID NO: 1233592 - RNA, 16 nt, Human
ugccuuuuucauuauu

SEQ ID NO: 1233593 - RNA, 17 nt, Human
ugccuuuuucauuauuu

SEQ ID NO: 1233594 - RNA, 13 nt, Human
ugccuuguuucau

SEQ ID NO: 1233595 - RNA, 13 nt, Human
ugccuuuuucauu

SEQ ID NO: 1233596 - RNA, 20 nt, Human
agcuggggccaggcuggguc

SEQ ID NO: 1233597 - RNA, 13 nt, Human
uggcagcaacaau

SEQ ID NO: 1233598 - RNA, 18 nt, Human
uggcaucaucucagcuca

SEQ ID NO: 1233599 - RNA, 20 nt, Human
aggcaggaguuucguuuuca

SEQ ID NO: 1233600 - RNA, 22 nt, Human
aggcagggaggaggcagagaag

SEQ ID NO: 1233601 - RNA, 20 nt, Human
aggcagcucuaaaugucaau

SEQ ID NO: 1233602 - RNA, 18 nt, Human
aggcaguucaaagcagga

SEQ ID NO: 1233603 - RNA, 19 nt, Human
aggcaguucaaagcaggau

SEQ ID NO: 1233604 - RNA, 17 nt, Human
uggacaccugcccugcc

SEQ ID NO: 1233605 - RNA, 18 nt, Human
uggacaccugcccugccc

SEQ ID NO: 1233606 - RNA, 23 nt, Human
uggacaccugcccugcccugcca

SEQ ID NO: 1233607 - RNA, 16 nt, Human
uggagaagaacugaaa

SEQ ID NO: 1233608 - RNA, 16 nt, Human
uggagcccacuguacu

SEQ ID NO: 1233609 - RNA, 19 nt, Human
uggagcccacuguacuugc

SEQ ID NO: 1233610 - RNA, 23 nt, Human
uggagcccacuguacuugcucuu

SEQ ID NO: 1233611 - RNA, 23 nt, Human
uggagccugcacggugaauggcu

SEQ ID NO: 1233612 - RNA, 14 nt, Human
uggaauuugaaaca

SEQ ID NO: 1233613 - RNA, 17 nt, Human
uggaauuuuccuccuuu

SEQ ID NO: 1233614 - RNA, 21 nt, Human
uggaauuuuccuccuuucucu

SEQ ID NO: 1233615 - RNA, 10 nt, Human
uggacaccug

SEQ ID NO: 1233616 - RNA, 11 nt, Human
uggacaccugc

SEQ ID NO: 1233617 - RNA, 12 nt, Human
uggacaccugcc

SEQ ID NO: 1233618 - RNA, 13 nt, Human
uggacaccugccc

SEQ ID NO: 1233619 - RNA, 14 nt, Human
uggacaccugcccu

SEQ ID NO: 1233620 - RNA, 15 nt, Human
uggacaccugcccug

SEQ ID NO: 1233621 - RNA, 16 nt, Human
uggacaccugcccugc

SEQ ID NO: 1233622 - RNA, 14 nt, Human
uggacaaaauggaa

SEQ ID NO: 1233623 - RNA, 17 nt, Human
uggacaaaauggaauac

SEQ ID NO: 1233624 - RNA, 19 nt, Human
aggaguuucguuuucaaaa

SEQ ID NO: 1233625 - RNA, 14 nt, Human
uggaagugcuaauu

SEQ ID NO: 1233626 - RNA, 15 nt, Human
uggaagugacuuugg

SEQ ID NO: 1233627 - RNA, 17 nt, Human
uggaagugacuuuggcu

SEQ ID NO: 1233628 - RNA, 23 nt, Human
uggaagugacuuuggcugcaugc

SEQ ID NO: 1233629 - RNA, 15 nt, Human
agggcuccuauucaa

SEQ ID NO: 1233630 - RNA, 22 nt, Human
agggcuguuauaaucuuucaca

SEQ ID NO: 1233631 - RNA, 15 nt, Human
ugggagaaaugaaaa

SEQ ID NO: 1233632 - RNA, 13 nt, Human
agggaaauuucag

SEQ ID NO: 1233633 - RNA, 21 nt, Human
agggagacuggguaggaaaga

SEQ ID NO: 1233634 - RNA, 16 nt, Human
ugggagaaaugaaaaa

SEQ ID NO: 1233635 - RNA, 14 nt, Human
ugggaggcucugga

SEQ ID NO: 1233636 - RNA, 17 nt, Human
ugggaggcucuggagcc

SEQ ID NO: 1233637 - RNA, 23 nt, Human
ugggaggcucuggagcccacugu

SEQ ID NO: 1233638 - RNA, 14 nt, Human
ugggcauucaaaug

SEQ ID NO: 1233639 - RNA, 15 nt, Human
aggcuuuuuuaucau

SEQ ID NO: 1233640 - RNA, 18 nt, Human
aggcuuuuuuaucaugug

SEQ ID NO: 1233641 - RNA, 21 nt, Human
aggcuuuuuuaucaugugaaa

SEQ ID NO: 1233642 - RNA, 15 nt, Human
agggaaaacauucca

SEQ ID NO: 1233643 - RNA, 16 nt, Human
agggaaaacauuccau

SEQ ID NO: 1233644 - RNA, 18 nt, Human
agggaaaacauuccaucc

SEQ ID NO: 1233645 - RNA, 10 nt, Human
aggcuggguc

SEQ ID NO: 1233646 - RNA, 15 nt, Human
aggcugggucgcccu

SEQ ID NO: 1233647 - RNA, 18 nt, Human
aggcugggucgcccugga

SEQ ID NO: 1233648 - RNA, 20 nt, Human
aggcugggucgcccuggacu

SEQ ID NO: 1233649 - RNA, 21 nt, Human
aggcugggucgcccuggacug

SEQ ID NO: 1233650 - RNA, 18 nt, Human
ugggaaacaaaaggauaa

SEQ ID NO: 1233651 - RNA, 14 nt, Human
uguacauauaagug

SEQ ID NO: 1233652 - RNA, 20 nt, Human
agguuucacuguguuggcca

SEQ ID NO: 1233653 - RNA, 13 nt, Human
agguugaaaaaca

SEQ ID NO: 1233654 - RNA, 13 nt, Human
aguaauuggaaag

SEQ ID NO: 1233655 - RNA, 12 nt, Human
aguaauuggaaa

SEQ ID NO: 1233656 - RNA, 13 nt, Human
aguaaugauaacu

SEQ ID NO: 1233657 - RNA, 16 nt, Human
aguaaaaacaaagaaa

SEQ ID NO: 1233658 - RNA, 23 nt, Human
aguaaaaacaaagaaauuaugug

SEQ ID NO: 1233659 - RNA, 14 nt, Human
aguaaaaaggcuaa

SEQ ID NO: 1233660 - RNA, 14 nt, Human
uguauauuacaaug

SEQ ID NO: 1233661 - RNA, 15 nt, Human
uguauauuacaauga

SEQ ID NO: 1233662 - RNA, 19 nt, Human
uguaguguuggagaagaac

SEQ ID NO: 1233663 - RNA, 18 nt, Human
uguaguguuggagaagaa

SEQ ID NO: 1233664 - RNA, 17 nt, Human
uguaguguuggagaaga

SEQ ID NO: 1233665 - RNA, 23 nt, Human
aguaccaguaggggcuuauaaua

SEQ ID NO: 1233666 - RNA, 15 nt, Human
agucaggaaagagaa

SEQ ID NO: 1233667 - RNA, 14 nt, Human
agucaggaaagaga

SEQ ID NO: 1233668 - RNA, 20 nt, Human
agucuauuuacggaacucaa

SEQ ID NO: 1233669 - RNA, 15 nt, Human
agucuauuuacggaa

SEQ ID NO: 1233670 - RNA, 12 nt, Human
aguauuaagcau

SEQ ID NO: 1233671 - RNA, 14 nt, Human
aguauuaagcauau

SEQ ID NO: 1233672 - RNA, 19 nt, Human
uguauauuacaaugaucac

SEQ ID NO: 1233673 - RNA, 13 nt, Human
aguauaauuaaca

SEQ ID NO: 1233674 - RNA, 14 nt, Human
aguauaauuaacau

SEQ ID NO: 1233675 - RNA, 16 nt, Human
aguauaauuaacaugu

SEQ ID NO: 1233676 - RNA, 23 nt, Human
aguauaauuaacauguuaaacca

SEQ ID NO: 1233677 - RNA, 14 nt, Human
agucaccagagacu

SEQ ID NO: 1233678 - RNA, 16 nt, Human
agucuugucucagauu

SEQ ID NO: 1233679 - RNA, 17 nt, Human
agucuugucucagauuu

SEQ ID NO: 1233680 - RNA, 19 nt, Human
agucuugucucagauuuua

SEQ ID NO: 1233681 - RNA, 16 nt, Human
agucuuucacauuuaa

SEQ ID NO: 1233682 - RNA, 20 nt, Human
agucuugucucagauuuuau

SEQ ID NO: 1233683 - RNA, 21 nt, Human
agucuugucucagauuuuauu

SEQ ID NO: 1233684 - RNA, 18 nt, Human
agucuuucacauuuaaau

SEQ ID NO: 1233685 - RNA, 12 nt, Human
agugagaggcug

SEQ ID NO: 1233686 - RNA, 18 nt, Human
agugacuuuggcugcaug

SEQ ID NO: 1233687 - RNA, 20 nt, Human
ugugcugguguaugugugaa

SEQ ID NO: 1233688 - RNA, 21 nt, Human
uguggaucaaauccagccugc

SEQ ID NO: 1233689 - RNA, 21 nt, Human
ugugcucaggagcccugggag

SEQ ID NO: 1233690 - RNA, 21 nt, Human
agugaguuggguguauugugc

SEQ ID NO: 1233691 - RNA, 14 nt, Human
agugcaaauuguca

SEQ ID NO: 1233692 - RNA, 23 nt, Human
agugcaguggcgcgaucucagcu

SEQ ID NO: 1233693 - RNA, 23 nt, Human
agugcaguggcgugaucucagcu

SEQ ID NO: 1233694 - RNA, 23 nt, Human
agugcaguggcaucaucucagcu

SEQ ID NO: 1233695 - RNA, 21 nt, Human
agugcacuaauguguaagaca

SEQ ID NO: 1233696 - RNA, 17 nt, Human
agugcacuaauguguaa

SEQ ID NO: 1233697 - RNA, 18 nt, Human
agugccagcaccugccca

SEQ ID NO: 1233698 - RNA, 22 nt, Human
uguugcccacagcuguaugauu

SEQ ID NO: 1233699 - RNA, 15 nt, Human
uguugcauagaauaa

SEQ ID NO: 1233700 - RNA, 18 nt, Human
aguguguguuuuucauaa

SEQ ID NO: 1233701 - RNA, 19 nt, Human
aguguguguuuuucauaaa

SEQ ID NO: 1233702 - RNA, 16 nt, Human
uguuaugacuauguaa

SEQ ID NO: 1233703 - RNA, 17 nt, Human
uguuaugacuauguaaa

SEQ ID NO: 1233704 - RNA, 18 nt, Human
uguuaugacuauguaaac

SEQ ID NO: 1233705 - RNA, 20 nt, Human
uguuaugacuauguaaacua

SEQ ID NO: 1233706 - RNA, 16 nt, Human
uguguuagagauuuuu

SEQ ID NO: 1233707 - RNA, 17 nt, Human
uguuacaaauuguagaa

SEQ ID NO: 1233708 - RNA, 18 nt, Human
uguuacaaauuguagaag

SEQ ID NO: 1233709 - RNA, 16 nt, Human
aguggggaaugaagau

SEQ ID NO: 1233710 - RNA, 14 nt, Human
auacuauaguacca

SEQ ID NO: 1233711 - RNA, 19 nt, Human
uuauauuugaaauauugac

SEQ ID NO: 1233712 - RNA, 19 nt, Human
auacgugggcauucaaaug

SEQ ID NO: 1233713 - RNA, 18 nt, Human
auacgugggcauucaaau

SEQ ID NO: 1233714 - RNA, 12 nt, Human
uuauaaacuuuu

SEQ ID NO: 1233715 - RNA, 16 nt, Human
uuauaaacuuuuuucu

SEQ ID NO: 1233716 - RNA, 22 nt, Human
uuauaaacuuuuuucuuacugu

SEQ ID NO: 1233717 - RNA, 21 nt, Human
auacaguucggugagcuacaa

SEQ ID NO: 1233718 - RNA, 22 nt, Human
auacauguaauucuaccaaggu

SEQ ID NO: 1233719 - RNA, 21 nt, Human
auacaggaugaugacuaugga

SEQ ID NO: 1233720 - RNA, 21 nt, Human
uuaugaauuacauuuguauaa

SEQ ID NO: 1233721 - RNA, 17 nt, Human
uuaugaauuacauuugu

SEQ ID NO: 1233722 - RNA, 16 nt, Human
uuaugaauuacauuug

SEQ ID NO: 1233723 - RNA, 14 nt, Human
uuaugaauuacauu

SEQ ID NO: 1233724 - RNA, 15 nt, Human
uuaugacuauguaaa

SEQ ID NO: 1233725 - RNA, 16 nt, Human
uuaugacuauguaaac

SEQ ID NO: 1233726 - RNA, 20 nt, Human
uuaugauacuugaaaauuaa

SEQ ID NO: 1233727 - RNA, 13 nt, Human
uuaugauccagca

SEQ ID NO: 1233728 - RNA, 18 nt, Human
uuaugauccagcagauua

SEQ ID NO: 1233729 - RNA, 19 nt, Human
uuaugaaacuuuuggaagg

SEQ ID NO: 1233730 - RNA, 20 nt, Human
uuaugaagcuuuuaugugaa

SEQ ID NO: 1233731 - RNA, 18 nt, Human
uuaugaaacuuuuggaag

SEQ ID NO: 1233732 - RNA, 17 nt, Human
uuaugaaacuuuuggaa

SEQ ID NO: 1233733 - RNA, 14 nt, Human
uuaugaaacuuuug

SEQ ID NO: 1233734 - RNA, 19 nt, Human
uuaugaaacuuguguaaau

SEQ ID NO: 1233735 - RNA, 13 nt, Human
uuaugaaacuugu

SEQ ID NO: 1233736 - RNA, 16 nt, Human
uuaugaaacuugugua

SEQ ID NO: 1233737 - RNA, 18 nt, Human
uuaugaaacuuguguaaa

SEQ ID NO: 1233738 - RNA, 22 nt, Human
uuaugauuaaguaaugauaacu

SEQ ID NO: 1233739 - RNA, 19 nt, Human
uuaugauuaaguaaugaua

SEQ ID NO: 1233740 - RNA, 22 nt, Human
uuaugauccagcagauuauuca

SEQ ID NO: 1233741 - RNA, 23 nt, Human
uuaugauccagcagauuauucac

SEQ ID NO: 1233742 - RNA, 11 nt, Human
uuauguaaauc

SEQ ID NO: 1233743 - RNA, 12 nt, Human
uuauguaaaucc

SEQ ID NO: 1233744 - RNA, 13 nt, Human
uuauguaaauccc

SEQ ID NO: 1233745 - RNA, 19 nt, Human
uuauguaaaucccauuauu

SEQ ID NO: 1233746 - RNA, 21 nt, Human
uuauguaaaucccauuauuca

SEQ ID NO: 1233747 - RNA, 22 nt, Human
uuauguaaaucccauuauucaa

SEQ ID NO: 1233748 - RNA, 23 nt, Human
uuauguaaaucccauuauucaaa

SEQ ID NO: 1233749 - RNA, 15 nt, Human
uuaugugaaacaugu

SEQ ID NO: 1233750 - RNA, 14 nt, Human
uuaugugacauuuu

SEQ ID NO: 1233751 - RNA, 19 nt, Human
uuaugugacauuuuacauu

SEQ ID NO: 1233752 - RNA, 22 nt, Human
uuaugugccagauuuaugcaua

SEQ ID NO: 1233753 - RNA, 20 nt, Human
uuaugugacauuuuacauua

SEQ ID NO: 1233754 - RNA, 16 nt, Human
uuaugugcgcugauaa

SEQ ID NO: 1233755 - RNA, 13 nt, Human
uuaugugaaacau

SEQ ID NO: 1233756 - RNA, 13 nt, Human
uuauuauguaaau

SEQ ID NO: 1233757 - RNA, 14 nt, Human
uuauuauguaaauc

SEQ ID NO: 1233758 - RNA, 16 nt, Human
uuauuauguaaauccc

SEQ ID NO: 1233759 - RNA, 22 nt, Human
uuauuauguaaaucccauuauu

SEQ ID NO: 1233760 - RNA, 13 nt, Human
uuauucaaaguug

SEQ ID NO: 1233761 - RNA, 15 nt, Human
uuauucaaaguugcc

SEQ ID NO: 1233762 - RNA, 19 nt, Human
uuauucaaaguugccuaaa

SEQ ID NO: 1233763 - RNA, 14 nt, Human
uuauucacugauuu

SEQ ID NO: 1233764 - RNA, 12 nt, Human
uuauucauaauu

SEQ ID NO: 1233765 - RNA, 23 nt, Human
uuauuaugaaacuuguguaaaua

SEQ ID NO: 1233766 - RNA, 17 nt, Human
uuauuaugaaacuugug

SEQ ID NO: 1233767 - RNA, 20 nt, Human
uuauuaugaaacuuguguaa

SEQ ID NO: 1233768 - RNA, 21 nt, Human
uuauuaugaaacuuguguaaa

SEQ ID NO: 1233769 - RNA, 22 nt, Human
uuauuaugaaacuuguguaaau

SEQ ID NO: 1233770 - RNA, 15 nt, Human
uuauuauauuuacaa

SEQ ID NO: 1233771 - RNA, 11 nt, Human
uuauuaugaaa

SEQ ID NO: 1233772 - RNA, 19 nt, Human
uuauguuaaaacugggaca

SEQ ID NO: 1233773 - RNA, 14 nt, Human
uuauuauauuuaca

SEQ ID NO: 1233774 - RNA, 17 nt, Human
uuauguugcauagaaua

SEQ ID NO: 1233775 - RNA, 18 nt, Human
auacucuuauaucuauau

SEQ ID NO: 1233776 - RNA, 14 nt, Human
auacucuuauaucu

SEQ ID NO: 1233777 - RNA, 15 nt, Human
auacuggauuguacu

SEQ ID NO: 1233778 - RNA, 14 nt, Human
auagacaauugagg

SEQ ID NO: 1233779 - RNA, 21 nt, Human
auagacaauugagguaaguuu

SEQ ID NO: 1233780 - RNA, 12 nt, Human
auagacacgcac

SEQ ID NO: 1233781 - RNA, 14 nt, Human
auagaauaaaauuu

SEQ ID NO: 1233782 - RNA, 19 nt, Human
auagaauaaaauuuuuaau

SEQ ID NO: 1233783 - RNA, 22 nt, Human
auagaauaaaauuuuuaaucuu

SEQ ID NO: 1233784 - RNA, 13 nt, Human
auagaaguaaaaa

SEQ ID NO: 1233785 - RNA, 14 nt, Human
auagaaccucuuug

SEQ ID NO: 1233786 - RNA, 20 nt, Human
auagaaccucuuugucuaca

SEQ ID NO: 1233787 - RNA, 14 nt, Human
auagagacgggacu

SEQ ID NO: 1233788 - RNA, 18 nt, Human
auagauaggucagugcaa

SEQ ID NO: 1233789 - RNA, 21 nt, Human
auagaggaagccugauuaaag

SEQ ID NO: 1233790 - RNA, 22 nt, Human
auagaggaagccugauuaaaga

SEQ ID NO: 1233791 - RNA, 13 nt, Human
auagauuagaauu

SEQ ID NO: 1233792 - RNA, 15 nt, Human
auagauuagaauucu

SEQ ID NO: 1233793 - RNA, 16 nt, Human
auagauuagaauucug

SEQ ID NO: 1233794 - RNA, 21 nt, Human
auagauuagagaguguugaaa

SEQ ID NO: 1233795 - RNA, 22 nt, Human
auagauuagagaguguugaaac

SEQ ID NO: 1233796 - RNA, 15 nt, Human
aguuuguugaaacac

SEQ ID NO: 1233797 - RNA, 16 nt, Human
uuaaauuuuuuuuaca

SEQ ID NO: 1233798 - RNA, 17 nt, Human
uuaaauuuuuuuuacau

SEQ ID NO: 1233799 - RNA, 21 nt, Human
uuaaaccaugggauaaaugcc

SEQ ID NO: 1233800 - RNA, 22 nt, Human
uuaaaccaugggauaaaugcca

SEQ ID NO: 1233801 - RNA, 23 nt, Human
uuaaaccaugggauaaaugccau

SEQ ID NO: 1233802 - RNA, 13 nt, Human
uuaaaguugaauu

SEQ ID NO: 1233803 - RNA, 16 nt, Human
uuaaaguugaauuuau

SEQ ID NO: 1233804 - RNA, 17 nt, Human
uuaaaguugaauuuauu

SEQ ID NO: 1233805 - RNA, 22 nt, Human
uuaaaguugaauuuauuggcuu

SEQ ID NO: 1233806 - RNA, 12 nt, Human
uuaaaaugagaa

SEQ ID NO: 1233807 - RNA, 19 nt, Human
uuaaaaugagaaaucuaaa

SEQ ID NO: 1233808 - RNA, 17 nt, Human
uuaaaccaugggauaaa

SEQ ID NO: 1233809 - RNA, 16 nt, Human
aguuuagcuggaaaag

SEQ ID NO: 1233810 - RNA, 15 nt, Human
aguuuagcuggaaaa

SEQ ID NO: 1233811 - RNA, 17 nt, Human
aguuuaaauuguaauag

SEQ ID NO: 1233812 - RNA, 20 nt, Human
aguuuaaauuguaauaggcg

SEQ ID NO: 1233813 - RNA, 19 nt, Human
uuaagacgaaacauuuguu

SEQ ID NO: 1233814 - RNA, 22 nt, Human
auaaaagggacugagaaauuua

SEQ ID NO: 1233815 - RNA, 23 nt, Human
aguuuuuugaaauuaugugacau

SEQ ID NO: 1233816 - RNA, 20 nt, Human
auaaaagccuguuuaagaga

SEQ ID NO: 1233817 - RNA, 16 nt, Human
aguuuuauaugcuucu

SEQ ID NO: 1233818 - RNA, 12 nt, Human
aguuuuguuugg

SEQ ID NO: 1233819 - RNA, 14 nt, Human
aguuuuguuuggac

SEQ ID NO: 1233820 - RNA, 16 nt, Human
aguuuuguuuggacca

SEQ ID NO: 1233821 - RNA, 18 nt, Human
aguuuuguuuggaccaaa

SEQ ID NO: 1233822 - RNA, 21 nt, Human
aguuuuuugaaauuaugugac

SEQ ID NO: 1233823 - RNA, 15 nt, Human
aguuuuuuuuauaca

SEQ ID NO: 1233824 - RNA, 22 nt, Human
uuaagagagucuauuuacggaa

SEQ ID NO: 1233825 - RNA, 22 nt, Human
uuaagacgaaacauuuguucua

SEQ ID NO: 1233826 - RNA, 16 nt, Human
uuaauuugguuuucac

SEQ ID NO: 1233827 - RNA, 13 nt, Human
uuaauuuuggaau

SEQ ID NO: 1233828 - RNA, 14 nt, Human
uuaauuuuggaauu

SEQ ID NO: 1233829 - RNA, 15 nt, Human
uuaauuuuggaauuu

SEQ ID NO: 1233830 - RNA, 13 nt, Human
uuaaucuuuaauu

SEQ ID NO: 1233831 - RNA, 17 nt, Human
uuaaucuuuaauuuuac

SEQ ID NO: 1233832 - RNA, 23 nt, Human
uuacuguacagacagaaaaaacu

SEQ ID NO: 1233833 - RNA, 20 nt, Human
uuacugcuuaauucaaauaa

SEQ ID NO: 1233834 - RNA, 17 nt, Human
uuacugucuuuuuucua

SEQ ID NO: 1233835 - RNA, 14 nt, Human
uuagaauucuguau

SEQ ID NO: 1233836 - RNA, 15 nt, Human
uuagaauucuguaua

SEQ ID NO: 1233837 - RNA, 17 nt, Human
uuagaauucuguauaga

SEQ ID NO: 1233838 - RNA, 17 nt, Human
uuacaguggggaaugaa

SEQ ID NO: 1233839 - RNA, 15 nt, Human
auaaaucugugaacu

SEQ ID NO: 1233840 - RNA, 16 nt, Human
auaaaucugugaacuu

SEQ ID NO: 1233841 - RNA, 19 nt, Human
auaaaucugugaacuugaa

SEQ ID NO: 1233842 - RNA, 17 nt, Human
auaaaugccaucaauaa

SEQ ID NO: 1233843 - RNA, 18 nt, Human
auaaaugccaucaauaaa

SEQ ID NO: 1233844 - RNA, 15 nt, Human
uuauaaaaauaaaaa

SEQ ID NO: 1233845 - RNA, 19 nt, Human
uuaguacuccccuccuuga

SEQ ID NO: 1233846 - RNA, 21 nt, Human
uuauaaaaauaaaaaacacug

SEQ ID NO: 1233847 - RNA, 22 nt, Human
uuauaaaaauaaaaaacacugg

SEQ ID NO: 1233848 - RNA, 17 nt, Human
uuagguaauuuuuuuca

SEQ ID NO: 1233849 - RNA, 13 nt, Human
uuaguaaucauau

SEQ ID NO: 1233850 - RNA, 14 nt, Human
uuaguaaucauauu

SEQ ID NO: 1233851 - RNA, 16 nt, Human
uuaggguuaugauuaa

SEQ ID NO: 1233852 - RNA, 14 nt, Human
uuaggguuaugauu

SEQ ID NO: 1233853 - RNA, 21 nt, Human
auaaucuuucacaggggacag

SEQ ID NO: 1233854 - RNA, 14 nt, Human
auaaucuuucacag

SEQ ID NO: 1233855 - RNA, 23 nt, Human
auaauucacauuguauucagagu

SEQ ID NO: 1233856 - RNA, 14 nt, Human
auaauuuagauggu

SEQ ID NO: 1233857 - RNA, 12 nt, Human
auaauuuuaaau

SEQ ID NO: 1233858 - RNA, 13 nt, Human
auaauuuuaaaug

SEQ ID NO: 1233859 - RNA, 14 nt, Human
auaauuuuaaaugu

SEQ ID NO: 1233860 - RNA, 17 nt, Human
augaauuacauuuguau

SEQ ID NO: 1233861 - RNA, 16 nt, Human
augaauuacauuugua

SEQ ID NO: 1233862 - RNA, 21 nt, Human
augaauauuuaguguucauaa

SEQ ID NO: 1233863 - RNA, 15 nt, Human
augaauuacauuugu

SEQ ID NO: 1233864 - RNA, 13 nt, Human
augaacuugagga

SEQ ID NO: 1233865 - RNA, 15 nt, Human
augaacuugaggaca

SEQ ID NO: 1233866 - RNA, 15 nt, Human
augaagauacugaaa

SEQ ID NO: 1233867 - RNA, 16 nt, Human
augaauauuuaguguu

SEQ ID NO: 1233868 - RNA, 18 nt, Human
augaacuuguaaaggaau

SEQ ID NO: 1233869 - RNA, 16 nt, Human
augaacuugaggacac

SEQ ID NO: 1233870 - RNA, 17 nt, Human
augaacuugaggacaca

SEQ ID NO: 1233871 - RNA, 18 nt, Human
augaacuugaggacacau

SEQ ID NO: 1233872 - RNA, 19 nt, Human
augaacuugaggacacaug

SEQ ID NO: 1233873 - RNA, 20 nt, Human
augaacuugaggacacaugu

SEQ ID NO: 1233874 - RNA, 21 nt, Human
augaacuugaggacacauguc

SEQ ID NO: 1233875 - RNA, 22 nt, Human
augaacuugaggacacaugucc

SEQ ID NO: 1233876 - RNA, 22 nt, Human
aucugccuaaggacuucuuuaa

SEQ ID NO: 1233877 - RNA, 23 nt, Human
aucugccuaaggacuucuuuaau

SEQ ID NO: 1233878 - RNA, 11 nt, Human
aucugccuaag

SEQ ID NO: 1233879 - RNA, 13 nt, Human
aucugccuaagga

SEQ ID NO: 1233880 - RNA, 21 nt, Human
aucugccuaaggacuucuuua

SEQ ID NO: 1233881 - RNA, 15 nt, Human
aucugcgugugugca

SEQ ID NO: 1233882 - RNA, 15 nt, Human
uugcauuuauaugua

SEQ ID NO: 1233883 - RNA, 20 nt, Human
uugcauuuauauguaccgua

SEQ ID NO: 1233884 - RNA, 14 nt, Human
aucuuauaauuuaa

SEQ ID NO: 1233885 - RNA, 21 nt, Human
auccucuccacagcugccucu

SEQ ID NO: 1233886 - RNA, 17 nt, Human
uugaagggaaauuucag

SEQ ID NO: 1233887 - RNA, 16 nt, Human
uugagauguguucaca

SEQ ID NO: 1233888 - RNA, 16 nt, Human
uugagucaaaaaaucu

SEQ ID NO: 1233889 - RNA, 18 nt, Human
uugacuuauaguacauga

SEQ ID NO: 1233890 - RNA, 14 nt, Human
aucucauuuccaag

SEQ ID NO: 1233891 - RNA, 17 nt, Human
auccaguuuuguuugga

SEQ ID NO: 1233892 - RNA, 21 nt, Human
auccauuuggaaaucuuuaaa

SEQ ID NO: 1233893 - RNA, 15 nt, Human
uucuuuguaaugaaa

SEQ ID NO: 1233894 - RNA, 16 nt, Human
uucuuuguaaugaaaa

SEQ ID NO: 1233895 - RNA, 17 nt, Human
uugaaauuguauuacaa

SEQ ID NO: 1233896 - RNA, 15 nt, Human
uugaaauuguaauua

SEQ ID NO: 1233897 - RNA, 17 nt, Human
uugaaauuguaauuaua

SEQ ID NO: 1233898 - RNA, 17 nt, Human
uugaaauuaugugacau

SEQ ID NO: 1233899 - RNA, 20 nt, Human
uugaaauuaugugacauuuu

SEQ ID NO: 1233900 - RNA, 13 nt, Human
uugaaauuguaau

SEQ ID NO: 1233901 - RNA, 14 nt, Human
uugaaauuguaauu

SEQ ID NO: 1233902 - RNA, 21 nt, Human
aucaaucuguaaaacuaagaa

SEQ ID NO: 1233903 - RNA, 23 nt, Human
aucaccugucuugccuuuuucau

SEQ ID NO: 1233904 - RNA, 16 nt, Human
aucaaggguacacugc

SEQ ID NO: 1233905 - RNA, 19 nt, Human
uuccguagguuauuuucag

SEQ ID NO: 1233906 - RNA, 15 nt, Human
uuccugaacaggaua

SEQ ID NO: 1233907 - RNA, 20 nt, Human
uuccuaaauauauuuuaaga

SEQ ID NO: 1233908 - RNA, 13 nt, Human
uucuaaaguaaaa

SEQ ID NO: 1233909 - RNA, 22 nt, Human
aucacuugucaauaaaauccau

SEQ ID NO: 1233910 - RNA, 23 nt, Human
uucuaggacugaauuaugaaacu

SEQ ID NO: 1233911 - RNA, 16 nt, Human
uucuaggacugaauua

SEQ ID NO: 1233912 - RNA, 14 nt, Human
uucuaggacugaau

SEQ ID NO: 1233913 - RNA, 13 nt, Human
uucuaggacugaa

SEQ ID NO: 1233914 - RNA, 17 nt, Human
aucaggguuaguauugu

SEQ ID NO: 1233915 - RNA, 14 nt, Human
augggauaaaugcc

SEQ ID NO: 1233916 - RNA, 16 nt, Human
auggcacuaguauuuc

SEQ ID NO: 1233917 - RNA, 14 nt, Human
auggcacuaguauu

SEQ ID NO: 1233918 - RNA, 14 nt, Human
auggagaaggaagg

SEQ ID NO: 1233919 - RNA, 15 nt, Human
auggagaaggaaggc

SEQ ID NO: 1233920 - RNA, 19 nt, Human
uuucauuauuuuauuauga

SEQ ID NO: 1233921 - RNA, 20 nt, Human
uuucauuauuuuauuaugaa

SEQ ID NO: 1233922 - RNA, 18 nt, Human
uuucccccuagccugccu

SEQ ID NO: 1233923 - RNA, 13 nt, Human
uuucauuauuuua

SEQ ID NO: 1233924 - RNA, 15 nt, Human
uuucauuauuuuauu

SEQ ID NO: 1233925 - RNA, 12 nt, Human
auggagaaggaa

SEQ ID NO: 1233926 - RNA, 13 nt, Human
auggagaaggaag

SEQ ID NO: 1233927 - RNA, 16 nt, Human
auggacuguggugacu

SEQ ID NO: 1233928 - RNA, 17 nt, Human
auggacuguggugacuu

SEQ ID NO: 1233929 - RNA, 22 nt, Human
auggacuguggugacuuuggau

SEQ ID NO: 1233930 - RNA, 15 nt, Human
auggacacuacaccc

SEQ ID NO: 1233931 - RNA, 16 nt, Human
auggacacuacaccca

SEQ ID NO: 1233932 - RNA, 17 nt, Human
auggacacuacacccag

SEQ ID NO: 1233933 - RNA, 18 nt, Human
auggacacuacacccagc

SEQ ID NO: 1233934 - RNA, 19 nt, Human
auggacacuacacccagca

SEQ ID NO: 1233935 - RNA, 22 nt, Human
auggacacuacacccagcaaua

SEQ ID NO: 1233936 - RNA, 17 nt, Human
uuucaaacauauauaac

SEQ ID NO: 1233937 - RNA, 16 nt, Human
uuucaaacauauauaa

SEQ ID NO: 1233938 - RNA, 22 nt, Human
uuucaaaauuguuacaaauugu

SEQ ID NO: 1233939 - RNA, 18 nt, Human
auggaacgcguugaaauu

SEQ ID NO: 1233940 - RNA, 19 nt, Human
auggaacgcguugaaauug

SEQ ID NO: 1233941 - RNA, 20 nt, Human
uuuauuuuguguuuaggaac

SEQ ID NO: 1233942 - RNA, 23 nt, Human
auggaacgcguugaaauuguaau

SEQ ID NO: 1233943 - RNA, 13 nt, Human
uuucaaaagaaag

SEQ ID NO: 1233944 - RNA, 15 nt, Human
auggaacgcguugaa

SEQ ID NO: 1233945 - RNA, 16 nt, Human
auggaacgcguugaaa

SEQ ID NO: 1233946 - RNA, 17 nt, Human
auggaacgcguugaaau

SEQ ID NO: 1233947 - RNA, 19 nt, Human
augcuguucaugaaagauu

SEQ ID NO: 1233948 - RNA, 14 nt, Human
augcugugugacuc

SEQ ID NO: 1233949 - RNA, 23 nt, Human
augcuguucaugaaagauucaau

SEQ ID NO: 1233950 - RNA, 16 nt, Human
augcuucccuuuccug

SEQ ID NO: 1233951 - RNA, 17 nt, Human
augcuguucaugaaaga

SEQ ID NO: 1233952 - RNA, 14 nt, Human
uuuauuacaguaua

SEQ ID NO: 1233953 - RNA, 18 nt, Human
uuuauuacaguauaauua

SEQ ID NO: 1233954 - RNA, 11 nt, Human
augcuauuucu

SEQ ID NO: 1233955 - RNA, 13 nt, Human
augcuauuucuau

SEQ ID NO: 1233956 - RNA, 14 nt, Human
augcuauuucuaua

SEQ ID NO: 1233957 - RNA, 15 nt, Human
augcuauuucuauau

SEQ ID NO: 1233958 - RNA, 20 nt, Human
augcuauuucuauauuuuca

SEQ ID NO: 1233959 - RNA, 21 nt, Human
augcuauuucuauauuuucau

SEQ ID NO: 1233960 - RNA, 22 nt, Human
augcuauuucuauauuuucauu

SEQ ID NO: 1233961 - RNA, 23 nt, Human
augcuauuucuauauuuucauuc

SEQ ID NO: 1233962 - RNA, 13 nt, Human
uuuauauuuacua

SEQ ID NO: 1233963 - RNA, 16 nt, Human
uuuauauuuacuaaaa

SEQ ID NO: 1233964 - RNA, 17 nt, Human
uuuaucaugugaaauca

SEQ ID NO: 1233965 - RNA, 18 nt, Human
uuuaucaugugaaaucau

SEQ ID NO: 1233966 - RNA, 15 nt, Human
augauaacuggaaac

SEQ ID NO: 1233967 - RNA, 22 nt, Human
augauccagcagauuauucacu

SEQ ID NO: 1233968 - RNA, 18 nt, Human
augauuaaguaaugauaa

SEQ ID NO: 1233969 - RNA, 14 nt, Human
augauuaaguaaug

SEQ ID NO: 1233970 - RNA, 17 nt, Human
augauacuugaaaauua

SEQ ID NO: 1233971 - RNA, 21 nt, Human
augauacuugaaaauuaacau

SEQ ID NO: 1233972 - RNA, 10 nt, Human
augauccagc

SEQ ID NO: 1233973 - RNA, 19 nt, Human
augauccagcagauuauuc

SEQ ID NO: 1233974 - RNA, 20 nt, Human
augauccagcagauuauuca

SEQ ID NO: 1233975 - RNA, 19 nt, Human
augauugaauuauauguuc

SEQ ID NO: 1233976 - RNA, 13 nt, Human
augcaguucugaa

SEQ ID NO: 1233977 - RNA, 18 nt, Human
uuuaaauauaugcuaagu

SEQ ID NO: 1233978 - RNA, 21 nt, Human
uuuaaauaaauaaauagcuag

SEQ ID NO: 1233979 - RNA, 14 nt, Human
uuugcaagccagau

SEQ ID NO: 1233980 - RNA, 19 nt, Human
auguagccccucuccugga

SEQ ID NO: 1233981 - RNA, 16 nt, Human
auguacuucaugcugu

SEQ ID NO: 1233982 - RNA, 16 nt, Human
auguaccguaggcuuu

SEQ ID NO: 1233983 - RNA, 22 nt, Human
auguauuacaguggggaaugaa

SEQ ID NO: 1233984 - RNA, 21 nt, Human
uuuggcauaacauaaaucugu

SEQ ID NO: 1233985 - RNA, 13 nt, Human
uuuggcaggugca

SEQ ID NO: 1233986 - RNA, 20 nt, Human
uuuggcauaacauaaaucug

SEQ ID NO: 1233987 - RNA, 16 nt, Human
augugacauuuuacau

SEQ ID NO: 1233988 - RNA, 18 nt, Human
augugacauuuuacauua

SEQ ID NO: 1233989 - RNA, 21 nt, Human
uuuguaguguuggagaagaac

SEQ ID NO: 1233990 - RNA, 19 nt, Human
uuuguaguguuggagaaga

SEQ ID NO: 1233991 - RNA, 12 nt, Human
uuuguauaaaag

SEQ ID NO: 1233992 - RNA, 13 nt, Human
uuuguaaugaaaa

SEQ ID NO: 1233993 - RNA, 14 nt, Human
uuuguaaugaaaac

SEQ ID NO: 1233994 - RNA, 17 nt, Human
uuugugaagcaaaauuu

SEQ ID NO: 1233995 - RNA, 20 nt, Human
uuugugaagguggaaauaaa

SEQ ID NO: 1233996 - RNA, 19 nt, Human
uuugugcugguguaugugu

SEQ ID NO: 1233997 - RNA, 21 nt, Human
augguucccuugaugaagaag

SEQ ID NO: 1233998 - RNA, 13 nt, Human
augguuguacaua

SEQ ID NO: 1233999 - RNA, 22 nt, Human
auguaaaucccauuauucaaag

SEQ ID NO: 1234000 - RNA, 23 nt, Human
auguaaaucccauuauucaaagu

SEQ ID NO: 1234001 - RNA, 14 nt, Human
auguaaaucccauu

SEQ ID NO: 1234002 - RNA, 20 nt, Human
auguaaaucccauuauucaa

SEQ ID NO: 1234003 - RNA, 19 nt, Human
uuucuguacuuuuuggcau

SEQ ID NO: 1234004 - RNA, 20 nt, Human
uuucuguacuuuuuggcaua

SEQ ID NO: 1234005 - RNA, 15 nt, Human
augggauaaaugcca

SEQ ID NO: 1234006 - RNA, 16 nt, Human
augggauaaaugccau

SEQ ID NO: 1234007 - RNA, 20 nt, Human
augggauaaaugccaucaau

SEQ ID NO: 1234008 - RNA, 14 nt, Human
auggggguuucacc

SEQ ID NO: 1234009 - RNA, 22 nt, Human
uuugaaauuaugugacauuuua

SEQ ID NO: 1234010 - RNA, 15 nt, Human
uuugaaauuauguga

SEQ ID NO: 1234011 - RNA, 17 nt, Human
uuugaaauuaugugaca

SEQ ID NO: 1234012 - RNA, 13 nt, Human
auugucuagugaa

SEQ ID NO: 1234013 - RNA, 15 nt, Human
auuguuuuacaauag

SEQ ID NO: 1234014 - RNA, 17 nt, Human
auuguuuuacaauaguu

SEQ ID NO: 1234015 - RNA, 18 nt, Human
auuguuuuacaauaguuc

SEQ ID NO: 1234016 - RNA, 13 nt, Human
auuguuuuacaau

SEQ ID NO: 1234017 - RNA, 14 nt, Human
auuguuuuacaaua

SEQ ID NO: 1234018 - RNA, 19 nt, Human
auuguuuuacaauaguucu

SEQ ID NO: 1234019 - RNA, 21 nt, Human
auugcuuuguauuguauauua

SEQ ID NO: 1234020 - RNA, 18 nt, Human
auugacuuuuuauggcac

SEQ ID NO: 1234021 - RNA, 13 nt, Human
auugacuuuuuau

SEQ ID NO: 1234022 - RNA, 13 nt, Human
auuggaaacaagu

SEQ ID NO: 1234023 - RNA, 19 nt, Human
auuggacaguaaaauccac

SEQ ID NO: 1234024 - RNA, 15 nt, Human
auuggcuuuucugau

SEQ ID NO: 1234025 - RNA, 16 nt, Human
auuggcuuuucugauc

SEQ ID NO: 1234026 - RNA, 19 nt, Human
auuggcuuuucugauccag

SEQ ID NO: 1234027 - RNA, 20 nt, Human
auuggcuuuucugauccagu

SEQ ID NO: 1234028 - RNA, 17 nt, Human
auuuauuuuaauaaugu

SEQ ID NO: 1234029 - RNA, 14 nt, Human
auuuauuuuaauaa

SEQ ID NO: 1234030 - RNA, 20 nt, Human
auuucuugagguaaaagcau

SEQ ID NO: 1234031 - RNA, 18 nt, Human
auuugaaacacuuugcau

SEQ ID NO: 1234032 - RNA, 16 nt, Human
auuugacauagucugg

SEQ ID NO: 1234033 - RNA, 17 nt, Human
auuugacauagucuggc

SEQ ID NO: 1234034 - RNA, 21 nt, Human
auuugacauagucuggcugua

SEQ ID NO: 1234035 - RNA, 23 nt, Human
auuucuaggacugaauuaugaaa

SEQ ID NO: 1234036 - RNA, 20 nt, Human
auuucuaggacugaauuaug

SEQ ID NO: 1234037 - RNA, 14 nt, Human
auuucccucucuca

SEQ ID NO: 1234038 - RNA, 18 nt, Human
auuucuaggacugaauua

SEQ ID NO: 1234039 - RNA, 17 nt, Human
auuucuaggacugaauu

SEQ ID NO: 1234040 - RNA, 23 nt, Human
auuugugaagguggaaauaaacu

SEQ ID NO: 1234041 - RNA, 16 nt, Human
auuuuaaaagaaugau

SEQ ID NO: 1234042 - RNA, 18 nt, Human
auuugugaagguggaaau

SEQ ID NO: 1234043 - RNA, 21 nt, Human
auuugugaagguggaaauaaa

SEQ ID NO: 1234044 - RNA, 23 nt, Human
auuuuaaaagaaugauuaugaau

SEQ ID NO: 1234045 - RNA, 15 nt, Human
auuuguauaaaauaa

SEQ ID NO: 1234046 - RNA, 14 nt, Human
auuuguauaaaaua

SEQ ID NO: 1234047 - RNA, 22 nt, Human
auuuguaguguuggagaagaac

SEQ ID NO: 1234048 - RNA, 12 nt, Human
auuuuggaauuu

SEQ ID NO: 1234049 - RNA, 16 nt, Human
auuuuguuucagugca

SEQ ID NO: 1234050 - RNA, 11 nt, Human
auuuuguuucu

SEQ ID NO: 1234051 - RNA, 17 nt, Human
auuuuguguuuaggaac

SEQ ID NO: 1234052 - RNA, 14 nt, Human
auuuucuauaauuu

SEQ ID NO: 1234053 - RNA, 15 nt, Human
auuuucuauaauuua

SEQ ID NO: 1234054 - RNA, 12 nt, Human
auuuuaauaaug

SEQ ID NO: 1234055 - RNA, 15 nt, Human
auuuuaauaaacacu

SEQ ID NO: 1234056 - RNA, 16 nt, Human
auuuuaauaaacacuc

SEQ ID NO: 1234057 - RNA, 17 nt, Human
auuuuaauaaacacucu

SEQ ID NO: 1234058 - RNA, 15 nt, Human
auuuuuguaguagcg

SEQ ID NO: 1234059 - RNA, 22 nt, Human
auuuuugugauuuugugauuga

SEQ ID NO: 1234060 - RNA, 22 nt, Human
auuuuuugggcagcaauuuaaa

SEQ ID NO: 1234061 - RNA, 23 nt, Human
auuuuuucucuaggaaauauuua

SEQ ID NO: 1234062 - RNA, 20 nt, Human
auuuuuucucuaggaaauau

SEQ ID NO: 1234063 - RNA, 16 nt, Human
auuuuuugaaaagcag

SEQ ID NO: 1234064 - RNA, 19 nt, Human
auuuuuugaaaagcagaca

SEQ ID NO: 1234065 - RNA, 14 nt, Human
auuuuguuucugua

SEQ ID NO: 1234066 - RNA, 15 nt, Human
auuuuguuucuguac

SEQ ID NO: 1234067 - RNA, 13 nt, Human
auucuguauagau

SEQ ID NO: 1234068 - RNA, 11 nt, Human
auucuguauag

SEQ ID NO: 1234069 - RNA, 12 nt, Human
auucuguauaga

SEQ ID NO: 1234070 - RNA, 19 nt, Human
auucuuaaaguugaauuua

SEQ ID NO: 1234071 - RNA, 20 nt, Human
auucuuaaaguugaauuuau

SEQ ID NO: 1234072 - RNA, 21 nt, Human
auucuuaaaguugaauuuauu

SEQ ID NO: 1234073 - RNA, 15 nt, Human
auucuguauagauua

SEQ ID NO: 1234074 - RNA, 21 nt, Human
auucuucccuaucuuugccac

SEQ ID NO: 1234075 - RNA, 20 nt, Human
auucuucccuaucuuugcca

SEQ ID NO: 1234076 - RNA, 15 nt, Human
auuauauuuacaaau

SEQ ID NO: 1234077 - RNA, 14 nt, Human
auuauauuaugaag

SEQ ID NO: 1234078 - RNA, 18 nt, Human
auuauauguucagauuau

SEQ ID NO: 1234079 - RNA, 18 nt, Human
auuauauuuauuacugua

SEQ ID NO: 1234080 - RNA, 15 nt, Human
auuauauuuauuacu

SEQ ID NO: 1234081 - RNA, 15 nt, Human
auuauuauuuggccc

SEQ ID NO: 1234082 - RNA, 13 nt, Human
auuauucaaaguu

SEQ ID NO: 1234083 - RNA, 14 nt, Human
auuauucaaaguug

SEQ ID NO: 1234084 - RNA, 15 nt, Human
auuauucaaaguugc

SEQ ID NO: 1234085 - RNA, 17 nt, Human
auuauucaaaguugccu

SEQ ID NO: 1234086 - RNA, 13 nt, Human
auucacauuguau

SEQ ID NO: 1234087 - RNA, 20 nt, Human
auucacauuguauucagagu

SEQ ID NO: 1234088 - RNA, 17 nt, Human
auuccagagcacugcuc

SEQ ID NO: 1234089 - RNA, 18 nt, Human
aaaaaauuggggauucuu

SEQ ID NO: 1234090 - RNA, 23 nt, Human
aaaaaauuggggauucuuaaagu

SEQ ID NO: 1234091 - RNA, 19 nt, Human
aacuuaaauuuuaguucuu

SEQ ID NO: 1234092 - RNA, 20 nt, Human
aacugacucuuaagaagacu

SEQ ID NO: 1234093 - RNA, 19 nt, Human
aacugacucuuaagaagac

SEQ ID NO: 1234094 - RNA, 18 nt, Human
aacugacucuuaagaaga

SEQ ID NO: 1234095 - RNA, 15 nt, Human
aacugacucuuaaga

SEQ ID NO: 1234096 - RNA, 14 nt, Human
aacggaagaagaga

SEQ ID NO: 1234097 - RNA, 12 nt, Human
aacggagucaaa

SEQ ID NO: 1234098 - RNA, 14 nt, Human
aacggaugauuucu

SEQ ID NO: 1234099 - RNA, 15 nt, Human
aacggaugauuucua

SEQ ID NO: 1234100 - RNA, 16 nt, Human
aacggaugauuucuau

SEQ ID NO: 1234101 - RNA, 17 nt, Human
aacggaugauuucuaug

SEQ ID NO: 1234102 - RNA, 16 nt, Human
aacuauugcauuuaua

SEQ ID NO: 1234103 - RNA, 21 nt, Human
aacuauugcauuuauauguac

SEQ ID NO: 1234104 - RNA, 13 nt, Human
aaauucuuucauu

SEQ ID NO: 1234105 - RNA, 19 nt, Human
aaauuaaaccggaccaucu

SEQ ID NO: 1234106 - RNA, 15 nt, Human
aaauuuuuuuuacau

SEQ ID NO: 1234107 - RNA, 17 nt, Human
aaaucuuauaauuuaaa

SEQ ID NO: 1234108 - RNA, 15 nt, Human
aaaugccuuuguacu

SEQ ID NO: 1234109 - RNA, 16 nt, Human
aaauuuuuuuuacauu

SEQ ID NO: 1234110 - RNA, 17 nt, Human
aaauuuuuuuuacauuu

SEQ ID NO: 1234111 - RNA, 18 nt, Human
aaauuuuuuuuacauuuu

SEQ ID NO: 1234112 - RNA, 17 nt, Human
aacacuaacaugauuug

SEQ ID NO: 1234113 - RNA, 14 nt, Human
aaccacuuuuugca

SEQ ID NO: 1234114 - RNA, 15 nt, Human
aaccacuuuuugcag

SEQ ID NO: 1234115 - RNA, 17 nt, Human
aaccacuuuuugcagcu

SEQ ID NO: 1234116 - RNA, 15 nt, Human
aaccagagugcugaa

SEQ ID NO: 1234117 - RNA, 15 nt, Human
aacaucccuccuggg

SEQ ID NO: 1234118 - RNA, 21 nt, Human
aaccgaacugauguaaguaaa

SEQ ID NO: 1234119 - RNA, 12 nt, Human
aaccagaucauu

SEQ ID NO: 1234120 - RNA, 23 nt, Human
aacccuaaauaauaaaaauaaac

SEQ ID NO: 1234121 - RNA, 14 nt, Human
aacccuagcaaaag

SEQ ID NO: 1234122 - RNA, 17 nt, Human
aaccuagggugauauua

SEQ ID NO: 1234123 - RNA, 19 nt, Human
aacagcuggugcccugcuu

SEQ ID NO: 1234124 - RNA, 20 nt, Human
aacagcuggugcccugcuuu

SEQ ID NO: 1234125 - RNA, 21 nt, Human
aacagcuggugcccugcuuuc

SEQ ID NO: 1234126 - RNA, 20 nt, Human
aaaccaugggauaaaugcca

SEQ ID NO: 1234127 - RNA, 15 nt, Human
aaaccaugggauaaa

SEQ ID NO: 1234128 - RNA, 17 nt, Human
aaagaaauauaccuaaa

SEQ ID NO: 1234129 - RNA, 17 nt, Human
aaaaucucaauauuuca

SEQ ID NO: 1234130 - RNA, 16 nt, Human
aaaaucucaauauuuc

SEQ ID NO: 1234131 - RNA, 21 nt, Human
aaaauugaugggauuugguca

SEQ ID NO: 1234132 - RNA, 22 nt, Human
aaacacugggagaaaugaaaaa

SEQ ID NO: 1234133 - RNA, 21 nt, Human
aaacacugggagaaaugaaaa

SEQ ID NO: 1234134 - RNA, 16 nt, Human
aaaaagaaacauuugg

SEQ ID NO: 1234135 - RNA, 13 nt, Human
aaaaguugaauuu

SEQ ID NO: 1234136 - RNA, 10 nt, Human
aaauaaauaa

SEQ ID NO: 1234137 - RNA, 18 nt, Human
aaauagcuagacugguga

SEQ ID NO: 1234138 - RNA, 20 nt, Human
aaauagcuuuuuucucugau

SEQ ID NO: 1234139 - RNA, 17 nt, Human
aaauagcuuuuuucucu

SEQ ID NO: 1234140 - RNA, 21 nt, Human
aaauauuuauuuuaauaaugu

SEQ ID NO: 1234141 - RNA, 20 nt, Human
aaauauuuauuuuaauaaug

SEQ ID NO: 1234142 - RNA, 15 nt, Human
aaauauuuauuuuaa

SEQ ID NO: 1234143 - RNA, 20 nt, Human
aaaucaaucuguaaaacuaa

SEQ ID NO: 1234144 - RNA, 15 nt, Human
aaaucugugaacuug

SEQ ID NO: 1234145 - RNA, 16 nt, Human
aaaucugugaacuuga

SEQ ID NO: 1234146 - RNA, 18 nt, Human
aaaucugugaacuugaaa

SEQ ID NO: 1234147 - RNA, 19 nt, Human
aaaucugugaacuugaaau

SEQ ID NO: 1234148 - RNA, 13 nt, Human
aagauacugaaau

SEQ ID NO: 1234149 - RNA, 14 nt, Human
aagauacugaaaua

SEQ ID NO: 1234150 - RNA, 14 nt, Human
aagcgccuccaacc

SEQ ID NO: 1234151 - RNA, 15 nt, Human
aagcgccuccaaccc

SEQ ID NO: 1234152 - RNA, 16 nt, Human
aagcgccuccaacccu

SEQ ID NO: 1234153 - RNA, 20 nt, Human
aagcgccuccaacccuagca

SEQ ID NO: 1234154 - RNA, 20 nt, Human
aagcuacagaagaaacuggg

SEQ ID NO: 1234155 - RNA, 23 nt, Human
aaggacuucuuuaauuuuggaau

SEQ ID NO: 1234156 - RNA, 14 nt, Human
aaggcagggaggag

SEQ ID NO: 1234157 - RNA, 18 nt, Human
aagcuguguggcagucug

SEQ ID NO: 1234158 - RNA, 14 nt, Human
aaggacaucagcaa

SEQ ID NO: 1234159 - RNA, 15 nt, Human
aaggacaucagcaaa

SEQ ID NO: 1234160 - RNA, 17 nt, Human
aaggacaucagcaaaca

SEQ ID NO: 1234161 - RNA, 14 nt, Human
aaggacuucuuuaa

SEQ ID NO: 1234162 - RNA, 15 nt, Human
aaggacuucuuuaau

SEQ ID NO: 1234163 - RNA, 20 nt, Human
aaggacuucuuuaauuuugg

SEQ ID NO: 1234164 - RNA, 21 nt, Human
aaggacuucuuuaauuuugga

SEQ ID NO: 1234165 - RNA, 16 nt, Human
aaguugacuuauagua

SEQ ID NO: 1234166 - RNA, 19 nt, Human
aaguugacuuauaguacau

SEQ ID NO: 1234167 - RNA, 20 nt, Human
aaguugacuuauaguacaug

SEQ ID NO: 1234168 - RNA, 21 nt, Human
aaguugacuuauaguacauga

SEQ ID NO: 1234169 - RNA, 23 nt, Human
aaguugacuuauaguacaugaua

SEQ ID NO: 1234170 - RNA, 12 nt, Human
aaguugccuaaa

SEQ ID NO: 1234171 - RNA, 15 nt, Human
aagucuccaaagucu

SEQ ID NO: 1234172 - RNA, 14 nt, Human
aagucuccaaaguc

SEQ ID NO: 1234173 - RNA, 18 nt, Human
aaguccaagcauuuagau

SEQ ID NO: 1234174 - RNA, 14 nt, Human
aaggucggaccagc

SEQ ID NO: 1234175 - RNA, 20 nt, Human
aaggugaggagcuugaaacc

SEQ ID NO: 1234176 - RNA, 15 nt, Human
aauccaaugaaauga

SEQ ID NO: 1234177 - RNA, 13 nt, Human
aauccagccugcu

SEQ ID NO: 1234178 - RNA, 15 nt, Human
aaugauuaugaauua

SEQ ID NO: 1234179 - RNA, 23 nt, Human
aaugauuaugaauuacauuugua

SEQ ID NO: 1234180 - RNA, 21 nt, Human
aaugauuaugaauuacauuug

SEQ ID NO: 1234181 - RNA, 18 nt, Human
aauccaagcaaaugugaa

SEQ ID NO: 1234182 - RNA, 12 nt, Human
aauauuaaagcc

SEQ ID NO: 1234183 - RNA, 13 nt, Human
aauacucuuauau

SEQ ID NO: 1234184 - RNA, 19 nt, Human
aaguugccuaaauccauuu

SEQ ID NO: 1234185 - RNA, 15 nt, Human
aaguugccuaaaucc

SEQ ID NO: 1234186 - RNA, 16 nt, Human
aaguugccuaaaucca

SEQ ID NO: 1234187 - RNA, 17 nt, Human
aaguugccuaaauccau

SEQ ID NO: 1234188 - RNA, 18 nt, Human
aaguugccuaaauccauu

SEQ ID NO: 1234189 - RNA, 23 nt, Human
aauguuucaaacauauauaacaa

SEQ ID NO: 1234190 - RNA, 22 nt, Human
aauguuuuuuuuuaaagacuuu

SEQ ID NO: 1234191 - RNA, 15 nt, Human
aauguuuuuuuuuaa

SEQ ID NO: 1234192 - RNA, 20 nt, Human
aauguuuuuuuuuaaagacu

SEQ ID NO: 1234193 - RNA, 17 nt, Human
agaaauaaauuuauuuc

SEQ ID NO: 1234194 - RNA, 22 nt, Human
acuuuauuuucuauaauuuaaa

SEQ ID NO: 1234195 - RNA, 22 nt, Human
acuuuaucuugaauaauguaag

SEQ ID NO: 1234196 - RNA, 15 nt, Human
acuuuauuuuguguu

SEQ ID NO: 1234197 - RNA, 12 nt, Human
acuuuuaugaua

SEQ ID NO: 1234198 - RNA, 16 nt, Human
acuuuuaugauacuug

SEQ ID NO: 1234199 - RNA, 23 nt, Human
acuuuuaugauacuugaaaauua

SEQ ID NO: 1234200 - RNA, 14 nt, Human
acuuuuggaaggua

SEQ ID NO: 1234201 - RNA, 18 nt, Human
acuuguaaaggaauuuaa

SEQ ID NO: 1234202 - RNA, 14 nt, Human
acuggugacugauu

SEQ ID NO: 1234203 - RNA, 16 nt, Human
acuggugacugauucu

SEQ ID NO: 1234204 - RNA, 22 nt, Human
acuguaagaaaauaucacuugu

SEQ ID NO: 1234205 - RNA, 19 nt, Human
acuguaagaaaauaucacu

SEQ ID NO: 1234206 - RNA, 15 nt, Human
acucauauuuucaug

SEQ ID NO: 1234207 - RNA, 20 nt, Human
acuaguauuucuaugaaaua

SEQ ID NO: 1234208 - RNA, 15 nt, Human
acuaagagagaauga

SEQ ID NO: 1234209 - RNA, 13 nt, Human
acuaagagagaau

SEQ ID NO: 1234210 - RNA, 14 nt, Human
acggaacucaaaua

SEQ ID NO: 1234211 - RNA, 22 nt, Human
acggaagaagagaucaggaaga

SEQ ID NO: 1234212 - RNA, 11 nt, Human
accugucuguc

SEQ ID NO: 1234213 - RNA, 12 nt, Human
accugucugucu

SEQ ID NO: 1234214 - RNA, 14 nt, Human
accugucugucugu

SEQ ID NO: 1234215 - RNA, 22 nt, Human
acaauugagguaaguuuuuuga

SEQ ID NO: 1234216 - RNA, 10 nt, Human
acaacuaagu

SEQ ID NO: 1234217 - RNA, 22 nt, Human
acaacuaagugauuuguauguc

SEQ ID NO: 1234218 - RNA, 14 nt, Human
aauuuuguuucugu

SEQ ID NO: 1234219 - RNA, 15 nt, Human
aauuuuguuucugua

SEQ ID NO: 1234220 - RNA, 14 nt, Human
acaacggagucaaa

SEQ ID NO: 1234221 - RNA, 20 nt, Human
acaacggagucaaaaauuaa

SEQ ID NO: 1234222 - RNA, 22 nt, Human
acaacggagucaaaaauuaaac

SEQ ID NO: 1234223 - RNA, 13 nt, Human
aauuuugugaagc

SEQ ID NO: 1234224 - RNA, 13 nt, Human
aauuuuguuucug

SEQ ID NO: 1234225 - RNA, 22 nt, Human
acaggaugguucccuugaugaa

SEQ ID NO: 1234226 - RNA, 18 nt, Human
acaggauccaggccggcu

SEQ ID NO: 1234227 - RNA, 19 nt, Human
acaggaucaguuaacuauu

SEQ ID NO: 1234228 - RNA, 12 nt, Human
acaggauccagg

SEQ ID NO: 1234229 - RNA, 13 nt, Human
acaggauccaggc

SEQ ID NO: 1234230 - RNA, 21 nt, Human
acaggaugaugacuauggaaa

SEQ ID NO: 1234231 - RNA, 14 nt, Human
acagagucuuccuc

SEQ ID NO: 1234232 - RNA, 19 nt, Human
acagagucuuccucugucu

SEQ ID NO: 1234233 - RNA, 17 nt, Human
acagccaacuauggccu

SEQ ID NO: 1234234 - RNA, 19 nt, Human
acagccaacuauggccugu

SEQ ID NO: 1234235 - RNA, 13 nt, Human
acaucagcaaaca

SEQ ID NO: 1234236 - RNA, 23 nt, Human
acauguuucuuuguaaugaaaac

SEQ ID NO: 1234237 - RNA, 19 nt, Human
acauguuucuuuguaauga

SEQ ID NO: 1234238 - RNA, 22 nt, Human
acauguuucuuuguaaugaaaa

SEQ ID NO: 1234239 - RNA, 17 nt, Human
acaggcacacaccacca

SEQ ID NO: 1234240 - RNA, 19 nt, Human
acauuuguucuauagcuuu

SEQ ID NO: 1234241 - RNA, 20 nt, Human
acauuuuaaaaaauggucac

SEQ ID NO: 1234242 - RNA, 17 nt, Human
accaauaaaauaauuuu

SEQ ID NO: 1234243 - RNA, 11 nt, Human
accaauaaagu

SEQ ID NO: 1234244 - RNA, 12 nt, Human
accaauaaagug

SEQ ID NO: 1234245 - RNA, 17 nt, Human
accaauaaagugacccu

SEQ ID NO: 1234246 - RNA, 21 nt, Human
accaccgcgcccagccuuuuu

SEQ ID NO: 1234247 - RNA, 15 nt, Human
accaccucucaauau

SEQ ID NO: 1234248 - RNA, 23 nt, Human
accaccucucaauauucaauaaa

SEQ ID NO: 1234249 - RNA, 22 nt, Human
accagagugcugaaggaaugga

SEQ ID NO: 1234250 - RNA, 13 nt, Human
accagaucauugu

SEQ ID NO: 1234251 - RNA, 22 nt, Human
acccauuagcagucccuccaca

SEQ ID NO: 1234252 - RNA, 14 nt, Human
acccagugcugaau

SEQ ID NO: 1234253 - RNA, 17 nt, Human
accccuccacucuuucu

SEQ ID NO: 1234254 - RNA, 13 nt, Human
accccuccacucu

SEQ ID NO: 1234255 - RNA, 23 nt, Human
aggcuacuguaaggcaaucaugg

SEQ ID NO: 1234256 - RNA, 17 nt, Human
aggcuagauguauguac

SEQ ID NO: 1234257 - RNA, 16 nt, Human
aggcuagauguaugua

SEQ ID NO: 1234258 - RNA, 15 nt, Human
aggcuagauguaugu

SEQ ID NO: 1234259 - RNA, 22 nt, Human
agggaccggcggaccccagcca

SEQ ID NO: 1234260 - RNA, 13 nt, Human
aggucccuaauaa

SEQ ID NO: 1234261 - RNA, 15 nt, Human
aggucccuaauaaag

SEQ ID NO: 1234262 - RNA, 16 nt, Human
aggucccuaauaaagc

SEQ ID NO: 1234263 - RNA, 20 nt, Human
agguaaaagcaucacaugaa

SEQ ID NO: 1234264 - RNA, 18 nt, Human
agguaaaucagacuauga

SEQ ID NO: 1234265 - RNA, 23 nt, Human
agguaaaucagacuaugaaguuu

SEQ ID NO: 1234266 - RNA, 17 nt, Human
agguaauuuuuuucacc

SEQ ID NO: 1234267 - RNA, 12 nt, Human
aggucccuaaua

SEQ ID NO: 1234268 - RNA, 12 nt, Human
aggacccaggac

SEQ ID NO: 1234269 - RNA, 13 nt, Human
aggacccaggaca

SEQ ID NO: 1234270 - RNA, 14 nt, Human
aggacccaggacag

SEQ ID NO: 1234271 - RNA, 18 nt, Human
aggacccaggacaggauc

SEQ ID NO: 1234272 - RNA, 23 nt, Human
aggacccaggacaggauccaggc

SEQ ID NO: 1234273 - RNA, 23 nt, Human
aggaugguucccuugaugaagaa

SEQ ID NO: 1234274 - RNA, 15 nt, Human
agcaugccuucaaau

SEQ ID NO: 1234275 - RNA, 13 nt, Human
agccaagugcagg

SEQ ID NO: 1234276 - RNA, 17 nt, Human
agagaacuuccagaucc

SEQ ID NO: 1234277 - RNA, 13 nt, Human
agagaagaaagaa

SEQ ID NO: 1234278 - RNA, 17 nt, Human
agagaagaaagaacgga

SEQ ID NO: 1234279 - RNA, 20 nt, Human
agacagagucuuccucuguc

SEQ ID NO: 1234280 - RNA, 19 nt, Human
agacagagucuuacucugu

SEQ ID NO: 1234281 - RNA, 20 nt, Human
agacagagucuuacucuguu

SEQ ID NO: 1234282 - RNA, 23 nt, Human
agacagagucuuccucugucucc

SEQ ID NO: 1234283 - RNA, 13 nt, Human
agaguguugaaac

SEQ ID NO: 1234284 - RNA, 16 nt, Human
augcauauuauuuuau

SEQ ID NO: 1234285 - RNA, 20 nt, Human
augcauauuauuuuauguug

SEQ ID NO: 1234286 - RNA, 15 nt, Human
auguuuucaggcuag

SEQ ID NO: 1234287 - RNA, 20 nt, Human
auggucacguuuggugcuuc

SEQ ID NO: 1234288 - RNA, 21 nt, Human
auggucacguuuggugcuucu

SEQ ID NO: 1234289 - RNA, 24 nt, Human
auggucacguuuggugcuucucag

SEQ ID NO: 1234290 - RNA, 20 nt, Human
augguccgugcuaaggacuu

SEQ ID NO: 1234291 - RNA, 21 nt, Human
augguccgugcuaaggacuug

SEQ ID NO: 1234292 - RNA, 14 nt, Human
augugaaaucauuc

SEQ ID NO: 1234293 - RNA, 23 nt, Human
augugaacaguuguguuugaagc

SEQ ID NO: 1234294 - RNA, 21 nt, Human
augugaacaguuguguuugaa

SEQ ID NO: 1234295 - RNA, 11 nt, Human
augugaacagu

SEQ ID NO: 1234296 - RNA, 18 nt, Human
aucuugaauaauguaaga

SEQ ID NO: 1234297 - RNA, 18 nt, Human
aucuggaaccaucagaaa

SEQ ID NO: 1234298 - RNA, 21 nt, Human
aucuauauuuuacauaaauuu

SEQ ID NO: 1234299 - RNA, 17 nt, Human
aucuauauuuuacauaa

SEQ ID NO: 1234300 - RNA, 22 nt, Human
augaagcuuuuaugugaaacau

SEQ ID NO: 1234301 - RNA, 19 nt, Human
augaaguuuuuuuuauaca

SEQ ID NO: 1234302 - RNA, 23 nt, Human
augaaguuuuuuuuauacaggau

SEQ ID NO: 1234303 - RNA, 20 nt, Human
auccucccacuucagccucc

SEQ ID NO: 1234304 - RNA, 18 nt, Human
auccagaaagaaaacuug

SEQ ID NO: 1234305 - RNA, 16 nt, Human
auccagaaagaaaacu

SEQ ID NO: 1234306 - RNA, 15 nt, Human
aucaugugaaaucau

SEQ ID NO: 1234307 - RNA, 16 nt, Human
aucaugugaaaucauu

SEQ ID NO: 1234308 - RNA, 15 nt, Human
auauuuauuuuaaua

SEQ ID NO: 1234309 - RNA, 14 nt, Human
auauuuauuuuaau

SEQ ID NO: 1234310 - RNA, 17 nt, Human
auauuuauuuuaauaau

SEQ ID NO: 1234311 - RNA, 15 nt, Human
auaaagcaggcagaa

SEQ ID NO: 1234312 - RNA, 18 nt, Human
auaaagcuguguggcagu

SEQ ID NO: 1234313 - RNA, 14 nt, Human
auaaaggacuguaa

SEQ ID NO: 1234314 - RNA, 15 nt, Human
auaaaagacagugaa

SEQ ID NO: 1234315 - RNA, 20 nt, Human
auaaacuuuuuucuuacugu

SEQ ID NO: 1234316 - RNA, 17 nt, Human
auaacauaaaucuguga

SEQ ID NO: 1234317 - RNA, 18 nt, Human
auaacauaaaucugugaa

SEQ ID NO: 1234318 - RNA, 19 nt, Human
auaacauaaaucugugaac

SEQ ID NO: 1234319 - RNA, 18 nt, Human
auaaaggauuaaugucaa

SEQ ID NO: 1234320 - RNA, 14 nt, Human
auaacauaaaucug

SEQ ID NO: 1234321 - RNA, 15 nt, Human
auaacauaaaucugu

SEQ ID NO: 1234322 - RNA, 13 nt, Human
auacccacccaga

SEQ ID NO: 1234323 - RNA, 14 nt, Human
auacccacccagaa

SEQ ID NO: 1234324 - RNA, 15 nt, Human
auaaggaaaaguuua

SEQ ID NO: 1234325 - RNA, 16 nt, Human
auaaggaaaaguuuaa

SEQ ID NO: 1234326 - RNA, 15 nt, Human
auaauuaacauguua

SEQ ID NO: 1234327 - RNA, 17 nt, Human
auaauuaacauguuaaa

SEQ ID NO: 1234328 - RNA, 22 nt, Human
auaugcuauuucuauauuuuca

SEQ ID NO: 1234329 - RNA, 23 nt, Human
auaugcuauuucuauauuuucau

SEQ ID NO: 1234330 - RNA, 22 nt, Human
auaugcuucuguuuuauaauuu

SEQ ID NO: 1234331 - RNA, 20 nt, Human
auaugcuucuguuuuauaau

SEQ ID NO: 1234332 - RNA, 23 nt, Human
auaugcuucuguuuuauaauuuu

SEQ ID NO: 1234333 - RNA, 16 nt, Human
auaugcuauuucuaua

SEQ ID NO: 1234334 - RNA, 18 nt, Human
auaugcuauuucuauauu

SEQ ID NO: 1234335 - RNA, 19 nt, Human
auaugcuauuucuauauuu

SEQ ID NO: 1234336 - RNA, 21 nt, Human
auaugcuauuucuauauuuuc

SEQ ID NO: 1234337 - RNA, 13 nt, Human
auauuuauuuuaa

SEQ ID NO: 1234338 - RNA, 14 nt, Human
auauuauuuuaugu

SEQ ID NO: 1234339 - RNA, 18 nt, Human
auauuuacuaaaauggac

SEQ ID NO: 1234340 - RNA, 20 nt, Human
auauuuacuaaaauggacug

SEQ ID NO: 1234341 - RNA, 23 nt, Human
auauuaugaagcuuuuaugugaa

SEQ ID NO: 1234342 - RNA, 16 nt, Human
auaucaaauauauuca

SEQ ID NO: 1234343 - RNA, 18 nt, Human
auagguuuggacaaaaug

SEQ ID NO: 1234344 - RNA, 14 nt, Human
auagguuuggacaa

SEQ ID NO: 1234345 - RNA, 15 nt, Human
auagguuuaauaauu

SEQ ID NO: 1234346 - RNA, 17 nt, Human
auagucaaauuguguga

SEQ ID NO: 1234347 - RNA, 14 nt, Human
auagucaaauugug

SEQ ID NO: 1234348 - RNA, 12 nt, Human
aguccuguaaug

SEQ ID NO: 1234349 - RNA, 19 nt, Human
aguccugggauuacaggug

SEQ ID NO: 1234350 - RNA, 14 nt, Human
agugacccugcucu

SEQ ID NO: 1234351 - RNA, 18 nt, Human
aguauggguuagggaaaa

SEQ ID NO: 1234352 - RNA, 23 nt, Human
agucaaauugugugaaagguacu

SEQ ID NO: 1234353 - RNA, 13 nt, Human
agucaaauugugu

SEQ ID NO: 1234354 - RNA, 16 nt, Human
aguaucuuuuuauuca

SEQ ID NO: 1234355 - RNA, 18 nt, Human
aguaucucuucagucucu

SEQ ID NO: 1234356 - RNA, 16 nt, Human
aguaucucuucagucu

SEQ ID NO: 1234357 - RNA, 16 nt, Human
aguuguguuugaagca

SEQ ID NO: 1234358 - RNA, 23 nt, Human
aguugaaaaucuuauaauuuaaa

SEQ ID NO: 1234359 - RNA, 22 nt, Human
aguugaaaaucuuauaauuuaa

SEQ ID NO: 1234360 - RNA, 19 nt, Human
aguggcgcgaucucagcuc

SEQ ID NO: 1234361 - RNA, 20 nt, Human
aguggcgcgaucucagcuca

SEQ ID NO: 1234362 - RNA, 19 nt, Human
aguggcgugaucucagcuc

SEQ ID NO: 1234363 - RNA, 20 nt, Human
aguggcgugaucucagcuca

SEQ ID NO: 1234364 - RNA, 21 nt, Human
cacaaauucugucucuggauu

SEQ ID NO: 1234365 - RNA, 17 nt, Human
caauagucaaauugugu

SEQ ID NO: 1234366 - RNA, 18 nt, Human
caauccucccacuucagc

SEQ ID NO: 1234367 - RNA, 22 nt, Human
caauccucccacuucagccucc

SEQ ID NO: 1234368 - RNA, 20 nt, Human
caaugaucaccgacugaaaa

SEQ ID NO: 1234369 - RNA, 18 nt, Human
cacacacaugcuucccuu

SEQ ID NO: 1234370 - RNA, 13 nt, Human
cacaacuauauug

SEQ ID NO: 1234371 - RNA, 19 nt, Human
cacacugggacuugcaaaa

SEQ ID NO: 1234372 - RNA, 20 nt, Human
cacaggaaccacaagacugc

SEQ ID NO: 1234373 - RNA, 20 nt, Human
cacauugguguuguacucaa

SEQ ID NO: 1234374 - RNA, 17 nt, Human
cacauuggaaacaaguc

SEQ ID NO: 1234375 - RNA, 18 nt, Human
cacauuggagauguuuag

SEQ ID NO: 1234376 - RNA, 12 nt, Human
cacauguccagu

SEQ ID NO: 1234377 - RNA, 16 nt, Human
cacauuccugaacagg

SEQ ID NO: 1234378 - RNA, 17 nt, Human
caagcacuaaacaaaga

SEQ ID NO: 1234379 - RNA, 22 nt, Human
caagugcagggccuguaauccc

SEQ ID NO: 1234380 - RNA, 15 nt, Human
caaauucugucucug

SEQ ID NO: 1234381 - RNA, 18 nt, Human
caaauucugucucuggau

SEQ ID NO: 1234382 - RNA, 21 nt, Human
caacucugaaggguaauuaua

SEQ ID NO: 1234383 - RNA, 15 nt, Human
caacugcuaaucuac

SEQ ID NO: 1234384 - RNA, 14 nt, Human
caacuucaguccaa

SEQ ID NO: 1234385 - RNA, 11 nt, Human
caacuuuguau

SEQ ID NO: 1234386 - RNA, 12 nt, Human
caacuuuguaua

SEQ ID NO: 1234387 - RNA, 15 nt, Human
caaaucacugaacuu

SEQ ID NO: 1234388 - RNA, 14 nt, Human
caaaucacugaacu

SEQ ID NO: 1234389 - RNA, 19 nt, Human
caaaguugccuaaauccau

SEQ ID NO: 1234390 - RNA, 12 nt, Human
caaauauauuca

SEQ ID NO: 1234391 - RNA, 23 nt, Human
caaauauauucagccuggcuuca

SEQ ID NO: 1234392 - RNA, 11 nt, Human
caaaaaacuac

SEQ ID NO: 1234393 - RNA, 15 nt, Human
caaaaaacuacuucu

SEQ ID NO: 1234394 - RNA, 20 nt, Human
caaauacgugggcauucaaa

SEQ ID NO: 1234395 - RNA, 15 nt, Human
cacccacccuuuuuu

SEQ ID NO: 1234396 - RNA, 23 nt, Human
caccccuaaaagaaacccugcac

SEQ ID NO: 1234397 - RNA, 21 nt, Human
ccagccuggggcugaggcuga

SEQ ID NO: 1234398 - RNA, 20 nt, Human
ccaccucgcagguucaagca

SEQ ID NO: 1234399 - RNA, 21 nt, Human
ccaccucgcagguucaagcaa

SEQ ID NO: 1234400 - RNA, 13 nt, Human
ccaccucucaaua

SEQ ID NO: 1234401 - RNA, 14 nt, Human
ccaccucucaauau

SEQ ID NO: 1234402 - RNA, 23 nt, Human
ccaccucucaauauucaauaaag

SEQ ID NO: 1234403 - RNA, 17 nt, Human
ccacccucguggacacc

SEQ ID NO: 1234404 - RNA, 18 nt, Human
ccacccucguggacaccu

SEQ ID NO: 1234405 - RNA, 20 nt, Human
ccacccucguggacaccugc

SEQ ID NO: 1234406 - RNA, 19 nt, Human
ccacccucguggacaccug

SEQ ID NO: 1234407 - RNA, 13 nt, Human
ccacuuuuugcag

SEQ ID NO: 1234408 - RNA, 14 nt, Human
ccacuuuuugcagc

SEQ ID NO: 1234409 - RNA, 15 nt, Human
ccacuuuuugcagcu

SEQ ID NO: 1234410 - RNA, 17 nt, Human
ccacuuuuugcagcuuu

SEQ ID NO: 1234411 - RNA, 16 nt, Human
ccacuuuuugcagcuu

SEQ ID NO: 1234412 - RNA, 18 nt, Human
ccagaaaccuuuguuugc

SEQ ID NO: 1234413 - RNA, 14 nt, Human
ccagaccauggaca

SEQ ID NO: 1234414 - RNA, 16 nt, Human
ccagaaugagacaucc

SEQ ID NO: 1234415 - RNA, 20 nt, Human
ccagguauucguuaucuaau

SEQ ID NO: 1234416 - RNA, 21 nt, Human
ccagguauucguuaucuaaua

SEQ ID NO: 1234417 - RNA, 18 nt, Human
ccaucaaggguacacugc

SEQ ID NO: 1234418 - RNA, 20 nt, Human
ccaucaucuauagaaagcua

SEQ ID NO: 1234419 - RNA, 20 nt, Human
ccagguagaggguguguaag

SEQ ID NO: 1234420 - RNA, 14 nt, Human
ccaggguggcagca

SEQ ID NO: 1234421 - RNA, 16 nt, Human
ccaggguggcagcaac

SEQ ID NO: 1234422 - RNA, 17 nt, Human
ccaggguggcagcaaca

SEQ ID NO: 1234423 - RNA, 12 nt, Human
ccaggcuggguc

SEQ ID NO: 1234424 - RNA, 16 nt, Human
ccaggcugggucgccc

SEQ ID NO: 1234425 - RNA, 21 nt, Human
ccaggcugggucgcccuggac

SEQ ID NO: 1234426 - RNA, 22 nt, Human
ccaggcugggucgcccuggacu

SEQ ID NO: 1234427 - RNA, 23 nt, Human
ccaggcugggucgcccuggacug

SEQ ID NO: 1234428 - RNA, 24 nt, Human
ccaggcugggucgcccuggacugu

SEQ ID NO: 1234429 - RNA, 13 nt, Human
ccauuuggaaauc

SEQ ID NO: 1234430 - RNA, 20 nt, Human
ccauguuaaccccuccacuc

SEQ ID NO: 1234431 - RNA, 11 nt, Human
ccauuauucaa

SEQ ID NO: 1234432 - RNA, 12 nt, Human
cccagaaugaga

SEQ ID NO: 1234433 - RNA, 18 nt, Human
cccagaaugagacaucca

SEQ ID NO: 1234434 - RNA, 18 nt, Human
cccauucauuccauucug

SEQ ID NO: 1234435 - RNA, 22 nt, Human
cccauucauuccauucuggaag

SEQ ID NO: 1234436 - RNA, 18 nt, Human
cccauuauucaaaguugc

SEQ ID NO: 1234437 - RNA, 23 nt, Human
cccauuauucaaaguugccuaaa

SEQ ID NO: 1234438 - RNA, 21 nt, Human
cccauucauuccauucuggaa

SEQ ID NO: 1234439 - RNA, 21 nt, Human
ccccacccucguggacaccug

SEQ ID NO: 1234440 - RNA, 22 nt, Human
ccccacccucguggacaccugc

SEQ ID NO: 1234441 - RNA, 23 nt, Human
ccccacccucguggacaccugcc

SEQ ID NO: 1234442 - RNA, 16 nt, Human
ccccacccugccucac

SEQ ID NO: 1234443 - RNA, 20 nt, Human
cccagaaugagacauccagc

SEQ ID NO: 1234444 - RNA, 18 nt, Human
ccccaguaucucuucagu

SEQ ID NO: 1234445 - RNA, 17 nt, Human
ccccaucauugguaccc

SEQ ID NO: 1234446 - RNA, 22 nt, Human
cccccagaaaagaaagcuacag

SEQ ID NO: 1234447 - RNA, 17 nt, Human
cccccacugccuuugac

SEQ ID NO: 1234448 - RNA, 12 nt, Human
ccccuccacucu

SEQ ID NO: 1234449 - RNA, 17 nt, Human
ccccuccacucuuucuu

SEQ ID NO: 1234450 - RNA, 15 nt, Human
ccccuagccugccuc

SEQ ID NO: 1234451 - RNA, 14 nt, Human
ccccugccucucug

SEQ ID NO: 1234452 - RNA, 15 nt, Human
ccccugccucucugc

SEQ ID NO: 1234453 - RNA, 16 nt, Human
ccccugccucucugca

SEQ ID NO: 1234454 - RNA, 17 nt, Human
ccccugccucucugcag

SEQ ID NO: 1234455 - RNA, 19 nt, Human
ccccugccucucugcaggu

SEQ ID NO: 1234456 - RNA, 17 nt, Human
ccccuggucccucugca

SEQ ID NO: 1234457 - RNA, 18 nt, Human
ccccuggucccucugcag

SEQ ID NO: 1234458 - RNA, 23 nt, Human
ccccuggugcacuggccccaccc

SEQ ID NO: 1234459 - RNA, 20 nt, Human
cccucucccaaaaaacuacu

SEQ ID NO: 1234460 - RNA, 13 nt, Human
cccucuuccuucc

SEQ ID NO: 1234461 - RNA, 15 nt, Human
cccucccuacccuaa

SEQ ID NO: 1234462 - RNA, 16 nt, Human
cccucccuacccuaac

SEQ ID NO: 1234463 - RNA, 16 nt, Human
cccucguggacaccug

SEQ ID NO: 1234464 - RNA, 17 nt, Human
cccucguggacaccugc

SEQ ID NO: 1234465 - RNA, 18 nt, Human
cccucguggacaccugcc

SEQ ID NO: 1234466 - RNA, 19 nt, Human
cccucguggacaccugccc

SEQ ID NO: 1234467 - RNA, 22 nt, Human
cccucguggacaccugcccugc

SEQ ID NO: 1234468 - RNA, 23 nt, Human
cccucguggacaccugcccugcc

SEQ ID NO: 1234469 - RNA, 16 nt, Human
cccugcugcugccugc

SEQ ID NO: 1234470 - RNA, 17 nt, Human
cccugcugcugccugcc

SEQ ID NO: 1234471 - RNA, 18 nt, Human
cccugcugcugccugccu

SEQ ID NO: 1234472 - RNA, 14 nt, Human
cccugcuuucagau

SEQ ID NO: 1234473 - RNA, 21 nt, Human
cccuggugcacuggccccacc

SEQ ID NO: 1234474 - RNA, 15 nt, Human
cccuugaugaagaag

SEQ ID NO: 1234475 - RNA, 13 nt, Human
cccugcugcugcc

SEQ ID NO: 1234476 - RNA, 15 nt, Human
cccugccucucugca

SEQ ID NO: 1234477 - RNA, 16 nt, Human
cccugccucucugcag

SEQ ID NO: 1234478 - RNA, 13 nt, Human
cccugccucucug

SEQ ID NO: 1234479 - RNA, 14 nt, Human
cccugccucucugc

SEQ ID NO: 1234480 - RNA, 13 nt, Human
ccgcagaaggaag

SEQ ID NO: 1234481 - RNA, 15 nt, Human
ccgcagaaggaaggc

SEQ ID NO: 1234482 - RNA, 18 nt, Human
ccgcagaaggaaggcagg

SEQ ID NO: 1234483 - RNA, 18 nt, Human
ccgccucagccucccaaa

SEQ ID NO: 1234484 - RNA, 20 nt, Human
ccgacugaaaauauuguuuu

SEQ ID NO: 1234485 - RNA, 20 nt, Human
ccgccucgaccucucucaaa

SEQ ID NO: 1234486 - RNA, 16 nt, Human
ccggggggucucuucu

SEQ ID NO: 1234487 - RNA, 16 nt, Human
ccuacuagucaccaga

SEQ ID NO: 1234488 - RNA, 11 nt, Human
ccuaaccaagu

SEQ ID NO: 1234489 - RNA, 14 nt, Human
ccugccaccuccug

SEQ ID NO: 1234490 - RNA, 16 nt, Human
ccugccaccuccugcc

SEQ ID NO: 1234491 - RNA, 19 nt, Human
ccugccaccuccugccuca

SEQ ID NO: 1234492 - RNA, 20 nt, Human
ccugaagcuaucguaaaauu

SEQ ID NO: 1234493 - RNA, 12 nt, Human
ccuaucuuugcc

SEQ ID NO: 1234494 - RNA, 13 nt, Human
ccuaucuuugcca

SEQ ID NO: 1234495 - RNA, 15 nt, Human
ccuaucuuugccacc

SEQ ID NO: 1234496 - RNA, 19 nt, Human
ccuaucuuugccacccuca

SEQ ID NO: 1234497 - RNA, 20 nt, Human
ccuaucuuugccacccucau

SEQ ID NO: 1234498 - RNA, 23 nt, Human
ccucuuccuucccugcugugaaa

SEQ ID NO: 1234499 - RNA, 17 nt, Human
ccugccaccuccugccu

SEQ ID NO: 1234500 - RNA, 12 nt, Human
ccugccaccugu

SEQ ID NO: 1234501 - RNA, 13 nt, Human
ccugccaccuguc

SEQ ID NO: 1234502 - RNA, 14 nt, Human
ccugccaccugucu

SEQ ID NO: 1234503 - RNA, 15 nt, Human
ccugccaccugucug

SEQ ID NO: 1234504 - RNA, 16 nt, Human
ccugccaccugucugu

SEQ ID NO: 1234505 - RNA, 17 nt, Human
ccugccaccugucuguc

SEQ ID NO: 1234506 - RNA, 21 nt, Human
ccugcccugccaccugucugu

SEQ ID NO: 1234507 - RNA, 18 nt, Human
ccugcccugccaccuguc

SEQ ID NO: 1234508 - RNA, 15 nt, Human
ccugcccugcccugc

SEQ ID NO: 1234509 - RNA, 16 nt, Human
ccugcccugcccugcc

SEQ ID NO: 1234510 - RNA, 17 nt, Human
ccugcccugcccugcca

SEQ ID NO: 1234511 - RNA, 11 nt, Human
ccugcccugcc

SEQ ID NO: 1234512 - RNA, 12 nt, Human
ccugcccugcca

SEQ ID NO: 1234513 - RNA, 14 nt, Human
ccugcccugccacc

SEQ ID NO: 1234514 - RNA, 15 nt, Human
ccugcccugccaccu

SEQ ID NO: 1234515 - RNA, 17 nt, Human
ccugcccugccaccugu

SEQ ID NO: 1234516 - RNA, 22 nt, Human
ccuucuccauggcccugccaug

SEQ ID NO: 1234517 - RNA, 19 nt, Human
ccuucuccauggcccugcc

SEQ ID NO: 1234518 - RNA, 15 nt, Human
ccuucaugcauggaa

SEQ ID NO: 1234519 - RNA, 12 nt, Human
ccuucaugcaug

SEQ ID NO: 1234520 - RNA, 21 nt, Human
ccuucaugcauggaaauuccc

SEQ ID NO: 1234521 - RNA, 18 nt, Human
ccuguggaucaaauccag

SEQ ID NO: 1234522 - RNA, 16 nt, Human
cgcacggcagccacag

SEQ ID NO: 1234523 - RNA, 24 nt, Human
cgcguugaaauuguaauuauaucu

SEQ ID NO: 1234524 - RNA, 17 nt, Human
cgcuaaacuuuucugau

SEQ ID NO: 1234525 - RNA, 18 nt, Human
cgcuaaacuuuucugaua

SEQ ID NO: 1234526 - RNA, 19 nt, Human
cgcuaaacuuuucugauag

SEQ ID NO: 1234527 - RNA, 16 nt, Human
cggcuugccacacccc

SEQ ID NO: 1234528 - RNA, 18 nt, Human
cgggaauuuucaucuagg

SEQ ID NO: 1234529 - RNA, 20 nt, Human
cgggaauuuucaucuaggau

SEQ ID NO: 1234530 - RNA, 18 nt, Human
cguuuggugcuucucaga

SEQ ID NO: 1234531 - RNA, 17 nt, Human
cuaaauauauuuuaaga

SEQ ID NO: 1234532 - RNA, 22 nt, Human
cuaaaauggacuguggugacuu

SEQ ID NO: 1234533 - RNA, 21 nt, Human
cuaaaauggacuguggugacu

SEQ ID NO: 1234534 - RNA, 15 nt, Human
cuaagagagaaugag

SEQ ID NO: 1234535 - RNA, 14 nt, Human
cuaagagagaauga

SEQ ID NO: 1234536 - RNA, 10 nt, Human
cuaaccaagu

SEQ ID NO: 1234537 - RNA, 12 nt, Human
cuaaccaaguuc

SEQ ID NO: 1234538 - RNA, 19 nt, Human
cuaaauucuuucauuuuag

SEQ ID NO: 1234539 - RNA, 13 nt, Human
cguuuucaaaauu

SEQ ID NO: 1234540 - RNA, 14 nt, Human
cuacacuaagagag

SEQ ID NO: 1234541 - RNA, 23 nt, Human
cuacacgagauacagaauuuuau

SEQ ID NO: 1234542 - RNA, 11 nt, Human
cuacacccagc

SEQ ID NO: 1234543 - RNA, 12 nt, Human
cuacacccagca

SEQ ID NO: 1234544 - RNA, 13 nt, Human
cuacacccagcaa

SEQ ID NO: 1234545 - RNA, 14 nt, Human
cuacacccagcaau

SEQ ID NO: 1234546 - RNA, 16 nt, Human
cuacacccagcaauag

SEQ ID NO: 1234547 - RNA, 21 nt, Human
cuaagcuucacuguaaaauaa

SEQ ID NO: 1234548 - RNA, 14 nt, Human
cuaaggacuucuuu

SEQ ID NO: 1234549 - RNA, 15 nt, Human
cuaaggacuucuuua

SEQ ID NO: 1234550 - RNA, 16 nt, Human
cuaaggacuucuuuaa

SEQ ID NO: 1234551 - RNA, 22 nt, Human
cuaaggacuucuuuaauuuugg

SEQ ID NO: 1234552 - RNA, 22 nt, Human
cuaauagggcaauuaauuccuu

SEQ ID NO: 1234553 - RNA, 20 nt, Human
cuaccaaggucuucuuaaua

SEQ ID NO: 1234554 - RNA, 22 nt, Human
cuaggaaauauuuauuuuaaua

SEQ ID NO: 1234555 - RNA, 15 nt, Human
cucagcucacugcaa

SEQ ID NO: 1234556 - RNA, 20 nt, Human
cucagcucacuacaaccucc

SEQ ID NO: 1234557 - RNA, 14 nt, Human
cucagcucacugca

SEQ ID NO: 1234558 - RNA, 20 nt, Human
cucagcucacugcaaccucc

SEQ ID NO: 1234559 - RNA, 23 nt, Human
cucagauuuuauuauguaaaucc

SEQ ID NO: 1234560 - RNA, 24 nt, Human
cucaggagcccugggaggcucugg

SEQ ID NO: 1234561 - RNA, 20 nt, Human
cucagcucucaguugcagcc

SEQ ID NO: 1234562 - RNA, 12 nt, Human
cucaggagcccu

SEQ ID NO: 1234563 - RNA, 13 nt, Human
cucaggagcccug

SEQ ID NO: 1234564 - RNA, 14 nt, Human
cucaggagcccugg

SEQ ID NO: 1234565 - RNA, 15 nt, Human
cucaggagcccuggg

SEQ ID NO: 1234566 - RNA, 16 nt, Human
cucaggagcccuggga

SEQ ID NO: 1234567 - RNA, 17 nt, Human
cucaggagcccugggag

SEQ ID NO: 1234568 - RNA, 20 nt, Human
cucaggagcccugggaggcu

SEQ ID NO: 1234569 - RNA, 21 nt, Human
cucaggagcccugggaggcuc

SEQ ID NO: 1234570 - RNA, 22 nt, Human
cucaggagcccugggaggcucu

SEQ ID NO: 1234571 - RNA, 23 nt, Human
cucaggagcccugggaggcucug

SEQ ID NO: 1234572 - RNA, 21 nt, Human
cucauuuccaagcaaguauua

SEQ ID NO: 1234573 - RNA, 17 nt, Human
cucauuuccaagcaagu

SEQ ID NO: 1234574 - RNA, 14 nt, Human
cucauuuccaagca

SEQ ID NO: 1234575 - RNA, 13 nt, Human
cucauuuccaagc

SEQ ID NO: 1234576 - RNA, 12 nt, Human
cucauuuccaag

SEQ ID NO: 1234577 - RNA, 12 nt, Human
cucauuucagga

SEQ ID NO: 1234578 - RNA, 13 nt, Human
cucauuucaggau

SEQ ID NO: 1234579 - RNA, 13 nt, Human
cuccaaaccacuu

SEQ ID NO: 1234580 - RNA, 22 nt, Human
cuccaaaccacuuuuugcagcu

SEQ ID NO: 1234581 - RNA, 13 nt, Human
cucaguugcagcc

SEQ ID NO: 1234582 - RNA, 18 nt, Human
cuccaccgcagaaggaag

SEQ ID NO: 1234583 - RNA, 16 nt, Human
cuccaccgcagaagga

SEQ ID NO: 1234584 - RNA, 17 nt, Human
cuccaccgcagaaggaa

SEQ ID NO: 1234585 - RNA, 20 nt, Human
cuccauuuaauaauuauaug

SEQ ID NO: 1234586 - RNA, 15 nt, Human
cuccauggcccugcc

SEQ ID NO: 1234587 - RNA, 16 nt, Human
cuccauggcccugcca

SEQ ID NO: 1234588 - RNA, 19 nt, Human
cuccauggcccugccaugc

SEQ ID NO: 1234589 - RNA, 13 nt, Human
cuccauuuaauaa

SEQ ID NO: 1234590 - RNA, 13 nt, Human
cucccucaaccuc

SEQ ID NO: 1234591 - RNA, 17 nt, Human
cucccucaaccucaucc

SEQ ID NO: 1234592 - RNA, 14 nt, Human
cuauugcauuuaua

SEQ ID NO: 1234593 - RNA, 17 nt, Human
cuauugcauuuauaugu

SEQ ID NO: 1234594 - RNA, 19 nt, Human
cuauugcauuuauauguac

SEQ ID NO: 1234595 - RNA, 19 nt, Human
cuauuucuauauuuucauu

SEQ ID NO: 1234596 - RNA, 20 nt, Human
cuauuucuauauuuucauuc

SEQ ID NO: 1234597 - RNA, 23 nt, Human
cucaacuccgugcuuaaccaaag

SEQ ID NO: 1234598 - RNA, 12 nt, Human
cuauaauuuaaa

SEQ ID NO: 1234599 - RNA, 13 nt, Human
cuauaauuuaaau

SEQ ID NO: 1234600 - RNA, 15 nt, Human
cuauaccaauaaagu

SEQ ID NO: 1234601 - RNA, 16 nt, Human
cuauaccaauaaagug

SEQ ID NO: 1234602 - RNA, 15 nt, Human
cuauacccacccaga

SEQ ID NO: 1234603 - RNA, 16 nt, Human
cuauacccacccagaa

SEQ ID NO: 1234604 - RNA, 19 nt, Human
cuaugaaauauuauguuaa

SEQ ID NO: 1234605 - RNA, 19 nt, Human
cuauauaagacaagaacuc

SEQ ID NO: 1234606 - RNA, 15 nt, Human
cuauagcuaaguaca

SEQ ID NO: 1234607 - RNA, 17 nt, Human
cuauagcuaaguacaca

SEQ ID NO: 1234608 - RNA, 22 nt, Human
cuaugaaguuuuuuuuauacag

SEQ ID NO: 1234609 - RNA, 18 nt, Human
cuaugcugaguuugugcu

SEQ ID NO: 1234610 - RNA, 13 nt, Human
cuaugcugaguuu

SEQ ID NO: 1234611 - RNA, 14 nt, Human
cuaugcugaguuug

SEQ ID NO: 1234612 - RNA, 15 nt, Human
cuaugcugaguuugu

SEQ ID NO: 1234613 - RNA, 20 nt, Human
cuaggaaauauuuauuuuaa

SEQ ID NO: 1234614 - RNA, 19 nt, Human
cuaggaaauauuuauuuua

SEQ ID NO: 1234615 - RNA, 15 nt, Human
cuaggaaauauuuau

SEQ ID NO: 1234616 - RNA, 14 nt, Human
cuaggaaauauuua

SEQ ID NO: 1234617 - RNA, 14 nt, Human
cuagacuggugacu

SEQ ID NO: 1234618 - RNA, 15 nt, Human
cuagacuggugacug

SEQ ID NO: 1234619 - RNA, 17 nt, Human
cuagacuggugacugau

SEQ ID NO: 1234620 - RNA, 18 nt, Human
cuagacuggugacugauu

SEQ ID NO: 1234621 - RNA, 19 nt, Human
cuagacuggugacugauuc

SEQ ID NO: 1234622 - RNA, 22 nt, Human
cuagacuggugacugauucuuc

SEQ ID NO: 1234623 - RNA, 23 nt, Human
cuagacuggugacugauucuuca

SEQ ID NO: 1234624 - RNA, 19 nt, Human
cuagaguuuagcuggaaaa

SEQ ID NO: 1234625 - RNA, 18 nt, Human
cuagaguuuagcuggaaa

SEQ ID NO: 1234626 - RNA, 15 nt, Human
cugccuaaggacuuc

SEQ ID NO: 1234627 - RNA, 19 nt, Human
cugccuaaggacuucuuua

SEQ ID NO: 1234628 - RNA, 12 nt, Human
cugccuaaggac

SEQ ID NO: 1234629 - RNA, 13 nt, Human
cugccuaaggacu

SEQ ID NO: 1234630 - RNA, 14 nt, Human
cugccuaaggacuu

SEQ ID NO: 1234631 - RNA, 22 nt, Human
cugccucucugcaggucccuaa

SEQ ID NO: 1234632 - RNA, 20 nt, Human
cugccucucugcaggucccu

SEQ ID NO: 1234633 - RNA, 21 nt, Human
cugccucucugcaggucccua

SEQ ID NO: 1234634 - RNA, 19 nt, Human
cucccuucaugcauggaaa

SEQ ID NO: 1234635 - RNA, 14 nt, Human
cugcugcugccugc

SEQ ID NO: 1234636 - RNA, 15 nt, Human
cugcugcugccugcc

SEQ ID NO: 1234637 - RNA, 16 nt, Human
cugcugcuacaauguc

SEQ ID NO: 1234638 - RNA, 13 nt, Human
cuggaauuugaaa

SEQ ID NO: 1234639 - RNA, 16 nt, Human
cuggagaugaggccag

SEQ ID NO: 1234640 - RNA, 17 nt, Human
cuggagaugaggccaga

SEQ ID NO: 1234641 - RNA, 18 nt, Human
cuggagaugaggccagac

SEQ ID NO: 1234642 - RNA, 20 nt, Human
cuggagaugaggccagacca

SEQ ID NO: 1234643 - RNA, 19 nt, Human
cuggagaugaggccagacc

SEQ ID NO: 1234644 - RNA, 23 nt, Human
cuggccccacccucguggacacc

SEQ ID NO: 1234645 - RNA, 12 nt, Human
cuggccccaccc

SEQ ID NO: 1234646 - RNA, 14 nt, Human
cuggagugcagugg

SEQ ID NO: 1234647 - RNA, 20 nt, Human
cuguauuuuaaaagaaugau

SEQ ID NO: 1234648 - RNA, 22 nt, Human
cuguauuuuaaaagaaugauua

SEQ ID NO: 1234649 - RNA, 16 nt, Human
cuguauagauuagaau

SEQ ID NO: 1234650 - RNA, 20 nt, Human
cuguauagauuagaauucug

SEQ ID NO: 1234651 - RNA, 16 nt, Human
cugugcaaggccuggu

SEQ ID NO: 1234652 - RNA, 22 nt, Human
cugucuccuaagcuggagugca

SEQ ID NO: 1234653 - RNA, 23 nt, Human
cuguucaugaaagauucaaugcc

SEQ ID NO: 1234654 - RNA, 18 nt, Human
cuguucaugaaagauuca

SEQ ID NO: 1234655 - RNA, 17 nt, Human
cuguucaugaaagauuc

SEQ ID NO: 1234656 - RNA, 15 nt, Human
cuguucauuccucca

SEQ ID NO: 1234657 - RNA, 16 nt, Human
cuguucauuccuccag

SEQ ID NO: 1234658 - RNA, 17 nt, Human
cuguucauuccuccagg

SEQ ID NO: 1234659 - RNA, 22 nt, Human
cuguucauuccuccagguauuc

SEQ ID NO: 1234660 - RNA, 19 nt, Human
cugugugcucaggagcccu

SEQ ID NO: 1234661 - RNA, 20 nt, Human
cugugugcucaggagcccug

SEQ ID NO: 1234662 - RNA, 21 nt, Human
cugugugcucaggagcccugg

SEQ ID NO: 1234663 - RNA, 23 nt, Human
cugugugcucaggagcccuggga

SEQ ID NO: 1234664 - RNA, 15 nt, Human
cuguguggcagucug

SEQ ID NO: 1234665 - RNA, 15 nt, Human
cuucuuuaauuuugg

SEQ ID NO: 1234666 - RNA, 16 nt, Human
cuucuuuaauuuugga

SEQ ID NO: 1234667 - RNA, 17 nt, Human
cuucuuuaauuuuggaa

SEQ ID NO: 1234668 - RNA, 18 nt, Human
cuucuuuaauuuuggaau

SEQ ID NO: 1234669 - RNA, 19 nt, Human
cuucuuuaauuuuggaauu

SEQ ID NO: 1234670 - RNA, 12 nt, Human
cuugaaaaaugc

SEQ ID NO: 1234671 - RNA, 18 nt, Human
cuugaaaaaugcauguug

SEQ ID NO: 1234672 - RNA, 12 nt, Human
cuugaaaauuaa

SEQ ID NO: 1234673 - RNA, 13 nt, Human
cuugaaaauuaac

SEQ ID NO: 1234674 - RNA, 18 nt, Human
cuugaaaauuaacaugaa

SEQ ID NO: 1234675 - RNA, 12 nt, Human
cuuccacccagu

SEQ ID NO: 1234676 - RNA, 14 nt, Human
cuuccacccagugc

SEQ ID NO: 1234677 - RNA, 20 nt, Human
cuucccuuuccugaguccca

SEQ ID NO: 1234678 - RNA, 14 nt, Human
cuucccuuuccuga

SEQ ID NO: 1234679 - RNA, 22 nt, Human
cuuagaugcaguucugaagaag

SEQ ID NO: 1234680 - RNA, 19 nt, Human
cuuauaucuauauuuuaca

SEQ ID NO: 1234681 - RNA, 13 nt, Human
cuuauauuaugga

SEQ ID NO: 1234682 - RNA, 14 nt, Human
cuuugaccugccuc

SEQ ID NO: 1234683 - RNA, 15 nt, Human
cuuugaccugccucc

SEQ ID NO: 1234684 - RNA, 18 nt, Human
cuuugaccugccucccuu

SEQ ID NO: 1234685 - RNA, 22 nt, Human
cuuugcauaacguauaaaagcc

SEQ ID NO: 1234686 - RNA, 20 nt, Human
cuuugucuacaccauuaugu

SEQ ID NO: 1234687 - RNA, 23 nt, Human
cuuugucuacaccauuaugugcg

SEQ ID NO: 1234688 - RNA, 15 nt, Human
cuuugugcugggguu

SEQ ID NO: 1234689 - RNA, 20 nt, Human
cuuugugcugggguuaucug

SEQ ID NO: 1234690 - RNA, 22 nt, Human
cuuugugcugggguuaucugaa

SEQ ID NO: 1234691 - RNA, 14 nt, Human
cuuuggcugcaugc

SEQ ID NO: 1234692 - RNA, 16 nt, Human
cuuuggcugcaugcga

SEQ ID NO: 1234693 - RNA, 16 nt, Human
cuuucucuuucguuac

SEQ ID NO: 1234694 - RNA, 22 nt, Human
cuuguuagaucuaguucacucu

SEQ ID NO: 1234695 - RNA, 16 nt, Human
cuuuaaaaggaaagaa

SEQ ID NO: 1234696 - RNA, 18 nt, Human
cuuuaaaaggaaagaaaa

SEQ ID NO: 1234697 - RNA, 17 nt, Human
cuuuaaaaggaaagaaa

SEQ ID NO: 1234698 - RNA, 17 nt, Human
cuuuaaaauuacaacua

SEQ ID NO: 1234699 - RNA, 19 nt, Human
cuuuaaaauuacaacuaag

SEQ ID NO: 1234700 - RNA, 20 nt, Human
cuuuaaaauuacaacuaagu

SEQ ID NO: 1234701 - RNA, 23 nt, Human
cuuuaucuugaauaauguaagac

SEQ ID NO: 1234702 - RNA, 18 nt, Human
cuuuaucuugaauaaugu

SEQ ID NO: 1234703 - RNA, 21 nt, Human
cuuuaucuugaauaauguaag

SEQ ID NO: 1234704 - RNA, 19 nt, Human
cuugaguuuaaauuguaau

SEQ ID NO: 1234705 - RNA, 12 nt, Human
cuuguguaaaua

SEQ ID NO: 1234706 - RNA, 14 nt, Human
cuuguguaaauaca

SEQ ID NO: 1234707 - RNA, 16 nt, Human
cuuguguaaauacaau

SEQ ID NO: 1234708 - RNA, 21 nt, Human
cuuguguaaauacaauuuugu

SEQ ID NO: 1234709 - RNA, 23 nt, Human
cuugucaauaaaauccauacauu

SEQ ID NO: 1234710 - RNA, 17 nt, Human
cuuguacuuuauuuucu

SEQ ID NO: 1234711 - RNA, 16 nt, Human
gaaacacaacuauauu

SEQ ID NO: 1234712 - RNA, 21 nt, Human
gaaacccugcacccauuagca

SEQ ID NO: 1234713 - RNA, 23 nt, Human
gaaacucguuaauuuguaguguu

SEQ ID NO: 1234714 - RNA, 19 nt, Human
gaaacuaggugcauauuua

SEQ ID NO: 1234715 - RNA, 17 nt, Human
gaaacggaugauuucua

SEQ ID NO: 1234716 - RNA, 18 nt, Human
gaaacggaugauuucuau

SEQ ID NO: 1234717 - RNA, 14 nt, Human
gaaaccuuccaccc

SEQ ID NO: 1234718 - RNA, 17 nt, Human
gaaagagaacuuccaga

SEQ ID NO: 1234719 - RNA, 13 nt, Human
gaaagaggaagca

SEQ ID NO: 1234720 - RNA, 21 nt, Human
gaaagaguacucuuguuuccu

SEQ ID NO: 1234721 - RNA, 19 nt, Human
gaaagcuauauaagacaag

SEQ ID NO: 1234722 - RNA, 17 nt, Human
gaaagcgccuccaaccc

SEQ ID NO: 1234723 - RNA, 22 nt, Human
gaaagcgccuccaacccuagca

SEQ ID NO: 1234724 - RNA, 15 nt, Human
gaaaaguugaauuuu

SEQ ID NO: 1234725 - RNA, 15 nt, Human
gaaaaguuuaauauu

SEQ ID NO: 1234726 - RNA, 14 nt, Human
gaaaaguugaauuu

SEQ ID NO: 1234727 - RNA, 19 nt, Human
gaaaaguuuaauauuaaag

SEQ ID NO: 1234728 - RNA, 20 nt, Human
gaaaaguuuaauauuaaagc

SEQ ID NO: 1234729 - RNA, 21 nt, Human
gaaaaguuuaauauuaaagcc

SEQ ID NO: 1234730 - RNA, 22 nt, Human
gaaaaguuuaauauuaaagcca

SEQ ID NO: 1234731 - RNA, 18 nt, Human
gaaaaucuuauaauuuaa

SEQ ID NO: 1234732 - RNA, 22 nt, Human
gaaaauauuguuuuacaauagu

SEQ ID NO: 1234733 - RNA, 15 nt, Human
gaaaauauuguuuua

SEQ ID NO: 1234734 - RNA, 23 nt, Human
gaaaaguuuaauauuaaagccau

SEQ ID NO: 1234735 - RNA, 16 nt, Human
cuuuuuggcauaacau

SEQ ID NO: 1234736 - RNA, 20 nt, Human
cuuuuuggcauaacauaaau

SEQ ID NO: 1234737 - RNA, 22 nt, Human
cuuuuuggcauaacauaaaucu

SEQ ID NO: 1234738 - RNA, 17 nt, Human
cuuuuuauggccuguga

SEQ ID NO: 1234739 - RNA, 16 nt, Human
gacaugggacauuugc

SEQ ID NO: 1234740 - RNA, 17 nt, Human
gacaugggacauuugcu

SEQ ID NO: 1234741 - RNA, 16 nt, Human
gaccaccucucaauau

SEQ ID NO: 1234742 - RNA, 22 nt, Human
gacaauugagguaaguuuuuug

SEQ ID NO: 1234743 - RNA, 16 nt, Human
gacaaggaaaaaauaa

SEQ ID NO: 1234744 - RNA, 20 nt, Human
gaauuucuaggacugaauua

SEQ ID NO: 1234745 - RNA, 19 nt, Human
gaauuucuaggacugaauu

SEQ ID NO: 1234746 - RNA, 20 nt, Human
gaauuugauaugugaacagu

SEQ ID NO: 1234747 - RNA, 20 nt, Human
gaauuugugaagguggaaau

SEQ ID NO: 1234748 - RNA, 13 nt, Human
gaauucuguauag

SEQ ID NO: 1234749 - RNA, 14 nt, Human
gaauucuguauaga

SEQ ID NO: 1234750 - RNA, 21 nt, Human
gaauucuguauagauuagaau

SEQ ID NO: 1234751 - RNA, 22 nt, Human
gaauucuguauagauuagaauu

SEQ ID NO: 1234752 - RNA, 16 nt, Human
gaauuggagcucgugg

SEQ ID NO: 1234753 - RNA, 14 nt, Human
gaauggcuuuguau

SEQ ID NO: 1234754 - RNA, 16 nt, Human
gaauggcuuuguauag

SEQ ID NO: 1234755 - RNA, 17 nt, Human
gaauggcuuuguauaga

SEQ ID NO: 1234756 - RNA, 21 nt, Human
gaauggcuuuguauagaaccu

SEQ ID NO: 1234757 - RNA, 16 nt, Human
gacugcauuauauuua

SEQ ID NO: 1234758 - RNA, 14 nt, Human
gacugcauuauauu

SEQ ID NO: 1234759 - RNA, 24 nt, Human
gacugcauuauauuuauuacugua

SEQ ID NO: 1234760 - RNA, 17 nt, Human
gacuggguaggaaagag

SEQ ID NO: 1234761 - RNA, 15 nt, Human
gacuuggccccugcc

SEQ ID NO: 1234762 - RNA, 16 nt, Human
gacuucuuuaauuuug

SEQ ID NO: 1234763 - RNA, 17 nt, Human
gacuucuuuaauuuugg

SEQ ID NO: 1234764 - RNA, 18 nt, Human
gacuucuuuaauuuugga

SEQ ID NO: 1234765 - RNA, 19 nt, Human
gacuucuuuaauuuuggaa

SEQ ID NO: 1234766 - RNA, 20 nt, Human
gacuucuuuaauuuuggaau

SEQ ID NO: 1234767 - RNA, 21 nt, Human
gacuucuuuaauuuuggaauu

SEQ ID NO: 1234768 - RNA, 21 nt, Human
gagaaaugaaaaaauauauau

SEQ ID NO: 1234769 - RNA, 22 nt, Human
gagaaccuagggugauauuaac

SEQ ID NO: 1234770 - RNA, 21 nt, Human
gagaaccuagggugauauuaa

SEQ ID NO: 1234771 - RNA, 14 nt, Human
gagaaauuuauaaa

SEQ ID NO: 1234772 - RNA, 13 nt, Human
gagaagaacugaa

SEQ ID NO: 1234773 - RNA, 16 nt, Human
gagaagaaagaacgga

SEQ ID NO: 1234774 - RNA, 21 nt, Human
gagaagaaagaacggaagaag

SEQ ID NO: 1234775 - RNA, 23 nt, Human
gagaacuuccagauccuggaaau

SEQ ID NO: 1234776 - RNA, 22 nt, Human
gagaacuuccagauccuggaaa

SEQ ID NO: 1234777 - RNA, 17 nt, Human
gagaaugagagacacac

SEQ ID NO: 1234778 - RNA, 13 nt, Human
gagaguguugaaa

SEQ ID NO: 1234779 - RNA, 15 nt, Human
gagacuggguaggaa

SEQ ID NO: 1234780 - RNA, 21 nt, Human
gagaaugagagacacacugaa

SEQ ID NO: 1234781 - RNA, 20 nt, Human
gagaaugagagacacacuga

SEQ ID NO: 1234782 - RNA, 20 nt, Human
gagcaagaccccaucucaaa

SEQ ID NO: 1234783 - RNA, 13 nt, Human
gagcacugcucca

SEQ ID NO: 1234784 - RNA, 15 nt, Human
gagaugaggccagac

SEQ ID NO: 1234785 - RNA, 13 nt, Human
gagaugaggccag

SEQ ID NO: 1234786 - RNA, 14 nt, Human
gagaugaggccaga

SEQ ID NO: 1234787 - RNA, 21 nt, Human
gagcccuucuauacccaccca

SEQ ID NO: 1234788 - RNA, 22 nt, Human
gagcccuucuauacccacccag

SEQ ID NO: 1234789 - RNA, 23 nt, Human
gagcccuucuauacccacccaga

SEQ ID NO: 1234790 - RNA, 16 nt, Human
gaggcagagaagaaag

SEQ ID NO: 1234791 - RNA, 18 nt, Human
gaggcagagaagaaagaa

SEQ ID NO: 1234792 - RNA, 21 nt, Human
gaggcgcaugaauuugugaag

SEQ ID NO: 1234793 - RNA, 23 nt, Human
gaggcugggaauggaggggcaga

SEQ ID NO: 1234794 - RNA, 22 nt, Human
gaggcugggaauggaggggcag

SEQ ID NO: 1234795 - RNA, 12 nt, Human
gagguaaguuuu

SEQ ID NO: 1234796 - RNA, 18 nt, Human
gagguugaaaaacaaaau

SEQ ID NO: 1234797 - RNA, 22 nt, Human
gaguaauccaagcaaaugugaa

SEQ ID NO: 1234798 - RNA, 21 nt, Human
gagucuauuuacggaacucaa

SEQ ID NO: 1234799 - RNA, 24 nt, Human
gauaugauucaaaugucuauaaac

SEQ ID NO: 1234800 - RNA, 22 nt, Human
gauaugauucaaaugucuauaa

SEQ ID NO: 1234801 - RNA, 14 nt, Human
gauaugauucaaau

SEQ ID NO: 1234802 - RNA, 15 nt, Human
gauauaagugugugu

SEQ ID NO: 1234803 - RNA, 17 nt, Human
gauauaaguguguguuu

SEQ ID NO: 1234804 - RNA, 22 nt, Human
gauaaauggcuuccuggcaaua

SEQ ID NO: 1234805 - RNA, 20 nt, Human
gauaaaugccaucaauaaaa

SEQ ID NO: 1234806 - RNA, 15 nt, Human
gauaaaugauagaca

SEQ ID NO: 1234807 - RNA, 11 nt, Human
gauaaaugcca

SEQ ID NO: 1234808 - RNA, 15 nt, Human
gauaaaugccaucaa

SEQ ID NO: 1234809 - RNA, 16 nt, Human
gaguguugaaacggau

SEQ ID NO: 1234810 - RNA, 23 nt, Human
gcacaaauucugucucuggauua

SEQ ID NO: 1234811 - RNA, 13 nt, Human
gcaauuuaaaugu

SEQ ID NO: 1234812 - RNA, 18 nt, Human
gcaauuuaaauguuauga

SEQ ID NO: 1234813 - RNA, 16 nt, Human
gcaauuaauuccuuca

SEQ ID NO: 1234814 - RNA, 20 nt, Human
gcaauuacaacggagucaaa

SEQ ID NO: 1234815 - RNA, 19 nt, Human
gcaauuaauuccuucagca

SEQ ID NO: 1234816 - RNA, 13 nt, Human
gcaacucugaagg

SEQ ID NO: 1234817 - RNA, 22 nt, Human
gcaccccagcuggggccaggcu

SEQ ID NO: 1234818 - RNA, 19 nt, Human
gcacuguggguagacacac

SEQ ID NO: 1234819 - RNA, 12 nt, Human
gcagaaggaagg

SEQ ID NO: 1234820 - RNA, 13 nt, Human
gcagaaggaaggc

SEQ ID NO: 1234821 - RNA, 15 nt, Human
gcagaaggaaggcag

SEQ ID NO: 1234822 - RNA, 22 nt, Human
gcagaaggaaggcagggaggag

SEQ ID NO: 1234823 - RNA, 16 nt, Human
gcagaaggaaggcagg

SEQ ID NO: 1234824 - RNA, 14 nt, Human
gcacuggccccacc

SEQ ID NO: 1234825 - RNA, 16 nt, Human
gcaaauugucacagga

SEQ ID NO: 1234826 - RNA, 13 nt, Human
gcaacaauaaaua

SEQ ID NO: 1234827 - RNA, 20 nt, Human
gauucaaugccccugaauuu

SEQ ID NO: 1234828 - RNA, 19 nt, Human
gauucaaugccccugaauu

SEQ ID NO: 1234829 - RNA, 21 nt, Human
gauucaaugccccugaauuua

SEQ ID NO: 1234830 - RNA, 14 nt, Human
gauuacacacguga

SEQ ID NO: 1234831 - RNA, 16 nt, Human
gauguuuaguaaucau

SEQ ID NO: 1234832 - RNA, 22 nt, Human
gaugguucccuugaugaagaag

SEQ ID NO: 1234833 - RNA, 17 nt, Human
gaugggguuucaccaug

SEQ ID NO: 1234834 - RNA, 12 nt, Human
gcccuggacugu

SEQ ID NO: 1234835 - RNA, 16 nt, Human
gcccuggacugugugc

SEQ ID NO: 1234836 - RNA, 22 nt, Human
gcccuggacugugugcucagga

SEQ ID NO: 1234837 - RNA, 13 nt, Human
gcccugggaggcu

SEQ ID NO: 1234838 - RNA, 14 nt, Human
gcccugggaggcuc

SEQ ID NO: 1234839 - RNA, 15 nt, Human
gcccugggaggcucu

SEQ ID NO: 1234840 - RNA, 16 nt, Human
gcccugggaggcucug

SEQ ID NO: 1234841 - RNA, 23 nt, Human
gcccugggaggcucuggagccca

SEQ ID NO: 1234842 - RNA, 17 nt, Human
gcccugggaggcucugg

SEQ ID NO: 1234843 - RNA, 18 nt, Human
gcccugggaggcucugga

SEQ ID NO: 1234844 - RNA, 19 nt, Human
gcccugggaggcucuggag

SEQ ID NO: 1234845 - RNA, 21 nt, Human
gcccugggaggcucuggagcc

SEQ ID NO: 1234846 - RNA, 19 nt, Human
gccucaccagcccuggcaa

SEQ ID NO: 1234847 - RNA, 19 nt, Human
gccucucugcaggucccua

SEQ ID NO: 1234848 - RNA, 22 nt, Human
gccuggggcugaggcugaggca

SEQ ID NO: 1234849 - RNA, 18 nt, Human
gccugcuuuuuauggccu

SEQ ID NO: 1234850 - RNA, 19 nt, Human
gccugcuuuuuauggccug

SEQ ID NO: 1234851 - RNA, 22 nt, Human
gccugcuuuuuauggccuguga

SEQ ID NO: 1234852 - RNA, 13 nt, Human
gccugauuaaaga

SEQ ID NO: 1234853 - RNA, 16 nt, Human
gccugauuaaagaaug

SEQ ID NO: 1234854 - RNA, 23 nt, Human
gccugcacggugaauggcuuugu

SEQ ID NO: 1234855 - RNA, 23 nt, Human
gccucucugcaggucccuaauaa

SEQ ID NO: 1234856 - RNA, 20 nt, Human
gccucucugcaggucccuaa

SEQ ID NO: 1234857 - RNA, 21 nt, Human
gccucucugcaggucccuaau

SEQ ID NO: 1234858 - RNA, 20 nt, Human
gccugagugacagagcaaga

SEQ ID NO: 1234859 - RNA, 17 nt, Human
gcucuccuccaccucaa

SEQ ID NO: 1234860 - RNA, 14 nt, Human
gcucuugaugccug

SEQ ID NO: 1234861 - RNA, 15 nt, Human
gcucuugaugccugg

SEQ ID NO: 1234862 - RNA, 16 nt, Human
gcucuugaugccuggc

SEQ ID NO: 1234863 - RNA, 17 nt, Human
gcucuugaugccuggcg

SEQ ID NO: 1234864 - RNA, 16 nt, Human
gcugauggagaaggaa

SEQ ID NO: 1234865 - RNA, 17 nt, Human
gcugauggagaaggaag

SEQ ID NO: 1234866 - RNA, 23 nt, Human
gccugugagcuaggaauuguguu

SEQ ID NO: 1234867 - RNA, 14 nt, Human
gcuaagcauuccaa

SEQ ID NO: 1234868 - RNA, 11 nt, Human
gcuaaggacuu

SEQ ID NO: 1234869 - RNA, 20 nt, Human
gcuccauuuuuagugaaaua

SEQ ID NO: 1234870 - RNA, 14 nt, Human
gcuccaagaauuuc

SEQ ID NO: 1234871 - RNA, 18 nt, Human
gcuuaugcuuaaauucaa

SEQ ID NO: 1234872 - RNA, 17 nt, Human
gcuuauaauaaaggacu

SEQ ID NO: 1234873 - RNA, 20 nt, Human
gcugucuacacuaagagaga

SEQ ID NO: 1234874 - RNA, 12 nt, Human
gcuguucaugaa

SEQ ID NO: 1234875 - RNA, 21 nt, Human
gcuguucaugaaagauucaau

SEQ ID NO: 1234876 - RNA, 14 nt, Human
ggaaaaguuuaaua

SEQ ID NO: 1234877 - RNA, 18 nt, Human
ggaaaaguuuaauauuaa

SEQ ID NO: 1234878 - RNA, 13 nt, Human
ggaacauaaaaag

SEQ ID NO: 1234879 - RNA, 18 nt, Human
ggaacauaaaaaggacau

SEQ ID NO: 1234880 - RNA, 16 nt, Human
gcuuuucccaaaagcc

SEQ ID NO: 1234881 - RNA, 15 nt, Human
ggaaaacauuccauc

SEQ ID NO: 1234882 - RNA, 23 nt, Human
gcuuucagauacuggauuguacu

SEQ ID NO: 1234883 - RNA, 14 nt, Human
gcuuucagauacug

SEQ ID NO: 1234884 - RNA, 18 nt, Human
gcuuucagauacuggauu

SEQ ID NO: 1234885 - RNA, 14 nt, Human
ggaauggaggggca

SEQ ID NO: 1234886 - RNA, 16 nt, Human
ggaauggaggggcaga

SEQ ID NO: 1234887 - RNA, 17 nt, Human
ggaauggaggggcagag

SEQ ID NO: 1234888 - RNA, 21 nt, Human
ggaauggaggggcagagccag

SEQ ID NO: 1234889 - RNA, 19 nt, Human
ggaauuacgugcucugugg

SEQ ID NO: 1234890 - RNA, 12 nt, Human
ggaauucuguau

SEQ ID NO: 1234891 - RNA, 15 nt, Human
ggaauucuguauaga

SEQ ID NO: 1234892 - RNA, 17 nt, Human
ggaauucuguauagauu

SEQ ID NO: 1234893 - RNA, 17 nt, Human
ggacaaaauggaauacu

SEQ ID NO: 1234894 - RNA, 16 nt, Human
ggacaaaauggaauac

SEQ ID NO: 1234895 - RNA, 19 nt, Human
ggaauuuucaucuaggauu

SEQ ID NO: 1234896 - RNA, 15 nt, Human
ggacacuacacccag

SEQ ID NO: 1234897 - RNA, 16 nt, Human
ggacacuacacccagc

SEQ ID NO: 1234898 - RNA, 17 nt, Human
ggacacuacacccagca

SEQ ID NO: 1234899 - RNA, 18 nt, Human
ggacacuacacccagcaa

SEQ ID NO: 1234900 - RNA, 19 nt, Human
ggacacuacacccagcaau

SEQ ID NO: 1234901 - RNA, 20 nt, Human
ggacacuacacccagcaaua

SEQ ID NO: 1234902 - RNA, 21 nt, Human
ggacacuacacccagcaauag

SEQ ID NO: 1234903 - RNA, 12 nt, Human
ggaauuguguuu

SEQ ID NO: 1234904 - RNA, 22 nt, Human
ggaauuggagcucgugggacag

SEQ ID NO: 1234905 - RNA, 16 nt, Human
ggaauuggagcucgug

SEQ ID NO: 1234906 - RNA, 18 nt, Human
ggaagugcuaauuuugaa

SEQ ID NO: 1234907 - RNA, 17 nt, Human
ggaaggcagggaggagg

SEQ ID NO: 1234908 - RNA, 21 nt, Human
ggaaggcagggaggaggcaga

SEQ ID NO: 1234909 - RNA, 16 nt, Human
ggaacgcguugaaauu

SEQ ID NO: 1234910 - RNA, 22 nt, Human
ggacacuacacccagcaauaga

SEQ ID NO: 1234911 - RNA, 16 nt, Human
ggacauuugcucaugg

SEQ ID NO: 1234912 - RNA, 16 nt, Human
ggaccaaaaaccagua

SEQ ID NO: 1234913 - RNA, 23 nt, Human
ggaccaaaaaccaguauuguaca

SEQ ID NO: 1234914 - RNA, 15 nt, Human
ggacuguggugacuu

SEQ ID NO: 1234915 - RNA, 17 nt, Human
ggacuguggugacuuug

SEQ ID NO: 1234916 - RNA, 21 nt, Human
ggacuguggugacuuuggaua

SEQ ID NO: 1234917 - RNA, 22 nt, Human
ggacuguggugacuuuggauaa

SEQ ID NO: 1234918 - RNA, 17 nt, Human
ggacugugugcucagga

SEQ ID NO: 1234919 - RNA, 14 nt, Human
ggacuguggugacu

SEQ ID NO: 1234920 - RNA, 14 nt, Human
ggagaugaggccag

SEQ ID NO: 1234921 - RNA, 15 nt, Human
ggagaugaggccaga

SEQ ID NO: 1234922 - RNA, 16 nt, Human
ggagaugaggccagac

SEQ ID NO: 1234923 - RNA, 19 nt, Human
ggcaaucauggugcucaga

SEQ ID NO: 1234924 - RNA, 16 nt, Human
ggauucuuaaaguuga

SEQ ID NO: 1234925 - RNA, 18 nt, Human
ggauucuuaaaguugaau

SEQ ID NO: 1234926 - RNA, 19 nt, Human
ggauucuuaaaguugaauu

SEQ ID NO: 1234927 - RNA, 20 nt, Human
ggauucuuaaaguugaauuu

SEQ ID NO: 1234928 - RNA, 18 nt, Human
ggagaugaggccagacca

SEQ ID NO: 1234929 - RNA, 11 nt, Human
ggccugugagc

SEQ ID NO: 1234930 - RNA, 20 nt, Human
ggccuguggaucaaauccag

SEQ ID NO: 1234931 - RNA, 23 nt, Human
guacuuuauuuucuauaauuuaa

SEQ ID NO: 1234932 - RNA, 12 nt, Human
guacuuuuuggc

SEQ ID NO: 1234933 - RNA, 21 nt, Human
guacuuuuuggcauaacauaa

SEQ ID NO: 1234934 - RNA, 14 nt, Human
guacuugcucuuga

SEQ ID NO: 1234935 - RNA, 22 nt, Human
guacuugcucuugaugccuggc

SEQ ID NO: 1234936 - RNA, 15 nt, Human
guacuugcucuugau

SEQ ID NO: 1234937 - RNA, 16 nt, Human
guacuugcucuugaug

SEQ ID NO: 1234938 - RNA, 18 nt, Human
guacuugcucuugaugcc

SEQ ID NO: 1234939 - RNA, 19 nt, Human
guacuugcucuugaugccu

SEQ ID NO: 1234940 - RNA, 15 nt, Human
guacagacagaaaaa

SEQ ID NO: 1234941 - RNA, 13 nt, Human
guaauuauaucug

SEQ ID NO: 1234942 - RNA, 15 nt, Human
guaauuggaaaggca

SEQ ID NO: 1234943 - RNA, 23 nt, Human
guaauucuaccaaggucuucuua

SEQ ID NO: 1234944 - RNA, 11 nt, Human
guaaugaaaac

SEQ ID NO: 1234945 - RNA, 13 nt, Human
guaaugaaaacca

SEQ ID NO: 1234946 - RNA, 19 nt, Human
guaaugauaacuggaaacu

SEQ ID NO: 1234947 - RNA, 20 nt, Human
gguuuucacauuggaaacaa

SEQ ID NO: 1234948 - RNA, 17 nt, Human
guaaaaauggaaacuau

SEQ ID NO: 1234949 - RNA, 18 nt, Human
guaaaaacaaagaaauua

SEQ ID NO: 1234950 - RNA, 20 nt, Human
guaaaaacaaagaaauuaug

SEQ ID NO: 1234951 - RNA, 23 nt, Human
guaagcauaagcuuaugcuuaaa

SEQ ID NO: 1234952 - RNA, 16 nt, Human
guaaaucccauuauuc

SEQ ID NO: 1234953 - RNA, 17 nt, Human
guaaaucccauuauuca

SEQ ID NO: 1234954 - RNA, 18 nt, Human
guaaaucccauuauucaa

SEQ ID NO: 1234955 - RNA, 19 nt, Human
guaaaucccauuauucaaa

SEQ ID NO: 1234956 - RNA, 20 nt, Human
guaaaucccauuauucaaag

SEQ ID NO: 1234957 - RNA, 21 nt, Human
guaaaucccauuauucaaagu

SEQ ID NO: 1234958 - RNA, 21 nt, Human
guaaauacaauuuuguuucug

SEQ ID NO: 1234959 - RNA, 16 nt, Human
guaaaauaaaaggucg

SEQ ID NO: 1234960 - RNA, 22 nt, Human
guaaauacaauuuuguuucugu

SEQ ID NO: 1234961 - RNA, 23 nt, Human
guaaauacaauuuuguuucugua

SEQ ID NO: 1234962 - RNA, 15 nt, Human
guaaaucccauuauu

SEQ ID NO: 1234963 - RNA, 14 nt, Human
ggugaauggcuuug

SEQ ID NO: 1234964 - RNA, 17 nt, Human
ggugaauggcuuuguau

SEQ ID NO: 1234965 - RNA, 20 nt, Human
ggugaauggcuuuguauaga

SEQ ID NO: 1234966 - RNA, 18 nt, Human
ggucccuaauaaagcugu

SEQ ID NO: 1234967 - RNA, 12 nt, Human
ggucccuaauaa

SEQ ID NO: 1234968 - RNA, 13 nt, Human
ggucccuaauaaa

SEQ ID NO: 1234969 - RNA, 16 nt, Human
ggucccuaauaaagcu

SEQ ID NO: 1234970 - RNA, 17 nt, Human
ggucccuaauaaagcug

SEQ ID NO: 1234971 - RNA, 16 nt, Human
gguccgugcuaaggac

SEQ ID NO: 1234972 - RNA, 17 nt, Human
gguccgugcuaaggacu

SEQ ID NO: 1234973 - RNA, 18 nt, Human
gguccgugcuaaggacuu

SEQ ID NO: 1234974 - RNA, 19 nt, Human
ggugcccugcuuucagaua

SEQ ID NO: 1234975 - RNA, 22 nt, Human
gguagacacacaugaaguccaa

SEQ ID NO: 1234976 - RNA, 15 nt, Human
gguagacacacauga

SEQ ID NO: 1234977 - RNA, 20 nt, Human
ggguuucaccauguuggcca

SEQ ID NO: 1234978 - RNA, 22 nt, Human
gguacuucaaauccuugaagau

SEQ ID NO: 1234979 - RNA, 19 nt, Human
gggugcugggccccugccu

SEQ ID NO: 1234980 - RNA, 22 nt, Human
gggcuccuccaggguggcagca

SEQ ID NO: 1234981 - RNA, 23 nt, Human
gggcuccuccaggguggcagcaa

SEQ ID NO: 1234982 - RNA, 20 nt, Human
gggcuuauaauaaaggacug

SEQ ID NO: 1234983 - RNA, 16 nt, Human
gggccuuuggcaggug

SEQ ID NO: 1234984 - RNA, 20 nt, Human
ggggcuuauaauaaaggacu

SEQ ID NO: 1234985 - RNA, 13 nt, Human
ggggcagagccag

SEQ ID NO: 1234986 - RNA, 14 nt, Human
ggggcagagccagg

SEQ ID NO: 1234987 - RNA, 15 nt, Human
ggggcagagccagga

SEQ ID NO: 1234988 - RNA, 16 nt, Human
ggggcagagccaggaa

SEQ ID NO: 1234989 - RNA, 18 nt, Human
guauuuuaaaagaaugau

SEQ ID NO: 1234990 - RNA, 17 nt, Human
guauuuuaaaagaauga

SEQ ID NO: 1234991 - RNA, 16 nt, Human
guauuuuaaaagaaug

SEQ ID NO: 1234992 - RNA, 21 nt, Human
gucaauaaaauccauacauuu

SEQ ID NO: 1234993 - RNA, 15 nt, Human
gucaauaaaauccau

SEQ ID NO: 1234994 - RNA, 20 nt, Human
gucacccaggcuggacugca

SEQ ID NO: 1234995 - RNA, 20 nt, Human
gucacccagguuggagugca

SEQ ID NO: 1234996 - RNA, 14 nt, Human
gucaccucauggaa

SEQ ID NO: 1234997 - RNA, 15 nt, Human
guauuauguguguuu

SEQ ID NO: 1234998 - RNA, 19 nt, Human
guauucaaaaauuaucuau

SEQ ID NO: 1234999 - RNA, 22 nt, Human
guauuacaguggggaaugaaga

SEQ ID NO: 1235000 - RNA, 20 nt, Human
guauuacaguggggaaugaa

SEQ ID NO: 1235001 - RNA, 22 nt, Human
guauuucuaugaaauauuaugu

SEQ ID NO: 1235002 - RNA, 17 nt, Human
guauuucuaugaaauau

SEQ ID NO: 1235003 - RNA, 16 nt, Human
guauucguuaucuaau

SEQ ID NO: 1235004 - RNA, 19 nt, Human
gucacguuuggugcuucuc

SEQ ID NO: 1235005 - RNA, 21 nt, Human
gucucuauaccaauaaaguga

SEQ ID NO: 1235006 - RNA, 13 nt, Human
gucugacuguuuc

SEQ ID NO: 1235007 - RNA, 23 nt, Human
gucuacacuaagagagaaugaga

SEQ ID NO: 1235008 - RNA, 17 nt, Human
gucuacacuaagagaga

SEQ ID NO: 1235009 - RNA, 13 nt, Human
gucucagauuuua

SEQ ID NO: 1235010 - RNA, 14 nt, Human
gucucagauuuuau

SEQ ID NO: 1235011 - RNA, 20 nt, Human
gugaaacucguuaauuugua

SEQ ID NO: 1235012 - RNA, 19 nt, Human
gugaaagaaaauaacaaua

SEQ ID NO: 1235013 - RNA, 13 nt, Human
gugaaagaaguaa

SEQ ID NO: 1235014 - RNA, 13 nt, Human
gugaaaucauuca

SEQ ID NO: 1235015 - RNA, 18 nt, Human
gugaaauuauucauaauu

SEQ ID NO: 1235016 - RNA, 20 nt, Human
gugaaauuauucauaauuau

SEQ ID NO: 1235017 - RNA, 13 nt, Human
gugaauggcuuug

SEQ ID NO: 1235018 - RNA, 14 nt, Human
gugaauggcuuugu

SEQ ID NO: 1235019 - RNA, 17 nt, Human
gugaauggcuuuguaua

SEQ ID NO: 1235020 - RNA, 18 nt, Human
gugaauggcuuuguauag

SEQ ID NO: 1235021 - RNA, 19 nt, Human
gugaauggcuuuguauaga

SEQ ID NO: 1235022 - RNA, 16 nt, Human
gugagcagucaggaaa

SEQ ID NO: 1235023 - RNA, 16 nt, Human
gugacaagcucacaga

SEQ ID NO: 1235024 - RNA, 24 nt, Human
gugcaguggcaucaucucagcuca

SEQ ID NO: 1235025 - RNA, 23 nt, Human
gugcagggccuguaaucccagca

SEQ ID NO: 1235026 - RNA, 18 nt, Human
gugcaaauugucacagga

SEQ ID NO: 1235027 - RNA, 24 nt, Human
gugcaguggcgcgaucucagcuca

SEQ ID NO: 1235028 - RNA, 24 nt, Human
gugcaguggcgugaucucagcuca

SEQ ID NO: 1235029 - RNA, 19 nt, Human
guggaacauaaaaaggaca

SEQ ID NO: 1235030 - RNA, 20 nt, Human
guggaacauaaaaaggacau

SEQ ID NO: 1235031 - RNA, 21 nt, Human
guggaacauaaaaaggacauc

SEQ ID NO: 1235032 - RNA, 11 nt, Human
guggcagucug

SEQ ID NO: 1235033 - RNA, 19 nt, Human
guggcaucaucucagcuca

SEQ ID NO: 1235034 - RNA, 22 nt, Human
ucaccgacugaaaauauuguuu

SEQ ID NO: 1235035 - RNA, 14 nt, Human
ucaccagagacuuu

SEQ ID NO: 1235036 - RNA, 15 nt, Human
ucaccagagacuuua

SEQ ID NO: 1235037 - RNA, 19 nt, Human
ucaccagagacuuuagggg

SEQ ID NO: 1235038 - RNA, 17 nt, Human
ucacauuggaaacaagu

SEQ ID NO: 1235039 - RNA, 18 nt, Human
ucacauugguguuguacu

SEQ ID NO: 1235040 - RNA, 22 nt, Human
ucacauuguauucagaguugau

SEQ ID NO: 1235041 - RNA, 12 nt, Human
ucacauuuaaau

SEQ ID NO: 1235042 - RNA, 14 nt, Human
ucacauuggaaaca

SEQ ID NO: 1235043 - RNA, 14 nt, Human
ucaauaaaauccau

SEQ ID NO: 1235044 - RNA, 19 nt, Human
ucaauaaaaaauuaugaca

SEQ ID NO: 1235045 - RNA, 23 nt, Human
ucaauuaaaauagucucuuuaaa

SEQ ID NO: 1235046 - RNA, 22 nt, Human
ucaacuccaaacugacucuuaa

SEQ ID NO: 1235047 - RNA, 13 nt, Human
ucaauaaaaaauu

SEQ ID NO: 1235048 - RNA, 14 nt, Human
ucaauaaaaaauua

SEQ ID NO: 1235049 - RNA, 16 nt, Human
ucaauaaaaaauuaug

SEQ ID NO: 1235050 - RNA, 16 nt, Human
ucaaauccuugaagau

SEQ ID NO: 1235051 - RNA, 17 nt, Human
ucaaacauauauaacaa

SEQ ID NO: 1235052 - RNA, 20 nt, Human
ucaaaccaaaucacugaacu

SEQ ID NO: 1235053 - RNA, 16 nt, Human
uauguucagauuauug

SEQ ID NO: 1235054 - RNA, 19 nt, Human
uauguuagugcaaauuguc

SEQ ID NO: 1235055 - RNA, 12 nt, Human
uauguuaaaacu

SEQ ID NO: 1235056 - RNA, 14 nt, Human
uauggaggcaggag

SEQ ID NO: 1235057 - RNA, 13 nt, Human
uauguguguuuua

SEQ ID NO: 1235058 - RNA, 17 nt, Human
uauuauauuuacaaaug

SEQ ID NO: 1235059 - RNA, 16 nt, Human
uauuaagcauauauuu

SEQ ID NO: 1235060 - RNA, 16 nt, Human
uauuauguuaaaacug

SEQ ID NO: 1235061 - RNA, 22 nt, Human
uauuauguaaaucccauuauuc

SEQ ID NO: 1235062 - RNA, 20 nt, Human
uauuauggaggcaggaguuu

SEQ ID NO: 1235063 - RNA, 12 nt, Human
uauuauguaaau

SEQ ID NO: 1235064 - RNA, 15 nt, Human
uauuauguaaauccc

SEQ ID NO: 1235065 - RNA, 20 nt, Human
uauuaugaaacuuguguaaa

SEQ ID NO: 1235066 - RNA, 21 nt, Human
uauuaugaaacuuguguaaau

SEQ ID NO: 1235067 - RNA, 22 nt, Human
uauuaugaaacuuguguaaaua

SEQ ID NO: 1235068 - RNA, 12 nt, Human
uauuaugaaacu

SEQ ID NO: 1235069 - RNA, 13 nt, Human
uauugcauuuaua

SEQ ID NO: 1235070 - RNA, 17 nt, Human
uauugcauuuauaugua

SEQ ID NO: 1235071 - RNA, 19 nt, Human
uauugugcgcuaaacuuuu

SEQ ID NO: 1235072 - RNA, 22 nt, Human
uauugugcgcuaaacuuuucug

SEQ ID NO: 1235073 - RNA, 23 nt, Human
uauugugcgcuaaacuuuucuga

SEQ ID NO: 1235074 - RNA, 14 nt, Human
uauuuauuacugua

SEQ ID NO: 1235075 - RNA, 13 nt, Human
uauuucuaugaaa

SEQ ID NO: 1235076 - RNA, 16 nt, Human
uauuugaaccaauaaa

SEQ ID NO: 1235077 - RNA, 21 nt, Human
uauuucuaugaaauauuaugu

SEQ ID NO: 1235078 - RNA, 15 nt, Human
uauuucuaugaaaua

SEQ ID NO: 1235079 - RNA, 14 nt, Human
uauuucuaugaaau

SEQ ID NO: 1235080 - RNA, 13 nt, Human
uauaugcuucugu

SEQ ID NO: 1235081 - RNA, 14 nt, Human
uauauguguaugca

SEQ ID NO: 1235082 - RNA, 13 nt, Human
uauauaacaaugc

SEQ ID NO: 1235083 - RNA, 18 nt, Human
uauaucugaggaauucug

SEQ ID NO: 1235084 - RNA, 19 nt, Human
uauaucugaggaauucugu

SEQ ID NO: 1235085 - RNA, 20 nt, Human
uauaucugaggaauucugua

SEQ ID NO: 1235086 - RNA, 21 nt, Human
uauaucugaggaauucuguau

SEQ ID NO: 1235087 - RNA, 22 nt, Human
uauaucugaggaauucuguaua

SEQ ID NO: 1235088 - RNA, 17 nt, Human
uauacuauaguaccagu

SEQ ID NO: 1235089 - RNA, 17 nt, Human
uaguugccuuaaaauaa

SEQ ID NO: 1235090 - RNA, 14 nt, Human
uauaauaaaggacu

SEQ ID NO: 1235091 - RNA, 19 nt, Human
uauaauaaaggacuguaau

SEQ ID NO: 1235092 - RNA, 22 nt, Human
uauaauaaaggacuguaaucuu

SEQ ID NO: 1235093 - RNA, 12 nt, Human
uauaauuaacau

SEQ ID NO: 1235094 - RNA, 13 nt, Human
uauaauuaacaug

SEQ ID NO: 1235095 - RNA, 14 nt, Human
uauaauuaacaugu

SEQ ID NO: 1235096 - RNA, 15 nt, Human
uauaauuaacauguu

SEQ ID NO: 1235097 - RNA, 16 nt, Human
uauaauuaacauguua

SEQ ID NO: 1235098 - RNA, 18 nt, Human
uauaauuaacauguuaaa

SEQ ID NO: 1235099 - RNA, 19 nt, Human
uauaauuaacauguuaaac

SEQ ID NO: 1235100 - RNA, 22 nt, Human
uauaauuaacauguuaaaccau

SEQ ID NO: 1235101 - RNA, 15 nt, Human
uauaauucacauugu

SEQ ID NO: 1235102 - RNA, 20 nt, Human
uauaauucacauuguauuca

SEQ ID NO: 1235103 - RNA, 19 nt, Human
uaguauuucuaugaaauau

SEQ ID NO: 1235104 - RNA, 18 nt, Human
uaguauuucuaugaaaua

SEQ ID NO: 1235105 - RNA, 15 nt, Human
uagugcaaauuguca

SEQ ID NO: 1235106 - RNA, 14 nt, Human
uagugcaaauuguc

SEQ ID NO: 1235107 - RNA, 14 nt, Human
uagucaaauugugu

SEQ ID NO: 1235108 - RNA, 13 nt, Human
uagucaaauugug

SEQ ID NO: 1235109 - RNA, 13 nt, Human
uaguguucauaaa

SEQ ID NO: 1235110 - RNA, 20 nt, Human
uaguugcaacuuuguauaaa

SEQ ID NO: 1235111 - RNA, 16 nt, Human
uaggucagugcaaaua

SEQ ID NO: 1235112 - RNA, 15 nt, Human
uaggucucaauaccu

SEQ ID NO: 1235113 - RNA, 17 nt, Human
uaucugaggaauucugu

SEQ ID NO: 1235114 - RNA, 18 nt, Human
uaucugaggaauucugua

SEQ ID NO: 1235115 - RNA, 19 nt, Human
uaucugaggaauucuguau

SEQ ID NO: 1235116 - RNA, 21 nt, Human
uaucugaggaauucuguauag

SEQ ID NO: 1235117 - RNA, 22 nt, Human
uaucugaggaauucuguauaga

SEQ ID NO: 1235118 - RNA, 15 nt, Human
uaucguaaaauuaag

SEQ ID NO: 1235119 - RNA, 18 nt, Human
uaucguaaaauuaagaaa

SEQ ID NO: 1235120 - RNA, 23 nt, Human
uaugaauuacauuuguauaaaau

SEQ ID NO: 1235121 - RNA, 17 nt, Human
uaugaauuacauuugua

SEQ ID NO: 1235122 - RNA, 20 nt, Human
uaugaaguuuuuuuuauaca

SEQ ID NO: 1235123 - RNA, 16 nt, Human
uaugcuucuguuuuau

SEQ ID NO: 1235124 - RNA, 15 nt, Human
uaugcuucuguuuua

SEQ ID NO: 1235125 - RNA, 20 nt, Human
uaugcauauuauuuuauguu

SEQ ID NO: 1235126 - RNA, 14 nt, Human
uaugcacaguaaaa

SEQ ID NO: 1235127 - RNA, 16 nt, Human
uaugacuauguaaacu

SEQ ID NO: 1235128 - RNA, 17 nt, Human
uaugacuauguaaacua

SEQ ID NO: 1235129 - RNA, 18 nt, Human
uaugacuauguaaacuac

SEQ ID NO: 1235130 - RNA, 21 nt, Human
uaugauucaaaugucuauaaa

SEQ ID NO: 1235131 - RNA, 16 nt, Human
uaugauucaaaugucu

SEQ ID NO: 1235132 - RNA, 16 nt, Human
uaugauucccagccag

SEQ ID NO: 1235133 - RNA, 18 nt, Human
ucaggagcccugggaggc

SEQ ID NO: 1235134 - RNA, 11 nt, Human
ucaggagcccu

SEQ ID NO: 1235135 - RNA, 12 nt, Human
ucaggagcccug

SEQ ID NO: 1235136 - RNA, 14 nt, Human
ucaggagcccuggg

SEQ ID NO: 1235137 - RNA, 15 nt, Human
ucaggagcccuggga

SEQ ID NO: 1235138 - RNA, 13 nt, Human
ucaggcuagaugu

SEQ ID NO: 1235139 - RNA, 15 nt, Human
ucagucucuauacca

SEQ ID NO: 1235140 - RNA, 18 nt, Human
ucagucucuauaccaaua

SEQ ID NO: 1235141 - RNA, 21 nt, Human
ucagucucuauaccaauaaag

SEQ ID NO: 1235142 - RNA, 20 nt, Human
ucagucucuauaccaauaaa

SEQ ID NO: 1235143 - RNA, 22 nt, Human
uccaaaccacuuuuugcagcuu

SEQ ID NO: 1235144 - RNA, 12 nt, Human
uccaaaccacuu

SEQ ID NO: 1235145 - RNA, 14 nt, Human
ucauggugcucaga

SEQ ID NO: 1235146 - RNA, 19 nt, Human
ucaucucagcucacugcaa

SEQ ID NO: 1235147 - RNA, 16 nt, Human
ucaucuccccaucauu

SEQ ID NO: 1235148 - RNA, 17 nt, Human
ucaugcuguucaugaaa

SEQ ID NO: 1235149 - RNA, 19 nt, Human
ucauggaauuggagcucgu

SEQ ID NO: 1235150 - RNA, 20 nt, Human
ucauggaacgcguugaaauu

SEQ ID NO: 1235151 - RNA, 21 nt, Human
ucauggaacgcguugaaauug

SEQ ID NO: 1235152 - RNA, 22 nt, Human
ucauggaacgcguugaaauugu

SEQ ID NO: 1235153 - RNA, 14 nt, Human
ucccauguucaagc

SEQ ID NO: 1235154 - RNA, 13 nt, Human
ucccauuauucaa

SEQ ID NO: 1235155 - RNA, 14 nt, Human
ucccauuauucaaa

SEQ ID NO: 1235156 - RNA, 16 nt, Human
ucccauuauucaaagu

SEQ ID NO: 1235157 - RNA, 18 nt, Human
ucccauuauucaaaguug

SEQ ID NO: 1235158 - RNA, 19 nt, Human
ucccauuauucaaaguugc

SEQ ID NO: 1235159 - RNA, 19 nt, Human
uccagguagagggugugua

SEQ ID NO: 1235160 - RNA, 21 nt, Human
uccagguauucguuaucuaau

SEQ ID NO: 1235161 - RNA, 14 nt, Human
uccaguaaaauaau

SEQ ID NO: 1235162 - RNA, 20 nt, Human
uccaguuuuguuuggaccaa

SEQ ID NO: 1235163 - RNA, 15 nt, Human
uccaguuuuguuugg

SEQ ID NO: 1235164 - RNA, 17 nt, Human
uccaguuuuguuuggac

SEQ ID NO: 1235165 - RNA, 15 nt, Human
uccauacauuugugu

SEQ ID NO: 1235166 - RNA, 20 nt, Human
uccaugggccauaugaaaag

SEQ ID NO: 1235167 - RNA, 14 nt, Human
uccagauccuggaa

SEQ ID NO: 1235168 - RNA, 14 nt, Human
uccagcagauuauu

SEQ ID NO: 1235169 - RNA, 15 nt, Human
uccagcagauuauuc

SEQ ID NO: 1235170 - RNA, 16 nt, Human
uccagcagauuauuca

SEQ ID NO: 1235171 - RNA, 17 nt, Human
uccagcagauuauucac

SEQ ID NO: 1235172 - RNA, 19 nt, Human
uccagaaauacaauuuuag

SEQ ID NO: 1235173 - RNA, 23 nt, Human
uccagaaagaaaacuuguauuau

SEQ ID NO: 1235174 - RNA, 21 nt, Human
ucccuucaucuggaaccauca

SEQ ID NO: 1235175 - RNA, 15 nt, Human
uccgcuauccaccaa

SEQ ID NO: 1235176 - RNA, 17 nt, Human
uccuccaccucaacucc

SEQ ID NO: 1235177 - RNA, 20 nt, Human
uccuccaggguggcagcaac

SEQ ID NO: 1235178 - RNA, 21 nt, Human
uccuccaggguggcagcaaca

SEQ ID NO: 1235179 - RNA, 20 nt, Human
uccuaucaccugucuugccu

SEQ ID NO: 1235180 - RNA, 22 nt, Human
uccuaagcuggagugcaguggc

SEQ ID NO: 1235181 - RNA, 17 nt, Human
uccuggcaauagucaaa

SEQ ID NO: 1235182 - RNA, 12 nt, Human
ucguggacaccu

SEQ ID NO: 1235183 - RNA, 13 nt, Human
ucguggacaccug

SEQ ID NO: 1235184 - RNA, 14 nt, Human
ucguggacaccugc

SEQ ID NO: 1235185 - RNA, 15 nt, Human
ucguggacaccugcc

SEQ ID NO: 1235186 - RNA, 16 nt, Human
ucguggacaccugccc

SEQ ID NO: 1235187 - RNA, 17 nt, Human
ucguggacaccugcccu

SEQ ID NO: 1235188 - RNA, 18 nt, Human
ucguggacaccugcccug

SEQ ID NO: 1235189 - RNA, 19 nt, Human
ucguggacaccugcccugc

SEQ ID NO: 1235190 - RNA, 20 nt, Human
ucguggacaccugcccugcc

SEQ ID NO: 1235191 - RNA, 17 nt, Human
ucuacacuaagagagaa

SEQ ID NO: 1235192 - RNA, 15 nt, Human
ucucagucugucacc

SEQ ID NO: 1235193 - RNA, 16 nt, Human
ucucauacccucccuc

SEQ ID NO: 1235194 - RNA, 16 nt, Human
ucuccagccucagccu

SEQ ID NO: 1235195 - RNA, 19 nt, Human
ucuccagccucagccuccc

SEQ ID NO: 1235196 - RNA, 18 nt, Human
ucuccagccucagcucuc

SEQ ID NO: 1235197 - RNA, 15 nt, Human
ugauagaggaagccu

SEQ ID NO: 1235198 - RNA, 24 nt, Human
ugaucagcuuauugucuagugaaa

SEQ ID NO: 1235199 - RNA, 17 nt, Human
ugaucagcuuauugucu

SEQ ID NO: 1235200 - RNA, 23 nt, Human
ugaugcuacaggauuugaaauug

SEQ ID NO: 1235201 - RNA, 20 nt, Human
ugaugcuacaggauuugaaa

SEQ ID NO: 1235202 - RNA, 11 nt, Human
ugaugccuggc

SEQ ID NO: 1235203 - RNA, 13 nt, Human
ugaugguuguaca

SEQ ID NO: 1235204 - RNA, 14 nt, Human
ugaugguuguacau

SEQ ID NO: 1235205 - RNA, 21 nt, Human
ugaugguuguacauauaagug

SEQ ID NO: 1235206 - RNA, 22 nt, Human
ugauuaugaauuacauuuguau

SEQ ID NO: 1235207 - RNA, 21 nt, Human
ugauuaugaauuacauuugua

SEQ ID NO: 1235208 - RNA, 22 nt, Human
ugauguuuagaaacacaacuau

SEQ ID NO: 1235209 - RNA, 19 nt, Human
ugauuaugaauuacauuug

SEQ ID NO: 1235210 - RNA, 17 nt, Human
ugauuaugaauuacauu

SEQ ID NO: 1235211 - RNA, 13 nt, Human
ugauuauauguca

SEQ ID NO: 1235212 - RNA, 21 nt, Human
ugauucuucagcaaaaauauu

SEQ ID NO: 1235213 - RNA, 17 nt, Human
ugagaaauuuauaaacu

SEQ ID NO: 1235214 - RNA, 12 nt, Human
ugagaccaccuc

SEQ ID NO: 1235215 - RNA, 15 nt, Human
ugagaccaccucuca

SEQ ID NO: 1235216 - RNA, 19 nt, Human
ugagaccaccucucaauau

SEQ ID NO: 1235217 - RNA, 16 nt, Human
ugauaacuggaaacuu

SEQ ID NO: 1235218 - RNA, 17 nt, Human
ugagggagaacaagacc

SEQ ID NO: 1235219 - RNA, 16 nt, Human
ugaggagcuugaaacc

SEQ ID NO: 1235220 - RNA, 16 nt, Human
ugaaagaugaucauuu

SEQ ID NO: 1235221 - RNA, 15 nt, Human
ugaaagguacuucaa

SEQ ID NO: 1235222 - RNA, 16 nt, Human
ugaaagguacuucaaa

SEQ ID NO: 1235223 - RNA, 20 nt, Human
ugaaaagcuccauuuuuagu

SEQ ID NO: 1235224 - RNA, 16 nt, Human
ugaaaagcagacauuu

SEQ ID NO: 1235225 - RNA, 19 nt, Human
ugaacaguuguguuugaag

SEQ ID NO: 1235226 - RNA, 16 nt, Human
ugaaauauugacuuuu

SEQ ID NO: 1235227 - RNA, 15 nt, Human
ugaaaucauucauuu

SEQ ID NO: 1235228 - RNA, 12 nt, Human
ugaaauuauuca

SEQ ID NO: 1235229 - RNA, 20 nt, Human
ugaaauuaugugacauuuua

SEQ ID NO: 1235230 - RNA, 22 nt, Human
ugaaauuaugugacauuuuaca

SEQ ID NO: 1235231 - RNA, 16 nt, Human
ucuugccuuuuucauu

SEQ ID NO: 1235232 - RNA, 17 nt, Human
ucuugccuuuuucauua

SEQ ID NO: 1235233 - RNA, 19 nt, Human
ucuugccuuuuucauuauu

SEQ ID NO: 1235234 - RNA, 14 nt, Human
ucuuugccacccuc

SEQ ID NO: 1235235 - RNA, 16 nt, Human
ucuuugccacccucau

SEQ ID NO: 1235236 - RNA, 17 nt, Human
ucuuugccacccucaug

SEQ ID NO: 1235237 - RNA, 18 nt, Human
ucuuugccacccucaugc

SEQ ID NO: 1235238 - RNA, 20 nt, Human
ucuuugccacccucaugcug

SEQ ID NO: 1235239 - RNA, 12 nt, Human
ucuuugccaagu

SEQ ID NO: 1235240 - RNA, 16 nt, Human
ucuuucuuucaauaaa

SEQ ID NO: 1235241 - RNA, 22 nt, Human
ugaaucauuuuaccuuugacaa

SEQ ID NO: 1235242 - RNA, 23 nt, Human
ugaaucauuuuaccuuugacaaa

SEQ ID NO: 1235243 - RNA, 17 nt, Human
ugaauuaugaaacuuuu

SEQ ID NO: 1235244 - RNA, 15 nt, Human
ugaauuaugaaacuu

SEQ ID NO: 1235245 - RNA, 13 nt, Human
ugaauuaugaaac

SEQ ID NO: 1235246 - RNA, 16 nt, Human
ugaauuauuuucucuc

SEQ ID NO: 1235247 - RNA, 18 nt, Human
ugaauuacauuuguauaa

SEQ ID NO: 1235248 - RNA, 16 nt, Human
ugaauuacauuuguau

SEQ ID NO: 1235249 - RNA, 15 nt, Human
ugaauuacauuugua

SEQ ID NO: 1235250 - RNA, 15 nt, Human
ugaauuauauguuca

SEQ ID NO: 1235251 - RNA, 20 nt, Human
ugaagucagaucugccuaag

SEQ ID NO: 1235252 - RNA, 11 nt, Human
ugaaguccaag

SEQ ID NO: 1235253 - RNA, 23 nt, Human
ugaagucagaucugccuaaggac

SEQ ID NO: 1235254 - RNA, 13 nt, Human
ugaaguccaagca

SEQ ID NO: 1235255 - RNA, 14 nt, Human
ugaagauacugaaa

SEQ ID NO: 1235256 - RNA, 18 nt, Human
ugaagauacugaaauaaa

SEQ ID NO: 1235257 - RNA, 16 nt, Human
ugaagauacugaaaua

SEQ ID NO: 1235258 - RNA, 15 nt, Human
ugaagauacugaaau

SEQ ID NO: 1235259 - RNA, 18 nt, Human
ugacaugggacauuugcu

SEQ ID NO: 1235260 - RNA, 17 nt, Human
ugacaugggacauuugc

SEQ ID NO: 1235261 - RNA, 16 nt, Human
ugacauagucuggcug

SEQ ID NO: 1235262 - RNA, 17 nt, Human
ugacauagucuggcugu

SEQ ID NO: 1235263 - RNA, 20 nt, Human
ugacaagcucacagaccuuu

SEQ ID NO: 1235264 - RNA, 15 nt, Human
ugacaagcucacaga

SEQ ID NO: 1235265 - RNA, 12 nt, Human
ugacaagcucac

SEQ ID NO: 1235266 - RNA, 23 nt, Human
ugacauaaguauuuaauucaugu

SEQ ID NO: 1235267 - RNA, 14 nt, Human
ugcaguucugaaga

SEQ ID NO: 1235268 - RNA, 12 nt, Human
ugcaguucugaa

SEQ ID NO: 1235269 - RNA, 18 nt, Human
ugcauauuauuuuauguu

SEQ ID NO: 1235270 - RNA, 14 nt, Human
ugccaccugucugu

SEQ ID NO: 1235271 - RNA, 15 nt, Human
ugccaccugucuguc

SEQ ID NO: 1235272 - RNA, 16 nt, Human
ugccaccugucugucu

SEQ ID NO: 1235273 - RNA, 14 nt, Human
ugccaccuccugcc

SEQ ID NO: 1235274 - RNA, 10 nt, Human
ugccaccugu

SEQ ID NO: 1235275 - RNA, 11 nt, Human
ugccaccuguc

SEQ ID NO: 1235276 - RNA, 12 nt, Human
ugccaccugucu

SEQ ID NO: 1235277 - RNA, 13 nt, Human
ugccaccugucug

SEQ ID NO: 1235278 - RNA, 17 nt, Human
ugccaggcuggagugca

SEQ ID NO: 1235279 - RNA, 19 nt, Human
ugccaggcuggagugcagu

SEQ ID NO: 1235280 - RNA, 20 nt, Human
ugccuaaauccauuuggaaa

SEQ ID NO: 1235281 - RNA, 22 nt, Human
ugccuaaauccauuuggaaauc

SEQ ID NO: 1235282 - RNA, 23 nt, Human
ugccuaaauccauuuggaaaucu

SEQ ID NO: 1235283 - RNA, 20 nt, Human
ugccucacccacccuuuuuu

SEQ ID NO: 1235284 - RNA, 23 nt, Human
ugccucacccacccuuuuuuaaa

SEQ ID NO: 1235285 - RNA, 13 nt, Human
ugccuaaauccau

SEQ ID NO: 1235286 - RNA, 15 nt, Human
ugccuaaauccauuu

SEQ ID NO: 1235287 - RNA, 19 nt, Human
ugccuaaauccauuuggaa

SEQ ID NO: 1235288 - RNA, 13 nt, Human
ugcugcugccugc

SEQ ID NO: 1235289 - RNA, 14 nt, Human
ugcugcugccugcc

SEQ ID NO: 1235290 - RNA, 14 nt, Human
ugcugggccccugc

SEQ ID NO: 1235291 - RNA, 16 nt, Human
ugcugggccccugccu

SEQ ID NO: 1235292 - RNA, 17 nt, Human
ugcugggccccugccuc

SEQ ID NO: 1235293 - RNA, 18 nt, Human
ugcugggccccugccucu

SEQ ID NO: 1235294 - RNA, 19 nt, Human
ugcugggccccugccucuc

SEQ ID NO: 1235295 - RNA, 21 nt, Human
ugcugggccccugccucucug

SEQ ID NO: 1235296 - RNA, 22 nt, Human
ugcugggccccugccucucugc

SEQ ID NO: 1235297 - RNA, 23 nt, Human
ugcugggccccugccucucugca

SEQ ID NO: 1235298 - RNA, 24 nt, Human
ugcugggccccugccucucugcag

SEQ ID NO: 1235299 - RNA, 15 nt, Human
ugcugccugcuuuuu

SEQ ID NO: 1235300 - RNA, 17 nt, Human
ugcugccugcuuuuuau

SEQ ID NO: 1235301 - RNA, 17 nt, Human
ugcugggguuaucugaa

SEQ ID NO: 1235302 - RNA, 20 nt, Human
ugcugggguuaucugaaguc

SEQ ID NO: 1235303 - RNA, 13 nt, Human
ugcugguguaugu

SEQ ID NO: 1235304 - RNA, 22 nt, Human
ugcugguguaugugugaaguga

SEQ ID NO: 1235305 - RNA, 13 nt, Human
ugcugguuuuagu

SEQ ID NO: 1235306 - RNA, 17 nt, Human
ugcuguucaugaaagau

SEQ ID NO: 1235307 - RNA, 16 nt, Human
ugcuguucaugaaaga

SEQ ID NO: 1235308 - RNA, 13 nt, Human
ugcucuccuccac

SEQ ID NO: 1235309 - RNA, 18 nt, Human
ugcucaggagcccuggga

SEQ ID NO: 1235310 - RNA, 19 nt, Human
ugcucaggagcccugggag

SEQ ID NO: 1235311 - RNA, 20 nt, Human
ugcucaggagcccugggagg

SEQ ID NO: 1235312 - RNA, 20 nt, Human
ugccuugcauaauggucaga

SEQ ID NO: 1235313 - RNA, 19 nt, Human
ugcgcuaaacuuuucugau

SEQ ID NO: 1235314 - RNA, 20 nt, Human
ugcgcuaaacuuuucugaua

SEQ ID NO: 1235315 - RNA, 21 nt, Human
ugcgcuaaacuuuucugauag

SEQ ID NO: 1235316 - RNA, 15 nt, Human
uggcgggguggggug

SEQ ID NO: 1235317 - RNA, 15 nt, Human
uggcacuaguauuuc

SEQ ID NO: 1235318 - RNA, 20 nt, Human
uggcaauagucaaauugugu

SEQ ID NO: 1235319 - RNA, 20 nt, Human
uggauaauaaggaaaaguuu

SEQ ID NO: 1235320 - RNA, 11 nt, Human
uggagaaggaa

SEQ ID NO: 1235321 - RNA, 12 nt, Human
uggagaaggaag

SEQ ID NO: 1235322 - RNA, 13 nt, Human
uggagaaggaagg

SEQ ID NO: 1235323 - RNA, 14 nt, Human
uggagaaggaaggc

SEQ ID NO: 1235324 - RNA, 16 nt, Human
uggacacuacacccag

SEQ ID NO: 1235325 - RNA, 17 nt, Human
uggacacuacacccagc

SEQ ID NO: 1235326 - RNA, 18 nt, Human
uggacacuacacccagca

SEQ ID NO: 1235327 - RNA, 19 nt, Human
uggacacuacacccagcaa

SEQ ID NO: 1235328 - RNA, 20 nt, Human
uggacacuacacccagcaau

SEQ ID NO: 1235329 - RNA, 22 nt, Human
uggaccaaaaaccaguauugua

SEQ ID NO: 1235330 - RNA, 15 nt, Human
uggugacuuuggaua

SEQ ID NO: 1235331 - RNA, 19 nt, Human
uggugacugauucuucagc

SEQ ID NO: 1235332 - RNA, 15 nt, Human
uggugacugauucuu

SEQ ID NO: 1235333 - RNA, 16 nt, Human
uggugacugauucuuc

SEQ ID NO: 1235334 - RNA, 21 nt, Human
ugguauguuuucaggcuagau

SEQ ID NO: 1235335 - RNA, 13 nt, Human
ugguauguuuuca

SEQ ID NO: 1235336 - RNA, 17 nt, Human
ugguccgugcuaaggac

SEQ ID NO: 1235337 - RNA, 18 nt, Human
ugguccgugcuaaggacu

SEQ ID NO: 1235338 - RNA, 19 nt, Human
ugguccgugcuaaggacuu

SEQ ID NO: 1235339 - RNA, 20 nt, Human
ugguccgugcuaaggacuug

SEQ ID NO: 1235340 - RNA, 21 nt, Human
ugggccccugccucucugcag

SEQ ID NO: 1235341 - RNA, 23 nt, Human
ugggccccugccucucugcaggu

SEQ ID NO: 1235342 - RNA, 21 nt, Human
uggggccaggcugggucgccc

SEQ ID NO: 1235343 - RNA, 22 nt, Human
uggggccaggcugggucgcccu

SEQ ID NO: 1235344 - RNA, 18 nt, Human
uucccuugaugaagaagu

SEQ ID NO: 1235345 - RNA, 21 nt, Human
uucccucucucauacccuccc

SEQ ID NO: 1235346 - RNA, 17 nt, Human
uucccuugaugaagaag

SEQ ID NO: 1235347 - RNA, 22 nt, Human
uucccugcugugaaagaaguaa

SEQ ID NO: 1235348 - RNA, 20 nt, Human
uucccuggaaaccuuccacc

SEQ ID NO: 1235349 - RNA, 23 nt, Human
uucccuggaaaccuuccacccag

SEQ ID NO: 1235350 - RNA, 22 nt, Human
uucccuggaaaccuuccaccca

SEQ ID NO: 1235351 - RNA, 13 nt, Human
uuccauucuggaa

SEQ ID NO: 1235352 - RNA, 15 nt, Human
uuccauucuggaagu

SEQ ID NO: 1235353 - RNA, 17 nt, Human
uucaugcaaacuuuauu

SEQ ID NO: 1235354 - RNA, 13 nt, Human
uucaugcauggaa

SEQ ID NO: 1235355 - RNA, 14 nt, Human
uucaugcauggaaa

SEQ ID NO: 1235356 - RNA, 18 nt, Human
uucaugaaagauucaaug

SEQ ID NO: 1235357 - RNA, 17 nt, Human
uucaugaaagauucaau

SEQ ID NO: 1235358 - RNA, 15 nt, Human
uucaugaaagauuca

SEQ ID NO: 1235359 - RNA, 19 nt, Human
uuccacucguguguuucua

SEQ ID NO: 1235360 - RNA, 18 nt, Human
uuccagagcacugcucca

SEQ ID NO: 1235361 - RNA, 15 nt, Human
uuauugucuagugaa

SEQ ID NO: 1235362 - RNA, 16 nt, Human
uuauuuuaauaauguu

SEQ ID NO: 1235363 - RNA, 15 nt, Human
uuauuuuaauaaugu

SEQ ID NO: 1235364 - RNA, 12 nt, Human
uuauuggcuuuu

SEQ ID NO: 1235365 - RNA, 16 nt, Human
uuauuggcuuuucuga

SEQ ID NO: 1235366 - RNA, 18 nt, Human
uuauuggcuuuucugauc

SEQ ID NO: 1235367 - RNA, 22 nt, Human
uuauuggcuuuucugauccagu

SEQ ID NO: 1235368 - RNA, 17 nt, Human
uuauuuuaauaauguuu

SEQ ID NO: 1235369 - RNA, 20 nt, Human
uuauuuuauguugcauagaa

SEQ ID NO: 1235370 - RNA, 13 nt, Human
uuauuuuauuaug

SEQ ID NO: 1235371 - RNA, 14 nt, Human
uuauuuuauuauga

SEQ ID NO: 1235372 - RNA, 17 nt, Human
uucaaauccuugaagau

SEQ ID NO: 1235373 - RNA, 11 nt, Human
uucaaaguugc

SEQ ID NO: 1235374 - RNA, 15 nt, Human
uucaaaguugccuaa

SEQ ID NO: 1235375 - RNA, 16 nt, Human
uucaaaguugccuaaa

SEQ ID NO: 1235376 - RNA, 17 nt, Human
uucaaaguugccuaaau

SEQ ID NO: 1235377 - RNA, 23 nt, Human
uucaaaguugccuaaauccauuu

SEQ ID NO: 1235378 - RNA, 22 nt, Human
uucaaaucaaucuguaaaacua

SEQ ID NO: 1235379 - RNA, 23 nt, Human
uucaaaucaaucuguaaaacuaa

SEQ ID NO: 1235380 - RNA, 20 nt, Human
uucagauaaucacaauacau

SEQ ID NO: 1235381 - RNA, 21 nt, Human
uucagaguugaugguuguaca

SEQ ID NO: 1235382 - RNA, 22 nt, Human
uucagaguugaugguuguacau

SEQ ID NO: 1235383 - RNA, 21 nt, Human
uucacucuccauuuaauaauu

SEQ ID NO: 1235384 - RNA, 18 nt, Human
uuauuacuguaagaaaau

SEQ ID NO: 1235385 - RNA, 17 nt, Human
uuauuacuguaagaaaa

SEQ ID NO: 1235386 - RNA, 14 nt, Human
uuauuacaguauaa

SEQ ID NO: 1235387 - RNA, 16 nt, Human
uuauuaaacaaauaau

SEQ ID NO: 1235388 - RNA, 17 nt, Human
uuaucugaagucagauc

SEQ ID NO: 1235389 - RNA, 13 nt, Human
uuaguugcaacuu

SEQ ID NO: 1235390 - RNA, 20 nt, Human
uuaguugcaacuuuguauaa

SEQ ID NO: 1235391 - RNA, 21 nt, Human
uuauggcacuaguauuucuau

SEQ ID NO: 1235392 - RNA, 16 nt, Human
uuaugcuuaaauucaa

SEQ ID NO: 1235393 - RNA, 18 nt, Human
uuagagaguguugaaacg

SEQ ID NO: 1235394 - RNA, 12 nt, Human
uuagagauuuuu

SEQ ID NO: 1235395 - RNA, 13 nt, Human
uuagaucuaguuc

SEQ ID NO: 1235396 - RNA, 14 nt, Human
uuagaucuaguuca

SEQ ID NO: 1235397 - RNA, 22 nt, Human
uuagaugcaguucugaagaaga

SEQ ID NO: 1235398 - RNA, 21 nt, Human
uuagaugcaguucugaagaag

SEQ ID NO: 1235399 - RNA, 20 nt, Human
uuagaugcaguucugaagaa

SEQ ID NO: 1235400 - RNA, 13 nt, Human
uuagcuggaaaag

SEQ ID NO: 1235401 - RNA, 12 nt, Human
uuagcuggaaaa

SEQ ID NO: 1235402 - RNA, 14 nt, Human
uuaguguucauaaa

SEQ ID NO: 1235403 - RNA, 22 nt, Human
uuaggaaguugacuuauaguac

SEQ ID NO: 1235404 - RNA, 23 nt, Human
uuaggaaguugacuuauaguaca

SEQ ID NO: 1235405 - RNA, 14 nt, Human
uuagggaaaacauu

SEQ ID NO: 1235406 - RNA, 19 nt, Human
uuagaaacacaacuauauu

SEQ ID NO: 1235407 - RNA, 14 nt, Human
uuagagaguguuga

SEQ ID NO: 1235408 - RNA, 16 nt, Human
uuagagaguguugaaa

SEQ ID NO: 1235409 - RNA, 17 nt, Human
uuagagaguguugaaac

SEQ ID NO: 1235410 - RNA, 19 nt, Human
uuacugucuuuuuucuaaa

SEQ ID NO: 1235411 - RNA, 19 nt, Human
uuaagcauauauuuuuaua

SEQ ID NO: 1235412 - RNA, 23 nt, Human
uuaagcauauauuuuuauauuua

SEQ ID NO: 1235413 - RNA, 13 nt, Human
uuaagcauauauu

SEQ ID NO: 1235414 - RNA, 15 nt, Human
uuaagcauauauuuu

SEQ ID NO: 1235415 - RNA, 18 nt, Human
uuaagcauauauuuuuau

SEQ ID NO: 1235416 - RNA, 21 nt, Human
uuaauauuaaagccauguuua

SEQ ID NO: 1235417 - RNA, 22 nt, Human
uuaauauuaaagccauguuuau

SEQ ID NO: 1235418 - RNA, 22 nt, Human
uuaaugucaauucuugccaaau

SEQ ID NO: 1235419 - RNA, 14 nt, Human
uuaaagacuuuuau

SEQ ID NO: 1235420 - RNA, 21 nt, Human
uuaaauguuuuuuuuuaaaga

SEQ ID NO: 1235421 - RNA, 23 nt, Human
uuaaauguuuuuuuuuaaagacu

SEQ ID NO: 1235422 - RNA, 14 nt, Human
uuaacuauugcauu

SEQ ID NO: 1235423 - RNA, 21 nt, Human
uuaacuauugcauuuauaugu

SEQ ID NO: 1235424 - RNA, 22 nt, Human
uuaacuauugcauuuauaugua

SEQ ID NO: 1235425 - RNA, 16 nt, Human
uguuuuuuuguuauua

SEQ ID NO: 1235426 - RNA, 18 nt, Human
uguuuuuuuguuauuaaa

SEQ ID NO: 1235427 - RNA, 18 nt, Human
uguuuuuuuuuaaagacu

SEQ ID NO: 1235428 - RNA, 13 nt, Human
uuaaaagaaugau

SEQ ID NO: 1235429 - RNA, 22 nt, Human
uguuucaaacauauauaacaau

SEQ ID NO: 1235430 - RNA, 21 nt, Human
uguuucaaacauauauaacaa

SEQ ID NO: 1235431 - RNA, 14 nt, Human
uggugcccugcuuu

SEQ ID NO: 1235432 - RNA, 18 nt, Human
uuucuuaaccagaucauu

SEQ ID NO: 1235433 - RNA, 21 nt, Human
uuugaaauuguauuacaaauc

SEQ ID NO: 1235434 - RNA, 13 nt, Human
uuugaaccaauaa

SEQ ID NO: 1235435 - RNA, 13 nt, Human
uuuguauucaaaa

SEQ ID NO: 1235436 - RNA, 18 nt, Human
uuugguaaggggaauuga

SEQ ID NO: 1235437 - RNA, 17 nt, Human
uuugauaugugaacagu

SEQ ID NO: 1235438 - RNA, 15 nt, Human
uuugauaugugaaca

SEQ ID NO: 1235439 - RNA, 14 nt, Human
uuugauaugugaac

SEQ ID NO: 1235440 - RNA, 19 nt, Human
uuugccacccucaugcugu

SEQ ID NO: 1235441 - RNA, 18 nt, Human
uuugccacccucaugcug

SEQ ID NO: 1235442 - RNA, 22 nt, Human
uuucuaaaguaaaaacaaagaa

SEQ ID NO: 1235443 - RNA, 17 nt, Human
uuucuaaaguaaaaaca

SEQ ID NO: 1235444 - RNA, 12 nt, Human
uuucucuaggaa

SEQ ID NO: 1235445 - RNA, 19 nt, Human
uuucugaaauuuccuggga

SEQ ID NO: 1235446 - RNA, 12 nt, Human
uuucugaaauuu

SEQ ID NO: 1235447 - RNA, 13 nt, Human
uuucugauccagu

SEQ ID NO: 1235448 - RNA, 15 nt, Human
uuucugauccaguuu

SEQ ID NO: 1235449 - RNA, 16 nt, Human
uuucugauccaguuuu

SEQ ID NO: 1235450 - RNA, 20 nt, Human
uuucugauccaguuuuguuu

SEQ ID NO: 1235451 - RNA, 22 nt, Human
uuucugauccaguuuuguuugg

SEQ ID NO: 1235452 - RNA, 22 nt, Human
uuuaugauacuugaaaauuaac

SEQ ID NO: 1235453 - RNA, 17 nt, Human
uuuauggcacuaguauu

SEQ ID NO: 1235454 - RNA, 17 nt, Human
uuuaguugcaacuuugu

SEQ ID NO: 1235455 - RNA, 18 nt, Human
uuuaguugcaacuuugua

SEQ ID NO: 1235456 - RNA, 14 nt, Human
uuuaaccucuaaau

SEQ ID NO: 1235457 - RNA, 15 nt, Human
uuuaauaaacacucu

SEQ ID NO: 1235458 - RNA, 19 nt, Human
uuuaauaauguuucaaaca

SEQ ID NO: 1235459 - RNA, 14 nt, Human
uuuaauaauuauau

SEQ ID NO: 1235460 - RNA, 15 nt, Human
uuuaauaauguuuca

SEQ ID NO: 1235461 - RNA, 22 nt, Human
uuuaauaaacacucuugaaaaa

SEQ ID NO: 1235462 - RNA, 14 nt, Human
uuuaauauuaaagc

SEQ ID NO: 1235463 - RNA, 15 nt, Human
uuuaauauuaaagcc

SEQ ID NO: 1235464 - RNA, 17 nt, Human
uuuaauauuaaagccau

SEQ ID NO: 1235465 - RNA, 20 nt, Human
uuuaauauuaaagccauguu

SEQ ID NO: 1235466 - RNA, 21 nt, Human
uuuaauauuaaagccauguuu

SEQ ID NO: 1235467 - RNA, 16 nt, Human
uuuacauggcuggagc

SEQ ID NO: 1235468 - RNA, 17 nt, Human
uuuaaaagaaugauuau

SEQ ID NO: 1235469 - RNA, 14 nt, Human
uuuaaaagaaugau

SEQ ID NO: 1235470 - RNA, 17 nt, Human
uuuaaaaggaaagaaaa

SEQ ID NO: 1235471 - RNA, 16 nt, Human
uuuaaaauuacaacua

SEQ ID NO: 1235472 - RNA, 12 nt, Human
uuuaaaaugucu

SEQ ID NO: 1235473 - RNA, 16 nt, Human
uuuaaaaugagaaauc

SEQ ID NO: 1235474 - RNA, 12 nt, Human
uuguuucuguac

SEQ ID NO: 1235475 - RNA, 14 nt, Human
uuguuucuguacuu

SEQ ID NO: 1235476 - RNA, 12 nt, Human
uuguuuuacaau

SEQ ID NO: 1235477 - RNA, 13 nt, Human
uuguuuuacaaua

SEQ ID NO: 1235478 - RNA, 13 nt, Human
uuguuuguuuagu

SEQ ID NO: 1235479 - RNA, 14 nt, Human
uuguuuguuuaguc

SEQ ID NO: 1235480 - RNA, 15 nt, Human
uuguuauuaaacaaa

SEQ ID NO: 1235481 - RNA, 22 nt, Human
uugcagcccugcugcugccugc

SEQ ID NO: 1235482 - RNA, 19 nt, Human
uugccaggcuggagugcag

SEQ ID NO: 1235483 - RNA, 23 nt, Human
uugccaggcuggagugcaguggc

SEQ ID NO: 1235484 - RNA, 16 nt, Human
uugcauaacguauaaa

SEQ ID NO: 1235485 - RNA, 17 nt, Human
uugauccagaaagaaaa

SEQ ID NO: 1235486 - RNA, 16 nt, Human
uugauaugugaacagu

SEQ ID NO: 1235487 - RNA, 20 nt, Human
uugauaugccuuuucccaac

SEQ ID NO: 1235488 - RNA, 18 nt, Human
uucuuaugccauauaauu

SEQ ID NO: 1235489 - RNA, 19 nt, Human
uucuuaggguuaugauuaa

SEQ ID NO: 1235490 - RNA, 11 nt, Human
uucuguauaga

SEQ ID NO: 1235491 - RNA, 13 nt, Human
uucuguauagauu

SEQ ID NO: 1235492 - RNA, 14 nt, Human
uucuguauagauua

SEQ ID NO: 1235493 - RNA, 21 nt, Human
uugaaaaucuuauaauuuaaa

SEQ ID NO: 1235494 - RNA, 12 nt, Human
uucuuuaauuuu

SEQ ID NO: 1235495 - RNA, 17 nt, Human
uucuuuaauuuuggaau

SEQ ID NO: 1235496 - RNA, 18 nt, Human
uucuuuaauuuuggaauu

SEQ ID NO: 1235497 - RNA, 16 nt, Human
uugaaacggaugauuu

SEQ ID NO: 1235498 - RNA, 19 nt, Human
uugaaacggaugauuucua

SEQ ID NO: 1235499 - RNA, 18 nt, Human
uugaaaauuaacaugaau

SEQ ID NO: 1235500 - RNA, 20 nt, Human
uugaaacggaugauuucuau

SEQ ID NO: 1235501 - RNA, 16 nt, Human
uugaagagguuuuaaa

SEQ ID NO: 1235502 - RNA, 20 nt, Human
uugaagcacagugaucaagu

SEQ ID NO: 1235503 - RNA, 21 nt, Human
uugaagagguuuuaaagcuuc

SEQ ID NO: 1235504 - RNA, 20 nt, Human
uugguaaggggaauugagga

SEQ ID NO: 1235505 - RNA, 18 nt, Human
uuggcauaacauaaaucu

SEQ ID NO: 1235506 - RNA, 19 nt, Human
uuggcauaacauaaaucug

SEQ ID NO: 1235507 - RNA, 20 nt, Human
uuggcauaacauaaaucugu

SEQ ID NO: 1235508 - RNA, 22 nt, Human
uuggcauaacauaaaucuguga

SEQ ID NO: 1235509 - RNA, 23 nt, Human
uuggcauaacauaaaucugugaa

SEQ ID NO: 1235510 - RNA, 15 nt, Human
uuguagcauccugga

SEQ ID NO: 1235511 - RNA, 22 nt, Human
uuguagaagucacauuccugaa

SEQ ID NO: 1235512 - RNA, 17 nt, Human
uuguagaagucacauuc

SEQ ID NO: 1235513 - RNA, 18 nt, Human
uuguacuuuagggaagua

SEQ ID NO: 1235514 - RNA, 13 nt, Human
uugccuuaaaaua

SEQ ID NO: 1235515 - RNA, 12 nt, Human
uugccuuuuuca

SEQ ID NO: 1235516 - RNA, 13 nt, Human
uugccuuuuucau

SEQ ID NO: 1235517 - RNA, 14 nt, Human
uugccuuuuucauu

SEQ ID NO: 1235518 - RNA, 15 nt, Human
uugccuuuuucauua

SEQ ID NO: 1235519 - RNA, 16 nt, Human
uugccuuuuucauuau

SEQ ID NO: 1235520 - RNA, 17 nt, Human
uugccuuuuucauuauu

SEQ ID NO: 1235521 - RNA, 18 nt, Human
uugcuaagcauuccaacu

SEQ ID NO: 1235522 - RNA, 16 nt, Human
uugcuaagcauuccaa

SEQ ID NO: 1235523 - RNA, 18 nt, Human
uuggacaaaauggaauac

SEQ ID NO: 1235524 - RNA, 22 nt, Human
cuugauaaauggcuuccuggca

SEQ ID NO: 1235525 - RNA, 14 nt, Human
ccagauuuuccuga

SEQ ID NO: 1235526 - RNA, 22 nt, Human
agcaaguaaaaaggcuaaaugg

SEQ ID NO: 1235527 - RNA, 21 nt, Human
augaauacauuuccaaaaugg

SEQ ID NO: 1235528 - RNA, 12 nt, Human
ugcgauaagaug

SEQ ID NO: 1235529 - RNA, 19 nt, Human
acuuuccaauaaagaguuc

SEQ ID NO: 1235530 - RNA, 22 nt, Human
accuuugacaaagguaaaucag

SEQ ID NO: 1235531 - RNA, 21 nt, Human
acaagauugcuuaauaaauug

SEQ ID NO: 1235532 - RNA, 17 nt, Hepatitis B virus
cucuaccguccccuucu

SEQ ID NO: 1235533 - RNA, 20 nt, Hepatitis B virus
cucggaaauacaccuccuuu

SEQ ID NO: 1235534 - RNA, 20 nt, Hepatitis B virus
gaacauuguucaccucacca

SEQ ID NO: 1235535 - RNA, 18 nt, Hepatitis B virus
cucccaucucuccaccuc

SEQ ID NO: 1235536 - RNA, 17 nt, Hepatitis B virus
ccucgacaaggcauggg

SEQ ID NO: 1235537 - RNA, 12 nt, Hepatitis B virus
cuuuaauccuga

SEQ ID NO: 1235538 - RNA, 21 nt, Hepatitis B virus
agaggacucuuggacucucag

SEQ ID NO: 1235539 - RNA, 17 nt, Hepatitis B virus
accauauucuugggaac

SEQ ID NO: 1235540 - RNA, 18 nt, Hepatitis B virus
cacuucgcuucaccucug

SEQ ID NO: 1235541 - RNA, 15 nt, Hepatitis B virus
ugcggaacuccuagc

SEQ ID NO: 1235542 - RNA, 21 nt, Hepatitis B virus
cggucuccccgucugugccuu

SEQ ID NO: 1235543 - RNA, 13 nt, Hepatitis B virus
uucgagaucuccu

SEQ ID NO: 1235544 - RNA, 12 nt, Hepatitis B virus
uuuccccucugc

SEQ ID NO: 1235545 - RNA, 14 nt, Hepatitis B virus
aaccgacaacucag

SEQ ID NO: 1235546 - RNA, 13 nt, Hepatitis B virus
cuaggcugugcug

SEQ ID NO: 1235547 - RNA, 16 nt, Hepatitis B virus
ucaaaacuaggcauua

SEQ ID NO: 1235548 - RNA, 22 nt, Hepatitis B virus
uccaaaccucgacaaggcaugg

SEQ ID NO: 1235549 - RNA, 13 nt, Hepatitis B virus
auuuacaggagga

SEQ ID NO: 1235550 - RNA, 17 nt, Hepatitis B virus
aaacuacacgcagcgcc

SEQ ID NO: 1235551 - RNA, 18 nt, Hepatitis B virus
acucauaaggugggaaac

SEQ ID NO: 1235552 - RNA, 15 nt, Hepatitis B virus
uguggcuccucugcc

SEQ ID NO: 1235553 - RNA, 15 nt, Hepatitis B virus
ugccagcagcaccuc

SEQ ID NO: 1235554 - RNA, 18 nt, Hepatitis B virus
acaccgccucugcucugu

SEQ ID NO: 1235555 - RNA, 18 nt, Hepatitis B virus
gucaaagaauuguggguc

SEQ ID NO: 1235556 - RNA, 15 nt, Hepatitis B virus
gucaggucucugcca

SEQ ID NO: 1235557 - RNA, 19 nt, Hepatitis B virus
uguucauguccuacuguuc

SEQ ID NO: 1235558 - RNA, 17 nt, Hepatitis B virus
ucuuuccuucuauucga

SEQ ID NO: 1235559 - RNA, 18 nt, Hepatitis B virus
acccugcguucggagcca

SEQ ID NO: 1235560 - RNA, 21 nt, Hepatitis B virus
cugggaggaguugggggagga

SEQ ID NO: 1235561 - RNA, 23 nt, Hepatitis B virus
caacggucaggucucugccaagu

SEQ ID NO: 1235562 - RNA, 14 nt, Hepatitis B virus
caagagcuacagca

SEQ ID NO: 1235563 - RNA, 15 nt, Hepatitis B virus
caaccccaacaagga

SEQ ID NO: 1235564 - RNA, 19 nt, Hepatitis B virus
cuuugcugccccuuuuaca

SEQ ID NO: 1235565 - RNA, 14 nt, Hepatitis B virus
uuuuccccucugcc

SEQ ID NO: 1235566 - RNA, 18 nt, Hepatitis B virus
uccucaggccaugcagug

SEQ ID NO: 1235567 - RNA, 23 nt, Hepatitis B virus
caccuccuuuccauggcugcuag

SEQ ID NO: 1235568 - RNA, 18 nt, Hepatitis B virus
gaacauuguucaccucac

SEQ ID NO: 1235569 - RNA, 18 nt, Hepatitis B virus
ugcuaggcugugcugcca

SEQ ID NO: 1235570 - RNA, 14 nt, Hepatitis B virus
uggacucucagcaa

SEQ ID NO: 1235571 - RNA, 16 nt, Hepatitis B virus
auugacaacacugcca

SEQ ID NO: 1235572 - RNA, 23 nt, Hepatitis B virus
gguucuauccuaaccuuaccaaa

SEQ ID NO: 1235573 - RNA, 18 nt, Hepatitis B virus
cuugcccaaggucuuaca

SEQ ID NO: 1235574 - RNA, 17 nt, Hepatitis B virus
gcccucaggcucagggc

SEQ ID NO: 1235575 - RNA, 18 nt, Hepatitis B virus
cucucuuuuuugccuucu

SEQ ID NO: 1235576 - RNA, 21 nt, Hepatitis B virus
uacuaggaggcuguaggcaua

SEQ ID NO: 1235577 - RNA, 17 nt, Hepatitis B virus
cucuuggacucucagca

SEQ ID NO: 1235578 - RNA, 16 nt, Hepatitis B virus
cuaggcugugcugcca

SEQ ID NO: 1235579 - RNA, 22 nt, Hepatitis B virus
guucaagccuccaagcugugcc

SEQ ID NO: 1235580 - RNA, 12 nt, Hepatitis B virus
caaaucagguag

SEQ ID NO: 1235581 - RNA, 13 nt, Hepatitis B virus
uuccccucugccu

SEQ ID NO: 1235582 - RNA, 14 nt, Hepatitis B virus
uacaaaaacucaag

SEQ ID NO: 1235583 - RNA, 21 nt, Hepatitis B virus
uguucauguccuacuguucaa

SEQ ID NO: 1235584 - RNA, 14 nt, Hepatitis B virus
ccaucucuccaccu

SEQ ID NO: 1235585 - RNA, 16 nt, Hepatitis B virus
gagcccucaggcucag

SEQ ID NO: 1235586 - RNA, 13 nt, Hepatitis B virus
auccucaggccau

SEQ ID NO: 1235587 - RNA, 23 nt, Hepatitis B virus
aucaccaguuggacccugcguuc

SEQ ID NO: 1235588 - RNA, 18 nt, Hepatitis B virus
auuggaaaguaugucaaa

SEQ ID NO: 1235589 - RNA, 23 nt, Hepatitis B virus
cccgucugugccuucucaucugc

SEQ ID NO: 1235590 - RNA, 12 nt, Hepatitis B virus
uccccucugccu

SEQ ID NO: 1235591 - RNA, 16 nt, Hepatitis B virus
guacuaggaggcugua

SEQ ID NO: 1235592 - RNA, 18 nt, Hepatitis B virus
cugugccuucucaucugc

SEQ ID NO: 1235593 - RNA, 14 nt, Hepatitis B virus
accaaauauuugcc

SEQ ID NO: 1235594 - RNA, 13 nt, Hepatitis B virus
caagagcuacagc

SEQ ID NO: 1235595 - RNA, 17 nt, Hepatitis B virus
ugccuucucaucugccg

SEQ ID NO: 1235596 - RNA, 13 nt, Hepatitis B virus
gccucugcucugu

SEQ ID NO: 1235597 - RNA, 14 nt, Hepatitis B virus
caccauacagcacu

SEQ ID NO: 1235598 - RNA, 17 nt, Hepatitis B virus
aaacuaggcauuauuua

SEQ ID NO: 1235599 - RNA, 17 nt, Hepatitis B virus
auguggcuauccugccu

SEQ ID NO: 1235600 - RNA, 17 nt, Hepatitis B virus
caggcaagcuauucugu

SEQ ID NO: 1235601 - RNA, 23 nt, Hepatitis B virus
cggcaacggucaggucucugcca

SEQ ID NO: 1235602 - RNA, 18 nt, Hepatitis B virus
cauggcugcuaggcugug

SEQ ID NO: 1235603 - RNA, 14 nt, Hepatitis B virus
ccucugggauucuu

SEQ ID NO: 1235604 - RNA, 20 nt, Hepatitis B virus
auggcugcuaggcugugcug

SEQ ID NO: 1235605 - RNA, 22 nt, Hepatitis B virus
ucacuggccagaggcaaaucag

SEQ ID NO: 1235606 - RNA, 14 nt, Hepatitis B virus
ccccuucuucaucu

SEQ ID NO: 1235607 - RNA, 19 nt, Hepatitis B virus
cuaggcugugcugccaacu

SEQ ID NO: 1235608 - RNA, 16 nt, Hepatitis B virus
cuacuguucaagccuc

SEQ ID NO: 1235609 - RNA, 20 nt, Hepatitis B virus
ggcauaaauuggucuguuca

SEQ ID NO: 1235610 - RNA, 14 nt, Hepatitis B virus
uacaaggccuuucu

SEQ ID NO: 1235611 - RNA, 17 nt, Hepatitis B virus
gccuccaagcugugccu

SEQ ID NO: 1235612 - RNA, 15 nt, Hepatitis B virus
cccaucucuccaccu

SEQ ID NO: 1235613 - RNA, 23 nt, Hepatitis B virus
ccaccacacggaggccuuuuggg

SEQ ID NO: 1235614 - RNA, 23 nt, Hepatitis B virus
augcaacuuuuuccccucugccu

SEQ ID NO: 1235615 - RNA, 24 nt, Hepatitis B virus
acccguauaaagaauuuggagcuu

SEQ ID NO: 1235616 - RNA, 16 nt, Hepatitis B virus
agcaugggagguuggu

SEQ ID NO: 1235617 - RNA, 21 nt, Hepatitis B virus
acuggccagaggcaaaucagg

SEQ ID NO: 1235618 - RNA, 16 nt, Hepatitis B virus
cugccccuuuuacaca

SEQ ID NO: 1235619 - RNA, 18 nt, Hepatitis B virus
cuuggccauaggccaucg

SEQ ID NO: 1235620 - RNA, 15 nt, Hepatitis B virus
aggccaugcagugga

SEQ ID NO: 1235621 - RNA, 14 nt, Hepatitis B virus
ucuuggacucucag

SEQ ID NO: 1235622 - RNA, 15 nt, Hepatitis B virus
uguccuacuguucaa

SEQ ID NO: 1235623 - RNA, 18 nt, Hepatitis B virus
cuuggacaaaggcauuaa

SEQ ID NO: 1235624 - RNA, 15 nt, Hepatitis B virus
agcagcaccuccucc

SEQ ID NO: 1235625 - RNA, 15 nt, Hepatitis B virus
gacaacacugccagc

SEQ ID NO: 1235626 - RNA, 21 nt, Hepatitis B virus
gcaacuuuuuccccucugccu

SEQ ID NO: 1235627 - RNA, 22 nt, Hepatitis B virus
ucuaagcaggcuuucacuuucu

SEQ ID NO: 1235628 - RNA, 13 nt, Hepatitis B virus
ccugccuccacca

SEQ ID NO: 1235629 - RNA, 23 nt, Hepatitis B virus
uggagcccucaggcucagggcau

SEQ ID NO: 1235630 - RNA, 19 nt, Hepatitis B virus
uccucgacaccgccucugc

SEQ ID NO: 1235631 - RNA, 12 nt, Hepatitis B virus
cauccucaggcc

SEQ ID NO: 1235632 - RNA, 15 nt, Hepatitis B virus
auuuacauacucugu

SEQ ID NO: 1235633 - RNA, 14 nt, Hepatitis B virus
aggcuggcauucua

SEQ ID NO: 1235634 - RNA, 16 nt, Hepatitis B virus
caaggaucacuggcca

SEQ ID NO: 1235635 - RNA, 13 nt, Hepatitis B virus
ccgccucugcucu

SEQ ID NO: 1235636 - RNA, 12 nt, Hepatitis B virus
uuccccucugcc

SEQ ID NO: 1235637 - RNA, 17 nt, Hepatitis B virus
ccucaccauacagcacu

SEQ ID NO: 1235638 - RNA, 17 nt, Hepatitis B virus
cucaggccaugcagugg

SEQ ID NO: 1235639 - RNA, 12 nt, Hepatitis B virus
cccucaggcuca

SEQ ID NO: 1235640 - RNA, 18 nt, Hepatitis B virus
ccaaaccucgacaaggca

SEQ ID NO: 1235641 - RNA, 14 nt, Hepatitis B virus
ggugggaaacuuua

SEQ ID NO: 1235642 - RNA, 21 nt, Hepatitis B virus
ucucuccaccucuaagagaca

SEQ ID NO: 1235643 - RNA, 14 nt, Hepatitis B virus
ggccaugcagugga

SEQ ID NO: 1235644 - RNA, 15 nt, Hepatitis B virus
auguccuacuguuca

SEQ ID NO: 1235645 - RNA, 15 nt, Hepatitis B virus
caagccuccaagcug

SEQ ID NO: 1235646 - RNA, 12 nt, Hepatitis B virus
acucuuggacuc

SEQ ID NO: 1235647 - RNA, 16 nt, Hepatitis B virus
agcccucaggcucagg

SEQ ID NO: 1235648 - RNA, 17 nt, Hepatitis B virus
uacugcggaacuccuag

SEQ ID NO: 1235649 - RNA, 19 nt, Hepatitis B virus
cuccccgucugugccuucu

SEQ ID NO: 1235650 - RNA, 14 nt, Hepatitis B virus
cguauuauccugaa

SEQ ID NO: 1235651 - RNA, 20 nt, Hepatitis B virus
uuuacaggaggacauuauua

SEQ ID NO: 1235652 - RNA, 19 nt, Hepatitis B virus
uuauccugaauaugcaguu

SEQ ID NO: 1235653 - RNA, 19 nt, Hepatitis B virus
ucggggccguuugggccuc

SEQ ID NO: 1235654 - RNA, 16 nt, Hepatitis B virus
uaaccuuaccaaauau

SEQ ID NO: 1235655 - RNA, 14 nt, Hepatitis B virus
cuucucaucugccg

SEQ ID NO: 1235656 - RNA, 17 nt, Hepatitis B virus
cacggggcgcaccucuc

SEQ ID NO: 1235657 - RNA, 17 nt, Hepatitis B virus
uccucaggccaugcagu

SEQ ID NO: 1235658 - RNA, 19 nt, Hepatitis B virus
ucucuuuuuugccuucuga

SEQ ID NO: 1235659 - RNA, 13 nt, Hepatitis B virus
gucugugccuucu

SEQ ID NO: 1235660 - RNA, 18 nt, Hepatitis B virus
aacuaggcauuauuuaca

SEQ ID NO: 1235661 - RNA, 13 nt, Hepatitis B virus
cucuccaccucua

SEQ ID NO: 1235662 - RNA, 23 nt, Hepatitis B virus
ugcacuucgcuucaccucugcac

SEQ ID NO: 1235663 - RNA, 12 nt, Hepatitis B virus
ccaugcagugga

SEQ ID NO: 1235664 - RNA, 18 nt, Hepatitis B virus
gugccuucucaucugccg

SEQ ID NO: 1235665 - RNA, 17 nt, Hepatitis B virus
gaaccuuuguggcuccu

SEQ ID NO: 1235666 - RNA, 19 nt, Hepatitis B virus
gucuccccgucugugccuu

SEQ ID NO: 1235667 - RNA, 13 nt, Hepatitis B virus
caucucuccaccu

SEQ ID NO: 1235668 - RNA, 21 nt, Hepatitis B virus
cuccggaacauuguucaccuc

SEQ ID NO: 1235669 - RNA, 14 nt, Hepatitis B virus
ucaggucucugcca

SEQ ID NO: 1235670 - RNA, 20 nt, Hepatitis B virus
acucaggcaagcuauucugu

SEQ ID NO: 1235671 - RNA, 21 nt, Hepatitis B virus
ggcauauugacaacacugcca

SEQ ID NO: 1235672 - RNA, 15 nt, Hepatitis B virus
caccgccucugcucu

SEQ ID NO: 1235673 - RNA, 22 nt, Hepatitis B virus
cgaccacggggcgcaccucucu

SEQ ID NO: 1235674 - RNA, 23 nt, Hepatitis B virus
aucuaagcaggcuuucacuuucu

SEQ ID NO: 1235675 - RNA, 18 nt, Hepatitis B virus
cuuucuguucccaauccu

SEQ ID NO: 1235676 - RNA, 11 nt, Hepatitis B virus
agcugugccuu

SEQ ID NO: 1235677 - RNA, 13 nt, Hepatitis B virus
accucucuuuacg

SEQ ID NO: 1235678 - RNA, 18 nt, Hepatitis B virus
caggucuugcccaagguc

SEQ ID NO: 1235679 - RNA, 21 nt, Hepatitis B virus
caacuuuuuccccucugccua

SEQ ID NO: 1235680 - RNA, 15 nt, Hepatitis B virus
ucaggcucagggcau

SEQ ID NO: 1235681 - RNA, 22 nt, Hepatitis B virus
guucccaauccucugggauucu

SEQ ID NO: 1235682 - RNA, 16 nt, Hepatitis B virus
gaccgaccuugaggca

SEQ ID NO: 1235683 - RNA, 12 nt, Hepatitis B virus
uggagcccucag

SEQ ID NO: 1235684 - RNA, 18 nt, Hepatitis B virus
ucuccccgucugugccuu

SEQ ID NO: 1235685 - RNA, 15 nt, Hepatitis B virus
gacaaggcaugggga

SEQ ID NO: 1235686 - RNA, 20 nt, Hepatitis B virus
ucggaaauacaccuccuuuc

SEQ ID NO: 1235687 - RNA, 18 nt, Hepatitis B virus
ggacucuuggacucucag

SEQ ID NO: 1235688 - RNA, 21 nt, Hepatitis B virus
uccagauugggacuucaaccc

SEQ ID NO: 1235689 - RNA, 23 nt, Hepatitis B virus
caacaauaugugggcccucugac

SEQ ID NO: 1235690 - RNA, 15 nt, Hepatitis B virus
cucaggcucagggca

SEQ ID NO: 1235691 - RNA, 23 nt, Hepatitis B virus
ccugcuagguucuauccuaaccu

SEQ ID NO: 1235692 - RNA, 15 nt, Hepatitis B virus
cucagcaaugucaac

SEQ ID NO: 1235693 - RNA, 16 nt, Hepatitis B virus
caccgccucugcucug

SEQ ID NO: 1235694 - RNA, 14 nt, Hepatitis B virus
ccuucucaucugcc

SEQ ID NO: 1235695 - RNA, 11 nt, Hepatitis B virus
gucugugccuu

SEQ ID NO: 1235696 - RNA, 14 nt, Hepatitis B virus
cccaauccucuggg

SEQ ID NO: 1235697 - RNA, 13 nt, Hepatitis B virus
caacacugccagc

SEQ ID NO: 1235698 - RNA, 15 nt, Hepatitis B virus
caccagcaccaugca

SEQ ID NO: 1235699 - RNA, 16 nt, Hepatitis B virus
cauuaaaccguauuau

SEQ ID NO: 1235700 - RNA, 13 nt, Hepatitis B virus
cuccuccugccuc

SEQ ID NO: 1235701 - RNA, 18 nt, Hepatitis B virus
agcaccuccuccugccuc

SEQ ID NO: 1235702 - RNA, 22 nt, Hepatitis B virus
cugcucuguaucgggaggccuu

SEQ ID NO: 1235703 - RNA, 14 nt, Hepatitis B virus
ucuuuaauccugau

SEQ ID NO: 1235704 - RNA, 14 nt, Hepatitis B virus
cgucugugccuucu

SEQ ID NO: 1235705 - RNA, 13 nt, Hepatitis B virus
gucauccucaggc

SEQ ID NO: 1235706 - RNA, 17 nt, Hepatitis B virus
uauccugaauaugcagu

SEQ ID NO: 1235707 - RNA, 16 nt, Hepatitis B virus
ccugaauaugcaguua

SEQ ID NO: 1235708 - RNA, 18 nt, Hepatitis B virus
agccuccaagcugugccu

SEQ ID NO: 1235709 - RNA, 14 nt, Hepatitis B virus
uuguggcuccucug

SEQ ID NO: 1235710 - RNA, 20 nt, Hepatitis B virus
cauuuacaggaggacauuau

SEQ ID NO: 1235711 - RNA, 15 nt, Hepatitis B virus
gccuaaucaucucau

SEQ ID NO: 1235712 - RNA, 23 nt, Hepatitis B virus
aaucuuucuguucccaauccucu

SEQ ID NO: 1235713 - RNA, 19 nt, Hepatitis B virus
acaauccagauugggacuu

SEQ ID NO: 1235714 - RNA, 15 nt, Hepatitis B virus
gcagucaggaagaca

SEQ ID NO: 1235715 - RNA, 17 nt, Hepatitis B virus
uggccagaggcaaauca

SEQ ID NO: 1235716 - RNA, 23 nt, Hepatitis B virus
accccaacaaggaucacuggcca

SEQ ID NO: 1235717 - RNA, 13 nt, Hepatitis B virus
ugggguggagccc

SEQ ID NO: 1235718 - RNA, 14 nt, Hepatitis B virus
cgcuucaccucugc

SEQ ID NO: 1235719 - RNA, 17 nt, Hepatitis B virus
uuugggcuuugcugccc

SEQ ID NO: 1235720 - RNA, 12 nt, Hepatitis B virus
ggacucuuggac

SEQ ID NO: 1235721 - RNA, 20 nt, Hepatitis B virus
ccaugcaacuuuuuccccuc

SEQ ID NO: 1235722 - RNA, 23 nt, Hepatitis B virus
ucuuggacucucagcaaugucaa

SEQ ID NO: 1235723 - RNA, 17 nt, Hepatitis B virus
uugaggcauacuucaaa

SEQ ID NO: 1235724 - RNA, 21 nt, Hepatitis B virus
aggaagacagccuacucccau

SEQ ID NO: 1235725 - RNA, 17 nt, Hepatitis B virus
cuucgcuucaccucugc

SEQ ID NO: 1235726 - RNA, 22 nt, Hepatitis B virus
caaggaucacuggccagaggca

SEQ ID NO: 1235727 - RNA, 18 nt, Hepatitis B virus
ggucuccccgucugugcc

SEQ ID NO: 1235728 - RNA, 17 nt, Hepatitis B virus
uggcuuuggggcaugga

SEQ ID NO: 1235729 - RNA, 18 nt, Hepatitis B virus
gacucauaaggugggaaa

SEQ ID NO: 1235730 - RNA, 13 nt, Hepatitis B virus
cacuuucucgcca

SEQ ID NO: 1235731 - RNA, 20 nt, Hepatitis B virus
ccgucugugccuucucaucu

SEQ ID NO: 1235732 - RNA, 17 nt, Hepatitis B virus
cuccucgacaccgccuc

SEQ ID NO: 1235733 - RNA, 13 nt, Hepatitis B virus
gucaacaauaugu

SEQ ID NO: 1235734 - RNA, 14 nt, Hepatitis B virus
cacaagaggacucu

SEQ ID NO: 1235735 - RNA, 16 nt, Hepatitis B virus
uuggacaaaggcauua

SEQ ID NO: 1235736 - RNA, 12 nt, Hepatitis B virus
ucuuggacucuc

SEQ ID NO: 1235737 - RNA, 15 nt, Hepatitis B virus
uuguucaccucacca

SEQ ID NO: 1235738 - RNA, 12 nt, Hepatitis B virus
gcugugcugcca

SEQ ID NO: 1235739 - RNA, 20 nt, Hepatitis B virus
cuucuguggaguuacucucu

SEQ ID NO: 1235740 - RNA, 19 nt, Hepatitis B virus
ccuccuuuccauggcugcu

SEQ ID NO: 1235741 - RNA, 15 nt, Hepatitis B virus
auccuaaccuuacca

SEQ ID NO: 1235742 - RNA, 14 nt, Hepatitis B virus
ccaagcugugccuu

SEQ ID NO: 1235743 - RNA, 13 nt, Hepatitis B virus
cuacuguaccugu

SEQ ID NO: 1235744 - RNA, 14 nt, Hepatitis B virus
caacacugccagca

SEQ ID NO: 1235745 - RNA, 19 nt, Hepatitis B virus
cacugccagcagcaccucc

SEQ ID NO: 1235746 - RNA, 13 nt, Hepatitis B virus
uggacucucagca

SEQ ID NO: 1235747 - RNA, 13 nt, Hepatitis B virus
caacuuuuucccc

SEQ ID NO: 1235748 - RNA, 23 nt, Hepatitis B virus
aucuccucgacaccgccucugcu

SEQ ID NO: 1235749 - RNA, 22 nt, Hepatitis B virus
ugccugcuagguucuauccuaa

SEQ ID NO: 1235750 - RNA, 19 nt, Hepatitis B virus
cauauugacaacacugcca

SEQ ID NO: 1235751 - RNA, 17 nt, Hepatitis B virus
aaaacucccuccuuucc

SEQ ID NO: 1235752 - RNA, 16 nt, Hepatitis B virus
caacucaaacaaucca

SEQ ID NO: 1235753 - RNA, 18 nt, Hepatitis B virus
caccagcaccaugcaacu

SEQ ID NO: 1235754 - RNA, 16 nt, Hepatitis B virus
cucuuggacucucagc

SEQ ID NO: 1235755 - RNA, 12 nt, Hepatitis B virus
ucgggaggccuu

SEQ ID NO: 1235756 - RNA, 12 nt, Hepatitis B virus
ccgucugugccu

SEQ ID NO: 1235757 - RNA, 19 nt, Hepatitis B virus
cggggccguuugggccucu

SEQ ID NO: 1235758 - RNA, 19 nt, Hepatitis B virus
cuuuugggcuuugcugccc

SEQ ID NO: 1235759 - RNA, 13 nt, Hepatitis B virus
aacguuggggcua

SEQ ID NO: 1235760 - RNA, 19 nt, Hepatitis B virus
agccuccaagcugugccuu

SEQ ID NO: 1235761 - RNA, 15 nt, Hepatitis B virus
cccuucuucaucugc

SEQ ID NO: 1235762 - RNA, 21 nt, Hepatitis B virus
accucgacaaggcauggggac

SEQ ID NO: 1235763 - RNA, 17 nt, Hepatitis B virus
accaaacguuggggcua

SEQ ID NO: 1235764 - RNA, 16 nt, Hepatitis B virus
ggcugcuaggcugugc

SEQ ID NO: 1235765 - RNA, 20 nt, Hepatitis B virus
caccaaucggcagucaggaa

SEQ ID NO: 1235766 - RNA, 19 nt, Hepatitis B virus
acuucaaaacuaggcauua

SEQ ID NO: 1235767 - RNA, 14 nt, Hepatitis B virus
uagagucuccggaa

SEQ ID NO: 1235768 - RNA, 20 nt, Hepatitis B virus
aacaagagcuacagcauggg

SEQ ID NO: 1235769 - RNA, 13 nt, Hepatitis B virus
gccaacucaaaca

SEQ ID NO: 1235770 - RNA, 22 nt, Hepatitis B virus
acauacucuguggaaggcuggc

SEQ ID NO: 1235771 - RNA, 17 nt, Hepatitis B virus
aauauuugcccuuggac

SEQ ID NO: 1235772 - RNA, 19 nt, Hepatitis B virus
ggagauuagguuaaagguc

SEQ ID NO: 1235773 - RNA, 14 nt, Hepatitis B virus
aggcugugcugcca

SEQ ID NO: 1235774 - RNA, 13 nt, Hepatitis B virus
caccgccucugcu

SEQ ID NO: 1235775 - RNA, 15 nt, Hepatitis B virus
ucccaauccucuggg

SEQ ID NO: 1235776 - RNA, 19 nt, Hepatitis B virus
uccagauugggacuucaac

SEQ ID NO: 1235777 - RNA, 14 nt, Hepatitis B virus
cccgucugugccuu

SEQ ID NO: 1235778 - RNA, 15 nt, Hepatitis B virus
acucccuccuuuccu

SEQ ID NO: 1235779 - RNA, 16 nt, Hepatitis B virus
ccuccuuuccucacau

SEQ ID NO: 1235780 - RNA, 12 nt, Hepatitis B virus
aggucucugcca

SEQ ID NO: 1235781 - RNA, 13 nt, Hepatitis B virus
gaucacuggccag

SEQ ID NO: 1235782 - RNA, 16 nt, Hepatitis B virus
caacucaguuguccuc

SEQ ID NO: 1235783 - RNA, 21 nt, Hepatitis B virus
gcggucuccccgucugugccu

SEQ ID NO: 1235784 - RNA, 19 nt, Hepatitis B virus
ccguccccuucuucaucug

SEQ ID NO: 1235785 - RNA, 17 nt, Hepatitis B virus
aucacuggccagaggca

SEQ ID NO: 1235786 - RNA, 13 nt, Hepatitis B virus
ucugacuucuuuc

SEQ ID NO: 1235787 - RNA, 16 nt, Hepatitis B virus
ucccaucucuccaccu

SEQ ID NO: 1235788 - RNA, 16 nt, Hepatitis B virus
gucauccucaggccau

SEQ ID NO: 1235789 - RNA, 15 nt, Hepatitis B virus
uggacaaaggcauua

SEQ ID NO: 1235790 - RNA, 13 nt, Hepatitis B virus
acauucauuuaca

SEQ ID NO: 1235791 - RNA, 15 nt, Hepatitis B virus
cuguggaaggcuggc

SEQ ID NO: 1235792 - RNA, 18 nt, Hepatitis B virus
acucuguggaaggcuggc

SEQ ID NO: 1235793 - RNA, 15 nt, Hepatitis B virus
guggcuccucugccg

SEQ ID NO: 1235794 - RNA, 20 nt, Hepatitis B virus
cuugcccaaggucuuacaca

SEQ ID NO: 1235795 - RNA, 17 nt, Hepatitis B virus
acuaggcauuauuuaca

SEQ ID NO: 1235796 - RNA, 18 nt, Hepatitis B virus
cgaccacggggcgcaccu

SEQ ID NO: 1235797 - RNA, 13 nt, Hepatitis B virus
cuagguucuaucc

SEQ ID NO: 1235798 - RNA, 21 nt, Hepatitis B virus
cauuguucaccucaccauaca

SEQ ID NO: 1235799 - RNA, 17 nt, Hepatitis B virus
ucccaucucuccaccuc

SEQ ID NO: 1235800 - RNA, 12 nt, Hepatitis B virus
gcuuugcugccc

SEQ ID NO: 1235801 - RNA, 22 nt, Hepatitis B virus
cuccucgacaccgccucugcuc

SEQ ID NO: 1235802 - RNA, 12 nt, Hepatitis B virus
cgcuucaccucu

SEQ ID NO: 1235803 - RNA, 23 nt, Hepatitis B virus
gcaacccccacggguuggggcuu

SEQ ID NO: 1235804 - RNA, 12 nt, Hepatitis B virus
cauggcugcuag

SEQ ID NO: 1235805 - RNA, 18 nt, Hepatitis B virus
cugcguucggagccaacu

SEQ ID NO: 1235806 - RNA, 19 nt, Hepatitis B virus
guccuacuguucaagccuc

SEQ ID NO: 1235807 - RNA, 17 nt, Hepatitis B virus
cagucauccucaggcca

SEQ ID NO: 1235808 - RNA, 13 nt, Hepatitis B virus
gaggcaaaucagg

SEQ ID NO: 1235809 - RNA, 17 nt, Hepatitis B virus
uuguggcuccucugccg

SEQ ID NO: 1235810 - RNA, 20 nt, Hepatitis B virus
uccucgacaccgccucugcu

SEQ ID NO: 1235811 - RNA, 16 nt, Hepatitis B virus
cuguucccaauccucu

SEQ ID NO: 1235812 - RNA, 13 nt, Hepatitis B virus
ucuucaucugccg

SEQ ID NO: 1235813 - RNA, 21 nt, Hepatitis B virus
ggucuuccaaaccucgacaag

SEQ ID NO: 1235814 - RNA, 12 nt, Hepatitis B virus
accugucuuuaa

SEQ ID NO: 1235815 - RNA, 19 nt, Hepatitis B virus
agguuggucuuccaaaccu

SEQ ID NO: 1235816 - RNA, 19 nt, Hepatitis B virus
ucuguaucgggaggccuua

SEQ ID NO: 1235817 - RNA, 15 nt, Hepatitis B virus
uuggacaaaggcauu

SEQ ID NO: 1235818 - RNA, 22 nt, Hepatitis B virus
ucuuccaaaccucgacaaggca

SEQ ID NO: 1235819 - RNA, 22 nt, Hepatitis B virus
cuccucugccgauccauacugc

SEQ ID NO: 1235820 - RNA, 17 nt, Hepatitis B virus
auugugggucuuuuggg

SEQ ID NO: 1235821 - RNA, 16 nt, Hepatitis B virus
cuccccgucugugccu

SEQ ID NO: 1235822 - RNA, 20 nt, Hepatitis B virus
cuccaccaaucggcagucag

SEQ ID NO: 1235823 - RNA, 18 nt, Hepatitis B virus
guggaaggcuggcauucu

SEQ ID NO: 1235824 - RNA, 13 nt, Hepatitis B virus
gcugugcugccaa

SEQ ID NO: 1235825 - RNA, 16 nt, Hepatitis B virus
acgcccaccaggucuu

SEQ ID NO: 1235826 - RNA, 13 nt, Hepatitis B virus
accaaucggcagu

SEQ ID NO: 1235827 - RNA, 21 nt, Hepatitis B virus
uuacuucaaaacuaggcauua

SEQ ID NO: 1235828 - RNA, 23 nt, Hepatitis B virus
cuguggaguuacucucuuuuuug

SEQ ID NO: 1235829 - RNA, 18 nt, Hepatitis B virus
gacagucauccucaggcc

SEQ ID NO: 1235830 - RNA, 13 nt, Hepatitis B virus
uucuuuccuucua

SEQ ID NO: 1235831 - RNA, 16 nt, Hepatitis B virus
gcugcuaggcugugcu

SEQ ID NO: 1235832 - RNA, 22 nt, Hepatitis B virus
cuguaccugucuuuaauccuga

SEQ ID NO: 1235833 - RNA, 15 nt, Hepatitis B virus
aauuggucuguucac

SEQ ID NO: 1235834 - RNA, 18 nt, Hepatitis B virus
ccugucuuuaauccugau

SEQ ID NO: 1235835 - RNA, 22 nt, Hepatitis B virus
gagacagucauccucaggccau

SEQ ID NO: 1235836 - RNA, 12 nt, Hepatitis B virus
acaauguggcua

SEQ ID NO: 1235837 - RNA, 13 nt, Hepatitis B virus
cauccucaggcca

SEQ ID NO: 1235838 - RNA, 23 nt, Hepatitis B virus
caauaugugggcccucugacagu

SEQ ID NO: 1235839 - RNA, 12 nt, Hepatitis B virus
agcaaugucaac

SEQ ID NO: 1235840 - RNA, 20 nt, Hepatitis B virus
auaugcaguuaaucauuacu

SEQ ID NO: 1235841 - RNA, 21 nt, Hepatitis B virus
cuacucccaucucuccaccuc

SEQ ID NO: 1235842 - RNA, 16 nt, Hepatitis B virus
acccugcguucggagc

SEQ ID NO: 1235843 - RNA, 22 nt, Hepatitis B virus
acuguaccugucuuuaauccug

SEQ ID NO: 1235844 - RNA, 16 nt, Hepatitis B virus
cuguucaccagcacca

SEQ ID NO: 1235845 - RNA, 23 nt, Hepatitis B virus
accucuaagagacagucauccuc

SEQ ID NO: 1235846 - RNA, 22 nt, Hepatitis B virus
gcaggcuuucacuuucucgcca

SEQ ID NO: 1235847 - RNA, 15 nt, Hepatitis B virus
cuuuacugggcuuua

SEQ ID NO: 1235848 - RNA, 22 nt, Hepatitis B virus
uacauacucuguggaaggcugg

SEQ ID NO: 1235849 - RNA, 11 nt, Hepatitis B virus
cccucaggcuc

SEQ ID NO: 1235850 - RNA, 16 nt, Hepatitis B virus
gcuacagcaugggagg

SEQ ID NO: 1235851 - RNA, 20 nt, Hepatitis B virus
cuccucgacaccgccucugc

SEQ ID NO: 1235852 - RNA, 13 nt, Hepatitis B virus
caucucauguuca

SEQ ID NO: 1235853 - RNA, 15 nt, Hepatitis B virus
ccagcaccaugcaac

SEQ ID NO: 1235854 - RNA, 21 nt, Hepatitis B virus
gcaacggucaggucucugcca

SEQ ID NO: 1235855 - RNA, 11 nt, Hepatitis B virus
acauucauuua

SEQ ID NO: 1235856 - RNA, 14 nt, Hepatitis B virus
ggcccucugacagu

SEQ ID NO: 1235857 - RNA, 15 nt, Hepatitis B virus
agcauuugguccagg

SEQ ID NO: 1235858 - RNA, 16 nt, Hepatitis B virus
ccccuucuucaucugc

SEQ ID NO: 1235859 - RNA, 15 nt, Hepatitis B virus
caagagcuacagcau

SEQ ID NO: 1235860 - RNA, 20 nt, Hepatitis B virus
cuuuguacuaggaggcugua

SEQ ID NO: 1235861 - RNA, 13 nt, Hepatitis B virus
ucgacaaggcaug

SEQ ID NO: 1235862 - RNA, 19 nt, Hepatitis B virus
aauaugugggcccucugac

SEQ ID NO: 1235863 - RNA, 19 nt, Hepatitis B virus
uauaaagaauuuggagcuu

SEQ ID NO: 1235864 - RNA, 15 nt, Hepatitis B virus
cuccaagcugugccu

SEQ ID NO: 1235865 - RNA, 17 nt, Hepatitis B virus
ucucuuuuuugccuucu

SEQ ID NO: 1235866 - RNA, 12 nt, Hepatitis B virus
ccuacuguucaa

SEQ ID NO: 1235867 - RNA, 15 nt, Hepatitis B virus
cuaaucaucucaugu

SEQ ID NO: 1235868 - RNA, 19 nt, Hepatitis B virus
ccuuuguggcuccucugcc

SEQ ID NO: 1235869 - RNA, 15 nt, Hepatitis B virus
ugccuucucaucugc

SEQ ID NO: 1235870 - RNA, 22 nt, Hepatitis B virus
ugcaacuuuuuccccucugccu

SEQ ID NO: 1235871 - RNA, 22 nt, Hepatitis B virus
auccugauuggaaaacucccuc

SEQ ID NO: 1235872 - RNA, 14 nt, Hepatitis B virus
gagcccucaggcuc

SEQ ID NO: 1235873 - RNA, 21 nt, Hepatitis B virus
cccugcguucggagccaacuc

SEQ ID NO: 1235874 - RNA, 16 nt, Hepatitis B virus
gaacauuguucaccuc

SEQ ID NO: 1235875 - RNA, 14 nt, Hepatitis B virus
uugggacuucaacc

SEQ ID NO: 1235876 - RNA, 18 nt, Hepatitis B virus
accucgacaaggcauggg

SEQ ID NO: 1235877 - RNA, 23 nt, Hepatitis B virus
cagcgccucauuuugugggucac

SEQ ID NO: 1235878 - RNA, 21 nt, Hepatitis B virus
ccuuggguggcuuuggggcau

SEQ ID NO: 1235879 - RNA, 19 nt, Hepatitis B virus
accccaccacacggaggcc

SEQ ID NO: 1235880 - RNA, 16 nt, Hepatitis B virus
auccugaauaugcagu

SEQ ID NO: 1235881 - RNA, 12 nt, Hepatitis B virus
acucuguggaag

SEQ ID NO: 1235882 - RNA, 15 nt, Hepatitis B virus
gaaccuuuguggcuc

SEQ ID NO: 1235883 - RNA, 12 nt, Hepatitis B virus
uggucuguucac

SEQ ID NO: 1235884 - RNA, 14 nt, Hepatitis B virus
aacggucaggucuc

SEQ ID NO: 1235885 - RNA, 18 nt, Hepatitis B virus
ugggagguuggucuucca

SEQ ID NO: 1235886 - RNA, 17 nt, Hepatitis B virus
acucucuuuuuugccuu

SEQ ID NO: 1235887 - RNA, 15 nt, Hepatitis B virus
gguggcuuuggggca

SEQ ID NO: 1235888 - RNA, 16 nt, Hepatitis B virus
acaauaucuaaaccuu

SEQ ID NO: 1235889 - RNA, 12 nt, Hepatitis B virus
cugccuccacca

SEQ ID NO: 1235890 - RNA, 15 nt, Hepatitis B virus
cucacauucauuuac

SEQ ID NO: 1235891 - RNA, 18 nt, Hepatitis B virus
uaugucaaagaauugugg

SEQ ID NO: 1235892 - RNA, 18 nt, Hepatitis B virus
ccagcagcaccuccuccu

SEQ ID NO: 1235893 - RNA, 13 nt, Hepatitis B virus
cccaauccucugg

SEQ ID NO: 1235894 - RNA, 18 nt, Hepatitis B virus
gccagaggcaaaucaggu

SEQ ID NO: 1235895 - RNA, 16 nt, Hepatitis B virus
caccccaccacacgga

SEQ ID NO: 1235896 - RNA, 19 nt, Hepatitis B virus
aagaauugugggucuuuug

SEQ ID NO: 1235897 - RNA, 15 nt, Hepatitis B virus
cugggauucuuuccc

SEQ ID NO: 1235898 - RNA, 21 nt, Hepatitis B virus
gagccaacucaaacaauccag

SEQ ID NO: 1235899 - RNA, 19 nt, Hepatitis B virus
ucaacaauaugugggcccu

SEQ ID NO: 1235900 - RNA, 14 nt, Hepatitis B virus
acuucaaaacuagg

SEQ ID NO: 1235901 - RNA, 21 nt, Hepatitis B virus
aucuuucuguucccaauccuc

SEQ ID NO: 1235902 - RNA, 16 nt, Hepatitis B virus
aucacuggccagaggc

SEQ ID NO: 1235903 - RNA, 15 nt, Hepatitis B virus
cugcguucggagcca

SEQ ID NO: 1235904 - RNA, 20 nt, Hepatitis B virus
ccugaauaugcaguuaauca

SEQ ID NO: 1235905 - RNA, 20 nt, Hepatitis B virus
ccuccaccaaucggcaguca

SEQ ID NO: 1235906 - RNA, 22 nt, Hepatitis B virus
ucuguucaccagcaccaugcaa

SEQ ID NO: 1235907 - RNA, 22 nt, Hepatitis B virus
ucaacaauaugugggcccucug

SEQ ID NO: 1235908 - RNA, 14 nt, Hepatitis B virus
aauccucugggauu

SEQ ID NO: 1235909 - RNA, 20 nt, Hepatitis B virus
caaaacuaggcauuauuuac

SEQ ID NO: 1235910 - RNA, 21 nt, Hepatitis B virus
ccgucugugccuucucaucug

SEQ ID NO: 1235911 - RNA, 11 nt, Hepatitis B virus
gguuggggcuu

SEQ ID NO: 1235912 - RNA, 23 nt, Hepatitis B virus
acgcggucuccccgucugugccu

SEQ ID NO: 1235913 - RNA, 15 nt, Hepatitis B virus
cucuuggacucucag

SEQ ID NO: 1235914 - RNA, 23 nt, Hepatitis B virus
gcacuucgcuucaccucugcacg

SEQ ID NO: 1235915 - RNA, 22 nt, Hepatitis B virus
ggucuuuugggcuuugcugccc

SEQ ID NO: 1235916 - RNA, 19 nt, Hepatitis B virus
acucucuuuuuugccuucu

SEQ ID NO: 1235917 - RNA, 14 nt, Hepatitis B virus
gacaacacugccag

SEQ ID NO: 1235918 - RNA, 24 nt, Hepatitis B virus
aggagauuaaaauuaauuaugccu

SEQ ID NO: 1235919 - RNA, 17 nt, Hepatitis B virus
cuuuugggguggagccc

SEQ ID NO: 1235920 - RNA, 15 nt, Hepatitis B virus
uccaggguucacccc

SEQ ID NO: 1235921 - RNA, 22 nt, Hepatitis B virus
cuuggguggcuuuggggcaugg

SEQ ID NO: 1235922 - RNA, 15 nt, Hepatitis B virus
uucgagaucuccucg

SEQ ID NO: 1235923 - RNA, 21 nt, Hepatitis B virus
uggaaccuuuguggcuccucu

SEQ ID NO: 1235924 - RNA, 13 nt, Hepatitis B virus
gagcccucaggcu

SEQ ID NO: 1235925 - RNA, 23 nt, Hepatitis B virus
gaggccuuuugggguggagcccu

SEQ ID NO: 1235926 - RNA, 17 nt, Hepatitis B virus
ccucugacaguuaauga

SEQ ID NO: 1235927 - RNA, 14 nt, Hepatitis B virus
ucauccucaggcca

SEQ ID NO: 1235928 - RNA, 22 nt, Hepatitis B virus
gcaccuccuccugccuccacca

SEQ ID NO: 1235929 - RNA, 21 nt, Hepatitis B virus
caccaggucuugcccaagguc

SEQ ID NO: 1235930 - RNA, 19 nt, Hepatitis B virus
cauccucaggccaugcagu

SEQ ID NO: 1235931 - RNA, 15 nt, Hepatitis B virus
ccuucuucaucugcc

SEQ ID NO: 1235932 - RNA, 19 nt, Hepatitis B virus
ggacuucaaccccaacaag

SEQ ID NO: 1235933 - RNA, 14 nt, Hepatitis B virus
aaccguauuauccu

SEQ ID NO: 1235934 - RNA, 15 nt, Hepatitis B virus
gcaugggagguuggu

SEQ ID NO: 1235935 - RNA, 14 nt, Hepatitis B virus
gccaacuggauccu

SEQ ID NO: 1235936 - RNA, 22 nt, Hepatitis B virus
uggacccugcguucggagccaa

SEQ ID NO: 1235937 - RNA, 16 nt, Hepatitis B virus
gccuccaagcugugcc

SEQ ID NO: 1235938 - RNA, 14 nt, Hepatitis B virus
uucaaagacuguuu

SEQ ID NO: 1235939 - RNA, 15 nt, Hepatitis B virus
uuaaucauuacuuca

SEQ ID NO: 1235940 - RNA, 16 nt, Hepatitis B virus
accauacagcacucag

SEQ ID NO: 1235941 - RNA, 19 nt, Hepatitis B virus
cuuucuguucccaauccuc

SEQ ID NO: 1235942 - RNA, 15 nt, Hepatitis B virus
aguuacucucuuuuu

SEQ ID NO: 1235943 - RNA, 13 nt, Hepatitis B virus
cuccaccucuaag

SEQ ID NO: 1235944 - RNA, 15 nt, Hepatitis B virus
cucucuuuuuugccu

SEQ ID NO: 1235945 - RNA, 19 nt, Hepatitis B virus
auuggaaaacucccuccuu

SEQ ID NO: 1235946 - RNA, 17 nt, Hepatitis B virus
uuaaucauuacuucaaa

SEQ ID NO: 1235947 - RNA, 18 nt, Hepatitis B virus
cuguggaguuacucucuu

SEQ ID NO: 1235948 - RNA, 19 nt, Hepatitis B virus
aagaauuuggagcuucugu

SEQ ID NO: 1235949 - RNA, 14 nt, Hepatitis B virus
caggaagacagccu

SEQ ID NO: 1235950 - RNA, 13 nt, Hepatitis B virus
acaaggccuuucu

SEQ ID NO: 1235951 - RNA, 18 nt, Hepatitis B virus
uggagcccucaggcucag

SEQ ID NO: 1235952 - RNA, 15 nt, Hepatitis B virus
cugccagcagcaccu

SEQ ID NO: 1235953 - RNA, 12 nt, Hepatitis B virus
cuucaucugccg

SEQ ID NO: 1235954 - RNA, 14 nt, Hepatitis B virus
guccuacuguucaa

SEQ ID NO: 1235955 - RNA, 21 nt, Hepatitis B virus
ggcauaaauuggucuguucac

SEQ ID NO: 1235956 - RNA, 16 nt, Hepatitis B virus
ucaccaguuggacccu

SEQ ID NO: 1235957 - RNA, 15 nt, Hepatitis B virus
cugccuugaugccuu

SEQ ID NO: 1235958 - RNA, 16 nt, Hepatitis B virus
ugugggcccucugaca

SEQ ID NO: 1235959 - RNA, 16 nt, Hepatitis B virus
gagcuacagcauggga

SEQ ID NO: 1235960 - RNA, 14 nt, Hepatitis B virus
gcuucaccucugca

SEQ ID NO: 1235961 - RNA, 17 nt, Hepatitis B virus
aaacuuuacugggcuuu

SEQ ID NO: 1235962 - RNA, 14 nt, Hepatitis B virus
gagcuucuguggag

SEQ ID NO: 1235963 - RNA, 20 nt, Hepatitis B virus
ccgucucggggccguuuggg

SEQ ID NO: 1235964 - RNA, 11 nt, Hepatitis B virus
ggagcuucugu

SEQ ID NO: 1235965 - RNA, 20 nt, Hepatitis B virus
ccggaacauuguucaccuca

SEQ ID NO: 1235966 - RNA, 17 nt, Hepatitis B virus
cuuggacaaaggcauua

SEQ ID NO: 1235967 - RNA, 16 nt, Hepatitis B virus
uuacauacucugugga

SEQ ID NO: 1235968 - RNA, 21 nt, Hepatitis B virus
uaccaaauauuugcccuugga

SEQ ID NO: 1235969 - RNA, 16 nt, Hepatitis B virus
caacuuacaaggccuu

SEQ ID NO: 1235970 - RNA, 14 nt, Hepatitis B virus
uccugccuccacca

SEQ ID NO: 1235971 - RNA, 23 nt, Hepatitis B virus
cugccuaaucaucucauguucau

SEQ ID NO: 1235972 - RNA, 21 nt, Hepatitis B virus
uguaccugucuuuaauccuga

SEQ ID NO: 1235973 - RNA, 17 nt, Hepatitis B virus
acaacacugccagcagc

SEQ ID NO: 1235974 - RNA, 14 nt, Hepatitis B virus
guuggucuuccaaa

SEQ ID NO: 1235975 - RNA, 15 nt, Hepatitis B virus
acucuuggacucuca

SEQ ID NO: 1235976 - RNA, 15 nt, Hepatitis B virus
caccuccuccugccu

SEQ ID NO: 1235977 - RNA, 22 nt, Hepatitis B virus
ucaagccuccaagcugugccuu

SEQ ID NO: 1235978 - RNA, 14 nt, Hepatitis B virus
gccuccaagcugug

SEQ ID NO: 1235979 - RNA, 19 nt, Hepatitis B virus
cacuucgcuucaccucugc

SEQ ID NO: 1235980 - RNA, 17 nt, Hepatitis B virus
uccccuucuucaucugc

SEQ ID NO: 1235981 - RNA, 12 nt, Human
aaaaaaugguuc

SEQ ID NO: 1235982 - RNA, 18 nt, Human
aaaaacagauuuggaaag

SEQ ID NO: 1235983 - RNA, 16 nt, Human
aaaaaccuauuccacu

SEQ ID NO: 1235984 - RNA, 18 nt, Human
aaaaaccugagauuuauu

SEQ ID NO: 1235985 - RNA, 22 nt, Human
aaaaaccugagauuuauuaaag

SEQ ID NO: 1235986 - RNA, 23 nt, Human
aaaaaccugagauuuauuaaaga

SEQ ID NO: 1235987 - RNA, 12 nt, Human
aaaaaccuuggg

SEQ ID NO: 1235988 - RNA, 22 nt, Human
aaaaaccuuguauaucuuguuu

SEQ ID NO: 1235989 - RNA, 13 nt, Human
aaaaaccuugggu

SEQ ID NO: 1235990 - RNA, 14 nt, Human
aaaaacuaaaaacu

SEQ ID NO: 1235991 - RNA, 17 nt, Human
aaaaacuaaaaacuaga

SEQ ID NO: 1235992 - RNA, 19 nt, Human
aaaaacuacaaccaaugga

SEQ ID NO: 1235993 - RNA, 11 nt, Human
aaaaacuauuu

SEQ ID NO: 1235994 - RNA, 16 nt, Human
aaaaaauguauaugca

SEQ ID NO: 1235995 - RNA, 20 nt, Human
aguggcgugaucucagcuca

SEQ ID NO: 1235996 - RNA, 14 nt, Human
aguggcucaacauu

SEQ ID NO: 1235997 - RNA, 19 nt, Human
aguggcgugaucucagcuc

SEQ ID NO: 1235998 - RNA, 20 nt, Human
aguggcgcgaucucagcuca

SEQ ID NO: 1235999 - RNA, 19 nt, Human
aguggcgcgaucucagcuc

SEQ ID NO: 1236000 - RNA, 18 nt, Human
aguggcugguccagggcu

SEQ ID NO: 1236001 - RNA, 19 nt, Human
aguggcugguccagggcua

SEQ ID NO: 1236002 - RNA, 22 nt, Human
aguggcuggggcauggaaggca

SEQ ID NO: 1236003 - RNA, 13 nt, Human
aguggcuggggca

SEQ ID NO: 1236004 - RNA, 16 nt, Human
aguggcuggggcaugg

SEQ ID NO: 1236005 - RNA, 15 nt, Human
aguggcugguccagg

SEQ ID NO: 1236006 - RNA, 17 nt, Human
aguggcugguccagggc

SEQ ID NO: 1236007 - RNA, 13 nt, Human
aguggcuccuccc

SEQ ID NO: 1236008 - RNA, 17 nt, Human
aguggcuccucccggug

SEQ ID NO: 1236009 - RNA, 21 nt, Human
aguggcuccucccggugccca

SEQ ID NO: 1236010 - RNA, 18 nt, Human
aguguaucaaaaugcucu

SEQ ID NO: 1236011 - RNA, 17 nt, Human
aguguaucaaaaugcuc

SEQ ID NO: 1236012 - RNA, 18 nt, Human
aguguaugacugcacaug

SEQ ID NO: 1236013 - RNA, 16 nt, Human
aguguaucaaaaugcu

SEQ ID NO: 1236014 - RNA, 15 nt, Human
aguguaucaaaaugc

SEQ ID NO: 1236015 - RNA, 14 nt, Human
aguguaucaaaaug

SEQ ID NO: 1236016 - RNA, 13 nt, Human
aguguaucaaaau

SEQ ID NO: 1236017 - RNA, 14 nt, Human
aguguaugauuacu

SEQ ID NO: 1236018 - RNA, 15 nt, Human
aguguaugauuacug

SEQ ID NO: 1236019 - RNA, 19 nt, Human
aguguaugauuacuggccu

SEQ ID NO: 1236020 - RNA, 16 nt, Human
aguguauggaaauaaa

SEQ ID NO: 1236021 - RNA, 20 nt, Human
aguguauggaaauaaaugua

SEQ ID NO: 1236022 - RNA, 21 nt, Human
aguguauggaaauaaauguau

SEQ ID NO: 1236023 - RNA, 22 nt, Human
aguguauggaaauaaauguauc

SEQ ID NO: 1236024 - RNA, 14 nt, Human
aguguauuuggaaa

SEQ ID NO: 1236025 - RNA, 23 nt, Human
aguguauuuggaaauaaagucag

SEQ ID NO: 1236026 - RNA, 14 nt, Human
aguguccucagggg

SEQ ID NO: 1236027 - RNA, 22 nt, Human
aguguccucuucccucucugca

SEQ ID NO: 1236028 - RNA, 18 nt, Human
aguguccugagccccagg

SEQ ID NO: 1236029 - RNA, 13 nt, Human
aguguccugagcu

SEQ ID NO: 1236030 - RNA, 22 nt, Human
agugucuguguuuugaaagaau

SEQ ID NO: 1236031 - RNA, 20 nt, Human
aguguccugagcucagcgug

SEQ ID NO: 1236032 - RNA, 15 nt, Human
aguguccugagcuca

SEQ ID NO: 1236033 - RNA, 17 nt, Human
aguguccugagcucagc

SEQ ID NO: 1236034 - RNA, 21 nt, Human
aguguccugagcucagcgugg

SEQ ID NO: 1236035 - RNA, 22 nt, Human
aguugaaaaucuuauaauuuaa

SEQ ID NO: 1236036 - RNA, 13 nt, Human
aguuccaagaguc

SEQ ID NO: 1236037 - RNA, 14 nt, Human
aguuccaagagucu

SEQ ID NO: 1236038 - RNA, 19 nt, Human
aguuccaagagucuaaaga

SEQ ID NO: 1236039 - RNA, 13 nt, Human
aguucaugagaau

SEQ ID NO: 1236040 - RNA, 21 nt, Human
aguucaugagaaucuauauuu

SEQ ID NO: 1236041 - RNA, 13 nt, Human
aguucaugcagcu

SEQ ID NO: 1236042 - RNA, 22 nt, Human
aguucaugcagcuguggcagag

SEQ ID NO: 1236043 - RNA, 13 nt, Human
aguucauguaaau

SEQ ID NO: 1236044 - RNA, 14 nt, Human
aguucauguaaaua

SEQ ID NO: 1236045 - RNA, 16 nt, Human
aguucauguaaauaau

SEQ ID NO: 1236046 - RNA, 17 nt, Human
aguucauguaaauaaua

SEQ ID NO: 1236047 - RNA, 17 nt, Human
aguucaugucugcuauc

SEQ ID NO: 1236048 - RNA, 16 nt, Human
aguucaugucugcuau

SEQ ID NO: 1236049 - RNA, 15 nt, Human
aguucauuagaaaua

SEQ ID NO: 1236050 - RNA, 16 nt, Human
aguucauuagaaauau

SEQ ID NO: 1236051 - RNA, 23 nt, Human
aguucauuagaaauauuuuaaaa

SEQ ID NO: 1236052 - RNA, 18 nt, Human
aguucauuagaaauauuu

SEQ ID NO: 1236053 - RNA, 19 nt, Human
aguuacagaaaugauuacu

SEQ ID NO: 1236054 - RNA, 13 nt, Human
aguuaagccuuug

SEQ ID NO: 1236055 - RNA, 14 nt, Human
aguuaagccuuugg

SEQ ID NO: 1236056 - RNA, 15 nt, Human
aguuaaucaucaaga

SEQ ID NO: 1236057 - RNA, 19 nt, Human
aguuaaucaucaagagaau

SEQ ID NO: 1236058 - RNA, 18 nt, Human
aguuaaucaucaagagaa

SEQ ID NO: 1236059 - RNA, 14 nt, Human
aguuaaucuugcuu

SEQ ID NO: 1236060 - RNA, 15 nt, Human
aguuaaucuugcuuu

SEQ ID NO: 1236061 - RNA, 16 nt, Human
aguuaaucuugcuuuc

SEQ ID NO: 1236062 - RNA, 18 nt, Human
aguuaaucuugcuuucuu

SEQ ID NO: 1236063 - RNA, 23 nt, Human
aguugaaaaucuuauaauuuaaa

SEQ ID NO: 1236064 - RNA, 16 nt, Human
aguugaaaauaaagug

SEQ ID NO: 1236065 - RNA, 18 nt, Human
aguugaaaauaaagugua

SEQ ID NO: 1236066 - RNA, 19 nt, Human
aguugaaaauaaaguguau

SEQ ID NO: 1236067 - RNA, 16 nt, Human
aguuguguuugaagca

SEQ ID NO: 1236068 - RNA, 21 nt, Human
aguugugucuggcaguuuaua

SEQ ID NO: 1236069 - RNA, 16 nt, Human
aguuguuguaaccugc

SEQ ID NO: 1236070 - RNA, 14 nt, Human
aguuguuguagaga

SEQ ID NO: 1236071 - RNA, 12 nt, Human
aguuguuguaac

SEQ ID NO: 1236072 - RNA, 14 nt, Human
aguuguguuucaac

SEQ ID NO: 1236073 - RNA, 23 nt, Human
aguuguguuucaacggaaagugc

SEQ ID NO: 1236074 - RNA, 23 nt, Human
aguuguucgggccaaggaccuga

SEQ ID NO: 1236075 - RNA, 18 nt, Human
aguuguucuuuuuagaaa

SEQ ID NO: 1236076 - RNA, 16 nt, Human
aguaucucuucagucu

SEQ ID NO: 1236077 - RNA, 18 nt, Human
aguaucucuucagucucu

SEQ ID NO: 1236078 - RNA, 16 nt, Human
aguaucuuuuuauuca

SEQ ID NO: 1236079 - RNA, 12 nt, Human
aguaucuuuuga

SEQ ID NO: 1236080 - RNA, 12 nt, Human
aguaugaaaaua

SEQ ID NO: 1236081 - RNA, 16 nt, Human
aguaugaauaaagaca

SEQ ID NO: 1236082 - RNA, 13 nt, Human
aguaugaaaauaa

SEQ ID NO: 1236083 - RNA, 22 nt, Human
aguaugaauuauucaauuuauu

SEQ ID NO: 1236084 - RNA, 23 nt, Human
aguaugcuugaaaagauaaauua

SEQ ID NO: 1236085 - RNA, 17 nt, Human
aguaugaauuauucaau

SEQ ID NO: 1236086 - RNA, 15 nt, Human
aguauggccuguguc

SEQ ID NO: 1236087 - RNA, 16 nt, Human
aguauggccuguguca

SEQ ID NO: 1236088 - RNA, 23 nt, Human
agucaaauugugugaaagguacu

SEQ ID NO: 1236089 - RNA, 22 nt, Human
agucaaaugguaggcauuuccu

SEQ ID NO: 1236090 - RNA, 23 nt, Human
agucaaaugguaggcauuuccua

SEQ ID NO: 1236091 - RNA, 14 nt, Human
agucaaauaacucc

SEQ ID NO: 1236092 - RNA, 18 nt, Human
aguauggguuagggaaaa

SEQ ID NO: 1236093 - RNA, 17 nt, Human
aguaugggacuggccuc

SEQ ID NO: 1236094 - RNA, 20 nt, Human
aguaugggacuggccucugc

SEQ ID NO: 1236095 - RNA, 18 nt, Human
aguauggggguuguaaau

SEQ ID NO: 1236096 - RNA, 19 nt, Human
aguauggggguuguaaauu

SEQ ID NO: 1236097 - RNA, 22 nt, Human
agucaacaguaaaccacugaaa

SEQ ID NO: 1236098 - RNA, 17 nt, Human
agucaacaguaaaccac

SEQ ID NO: 1236099 - RNA, 18 nt, Human
agucaacaguaaaccacu

SEQ ID NO: 1236100 - RNA, 20 nt, Human
agucaacaguaaaccacuga

SEQ ID NO: 1236101 - RNA, 21 nt, Human
agucaacaguaaaccacugaa

SEQ ID NO: 1236102 - RNA, 13 nt, Human
agucaacaguaaa

SEQ ID NO: 1236103 - RNA, 14 nt, Human
agucaacaguaaac

SEQ ID NO: 1236104 - RNA, 15 nt, Human
agucaacaguaaacc

SEQ ID NO: 1236105 - RNA, 16 nt, Human
agucaacaguaaacca

SEQ ID NO: 1236106 - RNA, 17 nt, Human
agugacccacaugccau

SEQ ID NO: 1236107 - RNA, 18 nt, Human
agugaccauacuaauuau

SEQ ID NO: 1236108 - RNA, 19 nt, Human
aguccugggauuacaggug

SEQ ID NO: 1236109 - RNA, 13 nt, Human
aguccugugaaug

SEQ ID NO: 1236110 - RNA, 18 nt, Human
aguccugugaaugccacu

SEQ ID NO: 1236111 - RNA, 19 nt, Human
aguccugugaaugccacug

SEQ ID NO: 1236112 - RNA, 20 nt, Human
aguccugugaaugccacugc

SEQ ID NO: 1236113 - RNA, 12 nt, Human
aguccuguaaug

SEQ ID NO: 1236114 - RNA, 21 nt, Human
aguccugugaaugccacugcc

SEQ ID NO: 1236115 - RNA, 14 nt, Human
agucugccacccag

SEQ ID NO: 1236116 - RNA, 11 nt, Human
agucugccagg

SEQ ID NO: 1236117 - RNA, 13 nt, Human
agucugccagggc

SEQ ID NO: 1236118 - RNA, 22 nt, Human
agucugccagggccccucuccc

SEQ ID NO: 1236119 - RNA, 12 nt, Human
agugaagaauac

SEQ ID NO: 1236120 - RNA, 14 nt, Human
agugaagaauacuu

SEQ ID NO: 1236121 - RNA, 22 nt, Human
agugaagaauacuucucauuuu

SEQ ID NO: 1236122 - RNA, 12 nt, Human
agugaagacaga

SEQ ID NO: 1236123 - RNA, 13 nt, Human
agugaagacagaa

SEQ ID NO: 1236124 - RNA, 20 nt, Human
agugaagacagaaccacagg

SEQ ID NO: 1236125 - RNA, 14 nt, Human
agugaagacagaag

SEQ ID NO: 1236126 - RNA, 21 nt, Human
agugaagacuagaaaauuaga

SEQ ID NO: 1236127 - RNA, 15 nt, Human
agugaagacagaagu

SEQ ID NO: 1236128 - RNA, 16 nt, Human
agugaagacuggaagc

SEQ ID NO: 1236129 - RNA, 15 nt, Human
agugaaggcuucucu

SEQ ID NO: 1236130 - RNA, 21 nt, Human
agugaaggcuucucucugugg

SEQ ID NO: 1236131 - RNA, 23 nt, Human
agugaagggaagagacagcccag

SEQ ID NO: 1236132 - RNA, 14 nt, Human
agugaaguugcugc

SEQ ID NO: 1236133 - RNA, 15 nt, Human
agugaaguugcugcu

SEQ ID NO: 1236134 - RNA, 23 nt, Human
agugaaguugcugcuucucccag

SEQ ID NO: 1236135 - RNA, 16 nt, Human
agugaaguugcugcuu

SEQ ID NO: 1236136 - RNA, 20 nt, Human
agugacagcuaggaugugca

SEQ ID NO: 1236137 - RNA, 12 nt, Human
agugacagcuag

SEQ ID NO: 1236138 - RNA, 14 nt, Human
auagucaaauugug

SEQ ID NO: 1236139 - RNA, 18 nt, Human
auaguauuuuuauauuua

SEQ ID NO: 1236140 - RNA, 17 nt, Human
auagucaaauuguguga

SEQ ID NO: 1236141 - RNA, 22 nt, Human
auauacucuagaugaaguuuua

SEQ ID NO: 1236142 - RNA, 20 nt, Human
auauacuuugaaaggagaug

SEQ ID NO: 1236143 - RNA, 23 nt, Human
auauagaucaguuauaaguagca

SEQ ID NO: 1236144 - RNA, 18 nt, Human
auauacuuuuacaaguaa

SEQ ID NO: 1236145 - RNA, 11 nt, Human
auauacuuuuu

SEQ ID NO: 1236146 - RNA, 20 nt, Human
auauacuuuuuuuucuuuaa

SEQ ID NO: 1236147 - RNA, 20 nt, Human
auauagaaguauaaagaauu

SEQ ID NO: 1236148 - RNA, 17 nt, Human
auauagaaguauaaaga

SEQ ID NO: 1236149 - RNA, 15 nt, Human
auagguuuaauaauu

SEQ ID NO: 1236150 - RNA, 14 nt, Human
auagguuuggacaa

SEQ ID NO: 1236151 - RNA, 18 nt, Human
auagguuuggacaaaaug

SEQ ID NO: 1236152 - RNA, 12 nt, Human
auagguuauuuu

SEQ ID NO: 1236153 - RNA, 12 nt, Human
auagguuuagag

SEQ ID NO: 1236154 - RNA, 21 nt, Human
auagguauaaguggugugugu

SEQ ID NO: 1236155 - RNA, 13 nt, Human
auaggucugaaau

SEQ ID NO: 1236156 - RNA, 14 nt, Human
auaggucugaaauu

SEQ ID NO: 1236157 - RNA, 15 nt, Human
auaggucugaaauuu

SEQ ID NO: 1236158 - RNA, 20 nt, Human
auaggugauccauguaacug

SEQ ID NO: 1236159 - RNA, 23 nt, Human
auaggugauccauguaacugccu

SEQ ID NO: 1236160 - RNA, 13 nt, Human
auagccaaaaaua

SEQ ID NO: 1236161 - RNA, 14 nt, Human
auagccaaaaauag

SEQ ID NO: 1236162 - RNA, 15 nt, Human
auagccaaaaauagc

SEQ ID NO: 1236163 - RNA, 16 nt, Human
auagccaaaaauagcu

SEQ ID NO: 1236164 - RNA, 18 nt, Human
auagccaaaaauagcuaa

SEQ ID NO: 1236165 - RNA, 13 nt, Human
auagccacauuug

SEQ ID NO: 1236166 - RNA, 16 nt, Human
auagccacauuuggaa

SEQ ID NO: 1236167 - RNA, 21 nt, Human
auagccacauuuggaauacuu

SEQ ID NO: 1236168 - RNA, 22 nt, Human
auagccacauuuggaauacuuu

SEQ ID NO: 1236169 - RNA, 23 nt, Human
auagccacauuuggaauacuuuu

SEQ ID NO: 1236170 - RNA, 13 nt, Human
auagccacuaacc

SEQ ID NO: 1236171 - RNA, 15 nt, Human
auagccacuaaccuu

SEQ ID NO: 1236172 - RNA, 20 nt, Human
auagccacuaaccuugccug

SEQ ID NO: 1236173 - RNA, 21 nt, Human
auagccacuaaccuugccugg

SEQ ID NO: 1236174 - RNA, 22 nt, Human
auagccacuaaccuugccuggu

SEQ ID NO: 1236175 - RNA, 23 nt, Human
auagccacuaaccuugccuggua

SEQ ID NO: 1236176 - RNA, 12 nt, Human
auagccauauuu

SEQ ID NO: 1236177 - RNA, 16 nt, Human
auagccauauuuguaa

SEQ ID NO: 1236178 - RNA, 20 nt, Human
auagccauauuuguaaaaug

SEQ ID NO: 1236179 - RNA, 22 nt, Human
auagccauauuuguaaaaugac

SEQ ID NO: 1236180 - RNA, 23 nt, Human
auagccauauuuguaaaaugaca

SEQ ID NO: 1236181 - RNA, 13 nt, Human
auagcccacuuac

SEQ ID NO: 1236182 - RNA, 15 nt, Human
auagcccacuuacau

SEQ ID NO: 1236183 - RNA, 19 nt, Human
auagcccacuuacauuuac

SEQ ID NO: 1236184 - RNA, 16 nt, Human
auaucaaauauauuca

SEQ ID NO: 1236185 - RNA, 19 nt, Human
auauauuuuuuucugaaau

SEQ ID NO: 1236186 - RNA, 23 nt, Human
auauauuuuuuuuuaagcucuga

SEQ ID NO: 1236187 - RNA, 15 nt, Human
auaucaauuuaaaaa

SEQ ID NO: 1236188 - RNA, 16 nt, Human
auaucauccacacaug

SEQ ID NO: 1236189 - RNA, 18 nt, Human
auaucauccacacaugaa

SEQ ID NO: 1236190 - RNA, 24 nt, Human
auaucauccacacaugaaucugca

SEQ ID NO: 1236191 - RNA, 16 nt, Human
auaucaucuaccuaga

SEQ ID NO: 1236192 - RNA, 20 nt, Human
auaucaucuaccuagauuua

SEQ ID NO: 1236193 - RNA, 21 nt, Human
auaucaugagugaauaaaugu

SEQ ID NO: 1236194 - RNA, 21 nt, Human
auaucaucuaccuagauuuaa

SEQ ID NO: 1236195 - RNA, 23 nt, Human
auauuaugaagcuuuuaugugaa

SEQ ID NO: 1236196 - RNA, 13 nt, Human
auauuaucuuuuc

SEQ ID NO: 1236197 - RNA, 12 nt, Human
auauuauaugga

SEQ ID NO: 1236198 - RNA, 13 nt, Human
auauuauauggaa

SEQ ID NO: 1236199 - RNA, 18 nt, Human
auauuauauggaaauaua

SEQ ID NO: 1236200 - RNA, 19 nt, Human
auauuauauggaaauauau

SEQ ID NO: 1236201 - RNA, 20 nt, Human
auauuauauggaaauauaua

SEQ ID NO: 1236202 - RNA, 16 nt, Human
auauuaugagaugcug

SEQ ID NO: 1236203 - RNA, 14 nt, Human
auauuaugagaugc

SEQ ID NO: 1236204 - RNA, 15 nt, Human
auauuaugagaugcu

SEQ ID NO: 1236205 - RNA, 12 nt, Human
auauuauuacuu

SEQ ID NO: 1236206 - RNA, 15 nt, Human
auauuauuacuugua

SEQ ID NO: 1236207 - RNA, 17 nt, Human
auauuauuacuuguaaa

SEQ ID NO: 1236208 - RNA, 19 nt, Human
auauuauuacuuguaaaua

SEQ ID NO: 1236209 - RNA, 19 nt, Human
auauuauuaguuuugauuu

SEQ ID NO: 1236210 - RNA, 22 nt, Human
auauuauuaguuuugauuuaau

SEQ ID NO: 1236211 - RNA, 18 nt, Human
auauuauuauaaucuuau

SEQ ID NO: 1236212 - RNA, 19 nt, Human
auauuauuauaaucuuaua

SEQ ID NO: 1236213 - RNA, 21 nt, Human
auauuauuauaaucuuauaau

SEQ ID NO: 1236214 - RNA, 23 nt, Human
auauuauuauaaucuuauaauug

SEQ ID NO: 1236215 - RNA, 19 nt, Human
auauuauuccucaaaaaau

SEQ ID NO: 1236216 - RNA, 15 nt, Human
auauuuaccucagcc

SEQ ID NO: 1236217 - RNA, 16 nt, Human
auauuuaccucagccu

SEQ ID NO: 1236218 - RNA, 17 nt, Human
auauuuaccucagccug

SEQ ID NO: 1236219 - RNA, 19 nt, Human
auauuuaccucagccuggg

SEQ ID NO: 1236220 - RNA, 14 nt, Human
auauuauuuuaugu

SEQ ID NO: 1236221 - RNA, 13 nt, Human
auauuuauuuuaa

SEQ ID NO: 1236222 - RNA, 14 nt, Human
auauuuacucuaua

SEQ ID NO: 1236223 - RNA, 18 nt, Human
auauuuaccucagccugg

SEQ ID NO: 1236224 - RNA, 13 nt, Human
auauccuaaacau

SEQ ID NO: 1236225 - RNA, 15 nt, Human
auauccuaaacauca

SEQ ID NO: 1236226 - RNA, 12 nt, Human
auauccaaaagc

SEQ ID NO: 1236227 - RNA, 19 nt, Human
auauccaaaagcuuuuuau

SEQ ID NO: 1236228 - RNA, 22 nt, Human
auauccuaaacaucauucauuu

SEQ ID NO: 1236229 - RNA, 23 nt, Human
auaugcuucuguuuuauaauuuu

SEQ ID NO: 1236230 - RNA, 20 nt, Human
auaugcucugauuuaucuga

SEQ ID NO: 1236231 - RNA, 17 nt, Human
auauuacgguuugcccc

SEQ ID NO: 1236232 - RNA, 20 nt, Human
auaugcuucuguuuuauaau

SEQ ID NO: 1236233 - RNA, 22 nt, Human
auaugcuucuguuuuauaauuu

SEQ ID NO: 1236234 - RNA, 13 nt, Human
auacacacaguua

SEQ ID NO: 1236235 - RNA, 23 nt, Human
auaccauuauauguucccccugu

SEQ ID NO: 1236236 - RNA, 14 nt, Human
auaagcuuuucuuu

SEQ ID NO: 1236237 - RNA, 13 nt, Human
auaaggaaaagcu

SEQ ID NO: 1236238 - RNA, 13 nt, Human
auaagcuuuucuu

SEQ ID NO: 1236239 - RNA, 20 nt, Human
auaaggaaaucaacuugcuu

SEQ ID NO: 1236240 - RNA, 22 nt, Human
auaaggaaaucaacuugcuuau

SEQ ID NO: 1236241 - RNA, 24 nt, Human
auaaggaaaucaacuugcuuauca

SEQ ID NO: 1236242 - RNA, 19 nt, Human
auaaggccauaaaacaggu

SEQ ID NO: 1236243 - RNA, 11 nt, Human
auaaggcaggg

SEQ ID NO: 1236244 - RNA, 21 nt, Human
auaaugggauuuucuuuucuu

SEQ ID NO: 1236245 - RNA, 14 nt, Human
auacccacccagaa

SEQ ID NO: 1236246 - RNA, 13 nt, Human
auacccacccaga

SEQ ID NO: 1236247 - RNA, 20 nt, Human
auaccucuaauaguauaaac

SEQ ID NO: 1236248 - RNA, 19 nt, Human
auaccucuaauaguauaaa

SEQ ID NO: 1236249 - RNA, 18 nt, Human
auaccucuaauaguauaa

SEQ ID NO: 1236250 - RNA, 14 nt, Human
auaccucuaauagu

SEQ ID NO: 1236251 - RNA, 20 nt, Human
auaccucaauuuucacugug

SEQ ID NO: 1236252 - RNA, 12 nt, Human
auaccucacuuu

SEQ ID NO: 1236253 - RNA, 18 nt, Human
auaccuuagugcaguuau

SEQ ID NO: 1236254 - RNA, 19 nt, Human
auaccuguguuucuugccu

SEQ ID NO: 1236255 - RNA, 20 nt, Human
auaccuguguuucuugccuc

SEQ ID NO: 1236256 - RNA, 22 nt, Human
auaccuguguuucuugccucau

SEQ ID NO: 1236257 - RNA, 21 nt, Human
auaccuguguuucuugccuca

SEQ ID NO: 1236258 - RNA, 15 nt, Human
auaaauuuuuuauaa

SEQ ID NO: 1236259 - RNA, 17 nt, Human
auaacaaaugccaaauu

SEQ ID NO: 1236260 - RNA, 20 nt, Human
auaacaaaugccaaauuaaa

SEQ ID NO: 1236261 - RNA, 21 nt, Human
auaacaaaugccaaauuaaaa

SEQ ID NO: 1236262 - RNA, 14 nt, Human
auaacaacuucaua

SEQ ID NO: 1236263 - RNA, 18 nt, Human
auaaaggauuaaugucaa

SEQ ID NO: 1236264 - RNA, 16 nt, Human
auaaaggcaguuuucu

SEQ ID NO: 1236265 - RNA, 17 nt, Human
auaaaggcaguuuucua

SEQ ID NO: 1236266 - RNA, 18 nt, Human
auaaaggcaguuuucuaa

SEQ ID NO: 1236267 - RNA, 20 nt, Human
auaaacuuuuuucuuacugu

SEQ ID NO: 1236268 - RNA, 14 nt, Human
auaaaagaaaauua

SEQ ID NO: 1236269 - RNA, 13 nt, Human
auaaagaaaagau

SEQ ID NO: 1236270 - RNA, 14 nt, Human
auaaagaaaagaug

SEQ ID NO: 1236271 - RNA, 15 nt, Human
auaaagaaaagaugc

SEQ ID NO: 1236272 - RNA, 16 nt, Human
auaaagaaaagaugca

SEQ ID NO: 1236273 - RNA, 17 nt, Human
auaaagaaaagaugcac

SEQ ID NO: 1236274 - RNA, 19 nt, Human
auaaagaaaagaugcacuu

SEQ ID NO: 1236275 - RNA, 13 nt, Human
auaaagaaaauga

SEQ ID NO: 1236276 - RNA, 15 nt, Human
auaaaagacagugaa

SEQ ID NO: 1236277 - RNA, 12 nt, Human
auaaaagaaaau

SEQ ID NO: 1236278 - RNA, 13 nt, Human
auaaaagaaaauu

SEQ ID NO: 1236279 - RNA, 16 nt, Human
auaaaagaaaauuaca

SEQ ID NO: 1236280 - RNA, 19 nt, Human
auaaaaauaaaaaagaucc

SEQ ID NO: 1236281 - RNA, 14 nt, Human
auaaaaauaaaaaa

SEQ ID NO: 1236282 - RNA, 16 nt, Human
auaaaaagugcuuuug

SEQ ID NO: 1236283 - RNA, 12 nt, Human
auaaaaaggugu

SEQ ID NO: 1236284 - RNA, 14 nt, Human
auaaaggacuguaa

SEQ ID NO: 1236285 - RNA, 13 nt, Human
auaaaggauguga

SEQ ID NO: 1236286 - RNA, 15 nt, Human
auaaaggaaaagaca

SEQ ID NO: 1236287 - RNA, 16 nt, Human
auaaaggaaaagacac

SEQ ID NO: 1236288 - RNA, 18 nt, Human
auaaaggaaaagacacau

SEQ ID NO: 1236289 - RNA, 14 nt, Human
auaaaggaugugau

SEQ ID NO: 1236290 - RNA, 17 nt, Human
auaaaggaugugauugu

SEQ ID NO: 1236291 - RNA, 21 nt, Human
auaaaggaugugauuguggaa

SEQ ID NO: 1236292 - RNA, 22 nt, Human
auaaaggaugugauuguggaau

SEQ ID NO: 1236293 - RNA, 18 nt, Human
auaaagcuguguggcagu

SEQ ID NO: 1236294 - RNA, 12 nt, Human
auaaaggaaaag

SEQ ID NO: 1236295 - RNA, 15 nt, Human
auaaagcaggcagaa

SEQ ID NO: 1236296 - RNA, 16 nt, Human
auaaagcaguauuuuu

SEQ ID NO: 1236297 - RNA, 14 nt, Human
auaaagcaguauuu

SEQ ID NO: 1236298 - RNA, 12 nt, Human
auaaagcauuua

SEQ ID NO: 1236299 - RNA, 13 nt, Human
auaaagcauuuaa

SEQ ID NO: 1236300 - RNA, 14 nt, Human
auaaagcauuuaac

SEQ ID NO: 1236301 - RNA, 18 nt, Human
auaaagccucaagguuuu

SEQ ID NO: 1236302 - RNA, 21 nt, Human
auaaagccucaagguuuuagg

SEQ ID NO: 1236303 - RNA, 22 nt, Human
auaaagccucaagguuuuaggu

SEQ ID NO: 1236304 - RNA, 11 nt, Human
auaaagaaugg

SEQ ID NO: 1236305 - RNA, 12 nt, Human
auaaagacaccu

SEQ ID NO: 1236306 - RNA, 18 nt, Human
auaaagaaauagaacaag

SEQ ID NO: 1236307 - RNA, 17 nt, Human
auaaagaaauagaacaa

SEQ ID NO: 1236308 - RNA, 17 nt, Human
auauuuauuuuaauaau

SEQ ID NO: 1236309 - RNA, 14 nt, Human
auauuuauuuuaau

SEQ ID NO: 1236310 - RNA, 15 nt, Human
auauuuauuuuaaua

SEQ ID NO: 1236311 - RNA, 15 nt, Human
aucacauguggacuu

SEQ ID NO: 1236312 - RNA, 12 nt, Human
aucagcguggcc

SEQ ID NO: 1236313 - RNA, 13 nt, Human
aucagcguggccu

SEQ ID NO: 1236314 - RNA, 15 nt, Human
aucagcguggccuug

SEQ ID NO: 1236315 - RNA, 16 nt, Human
aucagcguggccuugu

SEQ ID NO: 1236316 - RNA, 21 nt, Human
aucagcguggccuuguucugu

SEQ ID NO: 1236317 - RNA, 17 nt, Human
aucagcuauuuugugaa

SEQ ID NO: 1236318 - RNA, 13 nt, Human
aucagcuccuucc

SEQ ID NO: 1236319 - RNA, 15 nt, Human
aucagcuccuuccug

SEQ ID NO: 1236320 - RNA, 16 nt, Human
aucaugugaaaucauu

SEQ ID NO: 1236321 - RNA, 19 nt, Human
aucauguuaguaauaccuc

SEQ ID NO: 1236322 - RNA, 14 nt, Human
aucauguuaguaau

SEQ ID NO: 1236323 - RNA, 22 nt, Human
aucauguuaguaauaccucuaa

SEQ ID NO: 1236324 - RNA, 21 nt, Human
aucauguuaguaauaccucua

SEQ ID NO: 1236325 - RNA, 15 nt, Human
aucaugugaaaucau

SEQ ID NO: 1236326 - RNA, 17 nt, Human
aucagcuccuuccugga

SEQ ID NO: 1236327 - RNA, 16 nt, Human
auccagaaagaaaacu

SEQ ID NO: 1236328 - RNA, 18 nt, Human
auccagaaagaaaacuug

SEQ ID NO: 1236329 - RNA, 13 nt, Human
auccccaagccug

SEQ ID NO: 1236330 - RNA, 19 nt, Human
auccaggcagauccaggac

SEQ ID NO: 1236331 - RNA, 15 nt, Human
auccaggcaccagga

SEQ ID NO: 1236332 - RNA, 16 nt, Human
auccaggcaccaggac

SEQ ID NO: 1236333 - RNA, 14 nt, Human
auccaggcagaucc

SEQ ID NO: 1236334 - RNA, 15 nt, Human
auccaggcagaucca

SEQ ID NO: 1236335 - RNA, 16 nt, Human
auccaggcagauccag

SEQ ID NO: 1236336 - RNA, 14 nt, Human
auccagcucacuca

SEQ ID NO: 1236337 - RNA, 22 nt, Human
auccaggacuauauuugggccu

SEQ ID NO: 1236338 - RNA, 23 nt, Human
auccaggacuauauuugggccug

SEQ ID NO: 1236339 - RNA, 12 nt, Human
auccaggagcuc

SEQ ID NO: 1236340 - RNA, 14 nt, Human
auccaggagcucca

SEQ ID NO: 1236341 - RNA, 15 nt, Human
auccaggagcuccag

SEQ ID NO: 1236342 - RNA, 16 nt, Human
auccaggagcuccagu

SEQ ID NO: 1236343 - RNA, 21 nt, Human
auccaggagcuccaguguccu

SEQ ID NO: 1236344 - RNA, 16 nt, Human
auccccaagccuggca

SEQ ID NO: 1236345 - RNA, 20 nt, Human
auccccaacaugcacugaug

SEQ ID NO: 1236346 - RNA, 13 nt, Human
auccccuucuccc

SEQ ID NO: 1236347 - RNA, 12 nt, Human
auccuauguuuu

SEQ ID NO: 1236348 - RNA, 20 nt, Human
auccuauguuuuuguucaaa

SEQ ID NO: 1236349 - RNA, 15 nt, Human
auccucaaagaaagu

SEQ ID NO: 1236350 - RNA, 16 nt, Human
auccucaaagaaagug

SEQ ID NO: 1236351 - RNA, 18 nt, Human
auccucaaagaaagugua

SEQ ID NO: 1236352 - RNA, 19 nt, Human
auccucaaagaaaguguau

SEQ ID NO: 1236353 - RNA, 20 nt, Human
auccucaaagaaaguguauu

SEQ ID NO: 1236354 - RNA, 21 nt, Human
auccucaaagaaaguguauug

SEQ ID NO: 1236355 - RNA, 18 nt, Human
auccucaaaugcggggug

SEQ ID NO: 1236356 - RNA, 19 nt, Human
auccuccacguucugcuca

SEQ ID NO: 1236357 - RNA, 20 nt, Human
auccucccacuucagccucc

SEQ ID NO: 1236358 - RNA, 12 nt, Human
auccucccaggc

SEQ ID NO: 1236359 - RNA, 15 nt, Human
aucggcauuuguuuc

SEQ ID NO: 1236360 - RNA, 21 nt, Human
aucgcugggaaaugagaugac

SEQ ID NO: 1236361 - RNA, 13 nt, Human
auccucccagaaa

SEQ ID NO: 1236362 - RNA, 17 nt, Human
aucgcuucauguaacua

SEQ ID NO: 1236363 - RNA, 13 nt, Human
aucggaaaaauaa

SEQ ID NO: 1236364 - RNA, 15 nt, Human
aucggaaaaauaauc

SEQ ID NO: 1236365 - RNA, 23 nt, Human
augaaguuuuuuuuauacaggau

SEQ ID NO: 1236366 - RNA, 19 nt, Human
augagcuccuuaaggcucu

SEQ ID NO: 1236367 - RNA, 13 nt, Human
augacgcaaagag

SEQ ID NO: 1236368 - RNA, 10 nt, Human
augagcuccc

SEQ ID NO: 1236369 - RNA, 20 nt, Human
augagcucccacaagccuga

SEQ ID NO: 1236370 - RNA, 22 nt, Human
augagcucccacaagccugagg

SEQ ID NO: 1236371 - RNA, 21 nt, Human
augagcucccacaagccugag

SEQ ID NO: 1236372 - RNA, 19 nt, Human
augaggacucuauucuuua

SEQ ID NO: 1236373 - RNA, 19 nt, Human
augaaguuuuuuuuauaca

SEQ ID NO: 1236374 - RNA, 14 nt, Human
augaaguuuuacau

SEQ ID NO: 1236375 - RNA, 16 nt, Human
augaaguuuuacauug

SEQ ID NO: 1236376 - RNA, 22 nt, Human
augaagcuuuuaugugaaacau

SEQ ID NO: 1236377 - RNA, 21 nt, Human
augaaggagaggcaacaucca

SEQ ID NO: 1236378 - RNA, 15 nt, Human
augaagggcccgaga

SEQ ID NO: 1236379 - RNA, 15 nt, Human
augaagguaaauaaa

SEQ ID NO: 1236380 - RNA, 17 nt, Human
augaagguaaauaaaaa

SEQ ID NO: 1236381 - RNA, 18 nt, Human
augaaggugucauacaga

SEQ ID NO: 1236382 - RNA, 16 nt, Human
augaaaaaauguauau

SEQ ID NO: 1236383 - RNA, 14 nt, Human
augaaaaagaagaa

SEQ ID NO: 1236384 - RNA, 15 nt, Human
augaaaaagaagaau

SEQ ID NO: 1236385 - RNA, 17 nt, Human
augaaaaagaagaaucu

SEQ ID NO: 1236386 - RNA, 16 nt, Human
augaaaaagaagaauc

SEQ ID NO: 1236387 - RNA, 18 nt, Human
augaaaaauugcugacug

SEQ ID NO: 1236388 - RNA, 17 nt, Human
aucuauauuuuacauaa

SEQ ID NO: 1236389 - RNA, 21 nt, Human
aucuauauuuuacauaaauuu

SEQ ID NO: 1236390 - RNA, 22 nt, Human
aucuaucuuaauacuaaggaac

SEQ ID NO: 1236391 - RNA, 16 nt, Human
aucuaugcauuuucug

SEQ ID NO: 1236392 - RNA, 18 nt, Human
aucuaugcauuuucugga

SEQ ID NO: 1236393 - RNA, 17 nt, Human
aucuauggucgggagac

SEQ ID NO: 1236394 - RNA, 14 nt, Human
aucuauguuuuacc

SEQ ID NO: 1236395 - RNA, 19 nt, Human
aucuauuccugguagaaua

SEQ ID NO: 1236396 - RNA, 20 nt, Human
aucucccugagaugggcuuc

SEQ ID NO: 1236397 - RNA, 13 nt, Human
aucucccugccuc

SEQ ID NO: 1236398 - RNA, 14 nt, Human
aucucccugccucc

SEQ ID NO: 1236399 - RNA, 19 nt, Human
aucucccugccuccugccg

SEQ ID NO: 1236400 - RNA, 16 nt, Human
aucucccugccuccug

SEQ ID NO: 1236401 - RNA, 10 nt, Human
aucucccugg

SEQ ID NO: 1236402 - RNA, 14 nt, Human
aucucccuggugcu

SEQ ID NO: 1236403 - RNA, 15 nt, Human
aucucccuggugcuu

SEQ ID NO: 1236404 - RNA, 18 nt, Human
aucuggaaccaucagaaa

SEQ ID NO: 1236405 - RNA, 11 nt, Human
aucuggaaccc

SEQ ID NO: 1236406 - RNA, 14 nt, Human
aucuggaacccaga

SEQ ID NO: 1236407 - RNA, 15 nt, Human
aucuggaacccagac

SEQ ID NO: 1236408 - RNA, 16 nt, Human
aucuggaacccagacu

SEQ ID NO: 1236409 - RNA, 17 nt, Human
aucuggaacccagacuc

SEQ ID NO: 1236410 - RNA, 18 nt, Human
aucuggaacccagacuca

SEQ ID NO: 1236411 - RNA, 21 nt, Human
aucugcuuaggaguuuaggga

SEQ ID NO: 1236412 - RNA, 15 nt, Human
aucuggacuccucug

SEQ ID NO: 1236413 - RNA, 16 nt, Human
aucuggacuccucugu

SEQ ID NO: 1236414 - RNA, 17 nt, Human
aucuggacuccucuguc

SEQ ID NO: 1236415 - RNA, 18 nt, Human
aucuggacuccucugucc

SEQ ID NO: 1236416 - RNA, 19 nt, Human
aucuggacuccucugucca

SEQ ID NO: 1236417 - RNA, 22 nt, Human
aucuggacuccucuguccaggc

SEQ ID NO: 1236418 - RNA, 14 nt, Human
aucuggccuggcca

SEQ ID NO: 1236419 - RNA, 14 nt, Human
aucucggcucacug

SEQ ID NO: 1236420 - RNA, 15 nt, Human
aucucggcucacugc

SEQ ID NO: 1236421 - RNA, 16 nt, Human
aucucggcucacugca

SEQ ID NO: 1236422 - RNA, 18 nt, Human
aucucccuggugcuuaug

SEQ ID NO: 1236423 - RNA, 21 nt, Human
aucucccuggugcuuaugcuc

SEQ ID NO: 1236424 - RNA, 23 nt, Human
aucucccuggugcuuaugcucuu

SEQ ID NO: 1236425 - RNA, 21 nt, Human
aucucccuuuuccaugacugu

SEQ ID NO: 1236426 - RNA, 17 nt, Human
aucucugcuuuggaaau

SEQ ID NO: 1236427 - RNA, 22 nt, Human
aucucugggcuggaugagcucc

SEQ ID NO: 1236428 - RNA, 23 nt, Human
aucucugggcuggaugagcuccc

SEQ ID NO: 1236429 - RNA, 18 nt, Human
aucucuguaaagcuaaaa

SEQ ID NO: 1236430 - RNA, 21 nt, Human
aucucugggggcugaggagca

SEQ ID NO: 1236431 - RNA, 13 nt, Human
aucucuguaaagc

SEQ ID NO: 1236432 - RNA, 17 nt, Human
aucucuguaaagcuaaa

SEQ ID NO: 1236433 - RNA, 13 nt, Human
aucucugugccuu

SEQ ID NO: 1236434 - RNA, 14 nt, Human
aucucugugccuuc

SEQ ID NO: 1236435 - RNA, 15 nt, Human
aucucugugccuucg

SEQ ID NO: 1236436 - RNA, 18 nt, Human
aucucugugccuucgucu

SEQ ID NO: 1236437 - RNA, 15 nt, Human
aucucugugugcaca

SEQ ID NO: 1236438 - RNA, 17 nt, Human
aucucugugugcacaaa

SEQ ID NO: 1236439 - RNA, 19 nt, Human
aucucugugugcacaaaua

SEQ ID NO: 1236440 - RNA, 18 nt, Human
aucuugaauaauguaaga

SEQ ID NO: 1236441 - RNA, 16 nt, Human
aucuugaauuguaacu

SEQ ID NO: 1236442 - RNA, 16 nt, Human
aucuucugccuucuca

SEQ ID NO: 1236443 - RNA, 18 nt, Human
aucuucugccuucucaug

SEQ ID NO: 1236444 - RNA, 17 nt, Human
aucuucuuaugcaauuu

SEQ ID NO: 1236445 - RNA, 20 nt, Human
aucuucuuaugcaauuuccu

SEQ ID NO: 1236446 - RNA, 14 nt, Human
aucuucuucaccau

SEQ ID NO: 1236447 - RNA, 21 nt, Human
aucuggccuggccagugcccu

SEQ ID NO: 1236448 - RNA, 16 nt, Human
aucuggccuggccagu

SEQ ID NO: 1236449 - RNA, 19 nt, Human
aucuggccuggccagugcc

SEQ ID NO: 1236450 - RNA, 22 nt, Human
aucuggcugcaguuuugcuauc

SEQ ID NO: 1236451 - RNA, 21 nt, Human
aucuggcugcaguuuugcuau

SEQ ID NO: 1236452 - RNA, 12 nt, Human
aucuggcuucug

SEQ ID NO: 1236453 - RNA, 22 nt, Human
aucuggcuucuggccaggaagc

SEQ ID NO: 1236454 - RNA, 20 nt, Human
aucuggcuucuggccaggaa

SEQ ID NO: 1236455 - RNA, 15 nt, Human
aucugggaagcuauu

SEQ ID NO: 1236456 - RNA, 21 nt, Human
aucuucugccuuagucucagu

SEQ ID NO: 1236457 - RNA, 14 nt, Human
aucuucugccuucu

SEQ ID NO: 1236458 - RNA, 11 nt, Human
augugaacagu

SEQ ID NO: 1236459 - RNA, 21 nt, Human
augugaacaguuguguuugaa

SEQ ID NO: 1236460 - RNA, 23 nt, Human
augugaacaguuguguuugaagc

SEQ ID NO: 1236461 - RNA, 22 nt, Human
augugaaccauuaaccagaucu

SEQ ID NO: 1236462 - RNA, 12 nt, Human
augugaaccauu

SEQ ID NO: 1236463 - RNA, 12 nt, Human
augugaagccaa

SEQ ID NO: 1236464 - RNA, 21 nt, Human
augugaagccaauucagacag

SEQ ID NO: 1236465 - RNA, 22 nt, Human
augugaagccaauucagacagg

SEQ ID NO: 1236466 - RNA, 12 nt, Human
augugaagccuu

SEQ ID NO: 1236467 - RNA, 14 nt, Human
augugaaaucauuc

SEQ ID NO: 1236468 - RNA, 16 nt, Human
augucuuuucccauuu

SEQ ID NO: 1236469 - RNA, 17 nt, Human
augucuuuucccauuua

SEQ ID NO: 1236470 - RNA, 21 nt, Human
augucuuuucccauuuaucua

SEQ ID NO: 1236471 - RNA, 14 nt, Human
augucuucucccug

SEQ ID NO: 1236472 - RNA, 10 nt, Human
augucuugug

SEQ ID NO: 1236473 - RNA, 11 nt, Human
augucuugugu

SEQ ID NO: 1236474 - RNA, 16 nt, Human
augucuuuaaugcaau

SEQ ID NO: 1236475 - RNA, 13 nt, Human
augucuuccugga

SEQ ID NO: 1236476 - RNA, 13 nt, Human
augucaaacaaau

SEQ ID NO: 1236477 - RNA, 14 nt, Human
augucaaacaaaua

SEQ ID NO: 1236478 - RNA, 23 nt, Human
augugaauuguuaguuucugagu

SEQ ID NO: 1236479 - RNA, 11 nt, Human
augugaauugu

SEQ ID NO: 1236480 - RNA, 13 nt, Human
augugaagccuuc

SEQ ID NO: 1236481 - RNA, 14 nt, Human
augugaagccuucc

SEQ ID NO: 1236482 - RNA, 17 nt, Human
augugaagccuuccccu

SEQ ID NO: 1236483 - RNA, 15 nt, Human
augugaagccuuccc

SEQ ID NO: 1236484 - RNA, 19 nt, Human
augguccaauuaguuuccu

SEQ ID NO: 1236485 - RNA, 24 nt, Human
auggucacguuuggugcuucucag

SEQ ID NO: 1236486 - RNA, 18 nt, Human
auggucagcccuagggug

SEQ ID NO: 1236487 - RNA, 21 nt, Human
auggucacguuuggugcuucu

SEQ ID NO: 1236488 - RNA, 20 nt, Human
auggucacguuuggugcuuc

SEQ ID NO: 1236489 - RNA, 20 nt, Human
auggucacacacugaugcuu

SEQ ID NO: 1236490 - RNA, 15 nt, Human
auggucacacacuga

SEQ ID NO: 1236491 - RNA, 16 nt, Human
auggucacacacugau

SEQ ID NO: 1236492 - RNA, 18 nt, Human
auggucacacacugaugc

SEQ ID NO: 1236493 - RNA, 19 nt, Human
auggucacacacugaugcu

SEQ ID NO: 1236494 - RNA, 14 nt, Human
augguaguuuuuuc

SEQ ID NO: 1236495 - RNA, 17 nt, Human
augguaguuuuuucauc

SEQ ID NO: 1236496 - RNA, 18 nt, Human
augguaguuuuuucaucu

SEQ ID NO: 1236497 - RNA, 23 nt, Human
augguaucaauaaauagaccauu

SEQ ID NO: 1236498 - RNA, 19 nt, Human
augguaguuuuuucaucuu

SEQ ID NO: 1236499 - RNA, 14 nt, Human
auggucacacacug

SEQ ID NO: 1236500 - RNA, 23 nt, Human
auggucgagaaagaggcaccagg

SEQ ID NO: 1236501 - RNA, 17 nt, Human
auguaagcugaaaauau

SEQ ID NO: 1236502 - RNA, 23 nt, Human
auguaaggcuguguaagauuugu

SEQ ID NO: 1236503 - RNA, 18 nt, Human
auguaauggcaguuauau

SEQ ID NO: 1236504 - RNA, 16 nt, Human
auguaauggcaguuau

SEQ ID NO: 1236505 - RNA, 17 nt, Human
auguaauggcaguuaua

SEQ ID NO: 1236506 - RNA, 24 nt, Human
auguauucagcuuuaguagauauu

SEQ ID NO: 1236507 - RNA, 16 nt, Human
auguauugcacauugu

SEQ ID NO: 1236508 - RNA, 17 nt, Human
auguauugcacauugua

SEQ ID NO: 1236509 - RNA, 22 nt, Human
auguauugcacauuguaaaaag

SEQ ID NO: 1236510 - RNA, 13 nt, Human
auguauuuuaugu

SEQ ID NO: 1236511 - RNA, 14 nt, Human
auguauuuuauguu

SEQ ID NO: 1236512 - RNA, 16 nt, Human
auguauuuuauguuau

SEQ ID NO: 1236513 - RNA, 18 nt, Human
auguauuuuauguuauau

SEQ ID NO: 1236514 - RNA, 15 nt, Human
auguuuucaggcuag

SEQ ID NO: 1236515 - RNA, 22 nt, Human
auguuugcucagcuucuccaac

SEQ ID NO: 1236516 - RNA, 17 nt, Human
auguuucacaaggucuu

SEQ ID NO: 1236517 - RNA, 15 nt, Human
auguuucaagaggag

SEQ ID NO: 1236518 - RNA, 21 nt, Human
auguuucaagaggagccccca

SEQ ID NO: 1236519 - RNA, 12 nt, Human
auguuuccagca

SEQ ID NO: 1236520 - RNA, 18 nt, Human
augugggauuauggguca

SEQ ID NO: 1236521 - RNA, 20 nt, Human
augugggauuaugggucaca

SEQ ID NO: 1236522 - RNA, 22 nt, Human
augugggauuaugggucacagg

SEQ ID NO: 1236523 - RNA, 22 nt, Human
augugugcaacaggguauggac

SEQ ID NO: 1236524 - RNA, 17 nt, Human
auguucuaagaagugaa

SEQ ID NO: 1236525 - RNA, 12 nt, Human
auguuccuucca

SEQ ID NO: 1236526 - RNA, 11 nt, Human
auguuccuucc

SEQ ID NO: 1236527 - RNA, 17 nt, Human
auguucuaaccuuuaca

SEQ ID NO: 1236528 - RNA, 12 nt, Human
auguucuaaggc

SEQ ID NO: 1236529 - RNA, 20 nt, Human
auguucuauuuuuuguuuug

SEQ ID NO: 1236530 - RNA, 13 nt, Human
auguucuaaggcu

SEQ ID NO: 1236531 - RNA, 14 nt, Human
auguucuaaggcuc

SEQ ID NO: 1236532 - RNA, 15 nt, Human
auguucuaaggcucu

SEQ ID NO: 1236533 - RNA, 16 nt, Human
auguucuaaggcucug

SEQ ID NO: 1236534 - RNA, 17 nt, Human
auguucuaaggcucuga

SEQ ID NO: 1236535 - RNA, 18 nt, Human
auguucuaaggcucugag

SEQ ID NO: 1236536 - RNA, 19 nt, Human
auguucuaaggcucugaga

SEQ ID NO: 1236537 - RNA, 20 nt, Human
auguucuaaggcucugagag

SEQ ID NO: 1236538 - RNA, 18 nt, Human
auguucuaagucuuucca

SEQ ID NO: 1236539 - RNA, 19 nt, Human
auguucuaagucuuuccau

SEQ ID NO: 1236540 - RNA, 22 nt, Human
auguucuaaggcucugagaguc

SEQ ID NO: 1236541 - RNA, 12 nt, Human
auguucuaaguu

SEQ ID NO: 1236542 - RNA, 13 nt, Human
auguucuaaguuu

SEQ ID NO: 1236543 - RNA, 15 nt, Human
auguucuaaguuucu

SEQ ID NO: 1236544 - RNA, 16 nt, Human
auguucuaaguuucua

SEQ ID NO: 1236545 - RNA, 19 nt, Human
auguucuaaguuucuaaga

SEQ ID NO: 1236546 - RNA, 20 nt, Human
auguucuaaguuucuaagau

SEQ ID NO: 1236547 - RNA, 21 nt, Human
auguucuaaguuucuaagauu

SEQ ID NO: 1236548 - RNA, 23 nt, Human
auguucuaaguuucuaagauucu

SEQ ID NO: 1236549 - RNA, 13 nt, Human
augugggauuaug

SEQ ID NO: 1236550 - RNA, 14 nt, Human
augugggauuaugg

SEQ ID NO: 1236551 - RNA, 16 nt, Human
auguggcuugagaaau

SEQ ID NO: 1236552 - RNA, 21 nt, Human
auguggcuugagaaauaugga

SEQ ID NO: 1236553 - RNA, 20 nt, Human
augcauauuauuuuauguug

SEQ ID NO: 1236554 - RNA, 16 nt, Human
augcauauuauuuuau

SEQ ID NO: 1236555 - RNA, 12 nt, Human
augcaucuguuu

SEQ ID NO: 1236556 - RNA, 20 nt, Human
augcaucuguuuauucuaua

SEQ ID NO: 1236557 - RNA, 12 nt, Human
augccucugagg

SEQ ID NO: 1236558 - RNA, 13 nt, Human
augccucugaggc

SEQ ID NO: 1236559 - RNA, 14 nt, Human
augccucugaggcc

SEQ ID NO: 1236560 - RNA, 11 nt, Human
augcauauacu

SEQ ID NO: 1236561 - RNA, 14 nt, Human
augauguuaaaaaa

SEQ ID NO: 1236562 - RNA, 22 nt, Human
augauguuaaaaaaauaagaag

SEQ ID NO: 1236563 - RNA, 21 nt, Human
augauguuaaaaaaauaagaa

SEQ ID NO: 1236564 - RNA, 22 nt, Human
augaugccucugucuucuggac

SEQ ID NO: 1236565 - RNA, 13 nt, Human
augcaauuuuuau

SEQ ID NO: 1236566 - RNA, 18 nt, Human
augauuaaauaagauucu

SEQ ID NO: 1236567 - RNA, 17 nt, Human
augauuaaauaagauuc

SEQ ID NO: 1236568 - RNA, 17 nt, Human
augccucugaggccagc

SEQ ID NO: 1236569 - RNA, 18 nt, Human
augccucugaggccagcc

SEQ ID NO: 1236570 - RNA, 19 nt, Human
augccucugaggccagccu

SEQ ID NO: 1236571 - RNA, 20 nt, Human
augccucugaggccagccug

SEQ ID NO: 1236572 - RNA, 21 nt, Human
augccucugaggccagccugg

SEQ ID NO: 1236573 - RNA, 22 nt, Human
augccucugaggccagccuggc

SEQ ID NO: 1236574 - RNA, 23 nt, Human
augccucugaggccagccuggcc

SEQ ID NO: 1236575 - RNA, 22 nt, Human
augccucugccaaaggauguga

SEQ ID NO: 1236576 - RNA, 18 nt, Human
augccucugccaaaggau

SEQ ID NO: 1236577 - RNA, 19 nt, Human
augccucugucuucuggac

SEQ ID NO: 1236578 - RNA, 13 nt, Human
auggauucuaaaa

SEQ ID NO: 1236579 - RNA, 14 nt, Human
auggauucuaaaau

SEQ ID NO: 1236580 - RNA, 15 nt, Human
auggauucuaaaaug

SEQ ID NO: 1236581 - RNA, 18 nt, Human
auggauucuaaaaugccu

SEQ ID NO: 1236582 - RNA, 22 nt, Human
auggaggaaaaccaagccgugg

SEQ ID NO: 1236583 - RNA, 13 nt, Human
auggaaaggaugg

SEQ ID NO: 1236584 - RNA, 15 nt, Human
auggaaauauauauu

SEQ ID NO: 1236585 - RNA, 16 nt, Human
auggaaauauauauua

SEQ ID NO: 1236586 - RNA, 23 nt, Human
augcuugggaagacuccuagcug

SEQ ID NO: 1236587 - RNA, 18 nt, Human
augcuugggaagacuccu

SEQ ID NO: 1236588 - RNA, 22 nt, Human
auggaaacaagaugaaauucca

SEQ ID NO: 1236589 - RNA, 19 nt, Human
auggaaagcuucagugcug

SEQ ID NO: 1236590 - RNA, 12 nt, Human
augcuugggaag

SEQ ID NO: 1236591 - RNA, 12 nt, Human
augcugaaaaug

SEQ ID NO: 1236592 - RNA, 23 nt, Human
augcugaaaauguccuugugaug

SEQ ID NO: 1236593 - RNA, 12 nt, Human
augcugccccuc

SEQ ID NO: 1236594 - RNA, 23 nt, Human
augcugcaaguuaugaaauauuu

SEQ ID NO: 1236595 - RNA, 19 nt, Human
augcugcacagauggauuu

SEQ ID NO: 1236596 - RNA, 19 nt, Human
auggcugugccucugccug

SEQ ID NO: 1236597 - RNA, 20 nt, Human
auggcugugccucugccugu

SEQ ID NO: 1236598 - RNA, 21 nt, Human
agagugugaccaaaaguuaca

SEQ ID NO: 1236599 - RNA, 14 nt, Human
agagugucuuucca

SEQ ID NO: 1236600 - RNA, 15 nt, Human
agagugucuuuccac

SEQ ID NO: 1236601 - RNA, 11 nt, Human
agagugugacc

SEQ ID NO: 1236602 - RNA, 14 nt, Human
agagugugaccaaa

SEQ ID NO: 1236603 - RNA, 19 nt, Human
agaguggcuccucccggug

SEQ ID NO: 1236604 - RNA, 23 nt, Human
agaguggcuccucccggugccca

SEQ ID NO: 1236605 - RNA, 13 nt, Human
agaguggcugggg

SEQ ID NO: 1236606 - RNA, 14 nt, Human
agaguggcuggggc

SEQ ID NO: 1236607 - RNA, 16 nt, Human
agagggcacucugcuu

SEQ ID NO: 1236608 - RNA, 22 nt, Human
agaggacuguagggagggcggc

SEQ ID NO: 1236609 - RNA, 15 nt, Human
agaggaaggggccag

SEQ ID NO: 1236610 - RNA, 16 nt, Human
agaggaaggggccaga

SEQ ID NO: 1236611 - RNA, 15 nt, Human
agaggaccggcggcu

SEQ ID NO: 1236612 - RNA, 14 nt, Human
agaggacgggaggc

SEQ ID NO: 1236613 - RNA, 13 nt, Human
agagcccaggcuc

SEQ ID NO: 1236614 - RNA, 20 nt, Human
agagcccaggcucggccugc

SEQ ID NO: 1236615 - RNA, 15 nt, Human
agagcccaggagcuc

SEQ ID NO: 1236616 - RNA, 16 nt, Human
agagcccaggagcucc

SEQ ID NO: 1236617 - RNA, 17 nt, Human
agagcccaggagcuccc

SEQ ID NO: 1236618 - RNA, 19 nt, Human
agagcccaggagcuccccu

SEQ ID NO: 1236619 - RNA, 17 nt, Human
agauauauuuucuuucu

SEQ ID NO: 1236620 - RNA, 23 nt, Human
agauaucaucuaccuagauuuaa

SEQ ID NO: 1236621 - RNA, 14 nt, Human
agaguucaagaaau

SEQ ID NO: 1236622 - RNA, 15 nt, Human
agaguucaagaaaua

SEQ ID NO: 1236623 - RNA, 18 nt, Human
agaguucaagaaauaagu

SEQ ID NO: 1236624 - RNA, 21 nt, Human
agaguucaagaaauaaguuuu

SEQ ID NO: 1236625 - RNA, 16 nt, Human
agauaucgacuuguuu

SEQ ID NO: 1236626 - RNA, 14 nt, Human
agauggcugugccu

SEQ ID NO: 1236627 - RNA, 17 nt, Human
agauggcugugccucug

SEQ ID NO: 1236628 - RNA, 13 nt, Human
agauggcucccag

SEQ ID NO: 1236629 - RNA, 14 nt, Human
agauggcucccagg

SEQ ID NO: 1236630 - RNA, 23 nt, Human
agauggcucccaggggcucccuc

SEQ ID NO: 1236631 - RNA, 17 nt, Human
agauggcucccaggggc

SEQ ID NO: 1236632 - RNA, 16 nt, Human
agaugggcaucuuuug

SEQ ID NO: 1236633 - RNA, 18 nt, Human
agaugggcaucuuuugua

SEQ ID NO: 1236634 - RNA, 20 nt, Human
agaugggcaucuuuuguauu

SEQ ID NO: 1236635 - RNA, 21 nt, Human
agaugggcaucuuuuguauua

SEQ ID NO: 1236636 - RNA, 22 nt, Human
agaugggcaucuuuuguauuaa

SEQ ID NO: 1236637 - RNA, 22 nt, Human
agaugggcuucccaagggcugc

SEQ ID NO: 1236638 - RNA, 17 nt, Human
agaugggcuucccaagg

SEQ ID NO: 1236639 - RNA, 15 nt, Human
agaugaaauuccauu

SEQ ID NO: 1236640 - RNA, 12 nt, Human
agauggcagcuu

SEQ ID NO: 1236641 - RNA, 13 nt, Human
agauggcagcuuu

SEQ ID NO: 1236642 - RNA, 14 nt, Human
agauggcagcuuuu

SEQ ID NO: 1236643 - RNA, 21 nt, Human
agauggcagcuuuuaaaagau

SEQ ID NO: 1236644 - RNA, 21 nt, Human
agauggcauaaccugucucac

SEQ ID NO: 1236645 - RNA, 20 nt, Human
agauggcaucaaaaaagaua

SEQ ID NO: 1236646 - RNA, 20 nt, Human
agauggccagccccuuagac

SEQ ID NO: 1236647 - RNA, 15 nt, Human
agauggcccauccug

SEQ ID NO: 1236648 - RNA, 14 nt, Human
agaugaaagagcag

SEQ ID NO: 1236649 - RNA, 15 nt, Human
agaugaaagagcagu

SEQ ID NO: 1236650 - RNA, 18 nt, Human
agaucuuuuauuuugcca

SEQ ID NO: 1236651 - RNA, 16 nt, Human
agaucuuuuauuuugc

SEQ ID NO: 1236652 - RNA, 23 nt, Human
agacagagucuuccucugucucc

SEQ ID NO: 1236653 - RNA, 20 nt, Human
agacagagucuuacucuguu

SEQ ID NO: 1236654 - RNA, 19 nt, Human
agacagagucuuacucugu

SEQ ID NO: 1236655 - RNA, 20 nt, Human
agacagagucuuccucuguc

SEQ ID NO: 1236656 - RNA, 17 nt, Human
agacagcccaggauacu

SEQ ID NO: 1236657 - RNA, 22 nt, Human
agacagcccaggauacuggcac

SEQ ID NO: 1236658 - RNA, 23 nt, Human
agacagcccaggauacuggcaca

SEQ ID NO: 1236659 - RNA, 21 nt, Human
agacagcuccacccuggccga

SEQ ID NO: 1236660 - RNA, 19 nt, Human
agacaacagguaaaacagg

SEQ ID NO: 1236661 - RNA, 23 nt, Human
agacaacagguaaaacagggcca

SEQ ID NO: 1236662 - RNA, 16 nt, Human
agacaacgugcucuuu

SEQ ID NO: 1236663 - RNA, 19 nt, Human
agacaacgugcucuuuguu

SEQ ID NO: 1236664 - RNA, 20 nt, Human
agacaacgugcucuuuguuu

SEQ ID NO: 1236665 - RNA, 23 nt, Human
agacaacgugcucuuuguuuugu

SEQ ID NO: 1236666 - RNA, 21 nt, Human
agacaacgugcucuuuguuuu

SEQ ID NO: 1236667 - RNA, 18 nt, Human
agacggaaggguaaacaa

SEQ ID NO: 1236668 - RNA, 22 nt, Human
agacggagcccuggcaugucaa

SEQ ID NO: 1236669 - RNA, 20 nt, Human
agacggaaggguaaacaaua

SEQ ID NO: 1236670 - RNA, 19 nt, Human
agacgugaugccaggacca

SEQ ID NO: 1236671 - RNA, 15 nt, Human
agacccauuccuucc

SEQ ID NO: 1236672 - RNA, 22 nt, Human
agacccauuccuucccagaggg

SEQ ID NO: 1236673 - RNA, 17 nt, Human
agacccauuccuuccca

SEQ ID NO: 1236674 - RNA, 17 nt, Human
agagaagaaagaacgga

SEQ ID NO: 1236675 - RNA, 13 nt, Human
agagaagaaagaa

SEQ ID NO: 1236676 - RNA, 17 nt, Human
agagaacuuccagaucc

SEQ ID NO: 1236677 - RNA, 14 nt, Human
agagaagacaggcu

SEQ ID NO: 1236678 - RNA, 15 nt, Human
agagaagacaggcug

SEQ ID NO: 1236679 - RNA, 16 nt, Human
agagaagacaggcugg

SEQ ID NO: 1236680 - RNA, 15 nt, Human
agagagcagugcuuu

SEQ ID NO: 1236681 - RNA, 16 nt, Human
agagagcagugcuuuu

SEQ ID NO: 1236682 - RNA, 17 nt, Human
agagagcagugcuuuug

SEQ ID NO: 1236683 - RNA, 13 nt, Human
agagagcccgagg

SEQ ID NO: 1236684 - RNA, 18 nt, Human
agagagcccgaggaggug

SEQ ID NO: 1236685 - RNA, 18 nt, Human
agagagccugcaggaucu

SEQ ID NO: 1236686 - RNA, 14 nt, Human
agagagccugcagg

SEQ ID NO: 1236687 - RNA, 15 nt, Human
agagagccugcagga

SEQ ID NO: 1236688 - RNA, 13 nt, Human
agagcccaggagc

SEQ ID NO: 1236689 - RNA, 14 nt, Human
agacuggaagcuaa

SEQ ID NO: 1236690 - RNA, 19 nt, Human
agacuggaagcuaauuugc

SEQ ID NO: 1236691 - RNA, 23 nt, Human
agagaaaacaugcagaacaaaug

SEQ ID NO: 1236692 - RNA, 16 nt, Human
agagaaaacuaaagaa

SEQ ID NO: 1236693 - RNA, 17 nt, Human
agagaaaacaugcagaa

SEQ ID NO: 1236694 - RNA, 16 nt, Human
agagaaaacaugcaga

SEQ ID NO: 1236695 - RNA, 20 nt, Human
agagaaaaagcagaggccaa

SEQ ID NO: 1236696 - RNA, 20 nt, Human
agacuggaagcuaauuugca

SEQ ID NO: 1236697 - RNA, 20 nt, Human
agacugccauauuaaauuuu

SEQ ID NO: 1236698 - RNA, 21 nt, Human
agacugccauauuaaauuuuu

SEQ ID NO: 1236699 - RNA, 23 nt, Human
agacugcgauuugucccaggucc

SEQ ID NO: 1236700 - RNA, 13 nt, Human
agccaagugcagg

SEQ ID NO: 1236701 - RNA, 14 nt, Human
agccaauauuuuuc

SEQ ID NO: 1236702 - RNA, 12 nt, Human
agccaauauaac

SEQ ID NO: 1236703 - RNA, 17 nt, Human
agccagcacacagggca

SEQ ID NO: 1236704 - RNA, 18 nt, Human
agccagcacacagggcag

SEQ ID NO: 1236705 - RNA, 19 nt, Human
agccagcacacagggcagu

SEQ ID NO: 1236706 - RNA, 16 nt, Human
agccagcaccggacca

SEQ ID NO: 1236707 - RNA, 20 nt, Human
agccagcaccggaccagccu

SEQ ID NO: 1236708 - RNA, 21 nt, Human
agccagcaccggaccagccug

SEQ ID NO: 1236709 - RNA, 22 nt, Human
agccagcaccggaccagccugg

SEQ ID NO: 1236710 - RNA, 23 nt, Human
agccagcaccggaccagccuggc

SEQ ID NO: 1236711 - RNA, 13 nt, Human
agccagcaccugg

SEQ ID NO: 1236712 - RNA, 14 nt, Human
agccagcaccuggc

SEQ ID NO: 1236713 - RNA, 15 nt, Human
agccagcaccuggca

SEQ ID NO: 1236714 - RNA, 23 nt, Human
agccagcaccuggcaucgcacca

SEQ ID NO: 1236715 - RNA, 24 nt, Human
agccagcaccggaccagccuggcc

SEQ ID NO: 1236716 - RNA, 20 nt, Human
agccagcacuuguccagcug

SEQ ID NO: 1236717 - RNA, 21 nt, Human
agccagcacuuguccagcuga

SEQ ID NO: 1236718 - RNA, 22 nt, Human
agccagcacuuguccagcugag

SEQ ID NO: 1236719 - RNA, 15 nt, Human
agcaugccuucaaau

SEQ ID NO: 1236720 - RNA, 19 nt, Human
agcauggaacacuucgagu

SEQ ID NO: 1236721 - RNA, 17 nt, Human
agcauggaacacuucga

SEQ ID NO: 1236722 - RNA, 20 nt, Human
agcaugagagggaugaggca

SEQ ID NO: 1236723 - RNA, 12 nt, Human
agccaaauuuaa

SEQ ID NO: 1236724 - RNA, 19 nt, Human
agccaaauuuaaaacuguu

SEQ ID NO: 1236725 - RNA, 13 nt, Human
agccaaauuuaaa

SEQ ID NO: 1236726 - RNA, 18 nt, Human
agccaacacgcaccugcc

SEQ ID NO: 1236727 - RNA, 19 nt, Human
agccaacacgcaccugccu

SEQ ID NO: 1236728 - RNA, 22 nt, Human
agccaacacgcaccugccucag

SEQ ID NO: 1236729 - RNA, 16 nt, Human
agcaugaauuuguaau

SEQ ID NO: 1236730 - RNA, 17 nt, Human
agcaguguuagcuuagu

SEQ ID NO: 1236731 - RNA, 22 nt, Human
agcaguucaauaauccaugaaa

SEQ ID NO: 1236732 - RNA, 13 nt, Human
agcaguguuagcu

SEQ ID NO: 1236733 - RNA, 15 nt, Human
agcagugugaggcca

SEQ ID NO: 1236734 - RNA, 21 nt, Human
agcagugugaggccagggcag

SEQ ID NO: 1236735 - RNA, 16 nt, Human
agcaguucugcagagg

SEQ ID NO: 1236736 - RNA, 17 nt, Human
agcaguucugcagagga

SEQ ID NO: 1236737 - RNA, 18 nt, Human
agcagcgaccgcccccuc

SEQ ID NO: 1236738 - RNA, 23 nt, Human
agcagcgaccgcccccuccucua

SEQ ID NO: 1236739 - RNA, 13 nt, Human
agcagcgagccug

SEQ ID NO: 1236740 - RNA, 15 nt, Human
agcagcgagccugcu

SEQ ID NO: 1236741 - RNA, 14 nt, Human
agcagcgagccugc

SEQ ID NO: 1236742 - RNA, 18 nt, Human
agcacuguuuucuagugu

SEQ ID NO: 1236743 - RNA, 15 nt, Human
agcacuguuuucuag

SEQ ID NO: 1236744 - RNA, 22 nt, Human
agcagccuuucucucuuuauac

SEQ ID NO: 1236745 - RNA, 12 nt, Human
agcacugucccu

SEQ ID NO: 1236746 - RNA, 13 nt, Human
agcacugucccuu

SEQ ID NO: 1236747 - RNA, 15 nt, Human
agcacugucccuugc

SEQ ID NO: 1236748 - RNA, 16 nt, Human
agcacugucccuugcc

SEQ ID NO: 1236749 - RNA, 19 nt, Human
agcacugucccuugccuca

SEQ ID NO: 1236750 - RNA, 22 nt, Human
agcacugucccuugccucaaug

SEQ ID NO: 1236751 - RNA, 11 nt, Human
agcagcugagc

SEQ ID NO: 1236752 - RNA, 12 nt, Human
agcagcugagca

SEQ ID NO: 1236753 - RNA, 13 nt, Human
agcagcugagcag

SEQ ID NO: 1236754 - RNA, 14 nt, Human
agcagcugagcagg

SEQ ID NO: 1236755 - RNA, 16 nt, Human
agcagcugagcagggc

SEQ ID NO: 1236756 - RNA, 17 nt, Human
agcagcugagcagggcc

SEQ ID NO: 1236757 - RNA, 18 nt, Human
agcagcugagcagggccg

SEQ ID NO: 1236758 - RNA, 19 nt, Human
agcagcugagcagggccgg

SEQ ID NO: 1236759 - RNA, 18 nt, Human
agcagcugccaggagcac

SEQ ID NO: 1236760 - RNA, 21 nt, Human
agcagcugccaggagcacggc

SEQ ID NO: 1236761 - RNA, 18 nt, Human
agcagcuuagacuaaggc

SEQ ID NO: 1236762 - RNA, 20 nt, Human
agcacucgcuagcaguggca

SEQ ID NO: 1236763 - RNA, 23 nt, Human
agcacucgcuagcaguggcaggc

SEQ ID NO: 1236764 - RNA, 24 nt, Human
agcacucgcuagcaguggcaggca

SEQ ID NO: 1236765 - RNA, 19 nt, Human
agauggggaccagcagccc

SEQ ID NO: 1236766 - RNA, 16 nt, Human
agaugggggaaagcaa

SEQ ID NO: 1236767 - RNA, 21 nt, Human
agaugggggaaagcaaagcac

SEQ ID NO: 1236768 - RNA, 23 nt, Human
agaugggggaaagcaaagcacag

SEQ ID NO: 1236769 - RNA, 24 nt, Human
agaugggggaaagcaaagcacaga

SEQ ID NO: 1236770 - RNA, 16 nt, Human
agccccauuccuggga

SEQ ID NO: 1236771 - RNA, 15 nt, Human
agcccgguaagagca

SEQ ID NO: 1236772 - RNA, 16 nt, Human
agcccgguaagagcaa

SEQ ID NO: 1236773 - RNA, 17 nt, Human
agcccucacccuggggc

SEQ ID NO: 1236774 - RNA, 16 nt, Human
agcccucacacacccu

SEQ ID NO: 1236775 - RNA, 23 nt, Human
agcccucacacacccugucugcc

SEQ ID NO: 1236776 - RNA, 21 nt, Human
agcccuaaacaucauucuuga

SEQ ID NO: 1236777 - RNA, 21 nt, Human
agcccgguaagagcaaaagaa

SEQ ID NO: 1236778 - RNA, 22 nt, Human
agcccgguaagagcaaaagaau

SEQ ID NO: 1236779 - RNA, 14 nt, Human
agcccgucucagug

SEQ ID NO: 1236780 - RNA, 15 nt, Human
agcccgucucagugu

SEQ ID NO: 1236781 - RNA, 13 nt, Human
agcccuaaacauc

SEQ ID NO: 1236782 - RNA, 14 nt, Human
agcccuaaacauca

SEQ ID NO: 1236783 - RNA, 15 nt, Human
agcccuaaacaucau

SEQ ID NO: 1236784 - RNA, 13 nt, Human
agccccauuccug

SEQ ID NO: 1236785 - RNA, 17 nt, Human
agccgugccuucagcuc

SEQ ID NO: 1236786 - RNA, 13 nt, Human
agccguggcuucc

SEQ ID NO: 1236787 - RNA, 18 nt, Human
agccgugcucgccccagc

SEQ ID NO: 1236788 - RNA, 21 nt, Human
agccgggcgugguggugagug

SEQ ID NO: 1236789 - RNA, 12 nt, Human
agccguccuggc

SEQ ID NO: 1236790 - RNA, 15 nt, Human
agccgugccuucagc

SEQ ID NO: 1236791 - RNA, 16 nt, Human
agccgugccuucagcu

SEQ ID NO: 1236792 - RNA, 23 nt, Human
agccguccuggcgccuggcaguc

SEQ ID NO: 1236793 - RNA, 13 nt, Human
agccgugagcaug

SEQ ID NO: 1236794 - RNA, 13 nt, Human
agccguccuggcg

SEQ ID NO: 1236795 - RNA, 17 nt, Human
agccucccauccagggc

SEQ ID NO: 1236796 - RNA, 20 nt, Human
agccuccucaucccguguuc

SEQ ID NO: 1236797 - RNA, 18 nt, Human
agccucccauccagggcc

SEQ ID NO: 1236798 - RNA, 14 nt, Human
agccuccccugcca

SEQ ID NO: 1236799 - RNA, 17 nt, Human
agcccuccucugcacuc

SEQ ID NO: 1236800 - RNA, 21 nt, Human
agcccuccaucuaaacugccc

SEQ ID NO: 1236801 - RNA, 16 nt, Human
agcccucaucccgagc

SEQ ID NO: 1236802 - RNA, 19 nt, Human
agcccucacacacccuguc

SEQ ID NO: 1236803 - RNA, 14 nt, Human
agccgggagccuga

SEQ ID NO: 1236804 - RNA, 15 nt, Human
agccgcugagcgagg

SEQ ID NO: 1236805 - RNA, 19 nt, Human
agccgcugagcgaggagau

SEQ ID NO: 1236806 - RNA, 23 nt, Human
aggaugguucccuugaugaagaa

SEQ ID NO: 1236807 - RNA, 19 nt, Human
aggauguaaagaucaauaa

SEQ ID NO: 1236808 - RNA, 14 nt, Human
aggauggaacacgg

SEQ ID NO: 1236809 - RNA, 19 nt, Human
aggauggaacacggccaca

SEQ ID NO: 1236810 - RNA, 22 nt, Human
aggauguacaaggacagccccu

SEQ ID NO: 1236811 - RNA, 14 nt, Human
aggauuaaauaaug

SEQ ID NO: 1236812 - RNA, 20 nt, Human
aggauuaaauaauguaaaua

SEQ ID NO: 1236813 - RNA, 16 nt, Human
aggaccggcggcucgg

SEQ ID NO: 1236814 - RNA, 14 nt, Human
aggaccuaaaacau

SEQ ID NO: 1236815 - RNA, 16 nt, Human
aggaccuaaaacaucu

SEQ ID NO: 1236816 - RNA, 20 nt, Human
aggagaaucacuugaaccug

SEQ ID NO: 1236817 - RNA, 14 nt, Human
aggagaaugaauca

SEQ ID NO: 1236818 - RNA, 15 nt, Human
aggagaaugagccuc

SEQ ID NO: 1236819 - RNA, 18 nt, Human
aggagacacaccugaggc

SEQ ID NO: 1236820 - RNA, 15 nt, Human
aggaguagcugagcu

SEQ ID NO: 1236821 - RNA, 16 nt, Human
aggaguagcugagcuc

SEQ ID NO: 1236822 - RNA, 18 nt, Human
aggaguaugcagggagcu

SEQ ID NO: 1236823 - RNA, 14 nt, Human
aggagucacugaga

SEQ ID NO: 1236824 - RNA, 15 nt, Human
aggagucacugagac

SEQ ID NO: 1236825 - RNA, 17 nt, Human
aggagucacugagacca

SEQ ID NO: 1236826 - RNA, 20 nt, Human
aggaguccacuuuguuucgu

SEQ ID NO: 1236827 - RNA, 16 nt, Human
aggagucacugagacc

SEQ ID NO: 1236828 - RNA, 14 nt, Human
aggaguguccucuu

SEQ ID NO: 1236829 - RNA, 15 nt, Human
aggagugggugggga

SEQ ID NO: 1236830 - RNA, 13 nt, Human
aggagugugugug

SEQ ID NO: 1236831 - RNA, 22 nt, Human
aggaguuaguggauuacugcca

SEQ ID NO: 1236832 - RNA, 13 nt, Human
aggagucugaggu

SEQ ID NO: 1236833 - RNA, 15 nt, Human
aggagucugaggucc

SEQ ID NO: 1236834 - RNA, 16 nt, Human
aggagucugagguccu

SEQ ID NO: 1236835 - RNA, 17 nt, Human
aggagucugagguccug

SEQ ID NO: 1236836 - RNA, 18 nt, Human
aggagucugagguccuga

SEQ ID NO: 1236837 - RNA, 19 nt, Human
aggagucugagguccugag

SEQ ID NO: 1236838 - RNA, 20 nt, Human
aggagucugagguccugagc

SEQ ID NO: 1236839 - RNA, 21 nt, Human
aggagucugagguccugagca

SEQ ID NO: 1236840 - RNA, 22 nt, Human
aggaguggguggggaguggggg

SEQ ID NO: 1236841 - RNA, 23 nt, Human
aggacccaggacaggauccaggc

SEQ ID NO: 1236842 - RNA, 18 nt, Human
aggacccaggacaggauc

SEQ ID NO: 1236843 - RNA, 12 nt, Human
aggacccagggc

SEQ ID NO: 1236844 - RNA, 13 nt, Human
aggacccagggcu

SEQ ID NO: 1236845 - RNA, 14 nt, Human
aggacccagggcuc

SEQ ID NO: 1236846 - RNA, 15 nt, Human
aggacccagggcucu

SEQ ID NO: 1236847 - RNA, 14 nt, Human
aggacccaggacag

SEQ ID NO: 1236848 - RNA, 13 nt, Human
aggacccaggaca

SEQ ID NO: 1236849 - RNA, 12 nt, Human
aggacccaggac

SEQ ID NO: 1236850 - RNA, 14 nt, Human
aggacccaggaaag

SEQ ID NO: 1236851 - RNA, 17 nt, Human
aggacccagggcucugu

SEQ ID NO: 1236852 - RNA, 17 nt, Human
aggacccuggacccagc

SEQ ID NO: 1236853 - RNA, 13 nt, Human
aggacccagagga

SEQ ID NO: 1236854 - RNA, 15 nt, Human
aggacccagaggaag

SEQ ID NO: 1236855 - RNA, 20 nt, Human
agcuucuguugcugccucau

SEQ ID NO: 1236856 - RNA, 17 nt, Human
agcuuuucuauuuuaau

SEQ ID NO: 1236857 - RNA, 13 nt, Human
agcuuuugucuac

SEQ ID NO: 1236858 - RNA, 21 nt, Human
agcuuuugugggggacuguaa

SEQ ID NO: 1236859 - RNA, 22 nt, Human
agcuuuugugggggacuguaag

SEQ ID NO: 1236860 - RNA, 24 nt, Human
agcuuuugugggggacuguaaguu

SEQ ID NO: 1236861 - RNA, 22 nt, Human
agcuuuuuauuccuccugcuca

SEQ ID NO: 1236862 - RNA, 19 nt, Human
agcuuuuuccagaggcuau

SEQ ID NO: 1236863 - RNA, 13 nt, Human
agcuccuuccugg

SEQ ID NO: 1236864 - RNA, 15 nt, Human
agcuccuuccuggag

SEQ ID NO: 1236865 - RNA, 19 nt, Human
agcuccuuccuggagacug

SEQ ID NO: 1236866 - RNA, 14 nt, Human
agcucuuugucagg

SEQ ID NO: 1236867 - RNA, 15 nt, Human
agcucuuugucaggg

SEQ ID NO: 1236868 - RNA, 22 nt, Human
agcuccuuaaggcucuuuugua

SEQ ID NO: 1236869 - RNA, 16 nt, Human
agcugagcaaaucacc

SEQ ID NO: 1236870 - RNA, 20 nt, Human
agcugagcaaaucaccacaa

SEQ ID NO: 1236871 - RNA, 15 nt, Human
agcugagcaggccac

SEQ ID NO: 1236872 - RNA, 13 nt, Human
agcugagcagggc

SEQ ID NO: 1236873 - RNA, 23 nt, Human
agcugagauuauaggcaccuacc

SEQ ID NO: 1236874 - RNA, 16 nt, Human
agcugagagaaaauaa

SEQ ID NO: 1236875 - RNA, 16 nt, Human
agcucuuugucaggga

SEQ ID NO: 1236876 - RNA, 17 nt, Human
agcucuuugucagggag

SEQ ID NO: 1236877 - RNA, 12 nt, Human
agcugaaaauau

SEQ ID NO: 1236878 - RNA, 16 nt, Human
agcucccugugccccc

SEQ ID NO: 1236879 - RNA, 21 nt, Human
agcucccugugcccccagggu

SEQ ID NO: 1236880 - RNA, 19 nt, Human
agcucccugugcccccagg

SEQ ID NO: 1236881 - RNA, 16 nt, Human
agcucccuucuucccu

SEQ ID NO: 1236882 - RNA, 14 nt, Human
agcugagcagggcc

SEQ ID NO: 1236883 - RNA, 15 nt, Human
agcugagcagggccg

SEQ ID NO: 1236884 - RNA, 14 nt, Human
agcugcuccccacg

SEQ ID NO: 1236885 - RNA, 17 nt, Human
agcugcuccccacguca

SEQ ID NO: 1236886 - RNA, 16 nt, Human
agcugcucaacuugca

SEQ ID NO: 1236887 - RNA, 20 nt, Human
agcugcucaacuugcaaaau

SEQ ID NO: 1236888 - RNA, 19 nt, Human
agcuucuguugcugccuca

SEQ ID NO: 1236889 - RNA, 12 nt, Human
agcuuccuucag

SEQ ID NO: 1236890 - RNA, 13 nt, Human
agcuuccuucaga

SEQ ID NO: 1236891 - RNA, 15 nt, Human
agcuuccuucagaga

SEQ ID NO: 1236892 - RNA, 14 nt, Human
agcuuccuucagag

SEQ ID NO: 1236893 - RNA, 22 nt, Human
agcuuccaugauucuauuuaua

SEQ ID NO: 1236894 - RNA, 21 nt, Human
agcuucccuccccucuaguuu

SEQ ID NO: 1236895 - RNA, 12 nt, Human
aggucccuaaua

SEQ ID NO: 1236896 - RNA, 17 nt, Human
agguaauuuuuuucacc

SEQ ID NO: 1236897 - RNA, 17 nt, Human
agguacaaccuguucug

SEQ ID NO: 1236898 - RNA, 23 nt, Human
agguaaaucagacuaugaaguuu

SEQ ID NO: 1236899 - RNA, 14 nt, Human
agguaaauaaaaag

SEQ ID NO: 1236900 - RNA, 20 nt, Human
agguaaauaaaaagaaaggc

SEQ ID NO: 1236901 - RNA, 21 nt, Human
agguaaucgaccugccucggc

SEQ ID NO: 1236902 - RNA, 18 nt, Human
agguaaaucagacuauga

SEQ ID NO: 1236903 - RNA, 14 nt, Human
agguaaaaugccau

SEQ ID NO: 1236904 - RNA, 15 nt, Human
agguaaaaugccaug

SEQ ID NO: 1236905 - RNA, 16 nt, Human
agguaaaaugccauga

SEQ ID NO: 1236906 - RNA, 14 nt, Human
agguaaaacagggc

SEQ ID NO: 1236907 - RNA, 13 nt, Human
agguaaaaugcca

SEQ ID NO: 1236908 - RNA, 22 nt, Human
agguaaaaugccaugaugccuc

SEQ ID NO: 1236909 - RNA, 20 nt, Human
agguaaaagcaucacaugaa

SEQ ID NO: 1236910 - RNA, 16 nt, Human
aggucccuaauaaagc

SEQ ID NO: 1236911 - RNA, 16 nt, Human
agguacacagcucuag

SEQ ID NO: 1236912 - RNA, 16 nt, Human
agguacaagaagcauu

SEQ ID NO: 1236913 - RNA, 15 nt, Human
aggucccuaauaaag

SEQ ID NO: 1236914 - RNA, 13 nt, Human
aggucccuaauaa

SEQ ID NO: 1236915 - RNA, 23 nt, Human
aggucugaaauuuuucuucuuga

SEQ ID NO: 1236916 - RNA, 13 nt, Human
aggucugaaauuu

SEQ ID NO: 1236917 - RNA, 18 nt, Human
agguuauuaugauuagcu

SEQ ID NO: 1236918 - RNA, 19 nt, Human
agguuaucuacuuuuacuc

SEQ ID NO: 1236919 - RNA, 15 nt, Human
agguuaucagugcuu

SEQ ID NO: 1236920 - RNA, 18 nt, Human
agguuccgcuuggagcag

SEQ ID NO: 1236921 - RNA, 21 nt, Human
agguuccgcuuggagcagagg

SEQ ID NO: 1236922 - RNA, 23 nt, Human
agguuccgcuuggagcagagggg

SEQ ID NO: 1236923 - RNA, 15 nt, Human
agguuacaagccugc

SEQ ID NO: 1236924 - RNA, 21 nt, Human
agguuacaagccugcacaaua

SEQ ID NO: 1236925 - RNA, 22 nt, Human
agguguuuuguucaccauuaua

SEQ ID NO: 1236926 - RNA, 15 nt, Human
agguggaucuauuuc

SEQ ID NO: 1236927 - RNA, 16 nt, Human
agguggaucuauuuca

SEQ ID NO: 1236928 - RNA, 15 nt, Human
agguggauggcccca

SEQ ID NO: 1236929 - RNA, 18 nt, Human
agguguuuuguucaccau

SEQ ID NO: 1236930 - RNA, 20 nt, Human
aggugcuacacccuuuucca

SEQ ID NO: 1236931 - RNA, 21 nt, Human
aggugcuacacccuuuuccag

SEQ ID NO: 1236932 - RNA, 14 nt, Human
agggucccucugug

SEQ ID NO: 1236933 - RNA, 15 nt, Human
agggucccucugugu

SEQ ID NO: 1236934 - RNA, 18 nt, Human
agggucccucuguguauu

SEQ ID NO: 1236935 - RNA, 20 nt, Human
agggucccucuguguauuug

SEQ ID NO: 1236936 - RNA, 23 nt, Human
agggucccccacucuaaagcaaa

SEQ ID NO: 1236937 - RNA, 12 nt, Human
agggucccucug

SEQ ID NO: 1236938 - RNA, 12 nt, Human
aggguccugggg

SEQ ID NO: 1236939 - RNA, 15 nt, Human
aggguccuggggaac

SEQ ID NO: 1236940 - RNA, 21 nt, Human
aggguccuggggaaccugacc

SEQ ID NO: 1236941 - RNA, 23 nt, Human
aggguccuggggaaccugacccc

SEQ ID NO: 1236942 - RNA, 13 nt, Human
aggguccugggag

SEQ ID NO: 1236943 - RNA, 16 nt, Human
aggggccuccaugggc

SEQ ID NO: 1236944 - RNA, 22 nt, Human
aggggccuccaugggccccagg

SEQ ID NO: 1236945 - RNA, 12 nt, Human
agggucaggccu

SEQ ID NO: 1236946 - RNA, 13 nt, Human
agggucaggccuu

SEQ ID NO: 1236947 - RNA, 14 nt, Human
agggucaggccuuu

SEQ ID NO: 1236948 - RNA, 22 nt, Human
agggucaggccuuugagcucag

SEQ ID NO: 1236949 - RNA, 22 nt, Human
agggucauaucacucaggcccu

SEQ ID NO: 1236950 - RNA, 17 nt, Human
aggguccaacauagagc

SEQ ID NO: 1236951 - RNA, 22 nt, Human
agggaccggcggaccccagcca

SEQ ID NO: 1236952 - RNA, 22 nt, Human
agggacagaugaaugccgugga

SEQ ID NO: 1236953 - RNA, 15 nt, Human
aggcuguaacuacuu

SEQ ID NO: 1236954 - RNA, 15 nt, Human
aggcuguccuguaca

SEQ ID NO: 1236955 - RNA, 16 nt, Human
aggcuguccuguacau

SEQ ID NO: 1236956 - RNA, 21 nt, Human
aggcuguccuguacauugugg

SEQ ID NO: 1236957 - RNA, 16 nt, Human
aggcugucuguuguau

SEQ ID NO: 1236958 - RNA, 15 nt, Human
aggcuagauguaugu

SEQ ID NO: 1236959 - RNA, 16 nt, Human
aggcuagauguaugua

SEQ ID NO: 1236960 - RNA, 17 nt, Human
aggcuagauguauguac

SEQ ID NO: 1236961 - RNA, 12 nt, Human
aggcuguaacua

SEQ ID NO: 1236962 - RNA, 18 nt, Human
agggacgccugggggugc

SEQ ID NO: 1236963 - RNA, 22 nt, Human
agggacgccugggggugccagg

SEQ ID NO: 1236964 - RNA, 13 nt, Human
agggacgccuggg

SEQ ID NO: 1236965 - RNA, 15 nt, Human
agggacgccuggggg

SEQ ID NO: 1236966 - RNA, 23 nt, Human
agggacgccugggggugccagga

SEQ ID NO: 1236967 - RNA, 23 nt, Human
aggcuacuguaaggcaaucaugg

SEQ ID NO: 1236968 - RNA, 21 nt, Human
aggcuagaaccaccugccuau

SEQ ID NO: 1236969 - RNA, 17 nt, Human
aggcuacuucggggcug

SEQ ID NO: 1236970 - RNA, 20 nt, Human
aggcuacuucggggcuggga

SEQ ID NO: 1236971 - RNA, 22 nt, Human
aggcuacuucggggcugggaag

SEQ ID NO: 1236972 - RNA, 21 nt, Human
aggcgugagccaccgugccug

SEQ ID NO: 1236973 - RNA, 18 nt, Human
aggcgugagccaccucgc

SEQ ID NO: 1236974 - RNA, 17 nt, Human
aggcgugagccaccucg

SEQ ID NO: 1236975 - RNA, 18 nt, Human
aggcgugagccaccaugc

SEQ ID NO: 1236976 - RNA, 19 nt, Human
aggcccuuccucuccacug

SEQ ID NO: 1236977 - RNA, 23 nt, Human
aggccgaagcuaacagggaaggc

SEQ ID NO: 1236978 - RNA, 13 nt, Human
aggcccuuccucu

SEQ ID NO: 1236979 - RNA, 15 nt, Human
aggcccuuccucucc

SEQ ID NO: 1236980 - RNA, 17 nt, Human
aggcccuuccucuccac

SEQ ID NO: 1236981 - RNA, 18 nt, Human
aggcccuuccucuccacu

SEQ ID NO: 1236982 - RNA, 20 nt, Human
aggcccuuauuuucaagaaa

SEQ ID NO: 1236983 - RNA, 22 nt, Human
aggcccuuauuuucaagaaacu

SEQ ID NO: 1236984 - RNA, 13 nt, Human
accccuccacucu

SEQ ID NO: 1236985 - RNA, 12 nt, Human
accccuccccuc

SEQ ID NO: 1236986 - RNA, 13 nt, Human
accccuccccucc

SEQ ID NO: 1236987 - RNA, 14 nt, Human
accccuccccucca

SEQ ID NO: 1236988 - RNA, 19 nt, Human
accccuccccuccaucccu

SEQ ID NO: 1236989 - RNA, 20 nt, Human
accccuccccuccaucccug

SEQ ID NO: 1236990 - RNA, 17 nt, Human
accccuccacucuuucu

SEQ ID NO: 1236991 - RNA, 17 nt, Human
accccucauagcccuca

SEQ ID NO: 1236992 - RNA, 13 nt, Human
acccccugugccu

SEQ ID NO: 1236993 - RNA, 15 nt, Human
acccccugcagcuug

SEQ ID NO: 1236994 - RNA, 13 nt, Human
acccccugcagcu

SEQ ID NO: 1236995 - RNA, 18 nt, Human
acccccuucuccauccac

SEQ ID NO: 1236996 - RNA, 19 nt, Human
acccccuucuccauccaca

SEQ ID NO: 1236997 - RNA, 14 nt, Human
acccagugcugaau

SEQ ID NO: 1236998 - RNA, 14 nt, Human
acccagugcccucu

SEQ ID NO: 1236999 - RNA, 15 nt, Human
acccagugcccucuc

SEQ ID NO: 1237000 - RNA, 22 nt, Human
acccagugcccucuccccucag

SEQ ID NO: 1237001 - RNA, 17 nt, Human
acccaguugccaucugc

SEQ ID NO: 1237002 - RNA, 18 nt, Human
acccaguugccaucugcg

SEQ ID NO: 1237003 - RNA, 17 nt, Human
acccaguuuccuuggga

SEQ ID NO: 1237004 - RNA, 20 nt, Human
acccaguuucuaaacuggag

SEQ ID NO: 1237005 - RNA, 21 nt, Human
acccaguuucuaaacuggaga

SEQ ID NO: 1237006 - RNA, 21 nt, Human
acccaccugcuagugugaauu

SEQ ID NO: 1237007 - RNA, 22 nt, Human
acccauuagcagucccuccaca

SEQ ID NO: 1237008 - RNA, 15 nt, Human
acccauuuguucaua

SEQ ID NO: 1237009 - RNA, 23 nt, Human
acccauuuaaauuuuuuuccuua

SEQ ID NO: 1237010 - RNA, 20 nt, Human
acccauuuaaauuuuuuucc

SEQ ID NO: 1237011 - RNA, 13 nt, Human
acccauuccuucc

SEQ ID NO: 1237012 - RNA, 15 nt, Human
acccauuccuuccca

SEQ ID NO: 1237013 - RNA, 23 nt, Human
acccauuccuucccagaggggcc

SEQ ID NO: 1237014 - RNA, 16 nt, Human
acccauuccuucccag

SEQ ID NO: 1237015 - RNA, 14 nt, Human
acccccugcaaagc

SEQ ID NO: 1237016 - RNA, 17 nt, Human
acccccugcaaagccca

SEQ ID NO: 1237017 - RNA, 18 nt, Human
acccccugcaaagcccag

SEQ ID NO: 1237018 - RNA, 20 nt, Human
acccccugcaaagcccagcu

SEQ ID NO: 1237019 - RNA, 22 nt, Human
acccccugcaaagcccagcuug

SEQ ID NO: 1237020 - RNA, 14 nt, Human
acccauuuguucau

SEQ ID NO: 1237021 - RNA, 12 nt, Human
acccccugcagc

SEQ ID NO: 1237022 - RNA, 18 nt, Human
accauccuaggcugacac

SEQ ID NO: 1237023 - RNA, 15 nt, Human
accaucgcuuuauug

SEQ ID NO: 1237024 - RNA, 19 nt, Human
accaucgucuucuuggcca

SEQ ID NO: 1237025 - RNA, 20 nt, Human
accaucucccuggugcuuau

SEQ ID NO: 1237026 - RNA, 17 nt, Human
acccacaagaaaugaaa

SEQ ID NO: 1237027 - RNA, 21 nt, Human
acccacaagaaaugaaagcag

SEQ ID NO: 1237028 - RNA, 11 nt, Human
accaucucccu

SEQ ID NO: 1237029 - RNA, 12 nt, Human
accaucucccug

SEQ ID NO: 1237030 - RNA, 13 nt, Human
accaucucccugg

SEQ ID NO: 1237031 - RNA, 14 nt, Human
accaucucccuggu

SEQ ID NO: 1237032 - RNA, 16 nt, Human
accaucucccuggugc

SEQ ID NO: 1237033 - RNA, 17 nt, Human
accaucucccuggugcu

SEQ ID NO: 1237034 - RNA, 18 nt, Human
accaucucccuggugcuu

SEQ ID NO: 1237035 - RNA, 18 nt, Human
acccacacaaauaacaag

SEQ ID NO: 1237036 - RNA, 22 nt, Human
acccacacucagauccuccuca

SEQ ID NO: 1237037 - RNA, 23 nt, Human
acccaccgggccacuccuuccug

SEQ ID NO: 1237038 - RNA, 13 nt, Human
accagaucauugu

SEQ ID NO: 1237039 - RNA, 14 nt, Human
accagauaacuuuu

SEQ ID NO: 1237040 - RNA, 13 nt, Human
accagauaacuuu

SEQ ID NO: 1237041 - RNA, 22 nt, Human
accagagugcugaaggaaugga

SEQ ID NO: 1237042 - RNA, 23 nt, Human
accaccucucaauauucaauaaa

SEQ ID NO: 1237043 - RNA, 15 nt, Human
accaccucucaauau

SEQ ID NO: 1237044 - RNA, 17 nt, Human
accaccucuccagaggc

SEQ ID NO: 1237045 - RNA, 21 nt, Human
accaccgcgcccagccuuuuu

SEQ ID NO: 1237046 - RNA, 14 nt, Human
accagaugcagcuc

SEQ ID NO: 1237047 - RNA, 10 nt, Human
accagaugcu

SEQ ID NO: 1237048 - RNA, 11 nt, Human
accagaugcug

SEQ ID NO: 1237049 - RNA, 12 nt, Human
accagaugcuga

SEQ ID NO: 1237050 - RNA, 14 nt, Human
accagaugcugaaa

SEQ ID NO: 1237051 - RNA, 21 nt, Human
accagccauuggcuauuuaaa

SEQ ID NO: 1237052 - RNA, 17 nt, Human
accaauaaagugacccu

SEQ ID NO: 1237053 - RNA, 12 nt, Human
accaauaaagug

SEQ ID NO: 1237054 - RNA, 11 nt, Human
accaauaaagu

SEQ ID NO: 1237055 - RNA, 23 nt, Human
accaauagggcugagcucucugu

SEQ ID NO: 1237056 - RNA, 14 nt, Human
accacccugcucau

SEQ ID NO: 1237057 - RNA, 17 nt, Human
accaauaaaauaauuuu

SEQ ID NO: 1237058 - RNA, 23 nt, Human
accaaguuucagguauuaagaaa

SEQ ID NO: 1237059 - RNA, 23 nt, Human
accaaguuggaacauccuuggaa

SEQ ID NO: 1237060 - RNA, 20 nt, Human
accaagccaagggaaccugu

SEQ ID NO: 1237061 - RNA, 23 nt, Human
accaagccaagggaaccuguguc

SEQ ID NO: 1237062 - RNA, 17 nt, Human
accaaggcuuucucuac

SEQ ID NO: 1237063 - RNA, 23 nt, Human
accaaggcuuucucuacugauuc

SEQ ID NO: 1237064 - RNA, 14 nt, Human
accaagcacagcag

SEQ ID NO: 1237065 - RNA, 16 nt, Human
accaagcacagcagcc

SEQ ID NO: 1237066 - RNA, 17 nt, Human
accaagcacagcagccu

SEQ ID NO: 1237067 - RNA, 13 nt, Human
accaagcaggaaa

SEQ ID NO: 1237068 - RNA, 14 nt, Human
accaagcaucuugg

SEQ ID NO: 1237069 - RNA, 20 nt, Human
acauuuuaaaaaauggucac

SEQ ID NO: 1237070 - RNA, 16 nt, Human
acauuuuaaaagugcc

SEQ ID NO: 1237071 - RNA, 16 nt, Human
acauuuuaaacacauu

SEQ ID NO: 1237072 - RNA, 19 nt, Human
acauuuuaaaagugccauu

SEQ ID NO: 1237073 - RNA, 19 nt, Human
accaagauggcccauccug

SEQ ID NO: 1237074 - RNA, 19 nt, Human
accaagauuggccugaggc

SEQ ID NO: 1237075 - RNA, 19 nt, Human
acauuuguucuauagcuuu

SEQ ID NO: 1237076 - RNA, 13 nt, Human
acauuuauuuccu

SEQ ID NO: 1237077 - RNA, 14 nt, Human
acauuuauuuccuc

SEQ ID NO: 1237078 - RNA, 15 nt, Human
acauuuauuuccucc

SEQ ID NO: 1237079 - RNA, 16 nt, Human
acauuuauuuugacau

SEQ ID NO: 1237080 - RNA, 17 nt, Human
acaggcacacaccacca

SEQ ID NO: 1237081 - RNA, 14 nt, Human
acagggucugcucu

SEQ ID NO: 1237082 - RNA, 15 nt, Human
acagggucugcucuu

SEQ ID NO: 1237083 - RNA, 22 nt, Human
acagggucugcucuuucucugc

SEQ ID NO: 1237084 - RNA, 23 nt, Human
acagggucugcucuuucucugcc

SEQ ID NO: 1237085 - RNA, 24 nt, Human
acagggucugcucuuucucugcca

SEQ ID NO: 1237086 - RNA, 15 nt, Human
acaggguuucaccau

SEQ ID NO: 1237087 - RNA, 16 nt, Human
acagguaaaacagggc

SEQ ID NO: 1237088 - RNA, 14 nt, Human
acagguaaaacagg

SEQ ID NO: 1237089 - RNA, 15 nt, Human
acagguaaaacaggg

SEQ ID NO: 1237090 - RNA, 22 nt, Human
acauguuucuuuguaaugaaaa

SEQ ID NO: 1237091 - RNA, 19 nt, Human
acauguuucuuuguaauga

SEQ ID NO: 1237092 - RNA, 21 nt, Human
acaugugacauuuauauauug

SEQ ID NO: 1237093 - RNA, 13 nt, Human
acauguuuccagc

SEQ ID NO: 1237094 - RNA, 14 nt, Human
acauguuuccagca

SEQ ID NO: 1237095 - RNA, 21 nt, Human
acauguuuccagcauucccag

SEQ ID NO: 1237096 - RNA, 22 nt, Human
acauguuuccagcauucccagg

SEQ ID NO: 1237097 - RNA, 11 nt, Human
acauguuuccu

SEQ ID NO: 1237098 - RNA, 23 nt, Human
acauguuucuuuguaaugaaaac

SEQ ID NO: 1237099 - RNA, 23 nt, Human
acauguuuccagcauucccaggu

SEQ ID NO: 1237100 - RNA, 16 nt, Human
acauguuuccucuagu

SEQ ID NO: 1237101 - RNA, 13 nt, Human
acaucagcaaaca

SEQ ID NO: 1237102 - RNA, 13 nt, Human
acaugauucauuu

SEQ ID NO: 1237103 - RNA, 19 nt, Human
acaugauuccagccaucac

SEQ ID NO: 1237104 - RNA, 13 nt, Human
acaugauuuccuu

SEQ ID NO: 1237105 - RNA, 20 nt, Human
acaugcauuacugcaugcac

SEQ ID NO: 1237106 - RNA, 13 nt, Human
acaugugacauuu

SEQ ID NO: 1237107 - RNA, 14 nt, Human
acaugugacauuua

SEQ ID NO: 1237108 - RNA, 15 nt, Human
acaugugacauuuau

SEQ ID NO: 1237109 - RNA, 16 nt, Human
acaugugacauuuaua

SEQ ID NO: 1237110 - RNA, 16 nt, Human
acaugcauuacugcau

SEQ ID NO: 1237111 - RNA, 16 nt, Human
acaugauuuccuugaa

SEQ ID NO: 1237112 - RNA, 17 nt, Human
acaugauuuccuugaau

SEQ ID NO: 1237113 - RNA, 19 nt, Human
acagccaacuauggccugu

SEQ ID NO: 1237114 - RNA, 19 nt, Human
acagccaacuagccccugg

SEQ ID NO: 1237115 - RNA, 20 nt, Human
acagccaacuagccccuggg

SEQ ID NO: 1237116 - RNA, 17 nt, Human
acagccaacuauggccu

SEQ ID NO: 1237117 - RNA, 24 nt, Human
acagccaacacgcaccugccucag

SEQ ID NO: 1237118 - RNA, 15 nt, Human
acagccaaauuuaaa

SEQ ID NO: 1237119 - RNA, 16 nt, Human
acagccaacuagcccc

SEQ ID NO: 1237120 - RNA, 17 nt, Human
acagccaacuagccccu

SEQ ID NO: 1237121 - RNA, 18 nt, Human
acagccaacuagccccug

SEQ ID NO: 1237122 - RNA, 19 nt, Human
acagagucuuccucugucu

SEQ ID NO: 1237123 - RNA, 13 nt, Human
acagcaucagggu

SEQ ID NO: 1237124 - RNA, 20 nt, Human
acagccaacacgcaccugcc

SEQ ID NO: 1237125 - RNA, 21 nt, Human
acagccaacacgcaccugccu

SEQ ID NO: 1237126 - RNA, 22 nt, Human
acagccaacacgcaccugccuc

SEQ ID NO: 1237127 - RNA, 14 nt, Human
acagagucuuccuc

SEQ ID NO: 1237128 - RNA, 15 nt, Human
acagaggcccucaag

SEQ ID NO: 1237129 - RNA, 15 nt, Human
acacuggucugcugu

SEQ ID NO: 1237130 - RNA, 20 nt, Human
acacuggucugcuguuccag

SEQ ID NO: 1237131 - RNA, 16 nt, Human
acacuggucugcuguc

SEQ ID NO: 1237132 - RNA, 19 nt, Human
acacuguaguaaauaaugc

SEQ ID NO: 1237133 - RNA, 22 nt, Human
acacuguaguaaauaaugcuuu

SEQ ID NO: 1237134 - RNA, 22 nt, Human
acagaauuacuguaacugauua

SEQ ID NO: 1237135 - RNA, 18 nt, Human
acagaaugugauaaggaa

SEQ ID NO: 1237136 - RNA, 16 nt, Human
acagaauugcuuguuu

SEQ ID NO: 1237137 - RNA, 18 nt, Human
acagaauuuuauggugca

SEQ ID NO: 1237138 - RNA, 15 nt, Human
acagaggccccagcc

SEQ ID NO: 1237139 - RNA, 16 nt, Human
acagaggccccagccu

SEQ ID NO: 1237140 - RNA, 17 nt, Human
acagaggccccagccuc

SEQ ID NO: 1237141 - RNA, 18 nt, Human
acagaggccccagccucc

SEQ ID NO: 1237142 - RNA, 22 nt, Human
acagaggccccagccucccuga

SEQ ID NO: 1237143 - RNA, 20 nt, Human
acagaggcccucaagucuuu

SEQ ID NO: 1237144 - RNA, 11 nt, Human
acacugccagc

SEQ ID NO: 1237145 - RNA, 18 nt, Human
acacugcagccccaccca

SEQ ID NO: 1237146 - RNA, 16 nt, Human
acacugcacaauaacu

SEQ ID NO: 1237147 - RNA, 13 nt, Human
acacuggccccuc

SEQ ID NO: 1237148 - RNA, 14 nt, Human
acacuggccccuca

SEQ ID NO: 1237149 - RNA, 13 nt, Human
acacuggguggug

SEQ ID NO: 1237150 - RNA, 18 nt, Human
acacugggugguggccug

SEQ ID NO: 1237151 - RNA, 19 nt, Human
acacugggugguggccugg

SEQ ID NO: 1237152 - RNA, 23 nt, Human
acacugggugguggccugguccc

SEQ ID NO: 1237153 - RNA, 20 nt, Human
acacugggugguggccuggu

SEQ ID NO: 1237154 - RNA, 23 nt, Human
acacugcacaauaacuccuccca

SEQ ID NO: 1237155 - RNA, 21 nt, Human
acaggaugaugacuauggaaa

SEQ ID NO: 1237156 - RNA, 13 nt, Human
acaggauccaggc

SEQ ID NO: 1237157 - RNA, 12 nt, Human
acaggauccagg

SEQ ID NO: 1237158 - RNA, 19 nt, Human
acaggaucaguuaacuauu

SEQ ID NO: 1237159 - RNA, 18 nt, Human
acaggauccaggccggcu

SEQ ID NO: 1237160 - RNA, 22 nt, Human
acaggaugguucccuugaugaa

SEQ ID NO: 1237161 - RNA, 19 nt, Human
acaggcaaaauccuugcuu

SEQ ID NO: 1237162 - RNA, 21 nt, Human
acagccaacuagccccugggg

SEQ ID NO: 1237163 - RNA, 13 nt, Human
aauuuuguugcug

SEQ ID NO: 1237164 - RNA, 18 nt, Human
aauuuuguguaagaaaua

SEQ ID NO: 1237165 - RNA, 22 nt, Human
aauuuuguguaagaaauacaga

SEQ ID NO: 1237166 - RNA, 13 nt, Human
aauuuugugaagc

SEQ ID NO: 1237167 - RNA, 18 nt, Human
aauuuugugguuuucgag

SEQ ID NO: 1237168 - RNA, 14 nt, Human
aauuuuguguaaga

SEQ ID NO: 1237169 - RNA, 15 nt, Human
aauuuuguguaagaa

SEQ ID NO: 1237170 - RNA, 17 nt, Human
aauuuuguguaagaaau

SEQ ID NO: 1237171 - RNA, 15 nt, Human
aauuuuguaacgaag

SEQ ID NO: 1237172 - RNA, 12 nt, Human
aauuuucuuuca

SEQ ID NO: 1237173 - RNA, 18 nt, Human
aauuuuguaauguaucaa

SEQ ID NO: 1237174 - RNA, 22 nt, Human
aauuuuccuguccucuuucagc

SEQ ID NO: 1237175 - RNA, 19 nt, Human
aauuuuccuaauaaaguuc

SEQ ID NO: 1237176 - RNA, 23 nt, Human
aauuuuccuguccucuuucagcu

SEQ ID NO: 1237177 - RNA, 22 nt, Human
aauuuucuggaauacaugaaau

SEQ ID NO: 1237178 - RNA, 22 nt, Human
acaacggagucaaaaauuaaac

SEQ ID NO: 1237179 - RNA, 20 nt, Human
acaacggagucaaaaauuaa

SEQ ID NO: 1237180 - RNA, 14 nt, Human
acaacggagucaaa

SEQ ID NO: 1237181 - RNA, 12 nt, Human
acaaaauguuau

SEQ ID NO: 1237182 - RNA, 11 nt, Human
acaaaauguua

SEQ ID NO: 1237183 - RNA, 16 nt, Human
acaaaauguaugucug

SEQ ID NO: 1237184 - RNA, 17 nt, Human
acaaaauguuauuuccc

SEQ ID NO: 1237185 - RNA, 22 nt, Human
acaacuaagugauuuguauguc

SEQ ID NO: 1237186 - RNA, 22 nt, Human
acaacgugcucuuuguuuugug

SEQ ID NO: 1237187 - RNA, 10 nt, Human
acaacuaagu

SEQ ID NO: 1237188 - RNA, 18 nt, Human
acaacgugcucuuuguuu

SEQ ID NO: 1237189 - RNA, 22 nt, Human
acaagaaaggcugcuguacuga

SEQ ID NO: 1237190 - RNA, 21 nt, Human
acaagaaaggcugcuguacug

SEQ ID NO: 1237191 - RNA, 19 nt, Human
acaagaaaauaagagcuca

SEQ ID NO: 1237192 - RNA, 16 nt, Human
acaagaaaaauaaaga

SEQ ID NO: 1237193 - RNA, 17 nt, Human
acaagaaaaauaaagaa

SEQ ID NO: 1237194 - RNA, 18 nt, Human
acaagaaaaauaaagaaa

SEQ ID NO: 1237195 - RNA, 20 nt, Human
acaagaaaaauaaagaaaag

SEQ ID NO: 1237196 - RNA, 23 nt, Human
acaagaaaaauaaagaaaagaug

SEQ ID NO: 1237197 - RNA, 23 nt, Human
acaagaaaauaagagcucaggau

SEQ ID NO: 1237198 - RNA, 13 nt, Human
acaagaaaugaaa

SEQ ID NO: 1237199 - RNA, 19 nt, Human
aauuuuguuuauaagaaau

SEQ ID NO: 1237200 - RNA, 15 nt, Human
acaaggcagcaaggc

SEQ ID NO: 1237201 - RNA, 16 nt, Human
acaaggcagcaaggcc

SEQ ID NO: 1237202 - RNA, 18 nt, Human
acaaggcagcaaggcccg

SEQ ID NO: 1237203 - RNA, 22 nt, Human
acaaggcagcaaggcccgagca

SEQ ID NO: 1237204 - RNA, 21 nt, Human
acaaggcagcaaggcccgagc

SEQ ID NO: 1237205 - RNA, 18 nt, Human
acaaggccaucugggcuc

SEQ ID NO: 1237206 - RNA, 22 nt, Human
acaauugagguaaguuuuuuga

SEQ ID NO: 1237207 - RNA, 16 nt, Human
acaauugaaguaaacu

SEQ ID NO: 1237208 - RNA, 19 nt, Human
acaauugaaguaaacuuuu

SEQ ID NO: 1237209 - RNA, 22 nt, Human
acaauugaaguaaacuuuuugu

SEQ ID NO: 1237210 - RNA, 17 nt, Human
acaauugaagucaauua

SEQ ID NO: 1237211 - RNA, 20 nt, Human
acaauugggagcugccaaga

SEQ ID NO: 1237212 - RNA, 13 nt, Human
acaauugaaguaa

SEQ ID NO: 1237213 - RNA, 13 nt, Human
acaauugggagcu

SEQ ID NO: 1237214 - RNA, 14 nt, Human
acaauuguguagcc

SEQ ID NO: 1237215 - RNA, 16 nt, Human
acaauuguguagccuu

SEQ ID NO: 1237216 - RNA, 17 nt, Human
acaauuguguagccuuu

SEQ ID NO: 1237217 - RNA, 18 nt, Human
acaauuguguagccuuuu

SEQ ID NO: 1237218 - RNA, 23 nt, Human
acaauuguguagccuuuuuguau

SEQ ID NO: 1237219 - RNA, 21 nt, Human
acaauuguguagccuuuuugu

SEQ ID NO: 1237220 - RNA, 17 nt, Human
acacagauuugagcuca

SEQ ID NO: 1237221 - RNA, 17 nt, Human
acaccaacauaaaaaug

SEQ ID NO: 1237222 - RNA, 14 nt, Human
acaccaagcacagc

SEQ ID NO: 1237223 - RNA, 15 nt, Human
acacauuuuuuagga

SEQ ID NO: 1237224 - RNA, 16 nt, Human
acacauuuuuuaggaa

SEQ ID NO: 1237225 - RNA, 19 nt, Human
acacauuuuuuaggaaaug

SEQ ID NO: 1237226 - RNA, 14 nt, Human
acaccaaaguucua

SEQ ID NO: 1237227 - RNA, 15 nt, Human
acaccaaaguucuaa

SEQ ID NO: 1237228 - RNA, 18 nt, Human
acaccaacauaaaaauga

SEQ ID NO: 1237229 - RNA, 16 nt, Human
acacgcuccuuccucu

SEQ ID NO: 1237230 - RNA, 14 nt, Human
acacgcuccuuccu

SEQ ID NO: 1237231 - RNA, 22 nt, Human
acacgcgguuugguuugcagcg

SEQ ID NO: 1237232 - RNA, 17 nt, Human
accuguguuucuugccu

SEQ ID NO: 1237233 - RNA, 18 nt, Human
accuguguuucuugccuc

SEQ ID NO: 1237234 - RNA, 19 nt, Human
accuguguuucuugccuca

SEQ ID NO: 1237235 - RNA, 20 nt, Human
accuguguuucuugccucau

SEQ ID NO: 1237236 - RNA, 21 nt, Human
accuguguuucuugccucauu

SEQ ID NO: 1237237 - RNA, 12 nt, Human
accugucugucu

SEQ ID NO: 1237238 - RNA, 11 nt, Human
accugucuguc

SEQ ID NO: 1237239 - RNA, 18 nt, Human
accugucucaccuggacu

SEQ ID NO: 1237240 - RNA, 11 nt, Human
accuguccaau

SEQ ID NO: 1237241 - RNA, 16 nt, Human
accugccgagagucca

SEQ ID NO: 1237242 - RNA, 23 nt, Human
accugccgagaguccaucagccu

SEQ ID NO: 1237243 - RNA, 13 nt, Human
accugccucagga

SEQ ID NO: 1237244 - RNA, 20 nt, Human
accugcccugcugaguccca

SEQ ID NO: 1237245 - RNA, 21 nt, Human
accucuguauuugaaucagcc

SEQ ID NO: 1237246 - RNA, 18 nt, Human
accucuggguugggauca

SEQ ID NO: 1237247 - RNA, 15 nt, Human
accucugcugccucc

SEQ ID NO: 1237248 - RNA, 11 nt, Human
accuuucauac

SEQ ID NO: 1237249 - RNA, 18 nt, Human
accuuuccaccacagcca

SEQ ID NO: 1237250 - RNA, 11 nt, Human
accuuucuagu

SEQ ID NO: 1237251 - RNA, 15 nt, Human
accuuucuaguugaa

SEQ ID NO: 1237252 - RNA, 14 nt, Human
accuuuagguucuu

SEQ ID NO: 1237253 - RNA, 21 nt, Human
accuguugagcaucacagaau

SEQ ID NO: 1237254 - RNA, 17 nt, Human
accuguuaccuacuuug

SEQ ID NO: 1237255 - RNA, 18 nt, Human
accuguuaccuacuuuga

SEQ ID NO: 1237256 - RNA, 17 nt, Human
accuguuagcagacagg

SEQ ID NO: 1237257 - RNA, 14 nt, Human
accuguugagcauc

SEQ ID NO: 1237258 - RNA, 19 nt, Human
accuguugagcaucacaga

SEQ ID NO: 1237259 - RNA, 20 nt, Human
accuguugagcaucacagaa

SEQ ID NO: 1237260 - RNA, 22 nt, Human
accuguugagcaucacagaaug

SEQ ID NO: 1237261 - RNA, 23 nt, Human
accuuggguuagaccuacagggg

SEQ ID NO: 1237262 - RNA, 17 nt, Human
accuuggguuagaccua

SEQ ID NO: 1237263 - RNA, 22 nt, Human
acggaagaagagaucaggaaga

SEQ ID NO: 1237264 - RNA, 14 nt, Human
acggaacucaaaua

SEQ ID NO: 1237265 - RNA, 18 nt, Human
acgcuuuccugaauccaa

SEQ ID NO: 1237266 - RNA, 11 nt, Human
acgcuuugauu

SEQ ID NO: 1237267 - RNA, 15 nt, Human
acggaaagugcuguc

SEQ ID NO: 1237268 - RNA, 17 nt, Human
acgcuuuuugaaaaagc

SEQ ID NO: 1237269 - RNA, 14 nt, Human
acgcuuuugugaug

SEQ ID NO: 1237270 - RNA, 23 nt, Human
acgcuuuugugauggagugcugu

SEQ ID NO: 1237271 - RNA, 12 nt, Human
acgcuuugauuc

SEQ ID NO: 1237272 - RNA, 13 nt, Human
acgcuuugauuca

SEQ ID NO: 1237273 - RNA, 14 nt, Human
acgcuuugauucau

SEQ ID NO: 1237274 - RNA, 16 nt, Human
acgcuuugauucauag

SEQ ID NO: 1237275 - RNA, 17 nt, Human
acgccacagcccuuuug

SEQ ID NO: 1237276 - RNA, 22 nt, Human
acgccacagcccuuuugucucu

SEQ ID NO: 1237277 - RNA, 22 nt, Human
acgcaucuaguuccccuguuua

SEQ ID NO: 1237278 - RNA, 12 nt, Human
acgccacagccc

SEQ ID NO: 1237279 - RNA, 21 nt, Human
acgcaugcaguguuggggaug

SEQ ID NO: 1237280 - RNA, 13 nt, Human
acuaagagagaau

SEQ ID NO: 1237281 - RNA, 15 nt, Human
acuaagagagaauga

SEQ ID NO: 1237282 - RNA, 16 nt, Human
acuaagagaaguugua

SEQ ID NO: 1237283 - RNA, 17 nt, Human
acuaagagaaguuguaa

SEQ ID NO: 1237284 - RNA, 21 nt, Human
acgugacacaaacacacacaa

SEQ ID NO: 1237285 - RNA, 21 nt, Human
acgugaccggacuuuucugca

SEQ ID NO: 1237286 - RNA, 15 nt, Human
acuaauuccacaccu

SEQ ID NO: 1237287 - RNA, 18 nt, Human
acuaagccagcaccggac

SEQ ID NO: 1237288 - RNA, 20 nt, Human
acuaauuucaaaaugcuuuu

SEQ ID NO: 1237289 - RNA, 16 nt, Human
acuaauuucaaaaugc

SEQ ID NO: 1237290 - RNA, 19 nt, Human
acuaauuucaaaaugcuuu

SEQ ID NO: 1237291 - RNA, 23 nt, Human
acuaauuccacaccuuuuauuga

SEQ ID NO: 1237292 - RNA, 14 nt, Human
acuaauuucaaaau

SEQ ID NO: 1237293 - RNA, 20 nt, Human
acuaguauuucuaugaaaua

SEQ ID NO: 1237294 - RNA, 14 nt, Human
acuagccaaaccag

SEQ ID NO: 1237295 - RNA, 18 nt, Human
acuagccaaaccaggacc

SEQ ID NO: 1237296 - RNA, 15 nt, Human
acuagccaaaccuca

SEQ ID NO: 1237297 - RNA, 16 nt, Human
acuagccaaaccucac

SEQ ID NO: 1237298 - RNA, 17 nt, Human
acuauucuugauguaaa

SEQ ID NO: 1237299 - RNA, 11 nt, Human
acuauuuaaag

SEQ ID NO: 1237300 - RNA, 20 nt, Human
acuauuuaaagccuccucau

SEQ ID NO: 1237301 - RNA, 12 nt, Human
acuauuuaacug

SEQ ID NO: 1237302 - RNA, 13 nt, Human
acuauuuaacuga

SEQ ID NO: 1237303 - RNA, 14 nt, Human
acuauuuaacugac

SEQ ID NO: 1237304 - RNA, 15 nt, Human
acuauuuaacugacu

SEQ ID NO: 1237305 - RNA, 16 nt, Human
acuauuuaacugacua

SEQ ID NO: 1237306 - RNA, 17 nt, Human
acuauuuaacugacuau

SEQ ID NO: 1237307 - RNA, 17 nt, Human
acucagucucucuucuc

SEQ ID NO: 1237308 - RNA, 14 nt, Human
acucaguaauuugu

SEQ ID NO: 1237309 - RNA, 16 nt, Human
acucagggcuccuggg

SEQ ID NO: 1237310 - RNA, 18 nt, Human
acucagggcuucuaguuu

SEQ ID NO: 1237311 - RNA, 15 nt, Human
acucagguggcccua

SEQ ID NO: 1237312 - RNA, 20 nt, Human
acucagcuuucuuuaaaguu

SEQ ID NO: 1237313 - RNA, 16 nt, Human
acucaggagccuguga

SEQ ID NO: 1237314 - RNA, 17 nt, Human
acucagccacccugagu

SEQ ID NO: 1237315 - RNA, 18 nt, Human
acucagccacccugaguu

SEQ ID NO: 1237316 - RNA, 11 nt, Human
acucagcaugg

SEQ ID NO: 1237317 - RNA, 20 nt, Human
acucaaaugugaguguuuuu

SEQ ID NO: 1237318 - RNA, 16 nt, Human
acucaaauguucuaag

SEQ ID NO: 1237319 - RNA, 17 nt, Human
acucaaauguucuaagu

SEQ ID NO: 1237320 - RNA, 18 nt, Human
acucaaauguucuaaguu

SEQ ID NO: 1237321 - RNA, 17 nt, Human
acucaaaugaguaacau

SEQ ID NO: 1237322 - RNA, 14 nt, Human
acucaaaugaguaa

SEQ ID NO: 1237323 - RNA, 16 nt, Human
acucaaaugaguaaca

SEQ ID NO: 1237324 - RNA, 17 nt, Human
acucaaauggggccaga

SEQ ID NO: 1237325 - RNA, 20 nt, Human
acucaaauggggccagaucc

SEQ ID NO: 1237326 - RNA, 21 nt, Human
acucaaauggggccagaucca

SEQ ID NO: 1237327 - RNA, 22 nt, Human
acucaaauggggccagauccag

SEQ ID NO: 1237328 - RNA, 23 nt, Human
acucaaauggggccagauccagc

SEQ ID NO: 1237329 - RNA, 20 nt, Human
acuagauggaccugccugca

SEQ ID NO: 1237330 - RNA, 18 nt, Human
acuagauggaccugccug

SEQ ID NO: 1237331 - RNA, 12 nt, Human
acuagauguagu

SEQ ID NO: 1237332 - RNA, 13 nt, Human
acuagauguagua

SEQ ID NO: 1237333 - RNA, 16 nt, Human
acuagauguaguauuu

SEQ ID NO: 1237334 - RNA, 17 nt, Human
acuagauguaguauuuu

SEQ ID NO: 1237335 - RNA, 15 nt, Human
acucauauuuucaug

SEQ ID NO: 1237336 - RNA, 20 nt, Human
acucaucaauggggccaguc

SEQ ID NO: 1237337 - RNA, 23 nt, Human
acucauacacucguaugauacuu

SEQ ID NO: 1237338 - RNA, 18 nt, Human
acucauagacacugaucu

SEQ ID NO: 1237339 - RNA, 17 nt, Human
acucauauaauuauaug

SEQ ID NO: 1237340 - RNA, 18 nt, Human
acucauauaauuauaugu

SEQ ID NO: 1237341 - RNA, 19 nt, Human
acucauauaauuauauguu

SEQ ID NO: 1237342 - RNA, 23 nt, Human
acucauauaauuauauguuguaa

SEQ ID NO: 1237343 - RNA, 17 nt, Human
acucuauguucuaagaa

SEQ ID NO: 1237344 - RNA, 17 nt, Human
acucuagucaaugacau

SEQ ID NO: 1237345 - RNA, 13 nt, Human
acucuguaauugc

SEQ ID NO: 1237346 - RNA, 14 nt, Human
acucuguaauugca

SEQ ID NO: 1237347 - RNA, 15 nt, Human
acucuguaauugcaa

SEQ ID NO: 1237348 - RNA, 11 nt, Human
acucuguccug

SEQ ID NO: 1237349 - RNA, 13 nt, Human
acucuagucaaug

SEQ ID NO: 1237350 - RNA, 15 nt, Human
acucuagucaaugac

SEQ ID NO: 1237351 - RNA, 12 nt, Human
acucuauucuuu

SEQ ID NO: 1237352 - RNA, 20 nt, Human
acucuggugagucaccacuu

SEQ ID NO: 1237353 - RNA, 19 nt, Human
acucugguggcacaggagu

SEQ ID NO: 1237354 - RNA, 14 nt, Human
acucuggugccucc

SEQ ID NO: 1237355 - RNA, 16 nt, Human
acucuggugccuccag

SEQ ID NO: 1237356 - RNA, 17 nt, Human
acucuggugccuccaga

SEQ ID NO: 1237357 - RNA, 12 nt, Human
acucuguaauug

SEQ ID NO: 1237358 - RNA, 19 nt, Human
acuguaagaaaauaucacu

SEQ ID NO: 1237359 - RNA, 14 nt, Human
acugguuuucacau

SEQ ID NO: 1237360 - RNA, 13 nt, Human
acuguaagaaaau

SEQ ID NO: 1237361 - RNA, 22 nt, Human
acuguaagaaaauaucacuugu

SEQ ID NO: 1237362 - RNA, 13 nt, Human
acuggucugcugu

SEQ ID NO: 1237363 - RNA, 20 nt, Human
acugguuugaagaauguuaa

SEQ ID NO: 1237364 - RNA, 20 nt, Human
acugucucaagagggcacug

SEQ ID NO: 1237365 - RNA, 21 nt, Human
acugucucaagagggcacugg

SEQ ID NO: 1237366 - RNA, 23 nt, Human
acugucucaagagggcacuggug

SEQ ID NO: 1237367 - RNA, 17 nt, Human
acugguuugaagaaugu

SEQ ID NO: 1237368 - RNA, 22 nt, Human
acugucuccauggcccugcaaa

SEQ ID NO: 1237369 - RNA, 21 nt, Human
acugucucgaugcaaugaaca

SEQ ID NO: 1237370 - RNA, 15 nt, Human
acugucucucaugaa

SEQ ID NO: 1237371 - RNA, 17 nt, Human
acugucucucaugaacc

SEQ ID NO: 1237372 - RNA, 18 nt, Human
acugucucucaugaaccu

SEQ ID NO: 1237373 - RNA, 15 nt, Human
acugugaaggacccu

SEQ ID NO: 1237374 - RNA, 16 nt, Human
acugugaaggacccuu

SEQ ID NO: 1237375 - RNA, 19 nt, Human
acugugacccccagcuccg

SEQ ID NO: 1237376 - RNA, 21 nt, Human
acugugacccccagcuccggc

SEQ ID NO: 1237377 - RNA, 20 nt, Human
acugugccucagagaccagg

SEQ ID NO: 1237378 - RNA, 22 nt, Human
acugugccucagagaccagggc

SEQ ID NO: 1237379 - RNA, 23 nt, Human
acugugccucagagaccagggcu

SEQ ID NO: 1237380 - RNA, 16 nt, Human
acugcccccucugccc

SEQ ID NO: 1237381 - RNA, 17 nt, Human
acugcccccucugcccu

SEQ ID NO: 1237382 - RNA, 16 nt, Human
acuggaagcuaauuug

SEQ ID NO: 1237383 - RNA, 14 nt, Human
acugcccccucugc

SEQ ID NO: 1237384 - RNA, 15 nt, Human
acugcccccucugcc

SEQ ID NO: 1237385 - RNA, 21 nt, Human
acugcccauggacaggcuggc

SEQ ID NO: 1237386 - RNA, 19 nt, Human
acugcccauggacaggcug

SEQ ID NO: 1237387 - RNA, 21 nt, Human
acugccaggagggacaaagga

SEQ ID NO: 1237388 - RNA, 15 nt, Human
acugccaggagggac

SEQ ID NO: 1237389 - RNA, 12 nt, Human
acugccaggagg

SEQ ID NO: 1237390 - RNA, 13 nt, Human
acugccaggaggg

SEQ ID NO: 1237391 - RNA, 14 nt, Human
acugccaggaggga

SEQ ID NO: 1237392 - RNA, 19 nt, Human
acuggaagcuaauuugcau

SEQ ID NO: 1237393 - RNA, 20 nt, Human
acuggaagcuaauuugcauu

SEQ ID NO: 1237394 - RNA, 13 nt, Human
acuggagacugug

SEQ ID NO: 1237395 - RNA, 21 nt, Human
acuggagacugugugugcccu

SEQ ID NO: 1237396 - RNA, 12 nt, Human
acuggagcacaa

SEQ ID NO: 1237397 - RNA, 15 nt, Human
acuggagcagaaggg

SEQ ID NO: 1237398 - RNA, 18 nt, Human
acugguaggaaacuaggu

SEQ ID NO: 1237399 - RNA, 15 nt, Human
acugguaggaccaag

SEQ ID NO: 1237400 - RNA, 18 nt, Human
acugguauguaaaagaaa

SEQ ID NO: 1237401 - RNA, 21 nt, Human
acugguccaaaagauugcuga

SEQ ID NO: 1237402 - RNA, 22 nt, Human
acugguccaaaagauugcugaa

SEQ ID NO: 1237403 - RNA, 22 nt, Human
acuggucacggauuugugucug

SEQ ID NO: 1237404 - RNA, 12 nt, Human
acuggucucucu

SEQ ID NO: 1237405 - RNA, 15 nt, Human
acuggucuguaggga

SEQ ID NO: 1237406 - RNA, 12 nt, Human
acugccagcauu

SEQ ID NO: 1237407 - RNA, 20 nt, Human
acucugucucaguccaugaa

SEQ ID NO: 1237408 - RNA, 22 nt, Human
acucuguccugaaggccugagg

SEQ ID NO: 1237409 - RNA, 15 nt, Human
acucugucuuguguu

SEQ ID NO: 1237410 - RNA, 11 nt, Human
acucugugcca

SEQ ID NO: 1237411 - RNA, 18 nt, Human
acucugucucaguccaug

SEQ ID NO: 1237412 - RNA, 12 nt, Human
acucuguccuga

SEQ ID NO: 1237413 - RNA, 13 nt, Human
acucuguccugaa

SEQ ID NO: 1237414 - RNA, 19 nt, Human
acucuguccugaaggccug

SEQ ID NO: 1237415 - RNA, 20 nt, Human
acucuguccugaaggccuga

SEQ ID NO: 1237416 - RNA, 23 nt, Human
acucuguccugaaggccugaggu

SEQ ID NO: 1237417 - RNA, 14 nt, Human
acucugugccagag

SEQ ID NO: 1237418 - RNA, 18 nt, Human
acuuguaaaggaauuuaa

SEQ ID NO: 1237419 - RNA, 23 nt, Human
acuuggggaguuaagaccuggca

SEQ ID NO: 1237420 - RNA, 20 nt, Human
acuugguugguaggguggga

SEQ ID NO: 1237421 - RNA, 14 nt, Human
acuugguuuugcua

SEQ ID NO: 1237422 - RNA, 13 nt, Human
acuucuugaaggu

SEQ ID NO: 1237423 - RNA, 16 nt, Human
acuucuugaaggugcu

SEQ ID NO: 1237424 - RNA, 13 nt, Human
acuugggcacccc

SEQ ID NO: 1237425 - RNA, 17 nt, Human
acuugggcacccccagc

SEQ ID NO: 1237426 - RNA, 20 nt, Human
acuugggcacccccagccug

SEQ ID NO: 1237427 - RNA, 21 nt, Human
acuugggcacccccagccugg

SEQ ID NO: 1237428 - RNA, 22 nt, Human
acuugggcacccccagccuggg

SEQ ID NO: 1237429 - RNA, 23 nt, Human
acuugggcacccccagccugggc

SEQ ID NO: 1237430 - RNA, 21 nt, Human
acuuggggaguuaagaccugg

SEQ ID NO: 1237431 - RNA, 16 nt, Human
acuucuuauggaauug

SEQ ID NO: 1237432 - RNA, 17 nt, Human
acuucuuauggaauuga

SEQ ID NO: 1237433 - RNA, 20 nt, Human
acuucuuauggaauugauuu

SEQ ID NO: 1237434 - RNA, 21 nt, Human
acuucuuauggaauugauuug

SEQ ID NO: 1237435 - RNA, 23 nt, Human
acuucuuauggaauugauuugca

SEQ ID NO: 1237436 - RNA, 12 nt, Human
acuucuugaagg

SEQ ID NO: 1237437 - RNA, 12 nt, Human
acuucagacaua

SEQ ID NO: 1237438 - RNA, 17 nt, Human
acuucugggcuucaucu

SEQ ID NO: 1237439 - RNA, 19 nt, Human
acuucugggcuucaucugg

SEQ ID NO: 1237440 - RNA, 22 nt, Human
acuucugggcuucaucuggcaa

SEQ ID NO: 1237441 - RNA, 15 nt, Human
acuucuguaauugug

SEQ ID NO: 1237442 - RNA, 21 nt, Human
acuucuguaauuguguggauu

SEQ ID NO: 1237443 - RNA, 22 nt, Human
acuucacugugcuguuguuaug

SEQ ID NO: 1237444 - RNA, 12 nt, Human
acuucagaaaga

SEQ ID NO: 1237445 - RNA, 16 nt, Human
acuucagaaagacuug

SEQ ID NO: 1237446 - RNA, 24 nt, Human
acuucacugugcuguuguuaugau

SEQ ID NO: 1237447 - RNA, 21 nt, Human
acuucacugugcuguuguuau

SEQ ID NO: 1237448 - RNA, 20 nt, Human
acuucacugugcuguuguua

SEQ ID NO: 1237449 - RNA, 19 nt, Human
acuucacugugcuguuguu

SEQ ID NO: 1237450 - RNA, 17 nt, Human
acuucacugugcuguug

SEQ ID NO: 1237451 - RNA, 14 nt, Human
acuucacugugcug

SEQ ID NO: 1237452 - RNA, 13 nt, Human
acuucacugugcu

SEQ ID NO: 1237453 - RNA, 15 nt, Human
acuucaaaaguuugu

SEQ ID NO: 1237454 - RNA, 14 nt, Human
acuguuucuuuaaa

SEQ ID NO: 1237455 - RNA, 21 nt, Human
acuguuugccuucuacuuuua

SEQ ID NO: 1237456 - RNA, 22 nt, Human
acuguuugccuucuacuuuuaa

SEQ ID NO: 1237457 - RNA, 23 nt, Human
acuguuuggaaauugauuuugaa

SEQ ID NO: 1237458 - RNA, 17 nt, Human
acuuauuuaugaaccug

SEQ ID NO: 1237459 - RNA, 19 nt, Human
acuguuuggaaauaaaucu

SEQ ID NO: 1237460 - RNA, 14 nt, Human
acuuauuuuugaca

SEQ ID NO: 1237461 - RNA, 16 nt, Human
acuuauuuuugacagu

SEQ ID NO: 1237462 - RNA, 19 nt, Human
acuuauuuuugacaguguu

SEQ ID NO: 1237463 - RNA, 22 nt, Human
acuuauuuuugacaguguugaa

SEQ ID NO: 1237464 - RNA, 14 nt, Human
acuuuuggaaggua

SEQ ID NO: 1237465 - RNA, 22 nt, Human
acuuuugcuguaauguuaauau

SEQ ID NO: 1237466 - RNA, 17 nt, Human
agaaaauaaucauucuu

SEQ ID NO: 1237467 - RNA, 22 nt, Human
agaaaauaaggcacccaucugu

SEQ ID NO: 1237468 - RNA, 12 nt, Human
acuuuugacaaa

SEQ ID NO: 1237469 - RNA, 15 nt, Human
acuuuugcccuuuga

SEQ ID NO: 1237470 - RNA, 16 nt, Human
agaaaaucaggcuggc

SEQ ID NO: 1237471 - RNA, 23 nt, Human
acuuuuaugauacuugaaaauua

SEQ ID NO: 1237472 - RNA, 16 nt, Human
acuuuuaguaaaguca

SEQ ID NO: 1237473 - RNA, 23 nt, Human
acuuuuauuuccagugaaaucag

SEQ ID NO: 1237474 - RNA, 14 nt, Human
acuuuucccacucc

SEQ ID NO: 1237475 - RNA, 15 nt, Human
acuuuucccacucca

SEQ ID NO: 1237476 - RNA, 16 nt, Human
acuuuuaugauacuug

SEQ ID NO: 1237477 - RNA, 12 nt, Human
acuuuuaugaua

SEQ ID NO: 1237478 - RNA, 13 nt, Human
acuuuuacaagua

SEQ ID NO: 1237479 - RNA, 14 nt, Human
acuuuuacaaguaa

SEQ ID NO: 1237480 - RNA, 21 nt, Human
acuuuuacaaguaacaaaaau

SEQ ID NO: 1237481 - RNA, 15 nt, Human
acuuuuacucugccu

SEQ ID NO: 1237482 - RNA, 16 nt, Human
acuuuuacucugccua

SEQ ID NO: 1237483 - RNA, 19 nt, Human
acuuuuacucugccuacag

SEQ ID NO: 1237484 - RNA, 21 nt, Human
acuuuuacucugccuacagaa

SEQ ID NO: 1237485 - RNA, 15 nt, Human
acuuuauuuuguguu

SEQ ID NO: 1237486 - RNA, 20 nt, Human
acuuuuaaacuguguacaua

SEQ ID NO: 1237487 - RNA, 18 nt, Human
acuuuuaaugaacaaaug

SEQ ID NO: 1237488 - RNA, 13 nt, Human
acuuuuaauucau

SEQ ID NO: 1237489 - RNA, 22 nt, Human
acuuuaucuugaauaauguaag

SEQ ID NO: 1237490 - RNA, 15 nt, Human
acuuuaucacuuaaa

SEQ ID NO: 1237491 - RNA, 13 nt, Human
acuuuaucacuua

SEQ ID NO: 1237492 - RNA, 22 nt, Human
acuuuauccucauuccauaaau

SEQ ID NO: 1237493 - RNA, 22 nt, Human
acuuuauuuucuauaauuuaaa

SEQ ID NO: 1237494 - RNA, 17 nt, Human
agaaauaaauuuauuuc

SEQ ID NO: 1237495 - RNA, 19 nt, Human
agaaauaagugcccucucc

SEQ ID NO: 1237496 - RNA, 13 nt, Human
agaaauaaguuuu

SEQ ID NO: 1237497 - RNA, 14 nt, Human
agaaauaaguuuuu

SEQ ID NO: 1237498 - RNA, 16 nt, Human
agaaauaaguuuuugu

SEQ ID NO: 1237499 - RNA, 23 nt, Human
agaaauaaguuuuuguuucacag

SEQ ID NO: 1237500 - RNA, 12 nt, Human
agaaaguugauu

SEQ ID NO: 1237501 - RNA, 17 nt, Human
agaaauaaaaggaagcc

SEQ ID NO: 1237502 - RNA, 18 nt, Human
agaaauaaaaggaagcca

SEQ ID NO: 1237503 - RNA, 11 nt, Human
agaaaguguau

SEQ ID NO: 1237504 - RNA, 13 nt, Human
agaaaguguauuu

SEQ ID NO: 1237505 - RNA, 16 nt, Human
agaaaguguauuugga

SEQ ID NO: 1237506 - RNA, 17 nt, Human
agaaaguguauuuggaa

SEQ ID NO: 1237507 - RNA, 23 nt, Human
agaaagggcccugggccugccuc

SEQ ID NO: 1237508 - RNA, 16 nt, Human
agaaagguuaguauca

SEQ ID NO: 1237509 - RNA, 14 nt, Human
agaaagugagcagu

SEQ ID NO: 1237510 - RNA, 15 nt, Human
agaaagugccugaca

SEQ ID NO: 1237511 - RNA, 16 nt, Human
agaaagugagcagugu

SEQ ID NO: 1237512 - RNA, 19 nt, Human
agaaagucuuauuuauuca

SEQ ID NO: 1237513 - RNA, 22 nt, Human
agaaagucuuauuuauucauau

SEQ ID NO: 1237514 - RNA, 19 nt, Human
agaaagugccugacacacu

SEQ ID NO: 1237515 - RNA, 22 nt, Human
agaaagugccugacacacuaac

SEQ ID NO: 1237516 - RNA, 14 nt, Human
agaaagugccuuuc

SEQ ID NO: 1237517 - RNA, 16 nt, Human
agaaagugccuuucag

SEQ ID NO: 1237518 - RNA, 17 nt, Human
agaaagugccuuucagg

SEQ ID NO: 1237519 - RNA, 18 nt, Human
agaaagugccuuucagga

SEQ ID NO: 1237520 - RNA, 21 nt, Human
agaaagugccuuucaggaucu

SEQ ID NO: 1237521 - RNA, 22 nt, Human
agaaagugccuuucaggaucua

SEQ ID NO: 1237522 - RNA, 19 nt, Human
agaaaguggaaaacaagga

SEQ ID NO: 1237523 - RNA, 20 nt, Human
agaaaguggaaaacaaggaa

SEQ ID NO: 1237524 - RNA, 23 nt, Human
agaaaguggaaaacaaggaaguc

SEQ ID NO: 1237525 - RNA, 15 nt, Human
agaaaggcugcugua

SEQ ID NO: 1237526 - RNA, 15 nt, Human
agaaaggcuguuaaa

SEQ ID NO: 1237527 - RNA, 16 nt, Human
agaaaggcuguuaaau

SEQ ID NO: 1237528 - RNA, 21 nt, Human
agaaaggcuguuaaauacagg

SEQ ID NO: 1237529 - RNA, 22 nt, Human
agaaaggcuguuaaauacagga

SEQ ID NO: 1237530 - RNA, 13 nt, Human
agaaagggagggc

SEQ ID NO: 1237531 - RNA, 14 nt, Human
agaaagggagggcu

SEQ ID NO: 1237532 - RNA, 15 nt, Human
agaaagggagggcuc

SEQ ID NO: 1237533 - RNA, 16 nt, Human
agaaagggagggcucu

SEQ ID NO: 1237534 - RNA, 17 nt, Human
agaaagggagggcucug

SEQ ID NO: 1237535 - RNA, 18 nt, Human
agaaagggagggcucuga

SEQ ID NO: 1237536 - RNA, 19 nt, Human
agaaagggagggcucugag

SEQ ID NO: 1237537 - RNA, 21 nt, Human
agaaagggagggcucugaggc

SEQ ID NO: 1237538 - RNA, 20 nt, Human
agaaagggagggcucugagg

SEQ ID NO: 1237539 - RNA, 16 nt, Human
agaaagggcccugggc

SEQ ID NO: 1237540 - RNA, 20 nt, Human
agaaagggcccugggccugc

SEQ ID NO: 1237541 - RNA, 22 nt, Human
agaaagggcccugggccugccu

SEQ ID NO: 1237542 - RNA, 14 nt, Human
agaaaggggagccc

SEQ ID NO: 1237543 - RNA, 15 nt, Human
agaaaggggagccca

SEQ ID NO: 1237544 - RNA, 16 nt, Human
agaaaggggagcccac

SEQ ID NO: 1237545 - RNA, 17 nt, Human
agaaaggggagcccacu

SEQ ID NO: 1237546 - RNA, 13 nt, Human
agaaaaucacuua

SEQ ID NO: 1237547 - RNA, 15 nt, Human
agaaaaucuuuauaa

SEQ ID NO: 1237548 - RNA, 16 nt, Human
agaaaaugauacagca

SEQ ID NO: 1237549 - RNA, 22 nt, Human
agaaaaugcgguuauaaaaaau

SEQ ID NO: 1237550 - RNA, 20 nt, Human
aauguuuuuuuuuaaagacu

SEQ ID NO: 1237551 - RNA, 15 nt, Human
aauguuuuuuuuuaa

SEQ ID NO: 1237552 - RNA, 22 nt, Human
aauguuuuuuuuuaaagacuuu

SEQ ID NO: 1237553 - RNA, 14 nt, Human
aauguuugcauaua

SEQ ID NO: 1237554 - RNA, 13 nt, Human
aauguuugcauau

SEQ ID NO: 1237555 - RNA, 16 nt, Human
aauguuucuggauuuc

SEQ ID NO: 1237556 - RNA, 21 nt, Human
aauuaaaaaaaaagaucuguu

SEQ ID NO: 1237557 - RNA, 13 nt, Human
aauuaaaaaagau

SEQ ID NO: 1237558 - RNA, 15 nt, Human
aauuaaaaaagauaa

SEQ ID NO: 1237559 - RNA, 16 nt, Human
aauuaaaaaagauaaa

SEQ ID NO: 1237560 - RNA, 17 nt, Human
aauuaaaaaagauaaac

SEQ ID NO: 1237561 - RNA, 18 nt, Human
aauuaaaaaagauaaaca

SEQ ID NO: 1237562 - RNA, 19 nt, Human
aauuaaaaaagauaaacac

SEQ ID NO: 1237563 - RNA, 20 nt, Human
aauuaaaaaagauaaacaca

SEQ ID NO: 1237564 - RNA, 24 nt, Human
aauuaaaaaagauaaacacaagau

SEQ ID NO: 1237565 - RNA, 23 nt, Human
aauguuucaaacauauauaacaa

SEQ ID NO: 1237566 - RNA, 22 nt, Human
aauguuuacagauccccaagcc

SEQ ID NO: 1237567 - RNA, 22 nt, Human
aauguuucuucuagguucuaaa

SEQ ID NO: 1237568 - RNA, 23 nt, Human
aauguuucuucuagguucuaaaa

SEQ ID NO: 1237569 - RNA, 15 nt, Human
aauguuuaaaccuuu

SEQ ID NO: 1237570 - RNA, 23 nt, Human
aauguuuaaucauauaaauagaa

SEQ ID NO: 1237571 - RNA, 20 nt, Human
aauguuuacacucuuuguaa

SEQ ID NO: 1237572 - RNA, 23 nt, Human
aauguuuacacucuuuguaagag

SEQ ID NO: 1237573 - RNA, 20 nt, Human
aauguuuaaucauauaaaua

SEQ ID NO: 1237574 - RNA, 18 nt, Human
aauguuuaaucauauaaa

SEQ ID NO: 1237575 - RNA, 17 nt, Human
aauguuuaaucauauaa

SEQ ID NO: 1237576 - RNA, 16 nt, Human
aauguuuaaucauaua

SEQ ID NO: 1237577 - RNA, 14 nt, Human
aauguuuaaucaua

SEQ ID NO: 1237578 - RNA, 13 nt, Human
aauguuuaaucau

SEQ ID NO: 1237579 - RNA, 18 nt, Human
aauguccauucuuuauca

SEQ ID NO: 1237580 - RNA, 17 nt, Human
aaugucuuuaaugcaau

SEQ ID NO: 1237581 - RNA, 20 nt, Human
aaugucuuuaaugcaauaua

SEQ ID NO: 1237582 - RNA, 21 nt, Human
aaugucuuuaaugcaauauac

SEQ ID NO: 1237583 - RNA, 22 nt, Human
aaugcuggcuauagaugucuuu

SEQ ID NO: 1237584 - RNA, 19 nt, Human
aaugguguagaacacuaau

SEQ ID NO: 1237585 - RNA, 23 nt, Human
aaugcuggcuauagaugucuuuu

SEQ ID NO: 1237586 - RNA, 14 nt, Human
aauggugugggaga

SEQ ID NO: 1237587 - RNA, 23 nt, Human
aaugcuauaacuauguugauaaa

SEQ ID NO: 1237588 - RNA, 13 nt, Human
aaugcuagguucu

SEQ ID NO: 1237589 - RNA, 14 nt, Human
aaugcuagguucua

SEQ ID NO: 1237590 - RNA, 15 nt, Human
aaugcuagguucuac

SEQ ID NO: 1237591 - RNA, 17 nt, Human
aaugcuagguucuaccu

SEQ ID NO: 1237592 - RNA, 22 nt, Human
aaugcugcaaguuaugaaauau

SEQ ID NO: 1237593 - RNA, 15 nt, Human
aaugucaugcugccu

SEQ ID NO: 1237594 - RNA, 16 nt, Human
aaugucaugcugccuu

SEQ ID NO: 1237595 - RNA, 19 nt, Human
aaugucaugcugccuuauu

SEQ ID NO: 1237596 - RNA, 17 nt, Human
aaugucaugcugccuua

SEQ ID NO: 1237597 - RNA, 14 nt, Human
aaugucauugaaaa

SEQ ID NO: 1237598 - RNA, 19 nt, Human
aaugucauugaaaaacuaa

SEQ ID NO: 1237599 - RNA, 14 nt, Human
aaugucauuuuggu

SEQ ID NO: 1237600 - RNA, 19 nt, Human
aaugucauuuugguacuuu

SEQ ID NO: 1237601 - RNA, 22 nt, Human
aaugguucagaauuaaacuuuu

SEQ ID NO: 1237602 - RNA, 15 nt, Human
aaugguucagaauua

SEQ ID NO: 1237603 - RNA, 20 nt, Human
aaugucacuuuuugaggcaa

SEQ ID NO: 1237604 - RNA, 19 nt, Human
aaugucacuuuuugaggca

SEQ ID NO: 1237605 - RNA, 18 nt, Human
aaugcgggugagaguaau

SEQ ID NO: 1237606 - RNA, 21 nt, Human
aaugcgguuauaaaaaauggu

SEQ ID NO: 1237607 - RNA, 22 nt, Human
aaugcgguuauaaaaaaugguu

SEQ ID NO: 1237608 - RNA, 23 nt, Human
aaugcgguuauaaaaaaugguuc

SEQ ID NO: 1237609 - RNA, 22 nt, Human
aaugcgcaggcuggcccugccc

SEQ ID NO: 1237610 - RNA, 15 nt, Human
aaugccuuuucccaa

SEQ ID NO: 1237611 - RNA, 12 nt, Human
aaguugcugcuu

SEQ ID NO: 1237612 - RNA, 14 nt, Human
aaguugcugcuucu

SEQ ID NO: 1237613 - RNA, 21 nt, Human
aaguugcugcuucucccaggc

SEQ ID NO: 1237614 - RNA, 23 nt, Human
aaguugcugcuucucccaggcaa

SEQ ID NO: 1237615 - RNA, 13 nt, Human
aauacucuuauau

SEQ ID NO: 1237616 - RNA, 15 nt, Human
aauacugaacaucug

SEQ ID NO: 1237617 - RNA, 17 nt, Human
aauacuaccuugaaaau

SEQ ID NO: 1237618 - RNA, 18 nt, Human
aauacuaccuugaaaaua

SEQ ID NO: 1237619 - RNA, 21 nt, Human
aauacuaccuugaaaauaaga

SEQ ID NO: 1237620 - RNA, 20 nt, Human
aauacucaaaugaguaacau

SEQ ID NO: 1237621 - RNA, 13 nt, Human
aauacucaaauga

SEQ ID NO: 1237622 - RNA, 15 nt, Human
aauacuugucuguuu

SEQ ID NO: 1237623 - RNA, 14 nt, Human
aauacuuugaaugu

SEQ ID NO: 1237624 - RNA, 15 nt, Human
aauacuuugaaugug

SEQ ID NO: 1237625 - RNA, 16 nt, Human
aauacuuugaaugugu

SEQ ID NO: 1237626 - RNA, 23 nt, Human
aauacuuugcagcacagcugaga

SEQ ID NO: 1237627 - RNA, 17 nt, Human
aauacuuugaauguguu

SEQ ID NO: 1237628 - RNA, 20 nt, Human
aauacuuugaauguguuuca

SEQ ID NO: 1237629 - RNA, 15 nt, Human
aauacuuuuacucug

SEQ ID NO: 1237630 - RNA, 18 nt, Human
aauacuuuuacucugccu

SEQ ID NO: 1237631 - RNA, 20 nt, Human
aauacuuuuacucugccuac

SEQ ID NO: 1237632 - RNA, 11 nt, Human
aauacuuuugc

SEQ ID NO: 1237633 - RNA, 15 nt, Human
aauacuuuuuacaau

SEQ ID NO: 1237634 - RNA, 10 nt, Human
aauacuuuuu

SEQ ID NO: 1237635 - RNA, 16 nt, Human
aauacugagaaaaccu

SEQ ID NO: 1237636 - RNA, 18 nt, Human
aauacugagaaaaccugu

SEQ ID NO: 1237637 - RNA, 14 nt, Human
aauacugcaaauca

SEQ ID NO: 1237638 - RNA, 23 nt, Human
aauacugcuacagcaauuucuaa

SEQ ID NO: 1237639 - RNA, 13 nt, Human
aauacugcugaga

SEQ ID NO: 1237640 - RNA, 15 nt, Human
aauacugcugagaua

SEQ ID NO: 1237641 - RNA, 18 nt, Human
aauacugcugagauacau

SEQ ID NO: 1237642 - RNA, 21 nt, Human
aauacugcugagauacauaca

SEQ ID NO: 1237643 - RNA, 16 nt, Human
aauacuguauuuugua

SEQ ID NO: 1237644 - RNA, 21 nt, Human
aauauuagugaccucagcuuu

SEQ ID NO: 1237645 - RNA, 18 nt, Human
aaucaccacaaacuguaa

SEQ ID NO: 1237646 - RNA, 23 nt, Human
aaucaaguuggcuucuaaucaaa

SEQ ID NO: 1237647 - RNA, 21 nt, Human
aaucaagucuguuuacugcaa

SEQ ID NO: 1237648 - RNA, 18 nt, Human
aaucacaugaauuauuac

SEQ ID NO: 1237649 - RNA, 19 nt, Human
aaucacauucgaguguuuc

SEQ ID NO: 1237650 - RNA, 14 nt, Human
aaucaagggucagg

SEQ ID NO: 1237651 - RNA, 15 nt, Human
aaucaagggucaggc

SEQ ID NO: 1237652 - RNA, 18 nt, Human
aaucaagggucaggccuu

SEQ ID NO: 1237653 - RNA, 15 nt, Human
aaucaagucuguuua

SEQ ID NO: 1237654 - RNA, 17 nt, Human
aaucaagucuguuuacu

SEQ ID NO: 1237655 - RNA, 16 nt, Human
aauagaauguaaaugu

SEQ ID NO: 1237656 - RNA, 16 nt, Human
aauagaauuauaacug

SEQ ID NO: 1237657 - RNA, 14 nt, Human
aauagacaaauaga

SEQ ID NO: 1237658 - RNA, 19 nt, Human
aauagacaaauagaaaaug

SEQ ID NO: 1237659 - RNA, 14 nt, Human
aauagaauguaaau

SEQ ID NO: 1237660 - RNA, 13 nt, Human
aauagaaggugau

SEQ ID NO: 1237661 - RNA, 15 nt, Human
aauagaauaaaggca

SEQ ID NO: 1237662 - RNA, 16 nt, Human
aauagaauaaaggcag

SEQ ID NO: 1237663 - RNA, 14 nt, Human
aauagaaggugaug

SEQ ID NO: 1237664 - RNA, 17 nt, Human
aauauacuauauuuaug

SEQ ID NO: 1237665 - RNA, 22 nt, Human
aauagacaaauagaaaaugguc

SEQ ID NO: 1237666 - RNA, 13 nt, Human
aauauauauuaua

SEQ ID NO: 1237667 - RNA, 14 nt, Human
aauauauauuauac

SEQ ID NO: 1237668 - RNA, 16 nt, Human
aauauauauuauacuu

SEQ ID NO: 1237669 - RNA, 19 nt, Human
aauauauauuauacuugua

SEQ ID NO: 1237670 - RNA, 21 nt, Human
aauauauauuauacuuguaau

SEQ ID NO: 1237671 - RNA, 23 nt, Human
aauauauauuauacuuguaauua

SEQ ID NO: 1237672 - RNA, 13 nt, Human
aauauauauuauc

SEQ ID NO: 1237673 - RNA, 15 nt, Human
aauauauauuaucuu

SEQ ID NO: 1237674 - RNA, 16 nt, Human
aauauauauuaucuuu

SEQ ID NO: 1237675 - RNA, 19 nt, Human
aauauauauuaucuuuuca

SEQ ID NO: 1237676 - RNA, 18 nt, Human
aauauauauuaucuuuuc

SEQ ID NO: 1237677 - RNA, 20 nt, Human
aauauaucuaccccagacua

SEQ ID NO: 1237678 - RNA, 18 nt, Human
aauccaagcaaaugugaa

SEQ ID NO: 1237679 - RNA, 17 nt, Human
aauccaagcaaauguga

SEQ ID NO: 1237680 - RNA, 21 nt, Human
aaugauuaugaauuacauuug

SEQ ID NO: 1237681 - RNA, 23 nt, Human
aaugauuaugaauuacauuugua

SEQ ID NO: 1237682 - RNA, 15 nt, Human
aaugauuaugaauua

SEQ ID NO: 1237683 - RNA, 19 nt, Human
aaugauccuguauucagac

SEQ ID NO: 1237684 - RNA, 21 nt, Human
aaugauccuguauucagacag

SEQ ID NO: 1237685 - RNA, 23 nt, Human
aaugauccuguauucagacagau

SEQ ID NO: 1237686 - RNA, 21 nt, Human
aaugaaauccugcuucagugu

SEQ ID NO: 1237687 - RNA, 17 nt, Human
aaugaaguuguagguaa

SEQ ID NO: 1237688 - RNA, 13 nt, Human
aauccagccugcu

SEQ ID NO: 1237689 - RNA, 23 nt, Human
aauccaaguagauaggaagaaag

SEQ ID NO: 1237690 - RNA, 20 nt, Human
aauccaggcagauccaggac

SEQ ID NO: 1237691 - RNA, 15 nt, Human
aauccaaugaaauga

SEQ ID NO: 1237692 - RNA, 17 nt, Human
aauccaggcagauccag

SEQ ID NO: 1237693 - RNA, 18 nt, Human
aauccaggcagauccagg

SEQ ID NO: 1237694 - RNA, 21 nt, Human
aaucucuacaaacccucugua

SEQ ID NO: 1237695 - RNA, 16 nt, Human
aaucucuccacuuuca

SEQ ID NO: 1237696 - RNA, 18 nt, Human
aaucucuccacuuucagc

SEQ ID NO: 1237697 - RNA, 23 nt, Human
aaucucuccacuuucagcugucu

SEQ ID NO: 1237698 - RNA, 19 nt, Human
aaucucuccacuuucagcu

SEQ ID NO: 1237699 - RNA, 20 nt, Human
aaucucuccacuuucagcug

SEQ ID NO: 1237700 - RNA, 22 nt, Human
aaucucuccacuuucagcuguc

SEQ ID NO: 1237701 - RNA, 13 nt, Human
aaucucugggggc

SEQ ID NO: 1237702 - RNA, 12 nt, Human
aaucucuguaaa

SEQ ID NO: 1237703 - RNA, 13 nt, Human
aaucucuguaaag

SEQ ID NO: 1237704 - RNA, 13 nt, Human
aaucucugugccu

SEQ ID NO: 1237705 - RNA, 20 nt, Human
aaucucuuuuugcuuucgaa

SEQ ID NO: 1237706 - RNA, 18 nt, Human
aaugaaagcuacucauag

SEQ ID NO: 1237707 - RNA, 20 nt, Human
aaggugaggagcuugaaacc

SEQ ID NO: 1237708 - RNA, 14 nt, Human
aaggucggaccagc

SEQ ID NO: 1237709 - RNA, 21 nt, Human
aagguccgguguucuaagaug

SEQ ID NO: 1237710 - RNA, 19 nt, Human
aagguccacaggucuagac

SEQ ID NO: 1237711 - RNA, 19 nt, Human
aagguccgguguucuaaga

SEQ ID NO: 1237712 - RNA, 20 nt, Human
aagguccucugucagucaca

SEQ ID NO: 1237713 - RNA, 20 nt, Human
aaggucguuuuuuucauucc

SEQ ID NO: 1237714 - RNA, 18 nt, Human
aaggucguuuuuuucauu

SEQ ID NO: 1237715 - RNA, 21 nt, Human
aaggugacaucggaaaaauaa

SEQ ID NO: 1237716 - RNA, 19 nt, Human
aaggugcucucuuucuguc

SEQ ID NO: 1237717 - RNA, 14 nt, Human
aaguaguccuguga

SEQ ID NO: 1237718 - RNA, 18 nt, Human
aaguccaagcauuuagau

SEQ ID NO: 1237719 - RNA, 12 nt, Human
aaguccaaugug

SEQ ID NO: 1237720 - RNA, 17 nt, Human
aaguccuacaagcuaaa

SEQ ID NO: 1237721 - RNA, 18 nt, Human
aaguccggccccaguaca

SEQ ID NO: 1237722 - RNA, 14 nt, Human
aagucuccaaaguc

SEQ ID NO: 1237723 - RNA, 11 nt, Human
aagucucagcu

SEQ ID NO: 1237724 - RNA, 12 nt, Human
aagucucagcua

SEQ ID NO: 1237725 - RNA, 20 nt, Human
aagucuaccaaccuguucaa

SEQ ID NO: 1237726 - RNA, 24 nt, Human
aagucguccuuacuccugugggag

SEQ ID NO: 1237727 - RNA, 22 nt, Human
aagucguccuuacuccuguggg

SEQ ID NO: 1237728 - RNA, 21 nt, Human
aaguccuuuuuuuccaucuuu

SEQ ID NO: 1237729 - RNA, 14 nt, Human
aagucgguuagugg

SEQ ID NO: 1237730 - RNA, 19 nt, Human
aagucguccuuacuccugu

SEQ ID NO: 1237731 - RNA, 20 nt, Human
aagucguccuuacuccugug

SEQ ID NO: 1237732 - RNA, 21 nt, Human
aagucguccuuacuccugugg

SEQ ID NO: 1237733 - RNA, 9 nt, Human
aagggagcc

SEQ ID NO: 1237734 - RNA, 11 nt, Human
aagggagccaa

SEQ ID NO: 1237735 - RNA, 12 nt, Human
aagggagccaag

SEQ ID NO: 1237736 - RNA, 13 nt, Human
aagggagccaagg

SEQ ID NO: 1237737 - RNA, 14 nt, Human
aagggagccaaggg

SEQ ID NO: 1237738 - RNA, 18 nt, Human
aagggagccaagggaugg

SEQ ID NO: 1237739 - RNA, 19 nt, Human
aagggagccaagggaugga

SEQ ID NO: 1237740 - RNA, 21 nt, Human
aagggagccaagggauggaca

SEQ ID NO: 1237741 - RNA, 20 nt, Human
aagggaaguaguuaucaugu

SEQ ID NO: 1237742 - RNA, 22 nt, Human
aagggaaguaguuaucauguua

SEQ ID NO: 1237743 - RNA, 15 nt, Human
aagggaaccuguguc

SEQ ID NO: 1237744 - RNA, 17 nt, Human
aagggccagagccaggg

SEQ ID NO: 1237745 - RNA, 13 nt, Human
aagggagggggag

SEQ ID NO: 1237746 - RNA, 21 nt, Human
aagggagggcucugaggcgcc

SEQ ID NO: 1237747 - RNA, 16 nt, Human
aagggagggcucugag

SEQ ID NO: 1237748 - RNA, 17 nt, Human
aagggagggcucugagg

SEQ ID NO: 1237749 - RNA, 18 nt, Human
aagggagggcucugaggc

SEQ ID NO: 1237750 - RNA, 19 nt, Human
aagggagggcucugaggcg

SEQ ID NO: 1237751 - RNA, 16 nt, Human
aagggaggcugcugcu

SEQ ID NO: 1237752 - RNA, 13 nt, Human
aagggagggcaga

SEQ ID NO: 1237753 - RNA, 18 nt, Human
aagggagggcagagcugg

SEQ ID NO: 1237754 - RNA, 19 nt, Human
aagggagggcagagcuggu

SEQ ID NO: 1237755 - RNA, 20 nt, Human
aagggagggcagagcuggug

SEQ ID NO: 1237756 - RNA, 21 nt, Human
aagggagggcagagcuggugc

SEQ ID NO: 1237757 - RNA, 13 nt, Human
aagggagggcucu

SEQ ID NO: 1237758 - RNA, 14 nt, Human
aagggagggcucug

SEQ ID NO: 1237759 - RNA, 12 nt, Human
aagggccaaaga

SEQ ID NO: 1237760 - RNA, 20 nt, Human
aagggccaaagaaccaaaga

SEQ ID NO: 1237761 - RNA, 22 nt, Human
aagggccaaagaaccaaagaag

SEQ ID NO: 1237762 - RNA, 11 nt, Human
aagggccagag

SEQ ID NO: 1237763 - RNA, 12 nt, Human
aagggccagagc

SEQ ID NO: 1237764 - RNA, 13 nt, Human
aagggccagagcc

SEQ ID NO: 1237765 - RNA, 14 nt, Human
aagggccagagcca

SEQ ID NO: 1237766 - RNA, 15 nt, Human
aagggccagagccag

SEQ ID NO: 1237767 - RNA, 16 nt, Human
aagggccagagccagg

SEQ ID NO: 1237768 - RNA, 16 nt, Human
aagggaaaagucucuu

SEQ ID NO: 1237769 - RNA, 15 nt, Human
aagucuccaaagucu

SEQ ID NO: 1237770 - RNA, 19 nt, Human
aagucucagcuaagcucac

SEQ ID NO: 1237771 - RNA, 17 nt, Human
aagucucaucuggggag

SEQ ID NO: 1237772 - RNA, 13 nt, Human
aagucuguccuug

SEQ ID NO: 1237773 - RNA, 16 nt, Human
aagucuguccuugaag

SEQ ID NO: 1237774 - RNA, 21 nt, Human
aagucuguccuugaaggacua

SEQ ID NO: 1237775 - RNA, 22 nt, Human
aagucugugagauucauucaug

SEQ ID NO: 1237776 - RNA, 18 nt, Human
aagucuguccuugaagga

SEQ ID NO: 1237777 - RNA, 20 nt, Human
aagucuguugauuaaagaug

SEQ ID NO: 1237778 - RNA, 13 nt, Human
aagucuguuuacu

SEQ ID NO: 1237779 - RNA, 14 nt, Human
aagucuguuuacug

SEQ ID NO: 1237780 - RNA, 16 nt, Human
aagucuguuuacugca

SEQ ID NO: 1237781 - RNA, 13 nt, Human
aaguugaggggcu

SEQ ID NO: 1237782 - RNA, 23 nt, Human
aaguugacuuauaguacaugaua

SEQ ID NO: 1237783 - RNA, 16 nt, Human
aaguugagauaguuuu

SEQ ID NO: 1237784 - RNA, 18 nt, Human
aaguugagauaguuuuca

SEQ ID NO: 1237785 - RNA, 23 nt, Human
aaguugagauaguuuucauccau

SEQ ID NO: 1237786 - RNA, 19 nt, Human
aaguugagauaguuuucau

SEQ ID NO: 1237787 - RNA, 21 nt, Human
aaguugacuuauaguacauga

SEQ ID NO: 1237788 - RNA, 20 nt, Human
aaguugacuuauaguacaug

SEQ ID NO: 1237789 - RNA, 19 nt, Human
aaguugacuuauaguacau

SEQ ID NO: 1237790 - RNA, 16 nt, Human
aaguugacuuauagua

SEQ ID NO: 1237791 - RNA, 14 nt, Human
aaguguaaugaaua

SEQ ID NO: 1237792 - RNA, 14 nt, Human
aaguguaauugaga

SEQ ID NO: 1237793 - RNA, 14 nt, Human
aaguguacauaugu

SEQ ID NO: 1237794 - RNA, 13 nt, Human
aagugcuuucuuc

SEQ ID NO: 1237795 - RNA, 20 nt, Human
aaguggaacgaaaaugaaag

SEQ ID NO: 1237796 - RNA, 18 nt, Human
aaguggacaaauuuugag

SEQ ID NO: 1237797 - RNA, 17 nt, Human
aaggacaucagcaaaca

SEQ ID NO: 1237798 - RNA, 17 nt, Human
aaggacuuccuguccag

SEQ ID NO: 1237799 - RNA, 20 nt, Human
aaggacuuccuguccagcuc

SEQ ID NO: 1237800 - RNA, 21 nt, Human
aaggacuuccuguccagcucc

SEQ ID NO: 1237801 - RNA, 22 nt, Human
aaggacuuccuguccagcucca

SEQ ID NO: 1237802 - RNA, 15 nt, Human
aaggacaucagcaaa

SEQ ID NO: 1237803 - RNA, 14 nt, Human
aaggacaucagcaa

SEQ ID NO: 1237804 - RNA, 13 nt, Human
aaggacagccccu

SEQ ID NO: 1237805 - RNA, 19 nt, Human
aaggacagccccuccucca

SEQ ID NO: 1237806 - RNA, 18 nt, Human
aagcuguguggcagucug

SEQ ID NO: 1237807 - RNA, 16 nt, Human
aagcugguuuaauguu

SEQ ID NO: 1237808 - RNA, 19 nt, Human
aagcuacugugugugugaa

SEQ ID NO: 1237809 - RNA, 14 nt, Human
aaggcagggaggag

SEQ ID NO: 1237810 - RNA, 23 nt, Human
aaggacuuccuguccagcuccaa

SEQ ID NO: 1237811 - RNA, 20 nt, Human
aaggauucugcuggccucug

SEQ ID NO: 1237812 - RNA, 22 nt, Human
aaggauucugcuggccucugcg

SEQ ID NO: 1237813 - RNA, 12 nt, Human
aaggcagggagg

SEQ ID NO: 1237814 - RNA, 21 nt, Human
aaggcaggcagggcucuccug

SEQ ID NO: 1237815 - RNA, 14 nt, Human
aaggcaggcagggc

SEQ ID NO: 1237816 - RNA, 16 nt, Human
aaggcaggcagggcuc

SEQ ID NO: 1237817 - RNA, 17 nt, Human
aaggcaggcagggcucu

SEQ ID NO: 1237818 - RNA, 18 nt, Human
aaggcaggcagggcucuc

SEQ ID NO: 1237819 - RNA, 22 nt, Human
aaggcaggcagggcucuccugg

SEQ ID NO: 1237820 - RNA, 20 nt, Human
aaggcagcucuaaaugucaa

SEQ ID NO: 1237821 - RNA, 20 nt, Human
aagcuacagaagaaacuggg

SEQ ID NO: 1237822 - RNA, 15 nt, Human
aagcuaauuugcauu

SEQ ID NO: 1237823 - RNA, 22 nt, Human
aagcuaauuugcauuaaauuca

SEQ ID NO: 1237824 - RNA, 23 nt, Human
aagcuaauuugcauuaaauucac

SEQ ID NO: 1237825 - RNA, 20 nt, Human
aagcgccuccaacccuagca

SEQ ID NO: 1237826 - RNA, 16 nt, Human
aagcgccuccaacccu

SEQ ID NO: 1237827 - RNA, 22 nt, Human
aagcgcuagaggaagcagccaa

SEQ ID NO: 1237828 - RNA, 14 nt, Human
aagcuaauuugcau

SEQ ID NO: 1237829 - RNA, 15 nt, Human
aagcgccuccaaccc

SEQ ID NO: 1237830 - RNA, 14 nt, Human
aagcgccuccaacc

SEQ ID NO: 1237831 - RNA, 14 nt, Human
aagauacugaaaua

SEQ ID NO: 1237832 - RNA, 20 nt, Human
aagauacuaaggacguuguu

SEQ ID NO: 1237833 - RNA, 18 nt, Human
aagaugugcagcauuuca

SEQ ID NO: 1237834 - RNA, 20 nt, Human
aagaugugcagcauuucacu

SEQ ID NO: 1237835 - RNA, 21 nt, Human
aagaugugcagcauuucacuu

SEQ ID NO: 1237836 - RNA, 21 nt, Human
aagaugugauauucuaagacu

SEQ ID NO: 1237837 - RNA, 16 nt, Human
aagauguuaugguguu

SEQ ID NO: 1237838 - RNA, 15 nt, Human
aagauguucuggaua

SEQ ID NO: 1237839 - RNA, 20 nt, Human
aagauguucuggauaccauu

SEQ ID NO: 1237840 - RNA, 20 nt, Human
aagauguuaugguguuuaga

SEQ ID NO: 1237841 - RNA, 20 nt, Human
aagauuacaaaucagaaguc

SEQ ID NO: 1237842 - RNA, 21 nt, Human
aagauuacaaaucagaaguca

SEQ ID NO: 1237843 - RNA, 20 nt, Human
aagauuacucaguaauuugu

SEQ ID NO: 1237844 - RNA, 21 nt, Human
aagauuccggauccuaagcau

SEQ ID NO: 1237845 - RNA, 24 nt, Human
aagauuccggauccuaagcaucua

SEQ ID NO: 1237846 - RNA, 11 nt, Human
aagauucuaaa

SEQ ID NO: 1237847 - RNA, 12 nt, Human
aagauucuaaag

SEQ ID NO: 1237848 - RNA, 13 nt, Human
aagauucuaaagg

SEQ ID NO: 1237849 - RNA, 14 nt, Human
aagauucuaaugau

SEQ ID NO: 1237850 - RNA, 16 nt, Human
aagauucuaaugauga

SEQ ID NO: 1237851 - RNA, 11 nt, Human
aagauucuaga

SEQ ID NO: 1237852 - RNA, 12 nt, Human
aagauucuagau

SEQ ID NO: 1237853 - RNA, 13 nt, Human
aagauucuagauc

SEQ ID NO: 1237854 - RNA, 20 nt, Human
aagauucuagaucagaugcu

SEQ ID NO: 1237855 - RNA, 13 nt, Human
aagauucuagaug

SEQ ID NO: 1237856 - RNA, 14 nt, Human
aagauucuagauga

SEQ ID NO: 1237857 - RNA, 15 nt, Human
aagauucuagaugau

SEQ ID NO: 1237858 - RNA, 17 nt, Human
aagauucuauaguucua

SEQ ID NO: 1237859 - RNA, 19 nt, Human
aagauucuauaguucuaga

SEQ ID NO: 1237860 - RNA, 13 nt, Human
aagauacugaaau

SEQ ID NO: 1237861 - RNA, 21 nt, Human
aagauaaacguggauguuacu

SEQ ID NO: 1237862 - RNA, 13 nt, Human
aagauaaacauua

SEQ ID NO: 1237863 - RNA, 22 nt, Human
aagauaaacacaagauuggugu

SEQ ID NO: 1237864 - RNA, 14 nt, Human
aagaguuuugggag

SEQ ID NO: 1237865 - RNA, 17 nt, Human
aagauaaacacaagauu

SEQ ID NO: 1237866 - RNA, 13 nt, Human
aagaguuuuggga

SEQ ID NO: 1237867 - RNA, 23 nt, Human
aagaguuuugggaguuguaguua

SEQ ID NO: 1237868 - RNA, 16 nt, Human
aacuuuccaaacacca

SEQ ID NO: 1237869 - RNA, 14 nt, Human
aacuuuccucgccu

SEQ ID NO: 1237870 - RNA, 19 nt, Human
aacuuucauuccuucagau

SEQ ID NO: 1237871 - RNA, 14 nt, Human
aagagucuagauuc

SEQ ID NO: 1237872 - RNA, 20 nt, Human
aagagucuagauucaaaggu

SEQ ID NO: 1237873 - RNA, 23 nt, Human
aagagucuagauucaaagguucu

SEQ ID NO: 1237874 - RNA, 18 nt, Human
aagagugaauucccucac

SEQ ID NO: 1237875 - RNA, 23 nt, Human
aagagugauagucuuuugcuuuu

SEQ ID NO: 1237876 - RNA, 22 nt, Human
aagaguuugaugaggcccucca

SEQ ID NO: 1237877 - RNA, 19 nt, Human
aagccagcguccuccucug

SEQ ID NO: 1237878 - RNA, 14 nt, Human
aagccagcguccuc

SEQ ID NO: 1237879 - RNA, 17 nt, Human
aagccagcguccuccuc

SEQ ID NO: 1237880 - RNA, 16 nt, Human
aagcagccucucccca

SEQ ID NO: 1237881 - RNA, 17 nt, Human
aagcagccucuccccag

SEQ ID NO: 1237882 - RNA, 22 nt, Human
aagcagccucuccccaggucca

SEQ ID NO: 1237883 - RNA, 20 nt, Human
aagauucuauaguucuagac

SEQ ID NO: 1237884 - RNA, 14 nt, Human
aagcagcaacuauu

SEQ ID NO: 1237885 - RNA, 16 nt, Human
aagcagcaacuauuca

SEQ ID NO: 1237886 - RNA, 19 nt, Human
aagcagcaacuuguccuag

SEQ ID NO: 1237887 - RNA, 16 nt, Human
aagcagcacuuauaaa

SEQ ID NO: 1237888 - RNA, 12 nt, Human
aagcagcagccu

SEQ ID NO: 1237889 - RNA, 14 nt, Human
aagcagcagccucg

SEQ ID NO: 1237890 - RNA, 16 nt, Human
aagcagcagccucgcc

SEQ ID NO: 1237891 - RNA, 21 nt, Human
aagcagcagccucgccccugg

SEQ ID NO: 1237892 - RNA, 19 nt, Human
aagcagcgaccgcccccuc

SEQ ID NO: 1237893 - RNA, 20 nt, Human
aagcagcgaccgcccccucc

SEQ ID NO: 1237894 - RNA, 17 nt, Human
aagccaauucagacagg

SEQ ID NO: 1237895 - RNA, 14 nt, Human
aagccaauuucaau

SEQ ID NO: 1237896 - RNA, 21 nt, Human
aagccaauuucaaucuuauuu

SEQ ID NO: 1237897 - RNA, 12 nt, Human
aaaucuggaagc

SEQ ID NO: 1237898 - RNA, 14 nt, Human
aaaucuggcuucug

SEQ ID NO: 1237899 - RNA, 18 nt, Human
aaaucuggcuucuggcca

SEQ ID NO: 1237900 - RNA, 21 nt, Human
aaaucuggcuucuggccagga

SEQ ID NO: 1237901 - RNA, 20 nt, Human
aaaucaaucuguaaaacuaa

SEQ ID NO: 1237902 - RNA, 23 nt, Human
aaaucaaguauuugggaagugaa

SEQ ID NO: 1237903 - RNA, 18 nt, Human
aaaucaaguauuugggaa

SEQ ID NO: 1237904 - RNA, 19 nt, Human
aaaucaaugcuauaacuau

SEQ ID NO: 1237905 - RNA, 19 nt, Human
aaaucaauuacugguccaa

SEQ ID NO: 1237906 - RNA, 23 nt, Human
aaaucaauuacugguccaaaaga

SEQ ID NO: 1237907 - RNA, 19 nt, Human
aaaucacauauuuuaaaau

SEQ ID NO: 1237908 - RNA, 15 nt, Human
aaauauuuauuuuaa

SEQ ID NO: 1237909 - RNA, 13 nt, Human
aaauauuuauuuu

SEQ ID NO: 1237910 - RNA, 20 nt, Human
aaauauuuauuuuaauaaug

SEQ ID NO: 1237911 - RNA, 14 nt, Human
aaauaguuuggaua

SEQ ID NO: 1237912 - RNA, 17 nt, Human
aaauagcuuuuuucucu

SEQ ID NO: 1237913 - RNA, 23 nt, Human
aaauagcuuggguagcgcacucu

SEQ ID NO: 1237914 - RNA, 16 nt, Human
aaauagcuuaugaaaa

SEQ ID NO: 1237915 - RNA, 21 nt, Human
aaauagcguucuuguaauuuu

SEQ ID NO: 1237916 - RNA, 20 nt, Human
aaauagcguucuuguaauuu

SEQ ID NO: 1237917 - RNA, 20 nt, Human
aaauagcuuuuuucucugau

SEQ ID NO: 1237918 - RNA, 15 nt, Human
aaauagcuuaugaaa

SEQ ID NO: 1237919 - RNA, 15 nt, Human
aaauaggguauauuu

SEQ ID NO: 1237920 - RNA, 14 nt, Human
aaauaggcaggaag

SEQ ID NO: 1237921 - RNA, 16 nt, Human
aaauagggucuaacuc

SEQ ID NO: 1237922 - RNA, 20 nt, Human
aaauaggguauauuuuccua

SEQ ID NO: 1237923 - RNA, 17 nt, Human
aaauaguuaagacauga

SEQ ID NO: 1237924 - RNA, 22 nt, Human
aaauaguuaagacaugauuucc

SEQ ID NO: 1237925 - RNA, 15 nt, Human
aaauagcguucuugu

SEQ ID NO: 1237926 - RNA, 17 nt, Human
aaauagcguucuuguaa

SEQ ID NO: 1237927 - RNA, 18 nt, Human
aaauagcguucuuguaau

SEQ ID NO: 1237928 - RNA, 19 nt, Human
aaauagcguucuuguaauu

SEQ ID NO: 1237929 - RNA, 17 nt, Human
aaauaaaaggaagccaa

SEQ ID NO: 1237930 - RNA, 13 nt, Human
aaaguggaacgaa

SEQ ID NO: 1237931 - RNA, 20 nt, Human
aaaguggaacgaaaaugaaa

SEQ ID NO: 1237932 - RNA, 19 nt, Human
aaaguggccaagaagcagu

SEQ ID NO: 1237933 - RNA, 19 nt, Human
aaaguggaaaacaaggaag

SEQ ID NO: 1237934 - RNA, 20 nt, Human
aaaguggaaaacaaggaagu

SEQ ID NO: 1237935 - RNA, 16 nt, Human
aaaguccuuuuuuucc

SEQ ID NO: 1237936 - RNA, 18 nt, Human
aaaguccuuuuuuuccau

SEQ ID NO: 1237937 - RNA, 22 nt, Human
aaaguccuuuuuuuccaucuuu

SEQ ID NO: 1237938 - RNA, 15 nt, Human
aaauaaauguaucau

SEQ ID NO: 1237939 - RNA, 21 nt, Human
aaaggccuaauucuaugccug

SEQ ID NO: 1237940 - RNA, 10 nt, Human
aaaggccugg

SEQ ID NO: 1237941 - RNA, 11 nt, Human
aaaggccuggg

SEQ ID NO: 1237942 - RNA, 12 nt, Human
aaaggccugggg

SEQ ID NO: 1237943 - RNA, 13 nt, Human
aaaggccuggggu

SEQ ID NO: 1237944 - RNA, 19 nt, Human
aaaggcagaagcaacccaa

SEQ ID NO: 1237945 - RNA, 14 nt, Human
aaaggcagaagcaa

SEQ ID NO: 1237946 - RNA, 21 nt, Human
aaaggcacccccgucaagagu

SEQ ID NO: 1237947 - RNA, 22 nt, Human
aaagcccuuccaugucgccucu

SEQ ID NO: 1237948 - RNA, 23 nt, Human
aaagcccuuccaugucgccucug

SEQ ID NO: 1237949 - RNA, 15 nt, Human
aaagccaggucccuc

SEQ ID NO: 1237950 - RNA, 20 nt, Human
aaagccucaagguuuuaggu

SEQ ID NO: 1237951 - RNA, 12 nt, Human
aaaggcaaaggc

SEQ ID NO: 1237952 - RNA, 14 nt, Human
aaaggcaagcacuu

SEQ ID NO: 1237953 - RNA, 13 nt, Human
aaaggcaaggucc

SEQ ID NO: 1237954 - RNA, 19 nt, Human
aaagccaggucccucucau

SEQ ID NO: 1237955 - RNA, 21 nt, Human
aaagccagcguccuccucugu

SEQ ID NO: 1237956 - RNA, 23 nt, Human
aaagccaaggagucacugagacc

SEQ ID NO: 1237957 - RNA, 14 nt, Human
aaagccaagggcaa

SEQ ID NO: 1237958 - RNA, 13 nt, Human
aaaaguugaauuu

SEQ ID NO: 1237959 - RNA, 19 nt, Human
aaaauaaaauuaaagcuga

SEQ ID NO: 1237960 - RNA, 12 nt, Human
aaaauaaacaaa

SEQ ID NO: 1237961 - RNA, 14 nt, Human
aaaauaaacaaaua

SEQ ID NO: 1237962 - RNA, 18 nt, Human
aaaaguucugcagauaaa

SEQ ID NO: 1237963 - RNA, 13 nt, Human
aaaaguuccaaga

SEQ ID NO: 1237964 - RNA, 15 nt, Human
aaaaguuccaagagu

SEQ ID NO: 1237965 - RNA, 22 nt, Human
aaaaguuccaagagucuaaaga

SEQ ID NO: 1237966 - RNA, 23 nt, Human
aaaaguuccaagagucuaaagau

SEQ ID NO: 1237967 - RNA, 18 nt, Human
aaaaguuacauguuugca

SEQ ID NO: 1237968 - RNA, 19 nt, Human
aaaaguuacauguuugcac

SEQ ID NO: 1237969 - RNA, 12 nt, Human
aaaaguuauaac

SEQ ID NO: 1237970 - RNA, 21 nt, Human
aaaaucuacacuccagugaga

SEQ ID NO: 1237971 - RNA, 13 nt, Human
aaaauccuugcuu

SEQ ID NO: 1237972 - RNA, 20 nt, Human
aaaauccuugcuuaugacau

SEQ ID NO: 1237973 - RNA, 20 nt, Human
aaaauaaacaggucaaugaa

SEQ ID NO: 1237974 - RNA, 16 nt, Human
aaaauaaagaaaagau

SEQ ID NO: 1237975 - RNA, 14 nt, Human
aaaauaaagaaaua

SEQ ID NO: 1237976 - RNA, 21 nt, Human
aaaauaaagaaaagaugcacu

SEQ ID NO: 1237977 - RNA, 12 nt, Human
aaaauaaagaau

SEQ ID NO: 1237978 - RNA, 13 nt, Human
aaaauaaagaaug

SEQ ID NO: 1237979 - RNA, 21 nt, Human
aaaaucagguggcuuuugcgg

SEQ ID NO: 1237980 - RNA, 15 nt, Human
aaaaucaucagaaag

SEQ ID NO: 1237981 - RNA, 13 nt, Human
aaaaucaucagaa

SEQ ID NO: 1237982 - RNA, 16 nt, Human
aaaaagaaacauuugg

SEQ ID NO: 1237983 - RNA, 23 nt, Human
aaaaacucaauuaaaauuuuguu

SEQ ID NO: 1237984 - RNA, 14 nt, Human
aaaaagaagaaucu

SEQ ID NO: 1237985 - RNA, 19 nt, Human
aaaaagaaaggcuguuaaa

SEQ ID NO: 1237986 - RNA, 23 nt, Human
aaaaagaaaggcuguuaaauaca

SEQ ID NO: 1237987 - RNA, 20 nt, Human
aaaagugccauuaacaaaug

SEQ ID NO: 1237988 - RNA, 18 nt, Human
aaaagugggcuugauucu

SEQ ID NO: 1237989 - RNA, 17 nt, Human
aaaagugggcuugauuc

SEQ ID NO: 1237990 - RNA, 23 nt, Human
aaaaguggguuuuuuaguugaau

SEQ ID NO: 1237991 - RNA, 21 nt, Human
aaacacugggagaaaugaaaa

SEQ ID NO: 1237992 - RNA, 22 nt, Human
aaacacucaaguugauuagaaa

SEQ ID NO: 1237993 - RNA, 22 nt, Human
aaacacugggagaaaugaaaaa

SEQ ID NO: 1237994 - RNA, 13 nt, Human
aaacacugugcac

SEQ ID NO: 1237995 - RNA, 12 nt, Human
aaacacuuguaa

SEQ ID NO: 1237996 - RNA, 21 nt, Human
aaaauugaugggauuugguca

SEQ ID NO: 1237997 - RNA, 15 nt, Human
aaaauugcaaaucuu

SEQ ID NO: 1237998 - RNA, 16 nt, Human
aaaaucucaauauuuc

SEQ ID NO: 1237999 - RNA, 17 nt, Human
aaaaucucaauauuuca

SEQ ID NO: 1238000 - RNA, 12 nt, Human
aaacagaagccu

SEQ ID NO: 1238001 - RNA, 12 nt, Human
aaacagacacug

SEQ ID NO: 1238002 - RNA, 14 nt, Human
aaacagaacacuua

SEQ ID NO: 1238003 - RNA, 13 nt, Human
aaacagaacacuu

SEQ ID NO: 1238004 - RNA, 13 nt, Human
aaacagaaugucu

SEQ ID NO: 1238005 - RNA, 13 nt, Human
aaacagaaacaaa

SEQ ID NO: 1238006 - RNA, 19 nt, Human
aaacagaaacaaaaacacu

SEQ ID NO: 1238007 - RNA, 21 nt, Human
aaacagaaacaaaaacacuaa

SEQ ID NO: 1238008 - RNA, 12 nt, Human
aaacagaacacu

SEQ ID NO: 1238009 - RNA, 17 nt, Human
aaagaaauauaccuaaa

SEQ ID NO: 1238010 - RNA, 14 nt, Human
aaacugaggaauuu

SEQ ID NO: 1238011 - RNA, 19 nt, Human
aaacugaggaauuucaccu

SEQ ID NO: 1238012 - RNA, 18 nt, Human
aaacugaggaauuuucuu

SEQ ID NO: 1238013 - RNA, 19 nt, Human
aaacugaggaauuuucuuu

SEQ ID NO: 1238014 - RNA, 21 nt, Human
aaagagucuagauucaaaggu

SEQ ID NO: 1238015 - RNA, 15 nt, Human
aaagagucuagauuc

SEQ ID NO: 1238016 - RNA, 21 nt, Human
aaagaagggcugguauuguuc

SEQ ID NO: 1238017 - RNA, 15 nt, Human
aaagaaguaaaagca

SEQ ID NO: 1238018 - RNA, 20 nt, Human
aaagaguccauuguuuaaaa

SEQ ID NO: 1238019 - RNA, 21 nt, Human
aaagaguccauuguuuaaaaa

SEQ ID NO: 1238020 - RNA, 13 nt, Human
aaagagucuagau

SEQ ID NO: 1238021 - RNA, 14 nt, Human
aaagagucuagauu

SEQ ID NO: 1238022 - RNA, 20 nt, Human
aaagaagguuucagaaagaa

SEQ ID NO: 1238023 - RNA, 16 nt, Human
aaagaagcccccagcu

SEQ ID NO: 1238024 - RNA, 14 nt, Human
aaagaagaccugag

SEQ ID NO: 1238025 - RNA, 18 nt, Human
aaagaagaccugagaaug

SEQ ID NO: 1238026 - RNA, 22 nt, Human
aaagaagaccugagaauguauc

SEQ ID NO: 1238027 - RNA, 20 nt, Human
aaagaagaccugagaaugua

SEQ ID NO: 1238028 - RNA, 22 nt, Human
aaagaagagcgagagaucaaag

SEQ ID NO: 1238029 - RNA, 14 nt, Human
aaagaguucaagaa

SEQ ID NO: 1238030 - RNA, 20 nt, Human
aaagaguucaagaaauaagu

SEQ ID NO: 1238031 - RNA, 16 nt, Human
aaagaguucaagaaau

SEQ ID NO: 1238032 - RNA, 12 nt, Human
aaagauaaacac

SEQ ID NO: 1238033 - RNA, 16 nt, Human
aaagauaaacacaaga

SEQ ID NO: 1238034 - RNA, 17 nt, Human
aaagauaaacacaagau

SEQ ID NO: 1238035 - RNA, 18 nt, Human
aaagauaaacacaagauu

SEQ ID NO: 1238036 - RNA, 23 nt, Human
aaaccaucucccuggugcuuaug

SEQ ID NO: 1238037 - RNA, 23 nt, Human
aaaccaugaagagauuuuucaug

SEQ ID NO: 1238038 - RNA, 22 nt, Human
aaaccaucaaguugugccaaau

SEQ ID NO: 1238039 - RNA, 13 nt, Human
aaaccaucucccu

SEQ ID NO: 1238040 - RNA, 15 nt, Human
aaaccaucucccugg

SEQ ID NO: 1238041 - RNA, 19 nt, Human
aaaccaucucccuggugcu

SEQ ID NO: 1238042 - RNA, 22 nt, Human
aaaccaucucccuggugcuuau

SEQ ID NO: 1238043 - RNA, 15 nt, Human
aaaccaugcaaaugc

SEQ ID NO: 1238044 - RNA, 13 nt, Human
aaaccauguagaa

SEQ ID NO: 1238045 - RNA, 22 nt, Human
aaaccaugcucuggcauguuga

SEQ ID NO: 1238046 - RNA, 18 nt, Human
aaaccccuguaggccuca

SEQ ID NO: 1238047 - RNA, 16 nt, Human
aaacccuauugguaaa

SEQ ID NO: 1238048 - RNA, 15 nt, Human
aaacccuagccuugc

SEQ ID NO: 1238049 - RNA, 16 nt, Human
aaacccuagccuugcu

SEQ ID NO: 1238050 - RNA, 18 nt, Human
aaacccuagccuugcuug

SEQ ID NO: 1238051 - RNA, 13 nt, Human
aaacccuagccuu

SEQ ID NO: 1238052 - RNA, 14 nt, Human
aaacccuagccuug

SEQ ID NO: 1238053 - RNA, 17 nt, Human
aaacccuagccuugcuu

SEQ ID NO: 1238054 - RNA, 12 nt, Human
aacagcuggugu

SEQ ID NO: 1238055 - RNA, 13 nt, Human
aacagcuggugua

SEQ ID NO: 1238056 - RNA, 16 nt, Human
aacagcugguguagcu

SEQ ID NO: 1238057 - RNA, 17 nt, Human
aacagcugguguagcua

SEQ ID NO: 1238058 - RNA, 20 nt, Human
aacagcugguguagcuacag

SEQ ID NO: 1238059 - RNA, 21 nt, Human
aacagcugguguagcuacaga

SEQ ID NO: 1238060 - RNA, 23 nt, Human
aacagcugguguagcuacagaga

SEQ ID NO: 1238061 - RNA, 10 nt, Human
aacagcaucu

SEQ ID NO: 1238062 - RNA, 15 nt, Human
aacagcaucuccaag

SEQ ID NO: 1238063 - RNA, 19 nt, Human
aacagcaucuccaagcagc

SEQ ID NO: 1238064 - RNA, 21 nt, Human
aacagcaucuccaagcagcuu

SEQ ID NO: 1238065 - RNA, 22 nt, Human
aacagcauguacggauuuucag

SEQ ID NO: 1238066 - RNA, 20 nt, Human
aacagcaccaaaucaaaauc

SEQ ID NO: 1238067 - RNA, 19 nt, Human
aacagcagacucagcucug

SEQ ID NO: 1238068 - RNA, 20 nt, Human
aacagcagacucagcucuga

SEQ ID NO: 1238069 - RNA, 17 nt, Human
aaccuagggugauauua

SEQ ID NO: 1238070 - RNA, 23 nt, Human
aaccuacagagaugcuaagagaa

SEQ ID NO: 1238071 - RNA, 20 nt, Human
aaccuacaguuuuaacugug

SEQ ID NO: 1238072 - RNA, 11 nt, Human
aaccuagagau

SEQ ID NO: 1238073 - RNA, 14 nt, Human
aacccuagcaaaag

SEQ ID NO: 1238074 - RNA, 17 nt, Human
aacccguggaggcugcu

SEQ ID NO: 1238075 - RNA, 13 nt, Human
aacccuagccuug

SEQ ID NO: 1238076 - RNA, 23 nt, Human
aacccuaaauaauaaaaauaaac

SEQ ID NO: 1238077 - RNA, 18 nt, Human
aacccguggaggcugcuc

SEQ ID NO: 1238078 - RNA, 16 nt, Human
aacccuagccuugcuu

SEQ ID NO: 1238079 - RNA, 18 nt, Human
aacccuagccuugcuugu

SEQ ID NO: 1238080 - RNA, 19 nt, Human
aacccuagccuugcuuguu

SEQ ID NO: 1238081 - RNA, 21 nt, Human
aacccuauacuguaguauucu

SEQ ID NO: 1238082 - RNA, 12 nt, Human
aaccagaucauu

SEQ ID NO: 1238083 - RNA, 16 nt, Human
aaccagauauauauuc

SEQ ID NO: 1238084 - RNA, 15 nt, Human
aacccgucuggccca

SEQ ID NO: 1238085 - RNA, 14 nt, Human
aacccgugccaagu

SEQ ID NO: 1238086 - RNA, 13 nt, Human
aacccguggaggc

SEQ ID NO: 1238087 - RNA, 14 nt, Human
aacccguggaggcu

SEQ ID NO: 1238088 - RNA, 15 nt, Human
aacccguggaggcug

SEQ ID NO: 1238089 - RNA, 21 nt, Human
aaccgaacugauguaaguaaa

SEQ ID NO: 1238090 - RNA, 16 nt, Human
aacccuuugugugcuc

SEQ ID NO: 1238091 - RNA, 20 nt, Human
aacccuuugugugcucucca

SEQ ID NO: 1238092 - RNA, 20 nt, Human
aacccucacaucagagugac

SEQ ID NO: 1238093 - RNA, 14 nt, Human
aacccuugggccag

SEQ ID NO: 1238094 - RNA, 15 nt, Human
aacccuugggccaga

SEQ ID NO: 1238095 - RNA, 18 nt, Human
aacccuugggccagaagu

SEQ ID NO: 1238096 - RNA, 20 nt, Human
aacccuugggccagaaguac

SEQ ID NO: 1238097 - RNA, 15 nt, Human
aacccuauugguaaa

SEQ ID NO: 1238098 - RNA, 12 nt, Human
aacccucagagc

SEQ ID NO: 1238099 - RNA, 21 nt, Human
aacccuuggagccaauggaga

SEQ ID NO: 1238100 - RNA, 15 nt, Human
aacaucccuccuggg

SEQ ID NO: 1238101 - RNA, 22 nt, Human
aacagcugguguagcuacagag

SEQ ID NO: 1238102 - RNA, 16 nt, Human
aacagcuucucaauuu

SEQ ID NO: 1238103 - RNA, 11 nt, Human
aacauccaaaa

SEQ ID NO: 1238104 - RNA, 15 nt, Human
aacauccaaaaucuu

SEQ ID NO: 1238105 - RNA, 15 nt, Human
aaccagagugcugaa

SEQ ID NO: 1238106 - RNA, 14 nt, Human
aaccagacucuugc

SEQ ID NO: 1238107 - RNA, 17 nt, Human
aaccacuuuuugcagcu

SEQ ID NO: 1238108 - RNA, 15 nt, Human
aaccacuuuuugcag

SEQ ID NO: 1238109 - RNA, 14 nt, Human
aaccacuuuuugca

SEQ ID NO: 1238110 - RNA, 21 nt, Human
aaccacuuucuuauuuuuuuc

SEQ ID NO: 1238111 - RNA, 22 nt, Human
aaccacuuucuuauuuuuuucu

SEQ ID NO: 1238112 - RNA, 15 nt, Human
aaccacgccucuuga

SEQ ID NO: 1238113 - RNA, 17 nt, Human
aacacuaacaugauuug

SEQ ID NO: 1238114 - RNA, 18 nt, Human
aacacuaacauauaaugu

SEQ ID NO: 1238115 - RNA, 13 nt, Human
aacacggccacau

SEQ ID NO: 1238116 - RNA, 21 nt, Human
aacacggccacaucaaagagg

SEQ ID NO: 1238117 - RNA, 21 nt, Human
aacacguaucccaccugacau

SEQ ID NO: 1238118 - RNA, 14 nt, Human
aacacuaaaaauaa

SEQ ID NO: 1238119 - RNA, 15 nt, Human
aacacuaaaaauaaa

SEQ ID NO: 1238120 - RNA, 18 nt, Human
aaauuuuuuuuacauuuu

SEQ ID NO: 1238121 - RNA, 17 nt, Human
aaauuuuuuuuacauuu

SEQ ID NO: 1238122 - RNA, 16 nt, Human
aaauuuuuuuuacauu

SEQ ID NO: 1238123 - RNA, 19 nt, Human
aacaaaaacacuaaaaaua

SEQ ID NO: 1238124 - RNA, 18 nt, Human
aacaaauuuacagagaca

SEQ ID NO: 1238125 - RNA, 14 nt, Human
aacaacacuguagu

SEQ ID NO: 1238126 - RNA, 20 nt, Human
aacaacauguuuccagcauu

SEQ ID NO: 1238127 - RNA, 14 nt, Human
aacaaccucaacug

SEQ ID NO: 1238128 - RNA, 18 nt, Human
aacaaccucaacugccua

SEQ ID NO: 1238129 - RNA, 14 nt, Human
aacacauuucaaau

SEQ ID NO: 1238130 - RNA, 16 nt, Human
aacacauuucaaauga

SEQ ID NO: 1238131 - RNA, 21 nt, Human
aacacauuucaaaugaguuuu

SEQ ID NO: 1238132 - RNA, 20 nt, Human
aacaccauagguagaaugua

SEQ ID NO: 1238133 - RNA, 18 nt, Human
aacaccaugauuccuuua

SEQ ID NO: 1238134 - RNA, 19 nt, Human
aacaccaugauuccuuuaa

SEQ ID NO: 1238135 - RNA, 20 nt, Human
aacaccaugauuccuuuaac

SEQ ID NO: 1238136 - RNA, 15 nt, Human
aacaccauugaaggc

SEQ ID NO: 1238137 - RNA, 17 nt, Human
aacaccauugaaggcuu

SEQ ID NO: 1238138 - RNA, 19 nt, Human
aacaccauugaaggcuuaa

SEQ ID NO: 1238139 - RNA, 15 nt, Human
aaaugccuuuguacu

SEQ ID NO: 1238140 - RNA, 15 nt, Human
aaaugcgguuauaaa

SEQ ID NO: 1238141 - RNA, 22 nt, Human
aaaugcgguuauaaaaaauggu

SEQ ID NO: 1238142 - RNA, 23 nt, Human
aaaugcgguuauaaaaaaugguu

SEQ ID NO: 1238143 - RNA, 16 nt, Human
aaaugccuuuucccaa

SEQ ID NO: 1238144 - RNA, 21 nt, Human
aaaugccuuuucccaaaaugu

SEQ ID NO: 1238145 - RNA, 16 nt, Human
aaaugcgggguggggg

SEQ ID NO: 1238146 - RNA, 17 nt, Human
aaaucuuauaauuuaaa

SEQ ID NO: 1238147 - RNA, 16 nt, Human
aaaucuuauaguucua

SEQ ID NO: 1238148 - RNA, 17 nt, Human
aaaucuuauaguucuag

SEQ ID NO: 1238149 - RNA, 18 nt, Human
aaaucuuauaguucuagg

SEQ ID NO: 1238150 - RNA, 19 nt, Human
aaaucuuauaguucuaggc

SEQ ID NO: 1238151 - RNA, 20 nt, Human
aaaucuuauaguucuaggca

SEQ ID NO: 1238152 - RNA, 18 nt, Human
aaauguuuaaucauauaa

SEQ ID NO: 1238153 - RNA, 19 nt, Human
aaauguuuaaucauauaaa

SEQ ID NO: 1238154 - RNA, 17 nt, Human
aaauguuuaaucauaua

SEQ ID NO: 1238155 - RNA, 15 nt, Human
aaauguuuaaucaua

SEQ ID NO: 1238156 - RNA, 14 nt, Human
aaauguuuaaucau

SEQ ID NO: 1238157 - RNA, 13 nt, Human
aaauguuuaauca

SEQ ID NO: 1238158 - RNA, 11 nt, Human
aaauguuuaau

SEQ ID NO: 1238159 - RNA, 17 nt, Human
aaauguuggucauuuua

SEQ ID NO: 1238160 - RNA, 19 nt, Human
aaauguuggucauuuuaug

SEQ ID NO: 1238161 - RNA, 15 nt, Human
aaauuuuuuuuacau

SEQ ID NO: 1238162 - RNA, 19 nt, Human
aaauugcugacuguagcuu

SEQ ID NO: 1238163 - RNA, 23 nt, Human
aaauugcugacuguagcuuugga

SEQ ID NO: 1238164 - RNA, 14 nt, Human
aaauugcuccuuga

SEQ ID NO: 1238165 - RNA, 13 nt, Human
aaauugcuccuug

SEQ ID NO: 1238166 - RNA, 14 nt, Human
aaauugaaugcaaa

SEQ ID NO: 1238167 - RNA, 22 nt, Human
aaauugacacuuaaaaaugguu

SEQ ID NO: 1238168 - RNA, 19 nt, Human
aaauugacacuuaaaaaug

SEQ ID NO: 1238169 - RNA, 14 nt, Human
aaauugaauacuuu

SEQ ID NO: 1238170 - RNA, 17 nt, Human
aaauugaauacuuugaa

SEQ ID NO: 1238171 - RNA, 18 nt, Human
aaauugaauacuuugaau

SEQ ID NO: 1238172 - RNA, 19 nt, Human
aaauugaauacuuugaaug

SEQ ID NO: 1238173 - RNA, 21 nt, Human
aaauugaauacuuugaaugug

SEQ ID NO: 1238174 - RNA, 15 nt, Human
aaauugaaugcaaac

SEQ ID NO: 1238175 - RNA, 20 nt, Human
aaauugaauacuuugaaugu

SEQ ID NO: 1238176 - RNA, 13 nt, Human
aaauugaaugcaa

SEQ ID NO: 1238177 - RNA, 19 nt, Human
aaauuaaaccggaccaucu

SEQ ID NO: 1238178 - RNA, 19 nt, Human
aaauuaaacuuauuuacaa

SEQ ID NO: 1238179 - RNA, 13 nt, Human
aaauuaaagcauu

SEQ ID NO: 1238180 - RNA, 13 nt, Human
aaauuaaagcuga

SEQ ID NO: 1238181 - RNA, 17 nt, Human
aaauuaaagcugaaaac

SEQ ID NO: 1238182 - RNA, 13 nt, Human
aaauucuuucauu

SEQ ID NO: 1238183 - RNA, 20 nt, Human
aaauucuuucccagucuguc

SEQ ID NO: 1238184 - RNA, 13 nt, Human
aaauugaaaugua

SEQ ID NO: 1238185 - RNA, 20 nt, Human
aaauugaaauguaaggcugu

SEQ ID NO: 1238186 - RNA, 12 nt, Human
aaauugaaccuu

SEQ ID NO: 1238187 - RNA, 15 nt, Human
aaauugaaccuuugu

SEQ ID NO: 1238188 - RNA, 22 nt, Human
aaauugaaccuuugugcccuau

SEQ ID NO: 1238189 - RNA, 21 nt, Human
aacuauugcauuuauauguac

SEQ ID NO: 1238190 - RNA, 16 nt, Human
aacuauugcauuuaua

SEQ ID NO: 1238191 - RNA, 15 nt, Human
aacggauuccaaaga

SEQ ID NO: 1238192 - RNA, 17 nt, Human
aacuauuuucaaagacu

SEQ ID NO: 1238193 - RNA, 18 nt, Human
aacuauuuucaaagacuu

SEQ ID NO: 1238194 - RNA, 12 nt, Human
aacuauuuucag

SEQ ID NO: 1238195 - RNA, 13 nt, Human
aacuauuuucaga

SEQ ID NO: 1238196 - RNA, 14 nt, Human
aacuauuuucagau

SEQ ID NO: 1238197 - RNA, 20 nt, Human
aacuauuuucagaugugaac

SEQ ID NO: 1238198 - RNA, 16 nt, Human
aacuauuuucagaugu

SEQ ID NO: 1238199 - RNA, 15 nt, Human
aacucaaaauauuug

SEQ ID NO: 1238200 - RNA, 17 nt, Human
aacucacuccuuuuaaa

SEQ ID NO: 1238201 - RNA, 20 nt, Human
aacucacuccuuuuaaagaa

SEQ ID NO: 1238202 - RNA, 14 nt, Human
aacucacuuuccuc

SEQ ID NO: 1238203 - RNA, 12 nt, Human
aacggagucaaa

SEQ ID NO: 1238204 - RNA, 14 nt, Human
aacggaagaagaga

SEQ ID NO: 1238205 - RNA, 21 nt, Human
aacggaccaaagcaagacccu

SEQ ID NO: 1238206 - RNA, 14 nt, Human
aacggaccaaagca

SEQ ID NO: 1238207 - RNA, 11 nt, Human
aacgcagcccu

SEQ ID NO: 1238208 - RNA, 19 nt, Human
aacgcaaguucccaguugg

SEQ ID NO: 1238209 - RNA, 22 nt, Human
aacgcaaguucccaguuggagc

SEQ ID NO: 1238210 - RNA, 12 nt, Human
aacgcagcccug

SEQ ID NO: 1238211 - RNA, 20 nt, Human
aacgcucuagguacgaugac

SEQ ID NO: 1238212 - RNA, 15 nt, Human
aacgcugauuuaaag

SEQ ID NO: 1238213 - RNA, 14 nt, Human
aacgauuuuuaaaa

SEQ ID NO: 1238214 - RNA, 15 nt, Human
aacgauuuuuaaaau

SEQ ID NO: 1238215 - RNA, 19 nt, Human
aacgauuuuuaaaauguac

SEQ ID NO: 1238216 - RNA, 18 nt, Human
aacgauuuuuaaaaugua

SEQ ID NO: 1238217 - RNA, 15 nt, Human
aacugacucuuaaga

SEQ ID NO: 1238218 - RNA, 18 nt, Human
aacugacucuuaagaaga

SEQ ID NO: 1238219 - RNA, 12 nt, Human
aacucagaucca

SEQ ID NO: 1238220 - RNA, 13 nt, Human
aacucagauccag

SEQ ID NO: 1238221 - RNA, 14 nt, Human
aacucagauccagg

SEQ ID NO: 1238222 - RNA, 15 nt, Human
aacucagauccaggg

SEQ ID NO: 1238223 - RNA, 22 nt, Human
aacucagauccagggacagagg

SEQ ID NO: 1238224 - RNA, 19 nt, Human
aacugacucuuaagaagac

SEQ ID NO: 1238225 - RNA, 20 nt, Human
aacugacucuuaagaagacu

SEQ ID NO: 1238226 - RNA, 20 nt, Human
aacugacuauucuugaugua

SEQ ID NO: 1238227 - RNA, 22 nt, Human
aacugacuauucuugauguaaa

SEQ ID NO: 1238228 - RNA, 23 nt, Human
aacugacuauucuugauguaaaa

SEQ ID NO: 1238229 - RNA, 19 nt, Human
aacuuaaauuuuaguucuu

SEQ ID NO: 1238230 - RNA, 15 nt, Human
aacuuaaauguuauu

SEQ ID NO: 1238231 - RNA, 19 nt, Human
aacuuaaauguuauuaucu

SEQ ID NO: 1238232 - RNA, 21 nt, Human
aacuuaaauguuauuaucugg

SEQ ID NO: 1238233 - RNA, 13 nt, Human
aacuuaagccaau

SEQ ID NO: 1238234 - RNA, 22 nt, Human
aacuuaagccaauuucaaucuu

SEQ ID NO: 1238235 - RNA, 17 nt, Human
aacuuaaggcauuuguu

SEQ ID NO: 1238236 - RNA, 16 nt, Human
aacugagugccuuuug

SEQ ID NO: 1238237 - RNA, 20 nt, Human
aacugaggaauuuucuuugu

SEQ ID NO: 1238238 - RNA, 17 nt, Human
aacuuaauuuaauauuu

SEQ ID NO: 1238239 - RNA, 21 nt, Human
aacuuacaaagauucucuaug

SEQ ID NO: 1238240 - RNA, 20 nt, Human
aacuuuaugcuaagugaaau

SEQ ID NO: 1238241 - RNA, 21 nt, Human
aacuuuaugcuaagugaaaua

SEQ ID NO: 1238242 - RNA, 14 nt, Human
aacuuuaucacuua

SEQ ID NO: 1238243 - RNA, 15 nt, Human
ggcugcgcacugugu

SEQ ID NO: 1238244 - RNA, 14 nt, Human
ggcugcgcacugug

SEQ ID NO: 1238245 - RNA, 22 nt, Human
ggcugcucggggugcacaggag

SEQ ID NO: 1238246 - RNA, 21 nt, Human
ggcugcucggggugcacagga

SEQ ID NO: 1238247 - RNA, 22 nt, Human
ggcugacaugaagcuguugugu

SEQ ID NO: 1238248 - RNA, 13 nt, Human
ggcugaccacagc

SEQ ID NO: 1238249 - RNA, 15 nt, Human
ggcugaccacagcac

SEQ ID NO: 1238250 - RNA, 16 nt, Human
ggcugaccacagcaca

SEQ ID NO: 1238251 - RNA, 17 nt, Human
ggcugaccacagcacag

SEQ ID NO: 1238252 - RNA, 18 nt, Human
ggcugaccacagcacagc

SEQ ID NO: 1238253 - RNA, 22 nt, Human
ggcugaccacagcacagccaac

SEQ ID NO: 1238254 - RNA, 14 nt, Human
ggcucuucuccuuu

SEQ ID NO: 1238255 - RNA, 15 nt, Human
ggcucuucuccuuuc

SEQ ID NO: 1238256 - RNA, 23 nt, Human
ggcucuucuccuuucacaaccuu

SEQ ID NO: 1238257 - RNA, 16 nt, Human
ggcucuucuccuuuca

SEQ ID NO: 1238258 - RNA, 16 nt, Human
ggcugaauagcagaag

SEQ ID NO: 1238259 - RNA, 22 nt, Human
ggcugacagacagcccuccauc

SEQ ID NO: 1238260 - RNA, 13 nt, Human
ggcugcccuggug

SEQ ID NO: 1238261 - RNA, 19 nt, Human
ggcugaccacagcacagcc

SEQ ID NO: 1238262 - RNA, 21 nt, Human
ggcugcauugaaaagagcuga

SEQ ID NO: 1238263 - RNA, 14 nt, Human
ggcugcccuggugc

SEQ ID NO: 1238264 - RNA, 15 nt, Human
ggcugcccuggugcu

SEQ ID NO: 1238265 - RNA, 16 nt, Human
ggcugcccuggugcug

SEQ ID NO: 1238266 - RNA, 19 nt, Human
ggcugcccuggugcugcca

SEQ ID NO: 1238267 - RNA, 16 nt, Human
ggcugccuuagaaccu

SEQ ID NO: 1238268 - RNA, 16 nt, Human
ggcugccuucuggccu

SEQ ID NO: 1238269 - RNA, 22 nt, Human
ggcugcccuggugcugccacac

SEQ ID NO: 1238270 - RNA, 20 nt, Human
ggcugcauugaaaagagcug

SEQ ID NO: 1238271 - RNA, 23 nt, Human
ggcugccugagucgugaccugcu

SEQ ID NO: 1238272 - RNA, 20 nt, Human
ggcugccucccuuguggcag

SEQ ID NO: 1238273 - RNA, 12 nt, Human
ggcugccugagu

SEQ ID NO: 1238274 - RNA, 21 nt, Human
ggcucuuagcagcuuccagau

SEQ ID NO: 1238275 - RNA, 12 nt, Human
ggcucuucuccu

SEQ ID NO: 1238276 - RNA, 13 nt, Human
ggcucuucuccuu

SEQ ID NO: 1238277 - RNA, 18 nt, Human
ggcucuuagcagcuucca

SEQ ID NO: 1238278 - RNA, 19 nt, Human
ggcucuuagcagcuuccag

SEQ ID NO: 1238279 - RNA, 20 nt, Human
ggcucuuagcagcuuccaga

SEQ ID NO: 1238280 - RNA, 18 nt, Human
ggcucuaugagucuagau

SEQ ID NO: 1238281 - RNA, 23 nt, Human
ggcucuaugagucuagauguuua

SEQ ID NO: 1238282 - RNA, 18 nt, Human
ggcucuguccccagccug

SEQ ID NO: 1238283 - RNA, 23 nt, Human
ggcucuguccccagccugggaaa

SEQ ID NO: 1238284 - RNA, 16 nt, Human
ggcuccuugugccaga

SEQ ID NO: 1238285 - RNA, 19 nt, Human
ggcuccuugugccagagaa

SEQ ID NO: 1238286 - RNA, 17 nt, Human
ggcuccuugugggccug

SEQ ID NO: 1238287 - RNA, 19 nt, Human
ggcuccuugugggccuggg

SEQ ID NO: 1238288 - RNA, 17 nt, Human
ggcucuacuuccccaug

SEQ ID NO: 1238289 - RNA, 11 nt, Human
ggcucuagauc

SEQ ID NO: 1238290 - RNA, 22 nt, Human
ggcucuagaucauaaggcuuca

SEQ ID NO: 1238291 - RNA, 10 nt, Human
ggcuccuggu

SEQ ID NO: 1238292 - RNA, 23 nt, Human
ggcuccuggucaccuaggaagcc

SEQ ID NO: 1238293 - RNA, 14 nt, Human
ggcuccuguuuugc

SEQ ID NO: 1238294 - RNA, 15 nt, Human
ggcuccuguuuugca

SEQ ID NO: 1238295 - RNA, 20 nt, Human
ggcuccuucccaucgcuguc

SEQ ID NO: 1238296 - RNA, 17 nt, Human
ggcuccuugguucuuga

SEQ ID NO: 1238297 - RNA, 11 nt, Human
ggcuccuggac

SEQ ID NO: 1238298 - RNA, 12 nt, Human
ggcuccuggacc

SEQ ID NO: 1238299 - RNA, 14 nt, Human
ggcuccuggacccc

SEQ ID NO: 1238300 - RNA, 16 nt, Human
ggcucagauuguaaua

SEQ ID NO: 1238301 - RNA, 15 nt, Human
ggcucaggcaggggc

SEQ ID NO: 1238302 - RNA, 17 nt, Human
ggcucaggcaggggccu

SEQ ID NO: 1238303 - RNA, 21 nt, Human
ggcucaggcaggggccuccau

SEQ ID NO: 1238304 - RNA, 16 nt, Human
ggcucaggucacauaa

SEQ ID NO: 1238305 - RNA, 18 nt, Human
ggcucagugaaguugcug

SEQ ID NO: 1238306 - RNA, 19 nt, Human
ggcucagugaaguugcugc

SEQ ID NO: 1238307 - RNA, 21 nt, Human
ggcucagugaaguugcugcuu

SEQ ID NO: 1238308 - RNA, 20 nt, Human
ggcucagugaaguugcugcu

SEQ ID NO: 1238309 - RNA, 18 nt, Human
ggcucagagccggggugg

SEQ ID NO: 1238310 - RNA, 20 nt, Human
ggcucagaggguguccugca

SEQ ID NO: 1238311 - RNA, 16 nt, Human
ggcuccacuuggucug

SEQ ID NO: 1238312 - RNA, 14 nt, Human
ggcuccacuugguc

SEQ ID NO: 1238313 - RNA, 20 nt, Human
gggacagucaccucauggaa

SEQ ID NO: 1238314 - RNA, 21 nt, Human
gggacagucaccucauggaau

SEQ ID NO: 1238315 - RNA, 22 nt, Human
gggacagucaccucauggaauu

SEQ ID NO: 1238316 - RNA, 17 nt, Human
gggacagguccucagug

SEQ ID NO: 1238317 - RNA, 13 nt, Human
gggacagagcaga

SEQ ID NO: 1238318 - RNA, 17 nt, Human
gggacagaggccccagc

SEQ ID NO: 1238319 - RNA, 18 nt, Human
gggacagaggccccagcc

SEQ ID NO: 1238320 - RNA, 19 nt, Human
gggacagaggccccagccu

SEQ ID NO: 1238321 - RNA, 20 nt, Human
gggacagaggccccagccuc

SEQ ID NO: 1238322 - RNA, 21 nt, Human
gggacagaggccccagccucc

SEQ ID NO: 1238323 - RNA, 21 nt, Human
gggaacuggccaagcugaggu

SEQ ID NO: 1238324 - RNA, 20 nt, Human
gggaacuggccaagcugagg

SEQ ID NO: 1238325 - RNA, 11 nt, Human
gggaagacagu

SEQ ID NO: 1238326 - RNA, 12 nt, Human
gggaagacagug

SEQ ID NO: 1238327 - RNA, 14 nt, Human
gggaagacaguggc

SEQ ID NO: 1238328 - RNA, 22 nt, Human
gggacaccuaggcuaggguggg

SEQ ID NO: 1238329 - RNA, 22 nt, Human
gggaagacccauuccuucccag

SEQ ID NO: 1238330 - RNA, 16 nt, Human
gggaagacaguggccc

SEQ ID NO: 1238331 - RNA, 22 nt, Human
gggaagacuccuagcuguccuu

SEQ ID NO: 1238332 - RNA, 18 nt, Human
gggaagagacagcccagg

SEQ ID NO: 1238333 - RNA, 22 nt, Human
ggcuucccgcucagcccucccu

SEQ ID NO: 1238334 - RNA, 14 nt, Human
ggcuucucucugug

SEQ ID NO: 1238335 - RNA, 22 nt, Human
ggcuucugagcagcgagccugc

SEQ ID NO: 1238336 - RNA, 13 nt, Human
ggcuucugagcag

SEQ ID NO: 1238337 - RNA, 14 nt, Human
ggcuucugagcagc

SEQ ID NO: 1238338 - RNA, 12 nt, Human
ggcuucugcugg

SEQ ID NO: 1238339 - RNA, 15 nt, Human
ggcuucugcuggggc

SEQ ID NO: 1238340 - RNA, 19 nt, Human
ggcuucugcuggggccugg

SEQ ID NO: 1238341 - RNA, 21 nt, Human
ggcuucugcuggggccuggga

SEQ ID NO: 1238342 - RNA, 18 nt, Human
ggcuucuggccaggaagc

SEQ ID NO: 1238343 - RNA, 20 nt, Human
ggcuucugcuggggccuggg

SEQ ID NO: 1238344 - RNA, 20 nt, Human
gggaacagugugcaaggcag

SEQ ID NO: 1238345 - RNA, 12 nt, Human
gggaacaugggg

SEQ ID NO: 1238346 - RNA, 16 nt, Human
gggaacauggggagga

SEQ ID NO: 1238347 - RNA, 14 nt, Human
gggaacauggggag

SEQ ID NO: 1238348 - RNA, 12 nt, Human
gggaacuggcca

SEQ ID NO: 1238349 - RNA, 13 nt, Human
gggaacuggccaa

SEQ ID NO: 1238350 - RNA, 15 nt, Human
gggaacuggccaagc

SEQ ID NO: 1238351 - RNA, 16 nt, Human
gggaacuggccaagcu

SEQ ID NO: 1238352 - RNA, 18 nt, Human
gggaacuggccaagcuga

SEQ ID NO: 1238353 - RNA, 19 nt, Human
gggaacuggccaagcugag

SEQ ID NO: 1238354 - RNA, 16 nt, Human
gggaacucagauccag

SEQ ID NO: 1238355 - RNA, 13 nt, Human
gggaaccugaccc

SEQ ID NO: 1238356 - RNA, 13 nt, Human
gggaaccuguguc

SEQ ID NO: 1238357 - RNA, 14 nt, Human
gggaaccugugucc

SEQ ID NO: 1238358 - RNA, 15 nt, Human
gggaaccuguguccg

SEQ ID NO: 1238359 - RNA, 14 nt, Human
gggaaccccuuucc

SEQ ID NO: 1238360 - RNA, 17 nt, Human
gggaaccccuuucccac

SEQ ID NO: 1238361 - RNA, 19 nt, Human
gggaacccugcccacuccc

SEQ ID NO: 1238362 - RNA, 23 nt, Human
gggaacccugcccacucccagga

SEQ ID NO: 1238363 - RNA, 18 nt, Human
ggcuguaacugccaggcu

SEQ ID NO: 1238364 - RNA, 14 nt, Human
ggcuguaaggcucu

SEQ ID NO: 1238365 - RNA, 15 nt, Human
ggcuguaaggcucua

SEQ ID NO: 1238366 - RNA, 15 nt, Human
ggcuguaacugccag

SEQ ID NO: 1238367 - RNA, 16 nt, Human
ggcuguaacugccagg

SEQ ID NO: 1238368 - RNA, 17 nt, Human
ggcuguaacugccaggc

SEQ ID NO: 1238369 - RNA, 19 nt, Human
ggcuucccgcucagcccuc

SEQ ID NO: 1238370 - RNA, 21 nt, Human
ggcuucccgcucagcccuccc

SEQ ID NO: 1238371 - RNA, 15 nt, Human
ggcuucccgcucagc

SEQ ID NO: 1238372 - RNA, 16 nt, Human
ggcuucccgcucagcc

SEQ ID NO: 1238373 - RNA, 17 nt, Human
ggcuucccgcucagccc

SEQ ID NO: 1238374 - RNA, 18 nt, Human
ggcuucccgcucagcccu

SEQ ID NO: 1238375 - RNA, 14 nt, Human
ggcuucccgcucag

SEQ ID NO: 1238376 - RNA, 20 nt, Human
ggcugggucgcccuggacug

SEQ ID NO: 1238377 - RNA, 17 nt, Human
ggcugggucgcccugga

SEQ ID NO: 1238378 - RNA, 14 nt, Human
ggcugggucgcccu

SEQ ID NO: 1238379 - RNA, 22 nt, Human
aaaaauaagaagaaugcuuaau

SEQ ID NO: 1238380 - RNA, 21 nt, Human
aaaaauaagucaacaguaaac

SEQ ID NO: 1238381 - RNA, 12 nt, Human
aaaaauaauaau

SEQ ID NO: 1238382 - RNA, 18 nt, Human
aaaaauaagucaacagua

SEQ ID NO: 1238383 - RNA, 16 nt, Human
ggcuggggucccagca

SEQ ID NO: 1238384 - RNA, 17 nt, Human
ggcuggggucccagcag

SEQ ID NO: 1238385 - RNA, 18 nt, Human
ggcuggggucccagcagc

SEQ ID NO: 1238386 - RNA, 21 nt, Human
ggcuggggucccagcagcugc

SEQ ID NO: 1238387 - RNA, 14 nt, Human
aaaaauaacaauga

SEQ ID NO: 1238388 - RNA, 18 nt, Human
aaaaauaaauauaucuac

SEQ ID NO: 1238389 - RNA, 24 nt, Human
aaaaauaaauauaucuaccccaga

SEQ ID NO: 1238390 - RNA, 14 nt, Human
aaaaauaagaagaa

SEQ ID NO: 1238391 - RNA, 16 nt, Human
aaaaauaagaagaaug

SEQ ID NO: 1238392 - RNA, 13 nt, Human
aaaaggaaagaaa

SEQ ID NO: 1238393 - RNA, 18 nt, Human
aaaaggaagccaaagagu

SEQ ID NO: 1238394 - RNA, 14 nt, Human
aaaaggaaagaaaa

SEQ ID NO: 1238395 - RNA, 14 nt, Human
aaaagcuuuuuauu

SEQ ID NO: 1238396 - RNA, 13 nt, Human
aaaagcuuuuguc

SEQ ID NO: 1238397 - RNA, 21 nt, Human
aaaagcuuugaacccugggac

SEQ ID NO: 1238398 - RNA, 16 nt, Human
aaaagcauuuuguaau

SEQ ID NO: 1238399 - RNA, 14 nt, Human
aaaagcauuuugua

SEQ ID NO: 1238400 - RNA, 15 nt, Human
aaaagcauuuuguaa

SEQ ID NO: 1238401 - RNA, 23 nt, Human
aaaagccagguuccacagaggac

SEQ ID NO: 1238402 - RNA, 19 nt, Human
aaaagcccaccauuuggca

SEQ ID NO: 1238403 - RNA, 21 nt, Human
aaaagcccuagacuggugcua

SEQ ID NO: 1238404 - RNA, 13 nt, Human
gggacuugugucu

SEQ ID NO: 1238405 - RNA, 14 nt, Human
gggacuugugucug

SEQ ID NO: 1238406 - RNA, 15 nt, Human
gggacuugugucugc

SEQ ID NO: 1238407 - RNA, 23 nt, Human
gggagaaauagucggugaagaaa

SEQ ID NO: 1238408 - RNA, 13 nt, Human
gggagagcccagg

SEQ ID NO: 1238409 - RNA, 16 nt, Human
gggagagcccaggagc

SEQ ID NO: 1238410 - RNA, 17 nt, Human
gggagagcccaggagcu

SEQ ID NO: 1238411 - RNA, 18 nt, Human
gggagagcccaggagcuc

SEQ ID NO: 1238412 - RNA, 20 nt, Human
gggagagcccaggagcuccc

SEQ ID NO: 1238413 - RNA, 21 nt, Human
gggagaggcagcccaggaagu

SEQ ID NO: 1238414 - RNA, 12 nt, Human
gggagaggcagc

SEQ ID NO: 1238415 - RNA, 14 nt, Human
gggagagggcgcag

SEQ ID NO: 1238416 - RNA, 9 nt, Human
gggagccaa

SEQ ID NO: 1238417 - RNA, 11 nt, Human
gggagccaagg

SEQ ID NO: 1238418 - RNA, 12 nt, Human
gggagccaaggg

SEQ ID NO: 1238419 - RNA, 13 nt, Human
gggagccaaggga

SEQ ID NO: 1238420 - RNA, 14 nt, Human
gggagccaagggau

SEQ ID NO: 1238421 - RNA, 15 nt, Human
gggagccaagggaug

SEQ ID NO: 1238422 - RNA, 19 nt, Human
gggagccaugcgcccccuc

SEQ ID NO: 1238423 - RNA, 15 nt, Human
gggagccauuugaga

SEQ ID NO: 1238424 - RNA, 10 nt, Human
gggagcccac

SEQ ID NO: 1238425 - RNA, 20 nt, Human
gggaggcuggaagcugggag

SEQ ID NO: 1238426 - RNA, 15 nt, Human
gggagggaagggagc

SEQ ID NO: 1238427 - RNA, 18 nt, Human
gggagggaagggagccaa

SEQ ID NO: 1238428 - RNA, 22 nt, Human
gggagggauucugguuccaggg

SEQ ID NO: 1238429 - RNA, 11 nt, Human
gggagggcaga

SEQ ID NO: 1238430 - RNA, 13 nt, Human
gggagggggcaga

SEQ ID NO: 1238431 - RNA, 14 nt, Human
gggagggggcagaa

SEQ ID NO: 1238432 - RNA, 15 nt, Human
gggagggggcagaag

SEQ ID NO: 1238433 - RNA, 19 nt, Human
gggaugacuaaaauauuua

SEQ ID NO: 1238434 - RNA, 20 nt, Human
gggaugacuaaaauauuuau

SEQ ID NO: 1238435 - RNA, 16 nt, Human
gggaggguaggcagga

SEQ ID NO: 1238436 - RNA, 15 nt, Human
gggaggguaccagca

SEQ ID NO: 1238437 - RNA, 14 nt, Human
gggaggucauuuug

SEQ ID NO: 1238438 - RNA, 19 nt, Human
gggacauuugcucauggaa

SEQ ID NO: 1238439 - RNA, 19 nt, Human
gggacaugcuuagcagucc

SEQ ID NO: 1238440 - RNA, 20 nt, Human
gggacauuccaaagaacagc

SEQ ID NO: 1238441 - RNA, 17 nt, Human
aaaaaugguuuaaaugg

SEQ ID NO: 1238442 - RNA, 17 nt, Human
gggaccacccugagccg

SEQ ID NO: 1238443 - RNA, 20 nt, Human
gggaccagcagccccacacc

SEQ ID NO: 1238444 - RNA, 19 nt, Human
gggaccacccugagccggc

SEQ ID NO: 1238445 - RNA, 18 nt, Human
gggaccaggagugggugg

SEQ ID NO: 1238446 - RNA, 12 nt, Human
gggaccaggagu

SEQ ID NO: 1238447 - RNA, 13 nt, Human
aaaaaugguaauu

SEQ ID NO: 1238448 - RNA, 14 nt, Human
aaaacaucuuugaa

SEQ ID NO: 1238449 - RNA, 16 nt, Human
aaaacaucuuugaaau

SEQ ID NO: 1238450 - RNA, 24 nt, Human
aaaacaucuuugaaauuauguaaa

SEQ ID NO: 1238451 - RNA, 23 nt, Human
aaaacaugcagaacaaaugaaga

SEQ ID NO: 1238452 - RNA, 21 nt, Human
aaaacaugcagaacaaaugaa

SEQ ID NO: 1238453 - RNA, 20 nt, Human
aaaaccacauggcacagaga

SEQ ID NO: 1238454 - RNA, 11 nt, Human
aaaaauguagg

SEQ ID NO: 1238455 - RNA, 12 nt, Human
aaaaauguagga

SEQ ID NO: 1238456 - RNA, 16 nt, Human
aaaaauguauaugcac

SEQ ID NO: 1238457 - RNA, 18 nt, Human
aaaaauguaggagacugu

SEQ ID NO: 1238458 - RNA, 12 nt, Human
aaaaauguauuu

SEQ ID NO: 1238459 - RNA, 16 nt, Human
aaaaauguauuuuaug

SEQ ID NO: 1238460 - RNA, 20 nt, Human
aaaacuucguuuaaugaaug

SEQ ID NO: 1238461 - RNA, 15 nt, Human
aaaacuucagacaua

SEQ ID NO: 1238462 - RNA, 21 nt, Human
aaaacuuaugcugauuuauuu

SEQ ID NO: 1238463 - RNA, 21 nt, Human
aaaacuucaguuucacagaaa

SEQ ID NO: 1238464 - RNA, 21 nt, Human
aaaagauugaaguauuuugcu

SEQ ID NO: 1238465 - RNA, 14 nt, Human
aaaagauugcugaa

SEQ ID NO: 1238466 - RNA, 16 nt, Human
aaaagauugcugaaau

SEQ ID NO: 1238467 - RNA, 18 nt, Human
aaaagauugcugaaauuu

SEQ ID NO: 1238468 - RNA, 21 nt, Human
aaaagauugcugaaauuuuau

SEQ ID NO: 1238469 - RNA, 16 nt, Human
aaaagcaaaaaagaaa

SEQ ID NO: 1238470 - RNA, 21 nt, Human
aaaacucuacuuaauccaaug

SEQ ID NO: 1238471 - RNA, 19 nt, Human
aaaacucuuauaaauuucu

SEQ ID NO: 1238472 - RNA, 15 nt, Human
aaaacucuuucggua

SEQ ID NO: 1238473 - RNA, 12 nt, Human
aaaacucuuuga

SEQ ID NO: 1238474 - RNA, 11 nt, Human
aaaaccuguuc

SEQ ID NO: 1238475 - RNA, 14 nt, Human
aaaaccuuuugaaa

SEQ ID NO: 1238476 - RNA, 22 nt, Human
aaaaccuuccaugucaagauuc

SEQ ID NO: 1238477 - RNA, 23 nt, Human
aaaaccuguucaagucuaccaac

SEQ ID NO: 1238478 - RNA, 22 nt, Human
aaaaccugagauuuauuaaaga

SEQ ID NO: 1238479 - RNA, 17 nt, Human
aaaaccaucaaguugug

SEQ ID NO: 1238480 - RNA, 22 nt, Human
ggagacugcugagucaacccaa

SEQ ID NO: 1238481 - RNA, 15 nt, Human
ggagacugcccagcu

SEQ ID NO: 1238482 - RNA, 17 nt, Human
ggagagacacugguggg

SEQ ID NO: 1238483 - RNA, 21 nt, Human
ggcagcagggcuacccugagc

SEQ ID NO: 1238484 - RNA, 22 nt, Human
ggcagcagggguuggggaaaca

SEQ ID NO: 1238485 - RNA, 15 nt, Human
ggcagcagggguugg

SEQ ID NO: 1238486 - RNA, 13 nt, Human
ggcagcaguguga

SEQ ID NO: 1238487 - RNA, 14 nt, Human
ggcagcagugugag

SEQ ID NO: 1238488 - RNA, 19 nt, Human
ggcagcagugugaggccag

SEQ ID NO: 1238489 - RNA, 20 nt, Human
ggcagcagugugaggccagg

SEQ ID NO: 1238490 - RNA, 20 nt, Human
ggcagacauugugcuagugc

SEQ ID NO: 1238491 - RNA, 18 nt, Human
ggcagacucuuuaugcuu

SEQ ID NO: 1238492 - RNA, 19 nt, Human
ggcagacucuuuaugcuug

SEQ ID NO: 1238493 - RNA, 14 nt, Human
ggcagcagccagcc

SEQ ID NO: 1238494 - RNA, 15 nt, Human
ggcagcagccagccc

SEQ ID NO: 1238495 - RNA, 16 nt, Human
ggcagcagccagcccu

SEQ ID NO: 1238496 - RNA, 17 nt, Human
ggcagcagccagcccug

SEQ ID NO: 1238497 - RNA, 18 nt, Human
ggcagcagccagcccugc

SEQ ID NO: 1238498 - RNA, 19 nt, Human
ggcagcagccagcccugcc

SEQ ID NO: 1238499 - RNA, 20 nt, Human
ggcagcagccagcccugccu

SEQ ID NO: 1238500 - RNA, 21 nt, Human
ggcagcagccagcccugccug

SEQ ID NO: 1238501 - RNA, 23 nt, Human
ggcagcagccagcccugccugga

SEQ ID NO: 1238502 - RNA, 22 nt, Human
ggcagcagccagcccugccugg

SEQ ID NO: 1238503 - RNA, 12 nt, Human
ggcagcagcccc

SEQ ID NO: 1238504 - RNA, 14 nt, Human
ggcagcagccccca

SEQ ID NO: 1238505 - RNA, 15 nt, Human
ggcagcagcccccag

SEQ ID NO: 1238506 - RNA, 23 nt, Human
ggcagcagcccccagcucccacc

SEQ ID NO: 1238507 - RNA, 13 nt, Human
ggcagcagggcua

SEQ ID NO: 1238508 - RNA, 18 nt, Human
ggcagcagggcuacccug

SEQ ID NO: 1238509 - RNA, 15 nt, Human
ggcacugguggcccg

SEQ ID NO: 1238510 - RNA, 20 nt, Human
ggcacugcccugguggcccu

SEQ ID NO: 1238511 - RNA, 12 nt, Human
ggcacugcccug

SEQ ID NO: 1238512 - RNA, 14 nt, Human
ggcacugcccuggu

SEQ ID NO: 1238513 - RNA, 24 nt, Human
ggcacugcccugguggcccucucc

SEQ ID NO: 1238514 - RNA, 13 nt, Human
ggcacuguacaaa

SEQ ID NO: 1238515 - RNA, 17 nt, Human
ggcacuguaguucuaag

SEQ ID NO: 1238516 - RNA, 18 nt, Human
ggcacuguaguucuaaga

SEQ ID NO: 1238517 - RNA, 14 nt, Human
ggcacuuaaagcuu

SEQ ID NO: 1238518 - RNA, 20 nt, Human
ggcacuguaguucuaagacu

SEQ ID NO: 1238519 - RNA, 17 nt, Human
ggcacuuggcagccuug

SEQ ID NO: 1238520 - RNA, 18 nt, Human
ggcacuuggcagccuugu

SEQ ID NO: 1238521 - RNA, 22 nt, Human
ggcacuuugaaggggccucacc

SEQ ID NO: 1238522 - RNA, 12 nt, Human
ggcacagggucu

SEQ ID NO: 1238523 - RNA, 17 nt, Human
ggcacagggucugcucu

SEQ ID NO: 1238524 - RNA, 18 nt, Human
ggcacagggucugcucuu

SEQ ID NO: 1238525 - RNA, 19 nt, Human
ggcacagggucugcucuuu

SEQ ID NO: 1238526 - RNA, 13 nt, Human
ggcacucuagauu

SEQ ID NO: 1238527 - RNA, 19 nt, Human
ggcagggcgggcagagggc

SEQ ID NO: 1238528 - RNA, 21 nt, Human
ggcagggcgggcagagggcug

SEQ ID NO: 1238529 - RNA, 23 nt, Human
ggcagggcgggcagagggcugga

SEQ ID NO: 1238530 - RNA, 22 nt, Human
ggcagggcgggcagagggcugg

SEQ ID NO: 1238531 - RNA, 19 nt, Human
ggcagggcucuccuggcuu

SEQ ID NO: 1238532 - RNA, 12 nt, Human
ggcagggcucuc

SEQ ID NO: 1238533 - RNA, 13 nt, Human
ggcagggcucucc

SEQ ID NO: 1238534 - RNA, 16 nt, Human
ggcagggcucuccugg

SEQ ID NO: 1238535 - RNA, 17 nt, Human
ggcagggcucuccuggc

SEQ ID NO: 1238536 - RNA, 18 nt, Human
ggcagggcucuccuggcu

SEQ ID NO: 1238537 - RNA, 20 nt, Human
ggcagggcucuccuggcuuc

SEQ ID NO: 1238538 - RNA, 14 nt, Human
ggcaggggacagga

SEQ ID NO: 1238539 - RNA, 21 nt, Human
ggcaguguagggaguuguggg

SEQ ID NO: 1238540 - RNA, 16 nt, Human
ggcaguuaccauuaaa

SEQ ID NO: 1238541 - RNA, 22 nt, Human
ggcaguuaccauuaaaccaucu

SEQ ID NO: 1238542 - RNA, 24 nt, Human
ggcaguuaccauuaaaccaucucc

SEQ ID NO: 1238543 - RNA, 23 nt, Human
ggcaguuaccauuaaaccaucuc

SEQ ID NO: 1238544 - RNA, 12 nt, Human
ggcaguuauauu

SEQ ID NO: 1238545 - RNA, 14 nt, Human
ggcaguuauauuuu

SEQ ID NO: 1238546 - RNA, 16 nt, Human
ggcaguuauauuuugc

SEQ ID NO: 1238547 - RNA, 15 nt, Human
ggcaguucgcagcca

SEQ ID NO: 1238548 - RNA, 16 nt, Human
ggcaguucgcagccac

SEQ ID NO: 1238549 - RNA, 17 nt, Human
ggcaguucgcagccacc

SEQ ID NO: 1238550 - RNA, 18 nt, Human
ggcaguucgcagccaccc

SEQ ID NO: 1238551 - RNA, 19 nt, Human
ggcaguucgcagccacccu

SEQ ID NO: 1238552 - RNA, 20 nt, Human
ggcaguucgcagccacccug

SEQ ID NO: 1238553 - RNA, 21 nt, Human
ggcaguucgcagccacccuga

SEQ ID NO: 1238554 - RNA, 22 nt, Human
ggcaguucgcagccacccugag

SEQ ID NO: 1238555 - RNA, 23 nt, Human
ggcaguucgcagccacccugagg

SEQ ID NO: 1238556 - RNA, 10 nt, Human
ggcaguuuuu

SEQ ID NO: 1238557 - RNA, 22 nt, Human
ggcauacgagagcagaggucuc

SEQ ID NO: 1238558 - RNA, 17 nt, Human
ggcauacuauguggaug

SEQ ID NO: 1238559 - RNA, 15 nt, Human
ggccagucuguggau

SEQ ID NO: 1238560 - RNA, 18 nt, Human
ggccagucuguggaucag

SEQ ID NO: 1238561 - RNA, 23 nt, Human
ggccagucuguggaucagagaug

SEQ ID NO: 1238562 - RNA, 13 nt, Human
ggccagucugugg

SEQ ID NO: 1238563 - RNA, 14 nt, Human
ggccagucugugga

SEQ ID NO: 1238564 - RNA, 14 nt, Human
ggccaguguuuaaa

SEQ ID NO: 1238565 - RNA, 19 nt, Human
ggccaguguuuaaaacuuc

SEQ ID NO: 1238566 - RNA, 19 nt, Human
ggcccuugaguccccauug

SEQ ID NO: 1238567 - RNA, 18 nt, Human
ggccgaagcuaacaggga

SEQ ID NO: 1238568 - RNA, 19 nt, Human
ggccucacuaggcuucugg

SEQ ID NO: 1238569 - RNA, 12 nt, Human
ggccucacccac

SEQ ID NO: 1238570 - RNA, 13 nt, Human
ggccucacccacc

SEQ ID NO: 1238571 - RNA, 17 nt, Human
ggccucacccaccccug

SEQ ID NO: 1238572 - RNA, 18 nt, Human
ggccucacccaccccugc

SEQ ID NO: 1238573 - RNA, 18 nt, Human
ggccucaccgaguggggg

SEQ ID NO: 1238574 - RNA, 20 nt, Human
ggccgaagcuaacagggaag

SEQ ID NO: 1238575 - RNA, 16 nt, Human
ggccuccauccugagg

SEQ ID NO: 1238576 - RNA, 15 nt, Human
ggccuccauccugag

SEQ ID NO: 1238577 - RNA, 14 nt, Human
ggccuccauccuga

SEQ ID NO: 1238578 - RNA, 19 nt, Human
ggccucaccgagugggggc

SEQ ID NO: 1238579 - RNA, 18 nt, Human
ggccucagcucccacaag

SEQ ID NO: 1238580 - RNA, 13 nt, Human
ggcccggcagggc

SEQ ID NO: 1238581 - RNA, 14 nt, Human
ggcccggcagggcg

SEQ ID NO: 1238582 - RNA, 18 nt, Human
ggcccggcagggcgggca

SEQ ID NO: 1238583 - RNA, 15 nt, Human
ggcccucgcugccag

SEQ ID NO: 1238584 - RNA, 16 nt, Human
ggcccucgcugccagc

SEQ ID NO: 1238585 - RNA, 19 nt, Human
ggcccucgcugccagcucu

SEQ ID NO: 1238586 - RNA, 21 nt, Human
ggcccucgcugccagcucugu

SEQ ID NO: 1238587 - RNA, 22 nt, Human
ggcccucgcugccagcucugua

SEQ ID NO: 1238588 - RNA, 23 nt, Human
ggcccucgcugccagcucuguau

SEQ ID NO: 1238589 - RNA, 21 nt, Human
guacuucaaauccuugaagau

SEQ ID NO: 1238590 - RNA, 22 nt, Human
guacuucaaauccuugaagauu

SEQ ID NO: 1238591 - RNA, 15 nt, Human
guacuucaugcuguc

SEQ ID NO: 1238592 - RNA, 23 nt, Human
guacuguaugaucaaauguuuaa

SEQ ID NO: 1238593 - RNA, 14 nt, Human
guacuguucugugu

SEQ ID NO: 1238594 - RNA, 15 nt, Human
guacuguucuguguc

SEQ ID NO: 1238595 - RNA, 22 nt, Human
guacuguaugaucaaauguuua

SEQ ID NO: 1238596 - RNA, 21 nt, Human
guacuguaugaucaaauguuu

SEQ ID NO: 1238597 - RNA, 20 nt, Human
guacuguaugaucaaauguu

SEQ ID NO: 1238598 - RNA, 18 nt, Human
guacuguaugaucaaaug

SEQ ID NO: 1238599 - RNA, 18 nt, Human
guacuguucugugucuuu

SEQ ID NO: 1238600 - RNA, 17 nt, Human
guacuguucugugucuu

SEQ ID NO: 1238601 - RNA, 19 nt, Human
guacuggcugauggaguaa

SEQ ID NO: 1238602 - RNA, 17 nt, Human
guacuguaugaucaaau

SEQ ID NO: 1238603 - RNA, 14 nt, Human
guacuguaugauca

SEQ ID NO: 1238604 - RNA, 15 nt, Human
guacuguacagcugg

SEQ ID NO: 1238605 - RNA, 19 nt, Human
guacuguacagcuggcucu

SEQ ID NO: 1238606 - RNA, 20 nt, Human
guacuguacagcuggcucua

SEQ ID NO: 1238607 - RNA, 20 nt, Human
guacugggauuacaggcgug

SEQ ID NO: 1238608 - RNA, 13 nt, Human
guacugcauuauu

SEQ ID NO: 1238609 - RNA, 11 nt, Human
guacugccugc

SEQ ID NO: 1238610 - RNA, 13 nt, Human
guacugccugcuu

SEQ ID NO: 1238611 - RNA, 16 nt, Human
guacugccugcuuggg

SEQ ID NO: 1238612 - RNA, 15 nt, Human
guacugcauuauuug

SEQ ID NO: 1238613 - RNA, 13 nt, Human
guacugcagccuc

SEQ ID NO: 1238614 - RNA, 15 nt, Human
guacugauucaauuu

SEQ ID NO: 1238615 - RNA, 16 nt, Human
guacugauucaauuug

SEQ ID NO: 1238616 - RNA, 19 nt, Human
guacugaccccaucaccua

SEQ ID NO: 1238617 - RNA, 14 nt, Human
guacugacuuugcu

SEQ ID NO: 1238618 - RNA, 17 nt, Human
guacugacuuugcuugc

SEQ ID NO: 1238619 - RNA, 20 nt, Human
guacugacuuugcuugcuuu

SEQ ID NO: 1238620 - RNA, 18 nt, Human
guacugacuuugcuugcu

SEQ ID NO: 1238621 - RNA, 16 nt, Human
guacugagccuuguaa

SEQ ID NO: 1238622 - RNA, 14 nt, Human
guacuauuuaacug

SEQ ID NO: 1238623 - RNA, 18 nt, Human
guacuauuuaacugacua

SEQ ID NO: 1238624 - RNA, 15 nt, Human
guacucaaauguagc

SEQ ID NO: 1238625 - RNA, 14 nt, Human
guacuccucccagg

SEQ ID NO: 1238626 - RNA, 15 nt, Human
guacucccucucagg

SEQ ID NO: 1238627 - RNA, 16 nt, Human
guacucccucucagga

SEQ ID NO: 1238628 - RNA, 20 nt, Human
guacucccucucaggaucca

SEQ ID NO: 1238629 - RNA, 15 nt, Human
guacuauuuaacuga

SEQ ID NO: 1238630 - RNA, 18 nt, Human
guacuccacacugcacaa

SEQ ID NO: 1238631 - RNA, 19 nt, Human
guacuccacacugcacaau

SEQ ID NO: 1238632 - RNA, 21 nt, Human
guacuccacacugcacaauaa

SEQ ID NO: 1238633 - RNA, 19 nt, Human
guacuccacauauuucagu

SEQ ID NO: 1238634 - RNA, 19 nt, Human
guacccaccgggccacucc

SEQ ID NO: 1238635 - RNA, 15 nt, Human
guagaacacuaauuc

SEQ ID NO: 1238636 - RNA, 17 nt, Human
guagaacacuaauucau

SEQ ID NO: 1238637 - RNA, 18 nt, Human
guagaacacuaauucaua

SEQ ID NO: 1238638 - RNA, 14 nt, Human
guagaagggaaagc

SEQ ID NO: 1238639 - RNA, 18 nt, Human
guagaagggaaagcccau

SEQ ID NO: 1238640 - RNA, 16 nt, Human
guagaauguaaagcuu

SEQ ID NO: 1238641 - RNA, 21 nt, Human
guagaauguaaagcuugucug

SEQ ID NO: 1238642 - RNA, 19 nt, Human
guagaauguaaagcuuguc

SEQ ID NO: 1238643 - RNA, 17 nt, Human
guagaauuaucuaauuu

SEQ ID NO: 1238644 - RNA, 22 nt, Human
guagaauuaucuaauuuauaaa

SEQ ID NO: 1238645 - RNA, 14 nt, Human
guagaauugcauug

SEQ ID NO: 1238646 - RNA, 15 nt, Human
guagaauugcauuga

SEQ ID NO: 1238647 - RNA, 11 nt, Human
guagagacagg

SEQ ID NO: 1238648 - RNA, 21 nt, Human
guagacggcucaguauagaua

SEQ ID NO: 1238649 - RNA, 18 nt, Human
guagacaguauauaacua

SEQ ID NO: 1238650 - RNA, 14 nt, Human
guagaccaaaauaa

SEQ ID NO: 1238651 - RNA, 15 nt, Human
guagaccaaaauaaa

SEQ ID NO: 1238652 - RNA, 16 nt, Human
guagaccaaaauaaaa

SEQ ID NO: 1238653 - RNA, 15 nt, Human
guagaccacugccau

SEQ ID NO: 1238654 - RNA, 19 nt, Human
guagaccuuguuacuucug

SEQ ID NO: 1238655 - RNA, 20 nt, Human
guagaccuuguuacuucuga

SEQ ID NO: 1238656 - RNA, 21 nt, Human
guagaccuuguuacuucugag

SEQ ID NO: 1238657 - RNA, 22 nt, Human
guagaccuuguuacuucugagg

SEQ ID NO: 1238658 - RNA, 21 nt, Human
guagccucaaucgagugagac

SEQ ID NO: 1238659 - RNA, 15 nt, Human
aaauccauacauuug

SEQ ID NO: 1238660 - RNA, 18 nt, Human
aaauccauacauuugugu

SEQ ID NO: 1238661 - RNA, 18 nt, Human
guacaucuauuuuggauu

SEQ ID NO: 1238662 - RNA, 20 nt, Human
guacaucuauuuuggauugu

SEQ ID NO: 1238663 - RNA, 11 nt, Human
guacaugagaa

SEQ ID NO: 1238664 - RNA, 17 nt, Human
guacauggugcugggag

SEQ ID NO: 1238665 - RNA, 23 nt, Human
guaccaagacuacuagggaaaug

SEQ ID NO: 1238666 - RNA, 20 nt, Human
guaccaagacuacuagggaa

SEQ ID NO: 1238667 - RNA, 17 nt, Human
guaccaaccauccaauu

SEQ ID NO: 1238668 - RNA, 21 nt, Human
guaccaagaaucuugguuugc

SEQ ID NO: 1238669 - RNA, 14 nt, Human
guaccaaucauuuu

SEQ ID NO: 1238670 - RNA, 15 nt, Human
guaccaaucauuuua

SEQ ID NO: 1238671 - RNA, 21 nt, Human
guaccaaucauuuuaauuauu

SEQ ID NO: 1238672 - RNA, 22 nt, Human
guacauuugggaguuuuuauga

SEQ ID NO: 1238673 - RNA, 15 nt, Human
guacauuuuguaaca

SEQ ID NO: 1238674 - RNA, 23 nt, Human
guaccauuuaauggggaggacaa

SEQ ID NO: 1238675 - RNA, 13 nt, Human
guaccauuuuaaa

SEQ ID NO: 1238676 - RNA, 22 nt, Human
guaccaguuaauuuuuccaacu

SEQ ID NO: 1238677 - RNA, 23 nt, Human
guaccaguuaauuuuuccaacua

SEQ ID NO: 1238678 - RNA, 22 nt, Human
guaccauuuaauggggaggaca

SEQ ID NO: 1238679 - RNA, 15 nt, Human
guaccagauaacuuu

SEQ ID NO: 1238680 - RNA, 16 nt, Human
guaccagauaacuuuu

SEQ ID NO: 1238681 - RNA, 17 nt, Human
guaccagaugcagcuca

SEQ ID NO: 1238682 - RNA, 17 nt, Human
guaccagauaacuuuuu

SEQ ID NO: 1238683 - RNA, 10 nt, Human
guaccaguua

SEQ ID NO: 1238684 - RNA, 11 nt, Human
guaccaguuaa

SEQ ID NO: 1238685 - RNA, 16 nt, Human
guaccaguuaauuuuu

SEQ ID NO: 1238686 - RNA, 20 nt, Human
guaccaguuaauuuuuccaa

SEQ ID NO: 1238687 - RNA, 21 nt, Human
aaaucagacuaugaaguuuuu

SEQ ID NO: 1238688 - RNA, 14 nt, Human
aaaucagacuauga

SEQ ID NO: 1238689 - RNA, 18 nt, Human
aaaucagaagucaucuug

SEQ ID NO: 1238690 - RNA, 21 nt, Human
aaaucagaagucaucuugcua

SEQ ID NO: 1238691 - RNA, 17 nt, Human
aaaucacgcuuuuugaa

SEQ ID NO: 1238692 - RNA, 15 nt, Human
aaauauuccugcauu

SEQ ID NO: 1238693 - RNA, 18 nt, Human
aaauauucccuagaaacu

SEQ ID NO: 1238694 - RNA, 19 nt, Human
aaauauucccuagaaacuu

SEQ ID NO: 1238695 - RNA, 19 nt, Human
aaaucaccacaaacuguaa

SEQ ID NO: 1238696 - RNA, 20 nt, Human
aaaucaccacaaacuguaau

SEQ ID NO: 1238697 - RNA, 20 nt, Human
aaaucacgcuuuuugaaaaa

SEQ ID NO: 1238698 - RNA, 12 nt, Human
aaaucagaaguc

SEQ ID NO: 1238699 - RNA, 17 nt, Human
aaauauuaugagaugcu

SEQ ID NO: 1238700 - RNA, 17 nt, Human
aaauauuauguuaaaac

SEQ ID NO: 1238701 - RNA, 16 nt, Human
aaauauuaugagaugc

SEQ ID NO: 1238702 - RNA, 14 nt, Human
aaauauuagaaaca

SEQ ID NO: 1238703 - RNA, 17 nt, Human
aaauauuagaaacagcu

SEQ ID NO: 1238704 - RNA, 13 nt, Human
aaauauacuuuua

SEQ ID NO: 1238705 - RNA, 15 nt, Human
aaauccacuuuaucu

SEQ ID NO: 1238706 - RNA, 17 nt, Human
aaaucauuuuaugucaa

SEQ ID NO: 1238707 - RNA, 14 nt, Human
aaaucauuuugcaa

SEQ ID NO: 1238708 - RNA, 15 nt, Human
aaaucauuuuauguc

SEQ ID NO: 1238709 - RNA, 14 nt, Human
aaaucauuuuaugu

SEQ ID NO: 1238710 - RNA, 12 nt, Human
aaaucauuuguu

SEQ ID NO: 1238711 - RNA, 22 nt, Human
aaaucaggcuuuuguuuccuuu

SEQ ID NO: 1238712 - RNA, 23 nt, Human
aaaucaggcuuuuguuuccuuuu

SEQ ID NO: 1238713 - RNA, 11 nt, Human
aaaucaguaag

SEQ ID NO: 1238714 - RNA, 13 nt, Human
aaaucaguaagag

SEQ ID NO: 1238715 - RNA, 15 nt, Human
aaaucaguaagaggu

SEQ ID NO: 1238716 - RNA, 19 nt, Human
aaaucaguaagagguguua

SEQ ID NO: 1238717 - RNA, 16 nt, Human
aaaucaguaagaggug

SEQ ID NO: 1238718 - RNA, 22 nt, Human
aaaucauaagauauuuuucaug

SEQ ID NO: 1238719 - RNA, 20 nt, Human
guaauaggcguaacuaauuu

SEQ ID NO: 1238720 - RNA, 15 nt, Human
guaacugcuuucugu

SEQ ID NO: 1238721 - RNA, 17 nt, Human
guaacugcuuucuguuc

SEQ ID NO: 1238722 - RNA, 19 nt, Human
guaacugcuuucuguucca

SEQ ID NO: 1238723 - RNA, 20 nt, Human
guaacugcuuucuguuccaa

SEQ ID NO: 1238724 - RNA, 22 nt, Human
guaacugcuuucuguuccaaau

SEQ ID NO: 1238725 - RNA, 15 nt, Human
guaacucaucuguca

SEQ ID NO: 1238726 - RNA, 12 nt, Human
guaacugccagg

SEQ ID NO: 1238727 - RNA, 14 nt, Human
guaacugccuagaa

SEQ ID NO: 1238728 - RNA, 16 nt, Human
guaacugccuagaaac

SEQ ID NO: 1238729 - RNA, 20 nt, Human
guaacugccuagaaacaaca

SEQ ID NO: 1238730 - RNA, 17 nt, Human
guaacugccuagaaaca

SEQ ID NO: 1238731 - RNA, 14 nt, Human
guaacugcuuucug

SEQ ID NO: 1238732 - RNA, 16 nt, Human
guaaacuuuuugugcu

SEQ ID NO: 1238733 - RNA, 20 nt, Human
guaaacuguguauuccaaga

SEQ ID NO: 1238734 - RNA, 13 nt, Human
guaaacuguuucu

SEQ ID NO: 1238735 - RNA, 15 nt, Human
guaaacuguuucuuu

SEQ ID NO: 1238736 - RNA, 19 nt, Human
guaaacuuuaucacuuaaa

SEQ ID NO: 1238737 - RNA, 17 nt, Human
guaaacuuuaucacuua

SEQ ID NO: 1238738 - RNA, 21 nt, Human
guaauccaagcaaaugugaau

SEQ ID NO: 1238739 - RNA, 16 nt, Human
guaauauugacuugua

SEQ ID NO: 1238740 - RNA, 20 nt, Human
guaauuguguuuacauuuua

SEQ ID NO: 1238741 - RNA, 18 nt, Human
guaauuguguuuacauuu

SEQ ID NO: 1238742 - RNA, 17 nt, Human
guaauuguguuuacauu

SEQ ID NO: 1238743 - RNA, 21 nt, Human
guaauuguugcuaaucuucuu

SEQ ID NO: 1238744 - RNA, 15 nt, Human
guaauuguguuuaca

SEQ ID NO: 1238745 - RNA, 13 nt, Human
guaauuguguuua

SEQ ID NO: 1238746 - RNA, 15 nt, Human
guaauuguguggauu

SEQ ID NO: 1238747 - RNA, 21 nt, Human
guaauuguguggauucuuuaa

SEQ ID NO: 1238748 - RNA, 21 nt, Human
guaauuuaaaauaauuauaua

SEQ ID NO: 1238749 - RNA, 12 nt, Human
guaauuuaacuu

SEQ ID NO: 1238750 - RNA, 18 nt, Human
guaauuuagaaaucauuu

SEQ ID NO: 1238751 - RNA, 18 nt, Human
guaauuuggaucucuucu

SEQ ID NO: 1238752 - RNA, 16 nt, Human
guaauuugaggacaac

SEQ ID NO: 1238753 - RNA, 23 nt, Human
guaauuugagagaaauaugaaga

SEQ ID NO: 1238754 - RNA, 18 nt, Human
aaauacauuguauauaug

SEQ ID NO: 1238755 - RNA, 13 nt, Human
aaauacaugcuaa

SEQ ID NO: 1238756 - RNA, 18 nt, Human
aaauacaugcuaagagaa

SEQ ID NO: 1238757 - RNA, 17 nt, Human
aaauacauuuaaaacau

SEQ ID NO: 1238758 - RNA, 23 nt, Human
aaauacuaaugaaaacagaaugu

SEQ ID NO: 1238759 - RNA, 20 nt, Human
aaauacuauuuaaagccucc

SEQ ID NO: 1238760 - RNA, 15 nt, Human
aaauacugcaaauca

SEQ ID NO: 1238761 - RNA, 13 nt, Human
aaauacaagacug

SEQ ID NO: 1238762 - RNA, 13 nt, Human
aaauacaauuuuu

SEQ ID NO: 1238763 - RNA, 15 nt, Human
aaauacagacuggau

SEQ ID NO: 1238764 - RNA, 13 nt, Human
aaauacaggaaac

SEQ ID NO: 1238765 - RNA, 14 nt, Human
aaauacaggaaaca

SEQ ID NO: 1238766 - RNA, 16 nt, Human
aaauacaggaaacagu

SEQ ID NO: 1238767 - RNA, 22 nt, Human
aaauacagucuuccauuugcaa

SEQ ID NO: 1238768 - RNA, 23 nt, Human
aaauacagucuuccauuugcaag

SEQ ID NO: 1238769 - RNA, 13 nt, Human
aaauacaugacau

SEQ ID NO: 1238770 - RNA, 14 nt, Human
aaauacaagacugc

SEQ ID NO: 1238771 - RNA, 15 nt, Human
aaauacaaaaauacu

SEQ ID NO: 1238772 - RNA, 11 nt, Human
aaauacaaaaa

SEQ ID NO: 1238773 - RNA, 22 nt, Human
aaauaauuuuuauauuugaaau

SEQ ID NO: 1238774 - RNA, 23 nt, Human
aaauaauuuuuauauuugaaaua

SEQ ID NO: 1238775 - RNA, 23 nt, Human
guacacugccuucucaacuccaa

SEQ ID NO: 1238776 - RNA, 13 nt, Human
guacacucugcug

SEQ ID NO: 1238777 - RNA, 18 nt, Human
guacacucugcuguuuga

SEQ ID NO: 1238778 - RNA, 14 nt, Human
guacacucugcugu

SEQ ID NO: 1238779 - RNA, 18 nt, Human
guacacagcaccagaaug

SEQ ID NO: 1238780 - RNA, 20 nt, Human
guacacagcucuagacacug

SEQ ID NO: 1238781 - RNA, 20 nt, Human
guaauuuuguguaagaaaua

SEQ ID NO: 1238782 - RNA, 21 nt, Human
guaauuuuuuuaauuuacaaa

SEQ ID NO: 1238783 - RNA, 22 nt, Human
guaauuuuacacgcuuuuguga

SEQ ID NO: 1238784 - RNA, 20 nt, Human
guaauuuuacacgcuuuugu

SEQ ID NO: 1238785 - RNA, 14 nt, Human
guaauuuuggauuu

SEQ ID NO: 1238786 - RNA, 17 nt, Human
guaauuuuggauuuugc

SEQ ID NO: 1238787 - RNA, 14 nt, Human
guaauuuuguguaa

SEQ ID NO: 1238788 - RNA, 16 nt, Human
guaauuuuguguaaga

SEQ ID NO: 1238789 - RNA, 22 nt, Human
aaaguugcuauuugaacuuuuu

SEQ ID NO: 1238790 - RNA, 17 nt, Human
aaaguugguaaaccuuu

SEQ ID NO: 1238791 - RNA, 16 nt, Human
aaaguugguaaaccuu

SEQ ID NO: 1238792 - RNA, 13 nt, Human
aaaguuguuguaa

SEQ ID NO: 1238793 - RNA, 12 nt, Human
aaaguuuaauaa

SEQ ID NO: 1238794 - RNA, 15 nt, Human
aaaguuuaauaaauu

SEQ ID NO: 1238795 - RNA, 20 nt, Human
aaaguuuaaaacagaagccu

SEQ ID NO: 1238796 - RNA, 16 nt, Human
aaauaaaaagugcuuu

SEQ ID NO: 1238797 - RNA, 13 nt, Human
aaauaaaaagaaa

SEQ ID NO: 1238798 - RNA, 19 nt, Human
aaauaaaaagaaaggcugu

SEQ ID NO: 1238799 - RNA, 20 nt, Human
aaauaaaaagaaaggcuguu

SEQ ID NO: 1238800 - RNA, 17 nt, Human
aaauaacagauuucuca

SEQ ID NO: 1238801 - RNA, 19 nt, Human
aaauaaccaauccuggaca

SEQ ID NO: 1238802 - RNA, 13 nt, Human
aaauaacuggaaa

SEQ ID NO: 1238803 - RNA, 16 nt, Human
aaauaacuggaaaaca

SEQ ID NO: 1238804 - RNA, 19 nt, Human
aaauaacuggaaaacagaa

SEQ ID NO: 1238805 - RNA, 20 nt, Human
aaauaacuggaaaacagaac

SEQ ID NO: 1238806 - RNA, 21 nt, Human
aaauaacuggaaaacagaaca

SEQ ID NO: 1238807 - RNA, 13 nt, Human
aaauaauaauuuu

SEQ ID NO: 1238808 - RNA, 13 nt, Human
aaauaauacauua

SEQ ID NO: 1238809 - RNA, 17 nt, Human
aaauaauacugcugaga

SEQ ID NO: 1238810 - RNA, 13 nt, Human
aaauaaguuuuug

SEQ ID NO: 1238811 - RNA, 16 nt, Human
aaauaaguuuuuguuu

SEQ ID NO: 1238812 - RNA, 14 nt, Human
aaauaaucaaaagc

SEQ ID NO: 1238813 - RNA, 14 nt, Human
aaauaaucauucuu

SEQ ID NO: 1238814 - RNA, 15 nt, Human
aaauaaucaaaagcu

SEQ ID NO: 1238815 - RNA, 24 nt, Human
aaauaagaaacaacucuuugagaa

SEQ ID NO: 1238816 - RNA, 12 nt, Human
aaauaagaaacu

SEQ ID NO: 1238817 - RNA, 14 nt, Human
aaauaagaaacuuu

SEQ ID NO: 1238818 - RNA, 21 nt, Human
aaauaagaaacuuuuuuauuu

SEQ ID NO: 1238819 - RNA, 15 nt, Human
aaauaagaaacuuuu

SEQ ID NO: 1238820 - RNA, 14 nt, Human
aaauaagaagaaug

SEQ ID NO: 1238821 - RNA, 15 nt, Human
aaauaagaagaaugc

SEQ ID NO: 1238822 - RNA, 20 nt, Human
aaauaagaagaaugcuuaau

SEQ ID NO: 1238823 - RNA, 14 nt, Human
aaauaagaauagaa

SEQ ID NO: 1238824 - RNA, 17 nt, Human
aaauaagaauagaaaua

SEQ ID NO: 1238825 - RNA, 23 nt, Human
aaauaagacggauuuauuuuucc

SEQ ID NO: 1238826 - RNA, 17 nt, Human
aaauaagagcucaggau

SEQ ID NO: 1238827 - RNA, 12 nt, Human
aaauaagauucu

SEQ ID NO: 1238828 - RNA, 13 nt, Human
aaauaagauucua

SEQ ID NO: 1238829 - RNA, 13 nt, Human
guaaaccuuuuau

SEQ ID NO: 1238830 - RNA, 20 nt, Human
guaaaccacugaaaaaauau

SEQ ID NO: 1238831 - RNA, 18 nt, Human
guaaaccacugaaaaaau

SEQ ID NO: 1238832 - RNA, 19 nt, Human
guaaaccacugaaaaaaua

SEQ ID NO: 1238833 - RNA, 22 nt, Human
guaaaccacugaaaaaauauau

SEQ ID NO: 1238834 - RNA, 23 nt, Human
guaaaccaauccuaugcaugguu

SEQ ID NO: 1238835 - RNA, 12 nt, Human
guaaaccacuga

SEQ ID NO: 1238836 - RNA, 13 nt, Human
guaaaccacugaa

SEQ ID NO: 1238837 - RNA, 14 nt, Human
guaaaccacugaaa

SEQ ID NO: 1238838 - RNA, 16 nt, Human
guaaaccacugaaaaa

SEQ ID NO: 1238839 - RNA, 19 nt, Human
aaauaauuuuaucucuuuc

SEQ ID NO: 1238840 - RNA, 12 nt, Human
aaauaauuuugu

SEQ ID NO: 1238841 - RNA, 15 nt, Human
aaauaauuuuuauau

SEQ ID NO: 1238842 - RNA, 20 nt, Human
guaaacagauggcacuuuga

SEQ ID NO: 1238843 - RNA, 13 nt, Human
aaauaauuuugua

SEQ ID NO: 1238844 - RNA, 14 nt, Human
aaauaauuuuguaa

SEQ ID NO: 1238845 - RNA, 13 nt, Human
aaauaauuguugu

SEQ ID NO: 1238846 - RNA, 15 nt, Human
aaauaauuguuguuc

SEQ ID NO: 1238847 - RNA, 12 nt, Human
aaauaauuuuaa

SEQ ID NO: 1238848 - RNA, 17 nt, Human
aaauaauuguuguucug

SEQ ID NO: 1238849 - RNA, 14 nt, Human
aaauaauuuuaaac

SEQ ID NO: 1238850 - RNA, 18 nt, Human
aaauaauuuuaaacaaag

SEQ ID NO: 1238851 - RNA, 20 nt, Human
aaauaauuuuaaacaaaggu

SEQ ID NO: 1238852 - RNA, 12 nt, Human
aaaguauguucu

SEQ ID NO: 1238853 - RNA, 15 nt, Human
aaaguauuaaaaugc

SEQ ID NO: 1238854 - RNA, 19 nt, Human
aaaguauguucuaaccuuu

SEQ ID NO: 1238855 - RNA, 12 nt, Human
aaaguauucuuc

SEQ ID NO: 1238856 - RNA, 22 nt, Human
aaaguauucuucucuuccuuuu

SEQ ID NO: 1238857 - RNA, 16 nt, Human
aaaguuaccagugccu

SEQ ID NO: 1238858 - RNA, 22 nt, Human
aaaguuaccagugccuuaaacu

SEQ ID NO: 1238859 - RNA, 23 nt, Human
aaaguugcagcuguuuuguugac

SEQ ID NO: 1238860 - RNA, 21 nt, Human
aaaguucuguacucaaaugua

SEQ ID NO: 1238861 - RNA, 23 nt, Human
aaaguucugcagauaaacaguag

SEQ ID NO: 1238862 - RNA, 18 nt, Human
aaaguucuaauaauuucu

SEQ ID NO: 1238863 - RNA, 19 nt, Human
aaaguucuaauaauuucua

SEQ ID NO: 1238864 - RNA, 20 nt, Human
aaaguucuaauaauuucuaa

SEQ ID NO: 1238865 - RNA, 21 nt, Human
aaaguucuaauaauuucuaau

SEQ ID NO: 1238866 - RNA, 14 nt, Human
aaaguucuguacuc

SEQ ID NO: 1238867 - RNA, 18 nt, Human
aaaguuaguaucuuuuga

SEQ ID NO: 1238868 - RNA, 21 nt, Human
aaaguuaguaucuuuugauau

SEQ ID NO: 1238869 - RNA, 20 nt, Human
aaaguuaguaucuuuugaua

SEQ ID NO: 1238870 - RNA, 15 nt, Human
aaaguucuaagauuc

SEQ ID NO: 1238871 - RNA, 16 nt, Human
aaaguucuaagauucu

SEQ ID NO: 1238872 - RNA, 17 nt, Human
aaaguucuaagauucug

SEQ ID NO: 1238873 - RNA, 18 nt, Human
aaaguauguuagugcaaa

SEQ ID NO: 1238874 - RNA, 16 nt, Human
aaaguaguccugugaa

SEQ ID NO: 1238875 - RNA, 21 nt, Human
aaagguccacaggucuagacu

SEQ ID NO: 1238876 - RNA, 20 nt, Human
aaagguauuuuaaucaccaa

SEQ ID NO: 1238877 - RNA, 19 nt, Human
aaagguccacaggucuaga

SEQ ID NO: 1238878 - RNA, 20 nt, Human
aaagguccacaggucuagac

SEQ ID NO: 1238879 - RNA, 19 nt, Human
ggugcugggccccugccuc

SEQ ID NO: 1238880 - RNA, 22 nt, Human
ggugcuucuaguucugccagga

SEQ ID NO: 1238881 - RNA, 14 nt, Human
ggugcuucuccucu

SEQ ID NO: 1238882 - RNA, 15 nt, Human
gguggaacaagcaca

SEQ ID NO: 1238883 - RNA, 21 nt, Human
gguggaaaggugugagacugg

SEQ ID NO: 1238884 - RNA, 19 nt, Human
gguggaagcuuggggaaga

SEQ ID NO: 1238885 - RNA, 13 nt, Human
gguggagggccac

SEQ ID NO: 1238886 - RNA, 23 nt, Human
gguggagggccacaugggaggcu

SEQ ID NO: 1238887 - RNA, 16 nt, Human
ggugcugggccccugc

SEQ ID NO: 1238888 - RNA, 15 nt, Human
ggugcugggccccug

SEQ ID NO: 1238889 - RNA, 13 nt, Human
ggugcugggcccc

SEQ ID NO: 1238890 - RNA, 11 nt, Human
ggugcugggcc

SEQ ID NO: 1238891 - RNA, 21 nt, Human
ggugcauauuuauaaaaauaa

SEQ ID NO: 1238892 - RNA, 16 nt, Human
ggugcagggauguggg

SEQ ID NO: 1238893 - RNA, 20 nt, Human
ggucgcccuggacugugugc

SEQ ID NO: 1238894 - RNA, 22 nt, Human
ggucgaggaguaacaauacaaa

SEQ ID NO: 1238895 - RNA, 19 nt, Human
ggugaaacauuuucucccu

SEQ ID NO: 1238896 - RNA, 20 nt, Human
ggugaaacauuuucucccug

SEQ ID NO: 1238897 - RNA, 13 nt, Human
ggugaaaggaaau

SEQ ID NO: 1238898 - RNA, 14 nt, Human
ggucgcccuggacu

SEQ ID NO: 1238899 - RNA, 16 nt, Human
ggucgaggaguaacaa

SEQ ID NO: 1238900 - RNA, 15 nt, Human
gguccuuugggguga

SEQ ID NO: 1238901 - RNA, 16 nt, Human
gguccuuuugacacug

SEQ ID NO: 1238902 - RNA, 18 nt, Human
gguccuuuugacacugcu

SEQ ID NO: 1238903 - RNA, 18 nt, Human
ggugaacaaagcagccac

SEQ ID NO: 1238904 - RNA, 19 nt, Human
ggugaacaaagcagccacg

SEQ ID NO: 1238905 - RNA, 14 nt, Human
aaagguaaaucaga

SEQ ID NO: 1238906 - RNA, 14 nt, Human
aaagguacuucaaa

SEQ ID NO: 1238907 - RNA, 17 nt, Human
aaagggagucugccagg

SEQ ID NO: 1238908 - RNA, 12 nt, Human
aaaggagccugu

SEQ ID NO: 1238909 - RNA, 21 nt, Human
aaagggagaagugacauugca

SEQ ID NO: 1238910 - RNA, 11 nt, Human
aaaggagccug

SEQ ID NO: 1238911 - RNA, 17 nt, Human
aaagggagggcucugag

SEQ ID NO: 1238912 - RNA, 18 nt, Human
aaagggagggcucugagg

SEQ ID NO: 1238913 - RNA, 19 nt, Human
aaagggagggcucugaggc

SEQ ID NO: 1238914 - RNA, 22 nt, Human
aaagggagggcucugaggcgcc

SEQ ID NO: 1238915 - RNA, 22 nt, Human
aaaggaagcauuguaaaauaau

SEQ ID NO: 1238916 - RNA, 15 nt, Human
aaaggaaaucaaaug

SEQ ID NO: 1238917 - RNA, 17 nt, Human
aaaggaaaucaaaugaa

SEQ ID NO: 1238918 - RNA, 17 nt, Human
aaaggaagcauuguaaa

SEQ ID NO: 1238919 - RNA, 20 nt, Human
aaaggaagcauuguaaaaua

SEQ ID NO: 1238920 - RNA, 12 nt, Human
aaaggaagccaa

SEQ ID NO: 1238921 - RNA, 14 nt, Human
aaaggaagccaaag

SEQ ID NO: 1238922 - RNA, 15 nt, Human
aaaggaagccaaaga

SEQ ID NO: 1238923 - RNA, 23 nt, Human
aaagcugcugagaaucuagccuc

SEQ ID NO: 1238924 - RNA, 12 nt, Human
aaagcugaaaac

SEQ ID NO: 1238925 - RNA, 10 nt, Human
aaagcugccu

SEQ ID NO: 1238926 - RNA, 16 nt, Human
aaagcugguuuaaugu

SEQ ID NO: 1238927 - RNA, 15 nt, Human
aaagcugguuuaaug

SEQ ID NO: 1238928 - RNA, 13 nt, Human
aaagcuuucagaa

SEQ ID NO: 1238929 - RNA, 12 nt, Human
aaagcuuuccug

SEQ ID NO: 1238930 - RNA, 13 nt, Human
aaagcuuuccugc

SEQ ID NO: 1238931 - RNA, 14 nt, Human
aaagcuuuccugcc

SEQ ID NO: 1238932 - RNA, 22 nt, Human
aaagcuuuccugccccaggccu

SEQ ID NO: 1238933 - RNA, 23 nt, Human
aaagcuuuccugccccaggccug

SEQ ID NO: 1238934 - RNA, 17 nt, Human
aaagcucaaagguuugg

SEQ ID NO: 1238935 - RNA, 23 nt, Human
aaagcucaaagguuuggaaggag

SEQ ID NO: 1238936 - RNA, 15 nt, Human
aaagcugaaaacugc

SEQ ID NO: 1238937 - RNA, 14 nt, Human
aaagcucuagaauc

SEQ ID NO: 1238938 - RNA, 20 nt, Human
gguggaugauccccacgcca

SEQ ID NO: 1238939 - RNA, 19 nt, Human
aaagcacgaaauguuauuu

SEQ ID NO: 1238940 - RNA, 17 nt, Human
aaagcacgacaguggau

SEQ ID NO: 1238941 - RNA, 13 nt, Human
aaagacagugaaa

SEQ ID NO: 1238942 - RNA, 16 nt, Human
aaagacaugaagccac

SEQ ID NO: 1238943 - RNA, 19 nt, Human
aaagacauucaggacugcu

SEQ ID NO: 1238944 - RNA, 14 nt, Human
aaagaccaggccaa

SEQ ID NO: 1238945 - RNA, 15 nt, Human
aaagaccauuuuucc

SEQ ID NO: 1238946 - RNA, 14 nt, Human
aaagacccuggcuu

SEQ ID NO: 1238947 - RNA, 18 nt, Human
aaagacccuggcuuucau

SEQ ID NO: 1238948 - RNA, 18 nt, Human
aaagacguuuuauaagca

SEQ ID NO: 1238949 - RNA, 20 nt, Human
aaacuuguaauuuuuuuaau

SEQ ID NO: 1238950 - RNA, 18 nt, Human
aaacuuuccucgccugac

SEQ ID NO: 1238951 - RNA, 20 nt, Human
aaacuuucauuccuucagau

SEQ ID NO: 1238952 - RNA, 16 nt, Human
aaacuuugaaguuagc

SEQ ID NO: 1238953 - RNA, 19 nt, Human
aaacuuuggaaccagacuc

SEQ ID NO: 1238954 - RNA, 12 nt, Human
aaacuuuguagu

SEQ ID NO: 1238955 - RNA, 16 nt, Human
aaacuuuuaauucauu

SEQ ID NO: 1238956 - RNA, 16 nt, Human
aaacuuguauuaugug

SEQ ID NO: 1238957 - RNA, 16 nt, Human
aaacuuguaauuuuuu

SEQ ID NO: 1238958 - RNA, 19 nt, Human
aaacuugcaucacuuaacg

SEQ ID NO: 1238959 - RNA, 13 nt, Human
aaacuuggauacu

SEQ ID NO: 1238960 - RNA, 17 nt, Human
aaacuuggauacuugga

SEQ ID NO: 1238961 - RNA, 18 nt, Human
aaacuuggauacuuggau

SEQ ID NO: 1238962 - RNA, 20 nt, Human
aaacuuggauacuuggauuu

SEQ ID NO: 1238963 - RNA, 24 nt, Human
aaacuuggcucgaaucucugugcc

SEQ ID NO: 1238964 - RNA, 19 nt, Human
aaacuuggauacuuggauu

SEQ ID NO: 1238965 - RNA, 23 nt, Human
aaacuucagcgguuuauauaagc

SEQ ID NO: 1238966 - RNA, 22 nt, Human
aaacuucaguuucacagaaaau

SEQ ID NO: 1238967 - RNA, 20 nt, Human
aaacuucaguuucacagaaa

SEQ ID NO: 1238968 - RNA, 15 nt, Human
ggguggggggggugc

SEQ ID NO: 1238969 - RNA, 14 nt, Human
ggguggggagagac

SEQ ID NO: 1238970 - RNA, 18 nt, Human
ggguggggagagacgggc

SEQ ID NO: 1238971 - RNA, 14 nt, Human
gggugggggcagca

SEQ ID NO: 1238972 - RNA, 21 nt, Human
gguccugagcacugccaggag

SEQ ID NO: 1238973 - RNA, 22 nt, Human
gguccugagcacugccaggagg

SEQ ID NO: 1238974 - RNA, 23 nt, Human
gguccugagcacugccaggaggg

SEQ ID NO: 1238975 - RNA, 21 nt, Human
gguccugguggggcagcuccu

SEQ ID NO: 1238976 - RNA, 10 nt, Human
gguccuucaa

SEQ ID NO: 1238977 - RNA, 21 nt, Human
aaagauggcugugccucugcc

SEQ ID NO: 1238978 - RNA, 22 nt, Human
aaagauggcugugccucugccu

SEQ ID NO: 1238979 - RNA, 19 nt, Human
aaagaugcuuuuaacagag

SEQ ID NO: 1238980 - RNA, 15 nt, Human
aaagauggaguuucu

SEQ ID NO: 1238981 - RNA, 16 nt, Human
aaagauggaguuucua

SEQ ID NO: 1238982 - RNA, 17 nt, Human
aaagauggaguuucuaa

SEQ ID NO: 1238983 - RNA, 18 nt, Human
aaagauggaguuucuaag

SEQ ID NO: 1238984 - RNA, 19 nt, Human
aaagauggaguuucuaagg

SEQ ID NO: 1238985 - RNA, 21 nt, Human
aaagauggaguuucuaagguc

SEQ ID NO: 1238986 - RNA, 23 nt, Human
aaagauggcugugccucugccug

SEQ ID NO: 1238987 - RNA, 19 nt, Human
aaagcaagcugauuaaaug

SEQ ID NO: 1238988 - RNA, 20 nt, Human
aaagcaagcugauuaaauga

SEQ ID NO: 1238989 - RNA, 14 nt, Human
aaagcaaggaaacu

SEQ ID NO: 1238990 - RNA, 20 nt, Human
aaagcaaggaaacuauguaa

SEQ ID NO: 1238991 - RNA, 14 nt, Human
aaagcaauaugcau

SEQ ID NO: 1238992 - RNA, 19 nt, Human
aaagaggcaccaggaagcc

SEQ ID NO: 1238993 - RNA, 12 nt, Human
aaagaugcuuuu

SEQ ID NO: 1238994 - RNA, 13 nt, Human
aaagaugcuuuua

SEQ ID NO: 1238995 - RNA, 15 nt, Human
aaagaggaaugaagu

SEQ ID NO: 1238996 - RNA, 23 nt, Human
aaagacgcacuuuggcuuauaau

SEQ ID NO: 1238997 - RNA, 15 nt, Human
aaagacguuuuauaa

SEQ ID NO: 1238998 - RNA, 12 nt, Human
aaagacuggcuu

SEQ ID NO: 1238999 - RNA, 13 nt, Human
aaagacuggcuuu

SEQ ID NO: 1239000 - RNA, 21 nt, Human
aaagacuggcuuuuauuaaug

SEQ ID NO: 1239001 - RNA, 23 nt, Human
aaagacuggcuuuuauuaaugca

SEQ ID NO: 1239002 - RNA, 14 nt, Human
aaagagauacagag

SEQ ID NO: 1239003 - RNA, 15 nt, Human
gggucgcccuggacu

SEQ ID NO: 1239004 - RNA, 13 nt, Human
gggucgcccugga

SEQ ID NO: 1239005 - RNA, 14 nt, Human
gggucggcugacca

SEQ ID NO: 1239006 - RNA, 15 nt, Human
gggucggcugaccau

SEQ ID NO: 1239007 - RNA, 20 nt, Human
gggucggcugaccaugcuca

SEQ ID NO: 1239008 - RNA, 12 nt, Human
ggguccaugggc

SEQ ID NO: 1239009 - RNA, 13 nt, Human
gggucccagcagc

SEQ ID NO: 1239010 - RNA, 19 nt, Human
ggguccuuuugacacugcu

SEQ ID NO: 1239011 - RNA, 22 nt, Human
ggguccuuuugacacugcucua

SEQ ID NO: 1239012 - RNA, 14 nt, Human
gggucgaaagcucu

SEQ ID NO: 1239013 - RNA, 16 nt, Human
gggucgaaagcucuag

SEQ ID NO: 1239014 - RNA, 19 nt, Human
gggggugcugggccccugc

SEQ ID NO: 1239015 - RNA, 20 nt, Human
ggggguccuccuccagggac

SEQ ID NO: 1239016 - RNA, 12 nt, Human
gggggucuggcu

SEQ ID NO: 1239017 - RNA, 16 nt, Human
gggggucuggcuggug

SEQ ID NO: 1239018 - RNA, 17 nt, Human
gggggucuggcuggugu

SEQ ID NO: 1239019 - RNA, 22 nt, Human
gggggucuggcugguguuaaca

SEQ ID NO: 1239020 - RNA, 18 nt, Human
gggggugaugagggcagc

SEQ ID NO: 1239021 - RNA, 20 nt, Human
gggggugaugagggcagcag

SEQ ID NO: 1239022 - RNA, 22 nt, Human
gggggugaugagggcagcagcc

SEQ ID NO: 1239023 - RNA, 13 nt, Human
ggggguggccagg

SEQ ID NO: 1239024 - RNA, 20 nt, Human
ggggguggccaggccgggaa

SEQ ID NO: 1239025 - RNA, 13 nt, Human
ggggguggccgcu

SEQ ID NO: 1239026 - RNA, 11 nt, Human
ggguccaggag

SEQ ID NO: 1239027 - RNA, 12 nt, Human
ggguccaggagg

SEQ ID NO: 1239028 - RNA, 18 nt, Human
gggggcgcggcugggagg

SEQ ID NO: 1239029 - RNA, 20 nt, Human
gggggccuggcuggcugagg

SEQ ID NO: 1239030 - RNA, 15 nt, Human
gggggcgccuguggu

SEQ ID NO: 1239031 - RNA, 11 nt, Human
gggggccuggc

SEQ ID NO: 1239032 - RNA, 12 nt, Human
gggggccuggcu

SEQ ID NO: 1239033 - RNA, 13 nt, Human
gggggccuggcug

SEQ ID NO: 1239034 - RNA, 14 nt, Human
gggggccuggcugg

SEQ ID NO: 1239035 - RNA, 15 nt, Human
gggggccuggcuggc

SEQ ID NO: 1239036 - RNA, 17 nt, Human
gggggccuggcuggcug

SEQ ID NO: 1239037 - RNA, 15 nt, Human
gggggcggccuauga

SEQ ID NO: 1239038 - RNA, 16 nt, Human
ggggguccuccuccag

SEQ ID NO: 1239039 - RNA, 18 nt, Human
ggggguccuccuccaggg

SEQ ID NO: 1239040 - RNA, 19 nt, Human
ggggguccuccuccaggga

SEQ ID NO: 1239041 - RNA, 18 nt, Human
aaaccuuuuauauuuagu

SEQ ID NO: 1239042 - RNA, 18 nt, Human
aaaccuuuguuugcaucu

SEQ ID NO: 1239043 - RNA, 17 nt, Human
aaaccuuucuucaccaa

SEQ ID NO: 1239044 - RNA, 13 nt, Human
aaaccuuuugaaa

SEQ ID NO: 1239045 - RNA, 18 nt, Human
aaaccugaccccugcuca

SEQ ID NO: 1239046 - RNA, 16 nt, Human
aaaccugagauuuauu

SEQ ID NO: 1239047 - RNA, 21 nt, Human
aaaccugagauuuauuaaaga

SEQ ID NO: 1239048 - RNA, 22 nt, Human
aaaccugagauuuauuaaagaa

SEQ ID NO: 1239049 - RNA, 23 nt, Human
aaaccugagauuuauuaaagaaa

SEQ ID NO: 1239050 - RNA, 16 nt, Human
aaaccaauugcugcua

SEQ ID NO: 1239051 - RNA, 17 nt, Human
aaaccaauccuaugcau

SEQ ID NO: 1239052 - RNA, 14 nt, Human
aaaccucaccaacu

SEQ ID NO: 1239053 - RNA, 15 nt, Human
aaacauuaugaugug

SEQ ID NO: 1239054 - RNA, 18 nt, Human
aaacauuauuaaguaacu

SEQ ID NO: 1239055 - RNA, 12 nt, Human
aaacauucuauc

SEQ ID NO: 1239056 - RNA, 20 nt, Human
aaacauuaauagcagccuuu

SEQ ID NO: 1239057 - RNA, 22 nt, Human
aaacauuaauagcagccuuucu

SEQ ID NO: 1239058 - RNA, 21 nt, Human
aaacauuaauagcagccuuuc

SEQ ID NO: 1239059 - RNA, 15 nt, Human
aaacucguuaauuug

SEQ ID NO: 1239060 - RNA, 16 nt, Human
aaacucagggcuucua

SEQ ID NO: 1239061 - RNA, 21 nt, Human
aaacucauucauuagucaugu

SEQ ID NO: 1239062 - RNA, 13 nt, Human
aaacucaaaauau

SEQ ID NO: 1239063 - RNA, 21 nt, Human
aaacucaaaauauuuguacau

SEQ ID NO: 1239064 - RNA, 22 nt, Human
aaacuaggugcauauuuauaaa

SEQ ID NO: 1239065 - RNA, 18 nt, Human
aaacuagggccaagccca

SEQ ID NO: 1239066 - RNA, 22 nt, Human
aaacuauaagcaagaaggcaaa

SEQ ID NO: 1239067 - RNA, 16 nt, Human
aaacuaucuuggugaa

SEQ ID NO: 1239068 - RNA, 13 nt, Human
aaacgucuuaaau

SEQ ID NO: 1239069 - RNA, 18 nt, Human
aaacuaggugcauauuua

SEQ ID NO: 1239070 - RNA, 14 nt, Human
aaacgucuuaaaua

SEQ ID NO: 1239071 - RNA, 15 nt, Human
aaacgucuuaaauau

SEQ ID NO: 1239072 - RNA, 13 nt, Human
ggguggcagcaac

SEQ ID NO: 1239073 - RNA, 12 nt, Human
ggguggccaggc

SEQ ID NO: 1239074 - RNA, 13 nt, Human
ggguggccaggcc

SEQ ID NO: 1239075 - RNA, 14 nt, Human
ggguggccaggccg

SEQ ID NO: 1239076 - RNA, 18 nt, Human
ggguggccaggccgggaa

SEQ ID NO: 1239077 - RNA, 20 nt, Human
ggguggccaggccgggaaaa

SEQ ID NO: 1239078 - RNA, 17 nt, Human
ggguggccgcugagugg

SEQ ID NO: 1239079 - RNA, 21 nt, Human
ggguggccgcugaguggcagg

SEQ ID NO: 1239080 - RNA, 19 nt, Human
aaacuguguauuccaagac

SEQ ID NO: 1239081 - RNA, 22 nt, Human
aaacugcccccucugcccugcg

SEQ ID NO: 1239082 - RNA, 16 nt, Human
aaacucguuuuuuaca

SEQ ID NO: 1239083 - RNA, 12 nt, Human
aaacugugcacc

SEQ ID NO: 1239084 - RNA, 10 nt, Human
aaacugugua

SEQ ID NO: 1239085 - RNA, 14 nt, Human
aaacuguguaacug

SEQ ID NO: 1239086 - RNA, 17 nt, Human
aaacuguguaacugccc

SEQ ID NO: 1239087 - RNA, 20 nt, Human
aaacuguguaacugcccaaa

SEQ ID NO: 1239088 - RNA, 20 nt, Human
aaacuguguacauaacugaa

SEQ ID NO: 1239089 - RNA, 21 nt, Human
aaacuguguacauaacugaaa

SEQ ID NO: 1239090 - RNA, 16 nt, Human
aaacuguguauuccaa

SEQ ID NO: 1239091 - RNA, 18 nt, Human
aaacuguguauuccaaga

SEQ ID NO: 1239092 - RNA, 19 nt, Human
ggggaauugaggacacuga

SEQ ID NO: 1239093 - RNA, 19 nt, Human
ggggacacauguauuuggu

SEQ ID NO: 1239094 - RNA, 14 nt, Human
ggggaccagcagcc

SEQ ID NO: 1239095 - RNA, 13 nt, Human
ggggaaggcaggg

SEQ ID NO: 1239096 - RNA, 19 nt, Human
ggggaagagagccugcagg

SEQ ID NO: 1239097 - RNA, 21 nt, Human
ggggaagacccauuccuuccc

SEQ ID NO: 1239098 - RNA, 22 nt, Human
ggggaagacccauuccuuccca

SEQ ID NO: 1239099 - RNA, 20 nt, Human
ggggaagagagccugcagga

SEQ ID NO: 1239100 - RNA, 14 nt, Human
aaacaguagugaua

SEQ ID NO: 1239101 - RNA, 23 nt, Human
aaacagguauauacuuugaaagg

SEQ ID NO: 1239102 - RNA, 22 nt, Human
aaacaggucaaugaaugaaacu

SEQ ID NO: 1239103 - RNA, 21 nt, Human
ggggaccaggagugggugggg

SEQ ID NO: 1239104 - RNA, 17 nt, Human
ggggacacauguauuug

SEQ ID NO: 1239105 - RNA, 12 nt, Human
ggggaccaggag

SEQ ID NO: 1239106 - RNA, 13 nt, Human
ggggaccaggagu

SEQ ID NO: 1239107 - RNA, 21 nt, Human
ggggacuguaaguugggcuug

SEQ ID NO: 1239108 - RNA, 19 nt, Human
ggggacuuacaugauucau

SEQ ID NO: 1239109 - RNA, 15 nt, Human
ggggacuuggccucu

SEQ ID NO: 1239110 - RNA, 18 nt, Human
ggggacuuggccucucuc

SEQ ID NO: 1239111 - RNA, 19 nt, Human
ggggccgaugcccagagac

SEQ ID NO: 1239112 - RNA, 21 nt, Human
ggggccgaugcccagagacac

SEQ ID NO: 1239113 - RNA, 17 nt, Human
ggggccgggggcagucu

SEQ ID NO: 1239114 - RNA, 15 nt, Human
aaaauuuuuaaucuu

SEQ ID NO: 1239115 - RNA, 20 nt, Human
aaacaaaggccuaauucuau

SEQ ID NO: 1239116 - RNA, 17 nt, Human
aaacaaagguugagaug

SEQ ID NO: 1239117 - RNA, 12 nt, Human
aaaauuuauaac

SEQ ID NO: 1239118 - RNA, 20 nt, Human
aaaauuuauauuguaaauau

SEQ ID NO: 1239119 - RNA, 15 nt, Human
aaaauguuauuuccc

SEQ ID NO: 1239120 - RNA, 22 nt, Human
aaaauguuaucuucucaaguuc

SEQ ID NO: 1239121 - RNA, 16 nt, Human
aaaauguucagaaggu

SEQ ID NO: 1239122 - RNA, 16 nt, Human
aaaauguuauuucccu

SEQ ID NO: 1239123 - RNA, 15 nt, Human
aaaauguucuguuug

SEQ ID NO: 1239124 - RNA, 15 nt, Human
aaaauguucuuugga

SEQ ID NO: 1239125 - RNA, 12 nt, Human
aaaauguucuuu

SEQ ID NO: 1239126 - RNA, 13 nt, Human
aaaauguugaaau

SEQ ID NO: 1239127 - RNA, 14 nt, Human
aaaauguugagaau

SEQ ID NO: 1239128 - RNA, 17 nt, Human
aaaauguugcugaaaaa

SEQ ID NO: 1239129 - RNA, 17 nt, Human
aaaauguugaaauauga

SEQ ID NO: 1239130 - RNA, 21 nt, Human
aaaauguuggucauuuuaugu

SEQ ID NO: 1239131 - RNA, 22 nt, Human
aaaauguuuuuggucuuuuaua

SEQ ID NO: 1239132 - RNA, 17 nt, Human
aaacacauuaggaaaag

SEQ ID NO: 1239133 - RNA, 20 nt, Human
aaacaggguaacuaacuaaa

SEQ ID NO: 1239134 - RNA, 18 nt, Human
aaacagguauauacuuug

SEQ ID NO: 1239135 - RNA, 21 nt, Human
aaacagguauauacuuugaaa

SEQ ID NO: 1239136 - RNA, 15 nt, Human
aaacagggcugccuu

SEQ ID NO: 1239137 - RNA, 22 nt, Human
aaacagggcugccuucuggccu

SEQ ID NO: 1239138 - RNA, 16 nt, Human
aaaauuuuguuuauaa

SEQ ID NO: 1239139 - RNA, 14 nt, Human
aaacaauguuuaaa

SEQ ID NO: 1239140 - RNA, 12 nt, Human
aaacaauaccug

SEQ ID NO: 1239141 - RNA, 14 nt, Human
aaacaauauagucu

SEQ ID NO: 1239142 - RNA, 16 nt, Human
aaacaacaauuucuac

SEQ ID NO: 1239143 - RNA, 22 nt, Human
aaacaacaauuucuacuuugaa

SEQ ID NO: 1239144 - RNA, 16 nt, Human
gcuuugagagagaaag

SEQ ID NO: 1239145 - RNA, 15 nt, Human
gcuuugacucaggag

SEQ ID NO: 1239146 - RNA, 16 nt, Human
gcuuugacucaggagc

SEQ ID NO: 1239147 - RNA, 24 nt, Human
gcuuugacucaggagccugugaca

SEQ ID NO: 1239148 - RNA, 20 nt, Human
gcuuugacucaggagccugu

SEQ ID NO: 1239149 - RNA, 17 nt, Human
gcuuguaacuaaaauaa

SEQ ID NO: 1239150 - RNA, 22 nt, Human
gcuuguaacuaaaauaauuuug

SEQ ID NO: 1239151 - RNA, 23 nt, Human
gcuuguaacuaaaauaauuuugu

SEQ ID NO: 1239152 - RNA, 12 nt, Human
gcuucuugccuc

SEQ ID NO: 1239153 - RNA, 13 nt, Human
gcuucuugccucu

SEQ ID NO: 1239154 - RNA, 14 nt, Human
gcuucuugccucug

SEQ ID NO: 1239155 - RNA, 15 nt, Human
gcuucuugccucugu

SEQ ID NO: 1239156 - RNA, 16 nt, Human
gcuucuugccucugug

SEQ ID NO: 1239157 - RNA, 17 nt, Human
gcuucuugccucugugc

SEQ ID NO: 1239158 - RNA, 18 nt, Human
gcuucuugccucugugcu

SEQ ID NO: 1239159 - RNA, 19 nt, Human
gcuucuugccucugugcug

SEQ ID NO: 1239160 - RNA, 20 nt, Human
gcuugagaaauauggacacu

SEQ ID NO: 1239161 - RNA, 15 nt, Human
gcuugagccaggagg

SEQ ID NO: 1239162 - RNA, 21 nt, Human
gcuugagagcccugaggccua

SEQ ID NO: 1239163 - RNA, 15 nt, Human
gcuuguagccagccg

SEQ ID NO: 1239164 - RNA, 16 nt, Human
gcuuguagccagccgg

SEQ ID NO: 1239165 - RNA, 22 nt, Human
gcuuguagccagccggggcgag

SEQ ID NO: 1239166 - RNA, 22 nt, Human
gcuuguaggggaggggcuccuu

SEQ ID NO: 1239167 - RNA, 17 nt, Human
gcuuguagccagccggg

SEQ ID NO: 1239168 - RNA, 15 nt, Human
gcuuugaaacagaaa

SEQ ID NO: 1239169 - RNA, 19 nt, Human
gcuuugaaauugaaccuuu

SEQ ID NO: 1239170 - RNA, 17 nt, Human
gcuuugaaauugaaccu

SEQ ID NO: 1239171 - RNA, 16 nt, Human
gcuucuaguucugcca

SEQ ID NO: 1239172 - RNA, 17 nt, Human
gcuucuaguucugccag

SEQ ID NO: 1239173 - RNA, 21 nt, Human
gcuuccuccuccccaacugug

SEQ ID NO: 1239174 - RNA, 12 nt, Human
gcuuccuccugg

SEQ ID NO: 1239175 - RNA, 13 nt, Human
gcuuccuccugga

SEQ ID NO: 1239176 - RNA, 16 nt, Human
gcuuccuccuggaaau

SEQ ID NO: 1239177 - RNA, 14 nt, Human
gcuucguuuauuuu

SEQ ID NO: 1239178 - RNA, 16 nt, Human
gcuucguuuauuuuca

SEQ ID NO: 1239179 - RNA, 17 nt, Human
gcuucguuuauuuucaa

SEQ ID NO: 1239180 - RNA, 16 nt, Human
gcuucuaaguaaauac

SEQ ID NO: 1239181 - RNA, 18 nt, Human
gcuucuaaguaaauacaa

SEQ ID NO: 1239182 - RNA, 19 nt, Human
gcuucuaaguaaauacaau

SEQ ID NO: 1239183 - RNA, 20 nt, Human
gcuucuaaguaaauacaauu

SEQ ID NO: 1239184 - RNA, 21 nt, Human
gcuucuaaguaaauacaauuu

SEQ ID NO: 1239185 - RNA, 22 nt, Human
gcuucuaaguaaauacaauuuu

SEQ ID NO: 1239186 - RNA, 12 nt, Human
gcuuauguuaac

SEQ ID NO: 1239187 - RNA, 20 nt, Human
gcuuaugguaccagaugcag

SEQ ID NO: 1239188 - RNA, 15 nt, Human
gcuuauuuauuguau

SEQ ID NO: 1239189 - RNA, 15 nt, Human
gcuuauuccaugacu

SEQ ID NO: 1239190 - RNA, 17 nt, Human
gcuuauuccaugacugc

SEQ ID NO: 1239191 - RNA, 18 nt, Human
gcuuauuccaugacugcu

SEQ ID NO: 1239192 - RNA, 19 nt, Human
gcuuauuccaugacugcuu

SEQ ID NO: 1239193 - RNA, 20 nt, Human
gcuuauuuauuguauucugg

SEQ ID NO: 1239194 - RNA, 17 nt, Human
gcuuauuuauuguauuc

SEQ ID NO: 1239195 - RNA, 15 nt, Human
gcuucagcugccagu

SEQ ID NO: 1239196 - RNA, 20 nt, Human
gcuggaggcaggggcuuccu

SEQ ID NO: 1239197 - RNA, 21 nt, Human
gcuggaggcaggggcuuccug

SEQ ID NO: 1239198 - RNA, 22 nt, Human
gcuggaggcaggggcuuccugg

SEQ ID NO: 1239199 - RNA, 23 nt, Human
gcuggaggcaggggcuuccuggu

SEQ ID NO: 1239200 - RNA, 12 nt, Human
gcuggaggccca

SEQ ID NO: 1239201 - RNA, 13 nt, Human
gcuggaggcccag

SEQ ID NO: 1239202 - RNA, 14 nt, Human
gcuggaggcccagg

SEQ ID NO: 1239203 - RNA, 15 nt, Human
gcuggaggcccaggc

SEQ ID NO: 1239204 - RNA, 20 nt, Human
gcuggaggcccaggcuggga

SEQ ID NO: 1239205 - RNA, 16 nt, Human
gcuggaggcccaggcu

SEQ ID NO: 1239206 - RNA, 15 nt, Human
gcuggagugcagugg

SEQ ID NO: 1239207 - RNA, 14 nt, Human
gcucugggccauuc

SEQ ID NO: 1239208 - RNA, 20 nt, Human
gcucugggccauucuccaca

SEQ ID NO: 1239209 - RNA, 23 nt, Human
gcucugggccauucuccacagca

SEQ ID NO: 1239210 - RNA, 19 nt, Human
gcucuggggugggcaguuu

SEQ ID NO: 1239211 - RNA, 21 nt, Human
gcucuggggugggcaguuuuu

SEQ ID NO: 1239212 - RNA, 13 nt, Human
gcugcugcugggc

SEQ ID NO: 1239213 - RNA, 15 nt, Human
gcugcugcugggcuc

SEQ ID NO: 1239214 - RNA, 16 nt, Human
gcugcugcugggcuca

SEQ ID NO: 1239215 - RNA, 17 nt, Human
gcugcugcugggcucag

SEQ ID NO: 1239216 - RNA, 23 nt, Human
gcugggccccugccucucugcag

SEQ ID NO: 1239217 - RNA, 12 nt, Human
gcugggccuggu

SEQ ID NO: 1239218 - RNA, 13 nt, Human
gcugggccugguc

SEQ ID NO: 1239219 - RNA, 22 nt, Human
gcugggccuggucucacccugg

SEQ ID NO: 1239220 - RNA, 14 nt, Human
gcugggcucaguga

SEQ ID NO: 1239221 - RNA, 22 nt, Human
gcugggccccugccucucugca

SEQ ID NO: 1239222 - RNA, 21 nt, Human
gcugggccccugccucucugc

SEQ ID NO: 1239223 - RNA, 12 nt, Human
gcugggucgccc

SEQ ID NO: 1239224 - RNA, 16 nt, Human
gcugggucaggcaggg

SEQ ID NO: 1239225 - RNA, 19 nt, Human
gcuggguccaauuguggca

SEQ ID NO: 1239226 - RNA, 23 nt, Human
gcuggguccauaucacacacauu

SEQ ID NO: 1239227 - RNA, 13 nt, Human
gcugggucaggca

SEQ ID NO: 1239228 - RNA, 14 nt, Human
gcugggucaggcag

SEQ ID NO: 1239229 - RNA, 15 nt, Human
gcugggucaggcagg

SEQ ID NO: 1239230 - RNA, 14 nt, Human
gcuggcuggccuca

SEQ ID NO: 1239231 - RNA, 14 nt, Human
gcuggcuccagaug

SEQ ID NO: 1239232 - RNA, 17 nt, Human
gcuggcuccagaugcag

SEQ ID NO: 1239233 - RNA, 21 nt, Human
gcuggcuccagaugcagggca

SEQ ID NO: 1239234 - RNA, 22 nt, Human
gcuggcuccagaugcagggcag

SEQ ID NO: 1239235 - RNA, 23 nt, Human
gcuggcuccagaugcagggcagu

SEQ ID NO: 1239236 - RNA, 12 nt, Human
gcuggcucugag

SEQ ID NO: 1239237 - RNA, 15 nt, Human
ggacaggauccaggc

SEQ ID NO: 1239238 - RNA, 12 nt, Human
ggacagcuugug

SEQ ID NO: 1239239 - RNA, 17 nt, Human
ggacaggauguguuugc

SEQ ID NO: 1239240 - RNA, 18 nt, Human
ggacaggauguguuugcu

SEQ ID NO: 1239241 - RNA, 19 nt, Human
ggacaggacuaacacucag

SEQ ID NO: 1239242 - RNA, 20 nt, Human
ggacaggauguguuugcuuu

SEQ ID NO: 1239243 - RNA, 18 nt, Human
ggagaaaugaaaaaauau

SEQ ID NO: 1239244 - RNA, 22 nt, Human
ggagaaaucuggcuucuggcca

SEQ ID NO: 1239245 - RNA, 14 nt, Human
ggagaaagcugacu

SEQ ID NO: 1239246 - RNA, 15 nt, Human
ggagaaagcugacuu

SEQ ID NO: 1239247 - RNA, 22 nt, Human
ggagaaagcugacuuggcuggu

SEQ ID NO: 1239248 - RNA, 23 nt, Human
ggagaaagcugacuuggcuggug

SEQ ID NO: 1239249 - RNA, 16 nt, Human
ggagaaagggcccugg

SEQ ID NO: 1239250 - RNA, 22 nt, Human
ggacuuugcagccggcacaggg

SEQ ID NO: 1239251 - RNA, 16 nt, Human
ggacuuugcagccggc

SEQ ID NO: 1239252 - RNA, 17 nt, Human
ggacuuugcagccggca

SEQ ID NO: 1239253 - RNA, 13 nt, Human
ggagaaacuggaa

SEQ ID NO: 1239254 - RNA, 12 nt, Human
ggacuccucugu

SEQ ID NO: 1239255 - RNA, 23 nt, Human
ggacuccaggcccaaggcucccg

SEQ ID NO: 1239256 - RNA, 22 nt, Human
ggacuccaggcccaaggcuccc

SEQ ID NO: 1239257 - RNA, 19 nt, Human
ggacuugcaaaaaggguca

SEQ ID NO: 1239258 - RNA, 20 nt, Human
ggacuuuauagaucagccag

SEQ ID NO: 1239259 - RNA, 15 nt, Human
ggacuugaacccagg

SEQ ID NO: 1239260 - RNA, 18 nt, Human
ggacuaacacucagaagc

SEQ ID NO: 1239261 - RNA, 19 nt, Human
ggacuaacacucagaagcc

SEQ ID NO: 1239262 - RNA, 20 nt, Human
ggacuaacacucagaagccu

SEQ ID NO: 1239263 - RNA, 21 nt, Human
ggacuaacacucagaagccug

SEQ ID NO: 1239264 - RNA, 22 nt, Human
ggacuaacacucagaagccugg

SEQ ID NO: 1239265 - RNA, 23 nt, Human
ggacuaacacucagaagccuggg

SEQ ID NO: 1239266 - RNA, 19 nt, Human
ggacguggcucagccagca

SEQ ID NO: 1239267 - RNA, 14 nt, Human
ggacguuguuuugg

SEQ ID NO: 1239268 - RNA, 23 nt, Human
ggacuauauuugggccugcucca

SEQ ID NO: 1239269 - RNA, 19 nt, Human
ggacuaugaaaagcuagaa

SEQ ID NO: 1239270 - RNA, 18 nt, Human
ggacucaagccccggacu

SEQ ID NO: 1239271 - RNA, 17 nt, Human
ggacucagccuucagac

SEQ ID NO: 1239272 - RNA, 21 nt, Human
ggacucagccuucagacagag

SEQ ID NO: 1239273 - RNA, 13 nt, Human
ggacucagggcag

SEQ ID NO: 1239274 - RNA, 15 nt, Human
ggacucagggcagcg

SEQ ID NO: 1239275 - RNA, 22 nt, Human
ggacucagggcagcgccaggcu

SEQ ID NO: 1239276 - RNA, 20 nt, Human
ggacucagguggcccuacug

SEQ ID NO: 1239277 - RNA, 16 nt, Human
ggacucaucuuucccu

SEQ ID NO: 1239278 - RNA, 19 nt, Human
ggacucaucuuucccuccu

SEQ ID NO: 1239279 - RNA, 20 nt, Human
ggacucaucuuucccuccuu

SEQ ID NO: 1239280 - RNA, 21 nt, Human
ggacucaucuuucccuccuug

SEQ ID NO: 1239281 - RNA, 23 nt, Human
ggacucaucuuucccuccuuggu

SEQ ID NO: 1239282 - RNA, 22 nt, Human
ggacucaucuuucccuccuugg

SEQ ID NO: 1239283 - RNA, 14 nt, Human
ggacuccaggccca

SEQ ID NO: 1239284 - RNA, 15 nt, Human
ggacuccaggcccaa

SEQ ID NO: 1239285 - RNA, 13 nt, Human
ggacccugaaggg

SEQ ID NO: 1239286 - RNA, 11 nt, Human
ggacccugacc

SEQ ID NO: 1239287 - RNA, 13 nt, Human
ggacccuguccaa

SEQ ID NO: 1239288 - RNA, 15 nt, Human
ggacccugugagccg

SEQ ID NO: 1239289 - RNA, 13 nt, Human
ggacccugugagc

SEQ ID NO: 1239290 - RNA, 18 nt, Human
ggacguggcucagccagc

SEQ ID NO: 1239291 - RNA, 17 nt, Human
ggacggugcccaagcca

SEQ ID NO: 1239292 - RNA, 19 nt, Human
ggacggugcccaagccaga

SEQ ID NO: 1239293 - RNA, 21 nt, Human
ggacggugcccaagccagagg

SEQ ID NO: 1239294 - RNA, 21 nt, Human
ggacguacguaauaagguuuu

SEQ ID NO: 1239295 - RNA, 21 nt, Human
ggacccuccgcucuguagugc

SEQ ID NO: 1239296 - RNA, 23 nt, Human
ggaccccccuuucacaggcagcc

SEQ ID NO: 1239297 - RNA, 16 nt, Human
ggaagcuaauuugcau

SEQ ID NO: 1239298 - RNA, 18 nt, Human
ggaagcuagacacaugaa

SEQ ID NO: 1239299 - RNA, 22 nt, Human
ggaagcuagacacaugaaggua

SEQ ID NO: 1239300 - RNA, 19 nt, Human
ggaagcuagacacaugaag

SEQ ID NO: 1239301 - RNA, 15 nt, Human
ggaagcuagucuuuu

SEQ ID NO: 1239302 - RNA, 16 nt, Human
ggaagcuagucuuuug

SEQ ID NO: 1239303 - RNA, 17 nt, Human
ggaagcuagucuuuugc

SEQ ID NO: 1239304 - RNA, 19 nt, Human
ggaagcuagucuuuugcuu

SEQ ID NO: 1239305 - RNA, 18 nt, Human
ggaagcccauccugacca

SEQ ID NO: 1239306 - RNA, 20 nt, Human
ggaagcccauccugaccagc

SEQ ID NO: 1239307 - RNA, 13 nt, Human
ggaagcccccacc

SEQ ID NO: 1239308 - RNA, 21 nt, Human
ggaagcccccaccgugggcag

SEQ ID NO: 1239309 - RNA, 22 nt, Human
ggaagcccccaccgugggcagg

SEQ ID NO: 1239310 - RNA, 13 nt, Human
ggaagccccuggg

SEQ ID NO: 1239311 - RNA, 14 nt, Human
ggaagccccugggc

SEQ ID NO: 1239312 - RNA, 15 nt, Human
ggaagccccugggcc

SEQ ID NO: 1239313 - RNA, 18 nt, Human
ggaagccccugggcccag

SEQ ID NO: 1239314 - RNA, 19 nt, Human
ggaagccccugggcccagu

SEQ ID NO: 1239315 - RNA, 18 nt, Human
ggaaguugacuuauagua

SEQ ID NO: 1239316 - RNA, 15 nt, Human
ggaaguuuagcucug

SEQ ID NO: 1239317 - RNA, 16 nt, Human
ggaaguuuagcucuga

SEQ ID NO: 1239318 - RNA, 18 nt, Human
ggaaguuuagcucugaga

SEQ ID NO: 1239319 - RNA, 17 nt, Human
ggaaguuuagcucugag

SEQ ID NO: 1239320 - RNA, 21 nt, Human
ggaagcuuuggugagaaccug

SEQ ID NO: 1239321 - RNA, 20 nt, Human
ggaagcuuuggugagaaccu

SEQ ID NO: 1239322 - RNA, 23 nt, Human
ggaagcuagucuuuugcuuuugc

SEQ ID NO: 1239323 - RNA, 14 nt, Human
ggaagcuuggggaa

SEQ ID NO: 1239324 - RNA, 21 nt, Human
ggaagcucuuggagcugugag

SEQ ID NO: 1239325 - RNA, 17 nt, Human
ggaagcugcccugccca

SEQ ID NO: 1239326 - RNA, 20 nt, Human
ggaagcucuuggagcuguga

SEQ ID NO: 1239327 - RNA, 20 nt, Human
ggaagcugugcgugugugug

SEQ ID NO: 1239328 - RNA, 18 nt, Human
ggaaugaagcaaugcuuc

SEQ ID NO: 1239329 - RNA, 19 nt, Human
ggaaugaagauacugaaau

SEQ ID NO: 1239330 - RNA, 21 nt, Human
ggacaacugcucccaccuccu

SEQ ID NO: 1239331 - RNA, 22 nt, Human
ggacaacugcucccaccuccug

SEQ ID NO: 1239332 - RNA, 23 nt, Human
ggacaacugcucccaccuccuga

SEQ ID NO: 1239333 - RNA, 16 nt, Human
ggacaagacccccagc

SEQ ID NO: 1239334 - RNA, 13 nt, Human
ggacaagcauggu

SEQ ID NO: 1239335 - RNA, 18 nt, Human
ggaauaagcucccagggc

SEQ ID NO: 1239336 - RNA, 13 nt, Human
ggaauaauaccua

SEQ ID NO: 1239337 - RNA, 24 nt, Human
ggaaucauuucuauuucuccucca

SEQ ID NO: 1239338 - RNA, 19 nt, Human
ggaauaagguacaagaagc

SEQ ID NO: 1239339 - RNA, 17 nt, Human
ggacaccugcccugccc

SEQ ID NO: 1239340 - RNA, 19 nt, Human
ggacaccugggagaaaucu

SEQ ID NO: 1239341 - RNA, 19 nt, Human
ggacaaggacuaggguccu

SEQ ID NO: 1239342 - RNA, 18 nt, Human
ggacaagcuucugagacg

SEQ ID NO: 1239343 - RNA, 20 nt, Human
ggacaaguggacucagggca

SEQ ID NO: 1239344 - RNA, 23 nt, Human
ggacaauggaccggagagugggg

SEQ ID NO: 1239345 - RNA, 16 nt, Human
ggacaauggaccggag

SEQ ID NO: 1239346 - RNA, 16 nt, Human
ggacacgcucaguggg

SEQ ID NO: 1239347 - RNA, 22 nt, Human
ggacacgcucaguggggcagag

SEQ ID NO: 1239348 - RNA, 23 nt, Human
ggacacgcucaguggggcagagg

SEQ ID NO: 1239349 - RNA, 23 nt, Human
ggacacgggccuguccacaggcu

SEQ ID NO: 1239350 - RNA, 21 nt, Human
ggacacgggccuguccacagg

SEQ ID NO: 1239351 - RNA, 11 nt, Human
ggacagcugug

SEQ ID NO: 1239352 - RNA, 12 nt, Human
ggacagcugugc

SEQ ID NO: 1239353 - RNA, 14 nt, Human
ggacagcugugccu

SEQ ID NO: 1239354 - RNA, 15 nt, Human
ggacagcugugccuc

SEQ ID NO: 1239355 - RNA, 17 nt, Human
ggacagcugugccucgc

SEQ ID NO: 1239356 - RNA, 22 nt, Human
ggacagcuuguggcaagugaau

SEQ ID NO: 1239357 - RNA, 20 nt, Human
ggacagcugugccucgcucc

SEQ ID NO: 1239358 - RNA, 17 nt, Human
ggaagagaaggagcaga

SEQ ID NO: 1239359 - RNA, 12 nt, Human
ggaagagaagga

SEQ ID NO: 1239360 - RNA, 16 nt, Human
ggaagagacagcccag

SEQ ID NO: 1239361 - RNA, 17 nt, Human
ggaagagacagcccagg

SEQ ID NO: 1239362 - RNA, 21 nt, Human
ggaagagagccugcaggaucu

SEQ ID NO: 1239363 - RNA, 18 nt, Human
ggaagagagccugcagga

SEQ ID NO: 1239364 - RNA, 14 nt, Human
ggaacuugaacuga

SEQ ID NO: 1239365 - RNA, 16 nt, Human
ggaacuugaacugauu

SEQ ID NO: 1239366 - RNA, 18 nt, Human
ggaacuugaacugauuca

SEQ ID NO: 1239367 - RNA, 17 nt, Human
ggaacuugccugccuuu

SEQ ID NO: 1239368 - RNA, 22 nt, Human
ggaacuuggggaguuaagaccu

SEQ ID NO: 1239369 - RNA, 20 nt, Human
ggaacuugccugccuuucca

SEQ ID NO: 1239370 - RNA, 14 nt, Human
ggaagacaguggcc

SEQ ID NO: 1239371 - RNA, 15 nt, Human
ggaagacaguggccc

SEQ ID NO: 1239372 - RNA, 21 nt, Human
ggaacacuggggacuuggccu

SEQ ID NO: 1239373 - RNA, 17 nt, Human
ggaacuggaauccuuuc

SEQ ID NO: 1239374 - RNA, 11 nt, Human
ggaacuggagg

SEQ ID NO: 1239375 - RNA, 12 nt, Human
ggaacuggaggc

SEQ ID NO: 1239376 - RNA, 15 nt, Human
ggaacuggaggcagg

SEQ ID NO: 1239377 - RNA, 14 nt, Human
ggaacuggccaagc

SEQ ID NO: 1239378 - RNA, 16 nt, Human
ggaacuggccaagcug

SEQ ID NO: 1239379 - RNA, 17 nt, Human
ggaacuggccaagcuga

SEQ ID NO: 1239380 - RNA, 22 nt, Human
ggaacuggccaagcugaggugc

SEQ ID NO: 1239381 - RNA, 19 nt, Human
ggaacuggccaagcugagg

SEQ ID NO: 1239382 - RNA, 16 nt, Human
gccugaaagaggcuga

SEQ ID NO: 1239383 - RNA, 19 nt, Human
gccugcccaguugcacuca

SEQ ID NO: 1239384 - RNA, 12 nt, Human
gccugcccccac

SEQ ID NO: 1239385 - RNA, 19 nt, Human
gccugcccccaccccauuc

SEQ ID NO: 1239386 - RNA, 18 nt, Human
gccugcccccaccccauu

SEQ ID NO: 1239387 - RNA, 21 nt, Human
gccugccccuacccuggacuu

SEQ ID NO: 1239388 - RNA, 22 nt, Human
gccugccccuacccuggacuug

SEQ ID NO: 1239389 - RNA, 19 nt, Human
gccuccuuagaaaaaaaau

SEQ ID NO: 1239390 - RNA, 13 nt, Human
gccucccaaagug

SEQ ID NO: 1239391 - RNA, 16 nt, Human
gccucccaaagugcug

SEQ ID NO: 1239392 - RNA, 16 nt, Human
gccuccauccaaggcc

SEQ ID NO: 1239393 - RNA, 13 nt, Human
gccuccaugggcc

SEQ ID NO: 1239394 - RNA, 15 nt, Human
gccuccaugggcccc

SEQ ID NO: 1239395 - RNA, 19 nt, Human
gccuccaugggccccaggg

SEQ ID NO: 1239396 - RNA, 23 nt, Human
gccuccauccuacccccugugcc

SEQ ID NO: 1239397 - RNA, 15 nt, Human
gccuccauccaaggc

SEQ ID NO: 1239398 - RNA, 12 nt, Human
gccuccauccug

SEQ ID NO: 1239399 - RNA, 15 nt, Human
gccucuuagaugcag

SEQ ID NO: 1239400 - RNA, 13 nt, Human
gccuccuuccucu

SEQ ID NO: 1239401 - RNA, 14 nt, Human
gccuccuuccucuu

SEQ ID NO: 1239402 - RNA, 19 nt, Human
gccucuuaaauaaaccuuu

SEQ ID NO: 1239403 - RNA, 24 nt, Human
gccuccuuccucuuuuccuuccca

SEQ ID NO: 1239404 - RNA, 13 nt, Human
gccucuucccucu

SEQ ID NO: 1239405 - RNA, 21 nt, Human
gccucuuccagucuuccugac

SEQ ID NO: 1239406 - RNA, 23 nt, Human
gccucuuucaagcagucgugccu

SEQ ID NO: 1239407 - RNA, 13 nt, Human
gccuggccuggcc

SEQ ID NO: 1239408 - RNA, 15 nt, Human
gccugugccagguga

SEQ ID NO: 1239409 - RNA, 19 nt, Human
gccuguggcgccgucucca

SEQ ID NO: 1239410 - RNA, 19 nt, Human
gccugugccaggugagguc

SEQ ID NO: 1239411 - RNA, 22 nt, Human
gccugugccaggugaggucagc

SEQ ID NO: 1239412 - RNA, 19 nt, Human
gccugugccuccucacccc

SEQ ID NO: 1239413 - RNA, 21 nt, Human
gccuguggcgccgucuccagg

SEQ ID NO: 1239414 - RNA, 23 nt, Human
gccuguggcgccgucuccagggg

SEQ ID NO: 1239415 - RNA, 12 nt, Human
gccugugguucu

SEQ ID NO: 1239416 - RNA, 16 nt, Human
gccugugguucugaga

SEQ ID NO: 1239417 - RNA, 21 nt, Human
gccugugguucugagauggcu

SEQ ID NO: 1239418 - RNA, 23 nt, Human
gccuguucccauucuugcauggc

SEQ ID NO: 1239419 - RNA, 22 nt, Human
gccuguguagcugugaccugcu

SEQ ID NO: 1239420 - RNA, 19 nt, Human
gccuguguccaugcgcuca

SEQ ID NO: 1239421 - RNA, 19 nt, Human
gccuguucccauucuugca

SEQ ID NO: 1239422 - RNA, 12 nt, Human
gccuguguccau

SEQ ID NO: 1239423 - RNA, 14 nt, Human
gccuguguccaugc

SEQ ID NO: 1239424 - RNA, 15 nt, Human
gccuguguagcugug

SEQ ID NO: 1239425 - RNA, 16 nt, Human
gccuguguagcuguga

SEQ ID NO: 1239426 - RNA, 20 nt, Human
gccuguguagcugugaccug

SEQ ID NO: 1239427 - RNA, 21 nt, Human
gccuguguagcugugaccugc

SEQ ID NO: 1239428 - RNA, 14 nt, Human
gcgaucucagcuca

SEQ ID NO: 1239429 - RNA, 17 nt, Human
gcgaucucggcucacug

SEQ ID NO: 1239430 - RNA, 12 nt, Human
gcgagccugcua

SEQ ID NO: 1239431 - RNA, 13 nt, Human
gcgaugccagcca

SEQ ID NO: 1239432 - RNA, 14 nt, Human
gcgaugccagccaa

SEQ ID NO: 1239433 - RNA, 13 nt, Human
gcgauguggaacu

SEQ ID NO: 1239434 - RNA, 19 nt, Human
gcgauguggaacugcugcc

SEQ ID NO: 1239435 - RNA, 20 nt, Human
gcgauguggaacugcugcca

SEQ ID NO: 1239436 - RNA, 21 nt, Human
gcgauguggaacugcugccac

SEQ ID NO: 1239437 - RNA, 23 nt, Human
gcgauguggaacugcugccacug

SEQ ID NO: 1239438 - RNA, 22 nt, Human
gcgauguggaacugcugccacu

SEQ ID NO: 1239439 - RNA, 14 nt, Human
gcgauucccucucc

SEQ ID NO: 1239440 - RNA, 18 nt, Human
gcgauucccucucccagg

SEQ ID NO: 1239441 - RNA, 19 nt, Human
gcgauucccucucccaggc

SEQ ID NO: 1239442 - RNA, 22 nt, Human
gcgauucccucucccaggcccc

SEQ ID NO: 1239443 - RNA, 22 nt, Human
gcgcacugugacccccagcucc

SEQ ID NO: 1239444 - RNA, 20 nt, Human
gccuucggccuccauccuga

SEQ ID NO: 1239445 - RNA, 23 nt, Human
gccuucggccuccauccugaggc

SEQ ID NO: 1239446 - RNA, 21 nt, Human
gccuucggccuccauccugag

SEQ ID NO: 1239447 - RNA, 13 nt, Human
gcgagccugcuag

SEQ ID NO: 1239448 - RNA, 19 nt, Human
gcgaggagaugcuccuugg

SEQ ID NO: 1239449 - RNA, 20 nt, Human
gcgaggagaugcuccuuggg

SEQ ID NO: 1239450 - RNA, 15 nt, Human
gcgaggaggcuccag

SEQ ID NO: 1239451 - RNA, 16 nt, Human
gcgaggaggcuccaga

SEQ ID NO: 1239452 - RNA, 17 nt, Human
gcgaggaggcuccagag

SEQ ID NO: 1239453 - RNA, 18 nt, Human
gcgaggaggcuccagagg

SEQ ID NO: 1239454 - RNA, 14 nt, Human
gccuugccagagau

SEQ ID NO: 1239455 - RNA, 17 nt, Human
gccuugccagagaucca

SEQ ID NO: 1239456 - RNA, 16 nt, Human
gccuugcggcuccuca

SEQ ID NO: 1239457 - RNA, 17 nt, Human
gccuugcggcuccucag

SEQ ID NO: 1239458 - RNA, 20 nt, Human
gccuugcggcuccucaggga

SEQ ID NO: 1239459 - RNA, 18 nt, Human
gccuugcggcuccucagg

SEQ ID NO: 1239460 - RNA, 16 nt, Human
gcccccaccuggcuca

SEQ ID NO: 1239461 - RNA, 12 nt, Human
gcccccacugac

SEQ ID NO: 1239462 - RNA, 17 nt, Human
gcccccacugaccagaa

SEQ ID NO: 1239463 - RNA, 18 nt, Human
gcccccacccuguuccug

SEQ ID NO: 1239464 - RNA, 22 nt, Human
gcccccacccuguuccugcugc

SEQ ID NO: 1239465 - RNA, 23 nt, Human
gcccccacccuguuccugcugcu

SEQ ID NO: 1239466 - RNA, 17 nt, Human
gcccccaccgugggcag

SEQ ID NO: 1239467 - RNA, 18 nt, Human
gcccccaccgugggcagg

SEQ ID NO: 1239468 - RNA, 20 nt, Human
gcccccaccgugggcaggga

SEQ ID NO: 1239469 - RNA, 22 nt, Human
gcccccaccgugggcagggagc

SEQ ID NO: 1239470 - RNA, 19 nt, Human
gcccccacugccuuugacc

SEQ ID NO: 1239471 - RNA, 16 nt, Human
gccccccagccucugg

SEQ ID NO: 1239472 - RNA, 23 nt, Human
gccccugccaccuccugccucag

SEQ ID NO: 1239473 - RNA, 23 nt, Human
gccccugccucucugcagguccc

SEQ ID NO: 1239474 - RNA, 20 nt, Human
gccccugccucucugcaggu

SEQ ID NO: 1239475 - RNA, 21 nt, Human
gccccugccauuguagcgucu

SEQ ID NO: 1239476 - RNA, 17 nt, Human
gcccgguaagagcaaaa

SEQ ID NO: 1239477 - RNA, 16 nt, Human
gcccuaaugcgcaggc

SEQ ID NO: 1239478 - RNA, 17 nt, Human
gcccuaaugcgcaggcu

SEQ ID NO: 1239479 - RNA, 19 nt, Human
gcccuaaugcgcaggcugg

SEQ ID NO: 1239480 - RNA, 20 nt, Human
gcccuaaugcgcaggcuggc

SEQ ID NO: 1239481 - RNA, 13 nt, Human
gcccguccugccu

SEQ ID NO: 1239482 - RNA, 14 nt, Human
gcccguccugccug

SEQ ID NO: 1239483 - RNA, 12 nt, Human
gcccuaagcaga

SEQ ID NO: 1239484 - RNA, 15 nt, Human
gcccuaagcagaaag

SEQ ID NO: 1239485 - RNA, 16 nt, Human
gcccuaagcagaaagu

SEQ ID NO: 1239486 - RNA, 17 nt, Human
gcccuaagcagaaagug

SEQ ID NO: 1239487 - RNA, 18 nt, Human
gcccuaagcagaaagugc

SEQ ID NO: 1239488 - RNA, 21 nt, Human
gcccuaagcagaaagugccuu

SEQ ID NO: 1239489 - RNA, 23 nt, Human
gcccuaaugcgcaggcuggcccu

SEQ ID NO: 1239490 - RNA, 23 nt, Human
gcccucaagacccuuuuggguuu

SEQ ID NO: 1239491 - RNA, 14 nt, Human
gcccucaagucuuu

SEQ ID NO: 1239492 - RNA, 15 nt, Human
gcccucacccugggg

SEQ ID NO: 1239493 - RNA, 16 nt, Human
gcccucacacacccug

SEQ ID NO: 1239494 - RNA, 14 nt, Human
gcccucacccgccc

SEQ ID NO: 1239495 - RNA, 17 nt, Human
gcccugccaccugucug

SEQ ID NO: 1239496 - RNA, 16 nt, Human
gcccugccaccugucu

SEQ ID NO: 1239497 - RNA, 15 nt, Human
gcccugccaccuguc

SEQ ID NO: 1239498 - RNA, 14 nt, Human
gcccugccaccugu

SEQ ID NO: 1239499 - RNA, 13 nt, Human
gcccugccaccug

SEQ ID NO: 1239500 - RNA, 18 nt, Human
gcccugccaccugucugu

SEQ ID NO: 1239501 - RNA, 17 nt, Human
gcccugcccugccaccu

SEQ ID NO: 1239502 - RNA, 13 nt, Human
gcccugcccugcc

SEQ ID NO: 1239503 - RNA, 11 nt, Human
gcccugcccug

SEQ ID NO: 1239504 - RNA, 12 nt, Human
gcccugcccugg

SEQ ID NO: 1239505 - RNA, 16 nt, Human
gcccugcccugguuuc

SEQ ID NO: 1239506 - RNA, 18 nt, Human
gcccugcccugguuuccu

SEQ ID NO: 1239507 - RNA, 21 nt, Human
gcccugugcaaccucuuggcc

SEQ ID NO: 1239508 - RNA, 22 nt, Human
gcccugugccccuugacaacug

SEQ ID NO: 1239509 - RNA, 22 nt, Human
gcccuguccugccuaaggcuga

SEQ ID NO: 1239510 - RNA, 13 nt, Human
gcccuguccuggu

SEQ ID NO: 1239511 - RNA, 17 nt, Human
gcccuguccugguggua

SEQ ID NO: 1239512 - RNA, 22 nt, Human
gcccuguccuggugguauuuuc

SEQ ID NO: 1239513 - RNA, 19 nt, Human
gcccugugaggcugggucc

SEQ ID NO: 1239514 - RNA, 20 nt, Human
gcccugugccccuugacaac

SEQ ID NO: 1239515 - RNA, 17 nt, Human
gccgcccccugcccccc

SEQ ID NO: 1239516 - RNA, 23 nt, Human
gccgcccccugccccccagccuc

SEQ ID NO: 1239517 - RNA, 18 nt, Human
gccgcccugcgggugaac

SEQ ID NO: 1239518 - RNA, 13 nt, Human
gccgccgccucuu

SEQ ID NO: 1239519 - RNA, 12 nt, Human
gccuaggccugg

SEQ ID NO: 1239520 - RNA, 16 nt, Human
gccuaggccugggcag

SEQ ID NO: 1239521 - RNA, 17 nt, Human
gccuaggccugggcagu

SEQ ID NO: 1239522 - RNA, 19 nt, Human
gccuaggccugggcagugg

SEQ ID NO: 1239523 - RNA, 12 nt, Human
gccuaggcugca

SEQ ID NO: 1239524 - RNA, 15 nt, Human
gccuaggaggguccu

SEQ ID NO: 1239525 - RNA, 16 nt, Human
gccuaggaggguccuc

SEQ ID NO: 1239526 - RNA, 12 nt, Human
gccuaggauucu

SEQ ID NO: 1239527 - RNA, 13 nt, Human
gccuaggauucua

SEQ ID NO: 1239528 - RNA, 14 nt, Human
gccuaggauucuaa

SEQ ID NO: 1239529 - RNA, 15 nt, Human
gccuaggauucuaaa

SEQ ID NO: 1239530 - RNA, 16 nt, Human
gccuaggauucuaaaa

SEQ ID NO: 1239531 - RNA, 17 nt, Human
gccuaggccuaguccug

SEQ ID NO: 1239532 - RNA, 16 nt, Human
gccuaguauugacaaa

SEQ ID NO: 1239533 - RNA, 14 nt, Human
gccuaggcugcauu

SEQ ID NO: 1239534 - RNA, 14 nt, Human
gccuaguauugaca

SEQ ID NO: 1239535 - RNA, 19 nt, Human
gccuagugaaggcuucucu

SEQ ID NO: 1239536 - RNA, 22 nt, Human
gccuagugaaggcuucucucug

SEQ ID NO: 1239537 - RNA, 23 nt, Human
gccuagugaaggcuucucucugu

SEQ ID NO: 1239538 - RNA, 15 nt, Human
gcuccacuuggucug

SEQ ID NO: 1239539 - RNA, 17 nt, Human
gcuccacucugcuucuc

SEQ ID NO: 1239540 - RNA, 19 nt, Human
gcuccacucugcuucucug

SEQ ID NO: 1239541 - RNA, 20 nt, Human
gcuccacucugcuucucuga

SEQ ID NO: 1239542 - RNA, 21 nt, Human
gcuccacucugcuucucugac

SEQ ID NO: 1239543 - RNA, 13 nt, Human
gcuccacucugcu

SEQ ID NO: 1239544 - RNA, 15 nt, Human
gcuccacucugcuuc

SEQ ID NO: 1239545 - RNA, 16 nt, Human
gcuccacucugcuucu

SEQ ID NO: 1239546 - RNA, 16 nt, Human
gcuccacccuggccga

SEQ ID NO: 1239547 - RNA, 19 nt, Human
gcuccacccuggccgaguc

SEQ ID NO: 1239548 - RNA, 16 nt, Human
gcucccacaggcccuu

SEQ ID NO: 1239549 - RNA, 17 nt, Human
gcucccacaggcccuuc

SEQ ID NO: 1239550 - RNA, 20 nt, Human
gcucccacaggcccuuccuc

SEQ ID NO: 1239551 - RNA, 21 nt, Human
gcucccacaggcccuuccucu

SEQ ID NO: 1239552 - RNA, 23 nt, Human
gcuccacucugcuucucugacuu

SEQ ID NO: 1239553 - RNA, 19 nt, Human
gcuccacuuggucugugag

SEQ ID NO: 1239554 - RNA, 18 nt, Human
gcuccacuuggucuguga

SEQ ID NO: 1239555 - RNA, 12 nt, Human
gcuccccaugug

SEQ ID NO: 1239556 - RNA, 14 nt, Human
gcuccccauguguc

SEQ ID NO: 1239557 - RNA, 22 nt, Human
gcucccccagcaaagcccccag

SEQ ID NO: 1239558 - RNA, 21 nt, Human
gcuccccccagcccccuaaga

SEQ ID NO: 1239559 - RNA, 22 nt, Human
gcucccacaggcccuuccucuc

SEQ ID NO: 1239560 - RNA, 22 nt, Human
gcucccacagucccaucugcuu

SEQ ID NO: 1239561 - RNA, 15 nt, Human
gcucccaccuccuga

SEQ ID NO: 1239562 - RNA, 22 nt, Human
gcucccaccuccugacacccuu

SEQ ID NO: 1239563 - RNA, 16 nt, Human
gcucccaccuccugac

SEQ ID NO: 1239564 - RNA, 16 nt, Human
gcucccaggaccacag

SEQ ID NO: 1239565 - RNA, 21 nt, Human
gcuccugccaccacgcccggc

SEQ ID NO: 1239566 - RNA, 11 nt, Human
gcuccugcagc

SEQ ID NO: 1239567 - RNA, 11 nt, Human
gcuccuggacc

SEQ ID NO: 1239568 - RNA, 19 nt, Human
gcuccuggaccccccuuuc

SEQ ID NO: 1239569 - RNA, 15 nt, Human
gcuccuggcccagcc

SEQ ID NO: 1239570 - RNA, 16 nt, Human
gcuccuggcccagccu

SEQ ID NO: 1239571 - RNA, 17 nt, Human
gcuccuggcccagccuu

SEQ ID NO: 1239572 - RNA, 19 nt, Human
gcuccuggcccagccuuug

SEQ ID NO: 1239573 - RNA, 12 nt, Human
gcuccugccacc

SEQ ID NO: 1239574 - RNA, 18 nt, Human
gcuccugccaccacgccc

SEQ ID NO: 1239575 - RNA, 12 nt, Human
gcuccugcacuu

SEQ ID NO: 1239576 - RNA, 20 nt, Human
gcuccugcacuuacuugcuu

SEQ ID NO: 1239577 - RNA, 13 nt, Human
gcucugaucccuc

SEQ ID NO: 1239578 - RNA, 22 nt, Human
gcucugaucccucuacagagcu

SEQ ID NO: 1239579 - RNA, 23 nt, Human
gcucugaucccucuacagagcuu

SEQ ID NO: 1239580 - RNA, 13 nt, Human
gcucugaugaaaa

SEQ ID NO: 1239581 - RNA, 23 nt, Human
gcucugaugaaaaauugcugacu

SEQ ID NO: 1239582 - RNA, 11 nt, Human
gcucugaugca

SEQ ID NO: 1239583 - RNA, 16 nt, Human
gcucugaugcaucaga

SEQ ID NO: 1239584 - RNA, 19 nt, Human
gcucugaugcaucagaaag

SEQ ID NO: 1239585 - RNA, 20 nt, Human
gcucugaugcaucagaaagg

SEQ ID NO: 1239586 - RNA, 17 nt, Human
gcucugcaauuccccuc

SEQ ID NO: 1239587 - RNA, 14 nt, Human
gcucugagcgccuc

SEQ ID NO: 1239588 - RNA, 17 nt, Human
gcucugagcgccuccau

SEQ ID NO: 1239589 - RNA, 18 nt, Human
gcucugagcgccuccauc

SEQ ID NO: 1239590 - RNA, 12 nt, Human
gcucugagcugu

SEQ ID NO: 1239591 - RNA, 13 nt, Human
gcucugagcuguc

SEQ ID NO: 1239592 - RNA, 14 nt, Human
gcucugagcuguca

SEQ ID NO: 1239593 - RNA, 9 nt, Human
gcucugagg

SEQ ID NO: 1239594 - RNA, 10 nt, Human
gcucugaggc

SEQ ID NO: 1239595 - RNA, 23 nt, Human
gcucugaggcgccccaacccgug

SEQ ID NO: 1239596 - RNA, 20 nt, Human
gcucugaggcgccccaaccc

SEQ ID NO: 1239597 - RNA, 11 nt, Human
gcucugaggga

SEQ ID NO: 1239598 - RNA, 13 nt, Human
gcucugagggaaa

SEQ ID NO: 1239599 - RNA, 17 nt, Human
gcucugagggaaagggc

SEQ ID NO: 1239600 - RNA, 22 nt, Human
gcucugaguaccccugcuuugg

SEQ ID NO: 1239601 - RNA, 13 nt, Human
gcucuaacgccug

SEQ ID NO: 1239602 - RNA, 14 nt, Human
gcucuaacgccuga

SEQ ID NO: 1239603 - RNA, 15 nt, Human
gcucuaacgccugag

SEQ ID NO: 1239604 - RNA, 16 nt, Human
gcucuaacgccugagc

SEQ ID NO: 1239605 - RNA, 17 nt, Human
gcucuaacgccugagcc

SEQ ID NO: 1239606 - RNA, 18 nt, Human
gcucuaacgccugagccc

SEQ ID NO: 1239607 - RNA, 18 nt, Human
gcucggggugcacaggag

SEQ ID NO: 1239608 - RNA, 19 nt, Human
gcucggggugcacaggagg

SEQ ID NO: 1239609 - RNA, 20 nt, Human
gcucggggugcacaggaggg

SEQ ID NO: 1239610 - RNA, 21 nt, Human
gcucggggugcacaggagggg

SEQ ID NO: 1239611 - RNA, 19 nt, Human
gcucguccccaagugaccu

SEQ ID NO: 1239612 - RNA, 22 nt, Human
gcucguggacugagugggaagc

SEQ ID NO: 1239613 - RNA, 15 nt, Human
gcucuaacagcccuc

SEQ ID NO: 1239614 - RNA, 12 nt, Human
gcuagucuuuug

SEQ ID NO: 1239615 - RNA, 15 nt, Human
gcuagucuuuugcuu

SEQ ID NO: 1239616 - RNA, 17 nt, Human
gcuagucuuuugcuuuu

SEQ ID NO: 1239617 - RNA, 14 nt, Human
gcuagugacuugug

SEQ ID NO: 1239618 - RNA, 22 nt, Human
gcuagucuuuugcuuuugccca

SEQ ID NO: 1239619 - RNA, 21 nt, Human
gcuagugacuugugucccaug

SEQ ID NO: 1239620 - RNA, 20 nt, Human
gcucacugcaaccucugccu

SEQ ID NO: 1239621 - RNA, 23 nt, Human
gcucacucaucaauggggccagu

SEQ ID NO: 1239622 - RNA, 16 nt, Human
gcucacugcauccucc

SEQ ID NO: 1239623 - RNA, 19 nt, Human
gcuauuccagcuguccccc

SEQ ID NO: 1239624 - RNA, 14 nt, Human
gcuauucugucccu

SEQ ID NO: 1239625 - RNA, 19 nt, Human
gcuauucugucccuaggug

SEQ ID NO: 1239626 - RNA, 16 nt, Human
gcuauucugucccuag

SEQ ID NO: 1239627 - RNA, 14 nt, Human
gcuauuugaagugu

SEQ ID NO: 1239628 - RNA, 15 nt, Human
gcuauuugauguaau

SEQ ID NO: 1239629 - RNA, 19 nt, Human
gcuauuugauguaauacuu

SEQ ID NO: 1239630 - RNA, 17 nt, Human
gcuauuugauguaauac

SEQ ID NO: 1239631 - RNA, 15 nt, Human
gcuauuuguaaaucu

SEQ ID NO: 1239632 - RNA, 17 nt, Human
gcuauuuguaaaucugc

SEQ ID NO: 1239633 - RNA, 14 nt, Human
gcuauuugucaucu

SEQ ID NO: 1239634 - RNA, 19 nt, Human
gcuauuuguaaaucugcca

SEQ ID NO: 1239635 - RNA, 18 nt, Human
gcuauuuuauauuacacu

SEQ ID NO: 1239636 - RNA, 23 nt, Human
gcuauuuuauauuacacuacaca

SEQ ID NO: 1239637 - RNA, 13 nt, Human
gcuauuuuccagg

SEQ ID NO: 1239638 - RNA, 15 nt, Human
gcuauuuuccaggcu

SEQ ID NO: 1239639 - RNA, 24 nt, Human
gcuauuuuccaggcuucugcuggg

SEQ ID NO: 1239640 - RNA, 13 nt, Human
gcuauuuugugaa

SEQ ID NO: 1239641 - RNA, 21 nt, Human
gcuauuuuucuaacuacaaag

SEQ ID NO: 1239642 - RNA, 13 nt, Human
gcuauuuuucuaa

SEQ ID NO: 1239643 - RNA, 14 nt, Human
gcucacucagcacu

SEQ ID NO: 1239644 - RNA, 15 nt, Human
gcucacucagccacc

SEQ ID NO: 1239645 - RNA, 20 nt, Human
gcucacucagccacccugag

SEQ ID NO: 1239646 - RNA, 20 nt, Human
gcucagggccaugcugaggc

SEQ ID NO: 1239647 - RNA, 18 nt, Human
gcucagggaccauggcuu

SEQ ID NO: 1239648 - RNA, 20 nt, Human
gcucaggaugagggaaaaga

SEQ ID NO: 1239649 - RNA, 12 nt, Human
gcucaggcaggg

SEQ ID NO: 1239650 - RNA, 16 nt, Human
gcucaggcaggggccu

SEQ ID NO: 1239651 - RNA, 19 nt, Human
gcucaggcaggggccucca

SEQ ID NO: 1239652 - RNA, 24 nt, Human
gcucaggcaggggccuccaugggc

SEQ ID NO: 1239653 - RNA, 22 nt, Human
gcucaggcaggggccuccaugg

SEQ ID NO: 1239654 - RNA, 19 nt, Human
gcucagggccaugcugagg

SEQ ID NO: 1239655 - RNA, 20 nt, Human
gcucacugcauccuccgccu

SEQ ID NO: 1239656 - RNA, 19 nt, Human
gcucacugaccugccugua

SEQ ID NO: 1239657 - RNA, 16 nt, Human
gcucaggaaccgaggc

SEQ ID NO: 1239658 - RNA, 19 nt, Human
gcucaggaaccgaggcagg

SEQ ID NO: 1239659 - RNA, 20 nt, Human
gcucaggaaccgaggcaggg

SEQ ID NO: 1239660 - RNA, 21 nt, Human
gcucaggaaccgaggcaggga

SEQ ID NO: 1239661 - RNA, 17 nt, Human
gcucaggacagaugcca

SEQ ID NO: 1239662 - RNA, 20 nt, Human
gcucaggacagaugccacac

SEQ ID NO: 1239663 - RNA, 18 nt, Human
gcuagaacucccuuucaa

SEQ ID NO: 1239664 - RNA, 16 nt, Human
gcuagaacucccuuuc

SEQ ID NO: 1239665 - RNA, 20 nt, Human
gcuaauucucagaaaggcaa

SEQ ID NO: 1239666 - RNA, 15 nt, Human
gcuagaacucccuuu

SEQ ID NO: 1239667 - RNA, 14 nt, Human
gcuagaacucccuu

SEQ ID NO: 1239668 - RNA, 13 nt, Human
gcuagaacucccu

SEQ ID NO: 1239669 - RNA, 12 nt, Human
gcuagaacuccc

SEQ ID NO: 1239670 - RNA, 19 nt, Human
gcuacucuaguauuccaga

SEQ ID NO: 1239671 - RNA, 20 nt, Human
gcuacucuaguauuccagac

SEQ ID NO: 1239672 - RNA, 21 nt, Human
gcuacucuaguauuccagacc

SEQ ID NO: 1239673 - RNA, 22 nt, Human
gcuacucuccccacgagggcug

SEQ ID NO: 1239674 - RNA, 23 nt, Human
gcuacucuccccacgagggcugg

SEQ ID NO: 1239675 - RNA, 13 nt, Human
gcuacucugugcc

SEQ ID NO: 1239676 - RNA, 14 nt, Human
gcuacucugugcca

SEQ ID NO: 1239677 - RNA, 15 nt, Human
gcuacucugugccag

SEQ ID NO: 1239678 - RNA, 16 nt, Human
gcuacucugugccaga

SEQ ID NO: 1239679 - RNA, 17 nt, Human
gcuacucugugccagag

SEQ ID NO: 1239680 - RNA, 18 nt, Human
gcuacucugugccagagc

SEQ ID NO: 1239681 - RNA, 19 nt, Human
gcuacucugugccagagcc

SEQ ID NO: 1239682 - RNA, 20 nt, Human
gcuacucugugccagagccu

SEQ ID NO: 1239683 - RNA, 21 nt, Human
gcuacucugugccagagccug

SEQ ID NO: 1239684 - RNA, 23 nt, Human
gcuacucugugccagagccuggg

SEQ ID NO: 1239685 - RNA, 22 nt, Human
gcuacucugugccagagccugg

SEQ ID NO: 1239686 - RNA, 19 nt, Human
gcguuuuuuaaauguauac

SEQ ID NO: 1239687 - RNA, 22 nt, Human
gcguuugaccuuuuauguagua

SEQ ID NO: 1239688 - RNA, 11 nt, Human
gcgugcagaug

SEQ ID NO: 1239689 - RNA, 16 nt, Human
gcgggauggggcuccc

SEQ ID NO: 1239690 - RNA, 18 nt, Human
gcgugguggucccugggu

SEQ ID NO: 1239691 - RNA, 17 nt, Human
gcgugucaccugugcuu

SEQ ID NO: 1239692 - RNA, 15 nt, Human
gcgugugcaggagcg

SEQ ID NO: 1239693 - RNA, 17 nt, Human
gcgugguggucccuggg

SEQ ID NO: 1239694 - RNA, 21 nt, Human
gcuaauaaaaagcuuuugucu

SEQ ID NO: 1239695 - RNA, 17 nt, Human
gcuaaaacaaugaauaa

SEQ ID NO: 1239696 - RNA, 12 nt, Human
gcuaaaagaaac

SEQ ID NO: 1239697 - RNA, 15 nt, Human
gcuaaaagaaacuuu

SEQ ID NO: 1239698 - RNA, 16 nt, Human
gcuaaaagaaacuuuc

SEQ ID NO: 1239699 - RNA, 17 nt, Human
gcuaaaauaaagaaaua

SEQ ID NO: 1239700 - RNA, 14 nt, Human
gcuaaucagcauuc

SEQ ID NO: 1239701 - RNA, 23 nt, Human
gcuaauauuuuccuccugagugc

SEQ ID NO: 1239702 - RNA, 15 nt, Human
gcuaauaacugaucu

SEQ ID NO: 1239703 - RNA, 16 nt, Human
gcuaaucagcauucuc

SEQ ID NO: 1239704 - RNA, 17 nt, Human
gcuaaucagcauucuca

SEQ ID NO: 1239705 - RNA, 22 nt, Human
gcuaaucagcauucucacuccu

SEQ ID NO: 1239706 - RNA, 17 nt, Human
gcuaauucaaggaauuu

SEQ ID NO: 1239707 - RNA, 22 nt, Human
gcuaauucaaggaauuucuuaa

SEQ ID NO: 1239708 - RNA, 16 nt, Human
gcuaauucuacucaca

SEQ ID NO: 1239709 - RNA, 14 nt, Human
cugccucccuucau

SEQ ID NO: 1239710 - RNA, 22 nt, Human
cugccuccccuuaaaggggaga

SEQ ID NO: 1239711 - RNA, 20 nt, Human
cugccuccccucuccuuccu

SEQ ID NO: 1239712 - RNA, 20 nt, Human
cugaucugaugcaagcaaga

SEQ ID NO: 1239713 - RNA, 15 nt, Human
cugaucuggcugcag

SEQ ID NO: 1239714 - RNA, 22 nt, Human
cugaugaaaaauugcugacugu

SEQ ID NO: 1239715 - RNA, 12 nt, Human
cugaugaaaaua

SEQ ID NO: 1239716 - RNA, 13 nt, Human
cugaugaaaauaa

SEQ ID NO: 1239717 - RNA, 14 nt, Human
cugaugaaaauaaa

SEQ ID NO: 1239718 - RNA, 16 nt, Human
cugaugaaaauaaaga

SEQ ID NO: 1239719 - RNA, 17 nt, Human
cugaugaaaauaaagaa

SEQ ID NO: 1239720 - RNA, 18 nt, Human
cugaugaaaauaaagaau

SEQ ID NO: 1239721 - RNA, 19 nt, Human
cugaugaaaauaaagaaug

SEQ ID NO: 1239722 - RNA, 20 nt, Human
cugaugaaaauaaagaaugg

SEQ ID NO: 1239723 - RNA, 21 nt, Human
cugaugaacucuuaaucaaau

SEQ ID NO: 1239724 - RNA, 23 nt, Human
cugccucccuucaugcauggaaa

SEQ ID NO: 1239725 - RNA, 21 nt, Human
cugccucccuucaugcaugga

SEQ ID NO: 1239726 - RNA, 19 nt, Human
cugccucccuucaugcaug

SEQ ID NO: 1239727 - RNA, 18 nt, Human
cugccucccuucaugcau

SEQ ID NO: 1239728 - RNA, 17 nt, Human
cugccucccuucaugca

SEQ ID NO: 1239729 - RNA, 15 nt, Human
cugccucccuucaug

SEQ ID NO: 1239730 - RNA, 13 nt, Human
cugccuccucuuc

SEQ ID NO: 1239731 - RNA, 14 nt, Human
cugccuccucuuca

SEQ ID NO: 1239732 - RNA, 15 nt, Human
cugccuccucuucaa

SEQ ID NO: 1239733 - RNA, 24 nt, Human
cugccuccucuucaacugaccagc

SEQ ID NO: 1239734 - RNA, 16 nt, Human
cugccucccuuguggc

SEQ ID NO: 1239735 - RNA, 21 nt, Human
cugccucccuuguggcagcaa

SEQ ID NO: 1239736 - RNA, 18 nt, Human
cugccucucccaggcagg

SEQ ID NO: 1239737 - RNA, 19 nt, Human
cugccucucccaggcaggg

SEQ ID NO: 1239738 - RNA, 20 nt, Human
cugccucucccaggcagggg

SEQ ID NO: 1239739 - RNA, 20 nt, Human
cugccuggugcccagcacau

SEQ ID NO: 1239740 - RNA, 21 nt, Human
cugccucucccaggcaggggc

SEQ ID NO: 1239741 - RNA, 12 nt, Human
cugcuaggccag

SEQ ID NO: 1239742 - RNA, 15 nt, Human
cugcuaggccagagc

SEQ ID NO: 1239743 - RNA, 17 nt, Human
cugcucaggaaacgaga

SEQ ID NO: 1239744 - RNA, 16 nt, Human
cugcuaggccagagcc

SEQ ID NO: 1239745 - RNA, 18 nt, Human
cugcuaggccagagccca

SEQ ID NO: 1239746 - RNA, 19 nt, Human
cugcuaggccagagcccac

SEQ ID NO: 1239747 - RNA, 20 nt, Human
cugcuaggccagagcccacu

SEQ ID NO: 1239748 - RNA, 21 nt, Human
cugcuaggccagagcccacuc

SEQ ID NO: 1239749 - RNA, 13 nt, Human
cugcugaccugcu

SEQ ID NO: 1239750 - RNA, 14 nt, Human
cugcugaccugcug

SEQ ID NO: 1239751 - RNA, 15 nt, Human
cugcugaccugcuga

SEQ ID NO: 1239752 - RNA, 21 nt, Human
cugcugaccugcugaccugug

SEQ ID NO: 1239753 - RNA, 15 nt, Human
cugcugaccugugca

SEQ ID NO: 1239754 - RNA, 16 nt, Human
cugcugaccugugcac

SEQ ID NO: 1239755 - RNA, 12 nt, Human
cugcugagaacc

SEQ ID NO: 1239756 - RNA, 14 nt, Human
cugcugagaaccug

SEQ ID NO: 1239757 - RNA, 13 nt, Human
cugcugagaaccu

SEQ ID NO: 1239758 - RNA, 18 nt, Human
cugcucaguaaagcacuu

SEQ ID NO: 1239759 - RNA, 19 nt, Human
cugcucaguaaagcacuug

SEQ ID NO: 1239760 - RNA, 15 nt, Human
cugcucauauuguga

SEQ ID NO: 1239761 - RNA, 19 nt, Human
cugcucauauugugauucu

SEQ ID NO: 1239762 - RNA, 16 nt, Human
cugcucaucauucucu

SEQ ID NO: 1239763 - RNA, 17 nt, Human
cugcucaucauucucug

SEQ ID NO: 1239764 - RNA, 18 nt, Human
cugcucaucauucucugu

SEQ ID NO: 1239765 - RNA, 22 nt, Human
cugcucaucauucucugucuca

SEQ ID NO: 1239766 - RNA, 13 nt, Human
cugcucauccacu

SEQ ID NO: 1239767 - RNA, 19 nt, Human
cuggacuuggccccugcca

SEQ ID NO: 1239768 - RNA, 13 nt, Human
cuggacuuuccug

SEQ ID NO: 1239769 - RNA, 18 nt, Human
cuggacuuggccccugcc

SEQ ID NO: 1239770 - RNA, 17 nt, Human
cuggacuuggccccugc

SEQ ID NO: 1239771 - RNA, 14 nt, Human
cuggacuuuccugc

SEQ ID NO: 1239772 - RNA, 15 nt, Human
cuggacuuuccugca

SEQ ID NO: 1239773 - RNA, 16 nt, Human
cuggacuuuccugcaa

SEQ ID NO: 1239774 - RNA, 18 nt, Human
cuggacuuuccugcaacu

SEQ ID NO: 1239775 - RNA, 16 nt, Human
cuggacuugccucugc

SEQ ID NO: 1239776 - RNA, 20 nt, Human
cuggaguugaucuggaaccc

SEQ ID NO: 1239777 - RNA, 22 nt, Human
cuggaguugaucuggaacccag

SEQ ID NO: 1239778 - RNA, 15 nt, Human
cuggacuugccucug

SEQ ID NO: 1239779 - RNA, 14 nt, Human
cuggaacuugggga

SEQ ID NO: 1239780 - RNA, 21 nt, Human
cuggaagacgcaagggccuga

SEQ ID NO: 1239781 - RNA, 23 nt, Human
cuggaagauggggaccagcagcc

SEQ ID NO: 1239782 - RNA, 16 nt, Human
cuggaagagcagcccu

SEQ ID NO: 1239783 - RNA, 15 nt, Human
cuggaagauagcugu

SEQ ID NO: 1239784 - RNA, 16 nt, Human
cuggaagauagcugug

SEQ ID NO: 1239785 - RNA, 19 nt, Human
cuggaagauagcugugacu

SEQ ID NO: 1239786 - RNA, 14 nt, Human
cuggaagauccugc

SEQ ID NO: 1239787 - RNA, 18 nt, Human
cuggaagauccugcgggu

SEQ ID NO: 1239788 - RNA, 13 nt, Human
cuggaagaugggg

SEQ ID NO: 1239789 - RNA, 14 nt, Human
cuggaagaugggga

SEQ ID NO: 1239790 - RNA, 13 nt, Human
cuggaguuucaug

SEQ ID NO: 1239791 - RNA, 22 nt, Human
cuggaguuucauguacaagaug

SEQ ID NO: 1239792 - RNA, 18 nt, Human
cuggaguuucauguacaa

SEQ ID NO: 1239793 - RNA, 17 nt, Human
cuggauaacuuccacag

SEQ ID NO: 1239794 - RNA, 22 nt, Human
cuggauaacuuccacagggucc

SEQ ID NO: 1239795 - RNA, 18 nt, Human
cuggauaacuuccacagg

SEQ ID NO: 1239796 - RNA, 15 nt, Human
cuggaucagaacagg

SEQ ID NO: 1239797 - RNA, 13 nt, Human
cuggaucagcgug

SEQ ID NO: 1239798 - RNA, 14 nt, Human
cuggaucagcgugg

SEQ ID NO: 1239799 - RNA, 16 nt, Human
cuggaucagcguggcc

SEQ ID NO: 1239800 - RNA, 17 nt, Human
cuggaucagcguggccu

SEQ ID NO: 1239801 - RNA, 18 nt, Human
cuggaucagcguggccuu

SEQ ID NO: 1239802 - RNA, 12 nt, Human
cuggggcaggcu

SEQ ID NO: 1239803 - RNA, 14 nt, Human
cuggggcaggcugg

SEQ ID NO: 1239804 - RNA, 15 nt, Human
cuggggcaggcuggg

SEQ ID NO: 1239805 - RNA, 15 nt, Human
cuggggagcaggcag

SEQ ID NO: 1239806 - RNA, 16 nt, Human
cuggggagcaggcagc

SEQ ID NO: 1239807 - RNA, 17 nt, Human
cuggggagcaggcagcc

SEQ ID NO: 1239808 - RNA, 21 nt, Human
cuggggagcaggcagccagca

SEQ ID NO: 1239809 - RNA, 12 nt, Human
cuggggagcccg

SEQ ID NO: 1239810 - RNA, 15 nt, Human
cuggggagcccgucu

SEQ ID NO: 1239811 - RNA, 20 nt, Human
cuggggagcccgucucagug

SEQ ID NO: 1239812 - RNA, 22 nt, Human
cuggggagcgggucugcuccca

SEQ ID NO: 1239813 - RNA, 14 nt, Human
cuggggagcggguc

SEQ ID NO: 1239814 - RNA, 12 nt, Human
cugggccagaau

SEQ ID NO: 1239815 - RNA, 19 nt, Human
cugggccaacucaccugag

SEQ ID NO: 1239816 - RNA, 14 nt, Human
cugggccagaauuu

SEQ ID NO: 1239817 - RNA, 11 nt, Human
cuggggagcag

SEQ ID NO: 1239818 - RNA, 20 nt, Human
cuggggcugaggcugaggca

SEQ ID NO: 1239819 - RNA, 13 nt, Human
cuggggcucagag

SEQ ID NO: 1239820 - RNA, 14 nt, Human
cuggggcucagagc

SEQ ID NO: 1239821 - RNA, 17 nt, Human
cuggggcucagagccgg

SEQ ID NO: 1239822 - RNA, 16 nt, Human
cuggggcucagagccg

SEQ ID NO: 1239823 - RNA, 19 nt, Human
cuggggcucuaacgccuga

SEQ ID NO: 1239824 - RNA, 20 nt, Human
cuggggcucuaacgccugag

SEQ ID NO: 1239825 - RNA, 21 nt, Human
cuggggcucuaacgccugagc

SEQ ID NO: 1239826 - RNA, 22 nt, Human
cuggggcucuaacgccugagcc

SEQ ID NO: 1239827 - RNA, 23 nt, Human
cuggggcucuaacgccugagccc

SEQ ID NO: 1239828 - RNA, 18 nt, Human
cuggggccaggcuggguc

SEQ ID NO: 1239829 - RNA, 18 nt, Human
cuggggcuagggggagcc

SEQ ID NO: 1239830 - RNA, 12 nt, Human
cuggggcucaga

SEQ ID NO: 1239831 - RNA, 15 nt, Human
cuggggccaggcugg

SEQ ID NO: 1239832 - RNA, 16 nt, Human
cuggggcaggcugggc

SEQ ID NO: 1239833 - RNA, 17 nt, Human
cuggggcaggcugggcc

SEQ ID NO: 1239834 - RNA, 18 nt, Human
cuggggcaggcugggcca

SEQ ID NO: 1239835 - RNA, 19 nt, Human
cuggggcaggcugggccau

SEQ ID NO: 1239836 - RNA, 21 nt, Human
cuggggcaggcugggccaugu

SEQ ID NO: 1239837 - RNA, 17 nt, Human
cuggggcauggaaggca

SEQ ID NO: 1239838 - RNA, 15 nt, Human
cuggguggcuacucu

SEQ ID NO: 1239839 - RNA, 17 nt, Human
cuggguggcuacucugu

SEQ ID NO: 1239840 - RNA, 19 nt, Human
cuggguggcuacucugugc

SEQ ID NO: 1239841 - RNA, 20 nt, Human
cuggguggcuacucugugcc

SEQ ID NO: 1239842 - RNA, 21 nt, Human
cuggguggcuacucugugcca

SEQ ID NO: 1239843 - RNA, 22 nt, Human
cuggguggcuacucugugccag

SEQ ID NO: 1239844 - RNA, 15 nt, Human
cuggguggcucacuc

SEQ ID NO: 1239845 - RNA, 17 nt, Human
cuggguggcucacucag

SEQ ID NO: 1239846 - RNA, 16 nt, Human
cugggugguacccucu

SEQ ID NO: 1239847 - RNA, 18 nt, Human
cugggacuugcaaaaagg

SEQ ID NO: 1239848 - RNA, 23 nt, Human
cugggacuauaggcaugcgccac

SEQ ID NO: 1239849 - RNA, 13 nt, Human
cugggacucagcc

SEQ ID NO: 1239850 - RNA, 18 nt, Human
cugggacaacugcuccca

SEQ ID NO: 1239851 - RNA, 22 nt, Human
cugggacaacugcucccaccuc

SEQ ID NO: 1239852 - RNA, 14 nt, Human
cugggacucagccu

SEQ ID NO: 1239853 - RNA, 15 nt, Human
cugggacucagccuu

SEQ ID NO: 1239854 - RNA, 16 nt, Human
cugggacucagccuuc

SEQ ID NO: 1239855 - RNA, 17 nt, Human
cugggacucagccuuca

SEQ ID NO: 1239856 - RNA, 18 nt, Human
cugggacucagccuucag

SEQ ID NO: 1239857 - RNA, 21 nt, Human
cugggacucagccuucagaca

SEQ ID NO: 1239858 - RNA, 23 nt, Human
cugggaauggaggggcagagcca

SEQ ID NO: 1239859 - RNA, 20 nt, Human
cugggaauggaggggcagag

SEQ ID NO: 1239860 - RNA, 13 nt, Human
cugggaauggagg

SEQ ID NO: 1239861 - RNA, 23 nt, Human
cugggaagucguccuuacuccug

SEQ ID NO: 1239862 - RNA, 24 nt, Human
cuggcucugagcgccuccauccaa

SEQ ID NO: 1239863 - RNA, 15 nt, Human
cuggcccugcccugg

SEQ ID NO: 1239864 - RNA, 16 nt, Human
cuggccgggagccuga

SEQ ID NO: 1239865 - RNA, 19 nt, Human
cuggccuagaccagcagac

SEQ ID NO: 1239866 - RNA, 20 nt, Human
cuggccuagaccagcagaca

SEQ ID NO: 1239867 - RNA, 22 nt, Human
cuggccuagaccagcagacaga

SEQ ID NO: 1239868 - RNA, 13 nt, Human
cuggcucuccugg

SEQ ID NO: 1239869 - RNA, 17 nt, Human
cuggcucuccuggcccu

SEQ ID NO: 1239870 - RNA, 15 nt, Human
cuggcucuccuggcc

SEQ ID NO: 1239871 - RNA, 12 nt, Human
cuggcucugagc

SEQ ID NO: 1239872 - RNA, 13 nt, Human
cuggcucugagcg

SEQ ID NO: 1239873 - RNA, 20 nt, Human
cuggcucugagcgccuccau

SEQ ID NO: 1239874 - RNA, 21 nt, Human
cuggcucugagcgccuccauc

SEQ ID NO: 1239875 - RNA, 20 nt, Human
cuggcagccucccauccagg

SEQ ID NO: 1239876 - RNA, 22 nt, Human
cuggcagccucccauccagggc

SEQ ID NO: 1239877 - RNA, 23 nt, Human
cuggcagccucccauccagggcc

SEQ ID NO: 1239878 - RNA, 13 nt, Human
cuggccccucucc

SEQ ID NO: 1239879 - RNA, 14 nt, Human
cuggccccucuccc

SEQ ID NO: 1239880 - RNA, 15 nt, Human
cuggccccucucccu

SEQ ID NO: 1239881 - RNA, 24 nt, Human
cuggccccucucccuugggcucug

SEQ ID NO: 1239882 - RNA, 11 nt, Human
cuggcccugcc

SEQ ID NO: 1239883 - RNA, 13 nt, Human
cuggcccugcccu

SEQ ID NO: 1239884 - RNA, 14 nt, Human
cuggcccugcccug

SEQ ID NO: 1239885 - RNA, 14 nt, Human
cuggcagaggaggg

SEQ ID NO: 1239886 - RNA, 18 nt, Human
cuggcagagaugccuccc

SEQ ID NO: 1239887 - RNA, 20 nt, Human
cuggcagagaugccucccug

SEQ ID NO: 1239888 - RNA, 12 nt, Human
cuggcagccaca

SEQ ID NO: 1239889 - RNA, 14 nt, Human
cuggcagccacacu

SEQ ID NO: 1239890 - RNA, 15 nt, Human
cuggcagccacacuu

SEQ ID NO: 1239891 - RNA, 22 nt, Human
cuggcagccacacuucucagga

SEQ ID NO: 1239892 - RNA, 23 nt, Human
cuggcagccacacuucucaggac

SEQ ID NO: 1239893 - RNA, 20 nt, Human
cuggcagccgugccuucagc

SEQ ID NO: 1239894 - RNA, 21 nt, Human
cuggcagccgugccuucagcu

SEQ ID NO: 1239895 - RNA, 22 nt, Human
cuggcagccgugccuucagcuc

SEQ ID NO: 1239896 - RNA, 12 nt, Human
cuggcagccucc

SEQ ID NO: 1239897 - RNA, 14 nt, Human
cuggcagccuccca

SEQ ID NO: 1239898 - RNA, 15 nt, Human
cuggcagccucccau

SEQ ID NO: 1239899 - RNA, 14 nt, Human
cuggcagagaugcc

SEQ ID NO: 1239900 - RNA, 17 nt, Human
cuggcagagaugccucc

SEQ ID NO: 1239901 - RNA, 13 nt, Human
cuguuauaaucuu

SEQ ID NO: 1239902 - RNA, 19 nt, Human
cuguuauaaucuuucacag

SEQ ID NO: 1239903 - RNA, 12 nt, Human
cugugucuaaga

SEQ ID NO: 1239904 - RNA, 13 nt, Human
cugugucuaagau

SEQ ID NO: 1239905 - RNA, 13 nt, Human
cuguuagucauuu

SEQ ID NO: 1239906 - RNA, 14 nt, Human
cuguuagucauuug

SEQ ID NO: 1239907 - RNA, 15 nt, Human
cuguuagucauuugc

SEQ ID NO: 1239908 - RNA, 18 nt, Human
cuguuagucauuugcuga

SEQ ID NO: 1239909 - RNA, 14 nt, Human
cugugcgcccaggg

SEQ ID NO: 1239910 - RNA, 14 nt, Human
cugugucacccagg

SEQ ID NO: 1239911 - RNA, 23 nt, Human
cugugccuuguuuuuuguuuguu

SEQ ID NO: 1239912 - RNA, 17 nt, Human
cugugcgcccagggcug

SEQ ID NO: 1239913 - RNA, 20 nt, Human
cugugccuugucacgccaga

SEQ ID NO: 1239914 - RNA, 15 nt, Human
cugugccugaauauu

SEQ ID NO: 1239915 - RNA, 14 nt, Human
cugugaccugcuga

SEQ ID NO: 1239916 - RNA, 15 nt, Human
cugugaccugcugag

SEQ ID NO: 1239917 - RNA, 16 nt, Human
cugugaccugcugagc

SEQ ID NO: 1239918 - RNA, 17 nt, Human
cugugaccugcugagcu

SEQ ID NO: 1239919 - RNA, 18 nt, Human
cugugaccugcugagcuc

SEQ ID NO: 1239920 - RNA, 19 nt, Human
cugugaccugcugagcucu

SEQ ID NO: 1239921 - RNA, 20 nt, Human
cugugaccugcugagcucug

SEQ ID NO: 1239922 - RNA, 21 nt, Human
cugugaccugcugagcucuga

SEQ ID NO: 1239923 - RNA, 22 nt, Human
cugugaccugcugagcucugag

SEQ ID NO: 1239924 - RNA, 13 nt, Human
cugugacccccag

SEQ ID NO: 1239925 - RNA, 15 nt, Human
cugugacccccagcu

SEQ ID NO: 1239926 - RNA, 16 nt, Human
cugugacccccagcuc

SEQ ID NO: 1239927 - RNA, 17 nt, Human
cugugacccccagcucc

SEQ ID NO: 1239928 - RNA, 18 nt, Human
cugugacccccagcuccg

SEQ ID NO: 1239929 - RNA, 21 nt, Human
cugugacccccagcuccggcc

SEQ ID NO: 1239930 - RNA, 17 nt, Human
cugugaccucuccccug

SEQ ID NO: 1239931 - RNA, 18 nt, Human
cuguagacggcucaguau

SEQ ID NO: 1239932 - RNA, 23 nt, Human
cuguagaaaaaaaaauucacaug

SEQ ID NO: 1239933 - RNA, 18 nt, Human
cuguagaacucaaccucu

SEQ ID NO: 1239934 - RNA, 15 nt, Human
cuguagguugcacac

SEQ ID NO: 1239935 - RNA, 16 nt, Human
cuguagguugcacacu

SEQ ID NO: 1239936 - RNA, 24 nt, Human
cuguaggguaauuaguaacaugug

SEQ ID NO: 1239937 - RNA, 17 nt, Human
cuguagguugcacacuu

SEQ ID NO: 1239938 - RNA, 19 nt, Human
cuguagguugcacacuuug

SEQ ID NO: 1239939 - RNA, 22 nt, Human
cuguagguugcacacuuuggua

SEQ ID NO: 1239940 - RNA, 20 nt, Human
cuguagguugcacacuuugg

SEQ ID NO: 1239941 - RNA, 17 nt, Human
cuguaguaaauaaugcu

SEQ ID NO: 1239942 - RNA, 22 nt, Human
cuguaguaaauaaugcuuugaa

SEQ ID NO: 1239943 - RNA, 18 nt, Human
cuguaguaaauaaugcuu

SEQ ID NO: 1239944 - RNA, 19 nt, Human
cuguaguaaauaaugcuuu

SEQ ID NO: 1239945 - RNA, 20 nt, Human
cuguaguaaauaaugcuuug

SEQ ID NO: 1239946 - RNA, 22 nt, Human
cuguaguaggcauuuuuaccau

SEQ ID NO: 1239947 - RNA, 18 nt, Human
cuguaguaggcauuuuua

SEQ ID NO: 1239948 - RNA, 21 nt, Human
cuguacugauucaauuugaug

SEQ ID NO: 1239949 - RNA, 17 nt, Human
cuguacugauucaauuu

SEQ ID NO: 1239950 - RNA, 14 nt, Human
cuguacugauucaa

SEQ ID NO: 1239951 - RNA, 12 nt, Human
cuguacugccug

SEQ ID NO: 1239952 - RNA, 13 nt, Human
cuguacugccugc

SEQ ID NO: 1239953 - RNA, 14 nt, Human
cuguacugccugcu

SEQ ID NO: 1239954 - RNA, 13 nt, Human
cuguacugauuca

SEQ ID NO: 1239955 - RNA, 19 nt, Human
cuguacugaaguaaaacaa

SEQ ID NO: 1239956 - RNA, 20 nt, Human
cuguacugaaguaaaacaaa

SEQ ID NO: 1239957 - RNA, 15 nt, Human
cuguacugccugcuu

SEQ ID NO: 1239958 - RNA, 16 nt, Human
cuguacugccugcuug

SEQ ID NO: 1239959 - RNA, 17 nt, Human
cuguacugccugcuugg

SEQ ID NO: 1239960 - RNA, 18 nt, Human
cuguacugccugcuuggg

SEQ ID NO: 1239961 - RNA, 19 nt, Human
cuguacugccugcuugggg

SEQ ID NO: 1239962 - RNA, 17 nt, Human
cuguacuguucuguguc

SEQ ID NO: 1239963 - RNA, 20 nt, Human
cuguacuguucugugucuuu

SEQ ID NO: 1239964 - RNA, 19 nt, Human
cuguaacauacuggccugg

SEQ ID NO: 1239965 - RNA, 15 nt, Human
cuguaaccucuucag

SEQ ID NO: 1239966 - RNA, 19 nt, Human
cuguaaccucuucagaggc

SEQ ID NO: 1239967 - RNA, 20 nt, Human
cuguaaccucuucagaggcc

SEQ ID NO: 1239968 - RNA, 22 nt, Human
cuguaaccucuucagaggcccu

SEQ ID NO: 1239969 - RNA, 23 nt, Human
cuguaaccucuucagaggcccuc

SEQ ID NO: 1239970 - RNA, 15 nt, Human
cuguaacauucagga

SEQ ID NO: 1239971 - RNA, 16 nt, Human
cuguaacuacuuuaua

SEQ ID NO: 1239972 - RNA, 17 nt, Human
cuguaacuacuuuauaa

SEQ ID NO: 1239973 - RNA, 19 nt, Human
cuguaacuacuuuauaacu

SEQ ID NO: 1239974 - RNA, 14 nt, Human
cuguaacugccagg

SEQ ID NO: 1239975 - RNA, 15 nt, Human
cuguaacugccaggc

SEQ ID NO: 1239976 - RNA, 16 nt, Human
cuguaacugccaggcu

SEQ ID NO: 1239977 - RNA, 13 nt, Human
cuguaacugucac

SEQ ID NO: 1239978 - RNA, 15 nt, Human
cuggugaagcucacu

SEQ ID NO: 1239979 - RNA, 20 nt, Human
cuggugacaucagguuuuuc

SEQ ID NO: 1239980 - RNA, 18 nt, Human
cuggucuuguggaauugg

SEQ ID NO: 1239981 - RNA, 20 nt, Human
cuggucuuguggaauuggga

SEQ ID NO: 1239982 - RNA, 20 nt, Human
cuggugaagcucacuucugg

SEQ ID NO: 1239983 - RNA, 19 nt, Human
cuguaaacuuuaucacuua

SEQ ID NO: 1239984 - RNA, 18 nt, Human
cuguaaacuuuaucacuu

SEQ ID NO: 1239985 - RNA, 14 nt, Human
cuguaaacugugua

SEQ ID NO: 1239986 - RNA, 20 nt, Human
cuguaaacuguguauuccaa

SEQ ID NO: 1239987 - RNA, 13 nt, Human
cugguuuccugcc

SEQ ID NO: 1239988 - RNA, 14 nt, Human
cugguuuccugccc

SEQ ID NO: 1239989 - RNA, 16 nt, Human
cugguuuccugcccug

SEQ ID NO: 1239990 - RNA, 12 nt, Human
cuguaaacugug

SEQ ID NO: 1239991 - RNA, 13 nt, Human
cuguaaacugugu

SEQ ID NO: 1239992 - RNA, 16 nt, Human
cugguuguuaugugau

SEQ ID NO: 1239993 - RNA, 16 nt, Human
cugguuguuucuguuc

SEQ ID NO: 1239994 - RNA, 19 nt, Human
cugguuguuucuguuccaa

SEQ ID NO: 1239995 - RNA, 14 nt, Human
cugguuuaauguuu

SEQ ID NO: 1239996 - RNA, 21 nt, Human
cugguuguuucuguuccaaau

SEQ ID NO: 1239997 - RNA, 16 nt, Human
cugucacaaccaagaa

SEQ ID NO: 1239998 - RNA, 15 nt, Human
cugucacaaccaaga

SEQ ID NO: 1239999 - RNA, 19 nt, Human
cugucaguucuaaccuccu

SEQ ID NO: 1240000 - RNA, 14 nt, Human
cugucauagaaauu

SEQ ID NO: 1240001 - RNA, 16 nt, Human
cugucauagaaauuac

SEQ ID NO: 1240002 - RNA, 22 nt, Human
cugucauaugcucugauuuauc

SEQ ID NO: 1240003 - RNA, 16 nt, Human
cugucaucaauuaaag

SEQ ID NO: 1240004 - RNA, 23 nt, Human
cugucaucaauuaaaggcaaagg

SEQ ID NO: 1240005 - RNA, 16 nt, Human
cugucaucaucauggc

SEQ ID NO: 1240006 - RNA, 17 nt, Human
cugucaucaucauggcc

SEQ ID NO: 1240007 - RNA, 19 nt, Human
cugucaucaucauggccag

SEQ ID NO: 1240008 - RNA, 20 nt, Human
cugucaucaucauggccagc

SEQ ID NO: 1240009 - RNA, 21 nt, Human
cugucaucaucauggccagcu

SEQ ID NO: 1240010 - RNA, 17 nt, Human
cugucauccagcucacu

SEQ ID NO: 1240011 - RNA, 20 nt, Human
cugucauccucaaagaaagu

SEQ ID NO: 1240012 - RNA, 21 nt, Human
cugucauccucaaagaaagug

SEQ ID NO: 1240013 - RNA, 22 nt, Human
cugucauccucaaagaaagugu

SEQ ID NO: 1240014 - RNA, 23 nt, Human
cugucauccucaaagaaagugua

SEQ ID NO: 1240015 - RNA, 19 nt, Human
cuguccucccgagcuccuc

SEQ ID NO: 1240016 - RNA, 21 nt, Human
cuguccucccgagcuccucuu

SEQ ID NO: 1240017 - RNA, 13 nt, Human
cuguccucuuuca

SEQ ID NO: 1240018 - RNA, 15 nt, Human
cuguccucuuucagc

SEQ ID NO: 1240019 - RNA, 16 nt, Human
cuguccucuuucagcu

SEQ ID NO: 1240020 - RNA, 17 nt, Human
cuguccucuuucagcuc

SEQ ID NO: 1240021 - RNA, 18 nt, Human
cuguccucuuucagcucc

SEQ ID NO: 1240022 - RNA, 19 nt, Human
cuguccucuuucagcuccu

SEQ ID NO: 1240023 - RNA, 20 nt, Human
cuguccucuuucagcuccug

SEQ ID NO: 1240024 - RNA, 21 nt, Human
cuguccucuuucagcuccuga

SEQ ID NO: 1240025 - RNA, 22 nt, Human
cuguccucuuucagcuccugac

SEQ ID NO: 1240026 - RNA, 13 nt, Human
cuguccugggccu

SEQ ID NO: 1240027 - RNA, 14 nt, Human
cuguccugggccug

SEQ ID NO: 1240028 - RNA, 18 nt, Human
cuguccugggccugcaga

SEQ ID NO: 1240029 - RNA, 22 nt, Human
cuguccuguacauugugggaug

SEQ ID NO: 1240030 - RNA, 21 nt, Human
cuguccuggugguauuuucaa

SEQ ID NO: 1240031 - RNA, 15 nt, Human
cugucgcucucaguu

SEQ ID NO: 1240032 - RNA, 16 nt, Human
cugucgcucucaguuc

SEQ ID NO: 1240033 - RNA, 14 nt, Human
cuguccugguggua

SEQ ID NO: 1240034 - RNA, 17 nt, Human
cuguccuggugguauuu

SEQ ID NO: 1240035 - RNA, 19 nt, Human
cuguccuggugguauuuuc

SEQ ID NO: 1240036 - RNA, 20 nt, Human
cuguccuggugguauuuuca

SEQ ID NO: 1240037 - RNA, 23 nt, Human
cuguccuggugguauuuucaaua

SEQ ID NO: 1240038 - RNA, 14 nt, Human
cuguccuguacauu

SEQ ID NO: 1240039 - RNA, 14 nt, Human
cuguccugucauca

SEQ ID NO: 1240040 - RNA, 13 nt, Human
cugucgcugcuuc

SEQ ID NO: 1240041 - RNA, 14 nt, Human
cugucgcugcuucg

SEQ ID NO: 1240042 - RNA, 17 nt, Human
cugucgcugcuucgugg

SEQ ID NO: 1240043 - RNA, 19 nt, Human
cuuagcuaguuuuauucuu

SEQ ID NO: 1240044 - RNA, 16 nt, Human
cuuagcucaaugagca

SEQ ID NO: 1240045 - RNA, 18 nt, Human
cuuagcucaaugagcaug

SEQ ID NO: 1240046 - RNA, 19 nt, Human
cuuagcucaaugagcaugu

SEQ ID NO: 1240047 - RNA, 20 nt, Human
cuuagcucaaugagcauguu

SEQ ID NO: 1240048 - RNA, 13 nt, Human
cuuagcugggaga

SEQ ID NO: 1240049 - RNA, 14 nt, Human
cuuagcugucugcu

SEQ ID NO: 1240050 - RNA, 19 nt, Human
cuuagcucucccaacucuu

SEQ ID NO: 1240051 - RNA, 22 nt, Human
cuuagcucaaugagcauguuua

SEQ ID NO: 1240052 - RNA, 17 nt, Human
cuuagcugucugcucag

SEQ ID NO: 1240053 - RNA, 20 nt, Human
cuuagcuuuagaaacagugc

SEQ ID NO: 1240054 - RNA, 16 nt, Human
cuuagcuuuagaaaca

SEQ ID NO: 1240055 - RNA, 13 nt, Human
cuuagccuggacc

SEQ ID NO: 1240056 - RNA, 17 nt, Human
cuuagccuggaccucug

SEQ ID NO: 1240057 - RNA, 18 nt, Human
cuuagccuggaccucuga

SEQ ID NO: 1240058 - RNA, 19 nt, Human
cuuagccuggaccucugac

SEQ ID NO: 1240059 - RNA, 21 nt, Human
cuuagccuggaccucugacag

SEQ ID NO: 1240060 - RNA, 20 nt, Human
cuuagccuggaccucugaca

SEQ ID NO: 1240061 - RNA, 19 nt, Human
cuuagcauuuucugcaucu

SEQ ID NO: 1240062 - RNA, 21 nt, Human
cuuagcauuuucugcaucucc

SEQ ID NO: 1240063 - RNA, 19 nt, Human
cuuaccaggcaccaaaaga

SEQ ID NO: 1240064 - RNA, 20 nt, Human
cuuaccaggcaccaaaagaa

SEQ ID NO: 1240065 - RNA, 18 nt, Human
cuuagcaguccccuuccc

SEQ ID NO: 1240066 - RNA, 12 nt, Human
cuuagcaguccc

SEQ ID NO: 1240067 - RNA, 17 nt, Human
cuuagcaguccccuucc

SEQ ID NO: 1240068 - RNA, 16 nt, Human
cuuaggaagagccuuc

SEQ ID NO: 1240069 - RNA, 20 nt, Human
cuuaggaagagccuuccacc

SEQ ID NO: 1240070 - RNA, 23 nt, Human
cuuaggaagagccuuccacccag

SEQ ID NO: 1240071 - RNA, 21 nt, Human
cuuagggacagucaaaaccaa

SEQ ID NO: 1240072 - RNA, 15 nt, Human
cuuagggcaccaggg

SEQ ID NO: 1240073 - RNA, 16 nt, Human
cuguucaaagcugccu

SEQ ID NO: 1240074 - RNA, 14 nt, Human
cuguuuaagagaca

SEQ ID NO: 1240075 - RNA, 12 nt, Human
cuguuuaagaga

SEQ ID NO: 1240076 - RNA, 15 nt, Human
cuguuguagaagaca

SEQ ID NO: 1240077 - RNA, 16 nt, Human
cuguuuaaaaaaccac

SEQ ID NO: 1240078 - RNA, 20 nt, Human
cuguuuaaaaaaccacaugg

SEQ ID NO: 1240079 - RNA, 18 nt, Human
cuguuuaaaaaaccacau

SEQ ID NO: 1240080 - RNA, 12 nt, Human
cuguugggagag

SEQ ID NO: 1240081 - RNA, 17 nt, Human
cuuaaauaagaaacuuu

SEQ ID NO: 1240082 - RNA, 13 nt, Human
cuuaaauaagaaa

SEQ ID NO: 1240083 - RNA, 16 nt, Human
cuuaaauaagaaacuu

SEQ ID NO: 1240084 - RNA, 14 nt, Human
cuuacaaaugaaaa

SEQ ID NO: 1240085 - RNA, 21 nt, Human
cuuaaaaauuaaauuggaaag

SEQ ID NO: 1240086 - RNA, 21 nt, Human
cuuacauuagcaguuugcuuu

SEQ ID NO: 1240087 - RNA, 22 nt, Human
cuuacauuagcaguuugcuuug

SEQ ID NO: 1240088 - RNA, 18 nt, Human
cuuacaagccuaagaauc

SEQ ID NO: 1240089 - RNA, 22 nt, Human
cuuacauuuacaaacugaagag

SEQ ID NO: 1240090 - RNA, 20 nt, Human
cuuugaccugccucccuuca

SEQ ID NO: 1240091 - RNA, 17 nt, Human
cuuucucacuaaaucuu

SEQ ID NO: 1240092 - RNA, 22 nt, Human
cuuucucacuaaaucuuuuaua

SEQ ID NO: 1240093 - RNA, 15 nt, Human
cuuucucaguuuuca

SEQ ID NO: 1240094 - RNA, 16 nt, Human
cuuucucaguuuucau

SEQ ID NO: 1240095 - RNA, 17 nt, Human
cuuucucaguuuucaua

SEQ ID NO: 1240096 - RNA, 20 nt, Human
cuuucucaguuuucauaagu

SEQ ID NO: 1240097 - RNA, 23 nt, Human
cuuugaccugccucccuucaugc

SEQ ID NO: 1240098 - RNA, 13 nt, Human
cuuugacucagga

SEQ ID NO: 1240099 - RNA, 23 nt, Human
cuuugacucaggagccugugaca

SEQ ID NO: 1240100 - RNA, 21 nt, Human
cuuugacucuuuugccauuaa

SEQ ID NO: 1240101 - RNA, 18 nt, Human
cuuucucaauaagccuca

SEQ ID NO: 1240102 - RNA, 22 nt, Human
cuuuguauuguauauuacaaug

SEQ ID NO: 1240103 - RNA, 13 nt, Human
cuuuguauucaaa

SEQ ID NO: 1240104 - RNA, 12 nt, Human
cuuuuauaauuc

SEQ ID NO: 1240105 - RNA, 21 nt, Human
cuuuuauaauucucauuaaaa

SEQ ID NO: 1240106 - RNA, 12 nt, Human
cuuuuauacucu

SEQ ID NO: 1240107 - RNA, 15 nt, Human
cuuuguaaugaaaac

SEQ ID NO: 1240108 - RNA, 14 nt, Human
cuuuguaaugaaaa

SEQ ID NO: 1240109 - RNA, 22 nt, Human
cuuugcacgugcuguuugcugu

SEQ ID NO: 1240110 - RNA, 13 nt, Human
cuuugguucuaag

SEQ ID NO: 1240111 - RNA, 14 nt, Human
cuuugguucuaagg

SEQ ID NO: 1240112 - RNA, 15 nt, Human
cuuugguucuaagga

SEQ ID NO: 1240113 - RNA, 16 nt, Human
cuuugguucuaaggac

SEQ ID NO: 1240114 - RNA, 16 nt, Human
cuuuguaaugaaaacc

SEQ ID NO: 1240115 - RNA, 12 nt, Human
cuuuguaugcac

SEQ ID NO: 1240116 - RNA, 14 nt, Human
cuuugacuuuuugc

SEQ ID NO: 1240117 - RNA, 15 nt, Human
cuuugacuuuuugca

SEQ ID NO: 1240118 - RNA, 17 nt, Human
cuuugacuuuuugcauu

SEQ ID NO: 1240119 - RNA, 12 nt, Human
cuuugagagaga

SEQ ID NO: 1240120 - RNA, 15 nt, Human
cuuugagagagaaag

SEQ ID NO: 1240121 - RNA, 18 nt, Human
cuuugagagagaaaggac

SEQ ID NO: 1240122 - RNA, 18 nt, Human
cuuugcacagcucuccgg

SEQ ID NO: 1240123 - RNA, 14 nt, Human
cuuugcacgugcug

SEQ ID NO: 1240124 - RNA, 14 nt, Human
cuuugguucagcua

SEQ ID NO: 1240125 - RNA, 19 nt, Human
cuuucagcaagauaaacau

SEQ ID NO: 1240126 - RNA, 21 nt, Human
cuuucagcaagauaaacauua

SEQ ID NO: 1240127 - RNA, 20 nt, Human
cuuucagcaagacuucucuu

SEQ ID NO: 1240128 - RNA, 16 nt, Human
cuuuacccauuugggu

SEQ ID NO: 1240129 - RNA, 20 nt, Human
cuuucacuaaaacacacagg

SEQ ID NO: 1240130 - RNA, 17 nt, Human
cuuuacaugaggacucu

SEQ ID NO: 1240131 - RNA, 19 nt, Human
cuuuaccaaagaugaauga

SEQ ID NO: 1240132 - RNA, 16 nt, Human
cuuuaccaaagaugaa

SEQ ID NO: 1240133 - RNA, 17 nt, Human
cuugugcccucccuguc

SEQ ID NO: 1240134 - RNA, 15 nt, Human
cuugugcaguguuga

SEQ ID NO: 1240135 - RNA, 20 nt, Human
cuugugcccucccuguccuu

SEQ ID NO: 1240136 - RNA, 18 nt, Human
cuuguggaauugggagcu

SEQ ID NO: 1240137 - RNA, 13 nt, Human
cuuuaauguuuuu

SEQ ID NO: 1240138 - RNA, 17 nt, Human
cuuuaauguuuuuugcc

SEQ ID NO: 1240139 - RNA, 23 nt, Human
cuuuaauguuuuuugccacagcu

SEQ ID NO: 1240140 - RNA, 18 nt, Human
cuuuaauuaccaaccugu

SEQ ID NO: 1240141 - RNA, 19 nt, Human
cuuuaauuaccaaccuguu

SEQ ID NO: 1240142 - RNA, 21 nt, Human
cuuuaauguuuuuugccacag

SEQ ID NO: 1240143 - RNA, 14 nt, Human
cuuuaauucuguau

SEQ ID NO: 1240144 - RNA, 18 nt, Human
cuuuaauucuguaucugu

SEQ ID NO: 1240145 - RNA, 13 nt, Human
cuugucuuuauuu

SEQ ID NO: 1240146 - RNA, 19 nt, Human
cuugugaaucaagggucag

SEQ ID NO: 1240147 - RNA, 20 nt, Human
cuugugaaucaagggucagg

SEQ ID NO: 1240148 - RNA, 22 nt, Human
cuugugaaucaagggucaggcc

SEQ ID NO: 1240149 - RNA, 16 nt, Human
cuugucuauaaagcau

SEQ ID NO: 1240150 - RNA, 17 nt, Human
cuugucuauaaagcauu

SEQ ID NO: 1240151 - RNA, 20 nt, Human
cuugucuauaaagcauuuaa

SEQ ID NO: 1240152 - RNA, 20 nt, Human
cuuggugaauuuuuuuuucc

SEQ ID NO: 1240153 - RNA, 22 nt, Human
cuuggugaauuuuuuuuuccua

SEQ ID NO: 1240154 - RNA, 19 nt, Human
cuuggugauuccgcaguga

SEQ ID NO: 1240155 - RNA, 15 nt, Human
cuuggguuagaccua

SEQ ID NO: 1240156 - RNA, 16 nt, Human
cuuggguuagaccuac

SEQ ID NO: 1240157 - RNA, 18 nt, Human
cuuggguuagaccuacag

SEQ ID NO: 1240158 - RNA, 22 nt, Human
cuuggguuagaccuacaggggg

SEQ ID NO: 1240159 - RNA, 19 nt, Human
cuuggguuagaccuacagg

SEQ ID NO: 1240160 - RNA, 16 nt, Human
cuuggucugugagaug

SEQ ID NO: 1240161 - RNA, 19 nt, Human
cuuggucugugagaugcua

SEQ ID NO: 1240162 - RNA, 16 nt, Human
cuuggguagcgcacuc

SEQ ID NO: 1240163 - RNA, 18 nt, Human
cuuggggguucaggcccg

SEQ ID NO: 1240164 - RNA, 23 nt, Human
cuuggggguucaggcccggcagg

SEQ ID NO: 1240165 - RNA, 16 nt, Human
cuugaaggacuaauag

SEQ ID NO: 1240166 - RNA, 13 nt, Human
cuugaagggccag

SEQ ID NO: 1240167 - RNA, 14 nt, Human
cuugaagggccaga

SEQ ID NO: 1240168 - RNA, 15 nt, Human
cuugaagggccagag

SEQ ID NO: 1240169 - RNA, 16 nt, Human
cuugaagggccagagc

SEQ ID NO: 1240170 - RNA, 17 nt, Human
cuugaagggccagagcc

SEQ ID NO: 1240171 - RNA, 18 nt, Human
cuugaagggccagagcca

SEQ ID NO: 1240172 - RNA, 19 nt, Human
cuugaagggccagagccag

SEQ ID NO: 1240173 - RNA, 21 nt, Human
cuugaagggccagagccaggg

SEQ ID NO: 1240174 - RNA, 21 nt, Human
cuugaauuguaacuguucuug

SEQ ID NO: 1240175 - RNA, 22 nt, Human
cuugaauuguaacuguucuuga

SEQ ID NO: 1240176 - RNA, 20 nt, Human
cuugacaguggaacuacauu

SEQ ID NO: 1240177 - RNA, 23 nt, Human
cuugaagguauaucuagguuuau

SEQ ID NO: 1240178 - RNA, 20 nt, Human
cuugaagggccagagccagg

SEQ ID NO: 1240179 - RNA, 14 nt, Human
cuugaaggugcuga

SEQ ID NO: 1240180 - RNA, 22 nt, Human
cuugaaggugcugacggccagg

SEQ ID NO: 1240181 - RNA, 19 nt, Human
cuugaauguggcuugagaa

SEQ ID NO: 1240182 - RNA, 22 nt, Human
cuugaauguggcuugagaaaua

SEQ ID NO: 1240183 - RNA, 20 nt, Human
cuugaauguggcuugagaaa

SEQ ID NO: 1240184 - RNA, 17 nt, Human
cuugaauuguaacuguu

SEQ ID NO: 1240185 - RNA, 20 nt, Human
cuugaauuguaacuguucuu

SEQ ID NO: 1240186 - RNA, 23 nt, Human
cuugaucagccccacccuggccu

SEQ ID NO: 1240187 - RNA, 18 nt, Human
cuugaucaguuaagaaau

SEQ ID NO: 1240188 - RNA, 22 nt, Human
cuugaucaguuaagaaauuuca

SEQ ID NO: 1240189 - RNA, 16 nt, Human
cuugauccauuucuaa

SEQ ID NO: 1240190 - RNA, 18 nt, Human
cuugauccauuucuaauu

SEQ ID NO: 1240191 - RNA, 17 nt, Human
cuugauccauuucuaau

SEQ ID NO: 1240192 - RNA, 16 nt, Human
cuugauuauccauauu

SEQ ID NO: 1240193 - RNA, 15 nt, Human
cuugcaaaaaggguc

SEQ ID NO: 1240194 - RNA, 12 nt, Human
cuugauuuuugc

SEQ ID NO: 1240195 - RNA, 16 nt, Human
cuugcaaaaaggguca

SEQ ID NO: 1240196 - RNA, 15 nt, Human
cuugcaaaaucaguu

SEQ ID NO: 1240197 - RNA, 22 nt, Human
cuugcaaaaucaguuuuccucu

SEQ ID NO: 1240198 - RNA, 17 nt, Human
cuugcaaaaucaguuuu

SEQ ID NO: 1240199 - RNA, 16 nt, Human
cuugcaaaaucaguuu

SEQ ID NO: 1240200 - RNA, 19 nt, Human
cuugauuuuagccuucucu

SEQ ID NO: 1240201 - RNA, 20 nt, Human
cuugauuuuagccuucucug

SEQ ID NO: 1240202 - RNA, 21 nt, Human
cuugauuuuagccuucucugu

SEQ ID NO: 1240203 - RNA, 20 nt, Human
cuugcgguuccggcauggac

SEQ ID NO: 1240204 - RNA, 13 nt, Human
cuugcuaccagua

SEQ ID NO: 1240205 - RNA, 17 nt, Human
cuugcuaccaguauuua

SEQ ID NO: 1240206 - RNA, 18 nt, Human
cuugcuaccaguauuuag

SEQ ID NO: 1240207 - RNA, 20 nt, Human
cuugcuaccaguauuuagaa

SEQ ID NO: 1240208 - RNA, 13 nt, Human
cuugcuauucugu

SEQ ID NO: 1240209 - RNA, 14 nt, Human
cuugcuauucuguc

SEQ ID NO: 1240210 - RNA, 15 nt, Human
cuugcuauucugucc

SEQ ID NO: 1240211 - RNA, 17 nt, Human
cuugcuauucugucccu

SEQ ID NO: 1240212 - RNA, 23 nt, Human
cuugcuauucugucccuaggugu

SEQ ID NO: 1240213 - RNA, 20 nt, Human
cuugcuauucugucccuagg

SEQ ID NO: 1240214 - RNA, 16 nt, Human
cuuggauuuaguuuca

SEQ ID NO: 1240215 - RNA, 14 nt, Human
cuuggccucccaag

SEQ ID NO: 1240216 - RNA, 14 nt, Human
cuuggccucucucu

SEQ ID NO: 1240217 - RNA, 16 nt, Human
cuuggccucucucuag

SEQ ID NO: 1240218 - RNA, 17 nt, Human
cuuggccugaucagacc

SEQ ID NO: 1240219 - RNA, 13 nt, Human
cuuggccuggagc

SEQ ID NO: 1240220 - RNA, 14 nt, Human
cuuggccuggagca

SEQ ID NO: 1240221 - RNA, 15 nt, Human
cuuggccuggagcac

SEQ ID NO: 1240222 - RNA, 14 nt, Human
cuuggcgaugccag

SEQ ID NO: 1240223 - RNA, 15 nt, Human
cuuggcgaugccagc

SEQ ID NO: 1240224 - RNA, 17 nt, Human
cuuggcgaugccagcca

SEQ ID NO: 1240225 - RNA, 18 nt, Human
cuuggcgaugccagccaa

SEQ ID NO: 1240226 - RNA, 19 nt, Human
cuucugacauaauccagua

SEQ ID NO: 1240227 - RNA, 14 nt, Human
cuucugacagccuc

SEQ ID NO: 1240228 - RNA, 15 nt, Human
cuucugacagccuca

SEQ ID NO: 1240229 - RNA, 22 nt, Human
cuucugaauaaagcaauuagca

SEQ ID NO: 1240230 - RNA, 18 nt, Human
cuucugaauaaagcaauu

SEQ ID NO: 1240231 - RNA, 16 nt, Human
cuucugaauaaagcaa

SEQ ID NO: 1240232 - RNA, 15 nt, Human
cuucugaauaaagca

SEQ ID NO: 1240233 - RNA, 16 nt, Human
cuucucuuguuaggua

SEQ ID NO: 1240234 - RNA, 22 nt, Human
cuucucuuccuuuuaucaguag

SEQ ID NO: 1240235 - RNA, 19 nt, Human
cuucugacagccucaguga

SEQ ID NO: 1240236 - RNA, 16 nt, Human
cuucuuaauguacaua

SEQ ID NO: 1240237 - RNA, 15 nt, Human
cuucuuaauguacau

SEQ ID NO: 1240238 - RNA, 18 nt, Human
cuucuuaauguacauagu

SEQ ID NO: 1240239 - RNA, 21 nt, Human
cuucuuacaauaauucuauga

SEQ ID NO: 1240240 - RNA, 20 nt, Human
cuucuuaauguacauagugc

SEQ ID NO: 1240241 - RNA, 13 nt, Human
cuucuucaccauu

SEQ ID NO: 1240242 - RNA, 20 nt, Human
cuucucacauuuauauuuuu

SEQ ID NO: 1240243 - RNA, 13 nt, Human
cuucucacauuua

SEQ ID NO: 1240244 - RNA, 19 nt, Human
cuucuaguucugccaggag

SEQ ID NO: 1240245 - RNA, 13 nt, Human
cuucucuguucau

SEQ ID NO: 1240246 - RNA, 14 nt, Human
cuucucuguucauu

SEQ ID NO: 1240247 - RNA, 17 nt, Human
cuucucuguucauuucc

SEQ ID NO: 1240248 - RNA, 16 nt, Human
cuucuaguucugccag

SEQ ID NO: 1240249 - RNA, 16 nt, Human
cuucuagguucuaaaa

SEQ ID NO: 1240250 - RNA, 17 nt, Human
cuucuaguucugccagg

SEQ ID NO: 1240251 - RNA, 18 nt, Human
cuucuaguucugccagga

SEQ ID NO: 1240252 - RNA, 23 nt, Human
cuucuaaauggcaaaggaaggug

SEQ ID NO: 1240253 - RNA, 15 nt, Human
cuuccugacacuuua

SEQ ID NO: 1240254 - RNA, 16 nt, Human
cuuccugacacuuuaa

SEQ ID NO: 1240255 - RNA, 17 nt, Human
cuuccugacacuuuaau

SEQ ID NO: 1240256 - RNA, 18 nt, Human
cuuccugacacuuuaauu

SEQ ID NO: 1240257 - RNA, 13 nt, Human
cuucuaagacuuu

SEQ ID NO: 1240258 - RNA, 22 nt, Human
cuuccucugaggcugaaauuca

SEQ ID NO: 1240259 - RNA, 19 nt, Human
cuuccucuuuuccuuccca

SEQ ID NO: 1240260 - RNA, 16 nt, Human
cuuccucugaggcuga

SEQ ID NO: 1240261 - RNA, 13 nt, Human
cuuccucuccacu

SEQ ID NO: 1240262 - RNA, 14 nt, Human
cuuccucuccacug

SEQ ID NO: 1240263 - RNA, 15 nt, Human
cuuccucuccacugc

SEQ ID NO: 1240264 - RNA, 14 nt, Human
cuuccucugagccu

SEQ ID NO: 1240265 - RNA, 15 nt, Human
cuuccucugagccuu

SEQ ID NO: 1240266 - RNA, 20 nt, Human
cuuccucucgcggcccucag

SEQ ID NO: 1240267 - RNA, 21 nt, Human
cuuccucucgcggcccucagu

SEQ ID NO: 1240268 - RNA, 17 nt, Human
gaagcacagugaucaag

SEQ ID NO: 1240269 - RNA, 21 nt, Human
gaagaccuuuuucugcacuau

SEQ ID NO: 1240270 - RNA, 21 nt, Human
gaagacgugaugccaggacca

SEQ ID NO: 1240271 - RNA, 23 nt, Human
gaagacuaucuuacuauuucaca

SEQ ID NO: 1240272 - RNA, 19 nt, Human
gaagcacgugguaaaacac

SEQ ID NO: 1240273 - RNA, 18 nt, Human
gaagcagcaacuuguccu

SEQ ID NO: 1240274 - RNA, 19 nt, Human
gaagcagcaacuuguccua

SEQ ID NO: 1240275 - RNA, 12 nt, Human
gaagcagccucu

SEQ ID NO: 1240276 - RNA, 22 nt, Human
gaagcagccucuccccaggucc

SEQ ID NO: 1240277 - RNA, 13 nt, Human
gaagcagcagccu

SEQ ID NO: 1240278 - RNA, 12 nt, Human
gaagcagguucc

SEQ ID NO: 1240279 - RNA, 19 nt, Human
gaagcagguucccaagcuc

SEQ ID NO: 1240280 - RNA, 10 nt, Human
gaagacagug

SEQ ID NO: 1240281 - RNA, 12 nt, Human
gaagacaguggc

SEQ ID NO: 1240282 - RNA, 15 nt, Human
gaagacaguggcccc

SEQ ID NO: 1240283 - RNA, 13 nt, Human
gaagacaguggcc

SEQ ID NO: 1240284 - RNA, 17 nt, Human
gaagaccuuuuucugca

SEQ ID NO: 1240285 - RNA, 14 nt, Human
gaagaccuuuuucu

SEQ ID NO: 1240286 - RNA, 14 nt, Human
gaagaccugagaau

SEQ ID NO: 1240287 - RNA, 17 nt, Human
gaagaccugagaaugua

SEQ ID NO: 1240288 - RNA, 20 nt, Human
gaagacccauuccuucccag

SEQ ID NO: 1240289 - RNA, 22 nt, Human
gaagacccauuccuucccagag

SEQ ID NO: 1240290 - RNA, 14 nt, Human
gaagacccuccccg

SEQ ID NO: 1240291 - RNA, 16 nt, Human
gaagacagaaccacag

SEQ ID NO: 1240292 - RNA, 18 nt, Human
gaagacagaaccacaggg

SEQ ID NO: 1240293 - RNA, 17 nt, Human
gaagacagaaguuugca

SEQ ID NO: 1240294 - RNA, 12 nt, Human
gaaccaucagaa

SEQ ID NO: 1240295 - RNA, 19 nt, Human
gaaccaguccccccacccu

SEQ ID NO: 1240296 - RNA, 13 nt, Human
gaaccacuuucuu

SEQ ID NO: 1240297 - RNA, 15 nt, Human
gaaccacuuucuuau

SEQ ID NO: 1240298 - RNA, 20 nt, Human
gaaccacuuucuuauuuuuu

SEQ ID NO: 1240299 - RNA, 11 nt, Human
gaaccagacuc

SEQ ID NO: 1240300 - RNA, 16 nt, Human
gaaccagacucuugcc

SEQ ID NO: 1240301 - RNA, 17 nt, Human
gaaccagacucuugccu

SEQ ID NO: 1240302 - RNA, 21 nt, Human
gaaccccuacaugaaacagaa

SEQ ID NO: 1240303 - RNA, 17 nt, Human
gaaccccuucauccucu

SEQ ID NO: 1240304 - RNA, 20 nt, Human
gaaccccggggugcccacag

SEQ ID NO: 1240305 - RNA, 18 nt, Human
gaacccagcccacccccg

SEQ ID NO: 1240306 - RNA, 11 nt, Human
gaacccaggac

SEQ ID NO: 1240307 - RNA, 12 nt, Human
gaacccaggaca

SEQ ID NO: 1240308 - RNA, 13 nt, Human
gaacccaggacaa

SEQ ID NO: 1240309 - RNA, 19 nt, Human
gaacccaggacaagcaugg

SEQ ID NO: 1240310 - RNA, 16 nt, Human
gaacccaggacaagca

SEQ ID NO: 1240311 - RNA, 16 nt, Human
gaaccauuaaccagau

SEQ ID NO: 1240312 - RNA, 13 nt, Human
gaacccagacuca

SEQ ID NO: 1240313 - RNA, 16 nt, Human
gaacccagacucagac

SEQ ID NO: 1240314 - RNA, 17 nt, Human
gaacccagacucagaca

SEQ ID NO: 1240315 - RNA, 19 nt, Human
gaacccagacucagacauu

SEQ ID NO: 1240316 - RNA, 16 nt, Human
gaacccagcccacccc

SEQ ID NO: 1240317 - RNA, 17 nt, Human
gaacccagcccaccccc

SEQ ID NO: 1240318 - RNA, 13 nt, Human
gaacugaaaucau

SEQ ID NO: 1240319 - RNA, 17 nt, Human
gaacugauguaaguaaa

SEQ ID NO: 1240320 - RNA, 23 nt, Human
gaacugauucacaucucauuuuu

SEQ ID NO: 1240321 - RNA, 21 nt, Human
gaacugauucacaucucauuu

SEQ ID NO: 1240322 - RNA, 12 nt, Human
gaacugcaggcc

SEQ ID NO: 1240323 - RNA, 14 nt, Human
gaacugcaggcccu

SEQ ID NO: 1240324 - RNA, 16 nt, Human
gaacugcaggcccugg

SEQ ID NO: 1240325 - RNA, 17 nt, Human
gaacugcaggcccuggc

SEQ ID NO: 1240326 - RNA, 18 nt, Human
gaacugcaggcccuggcc

SEQ ID NO: 1240327 - RNA, 19 nt, Human
gaacugcaggcccuggccu

SEQ ID NO: 1240328 - RNA, 21 nt, Human
gaacugcaggcccuggccucc

SEQ ID NO: 1240329 - RNA, 23 nt, Human
gaacugcaggcccuggccucccc

SEQ ID NO: 1240330 - RNA, 14 nt, Human
gaacuccugaccuc

SEQ ID NO: 1240331 - RNA, 14 nt, Human
gaaccccuuuccca

SEQ ID NO: 1240332 - RNA, 15 nt, Human
gaacuccugaccuca

SEQ ID NO: 1240333 - RNA, 19 nt, Human
gaacccgggaggcagaggu

SEQ ID NO: 1240334 - RNA, 17 nt, Human
gaacccgggaggcagag

SEQ ID NO: 1240335 - RNA, 17 nt, Human
gaacuccugccauaguc

SEQ ID NO: 1240336 - RNA, 14 nt, Human
gaacucugguggca

SEQ ID NO: 1240337 - RNA, 18 nt, Human
gaacucugguggcacagg

SEQ ID NO: 1240338 - RNA, 19 nt, Human
gaacucugguggcacagga

SEQ ID NO: 1240339 - RNA, 13 nt, Human
gaacucuuaauca

SEQ ID NO: 1240340 - RNA, 20 nt, Human
gaacucuuaaucaaauagca

SEQ ID NO: 1240341 - RNA, 16 nt, Human
gaaagaacggaagaag

SEQ ID NO: 1240342 - RNA, 20 nt, Human
gaaagaacgcugauuuaaag

SEQ ID NO: 1240343 - RNA, 13 nt, Human
gaaagggagggcu

SEQ ID NO: 1240344 - RNA, 14 nt, Human
gaaagggagggcuc

SEQ ID NO: 1240345 - RNA, 15 nt, Human
gaaagggagggcucu

SEQ ID NO: 1240346 - RNA, 16 nt, Human
gaaagggagggcucug

SEQ ID NO: 1240347 - RNA, 17 nt, Human
gaaagggagggcucuga

SEQ ID NO: 1240348 - RNA, 18 nt, Human
gaaagggagggcucugag

SEQ ID NO: 1240349 - RNA, 18 nt, Human
gaaagaaaaucaggcugg

SEQ ID NO: 1240350 - RNA, 14 nt, Human
gaaacuggccaugg

SEQ ID NO: 1240351 - RNA, 18 nt, Human
gaaacuggccauggccug

SEQ ID NO: 1240352 - RNA, 19 nt, Human
gaaacuggccauggccugc

SEQ ID NO: 1240353 - RNA, 20 nt, Human
gaaacuggccauggccugca

SEQ ID NO: 1240354 - RNA, 21 nt, Human
gaaacuggccauggccugcaa

SEQ ID NO: 1240355 - RNA, 11 nt, Human
gaaaugaaaaa

SEQ ID NO: 1240356 - RNA, 20 nt, Human
gaaaucugugccugagaaca

SEQ ID NO: 1240357 - RNA, 20 nt, Human
gaaaucuggcuucuggccag

SEQ ID NO: 1240358 - RNA, 22 nt, Human
gaaaucuggcuucuggccagga

SEQ ID NO: 1240359 - RNA, 23 nt, Human
gaaaucuggcuucuggccaggaa

SEQ ID NO: 1240360 - RNA, 17 nt, Human
gaaaugaaagcagggac

SEQ ID NO: 1240361 - RNA, 14 nt, Human
gaacaaagcagcca

SEQ ID NO: 1240362 - RNA, 15 nt, Human
gaacaaagcagccac

SEQ ID NO: 1240363 - RNA, 16 nt, Human
gaacaaagcagccacg

SEQ ID NO: 1240364 - RNA, 19 nt, Human
gaacaaagcagccacgagg

SEQ ID NO: 1240365 - RNA, 19 nt, Human
gaaagggagggcucugagg

SEQ ID NO: 1240366 - RNA, 20 nt, Human
gaaagggagggcucugaggc

SEQ ID NO: 1240367 - RNA, 21 nt, Human
gaaagggagggcucugaggcg

SEQ ID NO: 1240368 - RNA, 20 nt, Human
gaaagggcccuccuuccuaa

SEQ ID NO: 1240369 - RNA, 21 nt, Human
gaaagggcccugggccugccu

SEQ ID NO: 1240370 - RNA, 13 nt, Human
gaaaggggagccc

SEQ ID NO: 1240371 - RNA, 15 nt, Human
gaaaggggagcccac

SEQ ID NO: 1240372 - RNA, 16 nt, Human
gaaaggggagcccacu

SEQ ID NO: 1240373 - RNA, 21 nt, Human
gaaaucuaguuauuuacagga

SEQ ID NO: 1240374 - RNA, 13 nt, Human
gaaaucccuucau

SEQ ID NO: 1240375 - RNA, 14 nt, Human
gaaaucccuucaua

SEQ ID NO: 1240376 - RNA, 15 nt, Human
gaaaucccuucauac

SEQ ID NO: 1240377 - RNA, 19 nt, Human
gaaaucccuucauacuuga

SEQ ID NO: 1240378 - RNA, 20 nt, Human
gaaaucccuucauacuugaa

SEQ ID NO: 1240379 - RNA, 19 nt, Human
gaacacuagacaagccaga

SEQ ID NO: 1240380 - RNA, 19 nt, Human
gaacaccauugaaggcuua

SEQ ID NO: 1240381 - RNA, 20 nt, Human
gaacaccauugaaggcuuaa

SEQ ID NO: 1240382 - RNA, 16 nt, Human
gaacacccuauauuuu

SEQ ID NO: 1240383 - RNA, 18 nt, Human
gaacaccuaugcaaagau

SEQ ID NO: 1240384 - RNA, 21 nt, Human
gaacaccuaugcaaagaugaa

SEQ ID NO: 1240385 - RNA, 14 nt, Human
gaacacggccacau

SEQ ID NO: 1240386 - RNA, 22 nt, Human
gaacacggccacaucaaagagg

SEQ ID NO: 1240387 - RNA, 15 nt, Human
gaacacuaauucaua

SEQ ID NO: 1240388 - RNA, 18 nt, Human
gaacacuaauucauaauc

SEQ ID NO: 1240389 - RNA, 15 nt, Human
gaacacuagacaagc

SEQ ID NO: 1240390 - RNA, 17 nt, Human
gaacacuagacaagcca

SEQ ID NO: 1240391 - RNA, 18 nt, Human
gaacacuagacaagccag

SEQ ID NO: 1240392 - RNA, 20 nt, Human
gaacacuagacaagccagaa

SEQ ID NO: 1240393 - RNA, 15 nt, Human
gaacaaauggccuuu

SEQ ID NO: 1240394 - RNA, 23 nt, Human
gaacaaauguuuauuaagcauca

SEQ ID NO: 1240395 - RNA, 13 nt, Human
gaacaaaugaaga

SEQ ID NO: 1240396 - RNA, 21 nt, Human
gaacaaugugcuaugugaaga

SEQ ID NO: 1240397 - RNA, 13 nt, Human
gaacaauugaagu

SEQ ID NO: 1240398 - RNA, 17 nt, Human
gaacaauugaaguaaac

SEQ ID NO: 1240399 - RNA, 20 nt, Human
gaacaauugaaguaaacuuu

SEQ ID NO: 1240400 - RNA, 15 nt, Human
gaacaauuuggcaau

SEQ ID NO: 1240401 - RNA, 19 nt, Human
gaacaauuuggcaauuuug

SEQ ID NO: 1240402 - RNA, 20 nt, Human
gaacaauuuggcaauuuugu

SEQ ID NO: 1240403 - RNA, 17 nt, Human
gaacacaaacuguaaau

SEQ ID NO: 1240404 - RNA, 17 nt, Human
gaacacauaauucagga

SEQ ID NO: 1240405 - RNA, 20 nt, Human
gaacacauaauucaggaagc

SEQ ID NO: 1240406 - RNA, 21 nt, Human
gaacaccagagaccucaaauu

SEQ ID NO: 1240407 - RNA, 20 nt, Human
gaacaccauagguagaaugu

SEQ ID NO: 1240408 - RNA, 16 nt, Human
gaacaccauugaaggc

SEQ ID NO: 1240409 - RNA, 19 nt, Human
gaacacaaacuguaaauaa

SEQ ID NO: 1240410 - RNA, 17 nt, Human
gaacacaggcaaaaucc

SEQ ID NO: 1240411 - RNA, 13 nt, Human
gaacacagaacug

SEQ ID NO: 1240412 - RNA, 20 nt, Human
gaacacagcaguucugcaga

SEQ ID NO: 1240413 - RNA, 21 nt, Human
gaaacaagucagucauucaga

SEQ ID NO: 1240414 - RNA, 14 nt, Human
gaaacaacuuggaa

SEQ ID NO: 1240415 - RNA, 14 nt, Human
gaaacaacacugua

SEQ ID NO: 1240416 - RNA, 15 nt, Human
gaaacaacacuguag

SEQ ID NO: 1240417 - RNA, 16 nt, Human
gaaacaacacuguagu

SEQ ID NO: 1240418 - RNA, 16 nt, Human
gaaacaaccaugucau

SEQ ID NO: 1240419 - RNA, 17 nt, Human
gaaacaacucuuugaga

SEQ ID NO: 1240420 - RNA, 20 nt, Human
gaaacaacucuuugagaaac

SEQ ID NO: 1240421 - RNA, 16 nt, Human
gaaaauuauuugcaua

SEQ ID NO: 1240422 - RNA, 20 nt, Human
gaaacaaagacaauuuauaa

SEQ ID NO: 1240423 - RNA, 23 nt, Human
gaaacaaagaguucaagaaauaa

SEQ ID NO: 1240424 - RNA, 12 nt, Human
gaaacaaagaug

SEQ ID NO: 1240425 - RNA, 17 nt, Human
gaaacaacacuguagua

SEQ ID NO: 1240426 - RNA, 22 nt, Human
gaaaacuuguauuauguguguu

SEQ ID NO: 1240427 - RNA, 19 nt, Human
gaaaacuuguauuaugugu

SEQ ID NO: 1240428 - RNA, 15 nt, Human
gaaaagaaagcuaca

SEQ ID NO: 1240429 - RNA, 21 nt, Human
gaaaagaaaauuuuuguagua

SEQ ID NO: 1240430 - RNA, 16 nt, Human
gaaaacuuuaaagcgu

SEQ ID NO: 1240431 - RNA, 21 nt, Human
gaaaacuuuaugcuaagugaa

SEQ ID NO: 1240432 - RNA, 12 nt, Human
gaaaacuuuaaa

SEQ ID NO: 1240433 - RNA, 13 nt, Human
gaaaaaaauguau

SEQ ID NO: 1240434 - RNA, 14 nt, Human
gaaaaaaauguauu

SEQ ID NO: 1240435 - RNA, 15 nt, Human
gaaaaaaauguauuu

SEQ ID NO: 1240436 - RNA, 20 nt, Human
gaaaaaaauguauuuuaugu

SEQ ID NO: 1240437 - RNA, 19 nt, Human
gaaaaaaauguauuuuaug

SEQ ID NO: 1240438 - RNA, 12 nt, Human
gaaaaaaauuga

SEQ ID NO: 1240439 - RNA, 14 nt, Human
gaaaaaaauugaaa

SEQ ID NO: 1240440 - RNA, 15 nt, Human
gaaaaaaauugaaau

SEQ ID NO: 1240441 - RNA, 16 nt, Human
gaaaaaaauugaaaug

SEQ ID NO: 1240442 - RNA, 19 nt, Human
gaaaaaaauugaaauguaa

SEQ ID NO: 1240443 - RNA, 18 nt, Human
gaaaaaaauugaaaugua

SEQ ID NO: 1240444 - RNA, 14 nt, Human
gaaaagaauagaag

SEQ ID NO: 1240445 - RNA, 22 nt, Human
gaaaagaauuguuggggguuuu

SEQ ID NO: 1240446 - RNA, 21 nt, Human
gaaaagacacauuuuuuagga

SEQ ID NO: 1240447 - RNA, 11 nt, Human
gaaaagaugca

SEQ ID NO: 1240448 - RNA, 22 nt, Human
gaaaagaugcacuuugcuuuaa

SEQ ID NO: 1240449 - RNA, 12 nt, Human
gaaaaugugugu

SEQ ID NO: 1240450 - RNA, 15 nt, Human
gaaaaugugugugug

SEQ ID NO: 1240451 - RNA, 20 nt, Human
gaaaagcaacauucauaguc

SEQ ID NO: 1240452 - RNA, 14 nt, Human
gaaaauguccagga

SEQ ID NO: 1240453 - RNA, 14 nt, Human
gaaaaugucuugug

SEQ ID NO: 1240454 - RNA, 16 nt, Human
gaaaagcaacauucau

SEQ ID NO: 1240455 - RNA, 17 nt, Human
gaaaauguccuugugau

SEQ ID NO: 1240456 - RNA, 15 nt, Human
gaaaauguccaggaa

SEQ ID NO: 1240457 - RNA, 21 nt, Human
gaaaauguucuguuugcugug

SEQ ID NO: 1240458 - RNA, 15 nt, Human
gaaaauguugagaau

SEQ ID NO: 1240459 - RNA, 17 nt, Human
gaaaauguugagaaucc

SEQ ID NO: 1240460 - RNA, 20 nt, Human
gaaaauguugagaaucccaa

SEQ ID NO: 1240461 - RNA, 15 nt, Human
gaaaauguucuguuu

SEQ ID NO: 1240462 - RNA, 13 nt, Human
gaaaauuauuuaa

SEQ ID NO: 1240463 - RNA, 23 nt, Human
gaaaauuauuuaaaccgcuaaaa

SEQ ID NO: 1240464 - RNA, 15 nt, Human
gaaaauuauuugcau

SEQ ID NO: 1240465 - RNA, 22 nt, Human
gacuauuaggugcaauuucaag

SEQ ID NO: 1240466 - RNA, 15 nt, Human
gacucaaauguucua

SEQ ID NO: 1240467 - RNA, 16 nt, Human
gacucaaauguucuaa

SEQ ID NO: 1240468 - RNA, 17 nt, Human
gacucaaauguucuaag

SEQ ID NO: 1240469 - RNA, 18 nt, Human
gacucaaauguucuaagu

SEQ ID NO: 1240470 - RNA, 19 nt, Human
gacucaaauguucuaaguu

SEQ ID NO: 1240471 - RNA, 23 nt, Human
gacucaaauguucuaaguuucua

SEQ ID NO: 1240472 - RNA, 18 nt, Human
gacucaagaagugaagaa

SEQ ID NO: 1240473 - RNA, 20 nt, Human
gacucaagaagugaagaaug

SEQ ID NO: 1240474 - RNA, 19 nt, Human
gacucaagaagugaagaau

SEQ ID NO: 1240475 - RNA, 19 nt, Human
gacuauauuugggccugcu

SEQ ID NO: 1240476 - RNA, 21 nt, Human
gacuauauuugggccugcucc

SEQ ID NO: 1240477 - RNA, 22 nt, Human
gacccuccaccgcagaaggaag

SEQ ID NO: 1240478 - RNA, 21 nt, Human
gacccuccaccgcagaaggaa

SEQ ID NO: 1240479 - RNA, 15 nt, Human
gacccuccccgcacc

SEQ ID NO: 1240480 - RNA, 17 nt, Human
gacccuccccgcacccc

SEQ ID NO: 1240481 - RNA, 18 nt, Human
gacccuccccaaaggcuu

SEQ ID NO: 1240482 - RNA, 19 nt, Human
gacccuccaccgcagaagg

SEQ ID NO: 1240483 - RNA, 20 nt, Human
gacccuaugggucuaggaca

SEQ ID NO: 1240484 - RNA, 20 nt, Human
gacccucaucuuucuuccaa

SEQ ID NO: 1240485 - RNA, 15 nt, Human
gacccucaucuuucu

SEQ ID NO: 1240486 - RNA, 19 nt, Human
gacccucaucuuucuucca

SEQ ID NO: 1240487 - RNA, 16 nt, Human
gacuuuggcugcaugc

SEQ ID NO: 1240488 - RNA, 15 nt, Human
gacuuugcuugcuuu

SEQ ID NO: 1240489 - RNA, 17 nt, Human
gacuuugcuugcuuuga

SEQ ID NO: 1240490 - RNA, 12 nt, Human
gacuuugcuugc

SEQ ID NO: 1240491 - RNA, 14 nt, Human
gacuuugcuugcuu

SEQ ID NO: 1240492 - RNA, 19 nt, Human
gacuuuggcugcaugcgag

SEQ ID NO: 1240493 - RNA, 13 nt, Human
gacuuuucugcaa

SEQ ID NO: 1240494 - RNA, 14 nt, Human
gacuuuucugcaaa

SEQ ID NO: 1240495 - RNA, 12 nt, Human
gacuuuucugua

SEQ ID NO: 1240496 - RNA, 13 nt, Human
gacuuuucuguaa

SEQ ID NO: 1240497 - RNA, 18 nt, Human
gacuuuucuguaauucag

SEQ ID NO: 1240498 - RNA, 19 nt, Human
gacuguuuucucucggcuc

SEQ ID NO: 1240499 - RNA, 21 nt, Human
gacuguuuucucucggcuccc

SEQ ID NO: 1240500 - RNA, 18 nt, Human
gacuguuuuucggacagu

SEQ ID NO: 1240501 - RNA, 19 nt, Human
gacuguuuuucggacaguu

SEQ ID NO: 1240502 - RNA, 16 nt, Human
gacuuucugccuggag

SEQ ID NO: 1240503 - RNA, 18 nt, Human
gacuuucugccuggagug

SEQ ID NO: 1240504 - RNA, 19 nt, Human
gacuuucuuuuuguagcug

SEQ ID NO: 1240505 - RNA, 23 nt, Human
gacuuucuuuuuguagcuggggc

SEQ ID NO: 1240506 - RNA, 18 nt, Human
gacuuucuuuuuugauau

SEQ ID NO: 1240507 - RNA, 21 nt, Human
gacuuucuuuuuugauauaga

SEQ ID NO: 1240508 - RNA, 23 nt, Human
gacuuucuuuuuugauauagaag

SEQ ID NO: 1240509 - RNA, 22 nt, Human
gacuuucuuuuuugauauagaa

SEQ ID NO: 1240510 - RNA, 21 nt, Human
gacuuugcagccggcacaggg

SEQ ID NO: 1240511 - RNA, 20 nt, Human
gacugugugcucaggagccc

SEQ ID NO: 1240512 - RNA, 17 nt, Human
gacugugugcucaggag

SEQ ID NO: 1240513 - RNA, 16 nt, Human
gacugugugcucagga

SEQ ID NO: 1240514 - RNA, 14 nt, Human
gacugugugcucag

SEQ ID NO: 1240515 - RNA, 18 nt, Human
gacuguacuccucccagg

SEQ ID NO: 1240516 - RNA, 20 nt, Human
gacuguaaguugggcuugcu

SEQ ID NO: 1240517 - RNA, 21 nt, Human
gacuguaaguugggcuugcua

SEQ ID NO: 1240518 - RNA, 21 nt, Human
gacugucucaagagggcacug

SEQ ID NO: 1240519 - RNA, 15 nt, Human
gacugucauagaaau

SEQ ID NO: 1240520 - RNA, 22 nt, Human
gacugucucaagagggcacugg

SEQ ID NO: 1240521 - RNA, 23 nt, Human
gacugucucaagagggcacuggu

SEQ ID NO: 1240522 - RNA, 18 nt, Human
gacugucuccauggcccu

SEQ ID NO: 1240523 - RNA, 16 nt, Human
gacuguacuccuccca

SEQ ID NO: 1240524 - RNA, 17 nt, Human
gacuguacuccucccag

SEQ ID NO: 1240525 - RNA, 14 nt, Human
gacucacaccugaa

SEQ ID NO: 1240526 - RNA, 22 nt, Human
gacugguguuaucaccgugggc

SEQ ID NO: 1240527 - RNA, 23 nt, Human
gacucacaccugaacugaacacc

SEQ ID NO: 1240528 - RNA, 19 nt, Human
gacucacaccacuagccuc

SEQ ID NO: 1240529 - RNA, 17 nt, Human
gacuguaaacacagaca

SEQ ID NO: 1240530 - RNA, 18 nt, Human
gacuguaaacacagacag

SEQ ID NO: 1240531 - RNA, 13 nt, Human
gacuguaaguugg

SEQ ID NO: 1240532 - RNA, 17 nt, Human
gacuguaaguugggcuu

SEQ ID NO: 1240533 - RNA, 14 nt, Human
gacucaagccccgg

SEQ ID NO: 1240534 - RNA, 15 nt, Human
gacucaagccccgga

SEQ ID NO: 1240535 - RNA, 14 nt, Human
gaagcaguggccuu

SEQ ID NO: 1240536 - RNA, 13 nt, Human
gacacucagaccu

SEQ ID NO: 1240537 - RNA, 15 nt, Human
gacacucagaccuga

SEQ ID NO: 1240538 - RNA, 16 nt, Human
gacacucauauaauua

SEQ ID NO: 1240539 - RNA, 21 nt, Human
gacagcccuucuuuccacaga

SEQ ID NO: 1240540 - RNA, 15 nt, Human
gacagccgccuggag

SEQ ID NO: 1240541 - RNA, 19 nt, Human
gacagccucagugacccug

SEQ ID NO: 1240542 - RNA, 18 nt, Human
gacagccucccccugucc

SEQ ID NO: 1240543 - RNA, 21 nt, Human
gacagaaagcagaacagugau

SEQ ID NO: 1240544 - RNA, 16 nt, Human
gacagaaaacauguuu

SEQ ID NO: 1240545 - RNA, 20 nt, Human
gacagaaagcagaacaguga

SEQ ID NO: 1240546 - RNA, 14 nt, Human
gacagaaagcagaa

SEQ ID NO: 1240547 - RNA, 21 nt, Human
gacacucgaggucgggcagca

SEQ ID NO: 1240548 - RNA, 16 nt, Human
gacacuccccgaaguc

SEQ ID NO: 1240549 - RNA, 21 nt, Human
gacacuccccgaagucuuuug

SEQ ID NO: 1240550 - RNA, 15 nt, Human
gacacucccuugggc

SEQ ID NO: 1240551 - RNA, 21 nt, Human
gacacucccuugggcucccug

SEQ ID NO: 1240552 - RNA, 11 nt, Human
gacagccuggc

SEQ ID NO: 1240553 - RNA, 12 nt, Human
gacagccuggca

SEQ ID NO: 1240554 - RNA, 13 nt, Human
gacagccuggcac

SEQ ID NO: 1240555 - RNA, 20 nt, Human
gacagccucccccugucccc

SEQ ID NO: 1240556 - RNA, 19 nt, Human
gacagggcggggguggcgg

SEQ ID NO: 1240557 - RNA, 19 nt, Human
gacaguaauuguguuuaca

SEQ ID NO: 1240558 - RNA, 18 nt, Human
gacaguaauuguguuuac

SEQ ID NO: 1240559 - RNA, 15 nt, Human
gacaguaauuguguu

SEQ ID NO: 1240560 - RNA, 20 nt, Human
gacaguaauuguguuuacau

SEQ ID NO: 1240561 - RNA, 22 nt, Human
gacaguaauuguguuuacauuu

SEQ ID NO: 1240562 - RNA, 14 nt, Human
gacaguauauaacu

SEQ ID NO: 1240563 - RNA, 17 nt, Human
gacaggguuucaccaug

SEQ ID NO: 1240564 - RNA, 12 nt, Human
gacaggguuuca

SEQ ID NO: 1240565 - RNA, 20 nt, Human
gacaguauggcagcuuuccu

SEQ ID NO: 1240566 - RNA, 21 nt, Human
gaccauggacacuacacccag

SEQ ID NO: 1240567 - RNA, 16 nt, Human
gaccauggacacuaca

SEQ ID NO: 1240568 - RNA, 15 nt, Human
gaccauaauguuaca

SEQ ID NO: 1240569 - RNA, 22 nt, Human
gaccaugcucaucugcuggucc

SEQ ID NO: 1240570 - RNA, 23 nt, Human
gaccauggacacuacacccagca

SEQ ID NO: 1240571 - RNA, 18 nt, Human
gaccauggaguggcagcc

SEQ ID NO: 1240572 - RNA, 20 nt, Human
gaccauggaguggcagccca

SEQ ID NO: 1240573 - RNA, 21 nt, Human
gaccauggaguggcagcccag

SEQ ID NO: 1240574 - RNA, 22 nt, Human
gaccauggaguggcagcccagc

SEQ ID NO: 1240575 - RNA, 22 nt, Human
gaccaugguuaagaguccaaga

SEQ ID NO: 1240576 - RNA, 23 nt, Human
gaccccugcucaguaaagcacuu

SEQ ID NO: 1240577 - RNA, 13 nt, Human
gaccccuggcuuu

SEQ ID NO: 1240578 - RNA, 21 nt, Human
gaccccuggcuuuucacugcu

SEQ ID NO: 1240579 - RNA, 22 nt, Human
gaccccuggcuuuucacugcug

SEQ ID NO: 1240580 - RNA, 16 nt, Human
gaccccuguucaugcc

SEQ ID NO: 1240581 - RNA, 18 nt, Human
gacccuaugggucuagga

SEQ ID NO: 1240582 - RNA, 21 nt, Human
gacccggcacccccugcagcu

SEQ ID NO: 1240583 - RNA, 22 nt, Human
gacccguucaacuuuuccuuug

SEQ ID NO: 1240584 - RNA, 23 nt, Human
gacccguucaugggggagggggc

SEQ ID NO: 1240585 - RNA, 16 nt, Human
gacccuaaaucuugac

SEQ ID NO: 1240586 - RNA, 19 nt, Human
gacccguucaugggggagg

SEQ ID NO: 1240587 - RNA, 16 nt, Human
gaccagucccagagca

SEQ ID NO: 1240588 - RNA, 14 nt, Human
gaccaguugcaguc

SEQ ID NO: 1240589 - RNA, 22 nt, Human
gaccaguugcagucacucuagu

SEQ ID NO: 1240590 - RNA, 19 nt, Human
gaccaguugcagucacucu

SEQ ID NO: 1240591 - RNA, 10 nt, Human
gaccaggagu

SEQ ID NO: 1240592 - RNA, 11 nt, Human
gaccaggagug

SEQ ID NO: 1240593 - RNA, 18 nt, Human
gaccaggagugggugggg

SEQ ID NO: 1240594 - RNA, 23 nt, Human
gaccaggcauccuccacaauagc

SEQ ID NO: 1240595 - RNA, 16 nt, Human
gaccaggcaccaggca

SEQ ID NO: 1240596 - RNA, 15 nt, Human
gaccaggcugccucc

SEQ ID NO: 1240597 - RNA, 13 nt, Human
gaccaggcuguag

SEQ ID NO: 1240598 - RNA, 15 nt, Human
gaccaggcuguagga

SEQ ID NO: 1240599 - RNA, 17 nt, Human
gaccagucaaccugggc

SEQ ID NO: 1240600 - RNA, 18 nt, Human
gaccagucaaccugggca

SEQ ID NO: 1240601 - RNA, 17 nt, Human
gaccagucccagagcag

SEQ ID NO: 1240602 - RNA, 21 nt, Human
gagcagugggaggguaccagc

SEQ ID NO: 1240603 - RNA, 18 nt, Human
gagcaguccuuggccugc

SEQ ID NO: 1240604 - RNA, 22 nt, Human
gagcaguccuuggccugcuaag

SEQ ID NO: 1240605 - RNA, 21 nt, Human
gagcagugaaugauucagugu

SEQ ID NO: 1240606 - RNA, 23 nt, Human
gagcaguccuuggccugcuaagg

SEQ ID NO: 1240607 - RNA, 13 nt, Human
gagcagugcuuuu

SEQ ID NO: 1240608 - RNA, 15 nt, Human
gagcagugcuuuugg

SEQ ID NO: 1240609 - RNA, 21 nt, Human
gagcagugcuuuuggcgggga

SEQ ID NO: 1240610 - RNA, 23 nt, Human
gagcagugcuuuuggcggggagg

SEQ ID NO: 1240611 - RNA, 14 nt, Human
gagcaguggcuggu

SEQ ID NO: 1240612 - RNA, 23 nt, Human
gagcaguggcugguccagggcua

SEQ ID NO: 1240613 - RNA, 22 nt, Human
gagaagcugcucaacuugcaaa

SEQ ID NO: 1240614 - RNA, 13 nt, Human
gagaagcugcuca

SEQ ID NO: 1240615 - RNA, 17 nt, Human
gagaagcucagcugcau

SEQ ID NO: 1240616 - RNA, 19 nt, Human
gagaagcuccucuccccag

SEQ ID NO: 1240617 - RNA, 22 nt, Human
gagaagcuccucuccccagccc

SEQ ID NO: 1240618 - RNA, 13 nt, Human
gagaagcucugaa

SEQ ID NO: 1240619 - RNA, 15 nt, Human
gagcgacagugagac

SEQ ID NO: 1240620 - RNA, 14 nt, Human
gagccuuccaccca

SEQ ID NO: 1240621 - RNA, 15 nt, Human
gagccuuccacccag

SEQ ID NO: 1240622 - RNA, 17 nt, Human
gagcgagagaucaaaga

SEQ ID NO: 1240623 - RNA, 19 nt, Human
gagcgagagaucaaagaug

SEQ ID NO: 1240624 - RNA, 20 nt, Human
gagcgagagaucaaagauga

SEQ ID NO: 1240625 - RNA, 18 nt, Human
gagcgaggagaugcuccu

SEQ ID NO: 1240626 - RNA, 21 nt, Human
gagcgaggagaugcuccuugg

SEQ ID NO: 1240627 - RNA, 13 nt, Human
gagcaucaugccu

SEQ ID NO: 1240628 - RNA, 14 nt, Human
gagcaucaugccuc

SEQ ID NO: 1240629 - RNA, 16 nt, Human
gagcaucaugccucug

SEQ ID NO: 1240630 - RNA, 17 nt, Human
gagcaucaugccucuga

SEQ ID NO: 1240631 - RNA, 18 nt, Human
gagcaucaugccucugag

SEQ ID NO: 1240632 - RNA, 19 nt, Human
gagcaucaugccucugagg

SEQ ID NO: 1240633 - RNA, 20 nt, Human
gagcaucaugccucugaggc

SEQ ID NO: 1240634 - RNA, 21 nt, Human
gagcaucaugccucugaggcc

SEQ ID NO: 1240635 - RNA, 22 nt, Human
gagcaucaugccucugaggcca

SEQ ID NO: 1240636 - RNA, 23 nt, Human
gagcaucaugccucugaggccag

SEQ ID NO: 1240637 - RNA, 24 nt, Human
gagcaucaugccucugaggccagc

SEQ ID NO: 1240638 - RNA, 15 nt, Human
gagcccgaggaggug

SEQ ID NO: 1240639 - RNA, 20 nt, Human
gagcccgaggaggugucuca

SEQ ID NO: 1240640 - RNA, 24 nt, Human
gagcccgaggaggugucucaggcu

SEQ ID NO: 1240641 - RNA, 22 nt, Human
gagcccgaggaggugucucagg

SEQ ID NO: 1240642 - RNA, 19 nt, Human
gagccugugccuccucacc

SEQ ID NO: 1240643 - RNA, 20 nt, Human
gagcugugaguucucccugu

SEQ ID NO: 1240644 - RNA, 21 nt, Human
gagcugugaguucucccugua

SEQ ID NO: 1240645 - RNA, 20 nt, Human
gagcuggugcggcuggccau

SEQ ID NO: 1240646 - RNA, 18 nt, Human
gagcuguauuaagccacu

SEQ ID NO: 1240647 - RNA, 18 nt, Human
gagcugugcaggugggga

SEQ ID NO: 1240648 - RNA, 18 nt, Human
gagucauucguucugugg

SEQ ID NO: 1240649 - RNA, 14 nt, Human
gagucauuuuuaca

SEQ ID NO: 1240650 - RNA, 12 nt, Human
gaguccaagcug

SEQ ID NO: 1240651 - RNA, 14 nt, Human
gaguccaagcuggg

SEQ ID NO: 1240652 - RNA, 19 nt, Human
gaguccaagguuuaaagag

SEQ ID NO: 1240653 - RNA, 14 nt, Human
gagugagacagacu

SEQ ID NO: 1240654 - RNA, 22 nt, Human
gagugagacccagcccucaucc

SEQ ID NO: 1240655 - RNA, 23 nt, Human
gagugagacccagcccucauccc

SEQ ID NO: 1240656 - RNA, 15 nt, Human
gaguccaagaaucca

SEQ ID NO: 1240657 - RNA, 16 nt, Human
gaguugaggccacugu

SEQ ID NO: 1240658 - RNA, 14 nt, Human
gagucacugagacc

SEQ ID NO: 1240659 - RNA, 15 nt, Human
gagucacugagacca

SEQ ID NO: 1240660 - RNA, 12 nt, Human
gaggggaccagg

SEQ ID NO: 1240661 - RNA, 13 nt, Human
gaggggaccagga

SEQ ID NO: 1240662 - RNA, 14 nt, Human
gaggggaccaggag

SEQ ID NO: 1240663 - RNA, 15 nt, Human
gaggggaccaggagu

SEQ ID NO: 1240664 - RNA, 16 nt, Human
gaggggaccaggagug

SEQ ID NO: 1240665 - RNA, 20 nt, Human
gaggcucuggagcccacugu

SEQ ID NO: 1240666 - RNA, 14 nt, Human
gaggcugccccucu

SEQ ID NO: 1240667 - RNA, 15 nt, Human
gaggcugccccucuc

SEQ ID NO: 1240668 - RNA, 18 nt, Human
gaggcugccccucucacc

SEQ ID NO: 1240669 - RNA, 19 nt, Human
gaggcugccccucucacca

SEQ ID NO: 1240670 - RNA, 13 nt, Human
gaggcugcccucc

SEQ ID NO: 1240671 - RNA, 14 nt, Human
gaggcugcccuccu

SEQ ID NO: 1240672 - RNA, 15 nt, Human
gaggcugcccuccug

SEQ ID NO: 1240673 - RNA, 23 nt, Human
gaggcugcccuccugugcucagc

SEQ ID NO: 1240674 - RNA, 15 nt, Human
gagggcgcaggccgu

SEQ ID NO: 1240675 - RNA, 13 nt, Human
gagggcggcaggg

SEQ ID NO: 1240676 - RNA, 19 nt, Human
gagggcggcaggggccugg

SEQ ID NO: 1240677 - RNA, 23 nt, Human
gagggcggcaggggccuggagau

SEQ ID NO: 1240678 - RNA, 12 nt, Human
gagggcgugucu

SEQ ID NO: 1240679 - RNA, 12 nt, Human
gaggggaagagg

SEQ ID NO: 1240680 - RNA, 16 nt, Human
gaggggaagaggccug

SEQ ID NO: 1240681 - RNA, 15 nt, Human
gaggggaagaggccu

SEQ ID NO: 1240682 - RNA, 14 nt, Human
gagggcucacucag

SEQ ID NO: 1240683 - RNA, 17 nt, Human
gagggcucacucagcca

SEQ ID NO: 1240684 - RNA, 19 nt, Human
gagggcucgaggggugggc

SEQ ID NO: 1240685 - RNA, 21 nt, Human
gagggcucgaggggugggcug

SEQ ID NO: 1240686 - RNA, 11 nt, Human
gagggcucuga

SEQ ID NO: 1240687 - RNA, 12 nt, Human
gagggcucugag

SEQ ID NO: 1240688 - RNA, 19 nt, Human
gaggcucuggagcccacug

SEQ ID NO: 1240689 - RNA, 14 nt, Human
gaggcucuggagcc

SEQ ID NO: 1240690 - RNA, 15 nt, Human
gaggccagccuggcc

SEQ ID NO: 1240691 - RNA, 16 nt, Human
gaggccagccuggccu

SEQ ID NO: 1240692 - RNA, 17 nt, Human
gaggccagccuggccuc

SEQ ID NO: 1240693 - RNA, 17 nt, Human
gaggcuccagagggcac

SEQ ID NO: 1240694 - RNA, 21 nt, Human
gaggccagaggcccccagccc

SEQ ID NO: 1240695 - RNA, 11 nt, Human
gaggccagccu

SEQ ID NO: 1240696 - RNA, 13 nt, Human
gaggccagccugg

SEQ ID NO: 1240697 - RNA, 14 nt, Human
gaggccagccuggc

SEQ ID NO: 1240698 - RNA, 21 nt, Human
gccaaggcagaggccugggcu

SEQ ID NO: 1240699 - RNA, 21 nt, Human
gccaaggagucacugagacca

SEQ ID NO: 1240700 - RNA, 14 nt, Human
gccaaggcagaggc

SEQ ID NO: 1240701 - RNA, 15 nt, Human
gccaaggcagaggcc

SEQ ID NO: 1240702 - RNA, 16 nt, Human
gccaaggcagaggccu

SEQ ID NO: 1240703 - RNA, 22 nt, Human
gccaagcaccuagccucgcucu

SEQ ID NO: 1240704 - RNA, 21 nt, Human
gccaagccauggguagccugg

SEQ ID NO: 1240705 - RNA, 16 nt, Human
gccaagcuccaagccc

SEQ ID NO: 1240706 - RNA, 14 nt, Human
gccaagcugaggug

SEQ ID NO: 1240707 - RNA, 15 nt, Human
gccaagcugaggugc

SEQ ID NO: 1240708 - RNA, 18 nt, Human
gccaagcugaggugccca

SEQ ID NO: 1240709 - RNA, 21 nt, Human
gccaagcugaggugcccagga

SEQ ID NO: 1240710 - RNA, 23 nt, Human
gccaagcugaggugcccaggaga

SEQ ID NO: 1240711 - RNA, 22 nt, Human
gccaagcugaggugcccaggag

SEQ ID NO: 1240712 - RNA, 14 nt, Human
gccaaggaaaggca

SEQ ID NO: 1240713 - RNA, 15 nt, Human
gccaaggaccugaga

SEQ ID NO: 1240714 - RNA, 19 nt, Human
gccaacuauggccugugga

SEQ ID NO: 1240715 - RNA, 16 nt, Human
gccaacuagccccugg

SEQ ID NO: 1240716 - RNA, 17 nt, Human
gccaacuagccccuggg

SEQ ID NO: 1240717 - RNA, 18 nt, Human
gccaacuaugauuauuaa

SEQ ID NO: 1240718 - RNA, 20 nt, Human
gccaacuagccccuggggug

SEQ ID NO: 1240719 - RNA, 15 nt, Human
gccaacuauggccug

SEQ ID NO: 1240720 - RNA, 14 nt, Human
gccaacuauggccu

SEQ ID NO: 1240721 - RNA, 15 nt, Human
gccaacuagccccug

SEQ ID NO: 1240722 - RNA, 21 nt, Human
gccaacuuuccccacguuaaa

SEQ ID NO: 1240723 - RNA, 15 nt, Human
gccaagaaacgucuu

SEQ ID NO: 1240724 - RNA, 21 nt, Human
gccaagaaacgucuucuaaac

SEQ ID NO: 1240725 - RNA, 22 nt, Human
gccaagaaacgucuucuaaacu

SEQ ID NO: 1240726 - RNA, 15 nt, Human
gccaagaagcagugg

SEQ ID NO: 1240727 - RNA, 16 nt, Human
gccaagaagcaguggc

SEQ ID NO: 1240728 - RNA, 19 nt, Human
gccaagaagcaguggccuu

SEQ ID NO: 1240729 - RNA, 20 nt, Human
gccaagaagcaguggccuua

SEQ ID NO: 1240730 - RNA, 14 nt, Human
gccaagacugcugu

SEQ ID NO: 1240731 - RNA, 15 nt, Human
gccaagacugcugug

SEQ ID NO: 1240732 - RNA, 20 nt, Human
gccaagacugcuguggccag

SEQ ID NO: 1240733 - RNA, 21 nt, Human
gccaagacugcuguggccagg

SEQ ID NO: 1240734 - RNA, 22 nt, Human
gccaagacugcuguggccagga

SEQ ID NO: 1240735 - RNA, 23 nt, Human
gccaagacugcuguggccaggag

SEQ ID NO: 1240736 - RNA, 18 nt, Human
gccaagagaaacuuccua

SEQ ID NO: 1240737 - RNA, 12 nt, Human
gcauuuccuggg

SEQ ID NO: 1240738 - RNA, 13 nt, Human
gcauuuccugggu

SEQ ID NO: 1240739 - RNA, 14 nt, Human
gcauuuccugggug

SEQ ID NO: 1240740 - RNA, 21 nt, Human
gcauuuccuggguggcuacuc

SEQ ID NO: 1240741 - RNA, 15 nt, Human
gccaaccuaaaacuc

SEQ ID NO: 1240742 - RNA, 17 nt, Human
gcauugugauuggccug

SEQ ID NO: 1240743 - RNA, 22 nt, Human
gcauugugauuggccuguagag

SEQ ID NO: 1240744 - RNA, 18 nt, Human
gcauuucccuuccuuccu

SEQ ID NO: 1240745 - RNA, 21 nt, Human
gcauuuccuaucaccuauuuc

SEQ ID NO: 1240746 - RNA, 18 nt, Human
gcauuuaaaacagacacu

SEQ ID NO: 1240747 - RNA, 22 nt, Human
gcauuucacuuucccgguguuc

SEQ ID NO: 1240748 - RNA, 23 nt, Human
gcaugucccuaccgagucucuuc

SEQ ID NO: 1240749 - RNA, 19 nt, Human
gcauguccuguaaagguua

SEQ ID NO: 1240750 - RNA, 10 nt, Human
gcauuguaaa

SEQ ID NO: 1240751 - RNA, 20 nt, Human
gcauuguaaaagcauuuugu

SEQ ID NO: 1240752 - RNA, 16 nt, Human
gcauuguaaaauaauu

SEQ ID NO: 1240753 - RNA, 12 nt, Human
gcauuguccucu

SEQ ID NO: 1240754 - RNA, 19 nt, Human
gcauggcauccuccagccc

SEQ ID NO: 1240755 - RNA, 21 nt, Human
gcauguacggauuuucaguua

SEQ ID NO: 1240756 - RNA, 13 nt, Human
gcauguaguaaca

SEQ ID NO: 1240757 - RNA, 16 nt, Human
gcauguaguaacacua

SEQ ID NO: 1240758 - RNA, 17 nt, Human
gcauguaguaacacuaa

SEQ ID NO: 1240759 - RNA, 21 nt, Human
gcauguaguaacacuaauaua

SEQ ID NO: 1240760 - RNA, 22 nt, Human
gcauguaguaacacuaauauau

SEQ ID NO: 1240761 - RNA, 24 nt, Human
gcauguaguaacacuaauauauuu

SEQ ID NO: 1240762 - RNA, 23 nt, Human
gcauguaguaacacuaauauauu

SEQ ID NO: 1240763 - RNA, 13 nt, Human
gcaucgcaaugua

SEQ ID NO: 1240764 - RNA, 18 nt, Human
gcaucgcaccauucugac

SEQ ID NO: 1240765 - RNA, 13 nt, Human
gcauggccaggug

SEQ ID NO: 1240766 - RNA, 17 nt, Human
gcauggcauccuccagc

SEQ ID NO: 1240767 - RNA, 18 nt, Human
gcauggcauccuccagcc

SEQ ID NO: 1240768 - RNA, 21 nt, Human
gcauggcauccuccagccccu

SEQ ID NO: 1240769 - RNA, 14 nt, Human
gcauggccaggugg

SEQ ID NO: 1240770 - RNA, 17 nt, Human
gcauggccagguggcca

SEQ ID NO: 1240771 - RNA, 20 nt, Human
gcaucgcaccauucugacuc

SEQ ID NO: 1240772 - RNA, 22 nt, Human
gcaucggacaagacccccagca

SEQ ID NO: 1240773 - RNA, 21 nt, Human
gcauggcagggggcugcugcu

SEQ ID NO: 1240774 - RNA, 18 nt, Human
gcauggcagggggcugcu

SEQ ID NO: 1240775 - RNA, 19 nt, Human
gcauggcagggggcugcug

SEQ ID NO: 1240776 - RNA, 20 nt, Human
gcauggcagggggcugcugc

SEQ ID NO: 1240777 - RNA, 17 nt, Human
gcacuuugcuuuaauau

SEQ ID NO: 1240778 - RNA, 19 nt, Human
gcacuuugcuuuaauauaa

SEQ ID NO: 1240779 - RNA, 20 nt, Human
gcacuuugcuuuaauauaaa

SEQ ID NO: 1240780 - RNA, 21 nt, Human
gcacuuugcuuuaauauaaau

SEQ ID NO: 1240781 - RNA, 16 nt, Human
gcacuuuggcuuauaa

SEQ ID NO: 1240782 - RNA, 17 nt, Human
gcacuuuggcuuauaau

SEQ ID NO: 1240783 - RNA, 21 nt, Human
gcacuuuggcuuauaauucuu

SEQ ID NO: 1240784 - RNA, 20 nt, Human
gcacuuuggcuuauaauucu

SEQ ID NO: 1240785 - RNA, 15 nt, Human
gcacucuucauggug

SEQ ID NO: 1240786 - RNA, 22 nt, Human
gcacugaaagucacggcugcgc

SEQ ID NO: 1240787 - RNA, 17 nt, Human
gcacugaagugcuuagu

SEQ ID NO: 1240788 - RNA, 20 nt, Human
gcacuuucuauccucuguaa

SEQ ID NO: 1240789 - RNA, 13 nt, Human
gcacucuucaugg

SEQ ID NO: 1240790 - RNA, 15 nt, Human
gcacucuagauucca

SEQ ID NO: 1240791 - RNA, 22 nt, Human
gcaggcuggccaguccaggcug

SEQ ID NO: 1240792 - RNA, 17 nt, Human
gcagggaacauggggag

SEQ ID NO: 1240793 - RNA, 18 nt, Human
gcagggaacauggggagg

SEQ ID NO: 1240794 - RNA, 13 nt, Human
gcaggcuggcccu

SEQ ID NO: 1240795 - RNA, 14 nt, Human
gcaggcuggcccug

SEQ ID NO: 1240796 - RNA, 12 nt, Human
gcaggcuggcca

SEQ ID NO: 1240797 - RNA, 14 nt, Human
gcaggcuggccagu

SEQ ID NO: 1240798 - RNA, 21 nt, Human
gcagcuucugcccccugcaga

SEQ ID NO: 1240799 - RNA, 19 nt, Human
gcaggcugagugcauuugg

SEQ ID NO: 1240800 - RNA, 12 nt, Human
gcaggcugauuu

SEQ ID NO: 1240801 - RNA, 17 nt, Human
gcaggcugauuucuagg

SEQ ID NO: 1240802 - RNA, 16 nt, Human
gcagcuucugcccccu

SEQ ID NO: 1240803 - RNA, 17 nt, Human
gcagcuucugcccccug

SEQ ID NO: 1240804 - RNA, 20 nt, Human
gcagcuucugcccccugcag

SEQ ID NO: 1240805 - RNA, 22 nt, Human
gcagcuucugcccccugcagaa

SEQ ID NO: 1240806 - RNA, 15 nt, Human
gcagcuuauucacaa

SEQ ID NO: 1240807 - RNA, 20 nt, Human
gcagcuguuuuguugacauu

SEQ ID NO: 1240808 - RNA, 12 nt, Human
gcagcuuccaga

SEQ ID NO: 1240809 - RNA, 17 nt, Human
gcagcuguuuuguugac

SEQ ID NO: 1240810 - RNA, 19 nt, Human
gcagcuuagaguuggccau

SEQ ID NO: 1240811 - RNA, 13 nt, Human
gcauaaauuauug

SEQ ID NO: 1240812 - RNA, 16 nt, Human
gcauaacaauuccucu

SEQ ID NO: 1240813 - RNA, 17 nt, Human
gcauaacaauuccucua

SEQ ID NO: 1240814 - RNA, 20 nt, Human
gcauacaaguuucauucucc

SEQ ID NO: 1240815 - RNA, 23 nt, Human
gcaguuuuuuuuuucuugucuau

SEQ ID NO: 1240816 - RNA, 15 nt, Human
gcauaaaagaugaaa

SEQ ID NO: 1240817 - RNA, 19 nt, Human
gcagggacuugaacccaua

SEQ ID NO: 1240818 - RNA, 20 nt, Human
gcagggacuguaaacacaga

SEQ ID NO: 1240819 - RNA, 13 nt, Human
gcagguucccaag

SEQ ID NO: 1240820 - RNA, 15 nt, Human
gcagguucccaagcu

SEQ ID NO: 1240821 - RNA, 16 nt, Human
gcagguucccaagcuc

SEQ ID NO: 1240822 - RNA, 18 nt, Human
gcagguucccaagcucag

SEQ ID NO: 1240823 - RNA, 19 nt, Human
gcagguucccaagcucaga

SEQ ID NO: 1240824 - RNA, 12 nt, Human
gcagguucccac

SEQ ID NO: 1240825 - RNA, 23 nt, Human
gcagguucccacuuaaaaauuaa

SEQ ID NO: 1240826 - RNA, 17 nt, Human
gcaguugagacaagaaa

SEQ ID NO: 1240827 - RNA, 23 nt, Human
gaucuggaaccucagccuggcca

SEQ ID NO: 1240828 - RNA, 13 nt, Human
gaucuggcugcag

SEQ ID NO: 1240829 - RNA, 12 nt, Human
gaucuggcaugu

SEQ ID NO: 1240830 - RNA, 16 nt, Human
gaucugggucucuaau

SEQ ID NO: 1240831 - RNA, 22 nt, Human
gaugaggccagaccauggacac

SEQ ID NO: 1240832 - RNA, 15 nt, Human
gaugaggcccuccac

SEQ ID NO: 1240833 - RNA, 15 nt, Human
gaugaggccagacca

SEQ ID NO: 1240834 - RNA, 13 nt, Human
gaugaggccagac

SEQ ID NO: 1240835 - RNA, 19 nt, Human
gaugaggcccuccacaccu

SEQ ID NO: 1240836 - RNA, 20 nt, Human
gaugaggcccuccacaccug

SEQ ID NO: 1240837 - RNA, 22 nt, Human
gaugaggcccuccacaccugcg

SEQ ID NO: 1240838 - RNA, 21 nt, Human
gaugaggcccuccacaccugc

SEQ ID NO: 1240839 - RNA, 18 nt, Human
gaugagcucccacaagcc

SEQ ID NO: 1240840 - RNA, 20 nt, Human
gaugagcucccacaagccug

SEQ ID NO: 1240841 - RNA, 21 nt, Human
gaugagcucccacaagccuga

SEQ ID NO: 1240842 - RNA, 23 nt, Human
gaugagcucccacaagccugagg

SEQ ID NO: 1240843 - RNA, 13 nt, Human
gaugaggcaaccc

SEQ ID NO: 1240844 - RNA, 14 nt, Human
gaugaugacuaugg

SEQ ID NO: 1240845 - RNA, 21 nt, Human
gaugagggaaaagaaaaagau

SEQ ID NO: 1240846 - RNA, 23 nt, Human
gaugauuaaauaagauucuaacg

SEQ ID NO: 1240847 - RNA, 16 nt, Human
gaugcuugggaagacu

SEQ ID NO: 1240848 - RNA, 15 nt, Human
gaugcuuuuaacaga

SEQ ID NO: 1240849 - RNA, 14 nt, Human
gaugcuuuuaacag

SEQ ID NO: 1240850 - RNA, 23 nt, Human
gauggaggaaaaccaagccgugg

SEQ ID NO: 1240851 - RNA, 15 nt, Human
gauggagugcuguuu

SEQ ID NO: 1240852 - RNA, 13 nt, Human
gauggaguuucua

SEQ ID NO: 1240853 - RNA, 15 nt, Human
gauggaguuucuaag

SEQ ID NO: 1240854 - RNA, 17 nt, Human
gauggaguuucuaaggu

SEQ ID NO: 1240855 - RNA, 14 nt, Human
gauguaaagauguu

SEQ ID NO: 1240856 - RNA, 17 nt, Human
gauguagaggagaaacu

SEQ ID NO: 1240857 - RNA, 19 nt, Human
gauguaauuuuguguaaga

SEQ ID NO: 1240858 - RNA, 12 nt, Human
gauguaaaguga

SEQ ID NO: 1240859 - RNA, 17 nt, Human
gauguaaggaugggcau

SEQ ID NO: 1240860 - RNA, 13 nt, Human
gauguaauacuuc

SEQ ID NO: 1240861 - RNA, 22 nt, Human
gauguaauacuucuugugugua

SEQ ID NO: 1240862 - RNA, 14 nt, Human
gauguaauacuucu

SEQ ID NO: 1240863 - RNA, 15 nt, Human
gauguaauacuucuu

SEQ ID NO: 1240864 - RNA, 13 nt, Human
gauguaauuuugu

SEQ ID NO: 1240865 - RNA, 17 nt, Human
gaugucccaacuuguaa

SEQ ID NO: 1240866 - RNA, 18 nt, Human
gauguacucuaaauacug

SEQ ID NO: 1240867 - RNA, 15 nt, Human
gaugucauacagaga

SEQ ID NO: 1240868 - RNA, 16 nt, Human
gaugucauacagagaa

SEQ ID NO: 1240869 - RNA, 17 nt, Human
gaugucauacagagaag

SEQ ID NO: 1240870 - RNA, 18 nt, Human
gaugucauacagagaagu

SEQ ID NO: 1240871 - RNA, 20 nt, Human
gaugucauacagagaaguca

SEQ ID NO: 1240872 - RNA, 18 nt, Human
gaugucccaacuuguaaa

SEQ ID NO: 1240873 - RNA, 11 nt, Human
gauguccccag

SEQ ID NO: 1240874 - RNA, 13 nt, Human
gauguccccagca

SEQ ID NO: 1240875 - RNA, 15 nt, Human
gauguccccagcaga

SEQ ID NO: 1240876 - RNA, 19 nt, Human
gaugucuccuaagcaccug

SEQ ID NO: 1240877 - RNA, 15 nt, Human
gaugucuccuaagca

SEQ ID NO: 1240878 - RNA, 13 nt, Human
gaugucuuggaac

SEQ ID NO: 1240879 - RNA, 21 nt, Human
gaugucuuggaacauuggaau

SEQ ID NO: 1240880 - RNA, 22 nt, Human
gaugucuuggaacauuggaaug

SEQ ID NO: 1240881 - RNA, 16 nt, Human
gaugucuuuguuaaga

SEQ ID NO: 1240882 - RNA, 12 nt, Human
gaugucuuuguu

SEQ ID NO: 1240883 - RNA, 19 nt, Human
gaugugaguugcacagcua

SEQ ID NO: 1240884 - RNA, 11 nt, Human
gaugugauaua

SEQ ID NO: 1240885 - RNA, 18 nt, Human
gaugugauauauaagugu

SEQ ID NO: 1240886 - RNA, 15 nt, Human
gaugugauauucuaa

SEQ ID NO: 1240887 - RNA, 15 nt, Human
gaugugauuguggaa

SEQ ID NO: 1240888 - RNA, 16 nt, Human
gaugugauuguggaau

SEQ ID NO: 1240889 - RNA, 18 nt, Human
gaugugauuguggaaugg

SEQ ID NO: 1240890 - RNA, 19 nt, Human
gaugugcacguaaaguacu

SEQ ID NO: 1240891 - RNA, 18 nt, Human
gaugugcagcauuucacu

SEQ ID NO: 1240892 - RNA, 19 nt, Human
gaugugcagcauuucacuu

SEQ ID NO: 1240893 - RNA, 11 nt, Human
gaugugcauuc

SEQ ID NO: 1240894 - RNA, 12 nt, Human
gauucuguacau

SEQ ID NO: 1240895 - RNA, 17 nt, Human
gauucuuuccauuugca

SEQ ID NO: 1240896 - RNA, 18 nt, Human
gauucuuuccauuugcau

SEQ ID NO: 1240897 - RNA, 19 nt, Human
gauucuuuccauuugcauu

SEQ ID NO: 1240898 - RNA, 14 nt, Human
gcaaaaaagaaaac

SEQ ID NO: 1240899 - RNA, 13 nt, Human
gcaaaaaagaaaa

SEQ ID NO: 1240900 - RNA, 21 nt, Human
gauuuuuuuuuuuuuccuguc

SEQ ID NO: 1240901 - RNA, 20 nt, Human
gauuuuuuuuuuuuuuuccu

SEQ ID NO: 1240902 - RNA, 21 nt, Human
gauuuuuuuuuuuuuuuccuu

SEQ ID NO: 1240903 - RNA, 19 nt, Human
gauuucaguucuaggaaaa

SEQ ID NO: 1240904 - RNA, 15 nt, Human
gauuucauacuguaa

SEQ ID NO: 1240905 - RNA, 15 nt, Human
gauuucauaguucag

SEQ ID NO: 1240906 - RNA, 18 nt, Human
gauuucauaguucagaau

SEQ ID NO: 1240907 - RNA, 17 nt, Human
gauuucauaguucagaa

SEQ ID NO: 1240908 - RNA, 16 nt, Human
gauuuuuuuuuuuucu

SEQ ID NO: 1240909 - RNA, 21 nt, Human
gauuuuuuuuuuuucucucaa

SEQ ID NO: 1240910 - RNA, 15 nt, Human
gauuucagcucacug

SEQ ID NO: 1240911 - RNA, 17 nt, Human
gauuucagcucacugca

SEQ ID NO: 1240912 - RNA, 20 nt, Human
gauuucagcucacugcaacc

SEQ ID NO: 1240913 - RNA, 20 nt, Human
gauucuuucccaauucacau

SEQ ID NO: 1240914 - RNA, 22 nt, Human
gauucuuuccauuugcauuugu

SEQ ID NO: 1240915 - RNA, 18 nt, Human
gauuuaacauuaucuagu

SEQ ID NO: 1240916 - RNA, 20 nt, Human
gauuuaagggcccaggucag

SEQ ID NO: 1240917 - RNA, 17 nt, Human
gcacucccaccugacac

SEQ ID NO: 1240918 - RNA, 18 nt, Human
gcacucccaccugacaca

SEQ ID NO: 1240919 - RNA, 22 nt, Human
gcacucccaccugacacaccag

SEQ ID NO: 1240920 - RNA, 11 nt, Human
gcacucuagau

SEQ ID NO: 1240921 - RNA, 12 nt, Human
gcacucuagauu

SEQ ID NO: 1240922 - RNA, 13 nt, Human
gcacucuagauuc

SEQ ID NO: 1240923 - RNA, 18 nt, Human
gcacuauaugcaaacagg

SEQ ID NO: 1240924 - RNA, 15 nt, Human
gcacuauaugcaaac

SEQ ID NO: 1240925 - RNA, 15 nt, Human
gcacuaucuuuaaac

SEQ ID NO: 1240926 - RNA, 19 nt, Human
gcacuaucuuuaaacgaaa

SEQ ID NO: 1240927 - RNA, 18 nt, Human
gcacuaucuuucagcucc

SEQ ID NO: 1240928 - RNA, 14 nt, Human
gcacuauaugcaaa

SEQ ID NO: 1240929 - RNA, 19 nt, Human
gcacuaucuuucagcucca

SEQ ID NO: 1240930 - RNA, 19 nt, Human
gcacucaaccuuaagaccu

SEQ ID NO: 1240931 - RNA, 12 nt, Human
gcaccuccucag

SEQ ID NO: 1240932 - RNA, 14 nt, Human
gcaccuccucagcc

SEQ ID NO: 1240933 - RNA, 15 nt, Human
gcaccuccucagccu

SEQ ID NO: 1240934 - RNA, 17 nt, Human
gcaccuccucagccuga

SEQ ID NO: 1240935 - RNA, 16 nt, Human
gcaccuccucagccug

SEQ ID NO: 1240936 - RNA, 17 nt, Human
gcaauacaaguuucauc

SEQ ID NO: 1240937 - RNA, 11 nt, Human
gcacacagcac

SEQ ID NO: 1240938 - RNA, 23 nt, Human
gcacacagcacgggggccaagga

SEQ ID NO: 1240939 - RNA, 18 nt, Human
gcacacagaggggaguca

SEQ ID NO: 1240940 - RNA, 18 nt, Human
gcacacagcuacucuccc

SEQ ID NO: 1240941 - RNA, 13 nt, Human
gcacacagcuacu

SEQ ID NO: 1240942 - RNA, 13 nt, Human
gcacacagggcag

SEQ ID NO: 1240943 - RNA, 14 nt, Human
gcaccggaccagcc

SEQ ID NO: 1240944 - RNA, 15 nt, Human
gcaccggaccagccu

SEQ ID NO: 1240945 - RNA, 16 nt, Human
gcaccggaccagccug

SEQ ID NO: 1240946 - RNA, 17 nt, Human
gcaccggaccagccugg

SEQ ID NO: 1240947 - RNA, 19 nt, Human
gcaccggaccagccuggcc

SEQ ID NO: 1240948 - RNA, 21 nt, Human
gcaccggaccagccuggccca

SEQ ID NO: 1240949 - RNA, 17 nt, Human
gcaccuaauccaggcag

SEQ ID NO: 1240950 - RNA, 18 nt, Human
gcaccuaauccaggcaga

SEQ ID NO: 1240951 - RNA, 17 nt, Human
gcaccuaccaccacgcc

SEQ ID NO: 1240952 - RNA, 18 nt, Human
gcaccuaccaccacgccc

SEQ ID NO: 1240953 - RNA, 18 nt, Human
gcaccuccacauccucca

SEQ ID NO: 1240954 - RNA, 22 nt, Human
gcaccuaauccaggcagaucca

SEQ ID NO: 1240955 - RNA, 23 nt, Human
gcaccuaauccaggcagauccag

SEQ ID NO: 1240956 - RNA, 11 nt, Human
gcaauagagac

SEQ ID NO: 1240957 - RNA, 22 nt, Human
gcacacaccaccacgccuggcu

SEQ ID NO: 1240958 - RNA, 22 nt, Human
gcaauagucaaauugugugaaa

SEQ ID NO: 1240959 - RNA, 18 nt, Human
gcaauagucaaauugugu

SEQ ID NO: 1240960 - RNA, 13 nt, Human
gcaauacauacca

SEQ ID NO: 1240961 - RNA, 18 nt, Human
gcaaguuuccaucaucua

SEQ ID NO: 1240962 - RNA, 13 nt, Human
gcaaccuccaccu

SEQ ID NO: 1240963 - RNA, 23 nt, Human
gcaaccguggcccuuccuggaca

SEQ ID NO: 1240964 - RNA, 19 nt, Human
gcaaccuaccuguugagca

SEQ ID NO: 1240965 - RNA, 19 nt, Human
gcaaccucaguaauuuaga

SEQ ID NO: 1240966 - RNA, 16 nt, Human
gcaaccuccaccuccu

SEQ ID NO: 1240967 - RNA, 17 nt, Human
gcaaccuccaccuccug

SEQ ID NO: 1240968 - RNA, 18 nt, Human
gcaaccguggcccuuccu

SEQ ID NO: 1240969 - RNA, 19 nt, Human
gcaaccguggcccuuccug

SEQ ID NO: 1240970 - RNA, 20 nt, Human
gcaaccguggcccuuccugg

SEQ ID NO: 1240971 - RNA, 21 nt, Human
gcaaccguggcccuuccugga

SEQ ID NO: 1240972 - RNA, 22 nt, Human
gcaaccguggcccuuccuggac

SEQ ID NO: 1240973 - RNA, 24 nt, Human
gcaaccguggcccuuccuggacag

SEQ ID NO: 1240974 - RNA, 18 nt, Human
gcaacccgugccaagucc

SEQ ID NO: 1240975 - RNA, 19 nt, Human
gcaacccgugccaagucca

SEQ ID NO: 1240976 - RNA, 22 nt, Human
gcaacccgugccaaguccaggu

SEQ ID NO: 1240977 - RNA, 23 nt, Human
gcaaccgucuguuaugcugugac

SEQ ID NO: 1240978 - RNA, 11 nt, Human
gcaaaagaaga

SEQ ID NO: 1240979 - RNA, 15 nt, Human
gcaaaagaagaaguu

SEQ ID NO: 1240980 - RNA, 19 nt, Human
gcaaaagaauggcagaaaa

SEQ ID NO: 1240981 - RNA, 17 nt, Human
gcaaaacucuacuuaau

SEQ ID NO: 1240982 - RNA, 22 nt, Human
gcaaaacucuacuuaauccaau

SEQ ID NO: 1240983 - RNA, 23 nt, Human
gcaaaacucuacuuaauccaaug

SEQ ID NO: 1240984 - RNA, 15 nt, Human
gcaacccgugccaag

SEQ ID NO: 1240985 - RNA, 23 nt, Human
cugacccuccaccgcagaaggaa

SEQ ID NO: 1240986 - RNA, 17 nt, Human
cugacccuaugggucua

SEQ ID NO: 1240987 - RNA, 15 nt, Human
cugacccuccccaaa

SEQ ID NO: 1240988 - RNA, 18 nt, Human
cugacccuccaccgcaga

SEQ ID NO: 1240989 - RNA, 16 nt, Human
cugaccccugcucagu

SEQ ID NO: 1240990 - RNA, 18 nt, Human
cugacccucaucuuucuu

SEQ ID NO: 1240991 - RNA, 13 nt, Human
cugaccccugcuc

SEQ ID NO: 1240992 - RNA, 14 nt, Human
cugaccccugcuca

SEQ ID NO: 1240993 - RNA, 22 nt, Human
cugacccuccccaaaggcuuug

SEQ ID NO: 1240994 - RNA, 18 nt, Human
cugagcugaggcagcagu

SEQ ID NO: 1240995 - RNA, 13 nt, Human
cugagcugugcag

SEQ ID NO: 1240996 - RNA, 22 nt, Human
cugaggaacccuuacaguagga

SEQ ID NO: 1240997 - RNA, 16 nt, Human
cugaggaacugucucg

SEQ ID NO: 1240998 - RNA, 22 nt, Human
cugagcuugcagagaugaggcc

SEQ ID NO: 1240999 - RNA, 15 nt, Human
cugagcugugcaggu

SEQ ID NO: 1241000 - RNA, 11 nt, Human
cugagcuguca

SEQ ID NO: 1241001 - RNA, 18 nt, Human
cugaggggcuaccaggaa

SEQ ID NO: 1241002 - RNA, 16 nt, Human
cugaggggggauccag

SEQ ID NO: 1241003 - RNA, 20 nt, Human
cugaggggcuaccaggaaag

SEQ ID NO: 1241004 - RNA, 12 nt, Human
cugagggucugu

SEQ ID NO: 1241005 - RNA, 16 nt, Human
cugagggucuguaggu

SEQ ID NO: 1241006 - RNA, 14 nt, Human
cugagggucuguag

SEQ ID NO: 1241007 - RNA, 21 nt, Human
cugaggaagacaagugaugcu

SEQ ID NO: 1241008 - RNA, 13 nt, Human
cugagguccugag

SEQ ID NO: 1241009 - RNA, 14 nt, Human
cugagguccugagc

SEQ ID NO: 1241010 - RNA, 15 nt, Human
cugagguccugagca

SEQ ID NO: 1241011 - RNA, 16 nt, Human
cugagguccugagcac

SEQ ID NO: 1241012 - RNA, 18 nt, Human
cugagguccugagcacug

SEQ ID NO: 1241013 - RNA, 19 nt, Human
cugagguccugagcacugc

SEQ ID NO: 1241014 - RNA, 20 nt, Human
cugagguccugagcacugcc

SEQ ID NO: 1241015 - RNA, 24 nt, Human
cugagguccugagcacugccagga

SEQ ID NO: 1241016 - RNA, 21 nt, Human
cugagguccugagcacugcca

SEQ ID NO: 1241017 - RNA, 17 nt, Human
cugaggggcuaccagga

SEQ ID NO: 1241018 - RNA, 16 nt, Human
cugaggaauuucaccu

SEQ ID NO: 1241019 - RNA, 16 nt, Human
cugaggaauuuucuuu

SEQ ID NO: 1241020 - RNA, 17 nt, Human
cugaguaccccugcuuu

SEQ ID NO: 1241021 - RNA, 21 nt, Human
cugagguuacuggaaauuagg

SEQ ID NO: 1241022 - RNA, 17 nt, Human
cugagguuacuggaaau

SEQ ID NO: 1241023 - RNA, 19 nt, Human
cugagguuacuggaaauua

SEQ ID NO: 1241024 - RNA, 24 nt, Human
cugaaaauauuguuuuacaauagu

SEQ ID NO: 1241025 - RNA, 22 nt, Human
cugaaaauauuguuuuacaaua

SEQ ID NO: 1241026 - RNA, 20 nt, Human
cugaaaauauuguuuuacaa

SEQ ID NO: 1241027 - RNA, 17 nt, Human
cugaaaauauuguuuua

SEQ ID NO: 1241028 - RNA, 22 nt, Human
cugaaaauauaaccagccauug

SEQ ID NO: 1241029 - RNA, 17 nt, Human
cugaaagaggaaugaag

SEQ ID NO: 1241030 - RNA, 13 nt, Human
cugaaagaggaau

SEQ ID NO: 1241031 - RNA, 15 nt, Human
cugaaaaaaaaccug

SEQ ID NO: 1241032 - RNA, 13 nt, Human
cugaaaaaauaua

SEQ ID NO: 1241033 - RNA, 15 nt, Human
cugaaaaaauauaug

SEQ ID NO: 1241034 - RNA, 19 nt, Human
cugaaaaaucuaagugaua

SEQ ID NO: 1241035 - RNA, 22 nt, Human
cugaaaaaucuaagugauauaa

SEQ ID NO: 1241036 - RNA, 21 nt, Human
cugaaaaaugguaauuguugc

SEQ ID NO: 1241037 - RNA, 17 nt, Human
cugaaaagguuuaugaa

SEQ ID NO: 1241038 - RNA, 13 nt, Human
cugaaaauauaac

SEQ ID NO: 1241039 - RNA, 15 nt, Human
cugaaaauauaacca

SEQ ID NO: 1241040 - RNA, 13 nt, Human
cucuugauuuuca

SEQ ID NO: 1241041 - RNA, 21 nt, Human
cucuugcacagucacugcucu

SEQ ID NO: 1241042 - RNA, 20 nt, Human
cucuugcacagucacugcuc

SEQ ID NO: 1241043 - RNA, 20 nt, Human
cucuugccucaaccucccaa

SEQ ID NO: 1241044 - RNA, 18 nt, Human
cucuugccucaaccuccc

SEQ ID NO: 1241045 - RNA, 17 nt, Human
cucuuuuuucguuuguu

SEQ ID NO: 1241046 - RNA, 18 nt, Human
cucuugauaccccccucu

SEQ ID NO: 1241047 - RNA, 19 nt, Human
cucuugauaccccccucug

SEQ ID NO: 1241048 - RNA, 21 nt, Human
cucuugauaccccccucuguc

SEQ ID NO: 1241049 - RNA, 23 nt, Human
cucuugauaccccccucugucuu

SEQ ID NO: 1241050 - RNA, 23 nt, Human
cucuugaguuugucgcucaugug

SEQ ID NO: 1241051 - RNA, 14 nt, Human
cugaaagaggcuga

SEQ ID NO: 1241052 - RNA, 22 nt, Human
cugaaagaggcugaggccugga

SEQ ID NO: 1241053 - RNA, 22 nt, Human
cugaaagaguccauuguuuaaa

SEQ ID NO: 1241054 - RNA, 14 nt, Human
cugaagcagccucu

SEQ ID NO: 1241055 - RNA, 15 nt, Human
cugaagcagccucuc

SEQ ID NO: 1241056 - RNA, 16 nt, Human
cugaagcagccucucc

SEQ ID NO: 1241057 - RNA, 20 nt, Human
cugaagcagccucuccccag

SEQ ID NO: 1241058 - RNA, 19 nt, Human
cugaagcagguucccaagc

SEQ ID NO: 1241059 - RNA, 20 nt, Human
cugaagcagguucccaagcu

SEQ ID NO: 1241060 - RNA, 21 nt, Human
cugaagcagguucccaagcuc

SEQ ID NO: 1241061 - RNA, 15 nt, Human
cugaagcccucccag

SEQ ID NO: 1241062 - RNA, 20 nt, Human
cugacacugcuggagaggcc

SEQ ID NO: 1241063 - RNA, 13 nt, Human
cugacacugcugg

SEQ ID NO: 1241064 - RNA, 14 nt, Human
cugacacugcugga

SEQ ID NO: 1241065 - RNA, 15 nt, Human
cugacacugcuggag

SEQ ID NO: 1241066 - RNA, 21 nt, Human
cugacacugcuggagaggccc

SEQ ID NO: 1241067 - RNA, 19 nt, Human
cugacacuuuaauuaccaa

SEQ ID NO: 1241068 - RNA, 16 nt, Human
cugacacccuucuccc

SEQ ID NO: 1241069 - RNA, 17 nt, Human
cugacacccuucuccca

SEQ ID NO: 1241070 - RNA, 21 nt, Human
cugacacccuucucccacucu

SEQ ID NO: 1241071 - RNA, 16 nt, Human
cugacaccuaacucuu

SEQ ID NO: 1241072 - RNA, 19 nt, Human
cugacaccuaacucuucuu

SEQ ID NO: 1241073 - RNA, 17 nt, Human
cugacacucccuugggc

SEQ ID NO: 1241074 - RNA, 14 nt, Human
cugacacaccaggc

SEQ ID NO: 1241075 - RNA, 17 nt, Human
cugacacaccaggcgcu

SEQ ID NO: 1241076 - RNA, 19 nt, Human
cugacacaccaggcgcuaa

SEQ ID NO: 1241077 - RNA, 23 nt, Human
cugacacaccaggcgcuaauuca

SEQ ID NO: 1241078 - RNA, 13 nt, Human
cugacacacuaac

SEQ ID NO: 1241079 - RNA, 16 nt, Human
cugacacacuaaccaa

SEQ ID NO: 1241080 - RNA, 19 nt, Human
cugacacacuaaccaagcu

SEQ ID NO: 1241081 - RNA, 20 nt, Human
cugacacacuaaccaagcug

SEQ ID NO: 1241082 - RNA, 23 nt, Human
cugacacacuaaccaagcugagu

SEQ ID NO: 1241083 - RNA, 22 nt, Human
cugacacacuaaccaagcugag

SEQ ID NO: 1241084 - RNA, 17 nt, Human
cugaccccucauagccc

SEQ ID NO: 1241085 - RNA, 18 nt, Human
cugaccccaucaccuacu

SEQ ID NO: 1241086 - RNA, 20 nt, Human
cugaccccucauagcccuca

SEQ ID NO: 1241087 - RNA, 21 nt, Human
cugaccccucauagcccucac

SEQ ID NO: 1241088 - RNA, 16 nt, Human
cugaccccaucaccua

SEQ ID NO: 1241089 - RNA, 21 nt, Human
cucguggacaccugcccugcc

SEQ ID NO: 1241090 - RNA, 20 nt, Human
cucguggacaccugcccugc

SEQ ID NO: 1241091 - RNA, 19 nt, Human
cucguggacaccugcccug

SEQ ID NO: 1241092 - RNA, 17 nt, Human
cucguggacaccugccc

SEQ ID NO: 1241093 - RNA, 18 nt, Human
cucguccccaagugaccu

SEQ ID NO: 1241094 - RNA, 20 nt, Human
cucguauaugucucaggucc

SEQ ID NO: 1241095 - RNA, 13 nt, Human
cucguauagcaug

SEQ ID NO: 1241096 - RNA, 14 nt, Human
cucguauagcaugc

SEQ ID NO: 1241097 - RNA, 18 nt, Human
cucggggugcacaggagg

SEQ ID NO: 1241098 - RNA, 18 nt, Human
cucguauaugucucaggu

SEQ ID NO: 1241099 - RNA, 16 nt, Human
cucguaagauuuccuu

SEQ ID NO: 1241100 - RNA, 18 nt, Human
cucgguauaguuuuguca

SEQ ID NO: 1241101 - RNA, 13 nt, Human
cucgguuucucca

SEQ ID NO: 1241102 - RNA, 16 nt, Human
cucggggauguguccu

SEQ ID NO: 1241103 - RNA, 19 nt, Human
cucggggauguguccugac

SEQ ID NO: 1241104 - RNA, 15 nt, Human
cucggggugcacagg

SEQ ID NO: 1241105 - RNA, 16 nt, Human
cucggggugcacagga

SEQ ID NO: 1241106 - RNA, 17 nt, Human
cucggggugcacaggag

SEQ ID NO: 1241107 - RNA, 19 nt, Human
cucggggugcacaggaggg

SEQ ID NO: 1241108 - RNA, 14 nt, Human
cuccuuucuggcuu

SEQ ID NO: 1241109 - RNA, 18 nt, Human
cuccuuuccauaaauccu

SEQ ID NO: 1241110 - RNA, 15 nt, Human
cuccuaggaaaauac

SEQ ID NO: 1241111 - RNA, 18 nt, Human
cuccuuucaucacacugg

SEQ ID NO: 1241112 - RNA, 10 nt, Human
cuccuuucca

SEQ ID NO: 1241113 - RNA, 14 nt, Human
cuccuagcuguccu

SEQ ID NO: 1241114 - RNA, 21 nt, Human
cuccuagcuguccuuuuuccu

SEQ ID NO: 1241115 - RNA, 13 nt, Human
cuccuuuuaaaga

SEQ ID NO: 1241116 - RNA, 14 nt, Human
cuccuuuuaaagaa

SEQ ID NO: 1241117 - RNA, 13 nt, Human
cucgaacuccuga

SEQ ID NO: 1241118 - RNA, 20 nt, Human
cucgaaacacagaaaccuuu

SEQ ID NO: 1241119 - RNA, 14 nt, Human
cucgaaacacagaa

SEQ ID NO: 1241120 - RNA, 15 nt, Human
cucgaaacacagaaa

SEQ ID NO: 1241121 - RNA, 19 nt, Human
cucgaaacacagaaaccuu

SEQ ID NO: 1241122 - RNA, 23 nt, Human
cuccuuuuaaagaaaaaaauuga

SEQ ID NO: 1241123 - RNA, 13 nt, Human
cuccuuuucccaa

SEQ ID NO: 1241124 - RNA, 13 nt, Human
cuccuuuuuccau

SEQ ID NO: 1241125 - RNA, 16 nt, Human
cucgaacuccugaccu

SEQ ID NO: 1241126 - RNA, 17 nt, Human
cucgaacuccugaccuu

SEQ ID NO: 1241127 - RNA, 20 nt, Human
cucgaacuauuuucaaagac

SEQ ID NO: 1241128 - RNA, 21 nt, Human
cucgaacuauuuucaaagacu

SEQ ID NO: 1241129 - RNA, 14 nt, Human
cucucccuugggcu

SEQ ID NO: 1241130 - RNA, 16 nt, Human
cucucccuugggcucu

SEQ ID NO: 1241131 - RNA, 17 nt, Human
cucucccuugggcucug

SEQ ID NO: 1241132 - RNA, 18 nt, Human
cucucccuugggcucuga

SEQ ID NO: 1241133 - RNA, 19 nt, Human
cucucccuugggcucugau

SEQ ID NO: 1241134 - RNA, 21 nt, Human
cucucccuugggcucugauga

SEQ ID NO: 1241135 - RNA, 23 nt, Human
cucucccuugggcucugaugaaa

SEQ ID NO: 1241136 - RNA, 17 nt, Human
cucucuggccuucggcc

SEQ ID NO: 1241137 - RNA, 22 nt, Human
cucucuggccuucggccuccau

SEQ ID NO: 1241138 - RNA, 19 nt, Human
cucucuggccuucggccuc

SEQ ID NO: 1241139 - RNA, 17 nt, Human
cucucuuuauacagcug

SEQ ID NO: 1241140 - RNA, 18 nt, Human
cucucuuuauacagcugu

SEQ ID NO: 1241141 - RNA, 19 nt, Human
cucucuuuauacagcugua

SEQ ID NO: 1241142 - RNA, 16 nt, Human
cucucuuugcauggau

SEQ ID NO: 1241143 - RNA, 18 nt, Human
cucucuuugcauggauuu

SEQ ID NO: 1241144 - RNA, 23 nt, Human
cucucuuugcccaguuggagacu

SEQ ID NO: 1241145 - RNA, 15 nt, Human
cucucuuugcccagu

SEQ ID NO: 1241146 - RNA, 12 nt, Human
cucugaaaccag

SEQ ID NO: 1241147 - RNA, 17 nt, Human
cucugaaaccaguguua

SEQ ID NO: 1241148 - RNA, 13 nt, Human
cucugaaagagaa

SEQ ID NO: 1241149 - RNA, 14 nt, Human
cucugaaagagaaa

SEQ ID NO: 1241150 - RNA, 16 nt, Human
cucugaaagagaaaca

SEQ ID NO: 1241151 - RNA, 21 nt, Human
cucugaaagagaaacacguau

SEQ ID NO: 1241152 - RNA, 11 nt, Human
cucugaaauac

SEQ ID NO: 1241153 - RNA, 17 nt, Human
cucugaaagagaaacac

SEQ ID NO: 1241154 - RNA, 12 nt, Human
cucugaacacau

SEQ ID NO: 1241155 - RNA, 13 nt, Human
cucugaacacauu

SEQ ID NO: 1241156 - RNA, 14 nt, Human
cuccgucaacucau

SEQ ID NO: 1241157 - RNA, 15 nt, Human
cuccgggaccuggug

SEQ ID NO: 1241158 - RNA, 19 nt, Human
cuccccaugauguuuagaa

SEQ ID NO: 1241159 - RNA, 22 nt, Human
cuccccagggaagcagcagccu

SEQ ID NO: 1241160 - RNA, 20 nt, Human
cuccccagggaagcagcagc

SEQ ID NO: 1241161 - RNA, 16 nt, Human
cuccccagguccagcu

SEQ ID NO: 1241162 - RNA, 17 nt, Human
cuccccagguccagcuc

SEQ ID NO: 1241163 - RNA, 18 nt, Human
cuccccagguccagcucu

SEQ ID NO: 1241164 - RNA, 19 nt, Human
cuccccagguccagcucug

SEQ ID NO: 1241165 - RNA, 20 nt, Human
cuccccagguccagcucugg

SEQ ID NO: 1241166 - RNA, 21 nt, Human
cuccccagguccagcucugga

SEQ ID NO: 1241167 - RNA, 23 nt, Human
cuccccagguccagcucuggagg

SEQ ID NO: 1241168 - RNA, 11 nt, Human
cuccccaguuc

SEQ ID NO: 1241169 - RNA, 17 nt, Human
cucccuccccuugccug

SEQ ID NO: 1241170 - RNA, 18 nt, Human
cucccuccccuugccugu

SEQ ID NO: 1241171 - RNA, 21 nt, Human
cucccuccccuugccugugcc

SEQ ID NO: 1241172 - RNA, 14 nt, Human
cucccucccucucc

SEQ ID NO: 1241173 - RNA, 15 nt, Human
cucccucccucuccg

SEQ ID NO: 1241174 - RNA, 19 nt, Human
cuccauagaccuuuucauu

SEQ ID NO: 1241175 - RNA, 19 nt, Human
cucccagaggagccaccag

SEQ ID NO: 1241176 - RNA, 21 nt, Human
cucccagaggagccaccaguu

SEQ ID NO: 1241177 - RNA, 22 nt, Human
cucccagaggagccaccaguuc

SEQ ID NO: 1241178 - RNA, 23 nt, Human
cucccagaggagccaccaguucu

SEQ ID NO: 1241179 - RNA, 14 nt, Human
cuccagggacagca

SEQ ID NO: 1241180 - RNA, 23 nt, Human
cuccagggacagcaacuaucaga

SEQ ID NO: 1241181 - RNA, 13 nt, Human
cuccaguguccug

SEQ ID NO: 1241182 - RNA, 14 nt, Human
cuccaguguccuga

SEQ ID NO: 1241183 - RNA, 16 nt, Human
cuccaguguccugagc

SEQ ID NO: 1241184 - RNA, 17 nt, Human
cuccaguguccugagcu

SEQ ID NO: 1241185 - RNA, 18 nt, Human
cuccaguguccugagcuc

SEQ ID NO: 1241186 - RNA, 19 nt, Human
cuccaguguccugagcuca

SEQ ID NO: 1241187 - RNA, 20 nt, Human
cuccaguguccugagcucag

SEQ ID NO: 1241188 - RNA, 21 nt, Human
cuccaguguccugagcucagc

SEQ ID NO: 1241189 - RNA, 22 nt, Human
cuccaguguccugagcucagcg

SEQ ID NO: 1241190 - RNA, 17 nt, Human
cucagacauuggcaccu

SEQ ID NO: 1241191 - RNA, 13 nt, Human
cucagacauuggc

SEQ ID NO: 1241192 - RNA, 18 nt, Human
cucagaccacaugcccca

SEQ ID NO: 1241193 - RNA, 15 nt, Human
cuaaacuuuuuuucu

SEQ ID NO: 1241194 - RNA, 14 nt, Human
cguuaccaggcagg

SEQ ID NO: 1241195 - RNA, 21 nt, Human
cguuacuagcagucacuugau

SEQ ID NO: 1241196 - RNA, 14 nt, Human
cguuaaaaacagau

SEQ ID NO: 1241197 - RNA, 21 nt, Human
cguuaaaaacagauuuggaaa

SEQ ID NO: 1241198 - RNA, 13 nt, Human
cgugucuggcaca

SEQ ID NO: 1241199 - RNA, 13 nt, Human
cguguccaccccc

SEQ ID NO: 1241200 - RNA, 21 nt, Human
cguguuuggguuuuuuuccuu

SEQ ID NO: 1241201 - RNA, 17 nt, Human
cguguccgacucuucug

SEQ ID NO: 1241202 - RNA, 22 nt, Human
cguguccccuauccuacuuccc

SEQ ID NO: 1241203 - RNA, 16 nt, Human
cgugucaccugugcuu

SEQ ID NO: 1241204 - RNA, 14 nt, Human
cguguccaccccca

SEQ ID NO: 1241205 - RNA, 17 nt, Human
cuaaagaaaaacaaacu

SEQ ID NO: 1241206 - RNA, 21 nt, Human
cuaaagaagguuucagaaaga

SEQ ID NO: 1241207 - RNA, 20 nt, Human
cuaaagaaaaacaaacucgu

SEQ ID NO: 1241208 - RNA, 17 nt, Human
cuaaacuuuuuuucugu

SEQ ID NO: 1241209 - RNA, 18 nt, Human
cuaaacuuuuuuucugua

SEQ ID NO: 1241210 - RNA, 21 nt, Human
cuaaacuuuuuuucuguacca

SEQ ID NO: 1241211 - RNA, 13 nt, Human
cuaaagaaaaaca

SEQ ID NO: 1241212 - RNA, 17 nt, Human
cuaaagcugguuuaaug

SEQ ID NO: 1241213 - RNA, 18 nt, Human
cuaaagcugguuuaaugu

SEQ ID NO: 1241214 - RNA, 14 nt, Human
cuaaaggaaaaaac

SEQ ID NO: 1241215 - RNA, 19 nt, Human
cuaaaggaaaaaaccaucc

SEQ ID NO: 1241216 - RNA, 19 nt, Human
cuaaaggaaaucaaaugaa

SEQ ID NO: 1241217 - RNA, 16 nt, Human
cuaaaggaguuuaugu

SEQ ID NO: 1241218 - RNA, 13 nt, Human
cuaaaggaguuua

SEQ ID NO: 1241219 - RNA, 15 nt, Human
cuaaagguccacagg

SEQ ID NO: 1241220 - RNA, 19 nt, Human
cuaaagguccacaggucua

SEQ ID NO: 1241221 - RNA, 20 nt, Human
cuaaagguccacaggucuag

SEQ ID NO: 1241222 - RNA, 21 nt, Human
cuaaagguccacaggucuaga

SEQ ID NO: 1241223 - RNA, 23 nt, Human
cuaaagguccacaggucuagacu

SEQ ID NO: 1241224 - RNA, 11 nt, Human
cuaaaguucua

SEQ ID NO: 1241225 - RNA, 12 nt, Human
cuaaaguucuaa

SEQ ID NO: 1241226 - RNA, 13 nt, Human
cuaaaguucuaag

SEQ ID NO: 1241227 - RNA, 14 nt, Human
cuaaaguucuaaga

SEQ ID NO: 1241228 - RNA, 15 nt, Human
cuaaaguucuaagau

SEQ ID NO: 1241229 - RNA, 17 nt, Human
cuaaaguucuaagauuc

SEQ ID NO: 1241230 - RNA, 18 nt, Human
cuaaaguucuaagauucu

SEQ ID NO: 1241231 - RNA, 19 nt, Human
cuaaaguucuaagauucug

SEQ ID NO: 1241232 - RNA, 20 nt, Human
cuaaaguucuaagauucuga

SEQ ID NO: 1241233 - RNA, 20 nt, Human
cuaacuacaaagguuuaaau

SEQ ID NO: 1241234 - RNA, 23 nt, Human
cuaacuacaaagguuuaaaugaa

SEQ ID NO: 1241235 - RNA, 15 nt, Human
cuaacuagacaccaa

SEQ ID NO: 1241236 - RNA, 21 nt, Human
cuaacuagacaccaaaguucu

SEQ ID NO: 1241237 - RNA, 22 nt, Human
cuaacuagacaccaaaguucua

SEQ ID NO: 1241238 - RNA, 23 nt, Human
cuaacuagacaccaaaguucuaa

SEQ ID NO: 1241239 - RNA, 17 nt, Human
cuaacucuucuuucauu

SEQ ID NO: 1241240 - RNA, 15 nt, Human
cuaacugcauacacu

SEQ ID NO: 1241241 - RNA, 15 nt, Human
cgguuuauauaagcu

SEQ ID NO: 1241242 - RNA, 20 nt, Human
cgguuaugaaauucaccccc

SEQ ID NO: 1241243 - RNA, 20 nt, Human
cgguucaggaaaauugaaug

SEQ ID NO: 1241244 - RNA, 21 nt, Human
cgguugaguuuugacugcuug

SEQ ID NO: 1241245 - RNA, 13 nt, Human
cguaauaagguuu

SEQ ID NO: 1241246 - RNA, 15 nt, Human
cguaauaagguuuua

SEQ ID NO: 1241247 - RNA, 23 nt, Human
cguaauaagguuuuaauuuagua

SEQ ID NO: 1241248 - RNA, 23 nt, Human
cggagaagugugccuucucucuc

SEQ ID NO: 1241249 - RNA, 13 nt, Human
cggugggccuggu

SEQ ID NO: 1241250 - RNA, 12 nt, Human
cggugggccugg

SEQ ID NO: 1241251 - RNA, 10 nt, Human
cggugggggu

SEQ ID NO: 1241252 - RNA, 11 nt, Human
cggugggggua

SEQ ID NO: 1241253 - RNA, 19 nt, Human
cgguggggguagggggcug

SEQ ID NO: 1241254 - RNA, 22 nt, Human
cgguggggguagggggcuggag

SEQ ID NO: 1241255 - RNA, 11 nt, Human
cggugucucuc

SEQ ID NO: 1241256 - RNA, 15 nt, Human
cggugugcaccaggg

SEQ ID NO: 1241257 - RNA, 16 nt, Human
cggugugcaccagggu

SEQ ID NO: 1241258 - RNA, 12 nt, Human
cguaauuuaacu

SEQ ID NO: 1241259 - RNA, 13 nt, Human
cgcugcugucaca

SEQ ID NO: 1241260 - RNA, 18 nt, Human
cgcugcuucgugggauac

SEQ ID NO: 1241261 - RNA, 20 nt, Human
cgcuggacucucagucucug

SEQ ID NO: 1241262 - RNA, 22 nt, Human
cgcaucuaguuccccuguuuau

SEQ ID NO: 1241263 - RNA, 12 nt, Human
cgauagagucuc

SEQ ID NO: 1241264 - RNA, 12 nt, Human
cgcaguuuuuuu

SEQ ID NO: 1241265 - RNA, 23 nt, Human
cgauacugcgacuuucugccugg

SEQ ID NO: 1241266 - RNA, 20 nt, Human
cgcaguuuuuuuuuucuugu

SEQ ID NO: 1241267 - RNA, 21 nt, Human
cgcaguuuuuuuuuucuuguc

SEQ ID NO: 1241268 - RNA, 15 nt, Human
cgcauaggaccuuuc

SEQ ID NO: 1241269 - RNA, 19 nt, Human
cgauacugcgacuuucugc

SEQ ID NO: 1241270 - RNA, 20 nt, Human
cgauacugcgacuuucugcc

SEQ ID NO: 1241271 - RNA, 22 nt, Human
cgauacugcgacuuucugccug

SEQ ID NO: 1241272 - RNA, 14 nt, Human
cgccuuccccaccc

SEQ ID NO: 1241273 - RNA, 19 nt, Human
cgaguagcugagauuauag

SEQ ID NO: 1241274 - RNA, 15 nt, Human
cgaguaauaugccug

SEQ ID NO: 1241275 - RNA, 18 nt, Human
cgauacaccgggccugga

SEQ ID NO: 1241276 - RNA, 20 nt, Human
cgauacaccgggccuggaga

SEQ ID NO: 1241277 - RNA, 21 nt, Human
cgauacaccgggccuggagaa

SEQ ID NO: 1241278 - RNA, 22 nt, Human
cgaggucgggcagcacaagugu

SEQ ID NO: 1241279 - RNA, 20 nt, Human
cuacuagggaaaugccuuug

SEQ ID NO: 1241280 - RNA, 13 nt, Human
cuacucaaagcau

SEQ ID NO: 1241281 - RNA, 13 nt, Human
cuacucacacagg

SEQ ID NO: 1241282 - RNA, 14 nt, Human
cuacucacacaggc

SEQ ID NO: 1241283 - RNA, 15 nt, Human
cuacucacacaggca

SEQ ID NO: 1241284 - RNA, 23 nt, Human
cuacucacacaggcauuuccugg

SEQ ID NO: 1241285 - RNA, 22 nt, Human
cuacucacacaggcauuuccug

SEQ ID NO: 1241286 - RNA, 23 nt, Human
cuacuaacaaucagcuccuuccu

SEQ ID NO: 1241287 - RNA, 17 nt, Human
cuacuaauagaauaaag

SEQ ID NO: 1241288 - RNA, 18 nt, Human
cuacuaauagaauaaagg

SEQ ID NO: 1241289 - RNA, 12 nt, Human
cuacuaauucca

SEQ ID NO: 1241290 - RNA, 15 nt, Human
cuacuaauuccacac

SEQ ID NO: 1241291 - RNA, 17 nt, Human
cuacuaauuccacaccu

SEQ ID NO: 1241292 - RNA, 17 nt, Human
cuacuaccuguaaugac

SEQ ID NO: 1241293 - RNA, 22 nt, Human
cuacuagagucugaacagcugu

SEQ ID NO: 1241294 - RNA, 18 nt, Human
cuaccuuccaguuccuca

SEQ ID NO: 1241295 - RNA, 13 nt, Human
cuaccuucucccc

SEQ ID NO: 1241296 - RNA, 16 nt, Human
cuaccuucuccccagc

SEQ ID NO: 1241297 - RNA, 21 nt, Human
cuaccuucuccccagcuccca

SEQ ID NO: 1241298 - RNA, 20 nt, Human
cuaccuucuccccagcuccc

SEQ ID NO: 1241299 - RNA, 14 nt, Human
cuaccuugaaaaua

SEQ ID NO: 1241300 - RNA, 19 nt, Human
cuaccuugaaaauaagaau

SEQ ID NO: 1241301 - RNA, 21 nt, Human
cuaccuugguucccccacuga

SEQ ID NO: 1241302 - RNA, 21 nt, Human
cuagacccacuggacucaccu

SEQ ID NO: 1241303 - RNA, 17 nt, Human
cuagaccagcagacaga

SEQ ID NO: 1241304 - RNA, 18 nt, Human
cuagaccagcagacagag

SEQ ID NO: 1241305 - RNA, 20 nt, Human
cuagaccagcagacagagcc

SEQ ID NO: 1241306 - RNA, 21 nt, Human
cuagaccagcagacagagcca

SEQ ID NO: 1241307 - RNA, 23 nt, Human
cuagacauggagguucuaaggcc

SEQ ID NO: 1241308 - RNA, 22 nt, Human
cuagacauggagguucuaaggc

SEQ ID NO: 1241309 - RNA, 11 nt, Human
cuagaccaaua

SEQ ID NO: 1241310 - RNA, 12 nt, Human
cuagaccaauaa

SEQ ID NO: 1241311 - RNA, 22 nt, Human
cuagacacaugaagguaaauaa

SEQ ID NO: 1241312 - RNA, 23 nt, Human
cuagacacaugaagguaaauaaa

SEQ ID NO: 1241313 - RNA, 15 nt, Human
cuagacaccaaaguu

SEQ ID NO: 1241314 - RNA, 16 nt, Human
cuagacaccaaaguuc

SEQ ID NO: 1241315 - RNA, 17 nt, Human
cuagacaccaaaguucu

SEQ ID NO: 1241316 - RNA, 18 nt, Human
cuagacaccaaaguucua

SEQ ID NO: 1241317 - RNA, 19 nt, Human
cuagacaccaaaguucuaa

SEQ ID NO: 1241318 - RNA, 13 nt, Human
cuagacacugcca

SEQ ID NO: 1241319 - RNA, 21 nt, Human
cuagacaccaaaguucuaaua

SEQ ID NO: 1241320 - RNA, 17 nt, Human
cuagacauggagguucu

SEQ ID NO: 1241321 - RNA, 18 nt, Human
cuagacauggagguucua

SEQ ID NO: 1241322 - RNA, 19 nt, Human
cuagacauggagguucuaa

SEQ ID NO: 1241323 - RNA, 20 nt, Human
cuagacauggagguucuaag

SEQ ID NO: 1241324 - RNA, 21 nt, Human
cuagacauggagguucuaagg

SEQ ID NO: 1241325 - RNA, 19 nt, Human
cuagaaucugcaauucaaa

SEQ ID NO: 1241326 - RNA, 16 nt, Human
cuagaauugaguguuu

SEQ ID NO: 1241327 - RNA, 19 nt, Human
cuagaauugaguguuuaaa

SEQ ID NO: 1241328 - RNA, 21 nt, Human
cuagaauugaguguuuaaagu

SEQ ID NO: 1241329 - RNA, 22 nt, Human
cuagaccagcagacagagccag

SEQ ID NO: 1241330 - RNA, 23 nt, Human
cuagaccagcagacagagccagg

SEQ ID NO: 1241331 - RNA, 21 nt, Human
cuagccauacgcucagcucau

SEQ ID NO: 1241332 - RNA, 18 nt, Human
cuagcccaaugaaaugaa

SEQ ID NO: 1241333 - RNA, 19 nt, Human
cuaggcccccacuugccuc

SEQ ID NO: 1241334 - RNA, 20 nt, Human
cuaggcccccacuugccucu

SEQ ID NO: 1241335 - RNA, 22 nt, Human
cuaggcccccacuugccucuuc

SEQ ID NO: 1241336 - RNA, 23 nt, Human
cuaggcccccacuugccucuucc

SEQ ID NO: 1241337 - RNA, 15 nt, Human
cuaggccuaguccug

SEQ ID NO: 1241338 - RNA, 15 nt, Human
cuaggccugggcagu

SEQ ID NO: 1241339 - RNA, 21 nt, Human
cuaggccuugcggcuccucag

SEQ ID NO: 1241340 - RNA, 16 nt, Human
cuaggccugggcagug

SEQ ID NO: 1241341 - RNA, 11 nt, Human
cuaguuuuuua

SEQ ID NO: 1241342 - RNA, 19 nt, Human
cuaguuuuuucuuccuuuu

SEQ ID NO: 1241343 - RNA, 23 nt, Human
cuaguuuuuucuuccuuuucacu

SEQ ID NO: 1241344 - RNA, 14 nt, Human
cuauaaagcaguau

SEQ ID NO: 1241345 - RNA, 16 nt, Human
cuauaaagcaguauuu

SEQ ID NO: 1241346 - RNA, 18 nt, Human
cuauaaagcaguauuuuu

SEQ ID NO: 1241347 - RNA, 19 nt, Human
cuauaaagcaguauuuuuc

SEQ ID NO: 1241348 - RNA, 11 nt, Human
cuauaaagcau

SEQ ID NO: 1241349 - RNA, 13 nt, Human
cuauaaagcauuu

SEQ ID NO: 1241350 - RNA, 14 nt, Human
cuauaaagcauuua

SEQ ID NO: 1241351 - RNA, 15 nt, Human
cuauaaagcauuuaa

SEQ ID NO: 1241352 - RNA, 14 nt, Human
cuaguucugccagg

SEQ ID NO: 1241353 - RNA, 15 nt, Human
cuaguucugccagga

SEQ ID NO: 1241354 - RNA, 16 nt, Human
cuaguucugccaggag

SEQ ID NO: 1241355 - RNA, 16 nt, Human
cuaguucuagaaaaac

SEQ ID NO: 1241356 - RNA, 23 nt, Human
cuaguucuagaaaaacaggcacu

SEQ ID NO: 1241357 - RNA, 15 nt, Human
cuaggguggggagag

SEQ ID NO: 1241358 - RNA, 21 nt, Human
cuaguuccccuguuuauucau

SEQ ID NO: 1241359 - RNA, 13 nt, Human
cuaguucugccag

SEQ ID NO: 1241360 - RNA, 20 nt, Human
cuaguuccccuguuuauuca

SEQ ID NO: 1241361 - RNA, 14 nt, Human
cuaguucuagaaaa

SEQ ID NO: 1241362 - RNA, 15 nt, Human
cuaguucuagaaaaa

SEQ ID NO: 1241363 - RNA, 13 nt, Human
cuaggguccuggg

SEQ ID NO: 1241364 - RNA, 14 nt, Human
cuaggguccugggg

SEQ ID NO: 1241365 - RNA, 15 nt, Human
cuaggguccugggga

SEQ ID NO: 1241366 - RNA, 17 nt, Human
cuaggguacauggugcu

SEQ ID NO: 1241367 - RNA, 21 nt, Human
cuaggguacauggugcuggga

SEQ ID NO: 1241368 - RNA, 15 nt, Human
cuaggcucugucugg

SEQ ID NO: 1241369 - RNA, 22 nt, Human
cuaggcucugucuggaagaugg

SEQ ID NO: 1241370 - RNA, 23 nt, Human
cuaggcugcauugaaaagagcug

SEQ ID NO: 1241371 - RNA, 15 nt, Human
cuaggcuaggguggg

SEQ ID NO: 1241372 - RNA, 13 nt, Human
cuaggcuccaccc

SEQ ID NO: 1241373 - RNA, 21 nt, Human
cuaggcugacaccuaacucuu

SEQ ID NO: 1241374 - RNA, 14 nt, Human
cuagggagccaugu

SEQ ID NO: 1241375 - RNA, 18 nt, Human
cuagggagccauuugaga

SEQ ID NO: 1241376 - RNA, 17 nt, Human
cuagggagccauuugag

SEQ ID NO: 1241377 - RNA, 22 nt, Human
cuagggaggcauggucugcccu

SEQ ID NO: 1241378 - RNA, 23 nt, Human
cuagggaggcauggucugcccuc

SEQ ID NO: 1241379 - RNA, 23 nt, Human
cuagggggagccccuucugcuca

SEQ ID NO: 1241380 - RNA, 19 nt, Human
cucagaaaacaaggaugaa

SEQ ID NO: 1241381 - RNA, 23 nt, Human
cucagaaaacaaggaugaauuaa

SEQ ID NO: 1241382 - RNA, 18 nt, Human
cucacuuuucccacucca

SEQ ID NO: 1241383 - RNA, 20 nt, Human
cucagaaaauaucccuccug

SEQ ID NO: 1241384 - RNA, 13 nt, Human
cucagaaaggcaa

SEQ ID NO: 1241385 - RNA, 10 nt, Human
cucagaaagu

SEQ ID NO: 1241386 - RNA, 15 nt, Human
cucagaaagugccug

SEQ ID NO: 1241387 - RNA, 16 nt, Human
cucagaaagugccuga

SEQ ID NO: 1241388 - RNA, 17 nt, Human
cucagaaagugccugac

SEQ ID NO: 1241389 - RNA, 18 nt, Human
cucagaaagugccugaca

SEQ ID NO: 1241390 - RNA, 11 nt, Human
cucagaaguaa

SEQ ID NO: 1241391 - RNA, 12 nt, Human
cucagaaguaaa

SEQ ID NO: 1241392 - RNA, 13 nt, Human
cucagaaguaaag

SEQ ID NO: 1241393 - RNA, 16 nt, Human
cucagaagucuuucag

SEQ ID NO: 1241394 - RNA, 21 nt, Human
cucagaagugcaucuggagag

SEQ ID NO: 1241395 - RNA, 16 nt, Human
cucagaaguuucuucu

SEQ ID NO: 1241396 - RNA, 19 nt, Human
cucagaaguuucuucuuua

SEQ ID NO: 1241397 - RNA, 22 nt, Human
cucagaagugcaucuggagaga

SEQ ID NO: 1241398 - RNA, 18 nt, Human
cucacuuguuuuauuuaa

SEQ ID NO: 1241399 - RNA, 20 nt, Human
cucacuuuccuccugaggcu

SEQ ID NO: 1241400 - RNA, 21 nt, Human
cucacuuuuaaugaacaaaug

SEQ ID NO: 1241401 - RNA, 22 nt, Human
cucacuuuuaaugaacaaaugg

SEQ ID NO: 1241402 - RNA, 12 nt, Human
cucacuuuuccc

SEQ ID NO: 1241403 - RNA, 14 nt, Human
cucacuuuucccac

SEQ ID NO: 1241404 - RNA, 15 nt, Human
cucacuuuucccacu

SEQ ID NO: 1241405 - RNA, 16 nt, Human
cucacuuuucccacuc

SEQ ID NO: 1241406 - RNA, 17 nt, Human
cucacuuuucccacucc

SEQ ID NO: 1241407 - RNA, 21 nt, Human
cucacuuuucccacuccaagc

SEQ ID NO: 1241408 - RNA, 19 nt, Human
cucaccuuggcaccagaca

SEQ ID NO: 1241409 - RNA, 21 nt, Human
cucaccuugugcuggggacag

SEQ ID NO: 1241410 - RNA, 12 nt, Human
cucacuucaggu

SEQ ID NO: 1241411 - RNA, 20 nt, Human
cucacuucugggcuucaucu

SEQ ID NO: 1241412 - RNA, 13 nt, Human
cucaccuggacuu

SEQ ID NO: 1241413 - RNA, 17 nt, Human
cucaccuggcccugcuu

SEQ ID NO: 1241414 - RNA, 15 nt, Human
cucaccuuccucauc

SEQ ID NO: 1241415 - RNA, 14 nt, Human
cucaccuucugagu

SEQ ID NO: 1241416 - RNA, 21 nt, Human
cucaccuucugaguacagagu

SEQ ID NO: 1241417 - RNA, 16 nt, Human
cucaccuuggcaccag

SEQ ID NO: 1241418 - RNA, 17 nt, Human
cucaccuuggcaccaga

SEQ ID NO: 1241419 - RNA, 16 nt, Human
cucaccucccccaucu

SEQ ID NO: 1241420 - RNA, 13 nt, Human
cucaccggcucuc

SEQ ID NO: 1241421 - RNA, 21 nt, Human
cucaccggcucucaccuggcc

SEQ ID NO: 1241422 - RNA, 19 nt, Human
cucaccugagucacccuac

SEQ ID NO: 1241423 - RNA, 22 nt, Human
cucaccucuagguccccauacu

SEQ ID NO: 1241424 - RNA, 23 nt, Human
cucaccucuagguccccauacuc

SEQ ID NO: 1241425 - RNA, 17 nt, Human
cucaccugcacuaacag

SEQ ID NO: 1241426 - RNA, 20 nt, Human
cucaccugcacuaacagagu

SEQ ID NO: 1241427 - RNA, 12 nt, Human
cucaccuggacu

SEQ ID NO: 1241428 - RNA, 14 nt, Human
cucacccuggggcu

SEQ ID NO: 1241429 - RNA, 21 nt, Human
cucacccugccuuaucuugca

SEQ ID NO: 1241430 - RNA, 15 nt, Human
cucacccuggaggca

SEQ ID NO: 1241431 - RNA, 13 nt, Human
cucacccugccuu

SEQ ID NO: 1241432 - RNA, 14 nt, Human
cucacccugccuua

SEQ ID NO: 1241433 - RNA, 15 nt, Human
cucacccugccuuau

SEQ ID NO: 1241434 - RNA, 21 nt, Human
cucacccgccccacucccucc

SEQ ID NO: 1241435 - RNA, 23 nt, Human
cucaaauacgugggcauucaaau

SEQ ID NO: 1241436 - RNA, 17 nt, Human
cucacaacagcugccug

SEQ ID NO: 1241437 - RNA, 21 nt, Human
cucaaauaaaaagugcuuuug

SEQ ID NO: 1241438 - RNA, 19 nt, Human
cucaaauaaaaagugcuuu

SEQ ID NO: 1241439 - RNA, 13 nt, Human
cucacaaggcagc

SEQ ID NO: 1241440 - RNA, 14 nt, Human
cucacaaggcagca

SEQ ID NO: 1241441 - RNA, 15 nt, Human
cucacaaggcagcaa

SEQ ID NO: 1241442 - RNA, 16 nt, Human
cucacaaggcagcaag

SEQ ID NO: 1241443 - RNA, 17 nt, Human
cucacaaggcagcaagg

SEQ ID NO: 1241444 - RNA, 19 nt, Human
cucacaaggcagcaaggcc

SEQ ID NO: 1241445 - RNA, 20 nt, Human
cucacaaggcagcaaggccc

SEQ ID NO: 1241446 - RNA, 21 nt, Human
cucacaaggcagcaaggcccg

SEQ ID NO: 1241447 - RNA, 19 nt, Human
cucacaaguggguaccccc

SEQ ID NO: 1241448 - RNA, 21 nt, Human
cucacaaguggguacccccag

SEQ ID NO: 1241449 - RNA, 20 nt, Human
cucacaaguggguaccccca

SEQ ID NO: 1241450 - RNA, 23 nt, Human
cucacacacccugucugccccgc

SEQ ID NO: 1241451 - RNA, 23 nt, Human
cucacacaggcauuuccugggug

SEQ ID NO: 1241452 - RNA, 21 nt, Human
cucacacaggcauuuccuggg

SEQ ID NO: 1241453 - RNA, 22 nt, Human
cucacacaggcauuuccugggu

SEQ ID NO: 1241454 - RNA, 12 nt, Human
cucacacaggca

SEQ ID NO: 1241455 - RNA, 13 nt, Human
cucacacaggcau

SEQ ID NO: 1241456 - RNA, 21 nt, Human
cuaucucugugugcacaaaua

SEQ ID NO: 1241457 - RNA, 16 nt, Human
cuaucugggaagcuau

SEQ ID NO: 1241458 - RNA, 15 nt, Human
cuaucucccugccuc

SEQ ID NO: 1241459 - RNA, 17 nt, Human
cuaucucccugccuccu

SEQ ID NO: 1241460 - RNA, 18 nt, Human
cuaucucccugccuccug

SEQ ID NO: 1241461 - RNA, 17 nt, Human
cuaucucugugugcaca

SEQ ID NO: 1241462 - RNA, 23 nt, Human
cuauguggaaguggggcgggcuu

SEQ ID NO: 1241463 - RNA, 19 nt, Human
cuauguggaaguggggcgg

SEQ ID NO: 1241464 - RNA, 23 nt, Human
cuaugucauuugcuggagcucug

SEQ ID NO: 1241465 - RNA, 16 nt, Human
cuaugucauuucauuu

SEQ ID NO: 1241466 - RNA, 18 nt, Human
cuaugucauuucauuucc

SEQ ID NO: 1241467 - RNA, 17 nt, Human
cuauuuugugaagccau

SEQ ID NO: 1241468 - RNA, 19 nt, Human
cuauuuuuaauguuuguac

SEQ ID NO: 1241469 - RNA, 14 nt, Human
cuauuuuuaucuga

SEQ ID NO: 1241470 - RNA, 13 nt, Human
cuauuuuuggagg

SEQ ID NO: 1241471 - RNA, 20 nt, Human
cuauuuuuggagguuuauua

SEQ ID NO: 1241472 - RNA, 18 nt, Human
cuauuuuuggcagucuga

SEQ ID NO: 1241473 - RNA, 21 nt, Human
cuauuuuuggcagucugaauu

SEQ ID NO: 1241474 - RNA, 13 nt, Human
cucaaaacaaagg

SEQ ID NO: 1241475 - RNA, 17 nt, Human
cuauuuuucauccuaaa

SEQ ID NO: 1241476 - RNA, 12 nt, Human
cuauuuuucuaa

SEQ ID NO: 1241477 - RNA, 15 nt, Human
cuauuuuucuaacua

SEQ ID NO: 1241478 - RNA, 20 nt, Human
cuauuuuucuaacuacaaag

SEQ ID NO: 1241479 - RNA, 22 nt, Human
cuauuuuuggcagucugaauuu

SEQ ID NO: 1241480 - RNA, 14 nt, Human
cucaaaacaaaggc

SEQ ID NO: 1241481 - RNA, 19 nt, Human
cucaaacugaggaauuuca

SEQ ID NO: 1241482 - RNA, 22 nt, Human
cucaaacugaggaauuucaccu

SEQ ID NO: 1241483 - RNA, 13 nt, Human
cucaaagaaagug

SEQ ID NO: 1241484 - RNA, 16 nt, Human
cucaaagaaaguguau

SEQ ID NO: 1241485 - RNA, 17 nt, Human
cucaaagaaaguguauu

SEQ ID NO: 1241486 - RNA, 18 nt, Human
cucaaagagggagugcau

SEQ ID NO: 1241487 - RNA, 19 nt, Human
cucaaagcaagcauucaga

SEQ ID NO: 1241488 - RNA, 20 nt, Human
cucaaagcaugggauuauua

SEQ ID NO: 1241489 - RNA, 17 nt, Human
cucaaagguuuggaagg

SEQ ID NO: 1241490 - RNA, 18 nt, Human
cucaaagguuuggaagga

SEQ ID NO: 1241491 - RNA, 19 nt, Human
cucaaagguuuggaaggag

SEQ ID NO: 1241492 - RNA, 23 nt, Human
cucaaagguuuggaaggagcaga

SEQ ID NO: 1241493 - RNA, 22 nt, Human
cucaaagguuuggaaggagcag

SEQ ID NO: 1241494 - RNA, 15 nt, Human
ccugccucucugcag

SEQ ID NO: 1241495 - RNA, 14 nt, Human
ccugccucucugca

SEQ ID NO: 1241496 - RNA, 18 nt, Human
ccugcugagucccaggcu

SEQ ID NO: 1241497 - RNA, 19 nt, Human
ccugcugagucccaggcug

SEQ ID NO: 1241498 - RNA, 20 nt, Human
ccugcugagucccaggcuga

SEQ ID NO: 1241499 - RNA, 13 nt, Human
ccugccucucugc

SEQ ID NO: 1241500 - RNA, 15 nt, Human
ccugccucucccagg

SEQ ID NO: 1241501 - RNA, 18 nt, Human
ccugccucucccaggcag

SEQ ID NO: 1241502 - RNA, 21 nt, Human
ccugccucucccaggcagggg

SEQ ID NO: 1241503 - RNA, 17 nt, Human
ccugccucagccucccg

SEQ ID NO: 1241504 - RNA, 12 nt, Human
ccugccucagga

SEQ ID NO: 1241505 - RNA, 23 nt, Human
ccugccucucaucaacugaauga

SEQ ID NO: 1241506 - RNA, 14 nt, Human
ccugccucucccag

SEQ ID NO: 1241507 - RNA, 16 nt, Human
ccugccucagccuccc

SEQ ID NO: 1241508 - RNA, 22 nt, Human
ccugccauuguagcgucuuucu

SEQ ID NO: 1241509 - RNA, 23 nt, Human
ccugaccccaaguuauccaccug

SEQ ID NO: 1241510 - RNA, 17 nt, Human
ccucuuucuucccauga

SEQ ID NO: 1241511 - RNA, 23 nt, Human
ccucuugccacugccucuuccuc

SEQ ID NO: 1241512 - RNA, 22 nt, Human
ccucuugccacugccucuuccu

SEQ ID NO: 1241513 - RNA, 22 nt, Human
ccucggccucccaaagugcugg

SEQ ID NO: 1241514 - RNA, 22 nt, Human
ccugcaggaucucaccaggcag

SEQ ID NO: 1241515 - RNA, 23 nt, Human
ccugcaggaucucaccaggcagc

SEQ ID NO: 1241516 - RNA, 20 nt, Human
ccugaguugcuuuucagcug

SEQ ID NO: 1241517 - RNA, 18 nt, Human
ccugacccucaucuuucu

SEQ ID NO: 1241518 - RNA, 16 nt, Human
ccugaccccugcucag

SEQ ID NO: 1241519 - RNA, 18 nt, Human
ccugaccccucauagccc

SEQ ID NO: 1241520 - RNA, 14 nt, Human
ccugaccccugcuc

SEQ ID NO: 1241521 - RNA, 15 nt, Human
ccugaccccugcuca

SEQ ID NO: 1241522 - RNA, 19 nt, Human
ccugacccucaucuuucuu

SEQ ID NO: 1241523 - RNA, 22 nt, Human
ccugacccucaucuuucuucca

SEQ ID NO: 1241524 - RNA, 21 nt, Human
ccugagaugggcuucccaagg

SEQ ID NO: 1241525 - RNA, 17 nt, Human
ccugagauucagauguc

SEQ ID NO: 1241526 - RNA, 18 nt, Human
ccugagaugggcuuccca

SEQ ID NO: 1241527 - RNA, 14 nt, Human
ccugagauuuauua

SEQ ID NO: 1241528 - RNA, 15 nt, Human
ccugagauuuauuaa

SEQ ID NO: 1241529 - RNA, 19 nt, Human
ccugagauuuauuaaagaa

SEQ ID NO: 1241530 - RNA, 21 nt, Human
ccugagauuuauuaaagaaaa

SEQ ID NO: 1241531 - RNA, 22 nt, Human
ccugagauuuauuaaagaaaaa

SEQ ID NO: 1241532 - RNA, 23 nt, Human
ccugagauuuauuaaagaaaaaa

SEQ ID NO: 1241533 - RNA, 13 nt, Human
ccugagcaacucu

SEQ ID NO: 1241534 - RNA, 16 nt, Human
ccugaggcugugguca

SEQ ID NO: 1241535 - RNA, 17 nt, Human
ccugaggcuguggucac

SEQ ID NO: 1241536 - RNA, 19 nt, Human
ccugagggucuguagguug

SEQ ID NO: 1241537 - RNA, 22 nt, Human
ccugaggucaggaguucaagac

SEQ ID NO: 1241538 - RNA, 20 nt, Human
ccugaggcuuuggauuugac

SEQ ID NO: 1241539 - RNA, 22 nt, Human
ccugaggcuuuggauuugacau

SEQ ID NO: 1241540 - RNA, 13 nt, Human
ccugagggaaagg

SEQ ID NO: 1241541 - RNA, 18 nt, Human
ccugagggaaaggccagc

SEQ ID NO: 1241542 - RNA, 19 nt, Human
ccugagggaaaggccagca

SEQ ID NO: 1241543 - RNA, 20 nt, Human
ccugagggaaaggccagcac

SEQ ID NO: 1241544 - RNA, 22 nt, Human
ccugagggaaaggccagcacuc

SEQ ID NO: 1241545 - RNA, 21 nt, Human
ccugagggaaaggccagcacu

SEQ ID NO: 1241546 - RNA, 12 nt, Human
ccugagggucug

SEQ ID NO: 1241547 - RNA, 13 nt, Human
ccugagggucugu

SEQ ID NO: 1241548 - RNA, 18 nt, Human
ccugagggucuguagguu

SEQ ID NO: 1241549 - RNA, 18 nt, Human
ccuggauggggcaggcca

SEQ ID NO: 1241550 - RNA, 14 nt, Human
ccuggauuugcaua

SEQ ID NO: 1241551 - RNA, 16 nt, Human
ccuggauuuuuaccag

SEQ ID NO: 1241552 - RNA, 13 nt, Human
ccuggccccucuc

SEQ ID NO: 1241553 - RNA, 12 nt, Human
ccuggccccucu

SEQ ID NO: 1241554 - RNA, 14 nt, Human
ccuggccuccccca

SEQ ID NO: 1241555 - RNA, 17 nt, Human
ccuggccucccccacuu

SEQ ID NO: 1241556 - RNA, 18 nt, Human
ccuggccucccccacuuu

SEQ ID NO: 1241557 - RNA, 15 nt, Human
ccuggccuccccugc

SEQ ID NO: 1241558 - RNA, 17 nt, Human
ccuggccuccccugcca

SEQ ID NO: 1241559 - RNA, 18 nt, Human
ccuggccuccccugccac

SEQ ID NO: 1241560 - RNA, 19 nt, Human
ccuggccuccccugccacc

SEQ ID NO: 1241561 - RNA, 20 nt, Human
ccuggccuccccugccacca

SEQ ID NO: 1241562 - RNA, 13 nt, Human
ccuggccuccugc

SEQ ID NO: 1241563 - RNA, 16 nt, Human
ccuggccuccugccuc

SEQ ID NO: 1241564 - RNA, 14 nt, Human
ccuggccuccugcc

SEQ ID NO: 1241565 - RNA, 15 nt, Human
ccuggccuccugccu

SEQ ID NO: 1241566 - RNA, 12 nt, Human
ccuggggcucua

SEQ ID NO: 1241567 - RNA, 18 nt, Human
ccuggggaaccugacccc

SEQ ID NO: 1241568 - RNA, 14 nt, Human
ccugggcuggaauc

SEQ ID NO: 1241569 - RNA, 20 nt, Human
ccugggcuggaaucaggaau

SEQ ID NO: 1241570 - RNA, 14 nt, Human
ccugggcugggaaa

SEQ ID NO: 1241571 - RNA, 13 nt, Human
ccugggcugggaa

SEQ ID NO: 1241572 - RNA, 15 nt, Human
ccugggcgcuggucc

SEQ ID NO: 1241573 - RNA, 11 nt, Human
ccuggccuuca

SEQ ID NO: 1241574 - RNA, 18 nt, Human
ccuggccuucaguguacc

SEQ ID NO: 1241575 - RNA, 18 nt, Human
ccugggccuugggcuccg

SEQ ID NO: 1241576 - RNA, 16 nt, Human
ccugggcgcugguccu

SEQ ID NO: 1241577 - RNA, 14 nt, Human
ccugggcuccugga

SEQ ID NO: 1241578 - RNA, 16 nt, Human
ccugggcuccuggacc

SEQ ID NO: 1241579 - RNA, 15 nt, Human
ccugggcuccuggac

SEQ ID NO: 1241580 - RNA, 21 nt, Human
ccuggugguggcucgggaggc

SEQ ID NO: 1241581 - RNA, 18 nt, Human
ccugguuuccugcccugg

SEQ ID NO: 1241582 - RNA, 19 nt, Human
ccugguuuccugcccuggg

SEQ ID NO: 1241583 - RNA, 20 nt, Human
ccugguuuccugcccuggga

SEQ ID NO: 1241584 - RNA, 21 nt, Human
ccugguuuccugcccugggag

SEQ ID NO: 1241585 - RNA, 20 nt, Human
ccugguuaaauaaggcaggg

SEQ ID NO: 1241586 - RNA, 13 nt, Human
ccugguucccguu

SEQ ID NO: 1241587 - RNA, 22 nt, Human
ccugguucccguuucuccaccu

SEQ ID NO: 1241588 - RNA, 20 nt, Human
ccuggggcucuaacgccuga

SEQ ID NO: 1241589 - RNA, 21 nt, Human
ccuggggcucuaacgccugag

SEQ ID NO: 1241590 - RNA, 23 nt, Human
ccuggggcucuaacgccugagcc

SEQ ID NO: 1241591 - RNA, 22 nt, Human
ccuggggcucuaacgccugagc

SEQ ID NO: 1241592 - RNA, 15 nt, Human
ccuggggcuggccuc

SEQ ID NO: 1241593 - RNA, 16 nt, Human
ccuggggcuggccucc

SEQ ID NO: 1241594 - RNA, 17 nt, Human
ccuggggcuggccuccc

SEQ ID NO: 1241595 - RNA, 19 nt, Human
ccuggggcuggccucccaa

SEQ ID NO: 1241596 - RNA, 14 nt, Human
ccugguggggcagc

SEQ ID NO: 1241597 - RNA, 15 nt, Human
ccugguggggcagcu

SEQ ID NO: 1241598 - RNA, 16 nt, Human
ccugguggggcagcuc

SEQ ID NO: 1241599 - RNA, 18 nt, Human
ccuggugguggcucggga

SEQ ID NO: 1241600 - RNA, 16 nt, Human
ccuggugguauuuuca

SEQ ID NO: 1241601 - RNA, 18 nt, Human
ccuggugguauuuucaau

SEQ ID NO: 1241602 - RNA, 19 nt, Human
ccuggugguauuuucaaua

SEQ ID NO: 1241603 - RNA, 21 nt, Human
ccuggugguauuuucaauagc

SEQ ID NO: 1241604 - RNA, 18 nt, Human
ccugguggggcagcuccu

SEQ ID NO: 1241605 - RNA, 19 nt, Human
ccugguggggcagcuccuc

SEQ ID NO: 1241606 - RNA, 23 nt, Human
ccugguggggcagcuccucuguc

SEQ ID NO: 1241607 - RNA, 21 nt, Human
ccugguggggcagcuccucug

SEQ ID NO: 1241608 - RNA, 21 nt, Human
ccugucucccuccucugcccg

SEQ ID NO: 1241609 - RNA, 10 nt, Human
ccuguaacuu

SEQ ID NO: 1241610 - RNA, 19 nt, Human
ccuguaacauacuggccug

SEQ ID NO: 1241611 - RNA, 23 nt, Human
ccuguaacauacuggccuggacu

SEQ ID NO: 1241612 - RNA, 16 nt, Human
ccuguaaccucuucag

SEQ ID NO: 1241613 - RNA, 21 nt, Human
ccuguaaccucuucagaggcc

SEQ ID NO: 1241614 - RNA, 17 nt, Human
ccugucucuacuaaaaa

SEQ ID NO: 1241615 - RNA, 22 nt, Human
ccugguuuccugcccugggagg

SEQ ID NO: 1241616 - RNA, 12 nt, Human
ccuguaaaccug

SEQ ID NO: 1241617 - RNA, 13 nt, Human
ccuguaaaccuga

SEQ ID NO: 1241618 - RNA, 12 nt, Human
ccuguaaacuuu

SEQ ID NO: 1241619 - RNA, 20 nt, Human
ccuguaaacuuuaucacuua

SEQ ID NO: 1241620 - RNA, 16 nt, Human
ccuguaacaagccaga

SEQ ID NO: 1241621 - RNA, 19 nt, Human
ccuguaaacuuuaucacuu

SEQ ID NO: 1241622 - RNA, 20 nt, Human
ccugucucucagggccaggc

SEQ ID NO: 1241623 - RNA, 19 nt, Human
ccugucucucagggccagg

SEQ ID NO: 1241624 - RNA, 14 nt, Human
ccucaaccucaucc

SEQ ID NO: 1241625 - RNA, 13 nt, Human
ccucaaccucauc

SEQ ID NO: 1241626 - RNA, 23 nt, Human
ccucaaccccuccccuccauccc

SEQ ID NO: 1241627 - RNA, 14 nt, Human
ccucaaccccuccc

SEQ ID NO: 1241628 - RNA, 17 nt, Human
ccucaaauuacuuugug

SEQ ID NO: 1241629 - RNA, 18 nt, Human
ccucaaauaaaaagugcu

SEQ ID NO: 1241630 - RNA, 22 nt, Human
ccucaaauaaaaagugcuuuug

SEQ ID NO: 1241631 - RNA, 21 nt, Human
ccucaaauaaaaagugcuuuu

SEQ ID NO: 1241632 - RNA, 15 nt, Human
ccucaaaucguccag

SEQ ID NO: 1241633 - RNA, 17 nt, Human
ccucagcucucaguugc

SEQ ID NO: 1241634 - RNA, 14 nt, Human
ccucagcucccaca

SEQ ID NO: 1241635 - RNA, 20 nt, Human
ccucagcucccacaagccuc

SEQ ID NO: 1241636 - RNA, 15 nt, Human
ccucagcucccacaa

SEQ ID NO: 1241637 - RNA, 14 nt, Human
ccucaagucuuucu

SEQ ID NO: 1241638 - RNA, 15 nt, Human
ccucaagucuuucuc

SEQ ID NO: 1241639 - RNA, 21 nt, Human
ccucaagucuuucucuuuccc

SEQ ID NO: 1241640 - RNA, 22 nt, Human
ccucagccuugccagagaucca

SEQ ID NO: 1241641 - RNA, 19 nt, Human
ccucaagucuuucucuuuc

SEQ ID NO: 1241642 - RNA, 14 nt, Human
ccucaaccucccaa

SEQ ID NO: 1241643 - RNA, 14 nt, Human
ccucaacugccuac

SEQ ID NO: 1241644 - RNA, 15 nt, Human
ccucaacugccuacu

SEQ ID NO: 1241645 - RNA, 16 nt, Human
ccucaagaaauaaaag

SEQ ID NO: 1241646 - RNA, 12 nt, Human
ccucaaccuccc

SEQ ID NO: 1241647 - RNA, 20 nt, Human
ccucaagguuuuagguucua

SEQ ID NO: 1241648 - RNA, 22 nt, Human
ccucaagguuuuagguucuaaa

SEQ ID NO: 1241649 - RNA, 23 nt, Human
ccucaagguuuuagguucuaaag

SEQ ID NO: 1241650 - RNA, 13 nt, Human
ccucaagucuuuc

SEQ ID NO: 1241651 - RNA, 21 nt, Human
ccucauuccaccuucccaugc

SEQ ID NO: 1241652 - RNA, 23 nt, Human
ccucauuauuuauguccaggugu

SEQ ID NO: 1241653 - RNA, 15 nt, Human
ccucccauccagggc

SEQ ID NO: 1241654 - RNA, 12 nt, Human
ccucccaggguu

SEQ ID NO: 1241655 - RNA, 13 nt, Human
ccucccaggguuu

SEQ ID NO: 1241656 - RNA, 18 nt, Human
ccucccaggguuuuaacu

SEQ ID NO: 1241657 - RNA, 19 nt, Human
ccucccaggguuuuaacuu

SEQ ID NO: 1241658 - RNA, 21 nt, Human
ccucccaggguuuuaacuuug

SEQ ID NO: 1241659 - RNA, 19 nt, Human
ccuccuaucagaaguuucu

SEQ ID NO: 1241660 - RNA, 13 nt, Human
ccuccucaccccc

SEQ ID NO: 1241661 - RNA, 14 nt, Human
ccuccucaccccca

SEQ ID NO: 1241662 - RNA, 16 nt, Human
ccuccucacccccagc

SEQ ID NO: 1241663 - RNA, 13 nt, Human
ccuccuuuuucca

SEQ ID NO: 1241664 - RNA, 21 nt, Human
ccuccuuuuuccaugcccuaa

SEQ ID NO: 1241665 - RNA, 16 nt, Human
ccucgaaacacagaaa

SEQ ID NO: 1241666 - RNA, 20 nt, Human
ccucgaaacacagaaaccuu

SEQ ID NO: 1241667 - RNA, 23 nt, Human
ccucgcaacccgugccaagucca

SEQ ID NO: 1241668 - RNA, 19 nt, Human
ccucggacuuagcugggag

SEQ ID NO: 1241669 - RNA, 20 nt, Human
ccucggacuuagcugggaga

SEQ ID NO: 1241670 - RNA, 18 nt, Human
ccucgcuggacucucagu

SEQ ID NO: 1241671 - RNA, 20 nt, Human
ccucgcccagcggcaucagg

SEQ ID NO: 1241672 - RNA, 21 nt, Human
ccucgcccagcggcaucaggc

SEQ ID NO: 1241673 - RNA, 16 nt, Human
ccucgccccuggcaga

SEQ ID NO: 1241674 - RNA, 15 nt, Human
ccucgccccuggcag

SEQ ID NO: 1241675 - RNA, 17 nt, Human
ccucgcuggacucucag

SEQ ID NO: 1241676 - RNA, 16 nt, Human
ccucccuucucuucac

SEQ ID NO: 1241677 - RNA, 20 nt, Human
ccucccuuggggccuaugca

SEQ ID NO: 1241678 - RNA, 13 nt, Human
ccuaauaaagcug

SEQ ID NO: 1241679 - RNA, 12 nt, Human
ccuaauaaagcu

SEQ ID NO: 1241680 - RNA, 14 nt, Human
ccguccugccugug

SEQ ID NO: 1241681 - RNA, 19 nt, Human
ccgucuuucuuuuauacug

SEQ ID NO: 1241682 - RNA, 16 nt, Human
ccgucuuuuccuguuu

SEQ ID NO: 1241683 - RNA, 19 nt, Human
ccgugaaugggugcccaca

SEQ ID NO: 1241684 - RNA, 14 nt, Human
ccgugacgucuggg

SEQ ID NO: 1241685 - RNA, 16 nt, Human
ccgugacgucugggug

SEQ ID NO: 1241686 - RNA, 15 nt, Human
ccgugagcauguuug

SEQ ID NO: 1241687 - RNA, 22 nt, Human
ccgugagccaaucccucaccuu

SEQ ID NO: 1241688 - RNA, 20 nt, Human
ccuaauucaauucaaagcug

SEQ ID NO: 1241689 - RNA, 16 nt, Human
ccuaauucaauucaaa

SEQ ID NO: 1241690 - RNA, 13 nt, Human
ccuagcccucuca

SEQ ID NO: 1241691 - RNA, 21 nt, Human
ccuaaugcgcaggcuggcccu

SEQ ID NO: 1241692 - RNA, 13 nt, Human
ccuaauuccacag

SEQ ID NO: 1241693 - RNA, 13 nt, Human
ccuaauguguuua

SEQ ID NO: 1241694 - RNA, 22 nt, Human
ccggcagcuucugcccccugca

SEQ ID NO: 1241695 - RNA, 18 nt, Human
ccggcagcuucugccccc

SEQ ID NO: 1241696 - RNA, 19 nt, Human
ccggcagcuucugcccccu

SEQ ID NO: 1241697 - RNA, 20 nt, Human
ccggcagcuucugcccccug

SEQ ID NO: 1241698 - RNA, 11 nt, Human
ccggcagggcg

SEQ ID NO: 1241699 - RNA, 16 nt, Human
ccggcacccccugcag

SEQ ID NO: 1241700 - RNA, 17 nt, Human
ccggcacccccugcagc

SEQ ID NO: 1241701 - RNA, 18 nt, Human
ccggcacccccugcagcu

SEQ ID NO: 1241702 - RNA, 19 nt, Human
ccggcacccccugcagcuu

SEQ ID NO: 1241703 - RNA, 21 nt, Human
ccggcacccccugcagcuugu

SEQ ID NO: 1241704 - RNA, 20 nt, Human
ccggcacccccugcagcuug

SEQ ID NO: 1241705 - RNA, 16 nt, Human
ccggcagcagccccca

SEQ ID NO: 1241706 - RNA, 16 nt, Human
ccggcagggcgggcag

SEQ ID NO: 1241707 - RNA, 21 nt, Human
ccggcagggcgggcagagggc

SEQ ID NO: 1241708 - RNA, 23 nt, Human
ccggcagggcgggcagagggcug

SEQ ID NO: 1241709 - RNA, 11 nt, Human
ccggccagccc

SEQ ID NO: 1241710 - RNA, 15 nt, Human
ccgguguucuaagau

SEQ ID NO: 1241711 - RNA, 14 nt, Human
ccgucccccucugg

SEQ ID NO: 1241712 - RNA, 15 nt, Human
ccguccccuagaguc

SEQ ID NO: 1241713 - RNA, 18 nt, Human
ccguccccuagaguccca

SEQ ID NO: 1241714 - RNA, 13 nt, Human
ccguccugccugu

SEQ ID NO: 1241715 - RNA, 15 nt, Human
ccguccugccugugg

SEQ ID NO: 1241716 - RNA, 12 nt, Human
ccguaauuuaac

SEQ ID NO: 1241717 - RNA, 13 nt, Human
ccguaauuuaacu

SEQ ID NO: 1241718 - RNA, 14 nt, Human
ccguaauuuaacuu

SEQ ID NO: 1241719 - RNA, 19 nt, Human
ccggcacagggucugcucu

SEQ ID NO: 1241720 - RNA, 20 nt, Human
ccggcacagggucugcucuu

SEQ ID NO: 1241721 - RNA, 14 nt, Human
ccggcacccccugc

SEQ ID NO: 1241722 - RNA, 15 nt, Human
ccggcacccccugca

SEQ ID NO: 1241723 - RNA, 21 nt, Human
cccuucuccauggcccugcca

SEQ ID NO: 1241724 - RNA, 23 nt, Human
cccuucuccauccacaugggagc

SEQ ID NO: 1241725 - RNA, 21 nt, Human
cccuucuauacccacccagaa

SEQ ID NO: 1241726 - RNA, 23 nt, Human
cccuucuauuuggggcuugauga

SEQ ID NO: 1241727 - RNA, 20 nt, Human
cccuucuauacccacccaga

SEQ ID NO: 1241728 - RNA, 19 nt, Human
cccuucuauacccacccag

SEQ ID NO: 1241729 - RNA, 18 nt, Human
cccuucuauacccaccca

SEQ ID NO: 1241730 - RNA, 13 nt, Human
cccuucuauaccc

SEQ ID NO: 1241731 - RNA, 14 nt, Human
cccuccuuccuaaa

SEQ ID NO: 1241732 - RNA, 11 nt, Human
cccuccuuccu

SEQ ID NO: 1241733 - RNA, 21 nt, Human
cccuccugugcucagcccuga

SEQ ID NO: 1241734 - RNA, 20 nt, Human
cccuccugugcucagcccug

SEQ ID NO: 1241735 - RNA, 20 nt, Human
cccuccuguugggagagggc

SEQ ID NO: 1241736 - RNA, 21 nt, Human
cccuccuucccaagugagucu

SEQ ID NO: 1241737 - RNA, 13 nt, Human
cccuccuucccaa

SEQ ID NO: 1241738 - RNA, 14 nt, Human
cccuucucccacuc

SEQ ID NO: 1241739 - RNA, 20 nt, Human
cccuucucccacucuccuag

SEQ ID NO: 1241740 - RNA, 14 nt, Human
cccuucuccccugc

SEQ ID NO: 1241741 - RNA, 15 nt, Human
cccuucuccccugca

SEQ ID NO: 1241742 - RNA, 16 nt, Human
cccuucuccccugcac

SEQ ID NO: 1241743 - RNA, 18 nt, Human
cccuucuccccugcacug

SEQ ID NO: 1241744 - RNA, 21 nt, Human
cccuucuccccugcacuguaa

SEQ ID NO: 1241745 - RNA, 12 nt, Human
ccgacagccugg

SEQ ID NO: 1241746 - RNA, 19 nt, Human
ccgaaggaaaagggcuuuc

SEQ ID NO: 1241747 - RNA, 13 nt, Human
ccgacagccuggc

SEQ ID NO: 1241748 - RNA, 14 nt, Human
ccgacagccuggca

SEQ ID NO: 1241749 - RNA, 15 nt, Human
ccgacagccuggcac

SEQ ID NO: 1241750 - RNA, 22 nt, Human
ccgacagccuggcacagggcag

SEQ ID NO: 1241751 - RNA, 23 nt, Human
ccgaaauaucuauguuuuaccaa

SEQ ID NO: 1241752 - RNA, 18 nt, Human
ccgaagccgccuguggac

SEQ ID NO: 1241753 - RNA, 21 nt, Human
ccgaagcuaacagggaaggca

SEQ ID NO: 1241754 - RNA, 23 nt, Human
ccgaagcuaacagggaaggcagg

SEQ ID NO: 1241755 - RNA, 15 nt, Human
ccgcagcccccaccc

SEQ ID NO: 1241756 - RNA, 21 nt, Human
ccgcagcccccacccccaagg

SEQ ID NO: 1241757 - RNA, 20 nt, Human
cccaagcaccugggauuaca

SEQ ID NO: 1241758 - RNA, 20 nt, Human
cccaagagcaucaugccucu

SEQ ID NO: 1241759 - RNA, 21 nt, Human
cccaagagcaucaugccucug

SEQ ID NO: 1241760 - RNA, 23 nt, Human
cccaagagcuacguauuuaauag

SEQ ID NO: 1241761 - RNA, 22 nt, Human
cccaagagcaucaugccucuga

SEQ ID NO: 1241762 - RNA, 20 nt, Human
cccaagaugggcaucuuuug

SEQ ID NO: 1241763 - RNA, 22 nt, Human
cccaagaugggcaucuuuugua

SEQ ID NO: 1241764 - RNA, 17 nt, Human
cccaagauugagcucuc

SEQ ID NO: 1241765 - RNA, 21 nt, Human
cccaagauugagcucucugcc

SEQ ID NO: 1241766 - RNA, 16 nt, Human
cccacccacuucugca

SEQ ID NO: 1241767 - RNA, 23 nt, Human
cccacccagaugccccuuucugg

SEQ ID NO: 1241768 - RNA, 13 nt, Human
cccacccaggcca

SEQ ID NO: 1241769 - RNA, 15 nt, Human
cccacccaggccagg

SEQ ID NO: 1241770 - RNA, 17 nt, Human
cccacccaggccaggca

SEQ ID NO: 1241771 - RNA, 21 nt, Human
cccacccaggccaggcaugug

SEQ ID NO: 1241772 - RNA, 18 nt, Human
cccaccccaaccugcucu

SEQ ID NO: 1241773 - RNA, 19 nt, Human
cccaccccaaccugcucuc

SEQ ID NO: 1241774 - RNA, 22 nt, Human
cccaccccaaccugcucuccuc

SEQ ID NO: 1241775 - RNA, 13 nt, Human
cccaacuccagaa

SEQ ID NO: 1241776 - RNA, 20 nt, Human
cccaacuaauuuuuguauuu

SEQ ID NO: 1241777 - RNA, 23 nt, Human
cccaacuacccccagcugugcuu

SEQ ID NO: 1241778 - RNA, 15 nt, Human
cccaacuccuuccag

SEQ ID NO: 1241779 - RNA, 16 nt, Human
cccaacuccuuccagc

SEQ ID NO: 1241780 - RNA, 18 nt, Human
cccaacuccuuccagcua

SEQ ID NO: 1241781 - RNA, 15 nt, Human
cccaacucuccccug

SEQ ID NO: 1241782 - RNA, 18 nt, Human
cccaagagcaucaugccu

SEQ ID NO: 1241783 - RNA, 15 nt, Human
cccaccccagggcag

SEQ ID NO: 1241784 - RNA, 13 nt, Human
cccaccccauucc

SEQ ID NO: 1241785 - RNA, 17 nt, Human
cccaccccauucccgca

SEQ ID NO: 1241786 - RNA, 13 nt, Human
cccacccccaagg

SEQ ID NO: 1241787 - RNA, 12 nt, Human
cccaccccugca

SEQ ID NO: 1241788 - RNA, 15 nt, Human
cccaccccugcacag

SEQ ID NO: 1241789 - RNA, 14 nt, Human
cccacucugcucug

SEQ ID NO: 1241790 - RNA, 15 nt, Human
cccacucugcucuga

SEQ ID NO: 1241791 - RNA, 16 nt, Human
cccacucugcucugau

SEQ ID NO: 1241792 - RNA, 17 nt, Human
cccacucugcucugaug

SEQ ID NO: 1241793 - RNA, 19 nt, Human
cccacucugcucugaugca

SEQ ID NO: 1241794 - RNA, 18 nt, Human
cccacucugcucugaugc

SEQ ID NO: 1241795 - RNA, 14 nt, Human
cccacugaccagaa

SEQ ID NO: 1241796 - RNA, 15 nt, Human
cccacugagaggaca

SEQ ID NO: 1241797 - RNA, 23 nt, Human
cccacuccucugcugaccugcug

SEQ ID NO: 1241798 - RNA, 12 nt, Human
cccacucuccua

SEQ ID NO: 1241799 - RNA, 14 nt, Human
cccacucuccuagg

SEQ ID NO: 1241800 - RNA, 15 nt, Human
cccacucuccuaggc

SEQ ID NO: 1241801 - RNA, 21 nt, Human
cccacucuccuaggcauucug

SEQ ID NO: 1241802 - RNA, 13 nt, Human
cccacucugcucu

SEQ ID NO: 1241803 - RNA, 21 nt, Human
ccauuucauuugugccagaau

SEQ ID NO: 1241804 - RNA, 22 nt, Human
ccauuucauuugugccagaaug

SEQ ID NO: 1241805 - RNA, 15 nt, Human
ccauuggaucucauu

SEQ ID NO: 1241806 - RNA, 19 nt, Human
ccauuggcuauuuaaaacu

SEQ ID NO: 1241807 - RNA, 20 nt, Human
ccauuggcuauuuaaaacuu

SEQ ID NO: 1241808 - RNA, 21 nt, Human
ccauuggcuauuuaaaacuug

SEQ ID NO: 1241809 - RNA, 13 nt, Human
ccauuucagagag

SEQ ID NO: 1241810 - RNA, 12 nt, Human
ccauucuuuccc

SEQ ID NO: 1241811 - RNA, 20 nt, Human
ccauucuuccuaguuuucuc

SEQ ID NO: 1241812 - RNA, 14 nt, Human
ccauucuuucccaa

SEQ ID NO: 1241813 - RNA, 20 nt, Human
ccauucuuucccaacaccuc

SEQ ID NO: 1241814 - RNA, 14 nt, Human
ccauucuuccuagu

SEQ ID NO: 1241815 - RNA, 19 nt, Human
ccauucuuccuaguuuucu

SEQ ID NO: 1241816 - RNA, 21 nt, Human
ccaugaguuggggucuggcag

SEQ ID NO: 1241817 - RNA, 22 nt, Human
ccaugaguuggggucuggcagc

SEQ ID NO: 1241818 - RNA, 23 nt, Human
ccaugaguuggggucuggcagcc

SEQ ID NO: 1241819 - RNA, 14 nt, Human
ccaugaucccugug

SEQ ID NO: 1241820 - RNA, 16 nt, Human
ccaugaucccuguguu

SEQ ID NO: 1241821 - RNA, 12 nt, Human
ccaugucgccuc

SEQ ID NO: 1241822 - RNA, 23 nt, Human
ccauguccaaagaggcugccccu

SEQ ID NO: 1241823 - RNA, 15 nt, Human
ccaugucgccucugc

SEQ ID NO: 1241824 - RNA, 16 nt, Human
ccaugucgccucugca

SEQ ID NO: 1241825 - RNA, 17 nt, Human
ccaugucgccucugcau

SEQ ID NO: 1241826 - RNA, 19 nt, Human
ccaugucgccucugcauuc

SEQ ID NO: 1241827 - RNA, 17 nt, Human
ccaugaucccuguguug

SEQ ID NO: 1241828 - RNA, 22 nt, Human
ccaugaucccuguguugucucu

SEQ ID NO: 1241829 - RNA, 19 nt, Human
ccaugaguuccagaaagua

SEQ ID NO: 1241830 - RNA, 21 nt, Human
ccaugaugacuuaguacaaag

SEQ ID NO: 1241831 - RNA, 14 nt, Human
ccaugaugccucug

SEQ ID NO: 1241832 - RNA, 20 nt, Human
ccaugaugccucugucuucu

SEQ ID NO: 1241833 - RNA, 20 nt, Human
ccauguaauggcaguuauau

SEQ ID NO: 1241834 - RNA, 23 nt, Human
ccauguaauggcaguuauauuuu

SEQ ID NO: 1241835 - RNA, 16 nt, Human
ccauguacaugaagaa

SEQ ID NO: 1241836 - RNA, 15 nt, Human
ccauguagaaaauuu

SEQ ID NO: 1241837 - RNA, 16 nt, Human
ccauguagaaaauuug

SEQ ID NO: 1241838 - RNA, 14 nt, Human
ccauaaucuggacu

SEQ ID NO: 1241839 - RNA, 21 nt, Human
ccauaaucuggacuccucugu

SEQ ID NO: 1241840 - RNA, 23 nt, Human
ccaguuggaguuuuuuguaccaa

SEQ ID NO: 1241841 - RNA, 15 nt, Human
ccaguuggaguuuuu

SEQ ID NO: 1241842 - RNA, 13 nt, Human
ccauccauggcca

SEQ ID NO: 1241843 - RNA, 14 nt, Human
ccauccauggccag

SEQ ID NO: 1241844 - RNA, 15 nt, Human
ccauccauggccagc

SEQ ID NO: 1241845 - RNA, 16 nt, Human
ccauccauggccagca

SEQ ID NO: 1241846 - RNA, 17 nt, Human
ccauccauggccagcag

SEQ ID NO: 1241847 - RNA, 18 nt, Human
ccauccauggccagcagc

SEQ ID NO: 1241848 - RNA, 13 nt, Human
ccauccccagcga

SEQ ID NO: 1241849 - RNA, 13 nt, Human
ccaucccaugcug

SEQ ID NO: 1241850 - RNA, 23 nt, Human
ccauccccuugaggucucagccc

SEQ ID NO: 1241851 - RNA, 22 nt, Human
ccauccccuugaggucucagcc

SEQ ID NO: 1241852 - RNA, 16 nt, Human
ccaucccuccccaguu

SEQ ID NO: 1241853 - RNA, 21 nt, Human
ccaguugcugcuucaauuuau

SEQ ID NO: 1241854 - RNA, 19 nt, Human
ccaguuggagcuccagccu

SEQ ID NO: 1241855 - RNA, 22 nt, Human
ccaguuggagcuccagccugac

SEQ ID NO: 1241856 - RNA, 15 nt, Human
ccaguugccaucugc

SEQ ID NO: 1241857 - RNA, 19 nt, Human
ccaguugcagucacucuag

SEQ ID NO: 1241858 - RNA, 14 nt, Human
ccaguugccuuuua

SEQ ID NO: 1241859 - RNA, 19 nt, Human
ccaguucuucgacuguugu

SEQ ID NO: 1241860 - RNA, 18 nt, Human
ccaguugcacucagguga

SEQ ID NO: 1241861 - RNA, 12 nt, Human
ccaguugcaguc

SEQ ID NO: 1241862 - RNA, 18 nt, Human
ccaggcuggagugcagug

SEQ ID NO: 1241863 - RNA, 17 nt, Human
ccaggcuggagugcagu

SEQ ID NO: 1241864 - RNA, 21 nt, Human
ccaggcugcucuugaacuccu

SEQ ID NO: 1241865 - RNA, 14 nt, Human
ccaggcugccgucc

SEQ ID NO: 1241866 - RNA, 21 nt, Human
ccaggcugccguccccuagag

SEQ ID NO: 1241867 - RNA, 14 nt, Human
ccaggcugccgugg

SEQ ID NO: 1241868 - RNA, 15 nt, Human
ccaggcugccguggg

SEQ ID NO: 1241869 - RNA, 18 nt, Human
ccaggcugccguggggcc

SEQ ID NO: 1241870 - RNA, 13 nt, Human
ccaggcugccucc

SEQ ID NO: 1241871 - RNA, 23 nt, Human
ccaggcugccucccuuguggcag

SEQ ID NO: 1241872 - RNA, 17 nt, Human
ccaggcaggucugaagc

SEQ ID NO: 1241873 - RNA, 19 nt, Human
ccaggggaacacuggggac

SEQ ID NO: 1241874 - RNA, 15 nt, Human
ccaggggagcagagg

SEQ ID NO: 1241875 - RNA, 20 nt, Human
ccaggggagcagaggggcag

SEQ ID NO: 1241876 - RNA, 19 nt, Human
ccaggggagcagaggggca

SEQ ID NO: 1241877 - RNA, 20 nt, Human
ccaggauacuggcacagagg

SEQ ID NO: 1241878 - RNA, 21 nt, Human
ccaggauacuggcacagaggu

SEQ ID NO: 1241879 - RNA, 16 nt, Human
ccaggauagagacugg

SEQ ID NO: 1241880 - RNA, 18 nt, Human
ccaggauagagacuggaa

SEQ ID NO: 1241881 - RNA, 18 nt, Human
ccaggaucguuuuuuccc

SEQ ID NO: 1241882 - RNA, 21 nt, Human
ccaggauggaacacggccaca

SEQ ID NO: 1241883 - RNA, 17 nt, Human
ccaggggggugaggagc

SEQ ID NO: 1241884 - RNA, 19 nt, Human
ccaggggggugaggagcug

SEQ ID NO: 1241885 - RNA, 20 nt, Human
ccaggggggugaggagcugg

SEQ ID NO: 1241886 - RNA, 15 nt, Human
ccagucaggcccagg

SEQ ID NO: 1241887 - RNA, 13 nt, Human
ccaguccaggcug

SEQ ID NO: 1241888 - RNA, 14 nt, Human
ccaguccaggcugc

SEQ ID NO: 1241889 - RNA, 15 nt, Human
ccaguccaggcugcc

SEQ ID NO: 1241890 - RNA, 16 nt, Human
ccaguccaggcugccg

SEQ ID NO: 1241891 - RNA, 19 nt, Human
ccaguccaggcugccgugg

SEQ ID NO: 1241892 - RNA, 18 nt, Human
ccagucccccugccccag

SEQ ID NO: 1241893 - RNA, 17 nt, Human
ccaguccaccugaggaa

SEQ ID NO: 1241894 - RNA, 14 nt, Human
ccaguccaguccua

SEQ ID NO: 1241895 - RNA, 13 nt, Human
ccagucccagagc

SEQ ID NO: 1241896 - RNA, 15 nt, Human
ccagucccagagcag

SEQ ID NO: 1241897 - RNA, 16 nt, Human
ccaguccuaucugggc

SEQ ID NO: 1241898 - RNA, 17 nt, Human
ccaguccuaucugggcu

SEQ ID NO: 1241899 - RNA, 18 nt, Human
ccaguccuaucugggcuu

SEQ ID NO: 1241900 - RNA, 21 nt, Human
ccaguccuaucugggcuuccu

SEQ ID NO: 1241901 - RNA, 19 nt, Human
ccaguccuaucugggcuuc

SEQ ID NO: 1241902 - RNA, 23 nt, Human
ccagcuuuucccaaaagcccauu

SEQ ID NO: 1241903 - RNA, 13 nt, Human
ccagcuuuuccca

SEQ ID NO: 1241904 - RNA, 13 nt, Human
ccagcuuuucaaa

SEQ ID NO: 1241905 - RNA, 20 nt, Human
ccagcuuugcuaccaaagca

SEQ ID NO: 1241906 - RNA, 18 nt, Human
ccagcagacagagccagg

SEQ ID NO: 1241907 - RNA, 19 nt, Human
ccagcagacagagccagga

SEQ ID NO: 1241908 - RNA, 20 nt, Human
ccagcagacagagccaggag

SEQ ID NO: 1241909 - RNA, 22 nt, Human
ccagcagacagagccaggagaa

SEQ ID NO: 1241910 - RNA, 16 nt, Human
ccagcacuuguccagc

SEQ ID NO: 1241911 - RNA, 19 nt, Human
ccagcacuuguccagcuga

SEQ ID NO: 1241912 - RNA, 20 nt, Human
ccagcacuuguccagcugag

SEQ ID NO: 1241913 - RNA, 22 nt, Human
ccacuccucugcugaccugcug

SEQ ID NO: 1241914 - RNA, 13 nt, Human
ccacuccuuccug

SEQ ID NO: 1241915 - RNA, 14 nt, Human
ccacuccuuccugc

SEQ ID NO: 1241916 - RNA, 18 nt, Human
ccacuccuuccugcccca

SEQ ID NO: 1241917 - RNA, 16 nt, Human
ccacuccuuccugccc

SEQ ID NO: 1241918 - RNA, 15 nt, Human
ccacucuaaagcaaa

SEQ ID NO: 1241919 - RNA, 17 nt, Human
ccagcacuuccauggga

SEQ ID NO: 1241920 - RNA, 21 nt, Human
ccagcagacagagccaggaga

SEQ ID NO: 1241921 - RNA, 13 nt, Human
ccagccccucugg

SEQ ID NO: 1241922 - RNA, 14 nt, Human
ccagccccucuggu

SEQ ID NO: 1241923 - RNA, 15 nt, Human
ccagcuacuuccucc

SEQ ID NO: 1241924 - RNA, 17 nt, Human
ccagcuacuuccuccuc

SEQ ID NO: 1241925 - RNA, 23 nt, Human
ccagcuaggaagagcaggacucc

SEQ ID NO: 1241926 - RNA, 14 nt, Human
ccagcuagugaccc

SEQ ID NO: 1241927 - RNA, 18 nt, Human
ccagcuagugacccacau

SEQ ID NO: 1241928 - RNA, 20 nt, Human
ccagcuagugacccacaugc

SEQ ID NO: 1241929 - RNA, 22 nt, Human
ccagcuagugacccacaugcca

SEQ ID NO: 1241930 - RNA, 22 nt, Human
ccagcuauguuauauugaaaaa

SEQ ID NO: 1241931 - RNA, 21 nt, Human
ccagcuagugacccacaugcc

SEQ ID NO: 1241932 - RNA, 17 nt, Human
ccagcucaauggacugg

SEQ ID NO: 1241933 - RNA, 14 nt, Human
ccagcuccaaccug

SEQ ID NO: 1241934 - RNA, 15 nt, Human
ccagcuccaaccugc

SEQ ID NO: 1241935 - RNA, 20 nt, Human
ccagcuccaaccugcaaaga

SEQ ID NO: 1241936 - RNA, 22 nt, Human
ccagcuccaaggggaaucagaa

SEQ ID NO: 1241937 - RNA, 15 nt, Human
ccagcucccaccucc

SEQ ID NO: 1241938 - RNA, 19 nt, Human
ccagcucccaccuccccuu

SEQ ID NO: 1241939 - RNA, 22 nt, Human
ccagcucccaccuccccuuggg

SEQ ID NO: 1241940 - RNA, 12 nt, Human
ccagcucccagg

SEQ ID NO: 1241941 - RNA, 13 nt, Human
ccagcucccagga

SEQ ID NO: 1241942 - RNA, 20 nt, Human
ccagcucccaggaccacagg

SEQ ID NO: 1241943 - RNA, 21 nt, Human
ccagcucccaggaccacaggc

SEQ ID NO: 1241944 - RNA, 23 nt, Human
ccagcucccaggaccacaggcuc

SEQ ID NO: 1241945 - RNA, 16 nt, Human
ccagcucccccucccu

SEQ ID NO: 1241946 - RNA, 15 nt, Human
ccagcucccccuccc

SEQ ID NO: 1241947 - RNA, 21 nt, Human
ccagcuuguuuacaugcuuau

SEQ ID NO: 1241948 - RNA, 12 nt, Human
ccagcuuucccu

SEQ ID NO: 1241949 - RNA, 14 nt, Human
ccagcuuucccugc

SEQ ID NO: 1241950 - RNA, 18 nt, Human
ccagcuuucccugccucu

SEQ ID NO: 1241951 - RNA, 23 nt, Human
ccagcuuguuuacaugcuuauuc

SEQ ID NO: 1241952 - RNA, 12 nt, Human
ccagcuuuccug

SEQ ID NO: 1241953 - RNA, 17 nt, Human
ccccugaauuuaaauag

SEQ ID NO: 1241954 - RNA, 17 nt, Human
ccccugaccacucagag

SEQ ID NO: 1241955 - RNA, 18 nt, Human
ccccugcaaagcccagcu

SEQ ID NO: 1241956 - RNA, 20 nt, Human
ccccugcaaagcccagcuug

SEQ ID NO: 1241957 - RNA, 13 nt, Human
ccccugcacucca

SEQ ID NO: 1241958 - RNA, 21 nt, Human
ccccugcaaagcccagcuuga

SEQ ID NO: 1241959 - RNA, 16 nt, Human
ccccugaccacucaga

SEQ ID NO: 1241960 - RNA, 13 nt, Human
ccccugaauuuaa

SEQ ID NO: 1241961 - RNA, 23 nt, Human
ccccucuuggagaagucucagcu

SEQ ID NO: 1241962 - RNA, 16 nt, Human
ccccucuggcuccagc

SEQ ID NO: 1241963 - RNA, 18 nt, Human
ccccucuggcuccagcug

SEQ ID NO: 1241964 - RNA, 14 nt, Human
ccccucuuggagaa

SEQ ID NO: 1241965 - RNA, 22 nt, Human
ccccucuuggagaagucucagc

SEQ ID NO: 1241966 - RNA, 17 nt, Human
ccccugccaccuccugc

SEQ ID NO: 1241967 - RNA, 15 nt, Human
ccccugccaccuccu

SEQ ID NO: 1241968 - RNA, 12 nt, Human
ccccugccacca

SEQ ID NO: 1241969 - RNA, 20 nt, Human
ccccugccaccaggccaccu

SEQ ID NO: 1241970 - RNA, 14 nt, Human
ccccugccagggca

SEQ ID NO: 1241971 - RNA, 15 nt, Human
ccccugccagggcag

SEQ ID NO: 1241972 - RNA, 19 nt, Human
ccccugccagggcagggcc

SEQ ID NO: 1241973 - RNA, 23 nt, Human
ccccugccagggcagggccccag

SEQ ID NO: 1241974 - RNA, 11 nt, Human
ccccugccccc

SEQ ID NO: 1241975 - RNA, 17 nt, Human
ccccugccccccagccu

SEQ ID NO: 1241976 - RNA, 23 nt, Human
ccccucugcccugcgggucacag

SEQ ID NO: 1241977 - RNA, 16 nt, Human
ccccucugcugcuguc

SEQ ID NO: 1241978 - RNA, 15 nt, Human
ccccucugcccugcg

SEQ ID NO: 1241979 - RNA, 20 nt, Human
ccccucugcccugcggguca

SEQ ID NO: 1241980 - RNA, 18 nt, Human
cccucaaccucauccucu

SEQ ID NO: 1241981 - RNA, 16 nt, Human
cccucacccuggggcu

SEQ ID NO: 1241982 - RNA, 14 nt, Human
cccucaccuccucu

SEQ ID NO: 1241983 - RNA, 17 nt, Human
cccggcuaauuuuugua

SEQ ID NO: 1241984 - RNA, 23 nt, Human
cccucagccucuccccugccugc

SEQ ID NO: 1241985 - RNA, 21 nt, Human
cccucaccuguagcagccagu

SEQ ID NO: 1241986 - RNA, 16 nt, Human
cccucaccuucugagu

SEQ ID NO: 1241987 - RNA, 20 nt, Human
cccucaccuuggcaccagac

SEQ ID NO: 1241988 - RNA, 21 nt, Human
cccucaccuuggcaccagaca

SEQ ID NO: 1241989 - RNA, 23 nt, Human
cccucaccuuggcaccagacacc

SEQ ID NO: 1241990 - RNA, 17 nt, Human
cccucacucgucucccc

SEQ ID NO: 1241991 - RNA, 20 nt, Human
cccucagccucuccccugcc

SEQ ID NO: 1241992 - RNA, 20 nt, Human
cccggcuaauuuuuguauuu

SEQ ID NO: 1241993 - RNA, 15 nt, Human
ccccugcccccugca

SEQ ID NO: 1241994 - RNA, 16 nt, Human
cccuccucucugcccu

SEQ ID NO: 1241995 - RNA, 15 nt, Human
cccuccucucugccc

SEQ ID NO: 1241996 - RNA, 13 nt, Human
cccuccuggcucu

SEQ ID NO: 1241997 - RNA, 17 nt, Human
cccuccuggugccaccu

SEQ ID NO: 1241998 - RNA, 18 nt, Human
cccuccugugcucagccc

SEQ ID NO: 1241999 - RNA, 19 nt, Human
cccuccugugcucagcccu

SEQ ID NO: 1242000 - RNA, 18 nt, Human
cccagcacagcuugaccu

SEQ ID NO: 1242001 - RNA, 19 nt, Human
cccagcacagcuugaccug

SEQ ID NO: 1242002 - RNA, 16 nt, Human
cccacuggacucaccu

SEQ ID NO: 1242003 - RNA, 12 nt, Human
cccacuggagca

SEQ ID NO: 1242004 - RNA, 13 nt, Human
cccacuggagcag

SEQ ID NO: 1242005 - RNA, 22 nt, Human
cccacuggagcagaaggggaga

SEQ ID NO: 1242006 - RNA, 19 nt, Human
cccagcacaugugcugccc

SEQ ID NO: 1242007 - RNA, 23 nt, Human
cccagccagcgucggucugugcc

SEQ ID NO: 1242008 - RNA, 11 nt, Human
cccagccagcg

SEQ ID NO: 1242009 - RNA, 13 nt, Human
cccagccaggccc

SEQ ID NO: 1242010 - RNA, 17 nt, Human
cccagccaggcccagcc

SEQ ID NO: 1242011 - RNA, 13 nt, Human
cccagccauccag

SEQ ID NO: 1242012 - RNA, 19 nt, Human
cccagccagggcucaaucu

SEQ ID NO: 1242013 - RNA, 21 nt, Human
cccagccagggcucaaucucu

SEQ ID NO: 1242014 - RNA, 14 nt, Human
cccagccaggccca

SEQ ID NO: 1242015 - RNA, 15 nt, Human
cccagccaggcccag

SEQ ID NO: 1242016 - RNA, 16 nt, Human
cccagccaggcccagc

SEQ ID NO: 1242017 - RNA, 16 nt, Human
cccagccagggcucaa

SEQ ID NO: 1242018 - RNA, 22 nt, Human
cccagccagggcucaaucucug

SEQ ID NO: 1242019 - RNA, 20 nt, Human
cccagcuggggccaggcugg

SEQ ID NO: 1242020 - RNA, 16 nt, Human
cccaggcugagccuca

SEQ ID NO: 1242021 - RNA, 17 nt, Human
cccaggcugagccucag

SEQ ID NO: 1242022 - RNA, 15 nt, Human
cccagggaagcagca

SEQ ID NO: 1242023 - RNA, 17 nt, Human
cccagggaagcagcagc

SEQ ID NO: 1242024 - RNA, 19 nt, Human
cccagggaagcagcagccu

SEQ ID NO: 1242025 - RNA, 20 nt, Human
cccagggaagcagcagccuc

SEQ ID NO: 1242026 - RNA, 18 nt, Human
cccaggcugagccucagu

SEQ ID NO: 1242027 - RNA, 12 nt, Human
cccaggcugccg

SEQ ID NO: 1242028 - RNA, 14 nt, Human
cccaggcugccguc

SEQ ID NO: 1242029 - RNA, 15 nt, Human
cccaggcugccgucc

SEQ ID NO: 1242030 - RNA, 13 nt, Human
cccaggcuggagu

SEQ ID NO: 1242031 - RNA, 22 nt, Human
cccaggcugccguccccuagag

SEQ ID NO: 1242032 - RNA, 23 nt, Human
cccagggaagcagcagccucgcc

SEQ ID NO: 1242033 - RNA, 18 nt, Human
cccagggacaccugggag

SEQ ID NO: 1242034 - RNA, 19 nt, Human
cccagggacaccugggaga

SEQ ID NO: 1242035 - RNA, 20 nt, Human
cccaucaccuacucacacag

SEQ ID NO: 1242036 - RNA, 21 nt, Human
cccaucaccuacucacacagg

SEQ ID NO: 1242037 - RNA, 22 nt, Human
cccaucaccuacucacacaggc

SEQ ID NO: 1242038 - RNA, 23 nt, Human
cccaucaccuacucacacaggca

SEQ ID NO: 1242039 - RNA, 22 nt, Human
cccaucagugcucccucacaug

SEQ ID NO: 1242040 - RNA, 23 nt, Human
cccaucagugcucccucacaugu

SEQ ID NO: 1242041 - RNA, 14 nt, Human
cccaucaggguagg

SEQ ID NO: 1242042 - RNA, 15 nt, Human
cccaucccuccccag

SEQ ID NO: 1242043 - RNA, 16 nt, Human
cccaucccuccccagu

SEQ ID NO: 1242044 - RNA, 15 nt, Human
cccauccugaccagc

SEQ ID NO: 1242045 - RNA, 18 nt, Human
cccauccuguggucacug

SEQ ID NO: 1242046 - RNA, 22 nt, Human
cccauccuguguguuaagcucu

SEQ ID NO: 1242047 - RNA, 17 nt, Human
ccccagaggcuggguga

SEQ ID NO: 1242048 - RNA, 11 nt, Human
ccccagauauc

SEQ ID NO: 1242049 - RNA, 20 nt, Human
ccccagcccagggcuccugc

SEQ ID NO: 1242050 - RNA, 21 nt, Human
ccccagcccagggcuccugca

SEQ ID NO: 1242051 - RNA, 12 nt, Human
ccccagcccaga

SEQ ID NO: 1242052 - RNA, 13 nt, Human
ccccagcccagag

SEQ ID NO: 1242053 - RNA, 15 nt, Human
ccccagcccagagac

SEQ ID NO: 1242054 - RNA, 16 nt, Human
ccccagcccagagaca

SEQ ID NO: 1242055 - RNA, 12 nt, Human
ccccagcccagg

SEQ ID NO: 1242056 - RNA, 14 nt, Human
ccccagcccagggc

SEQ ID NO: 1242057 - RNA, 15 nt, Human
ccccagcccagggcu

SEQ ID NO: 1242058 - RNA, 19 nt, Human
ccccauggagcugggcuaa

SEQ ID NO: 1242059 - RNA, 13 nt, Human
ccccauggcccug

SEQ ID NO: 1242060 - RNA, 16 nt, Human
ccccauggcccugagc

SEQ ID NO: 1242061 - RNA, 17 nt, Human
ccccauggcccugagcg

SEQ ID NO: 1242062 - RNA, 19 nt, Human
ccccauggucagcccuagg

SEQ ID NO: 1242063 - RNA, 21 nt, Human
ccccauggugcuaggaagagg

SEQ ID NO: 1242064 - RNA, 20 nt, Human
ccccauggugcuaggaagag

SEQ ID NO: 1242065 - RNA, 14 nt, Human
ccccauguguccug

SEQ ID NO: 1242066 - RNA, 16 nt, Human
ccccauguguccuggu

SEQ ID NO: 1242067 - RNA, 18 nt, Human
ccccauguguccugguuc

SEQ ID NO: 1242068 - RNA, 23 nt, Human
ccccauguguccugguucccguu

SEQ ID NO: 1242069 - RNA, 15 nt, Human
ccccauguucugucc

SEQ ID NO: 1242070 - RNA, 13 nt, Human
ccccauucccgca

SEQ ID NO: 1242071 - RNA, 13 nt, Human
cccauuucugagg

SEQ ID NO: 1242072 - RNA, 17 nt, Human
cccauuuugaaucacau

SEQ ID NO: 1242073 - RNA, 12 nt, Human
cccauuuuuccu

SEQ ID NO: 1242074 - RNA, 13 nt, Human
cccauuuuuccuu

SEQ ID NO: 1242075 - RNA, 14 nt, Human
ccccgcagacaccu

SEQ ID NO: 1242076 - RNA, 20 nt, Human
cccccuuuccuggacacuca

SEQ ID NO: 1242077 - RNA, 14 nt, Human
cccccuugaguggg

SEQ ID NO: 1242078 - RNA, 20 nt, Human
cccccuuuagaucucugaag

SEQ ID NO: 1242079 - RNA, 21 nt, Human
cccccuuuagaucucugaagc

SEQ ID NO: 1242080 - RNA, 17 nt, Human
cccccuuucacaggcag

SEQ ID NO: 1242081 - RNA, 22 nt, Human
cccccuuucacaggcagccagu

SEQ ID NO: 1242082 - RNA, 18 nt, Human
cccccuuucacaggcagc

SEQ ID NO: 1242083 - RNA, 12 nt, Human
cccccuuuccug

SEQ ID NO: 1242084 - RNA, 21 nt, Human
cacucuguucauuccuccagg

SEQ ID NO: 1242085 - RNA, 20 nt, Human
cacucuguucauuccuccag

SEQ ID NO: 1242086 - RNA, 19 nt, Human
cacucuguucauuccucca

SEQ ID NO: 1242087 - RNA, 18 nt, Human
cacucuguucauuccucc

SEQ ID NO: 1242088 - RNA, 17 nt, Human
cacucuguucauuccuc

SEQ ID NO: 1242089 - RNA, 23 nt, Human
cacuaccgaaugugucuuuagau

SEQ ID NO: 1242090 - RNA, 23 nt, Human
cacuccagccugagcgacaguga

SEQ ID NO: 1242091 - RNA, 20 nt, Human
cacuaccgaaugugucuuua

SEQ ID NO: 1242092 - RNA, 13 nt, Human
cacuccagccuga

SEQ ID NO: 1242093 - RNA, 21 nt, Human
cacuacacccagcaauagaga

SEQ ID NO: 1242094 - RNA, 12 nt, Human
cacggccuuucu

SEQ ID NO: 1242095 - RNA, 20 nt, Human
cacggccuuucuagccuggc

SEQ ID NO: 1242096 - RNA, 20 nt, Human
cacggccacacagcugccgg

SEQ ID NO: 1242097 - RNA, 16 nt, Human
cacggccacacagcug

SEQ ID NO: 1242098 - RNA, 17 nt, Human
cacggccacacagcugc

SEQ ID NO: 1242099 - RNA, 18 nt, Human
cacggccacacagcugcc

SEQ ID NO: 1242100 - RNA, 19 nt, Human
cacggccacacagcugccg

SEQ ID NO: 1242101 - RNA, 13 nt, Human
cacggccacauca

SEQ ID NO: 1242102 - RNA, 19 nt, Human
cacggccacaucaaagagg

SEQ ID NO: 1242103 - RNA, 22 nt, Human
cacucuguucauuccuccaggu

SEQ ID NO: 1242104 - RNA, 14 nt, Human
cacucuucauggug

SEQ ID NO: 1242105 - RNA, 23 nt, Human
caccuuuauucuggcagaggagg

SEQ ID NO: 1242106 - RNA, 13 nt, Human
caccugcccaacc

SEQ ID NO: 1242107 - RNA, 17 nt, Human
caccucagauggcagcu

SEQ ID NO: 1242108 - RNA, 18 nt, Human
caccucagauggcagcuu

SEQ ID NO: 1242109 - RNA, 19 nt, Human
caccucagauggcagcuuu

SEQ ID NO: 1242110 - RNA, 20 nt, Human
caccucagauggcagcuuuu

SEQ ID NO: 1242111 - RNA, 18 nt, Human
caccugcccaaccugcuc

SEQ ID NO: 1242112 - RNA, 19 nt, Human
caccugcccaaccugcucu

SEQ ID NO: 1242113 - RNA, 21 nt, Human
caccucagauggcagcuuuua

SEQ ID NO: 1242114 - RNA, 15 nt, Human
caccugccccaacuc

SEQ ID NO: 1242115 - RNA, 16 nt, Human
caccugccccaacucu

SEQ ID NO: 1242116 - RNA, 17 nt, Human
caccuuuguuucucccc

SEQ ID NO: 1242117 - RNA, 12 nt, Human
caccuuucuagu

SEQ ID NO: 1242118 - RNA, 13 nt, Human
caccuuucuaguu

SEQ ID NO: 1242119 - RNA, 17 nt, Human
caccuuucuaguugaaa

SEQ ID NO: 1242120 - RNA, 17 nt, Human
cacgaaauguuauuuuu

SEQ ID NO: 1242121 - RNA, 13 nt, Human
cacgaaauguuau

SEQ ID NO: 1242122 - RNA, 15 nt, Human
cacgaaauguuauuu

SEQ ID NO: 1242123 - RNA, 16 nt, Human
cacgaaauguuauuuu

SEQ ID NO: 1242124 - RNA, 19 nt, Human
caccuuuguuucuccccca

SEQ ID NO: 1242125 - RNA, 17 nt, Human
caccuuuuuucaacagu

SEQ ID NO: 1242126 - RNA, 20 nt, Human
caccucagagacauacaccu

SEQ ID NO: 1242127 - RNA, 12 nt, Human
caccucagaugg

SEQ ID NO: 1242128 - RNA, 13 nt, Human
caccucagauggc

SEQ ID NO: 1242129 - RNA, 17 nt, Human
caccuaggcuagggugg

SEQ ID NO: 1242130 - RNA, 14 nt, Human
caccuagcagcacc

SEQ ID NO: 1242131 - RNA, 13 nt, Human
caccuagcugaau

SEQ ID NO: 1242132 - RNA, 14 nt, Human
caccuagcugaaug

SEQ ID NO: 1242133 - RNA, 18 nt, Human
caccuagcugaauguuuu

SEQ ID NO: 1242134 - RNA, 19 nt, Human
caccuagcugaauguuuuu

SEQ ID NO: 1242135 - RNA, 21 nt, Human
caccuagcugaauguuuuucu

SEQ ID NO: 1242136 - RNA, 22 nt, Human
caccuagcugaauguuuuucua

SEQ ID NO: 1242137 - RNA, 23 nt, Human
caccuagcugaauguuuuucuaa

SEQ ID NO: 1242138 - RNA, 17 nt, Human
caccuaggaagccucag

SEQ ID NO: 1242139 - RNA, 18 nt, Human
caccuaggaagccucaga

SEQ ID NO: 1242140 - RNA, 24 nt, Human
caccuaggaagccucagauuccuu

SEQ ID NO: 1242141 - RNA, 19 nt, Human
caccuaggaagccucagau

SEQ ID NO: 1242142 - RNA, 12 nt, Human
caccuacugagu

SEQ ID NO: 1242143 - RNA, 18 nt, Human
cacuuuagaauaugccuu

SEQ ID NO: 1242144 - RNA, 20 nt, Human
cacuuuaauuaccaaccugu

SEQ ID NO: 1242145 - RNA, 22 nt, Human
cacuuuacacaauagaauuaua

SEQ ID NO: 1242146 - RNA, 17 nt, Human
cacuuguguuuugcaag

SEQ ID NO: 1242147 - RNA, 19 nt, Human
cacuuguugauuaauggaa

SEQ ID NO: 1242148 - RNA, 19 nt, Human
cacuuuaaaauaucuacau

SEQ ID NO: 1242149 - RNA, 15 nt, Human
cacuuaauguauguu

SEQ ID NO: 1242150 - RNA, 22 nt, Human
cacuuguggguuuuuguuuugu

SEQ ID NO: 1242151 - RNA, 20 nt, Human
cacuuaaguuaguuccacug

SEQ ID NO: 1242152 - RNA, 22 nt, Human
cacuuaaguuaguuccacugag

SEQ ID NO: 1242153 - RNA, 12 nt, Human
cacuuaauguau

SEQ ID NO: 1242154 - RNA, 14 nt, Human
cacuuaauguaugu

SEQ ID NO: 1242155 - RNA, 12 nt, Human
cacuuaacaaac

SEQ ID NO: 1242156 - RNA, 18 nt, Human
cacuuaacaaacaaauuu

SEQ ID NO: 1242157 - RNA, 23 nt, Human
cacuuaaccaagacaaaaagcca

SEQ ID NO: 1242158 - RNA, 19 nt, Human
cacugggagaaaugaaaaa

SEQ ID NO: 1242159 - RNA, 13 nt, Human
cacugggcuucua

SEQ ID NO: 1242160 - RNA, 20 nt, Human
cacugggaggcuccccuucu

SEQ ID NO: 1242161 - RNA, 18 nt, Human
cacugggaggcuccccuu

SEQ ID NO: 1242162 - RNA, 14 nt, Human
cacugggugguggc

SEQ ID NO: 1242163 - RNA, 15 nt, Human
cacugggugguggcc

SEQ ID NO: 1242164 - RNA, 17 nt, Human
cacugggugguggccug

SEQ ID NO: 1242165 - RNA, 18 nt, Human
cacugggugguggccugg

SEQ ID NO: 1242166 - RNA, 22 nt, Human
cacugggugguggccugguccc

SEQ ID NO: 1242167 - RNA, 20 nt, Human
cacugggugguggccugguc

SEQ ID NO: 1242168 - RNA, 20 nt, Human
cacugguagaccaaaauaaa

SEQ ID NO: 1242169 - RNA, 15 nt, Human
cacuuaaaaaugguu

SEQ ID NO: 1242170 - RNA, 23 nt, Human
cacuguuuucuaguguaucaaaa

SEQ ID NO: 1242171 - RNA, 21 nt, Human
cacuguuuucuaguguaucaa

SEQ ID NO: 1242172 - RNA, 15 nt, Human
cacuuaaacuugcau

SEQ ID NO: 1242173 - RNA, 17 nt, Human
cacuguuuucuagugua

SEQ ID NO: 1242174 - RNA, 16 nt, Human
cacuguuuucuagugu

SEQ ID NO: 1242175 - RNA, 14 nt, Human
cacuguuuucuagu

SEQ ID NO: 1242176 - RNA, 11 nt, Human
cacuguuuaag

SEQ ID NO: 1242177 - RNA, 22 nt, Human
cacuguuuguuuacaaaaucag

SEQ ID NO: 1242178 - RNA, 18 nt, Human
cacugccauaugauuuac

SEQ ID NO: 1242179 - RNA, 14 nt, Human
cagaaauacaauuu

SEQ ID NO: 1242180 - RNA, 14 nt, Human
cagaaauacuacug

SEQ ID NO: 1242181 - RNA, 22 nt, Human
cagaaagggagggcucugaggc

SEQ ID NO: 1242182 - RNA, 12 nt, Human
cagaaagugccu

SEQ ID NO: 1242183 - RNA, 14 nt, Human
cagaaagugccuga

SEQ ID NO: 1242184 - RNA, 15 nt, Human
cagaaagugccugac

SEQ ID NO: 1242185 - RNA, 16 nt, Human
cagaaagugccugaca

SEQ ID NO: 1242186 - RNA, 19 nt, Human
cagaaagugccugacacac

SEQ ID NO: 1242187 - RNA, 23 nt, Human
cagaaagugccugacacacuaac

SEQ ID NO: 1242188 - RNA, 15 nt, Human
cagaaagugccuuuc

SEQ ID NO: 1242189 - RNA, 16 nt, Human
cagaaagugccuuuca

SEQ ID NO: 1242190 - RNA, 17 nt, Human
cagaaagugccuuucag

SEQ ID NO: 1242191 - RNA, 18 nt, Human
cagaaagugccuuucagg

SEQ ID NO: 1242192 - RNA, 19 nt, Human
cagaaagugccuuucagga

SEQ ID NO: 1242193 - RNA, 22 nt, Human
cagaaagugccuuucaggaucu

SEQ ID NO: 1242194 - RNA, 23 nt, Human
cagaaagugccuuucaggaucua

SEQ ID NO: 1242195 - RNA, 16 nt, Human
cagaaaggaaaaacaa

SEQ ID NO: 1242196 - RNA, 17 nt, Human
cagaaaggaaaaacaaa

SEQ ID NO: 1242197 - RNA, 19 nt, Human
cagaaaggaaaaacaaacu

SEQ ID NO: 1242198 - RNA, 15 nt, Human
cagaaagggagggcu

SEQ ID NO: 1242199 - RNA, 20 nt, Human
cagaaaggacuccuccuuuu

SEQ ID NO: 1242200 - RNA, 16 nt, Human
cagaaagggagggcuc

SEQ ID NO: 1242201 - RNA, 17 nt, Human
cagaaagggagggcucu

SEQ ID NO: 1242202 - RNA, 18 nt, Human
cagaaagggagggcucug

SEQ ID NO: 1242203 - RNA, 19 nt, Human
cagaaagggagggcucuga

SEQ ID NO: 1242204 - RNA, 20 nt, Human
cagaaagggagggcucugag

SEQ ID NO: 1242205 - RNA, 21 nt, Human
cagaaagggagggcucugagg

SEQ ID NO: 1242206 - RNA, 23 nt, Human
cagaaagggagggcucugaggcg

SEQ ID NO: 1242207 - RNA, 18 nt, Human
cagaacagugauuaccag

SEQ ID NO: 1242208 - RNA, 19 nt, Human
cagaaguuucucagcuccc

SEQ ID NO: 1242209 - RNA, 17 nt, Human
cagaacagugauuacca

SEQ ID NO: 1242210 - RNA, 12 nt, Human
cagaacagugau

SEQ ID NO: 1242211 - RNA, 11 nt, Human
cagaacaguga

SEQ ID NO: 1242212 - RNA, 22 nt, Human
cagaaauauuugugacaaaaaa

SEQ ID NO: 1242213 - RNA, 21 nt, Human
cagaaauauuugugacaaaaa

SEQ ID NO: 1242214 - RNA, 21 nt, Human
cagaaaugaggagacacaccu

SEQ ID NO: 1242215 - RNA, 23 nt, Human
cagaaaugaggccauggacucug

SEQ ID NO: 1242216 - RNA, 20 nt, Human
cagaaaugaggccauggacu

SEQ ID NO: 1242217 - RNA, 20 nt, Human
caauaaaauccauacauuug

SEQ ID NO: 1242218 - RNA, 23 nt, Human
caauaaaauccauacauuugugu

SEQ ID NO: 1242219 - RNA, 20 nt, Human
caauaaaaauguuuaacggu

SEQ ID NO: 1242220 - RNA, 14 nt, Human
caauaaaacauuaa

SEQ ID NO: 1242221 - RNA, 15 nt, Human
caauaaaacauuaau

SEQ ID NO: 1242222 - RNA, 16 nt, Human
caaguuucauccagaa

SEQ ID NO: 1242223 - RNA, 20 nt, Human
caaguuucauccagaacuac

SEQ ID NO: 1242224 - RNA, 13 nt, Human
caaguuucaucca

SEQ ID NO: 1242225 - RNA, 22 nt, Human
caaguuuaucaguaaauaacug

SEQ ID NO: 1242226 - RNA, 20 nt, Human
caaguuuaucaguaaauaac

SEQ ID NO: 1242227 - RNA, 21 nt, Human
caaggccugguguuucuugau

SEQ ID NO: 1242228 - RNA, 22 nt, Human
caaggccugguguuucuugaua

SEQ ID NO: 1242229 - RNA, 22 nt, Human
caaggccuuauuggaaagcagu

SEQ ID NO: 1242230 - RNA, 15 nt, Human
caaggcucugagcaa

SEQ ID NO: 1242231 - RNA, 13 nt, Human
caaggcggugcuu

SEQ ID NO: 1242232 - RNA, 16 nt, Human
caaggcggugcuugau

SEQ ID NO: 1242233 - RNA, 21 nt, Human
caagucagucauucagauaug

SEQ ID NO: 1242234 - RNA, 23 nt, Human
caagucaguccaggaugcuaaca

SEQ ID NO: 1242235 - RNA, 20 nt, Human
caagucauagguuaauauuu

SEQ ID NO: 1242236 - RNA, 19 nt, Human
caagucaggcccuuauuuu

SEQ ID NO: 1242237 - RNA, 22 nt, Human
caagauuguuccugcuuuuccc

SEQ ID NO: 1242238 - RNA, 14 nt, Human
caaggcacucuaga

SEQ ID NO: 1242239 - RNA, 15 nt, Human
caaggcacucuagau

SEQ ID NO: 1242240 - RNA, 13 nt, Human
caagauucuagau

SEQ ID NO: 1242241 - RNA, 14 nt, Human
caagauucuagaug

SEQ ID NO: 1242242 - RNA, 17 nt, Human
caagauucuagaugauu

SEQ ID NO: 1242243 - RNA, 18 nt, Human
caagauucuagaugauua

SEQ ID NO: 1242244 - RNA, 16 nt, Human
caagauugagcucucu

SEQ ID NO: 1242245 - RNA, 17 nt, Human
caagauugagcucucug

SEQ ID NO: 1242246 - RNA, 19 nt, Human
caagauugagcucucugcc

SEQ ID NO: 1242247 - RNA, 20 nt, Human
caagauugagcucucugccc

SEQ ID NO: 1242248 - RNA, 23 nt, Human
caagauugagcucucugcccuug

SEQ ID NO: 1242249 - RNA, 20 nt, Human
caagauugguguuuuuuucu

SEQ ID NO: 1242250 - RNA, 21 nt, Human
caagauugguguuuuuuucua

SEQ ID NO: 1242251 - RNA, 22 nt, Human
caagauugguguuuuuuucuau

SEQ ID NO: 1242252 - RNA, 15 nt, Human
caagauuguguccca

SEQ ID NO: 1242253 - RNA, 20 nt, Human
caagauugugucccauuccc

SEQ ID NO: 1242254 - RNA, 16 nt, Human
caaggcacucuagauu

SEQ ID NO: 1242255 - RNA, 17 nt, Human
caaggcacucuagauuc

SEQ ID NO: 1242256 - RNA, 19 nt, Human
caaggcacucuagauucca

SEQ ID NO: 1242257 - RNA, 13 nt, Human
caaggcccgagca

SEQ ID NO: 1242258 - RNA, 14 nt, Human
caaggcccgagcag

SEQ ID NO: 1242259 - RNA, 16 nt, Human
caaggcccgagcagcu

SEQ ID NO: 1242260 - RNA, 17 nt, Human
caaggcccgagcagcug

SEQ ID NO: 1242261 - RNA, 18 nt, Human
caaggcccgagcagcuga

SEQ ID NO: 1242262 - RNA, 19 nt, Human
caaggcccgagcagcugag

SEQ ID NO: 1242263 - RNA, 21 nt, Human
caaggcccgagcagcugagca

SEQ ID NO: 1242264 - RNA, 20 nt, Human
caaggcccgagcagcugagc

SEQ ID NO: 1242265 - RNA, 20 nt, Human
caauaaaaucuugaaaaugc

SEQ ID NO: 1242266 - RNA, 20 nt, Human
caauaaaauuauagcucuaa

SEQ ID NO: 1242267 - RNA, 13 nt, Human
caauaaaauuaua

SEQ ID NO: 1242268 - RNA, 23 nt, Human
caauaaaauuauagcucuaaugu

SEQ ID NO: 1242269 - RNA, 23 nt, Human
caauugagaaaaauauauacuaa

SEQ ID NO: 1242270 - RNA, 14 nt, Human
caauugagaaaaau

SEQ ID NO: 1242271 - RNA, 21 nt, Human
caauugacaacaguuacauaa

SEQ ID NO: 1242272 - RNA, 22 nt, Human
caauugacaacaguuacauaau

SEQ ID NO: 1242273 - RNA, 19 nt, Human
caauugacugucacuguuc

SEQ ID NO: 1242274 - RNA, 21 nt, Human
caauugcacgcggagugaguu

SEQ ID NO: 1242275 - RNA, 14 nt, Human
caauugcaucuccc

SEQ ID NO: 1242276 - RNA, 15 nt, Human
caauugcaucuccca

SEQ ID NO: 1242277 - RNA, 17 nt, Human
caauugcaucucccaga

SEQ ID NO: 1242278 - RNA, 23 nt, Human
caauugcacgcggagugaguuuu

SEQ ID NO: 1242279 - RNA, 17 nt, Human
caauugcugcuacuuau

SEQ ID NO: 1242280 - RNA, 13 nt, Human
caauuucggauuu

SEQ ID NO: 1242281 - RNA, 17 nt, Human
caauuucggauuuuuuc

SEQ ID NO: 1242282 - RNA, 21 nt, Human
caauuucggauuuuuuccaaa

SEQ ID NO: 1242283 - RNA, 22 nt, Human
caauuucggauuuuuuccaaaa

SEQ ID NO: 1242284 - RNA, 17 nt, Human
caauuucuaauuuuuaa

SEQ ID NO: 1242285 - RNA, 15 nt, Human
caauugaaguaaacu

SEQ ID NO: 1242286 - RNA, 17 nt, Human
caauugaaguaaacuuu

SEQ ID NO: 1242287 - RNA, 21 nt, Human
caauugaaguaaacuuuuugu

SEQ ID NO: 1242288 - RNA, 18 nt, Human
caauugaaguaaacuuuu

SEQ ID NO: 1242289 - RNA, 14 nt, Human
caauugacaacagu

SEQ ID NO: 1242290 - RNA, 20 nt, Human
caauuucuacaaaauccuga

SEQ ID NO: 1242291 - RNA, 16 nt, Human
caauuucuacuuugaa

SEQ ID NO: 1242292 - RNA, 20 nt, Human
caauuucuacuuugaaguca

SEQ ID NO: 1242293 - RNA, 21 nt, Human
caauuucuacuuugaagucau

SEQ ID NO: 1242294 - RNA, 19 nt, Human
caauuucuaauuuuuaaga

SEQ ID NO: 1242295 - RNA, 13 nt, Human
caauuucugaaca

SEQ ID NO: 1242296 - RNA, 15 nt, Human
caauuucuguguugc

SEQ ID NO: 1242297 - RNA, 22 nt, Human
caauuucuguguugccaagcuc

SEQ ID NO: 1242298 - RNA, 20 nt, Human
caauuucuguguugccaagc

SEQ ID NO: 1242299 - RNA, 18 nt, Human
cacaagauggaauuuauc

SEQ ID NO: 1242300 - RNA, 22 nt, Human
caaucccuuaauauccuaaaca

SEQ ID NO: 1242301 - RNA, 20 nt, Human
caaucccucaccuucugagu

SEQ ID NO: 1242302 - RNA, 23 nt, Human
caaucccaccaacccucagagcc

SEQ ID NO: 1242303 - RNA, 16 nt, Human
caaucccaccaacccu

SEQ ID NO: 1242304 - RNA, 17 nt, Human
caaucccaccaacccuc

SEQ ID NO: 1242305 - RNA, 22 nt, Human
caaucccaccaacccucagagc

SEQ ID NO: 1242306 - RNA, 17 nt, Human
caaucauuuuaauuauu

SEQ ID NO: 1242307 - RNA, 20 nt, Human
caauccaguggacuucgcag

SEQ ID NO: 1242308 - RNA, 22 nt, Human
cacaagauggaauuuaucaaac

SEQ ID NO: 1242309 - RNA, 13 nt, Human
caccagggaaggg

SEQ ID NO: 1242310 - RNA, 20 nt, Human
caccaggcuugccugcaggc

SEQ ID NO: 1242311 - RNA, 18 nt, Human
caccagggaaggggacaa

SEQ ID NO: 1242312 - RNA, 21 nt, Human
caccagggaaggggacaagga

SEQ ID NO: 1242313 - RNA, 16 nt, Human
caccagggcaucucug

SEQ ID NO: 1242314 - RNA, 17 nt, Human
caccagggcaucucugg

SEQ ID NO: 1242315 - RNA, 18 nt, Human
caccagggcaucucuggg

SEQ ID NO: 1242316 - RNA, 19 nt, Human
caccagggcaucucugggc

SEQ ID NO: 1242317 - RNA, 20 nt, Human
caccagggcaucucugggcu

SEQ ID NO: 1242318 - RNA, 23 nt, Human
caccagggcaucucugggcugga

SEQ ID NO: 1242319 - RNA, 21 nt, Human
caccagggcaucucugggcug

SEQ ID NO: 1242320 - RNA, 22 nt, Human
caccagggcaucucugggcugg

SEQ ID NO: 1242321 - RNA, 19 nt, Human
cacccagccccagccaggg

SEQ ID NO: 1242322 - RNA, 15 nt, Human
caccccaauccuccc

SEQ ID NO: 1242323 - RNA, 21 nt, Human
caccccacccacuucugcacu

SEQ ID NO: 1242324 - RNA, 19 nt, Human
caccccaauccucccagaa

SEQ ID NO: 1242325 - RNA, 15 nt, Human
cacccauuuuuccuu

SEQ ID NO: 1242326 - RNA, 18 nt, Human
cacccauuuuuccuuuug

SEQ ID NO: 1242327 - RNA, 18 nt, Human
caccccaaagcuuuccug

SEQ ID NO: 1242328 - RNA, 19 nt, Human
caccccaaagcuuuccugc

SEQ ID NO: 1242329 - RNA, 15 nt, Human
caccccaaccugcuc

SEQ ID NO: 1242330 - RNA, 16 nt, Human
caccccaaccugcucu

SEQ ID NO: 1242331 - RNA, 20 nt, Human
caccccaaccugcucuccuc

SEQ ID NO: 1242332 - RNA, 21 nt, Human
caccccaaccugcucuccucu

SEQ ID NO: 1242333 - RNA, 22 nt, Human
caccccaaccugcucuccucuu

SEQ ID NO: 1242334 - RNA, 13 nt, Human
caccaacccucag

SEQ ID NO: 1242335 - RNA, 14 nt, Human
caccaacccucagg

SEQ ID NO: 1242336 - RNA, 15 nt, Human
caccaacccucaggg

SEQ ID NO: 1242337 - RNA, 16 nt, Human
caccaacccucagggc

SEQ ID NO: 1242338 - RNA, 13 nt, Human
caccaaaugugcu

SEQ ID NO: 1242339 - RNA, 14 nt, Human
caccaaaguucuaa

SEQ ID NO: 1242340 - RNA, 16 nt, Human
caccaaaguucuaaua

SEQ ID NO: 1242341 - RNA, 17 nt, Human
caccaaaguucuaauaa

SEQ ID NO: 1242342 - RNA, 22 nt, Human
caccaaaguucuaauaauuucu

SEQ ID NO: 1242343 - RNA, 14 nt, Human
caccaaaucaaaau

SEQ ID NO: 1242344 - RNA, 16 nt, Human
caccaaaucaaaaucu

SEQ ID NO: 1242345 - RNA, 18 nt, Human
caccaaaucaaaaucucu

SEQ ID NO: 1242346 - RNA, 21 nt, Human
caccaaaucaaaaucucucca

SEQ ID NO: 1242347 - RNA, 17 nt, Human
caccaaagagaaugccc

SEQ ID NO: 1242348 - RNA, 13 nt, Human
caccaaagagaau

SEQ ID NO: 1242349 - RNA, 12 nt, Human
caccaaaguucu

SEQ ID NO: 1242350 - RNA, 13 nt, Human
caccaaaguucua

SEQ ID NO: 1242351 - RNA, 15 nt, Human
caccaaaagaaguaa

SEQ ID NO: 1242352 - RNA, 13 nt, Human
cacaucucaacag

SEQ ID NO: 1242353 - RNA, 14 nt, Human
cacaucucaacagg

SEQ ID NO: 1242354 - RNA, 20 nt, Human
cacaucucaacaggccucag

SEQ ID NO: 1242355 - RNA, 21 nt, Human
cacaucucaacaggccucagg

SEQ ID NO: 1242356 - RNA, 23 nt, Human
cacaucucaacaggccucagggc

SEQ ID NO: 1242357 - RNA, 12 nt, Human
cacaucuguguc

SEQ ID NO: 1242358 - RNA, 16 nt, Human
cacaucugugucuugu

SEQ ID NO: 1242359 - RNA, 17 nt, Human
cacaucugugucuuguu

SEQ ID NO: 1242360 - RNA, 18 nt, Human
cacaucugugucuuguuu

SEQ ID NO: 1242361 - RNA, 23 nt, Human
cacaucugugucuuguuuggaau

SEQ ID NO: 1242362 - RNA, 13 nt, Human
cacacauugcugu

SEQ ID NO: 1242363 - RNA, 14 nt, Human
cacagaaaauaagg

SEQ ID NO: 1242364 - RNA, 17 nt, Human
cacagaaaauaaggcac

SEQ ID NO: 1242365 - RNA, 17 nt, Human
cacacuuugguaccaga

SEQ ID NO: 1242366 - RNA, 12 nt, Human
cacacuuuggua

SEQ ID NO: 1242367 - RNA, 16 nt, Human
cacagaaaccaauuuu

SEQ ID NO: 1242368 - RNA, 12 nt, Human
cacagaaaccuu

SEQ ID NO: 1242369 - RNA, 23 nt, Human
cacagaaaauaaggcacccaucu

SEQ ID NO: 1242370 - RNA, 13 nt, Human
cacagaacccuug

SEQ ID NO: 1242371 - RNA, 10 nt, Human
cacagcuccu

SEQ ID NO: 1242372 - RNA, 15 nt, Human
cacagcuccucccac

SEQ ID NO: 1242373 - RNA, 20 nt, Human
cacagcucuccggucucucu

SEQ ID NO: 1242374 - RNA, 21 nt, Human
cacagcucuccggucucucuc

SEQ ID NO: 1242375 - RNA, 17 nt, Human
cacaggcuucugagcag

SEQ ID NO: 1242376 - RNA, 18 nt, Human
cacaggccuguguagcug

SEQ ID NO: 1242377 - RNA, 21 nt, Human
cacaggccuguguagcuguga

SEQ ID NO: 1242378 - RNA, 22 nt, Human
cacaggccuguguagcugugac

SEQ ID NO: 1242379 - RNA, 23 nt, Human
cacaggccuguguagcugugacc

SEQ ID NO: 1242380 - RNA, 24 nt, Human
cacaggccuguguagcugugaccu

SEQ ID NO: 1242381 - RNA, 13 nt, Human
cacaggcucaggc

SEQ ID NO: 1242382 - RNA, 14 nt, Human
cacaggcucaggca

SEQ ID NO: 1242383 - RNA, 15 nt, Human
cacaggcucaggcag

SEQ ID NO: 1242384 - RNA, 19 nt, Human
cacaggcucaggcaggggc

SEQ ID NO: 1242385 - RNA, 16 nt, Human
cacaggcucaggcagg

SEQ ID NO: 1242386 - RNA, 18 nt, Human
cacaggcuucugagcagc

SEQ ID NO: 1242387 - RNA, 17 nt, Human
auuaugggucacaggaa

SEQ ID NO: 1242388 - RNA, 22 nt, Human
auuauggagucauuuuuacaau

SEQ ID NO: 1242389 - RNA, 15 nt, Human
auuaugggucacagg

SEQ ID NO: 1242390 - RNA, 16 nt, Human
auuaugggucacagga

SEQ ID NO: 1242391 - RNA, 19 nt, Human
auuaugccuuuuuugauca

SEQ ID NO: 1242392 - RNA, 18 nt, Human
auuauggaaaaaaaauau

SEQ ID NO: 1242393 - RNA, 16 nt, Human
auucaaaugucuauaa

SEQ ID NO: 1242394 - RNA, 13 nt, Human
auucaaauuuuau

SEQ ID NO: 1242395 - RNA, 12 nt, Human
auucaacaaaca

SEQ ID NO: 1242396 - RNA, 13 nt, Human
auucaacaaacau

SEQ ID NO: 1242397 - RNA, 22 nt, Human
auucaaucuguaaacuguguau

SEQ ID NO: 1242398 - RNA, 17 nt, Human
auucaaucuguaaacug

SEQ ID NO: 1242399 - RNA, 18 nt, Human
auucaaucuguaaacugu

SEQ ID NO: 1242400 - RNA, 14 nt, Human
auucaaucuguaaa

SEQ ID NO: 1242401 - RNA, 15 nt, Human
auucaaucuguaaac

SEQ ID NO: 1242402 - RNA, 16 nt, Human
auucaaucuguaaacu

SEQ ID NO: 1242403 - RNA, 20 nt, Human
auuaguacuccccuccuuga

SEQ ID NO: 1242404 - RNA, 18 nt, Human
auuaguaagcuagcaaau

SEQ ID NO: 1242405 - RNA, 16 nt, Human
auuaguaacauguguu

SEQ ID NO: 1242406 - RNA, 17 nt, Human
auuaguaacauguguua

SEQ ID NO: 1242407 - RNA, 22 nt, Human
auuaggcuguaacuacuuuaua

SEQ ID NO: 1242408 - RNA, 23 nt, Human
auuaggcuguaacuacuuuauaa

SEQ ID NO: 1242409 - RNA, 13 nt, Human
auuaggccagcaa

SEQ ID NO: 1242410 - RNA, 13 nt, Human
auuaguaacaugu

SEQ ID NO: 1242411 - RNA, 19 nt, Human
auuaugaauuacauuugua

SEQ ID NO: 1242412 - RNA, 20 nt, Human
auuaugaauuacauuuguau

SEQ ID NO: 1242413 - RNA, 22 nt, Human
auuaugaauuacauuuguauaa

SEQ ID NO: 1242414 - RNA, 19 nt, Human
auuaguacacagcaccaga

SEQ ID NO: 1242415 - RNA, 16 nt, Human
auuaugcauuauauca

SEQ ID NO: 1242416 - RNA, 14 nt, Human
auuaggauuucaug

SEQ ID NO: 1242417 - RNA, 16 nt, Human
auuaggauuucaugau

SEQ ID NO: 1242418 - RNA, 14 nt, Human
auuaggcagacucu

SEQ ID NO: 1242419 - RNA, 21 nt, Human
auuaggcagacucuuuaugcu

SEQ ID NO: 1242420 - RNA, 14 nt, Human
auuaggcuguaacu

SEQ ID NO: 1242421 - RNA, 15 nt, Human
auuaggcuguaacua

SEQ ID NO: 1242422 - RNA, 17 nt, Human
auuaggcuguaacuacu

SEQ ID NO: 1242423 - RNA, 21 nt, Human
auuaggcuguaacuacuuuau

SEQ ID NO: 1242424 - RNA, 15 nt, Human
auuaaaugacacuca

SEQ ID NO: 1242425 - RNA, 13 nt, Human
auuaaauuacaga

SEQ ID NO: 1242426 - RNA, 17 nt, Human
auucuugccaaauauaa

SEQ ID NO: 1242427 - RNA, 21 nt, Human
auucucugugucuaagauucu

SEQ ID NO: 1242428 - RNA, 19 nt, Human
auucuugauguaaaaucuu

SEQ ID NO: 1242429 - RNA, 20 nt, Human
auucuugauguaaaaucuug

SEQ ID NO: 1242430 - RNA, 17 nt, Human
auuccuucagcacuuua

SEQ ID NO: 1242431 - RNA, 15 nt, Human
auuccuucagauuug

SEQ ID NO: 1242432 - RNA, 16 nt, Human
auuccuucccagaggg

SEQ ID NO: 1242433 - RNA, 15 nt, Human
auuccuucagcacuu

SEQ ID NO: 1242434 - RNA, 12 nt, Human
auuccuucccau

SEQ ID NO: 1242435 - RNA, 17 nt, Human
auuccugggaaauauuc

SEQ ID NO: 1242436 - RNA, 22 nt, Human
auuccugggaaauauucccuag

SEQ ID NO: 1242437 - RNA, 22 nt, Human
auuccuguggauguaaagugau

SEQ ID NO: 1242438 - RNA, 19 nt, Human
auuccuuagacucuuuucc

SEQ ID NO: 1242439 - RNA, 22 nt, Human
auuccuuagacucuuuuccuuc

SEQ ID NO: 1242440 - RNA, 11 nt, Human
auuccuccagg

SEQ ID NO: 1242441 - RNA, 23 nt, Human
auuccucaugaauguaaauuugu

SEQ ID NO: 1242442 - RNA, 16 nt, Human
auuccucaugaaugua

SEQ ID NO: 1242443 - RNA, 17 nt, Human
auuccucaugaauguaa

SEQ ID NO: 1242444 - RNA, 18 nt, Human
auuccucaugaauguaaa

SEQ ID NO: 1242445 - RNA, 19 nt, Human
auuccucaugaauguaaau

SEQ ID NO: 1242446 - RNA, 13 nt, Human
auuccuccugcuc

SEQ ID NO: 1242447 - RNA, 14 nt, Human
auuccuccugcuca

SEQ ID NO: 1242448 - RNA, 15 nt, Human
auuccuccugcucau

SEQ ID NO: 1242449 - RNA, 16 nt, Human
auuccuccugcucaua

SEQ ID NO: 1242450 - RNA, 15 nt, Human
auuccugcauuugug

SEQ ID NO: 1242451 - RNA, 20 nt, Human
auuccuccugcucauauugu

SEQ ID NO: 1242452 - RNA, 22 nt, Human
auuccucaugaauguaaauuug

SEQ ID NO: 1242453 - RNA, 18 nt, Human
auuccugcauuugugaaa

SEQ ID NO: 1242454 - RNA, 22 nt, Human
auuccuauugugcaauguaaau

SEQ ID NO: 1242455 - RNA, 17 nt, Human
auuccucaacguauugu

SEQ ID NO: 1242456 - RNA, 20 nt, Human
auuccuuuaacaacauguuu

SEQ ID NO: 1242457 - RNA, 17 nt, Human
auucucugagcugugca

SEQ ID NO: 1242458 - RNA, 18 nt, Human
auucucugagcugugcag

SEQ ID NO: 1242459 - RNA, 17 nt, Human
auucucuggcuguaagg

SEQ ID NO: 1242460 - RNA, 19 nt, Human
auucucuggcuguaaggcu

SEQ ID NO: 1242461 - RNA, 20 nt, Human
auucucuggcuguaaggcuc

SEQ ID NO: 1242462 - RNA, 21 nt, Human
auucucuggcuguaaggcucu

SEQ ID NO: 1242463 - RNA, 22 nt, Human
auucucuggcuguaaggcucua

SEQ ID NO: 1242464 - RNA, 12 nt, Human
auucucugucuc

SEQ ID NO: 1242465 - RNA, 13 nt, Human
auucucugucuca

SEQ ID NO: 1242466 - RNA, 14 nt, Human
auucucugucucau

SEQ ID NO: 1242467 - RNA, 16 nt, Human
auucucugucucaucc

SEQ ID NO: 1242468 - RNA, 17 nt, Human
auucucugucucaucca

SEQ ID NO: 1242469 - RNA, 18 nt, Human
auucucugucucauccau

SEQ ID NO: 1242470 - RNA, 19 nt, Human
auucucugucucauccauc

SEQ ID NO: 1242471 - RNA, 17 nt, Human
auucucugugucuaaga

SEQ ID NO: 1242472 - RNA, 18 nt, Human
auucucugugucuaagau

SEQ ID NO: 1242473 - RNA, 20 nt, Human
auucucugugucuaagauuc

SEQ ID NO: 1242474 - RNA, 20 nt, Human
auuguguucccauuucagcu

SEQ ID NO: 1242475 - RNA, 18 nt, Human
auuguaagcaugcacaaa

SEQ ID NO: 1242476 - RNA, 13 nt, Human
auuguaacuguuc

SEQ ID NO: 1242477 - RNA, 15 nt, Human
auuguaacuguucuu

SEQ ID NO: 1242478 - RNA, 19 nt, Human
auuguaacuguucuugaau

SEQ ID NO: 1242479 - RNA, 10 nt, Human
auuguaacuc

SEQ ID NO: 1242480 - RNA, 22 nt, Human
auuguguuuacauuuuauggug

SEQ ID NO: 1242481 - RNA, 14 nt, Human
auuguuaaaggcua

SEQ ID NO: 1242482 - RNA, 17 nt, Human
auuguuaauuuuuccua

SEQ ID NO: 1242483 - RNA, 20 nt, Human
auuguuacauuauguggaaa

SEQ ID NO: 1242484 - RNA, 15 nt, Human
auuguuacagaagcu

SEQ ID NO: 1242485 - RNA, 13 nt, Human
auuguuguucugu

SEQ ID NO: 1242486 - RNA, 14 nt, Human
auuguuguucuguu

SEQ ID NO: 1242487 - RNA, 18 nt, Human
auuguuguucuguuaacu

SEQ ID NO: 1242488 - RNA, 21 nt, Human
auuguuguucuguuaacugaa

SEQ ID NO: 1242489 - RNA, 19 nt, Human
auuguuguucuguuaacug

SEQ ID NO: 1242490 - RNA, 23 nt, Human
auuguguuuacauuuuauggugc

SEQ ID NO: 1242491 - RNA, 19 nt, Human
auuguguuuacauuuuaug

SEQ ID NO: 1242492 - RNA, 18 nt, Human
auuguguuuacauuuuau

SEQ ID NO: 1242493 - RNA, 15 nt, Human
auuguguuuacauuu

SEQ ID NO: 1242494 - RNA, 14 nt, Human
auuguguuuacauu

SEQ ID NO: 1242495 - RNA, 12 nt, Human
auuguguuuaca

SEQ ID NO: 1242496 - RNA, 20 nt, Human
auuguguuaccuguagauuc

SEQ ID NO: 1242497 - RNA, 15 nt, Human
auuguguucccauuu

SEQ ID NO: 1242498 - RNA, 13 nt, Human
auuguguuugugu

SEQ ID NO: 1242499 - RNA, 14 nt, Human
auugcuguccugga

SEQ ID NO: 1242500 - RNA, 21 nt, Human
auugcuuacaagccuaagaau

SEQ ID NO: 1242501 - RNA, 18 nt, Human
auuguaacccugucugga

SEQ ID NO: 1242502 - RNA, 22 nt, Human
auuguuuaaaaaucuuaaugua

SEQ ID NO: 1242503 - RNA, 11 nt, Human
auuucuauuaa

SEQ ID NO: 1242504 - RNA, 15 nt, Human
auuucuauuucuccu

SEQ ID NO: 1242505 - RNA, 18 nt, Human
auuucuauuucuccucca

SEQ ID NO: 1242506 - RNA, 20 nt, Human
auuucuauuucuccuccaug

SEQ ID NO: 1242507 - RNA, 18 nt, Human
auuucugcauauguugaa

SEQ ID NO: 1242508 - RNA, 22 nt, Human
auuucugcauauguugaauacu

SEQ ID NO: 1242509 - RNA, 23 nt, Human
auuucugcauauguugaauacuu

SEQ ID NO: 1242510 - RNA, 13 nt, Human
auuucugccuccc

SEQ ID NO: 1242511 - RNA, 16 nt, Human
auuucugccuccccuu

SEQ ID NO: 1242512 - RNA, 19 nt, Human
auuucauaguucagaauuu

SEQ ID NO: 1242513 - RNA, 23 nt, Human
auuucuauagccaaaaauagcua

SEQ ID NO: 1242514 - RNA, 14 nt, Human
auuucuaugaaaua

SEQ ID NO: 1242515 - RNA, 21 nt, Human
auuucagaaguuaguuuguau

SEQ ID NO: 1242516 - RNA, 12 nt, Human
auuucagacucc

SEQ ID NO: 1242517 - RNA, 16 nt, Human
auuucaguucuaggaa

SEQ ID NO: 1242518 - RNA, 17 nt, Human
auuucaguucuaggaaa

SEQ ID NO: 1242519 - RNA, 18 nt, Human
auuucaguucuaggaaaa

SEQ ID NO: 1242520 - RNA, 19 nt, Human
auuucaguucuaggaaaau

SEQ ID NO: 1242521 - RNA, 23 nt, Human
auuucauacuguaacauucagga

SEQ ID NO: 1242522 - RNA, 13 nt, Human
auuucauaguuca

SEQ ID NO: 1242523 - RNA, 14 nt, Human
auuucauaguucag

SEQ ID NO: 1242524 - RNA, 15 nt, Human
auuucauaguucaga

SEQ ID NO: 1242525 - RNA, 16 nt, Human
auuucauaguucagaa

SEQ ID NO: 1242526 - RNA, 17 nt, Human
auuucauaguucagaau

SEQ ID NO: 1242527 - RNA, 11 nt, Human
auuucuguguu

SEQ ID NO: 1242528 - RNA, 22 nt, Human
auuuaugcauauuauuuuaugu

SEQ ID NO: 1242529 - RNA, 16 nt, Human
auuuaugcauauuauu

SEQ ID NO: 1242530 - RNA, 12 nt, Human
auuucacuggag

SEQ ID NO: 1242531 - RNA, 14 nt, Human
auuucacuggagca

SEQ ID NO: 1242532 - RNA, 16 nt, Human
auuucacuggagcaca

SEQ ID NO: 1242533 - RNA, 17 nt, Human
auuucacuggagcacaa

SEQ ID NO: 1242534 - RNA, 19 nt, Human
auuucacuggagcacaaua

SEQ ID NO: 1242535 - RNA, 19 nt, Human
auuucacuguagcucuaaa

SEQ ID NO: 1242536 - RNA, 24 nt, Human
auuucacuguagcucuaaaaucug

SEQ ID NO: 1242537 - RNA, 13 nt, Human
auuucacugucuu

SEQ ID NO: 1242538 - RNA, 22 nt, Human
auuucacugucuuuaauucugu

SEQ ID NO: 1242539 - RNA, 23 nt, Human
auuucacugucuuuaauucugua

SEQ ID NO: 1242540 - RNA, 16 nt, Human
auuucacuuauuuaga

SEQ ID NO: 1242541 - RNA, 12 nt, Human
auuucacuuguc

SEQ ID NO: 1242542 - RNA, 12 nt, Human
auuucagaaguu

SEQ ID NO: 1242543 - RNA, 19 nt, Human
auuucagaaguuaguuugu

SEQ ID NO: 1242544 - RNA, 13 nt, Human
auuuauauugaua

SEQ ID NO: 1242545 - RNA, 20 nt, Human
auuuauauugauaagaucuu

SEQ ID NO: 1242546 - RNA, 21 nt, Human
auuuauauugauaagaucuuu

SEQ ID NO: 1242547 - RNA, 22 nt, Human
auuuauauugauaagaucuuuu

SEQ ID NO: 1242548 - RNA, 15 nt, Human
auuuauauuguaaau

SEQ ID NO: 1242549 - RNA, 15 nt, Human
auuuauaucacaugu

SEQ ID NO: 1242550 - RNA, 15 nt, Human
auuuauauguacaug

SEQ ID NO: 1242551 - RNA, 16 nt, Human
auuuauauguacauga

SEQ ID NO: 1242552 - RNA, 17 nt, Human
auuuauauguacaugag

SEQ ID NO: 1242553 - RNA, 19 nt, Human
auuuaucugagucaacucc

SEQ ID NO: 1242554 - RNA, 18 nt, Human
auuuauauuguaaauauu

SEQ ID NO: 1242555 - RNA, 22 nt, Human
auuuaucuuuacuuuuaaacag

SEQ ID NO: 1242556 - RNA, 21 nt, Human
auuuaugaaaguauuaaaaug

SEQ ID NO: 1242557 - RNA, 23 nt, Human
auuuaugaauugaauuaucuugg

SEQ ID NO: 1242558 - RNA, 17 nt, Human
auuuaugagcucuucau

SEQ ID NO: 1242559 - RNA, 15 nt, Human
auuuaauaaucugua

SEQ ID NO: 1242560 - RNA, 17 nt, Human
caacucauauuuucaug

SEQ ID NO: 1242561 - RNA, 20 nt, Human
caacucacuccuuuuaaaga

SEQ ID NO: 1242562 - RNA, 21 nt, Human
caacucacuccuuuuaaagaa

SEQ ID NO: 1242563 - RNA, 23 nt, Human
caacucacuccuuuuaaagaaaa

SEQ ID NO: 1242564 - RNA, 15 nt, Human
caacuaggaucagaa

SEQ ID NO: 1242565 - RNA, 15 nt, Human
caacucacuccuuuu

SEQ ID NO: 1242566 - RNA, 16 nt, Human
caacucacuccuuuua

SEQ ID NO: 1242567 - RNA, 17 nt, Human
caacucacuccuuuuaa

SEQ ID NO: 1242568 - RNA, 18 nt, Human
caacucacuccuuuuaaa

SEQ ID NO: 1242569 - RNA, 21 nt, Human
caacuaccugagcuaaauaaa

SEQ ID NO: 1242570 - RNA, 17 nt, Human
caacuacuguguuaugc

SEQ ID NO: 1242571 - RNA, 18 nt, Human
caacuagccccuggggug

SEQ ID NO: 1242572 - RNA, 18 nt, Human
caacuaauuuuuguauuu

SEQ ID NO: 1242573 - RNA, 19 nt, Human
caacuacagucuaaagcug

SEQ ID NO: 1242574 - RNA, 15 nt, Human
caacuacagucuaaa

SEQ ID NO: 1242575 - RNA, 17 nt, Human
caacuacccccagcugu

SEQ ID NO: 1242576 - RNA, 19 nt, Human
caacuacccccagcugugc

SEQ ID NO: 1242577 - RNA, 20 nt, Human
caacuacccccagcugugcu

SEQ ID NO: 1242578 - RNA, 11 nt, Human
caacuaccuga

SEQ ID NO: 1242579 - RNA, 15 nt, Human
caacuaccugagcua

SEQ ID NO: 1242580 - RNA, 13 nt, Human
caacuacuaauag

SEQ ID NO: 1242581 - RNA, 15 nt, Human
caacuacuaauagaa

SEQ ID NO: 1242582 - RNA, 21 nt, Human
caacuacuaauagaauaaagg

SEQ ID NO: 1242583 - RNA, 19 nt, Human
caacuacuaccuguaauga

SEQ ID NO: 1242584 - RNA, 14 nt, Human
caaccauccaauua

SEQ ID NO: 1242585 - RNA, 13 nt, Human
caaccaucgcuuu

SEQ ID NO: 1242586 - RNA, 18 nt, Human
caaccaugagaccacugu

SEQ ID NO: 1242587 - RNA, 23 nt, Human
caaccaugagaccacuguuauca

SEQ ID NO: 1242588 - RNA, 21 nt, Human
caaccagaccauugucucaga

SEQ ID NO: 1242589 - RNA, 19 nt, Human
caaccagauugucagcucc

SEQ ID NO: 1242590 - RNA, 20 nt, Human
caaccagauugucagcuccu

SEQ ID NO: 1242591 - RNA, 21 nt, Human
caaccccuccccuccaucccu

SEQ ID NO: 1242592 - RNA, 22 nt, Human
caaccccuccccuccaucccug

SEQ ID NO: 1242593 - RNA, 22 nt, Human
caagauggggagugagaggcug

SEQ ID NO: 1242594 - RNA, 15 nt, Human
caagauggcccaucc

SEQ ID NO: 1242595 - RNA, 16 nt, Human
caagaugggcaucuuu

SEQ ID NO: 1242596 - RNA, 17 nt, Human
caagaugggcaucuuuu

SEQ ID NO: 1242597 - RNA, 18 nt, Human
caagaugggcaucuuuug

SEQ ID NO: 1242598 - RNA, 19 nt, Human
caagauggaauuuaucaaa

SEQ ID NO: 1242599 - RNA, 20 nt, Human
caagaugggcaucuuuugua

SEQ ID NO: 1242600 - RNA, 21 nt, Human
caagaugggcaucuuuuguau

SEQ ID NO: 1242601 - RNA, 20 nt, Human
caagaauuucuaggacugaa

SEQ ID NO: 1242602 - RNA, 19 nt, Human
caagacccaaaaggcagaa

SEQ ID NO: 1242603 - RNA, 14 nt, Human
caacucgcuuuagg

SEQ ID NO: 1242604 - RNA, 19 nt, Human
caacucgcuuuaggucagc

SEQ ID NO: 1242605 - RNA, 17 nt, Human
caacuccuuccagcuag

SEQ ID NO: 1242606 - RNA, 16 nt, Human
caacucguauagcaug

SEQ ID NO: 1242607 - RNA, 22 nt, Human
caacucacuccuuuuaaagaaa

SEQ ID NO: 1242608 - RNA, 16 nt, Human
caacuccuaguucuag

SEQ ID NO: 1242609 - RNA, 19 nt, Human
caacuccuaguucuagaaa

SEQ ID NO: 1242610 - RNA, 20 nt, Human
caacuccuaguucuagaaaa

SEQ ID NO: 1242611 - RNA, 22 nt, Human
caacuccuaguucuagaaaaac

SEQ ID NO: 1242612 - RNA, 23 nt, Human
caacuccuaguucuagaaaaaca

SEQ ID NO: 1242613 - RNA, 14 nt, Human
caagaauggaucac

SEQ ID NO: 1242614 - RNA, 21 nt, Human
caagaauggaucacaagaugg

SEQ ID NO: 1242615 - RNA, 22 nt, Human
caagaauggaucacaagaugga

SEQ ID NO: 1242616 - RNA, 21 nt, Human
caagaauuggaagcugcccug

SEQ ID NO: 1242617 - RNA, 19 nt, Human
caacucguauagcaugcau

SEQ ID NO: 1242618 - RNA, 18 nt, Human
caacucuccccugaccug

SEQ ID NO: 1242619 - RNA, 24 nt, Human
caacucuccccugaccugugagcc

SEQ ID NO: 1242620 - RNA, 13 nt, Human
caagaauggauca

SEQ ID NO: 1242621 - RNA, 18 nt, Human
caacacacacaugcuucc

SEQ ID NO: 1242622 - RNA, 14 nt, Human
caacacagaggcag

SEQ ID NO: 1242623 - RNA, 15 nt, Human
caacaccaagcacag

SEQ ID NO: 1242624 - RNA, 13 nt, Human
caacaccaagcac

SEQ ID NO: 1242625 - RNA, 23 nt, Human
caacacacacaugcuucccuuuc

SEQ ID NO: 1242626 - RNA, 15 nt, Human
caacacacacaugcu

SEQ ID NO: 1242627 - RNA, 21 nt, Human
caacacacagauuugagcuca

SEQ ID NO: 1242628 - RNA, 22 nt, Human
caacacacagauuugagcucag

SEQ ID NO: 1242629 - RNA, 19 nt, Human
caacaaccucaacugccua

SEQ ID NO: 1242630 - RNA, 18 nt, Human
caacaaccucaacugccu

SEQ ID NO: 1242631 - RNA, 21 nt, Human
caacaagaagggacugagaga

SEQ ID NO: 1242632 - RNA, 20 nt, Human
caacaagaagggacugagag

SEQ ID NO: 1242633 - RNA, 22 nt, Human
caaagguaaaucagacuaugaa

SEQ ID NO: 1242634 - RNA, 13 nt, Human
caaaggguggaau

SEQ ID NO: 1242635 - RNA, 14 nt, Human
caaagguaaaucag

SEQ ID NO: 1242636 - RNA, 22 nt, Human
caaagucaggaaucaucaggaa

SEQ ID NO: 1242637 - RNA, 18 nt, Human
caaagucauaauugcauu

SEQ ID NO: 1242638 - RNA, 18 nt, Human
caaagucaggaaucauca

SEQ ID NO: 1242639 - RNA, 23 nt, Human
caaagucauaauugcauugacuu

SEQ ID NO: 1242640 - RNA, 23 nt, Human
caaagcaucuugcauuaugcaau

SEQ ID NO: 1242641 - RNA, 16 nt, Human
caaagcaugaaaugga

SEQ ID NO: 1242642 - RNA, 19 nt, Human
caaaguccugggauuacag

SEQ ID NO: 1242643 - RNA, 14 nt, Human
caaaguccuuuuuu

SEQ ID NO: 1242644 - RNA, 17 nt, Human
caaaguccuuuuuuucc

SEQ ID NO: 1242645 - RNA, 19 nt, Human
caaaguccuuuuuuuccau

SEQ ID NO: 1242646 - RNA, 23 nt, Human
caaaguccuuuuuuuccaucuuu

SEQ ID NO: 1242647 - RNA, 13 nt, Human
caaaucuggaagc

SEQ ID NO: 1242648 - RNA, 19 nt, Human
caaaugaagacaaaacaua

SEQ ID NO: 1242649 - RNA, 18 nt, Human
caaaugaaauauauuuaa

SEQ ID NO: 1242650 - RNA, 19 nt, Human
caaaugaaauauauuuaaa

SEQ ID NO: 1242651 - RNA, 20 nt, Human
caaaugaaauauauuuaaaa

SEQ ID NO: 1242652 - RNA, 12 nt, Human
caaaucuugaaa

SEQ ID NO: 1242653 - RNA, 19 nt, Human
caaaucuugaaauuaagaa

SEQ ID NO: 1242654 - RNA, 13 nt, Human
caaaucuugaaau

SEQ ID NO: 1242655 - RNA, 22 nt, Human
caaaucuugguugaugccaaaa

SEQ ID NO: 1242656 - RNA, 14 nt, Human
caacaaagaacacu

SEQ ID NO: 1242657 - RNA, 12 nt, Human
caaaugagccau

SEQ ID NO: 1242658 - RNA, 13 nt, Human
caaaugagccaug

SEQ ID NO: 1242659 - RNA, 21 nt, Human
caaaugccaaauuaaaaaaga

SEQ ID NO: 1242660 - RNA, 14 nt, Human
auuuuauguugcau

SEQ ID NO: 1242661 - RNA, 13 nt, Human
auuuuauguuaua

SEQ ID NO: 1242662 - RNA, 14 nt, Human
auuuuauguuauau

SEQ ID NO: 1242663 - RNA, 15 nt, Human
auuuuauguuauaua

SEQ ID NO: 1242664 - RNA, 17 nt, Human
auuuuauguuauauaua

SEQ ID NO: 1242665 - RNA, 23 nt, Human
auuuuauguuauauauaaauaua

SEQ ID NO: 1242666 - RNA, 18 nt, Human
auuuuauguuauauauaa

SEQ ID NO: 1242667 - RNA, 19 nt, Human
auuuucugguaggaauagc

SEQ ID NO: 1242668 - RNA, 14 nt, Human
auuuucugguucua

SEQ ID NO: 1242669 - RNA, 19 nt, Human
auuuucugguucuaacauu

SEQ ID NO: 1242670 - RNA, 15 nt, Human
auuuucugguucuaa

SEQ ID NO: 1242671 - RNA, 17 nt, Human
auuuucugguucuaaca

SEQ ID NO: 1242672 - RNA, 16 nt, Human
auuuucugugccugaa

SEQ ID NO: 1242673 - RNA, 18 nt, Human
auuuucugugccugaaua

SEQ ID NO: 1242674 - RNA, 20 nt, Human
auuuucugugccugaauauu

SEQ ID NO: 1242675 - RNA, 22 nt, Human
auuuuauggugccuaguauuga

SEQ ID NO: 1242676 - RNA, 14 nt, Human
auuuuauggugcau

SEQ ID NO: 1242677 - RNA, 22 nt, Human
auuuuauguuaagggaagaauu

SEQ ID NO: 1242678 - RNA, 16 nt, Human
auuuuauggugcauua

SEQ ID NO: 1242679 - RNA, 12 nt, Human
auuuuauguuau

SEQ ID NO: 1242680 - RNA, 15 nt, Human
auuuuauaugcuuac

SEQ ID NO: 1242681 - RNA, 16 nt, Human
auuuuauaugcuuacu

SEQ ID NO: 1242682 - RNA, 18 nt, Human
auuuuauaugcuuacuga

SEQ ID NO: 1242683 - RNA, 19 nt, Human
auuuuagggguagcauuug

SEQ ID NO: 1242684 - RNA, 18 nt, Human
auuuuaggagcuaaggcu

SEQ ID NO: 1242685 - RNA, 19 nt, Human
auuuuaggagcuaaggcuc

SEQ ID NO: 1242686 - RNA, 20 nt, Human
auuuuaggagcuaaggcucu

SEQ ID NO: 1242687 - RNA, 21 nt, Human
auuuuaggagcuaaggcucua

SEQ ID NO: 1242688 - RNA, 22 nt, Human
auuuuaggagcuaaggcucuau

SEQ ID NO: 1242689 - RNA, 21 nt, Human
auuuuauaucaauuuaaaaaa

SEQ ID NO: 1242690 - RNA, 18 nt, Human
auuuuagcgugcucacug

SEQ ID NO: 1242691 - RNA, 13 nt, Human
auuuuagcuuuug

SEQ ID NO: 1242692 - RNA, 18 nt, Human
auuuugaaucaauaauau

SEQ ID NO: 1242693 - RNA, 11 nt, Human
auuuugaauca

SEQ ID NO: 1242694 - RNA, 12 nt, Human
auuuugaaucaa

SEQ ID NO: 1242695 - RNA, 13 nt, Human
auuuugaaucaau

SEQ ID NO: 1242696 - RNA, 14 nt, Human
auuuugaaucaaua

SEQ ID NO: 1242697 - RNA, 15 nt, Human
auuuugaaucaauaa

SEQ ID NO: 1242698 - RNA, 17 nt, Human
auuuugaaucaauaaua

SEQ ID NO: 1242699 - RNA, 21 nt, Human
auuuucugugccugaauauuu

SEQ ID NO: 1242700 - RNA, 20 nt, Human
auuuugaaccugaugaaaau

SEQ ID NO: 1242701 - RNA, 22 nt, Human
auuuugaaccugaugaaaauaa

SEQ ID NO: 1242702 - RNA, 13 nt, Human
auuuugaagugcu

SEQ ID NO: 1242703 - RNA, 19 nt, Human
auuuugaagugcuguuuau

SEQ ID NO: 1242704 - RNA, 22 nt, Human
auuuugaagugcuguuuauuaa

SEQ ID NO: 1242705 - RNA, 18 nt, Human
auuuuuaauauauacuau

SEQ ID NO: 1242706 - RNA, 19 nt, Human
auuuuuaauauauacuaug

SEQ ID NO: 1242707 - RNA, 21 nt, Human
auuuuuagauaguuagaaccu

SEQ ID NO: 1242708 - RNA, 16 nt, Human
auuuuuauaaauacug

SEQ ID NO: 1242709 - RNA, 13 nt, Human
caaaagaagcccc

SEQ ID NO: 1242710 - RNA, 16 nt, Human
caaaagaagcccccag

SEQ ID NO: 1242711 - RNA, 17 nt, Human
caaaagaagcccccagc

SEQ ID NO: 1242712 - RNA, 18 nt, Human
caaaagaagcccccagcu

SEQ ID NO: 1242713 - RNA, 19 nt, Human
caaaagaagcccccagcua

SEQ ID NO: 1242714 - RNA, 20 nt, Human
caaaagaagcccggcuccug

SEQ ID NO: 1242715 - RNA, 22 nt, Human
caaaagaagcccggcuccuggu

SEQ ID NO: 1242716 - RNA, 12 nt, Human
caaaagaaguaa

SEQ ID NO: 1242717 - RNA, 19 nt, Human
caaaagaaguaaaagcaaa

SEQ ID NO: 1242718 - RNA, 17 nt, Human
caaaagaaguaaaagca

SEQ ID NO: 1242719 - RNA, 18 nt, Human
caaaagaaguaaaagcaa

SEQ ID NO: 1242720 - RNA, 19 nt, Human
caaaagaauggcagaaaag

SEQ ID NO: 1242721 - RNA, 20 nt, Human
caaaagaauggcagaaaagu

SEQ ID NO: 1242722 - RNA, 18 nt, Human
caaaagcuuacaaauacu

SEQ ID NO: 1242723 - RNA, 23 nt, Human
auuuuuauauuaaccagauauau

SEQ ID NO: 1242724 - RNA, 15 nt, Human
auuuuuauauuugaa

SEQ ID NO: 1242725 - RNA, 16 nt, Human
auuuuuauauuugaaa

SEQ ID NO: 1242726 - RNA, 14 nt, Human
auuuuuauauuuaa

SEQ ID NO: 1242727 - RNA, 21 nt, Human
caaaaggauaaugaauacuuu

SEQ ID NO: 1242728 - RNA, 13 nt, Human
caaaagcuuuuua

SEQ ID NO: 1242729 - RNA, 17 nt, Human
caaacauauauaacaau

SEQ ID NO: 1242730 - RNA, 17 nt, Human
caaaccaaaucacugaa

SEQ ID NO: 1242731 - RNA, 12 nt, Human
caaacauuuuga

SEQ ID NO: 1242732 - RNA, 15 nt, Human
caaacauuuugaaag

SEQ ID NO: 1242733 - RNA, 18 nt, Human
caaaccccgaccaccugc

SEQ ID NO: 1242734 - RNA, 18 nt, Human
caaacccuagccuugcuu

SEQ ID NO: 1242735 - RNA, 20 nt, Human
caaacccuagccuugcuugu

SEQ ID NO: 1242736 - RNA, 21 nt, Human
caaaccccgaccaccugccca

SEQ ID NO: 1242737 - RNA, 15 nt, Human
caaacccuagccuug

SEQ ID NO: 1242738 - RNA, 20 nt, Human
caaacauuuugaaagucugu

SEQ ID NO: 1242739 - RNA, 18 nt, Human
caaacauuuucuggccag

SEQ ID NO: 1242740 - RNA, 23 nt, Human
caaacauuuucuggccaguguuu

SEQ ID NO: 1242741 - RNA, 21 nt, Human
caaagaguucaagaaauaagu

SEQ ID NO: 1242742 - RNA, 18 nt, Human
caaagaguuugaugaggc

SEQ ID NO: 1242743 - RNA, 17 nt, Human
caaagauaucucaucuc

SEQ ID NO: 1242744 - RNA, 23 nt, Human
cauccuucaucuggauuccagag

SEQ ID NO: 1242745 - RNA, 18 nt, Human
cauccuuccucacaccag

SEQ ID NO: 1242746 - RNA, 16 nt, Human
caucugcgugacaaua

SEQ ID NO: 1242747 - RNA, 18 nt, Human
caucugcgugacaauaaa

SEQ ID NO: 1242748 - RNA, 19 nt, Human
caucugcgugacaauaaaa

SEQ ID NO: 1242749 - RNA, 22 nt, Human
caucugcgugacaauaaaacau

SEQ ID NO: 1242750 - RNA, 23 nt, Human
caucugcgugacaauaaaacauu

SEQ ID NO: 1242751 - RNA, 10 nt, Human
caucugcucc

SEQ ID NO: 1242752 - RNA, 11 nt, Human
caucugcuccu

SEQ ID NO: 1242753 - RNA, 22 nt, Human
caucugcuccuggaucucccug

SEQ ID NO: 1242754 - RNA, 14 nt, Human
caucugcuccugga

SEQ ID NO: 1242755 - RNA, 20 nt, Human
caucugggaacuugucacag

SEQ ID NO: 1242756 - RNA, 21 nt, Human
caucugggaacuugucacaga

SEQ ID NO: 1242757 - RNA, 15 nt, Human
caucugggccuuggc

SEQ ID NO: 1242758 - RNA, 23 nt, Human
cauccaugccucagaagugcauc

SEQ ID NO: 1242759 - RNA, 14 nt, Human
cauccauggccagc

SEQ ID NO: 1242760 - RNA, 15 nt, Human
cauccauggccagca

SEQ ID NO: 1242761 - RNA, 18 nt, Human
cauccauggccagcagca

SEQ ID NO: 1242762 - RNA, 21 nt, Human
cauccauggccagcagcaccu

SEQ ID NO: 1242763 - RNA, 22 nt, Human
cauccauggccagcagcaccug

SEQ ID NO: 1242764 - RNA, 18 nt, Human
cauccauguccaaccccc

SEQ ID NO: 1242765 - RNA, 18 nt, Human
cauccauguuccgagaag

SEQ ID NO: 1242766 - RNA, 19 nt, Human
cauccauguuccgagaaga

SEQ ID NO: 1242767 - RNA, 18 nt, Human
caucugggccuuggccug

SEQ ID NO: 1242768 - RNA, 20 nt, Human
caucugggccuuggccugga

SEQ ID NO: 1242769 - RNA, 23 nt, Human
caucugggccuuggccuggagca

SEQ ID NO: 1242770 - RNA, 16 nt, Human
caucugggcuccucca

SEQ ID NO: 1242771 - RNA, 17 nt, Human
caucugggcuccuccag

SEQ ID NO: 1242772 - RNA, 20 nt, Human
caucugggcuccuccagggu

SEQ ID NO: 1242773 - RNA, 18 nt, Human
caucuggggagcaggcag

SEQ ID NO: 1242774 - RNA, 23 nt, Human
caucuggggagcaggcagccagc

SEQ ID NO: 1242775 - RNA, 19 nt, Human
caucuggggagcaggcagc

SEQ ID NO: 1242776 - RNA, 16 nt, Human
cauaugcuaccaccag

SEQ ID NO: 1242777 - RNA, 17 nt, Human
cauaugcuaccaccagc

SEQ ID NO: 1242778 - RNA, 18 nt, Human
cauaugcuaccaccagcu

SEQ ID NO: 1242779 - RNA, 19 nt, Human
cauaugcuaccaccagcug

SEQ ID NO: 1242780 - RNA, 20 nt, Human
cauaugcuaccaccagcugu

SEQ ID NO: 1242781 - RNA, 12 nt, Human
cauaauugcauu

SEQ ID NO: 1242782 - RNA, 21 nt, Human
cauaauugugauuagacagaa

SEQ ID NO: 1242783 - RNA, 22 nt, Human
cauaauuuaguuucauauaaag

SEQ ID NO: 1242784 - RNA, 18 nt, Human
cauaauugcauugacuuu

SEQ ID NO: 1242785 - RNA, 15 nt, Human
cauaauuuggaggga

SEQ ID NO: 1242786 - RNA, 20 nt, Human
cauacaccuaugucauuuca

SEQ ID NO: 1242787 - RNA, 23 nt, Human
cauacacuuauuggaacucugcu

SEQ ID NO: 1242788 - RNA, 14 nt, Human
cauacacuuuuucu

SEQ ID NO: 1242789 - RNA, 23 nt, Human
cauacagaauuacuguaacugau

SEQ ID NO: 1242790 - RNA, 11 nt, Human
cauacagagaa

SEQ ID NO: 1242791 - RNA, 12 nt, Human
cauacagagaag

SEQ ID NO: 1242792 - RNA, 13 nt, Human
cauacagagaagu

SEQ ID NO: 1242793 - RNA, 15 nt, Human
cauacagagaaguca

SEQ ID NO: 1242794 - RNA, 17 nt, Human
cauacagagaagucaca

SEQ ID NO: 1242795 - RNA, 22 nt, Human
cauagcaccuaacaacauugua

SEQ ID NO: 1242796 - RNA, 12 nt, Human
cauagcucuggg

SEQ ID NO: 1242797 - RNA, 13 nt, Human
cauagcucugggg

SEQ ID NO: 1242798 - RNA, 20 nt, Human
cauagcucuggggugggcag

SEQ ID NO: 1242799 - RNA, 12 nt, Human
caugcacaaauu

SEQ ID NO: 1242800 - RNA, 14 nt, Human
caugcacaguauuu

SEQ ID NO: 1242801 - RNA, 17 nt, Human
caugcacaguauuugua

SEQ ID NO: 1242802 - RNA, 18 nt, Human
caugcacaguauuuguaa

SEQ ID NO: 1242803 - RNA, 19 nt, Human
caugcacaguauuuguaau

SEQ ID NO: 1242804 - RNA, 20 nt, Human
caugcacaguauuuguaauu

SEQ ID NO: 1242805 - RNA, 13 nt, Human
caugacagccucc

SEQ ID NO: 1242806 - RNA, 14 nt, Human
caugacagccucca

SEQ ID NO: 1242807 - RNA, 16 nt, Human
caugcacccucauaca

SEQ ID NO: 1242808 - RNA, 20 nt, Human
caugcacccucauacacaga

SEQ ID NO: 1242809 - RNA, 22 nt, Human
caugcacaguauuuguaauuaa

SEQ ID NO: 1242810 - RNA, 16 nt, Human
caugcucaucugcugg

SEQ ID NO: 1242811 - RNA, 17 nt, Human
caugcucaucugcuggu

SEQ ID NO: 1242812 - RNA, 18 nt, Human
caugcucaucugcugguc

SEQ ID NO: 1242813 - RNA, 19 nt, Human
caugcucaucugcuggucc

SEQ ID NO: 1242814 - RNA, 22 nt, Human
caugcuccagauuagagccugu

SEQ ID NO: 1242815 - RNA, 14 nt, Human
caugcuccucuucc

SEQ ID NO: 1242816 - RNA, 16 nt, Human
caugcuccucuucccc

SEQ ID NO: 1242817 - RNA, 17 nt, Human
caugcuccucuucccca

SEQ ID NO: 1242818 - RNA, 18 nt, Human
caugcuccucuuccccag

SEQ ID NO: 1242819 - RNA, 16 nt, Human
caugaaggugucauac

SEQ ID NO: 1242820 - RNA, 22 nt, Human
caugaagguaaauaaaaagaaa

SEQ ID NO: 1242821 - RNA, 13 nt, Human
caugaaguauuuu

SEQ ID NO: 1242822 - RNA, 21 nt, Human
caugaaguauuuuuucaguau

SEQ ID NO: 1242823 - RNA, 14 nt, Human
caugaaguauuuuu

SEQ ID NO: 1242824 - RNA, 15 nt, Human
caugaagcuguugug

SEQ ID NO: 1242825 - RNA, 14 nt, Human
caugaagguaaaua

SEQ ID NO: 1242826 - RNA, 16 nt, Human
caugaagguaaauaaa

SEQ ID NO: 1242827 - RNA, 17 nt, Human
caugaagguaaauaaaa

SEQ ID NO: 1242828 - RNA, 20 nt, Human
caugaagguaaauaaaaaga

SEQ ID NO: 1242829 - RNA, 21 nt, Human
caugaagguaaauaaaaagaa

SEQ ID NO: 1242830 - RNA, 16 nt, Human
cauggccagcuaauuu

SEQ ID NO: 1242831 - RNA, 14 nt, Human
cauggccagcugga

SEQ ID NO: 1242832 - RNA, 20 nt, Human
cauggccagcuggaggcagg

SEQ ID NO: 1242833 - RNA, 13 nt, Human
cauggccaggugg

SEQ ID NO: 1242834 - RNA, 19 nt, Human
cauggcauccuccagcccc

SEQ ID NO: 1242835 - RNA, 13 nt, Human
cauggccagcagc

SEQ ID NO: 1242836 - RNA, 14 nt, Human
cauggccagcagca

SEQ ID NO: 1242837 - RNA, 20 nt, Human
cauggccagcagcaccugcc

SEQ ID NO: 1242838 - RNA, 22 nt, Human
cauggccagcagcaccugcccu

SEQ ID NO: 1242839 - RNA, 23 nt, Human
cauggccagcagcaccugcccua

SEQ ID NO: 1242840 - RNA, 14 nt, Human
cauggccagguggc

SEQ ID NO: 1242841 - RNA, 21 nt, Human
cauggccagcuggaggcaggg

SEQ ID NO: 1242842 - RNA, 19 nt, Human
caugcuccucuuccccaga

SEQ ID NO: 1242843 - RNA, 15 nt, Human
cauggcauccaagac

SEQ ID NO: 1242844 - RNA, 14 nt, Human
cauggcauccucca

SEQ ID NO: 1242845 - RNA, 15 nt, Human
cauggcauccuccag

SEQ ID NO: 1242846 - RNA, 16 nt, Human
cauggcauccuccagc

SEQ ID NO: 1242847 - RNA, 18 nt, Human
cauggcauccuccagccc

SEQ ID NO: 1242848 - RNA, 22 nt, Human
cauggcauccuccagccccugu

SEQ ID NO: 1242849 - RNA, 12 nt, Human
cauuccuuccca

SEQ ID NO: 1242850 - RNA, 22 nt, Human
cauuccuucccagaggggccug

SEQ ID NO: 1242851 - RNA, 15 nt, Human
cauuccuugcugaaa

SEQ ID NO: 1242852 - RNA, 22 nt, Human
cauucgcuacuaugauuuaauu

SEQ ID NO: 1242853 - RNA, 15 nt, Human
cauuccuucccagag

SEQ ID NO: 1242854 - RNA, 18 nt, Human
cauucuagguuugcaaga

SEQ ID NO: 1242855 - RNA, 14 nt, Human
cauucuauuguuaa

SEQ ID NO: 1242856 - RNA, 13 nt, Human
cauucucacuccu

SEQ ID NO: 1242857 - RNA, 20 nt, Human
cauucucacaggucccaaau

SEQ ID NO: 1242858 - RNA, 14 nt, Human
cauucucacuccua

SEQ ID NO: 1242859 - RNA, 22 nt, Human
cauguugcccccgugagccaau

SEQ ID NO: 1242860 - RNA, 21 nt, Human
cauuaguacacagcaccagaa

SEQ ID NO: 1242861 - RNA, 24 nt, Human
cauuaucuaguucauugaaucauu

SEQ ID NO: 1242862 - RNA, 21 nt, Human
cauuagucauguuuaucugcu

SEQ ID NO: 1242863 - RNA, 22 nt, Human
cauuagucauguuuaucugcuu

SEQ ID NO: 1242864 - RNA, 22 nt, Human
cauuagucucagugaagacuau

SEQ ID NO: 1242865 - RNA, 19 nt, Human
caugucaagauucagcuag

SEQ ID NO: 1242866 - RNA, 18 nt, Human
caugucaaggguucaaga

SEQ ID NO: 1242867 - RNA, 20 nt, Human
caugucaaggguucaagauu

SEQ ID NO: 1242868 - RNA, 17 nt, Human
caugucaagauucagcu

SEQ ID NO: 1242869 - RNA, 14 nt, Human
caugucaagauuca

SEQ ID NO: 1242870 - RNA, 23 nt, Human
cauguaucuaugcauuuucugga

SEQ ID NO: 1242871 - RNA, 20 nt, Human
cauguaucuaugcauuuucu

SEQ ID NO: 1242872 - RNA, 22 nt, Human
caugucaacagcguuccuagag

SEQ ID NO: 1242873 - RNA, 17 nt, Human
cauguaguaacacuaau

SEQ ID NO: 1242874 - RNA, 19 nt, Human
cauguaguaacacuaauau

SEQ ID NO: 1242875 - RNA, 21 nt, Human
cauguaguaacacuaauauau

SEQ ID NO: 1242876 - RNA, 22 nt, Human
cauguaguaacacuaauauauu

SEQ ID NO: 1242877 - RNA, 23 nt, Human
cauguaguaacacuaauauauuu

SEQ ID NO: 1242878 - RNA, 13 nt, Human
cauuuauauguac

SEQ ID NO: 1242879 - RNA, 13 nt, Human
cauuuauauugau

SEQ ID NO: 1242880 - RNA, 15 nt, Human
cauuuauauauugaa

SEQ ID NO: 1242881 - RNA, 22 nt, Human
cauuuauauauugaauuaauau

SEQ ID NO: 1242882 - RNA, 22 nt, Human
cauuucagaguucuuuuugaag

SEQ ID NO: 1242883 - RNA, 23 nt, Human
cauuucagaaguuaguuuguaua

SEQ ID NO: 1242884 - RNA, 21 nt, Human
cauuucaucuaccauuuucug

SEQ ID NO: 1242885 - RNA, 14 nt, Human
cauuugugaaauga

SEQ ID NO: 1242886 - RNA, 16 nt, Human
cauuugugaaaugaug

SEQ ID NO: 1242887 - RNA, 23 nt, Human
cauuuggaguguuccccuuccac

SEQ ID NO: 1242888 - RNA, 21 nt, Human
cauuuggauccuguguggaga

SEQ ID NO: 1242889 - RNA, 20 nt, Human
cauuuggcaaugccaucauc

SEQ ID NO: 1242890 - RNA, 17 nt, Human
cauuuggaauacuuuuu

SEQ ID NO: 1242891 - RNA, 15 nt, Human
cauuuggaauacuuu

SEQ ID NO: 1242892 - RNA, 11 nt, Human
cauugcuuuuc

SEQ ID NO: 1242893 - RNA, 18 nt, Human
cauuggaaauuuagcauu

SEQ ID NO: 1242894 - RNA, 15 nt, Human
cauuguaaacaaacu

SEQ ID NO: 1242895 - RNA, 12 nt, Human
cauuuauauauu

SEQ ID NO: 1242896 - RNA, 13 nt, Human
cauuuauauauug

SEQ ID NO: 1242897 - RNA, 19 nt, Human
cauuggaaauuuagcauug

SEQ ID NO: 1242898 - RNA, 20 nt, Human
cauuggaaauuuagcauugu

SEQ ID NO: 1242899 - RNA, 21 nt, Human
cauuggaaauuuagcauugua

SEQ ID NO: 1242900 - RNA, 14 nt, Human
cauuggaacuggag

SEQ ID NO: 1242901 - RNA, 15 nt, Human
cauuggaacuggagg

SEQ ID NO: 1242902 - RNA, 16 nt, Human
cauuggaacuggaggc

SEQ ID NO: 1242903 - RNA, 19 nt, Human
cauuggaacuggaggcagg

SEQ ID NO: 1242904 - RNA, 15 nt, Human
cauuguaaaagcauu

SEQ ID NO: 1242905 - RNA, 20 nt, Human
cauuguaaaagcauuuugua

SEQ ID NO: 1242906 - RNA, 21 nt, Human
cauuguaaaagcauuuuguaa

SEQ ID NO: 1242907 - RNA, 22 nt, Human
cauuguaaaagcauuuuguaau

SEQ ID NO: 1242908 - RNA, 23 nt, Human
cauuguaaaagcauuuuguaaua

SEQ ID NO: 1242909 - RNA, 13 nt, Human
cauuguaaaauaa

SEQ ID NO: 1242910 - RNA, 14 nt, Human
cauuguaaaauaau

SEQ ID NO: 1242911 - RNA, 15 nt, Human
cauuguaaaauaauu

SEQ ID NO: 1242912 - RNA, 16 nt, Human
cauuguaaaauaauuc

SEQ ID NO: 1242913 - RNA, 18 nt, Human
ccaaggaugccccguccc

SEQ ID NO: 1242914 - RNA, 15 nt, Human
ccaaggcagaggccu

SEQ ID NO: 1242915 - RNA, 16 nt, Human
ccaaggcagaggccug

SEQ ID NO: 1242916 - RNA, 20 nt, Human
ccaaggcagaggccugggcu

SEQ ID NO: 1242917 - RNA, 18 nt, Human
ccaagaagcaguggccuu

SEQ ID NO: 1242918 - RNA, 15 nt, Human
ccaacgcuccaaagu

SEQ ID NO: 1242919 - RNA, 11 nt, Human
ccaacuuuucu

SEQ ID NO: 1242920 - RNA, 14 nt, Human
ccaacuuuucuauu

SEQ ID NO: 1242921 - RNA, 14 nt, Human
ccaagaaacgucuu

SEQ ID NO: 1242922 - RNA, 14 nt, Human
ccaagaagcagugg

SEQ ID NO: 1242923 - RNA, 13 nt, Human
ccaaaugcagcuu

SEQ ID NO: 1242924 - RNA, 15 nt, Human
ccaaaugcagcuuua

SEQ ID NO: 1242925 - RNA, 18 nt, Human
ccaaaugcagcuuuaaaa

SEQ ID NO: 1242926 - RNA, 19 nt, Human
ccaaauacuaaugaaaaca

SEQ ID NO: 1242927 - RNA, 13 nt, Human
ccaaauauguccu

SEQ ID NO: 1242928 - RNA, 15 nt, Human
ccaaauauguccugg

SEQ ID NO: 1242929 - RNA, 11 nt, Human
ccaaaguucua

SEQ ID NO: 1242930 - RNA, 12 nt, Human
ccaaaguucuaa

SEQ ID NO: 1242931 - RNA, 14 nt, Human
ccaaaguucuaaua

SEQ ID NO: 1242932 - RNA, 19 nt, Human
ccaaaguucuaauaauuuc

SEQ ID NO: 1242933 - RNA, 20 nt, Human
ccaaaguucuaauaauuucu

SEQ ID NO: 1242934 - RNA, 23 nt, Human
ccaaaguucuaauaauuucuaau

SEQ ID NO: 1242935 - RNA, 15 nt, Human
ccaaaguuguuguaa

SEQ ID NO: 1242936 - RNA, 23 nt, Human
ccaaaguuguuguaaccugcugu

SEQ ID NO: 1242937 - RNA, 19 nt, Human
ccaaaguuguuguaaccug

SEQ ID NO: 1242938 - RNA, 21 nt, Human
ccaaggcagaggccugggcug

SEQ ID NO: 1242939 - RNA, 22 nt, Human
ccaaggcagaggccugggcugg

SEQ ID NO: 1242940 - RNA, 13 nt, Human
ccaauccuauguu

SEQ ID NO: 1242941 - RNA, 14 nt, Human
ccaauccuauguuu

SEQ ID NO: 1242942 - RNA, 23 nt, Human
ccaauccuaugcaugguuucagc

SEQ ID NO: 1242943 - RNA, 16 nt, Human
ccaauccucccagaaa

SEQ ID NO: 1242944 - RNA, 23 nt, Human
ccaaugaaaaaauguauaugcac

SEQ ID NO: 1242945 - RNA, 15 nt, Human
ccaaugaaaaaaugu

SEQ ID NO: 1242946 - RNA, 16 nt, Human
ccacagaagcuccagg

SEQ ID NO: 1242947 - RNA, 21 nt, Human
ccacacuucaggcucuucucc

SEQ ID NO: 1242948 - RNA, 16 nt, Human
ccacacuucaggcucu

SEQ ID NO: 1242949 - RNA, 20 nt, Human
ccacacuucaggcucuucuc

SEQ ID NO: 1242950 - RNA, 14 nt, Human
ccacacuucaaacu

SEQ ID NO: 1242951 - RNA, 17 nt, Human
ccacacuucaaacuacu

SEQ ID NO: 1242952 - RNA, 18 nt, Human
ccacacuucaaacuacuu

SEQ ID NO: 1242953 - RNA, 18 nt, Human
ccaccagucugacuguuu

SEQ ID NO: 1242954 - RNA, 16 nt, Human
ccaccagggcaucucu

SEQ ID NO: 1242955 - RNA, 19 nt, Human
ccaccagggcaucucuggg

SEQ ID NO: 1242956 - RNA, 21 nt, Human
ccaccagggcaucucugggcu

SEQ ID NO: 1242957 - RNA, 15 nt, Human
ccaccacgcccggcu

SEQ ID NO: 1242958 - RNA, 16 nt, Human
ccacagcccugucagc

SEQ ID NO: 1242959 - RNA, 17 nt, Human
ccacagcccugucagca

SEQ ID NO: 1242960 - RNA, 20 nt, Human
ccacagcccugucagcauga

SEQ ID NO: 1242961 - RNA, 19 nt, Human
ccacagcccugucagcaug

SEQ ID NO: 1242962 - RNA, 18 nt, Human
ccacagcccuuuugucuc

SEQ ID NO: 1242963 - RNA, 20 nt, Human
ccacagcccuuuugucucug

SEQ ID NO: 1242964 - RNA, 18 nt, Human
ccacagaagcuccaggua

SEQ ID NO: 1242965 - RNA, 16 nt, Human
ccacagaagugcuuuc

SEQ ID NO: 1242966 - RNA, 18 nt, Human
ccacagacggaaggguaa

SEQ ID NO: 1242967 - RNA, 21 nt, Human
ccacagacggaaggguaaaca

SEQ ID NO: 1242968 - RNA, 22 nt, Human
ccacagacggaaggguaaacaa

SEQ ID NO: 1242969 - RNA, 13 nt, Human
ccacagccagggg

SEQ ID NO: 1242970 - RNA, 16 nt, Human
ccacagauaacugaaa

SEQ ID NO: 1242971 - RNA, 18 nt, Human
ccacagauaacugaaaau

SEQ ID NO: 1242972 - RNA, 23 nt, Human
ccacagacggaaggguaaacaau

SEQ ID NO: 1242973 - RNA, 13 nt, Human
ccacagaggacac

SEQ ID NO: 1242974 - RNA, 12 nt, Human
ccacagcccugu

SEQ ID NO: 1242975 - RNA, 14 nt, Human
ccacagcccuguca

SEQ ID NO: 1242976 - RNA, 15 nt, Human
ccacagcccugucag

SEQ ID NO: 1242977 - RNA, 20 nt, Human
ccaccagggcaucucugggc

SEQ ID NO: 1242978 - RNA, 19 nt, Human
ccaccgggcugggagcucu

SEQ ID NO: 1242979 - RNA, 15 nt, Human
ccaccgggccacucc

SEQ ID NO: 1242980 - RNA, 18 nt, Human
ccaccgggccacuccuuc

SEQ ID NO: 1242981 - RNA, 19 nt, Human
ccaccgggccacuccuucc

SEQ ID NO: 1242982 - RNA, 20 nt, Human
ccaccgggccacuccuuccu

SEQ ID NO: 1242983 - RNA, 13 nt, Human
ccaccgggccacu

SEQ ID NO: 1242984 - RNA, 14 nt, Human
ccaccgggccacuc

SEQ ID NO: 1242985 - RNA, 22 nt, Human
ccaccgggcugggagcucugca

SEQ ID NO: 1242986 - RNA, 21 nt, Human
ccaccgggccacuccuuccug

SEQ ID NO: 1242987 - RNA, 22 nt, Human
ccaccgggccacuccuuccugc

SEQ ID NO: 1242988 - RNA, 21 nt, Human
ccaccuagacuguaaaccucu

SEQ ID NO: 1242989 - RNA, 13 nt, Human
ccaccuagcagca

SEQ ID NO: 1242990 - RNA, 14 nt, Human
ccaccuagcagcac

SEQ ID NO: 1242991 - RNA, 23 nt, Human
ccaccuagcagcaccguucugug

SEQ ID NO: 1242992 - RNA, 18 nt, Human
ccacgccucuugaccagg

SEQ ID NO: 1242993 - RNA, 19 nt, Human
ccacgccucuugaccaggc

SEQ ID NO: 1242994 - RNA, 21 nt, Human
ccacgccucuugaccaggcug

SEQ ID NO: 1242995 - RNA, 18 nt, Human
ccacgcuagggcuggcuc

SEQ ID NO: 1242996 - RNA, 15 nt, Human
ccacgcucacccccu

SEQ ID NO: 1242997 - RNA, 12 nt, Human
ccacgcuccagc

SEQ ID NO: 1242998 - RNA, 13 nt, Human
ccacgcuccagcu

SEQ ID NO: 1242999 - RNA, 16 nt, Human
ccacgcuccagcugcc

SEQ ID NO: 1243000 - RNA, 18 nt, Human
ccaccucagaccccgggg

SEQ ID NO: 1243001 - RNA, 12 nt, Human
ccacgagggcug

SEQ ID NO: 1243002 - RNA, 13 nt, Human
ccacgccacagcc

SEQ ID NO: 1243003 - RNA, 14 nt, Human
ccacgccacagccc

SEQ ID NO: 1243004 - RNA, 18 nt, Human
ccacgccacagcccuuuu

SEQ ID NO: 1243005 - RNA, 21 nt, Human
ccacgccacagcccuuuuguc

SEQ ID NO: 1243006 - RNA, 12 nt, Human
ccacgccacagc

SEQ ID NO: 1243007 - RNA, 14 nt, Human
ccacgagggcuggc

SEQ ID NO: 1243008 - RNA, 15 nt, Human
ccacgagggcuggcu

SEQ ID NO: 1243009 - RNA, 17 nt, Human
ccacgagggcuggcugg

SEQ ID NO: 1243010 - RNA, 19 nt, Human
ccacgagggcuggcuggcc

SEQ ID NO: 1243011 - RNA, 22 nt, Human
ccacgagggcuggcuggccuca

SEQ ID NO: 1243012 - RNA, 20 nt, Human
ccacgagggcuggcuggccu

SEQ ID NO: 1243013 - RNA, 14 nt, Human
ccacuccucugacu

SEQ ID NO: 1243014 - RNA, 20 nt, Human
ccacuccucugacucagggc

SEQ ID NO: 1243015 - RNA, 14 nt, Human
ccacuccucugcug

SEQ ID NO: 1243016 - RNA, 15 nt, Human
ccacuccucugcuga

SEQ ID NO: 1243017 - RNA, 22 nt, Human
cagugcacuaauguguaagaca

SEQ ID NO: 1243018 - RNA, 14 nt, Human
cagugcacugaaag

SEQ ID NO: 1243019 - RNA, 17 nt, Human
cagugcaccugucauau

SEQ ID NO: 1243020 - RNA, 19 nt, Human
cagugggacagggcauggc

SEQ ID NO: 1243021 - RNA, 22 nt, Human
cagugggagcaaacugcaugcc

SEQ ID NO: 1243022 - RNA, 18 nt, Human
cagugccaggaacccuua

SEQ ID NO: 1243023 - RNA, 18 nt, Human
cagucugagagaggccau

SEQ ID NO: 1243024 - RNA, 22 nt, Human
cagucugaugagaacucugagc

SEQ ID NO: 1243025 - RNA, 14 nt, Human
cagucucccucccu

SEQ ID NO: 1243026 - RNA, 19 nt, Human
cagucucagaaugucauuu

SEQ ID NO: 1243027 - RNA, 13 nt, Human
cagucgugccugu

SEQ ID NO: 1243028 - RNA, 14 nt, Human
cagucgugccugug

SEQ ID NO: 1243029 - RNA, 21 nt, Human
cagucucagaaugucauuuug

SEQ ID NO: 1243030 - RNA, 13 nt, Human
caguccuuggccu

SEQ ID NO: 1243031 - RNA, 15 nt, Human
caguccuuggccugc

SEQ ID NO: 1243032 - RNA, 16 nt, Human
caguccuuggccugcu

SEQ ID NO: 1243033 - RNA, 19 nt, Human
caguccuuggccugcuaag

SEQ ID NO: 1243034 - RNA, 15 nt, Human
cagucgauagagcug

SEQ ID NO: 1243035 - RNA, 16 nt, Human
cagucgauagagcugu

SEQ ID NO: 1243036 - RNA, 15 nt, Human
caguauugcucaccc

SEQ ID NO: 1243037 - RNA, 22 nt, Human
cagguuucuaagcauaaaagau

SEQ ID NO: 1243038 - RNA, 21 nt, Human
caguauugcucacccagugcc

SEQ ID NO: 1243039 - RNA, 17 nt, Human
caguauuuuuuuuuuua

SEQ ID NO: 1243040 - RNA, 24 nt, Human
cagucaaaaccaagucacuuaggu

SEQ ID NO: 1243041 - RNA, 14 nt, Human
cagucaaccugggc

SEQ ID NO: 1243042 - RNA, 15 nt, Human
cagucaaccugggca

SEQ ID NO: 1243043 - RNA, 16 nt, Human
cagucaaccugggcaa

SEQ ID NO: 1243044 - RNA, 22 nt, Human
cagucaaccugggcaaagccua

SEQ ID NO: 1243045 - RNA, 15 nt, Human
cagucaccucaugga

SEQ ID NO: 1243046 - RNA, 21 nt, Human
cagucaaccugggcaaagccu

SEQ ID NO: 1243047 - RNA, 23 nt, Human
caggugcagcccccacugccuuu

SEQ ID NO: 1243048 - RNA, 16 nt, Human
cagguuggcucugcca

SEQ ID NO: 1243049 - RNA, 17 nt, Human
cagguuggcucugccag

SEQ ID NO: 1243050 - RNA, 18 nt, Human
cagguuggcucugccagu

SEQ ID NO: 1243051 - RNA, 21 nt, Human
cagguuggcucugccaguccu

SEQ ID NO: 1243052 - RNA, 23 nt, Human
cagguuggcucugccaguccugu

SEQ ID NO: 1243053 - RNA, 22 nt, Human
cagguuggcucugccaguccug

SEQ ID NO: 1243054 - RNA, 20 nt, Human
caggugcuaauuuguuuugg

SEQ ID NO: 1243055 - RNA, 21 nt, Human
caggugcuacacccuuuucca

SEQ ID NO: 1243056 - RNA, 20 nt, Human
caggugcagcccccacugcc

SEQ ID NO: 1243057 - RNA, 18 nt, Human
caggugcagcccccacug

SEQ ID NO: 1243058 - RNA, 21 nt, Human
caggugaggucagcacaucuc

SEQ ID NO: 1243059 - RNA, 16 nt, Human
caggugaggucuguuc

SEQ ID NO: 1243060 - RNA, 21 nt, Human
caggugaggucuguuccuuuu

SEQ ID NO: 1243061 - RNA, 13 nt, Human
cagggucugcucu

SEQ ID NO: 1243062 - RNA, 14 nt, Human
cagggucugcucuu

SEQ ID NO: 1243063 - RNA, 17 nt, Human
cagggucugcucuuucu

SEQ ID NO: 1243064 - RNA, 20 nt, Human
cagggucugcucuuucucug

SEQ ID NO: 1243065 - RNA, 16 nt, Human
cagggugggcuugugg

SEQ ID NO: 1243066 - RNA, 21 nt, Human
cagggucugcucuuucucugc

SEQ ID NO: 1243067 - RNA, 22 nt, Human
cagggucugcucuuucucugcc

SEQ ID NO: 1243068 - RNA, 23 nt, Human
cagggucugcucuuucucugcca

SEQ ID NO: 1243069 - RNA, 13 nt, Human
cagggugugugcu

SEQ ID NO: 1243070 - RNA, 15 nt, Human
caggguuaagaagac

SEQ ID NO: 1243071 - RNA, 19 nt, Human
caggguugaccccagagga

SEQ ID NO: 1243072 - RNA, 20 nt, Human
caggguugaccccagaggau

SEQ ID NO: 1243073 - RNA, 17 nt, Human
caggcagccagcaucug

SEQ ID NO: 1243074 - RNA, 13 nt, Human
caggcagccagca

SEQ ID NO: 1243075 - RNA, 14 nt, Human
caggcagccagcau

SEQ ID NO: 1243076 - RNA, 16 nt, Human
caggcagccagcaucu

SEQ ID NO: 1243077 - RNA, 18 nt, Human
caggcagccagcaucugg

SEQ ID NO: 1243078 - RNA, 17 nt, Human
caggagcuuuggaccua

SEQ ID NO: 1243079 - RNA, 15 nt, Human
caggaggaauacuga

SEQ ID NO: 1243080 - RNA, 14 nt, Human
caggacccugaagg

SEQ ID NO: 1243081 - RNA, 15 nt, Human
caggacccugaaggg

SEQ ID NO: 1243082 - RNA, 16 nt, Human
caggacccugaagggg

SEQ ID NO: 1243083 - RNA, 13 nt, Human
caggacccugaag

SEQ ID NO: 1243084 - RNA, 19 nt, Human
caggagggacaaaggagcc

SEQ ID NO: 1243085 - RNA, 20 nt, Human
caggagggacaaaggagccu

SEQ ID NO: 1243086 - RNA, 21 nt, Human
caggagggacaaaggagccug

SEQ ID NO: 1243087 - RNA, 22 nt, Human
caggagggacaaaggagccugu

SEQ ID NO: 1243088 - RNA, 24 nt, Human
caggagggacaaaggagccuguga

SEQ ID NO: 1243089 - RNA, 15 nt, Human
caggagggaggggga

SEQ ID NO: 1243090 - RNA, 23 nt, Human
caggagggacaaaggagccugug

SEQ ID NO: 1243091 - RNA, 23 nt, Human
caggagggagggggaaggcaggg

SEQ ID NO: 1243092 - RNA, 21 nt, Human
caggagggcggccuccuucug

SEQ ID NO: 1243093 - RNA, 22 nt, Human
caggagggcggccuccuucuga

SEQ ID NO: 1243094 - RNA, 15 nt, Human
caggaggggggaggg

SEQ ID NO: 1243095 - RNA, 23 nt, Human
caggaggggggagggaagggagc

SEQ ID NO: 1243096 - RNA, 16 nt, Human
caggagggggucgugg

SEQ ID NO: 1243097 - RNA, 18 nt, Human
caggagggggucguggag

SEQ ID NO: 1243098 - RNA, 19 nt, Human
caggagggggucguggaga

SEQ ID NO: 1243099 - RNA, 20 nt, Human
caggagggggucguggagag

SEQ ID NO: 1243100 - RNA, 21 nt, Human
caggagggggucguggagagc

SEQ ID NO: 1243101 - RNA, 23 nt, Human
caggagggggucguggagagcua

SEQ ID NO: 1243102 - RNA, 20 nt, Human
caggaggugccacuggagug

SEQ ID NO: 1243103 - RNA, 17 nt, Human
caggaggugccacugga

SEQ ID NO: 1243104 - RNA, 19 nt, Human
caggaggugccacuggagu

SEQ ID NO: 1243105 - RNA, 15 nt, Human
caggcagauccagga

SEQ ID NO: 1243106 - RNA, 17 nt, Human
caggcagauccaggacu

SEQ ID NO: 1243107 - RNA, 18 nt, Human
caggcagauccaggacua

SEQ ID NO: 1243108 - RNA, 14 nt, Human
cagggagggccugg

SEQ ID NO: 1243109 - RNA, 16 nt, Human
cagggagggccugggc

SEQ ID NO: 1243110 - RNA, 17 nt, Human
cagggagggccugggcc

SEQ ID NO: 1243111 - RNA, 16 nt, Human
cagggaggcugguccu

SEQ ID NO: 1243112 - RNA, 22 nt, Human
cagggaggcugguccuauggcc

SEQ ID NO: 1243113 - RNA, 20 nt, Human
caggcuggcccugcccuggu

SEQ ID NO: 1243114 - RNA, 17 nt, Human
caggcgccccuuccccc

SEQ ID NO: 1243115 - RNA, 15 nt, Human
caggcgcuaauucaa

SEQ ID NO: 1243116 - RNA, 18 nt, Human
caggcuggcccugcccug

SEQ ID NO: 1243117 - RNA, 19 nt, Human
caggcuggcccugcccugg

SEQ ID NO: 1243118 - RNA, 18 nt, Human
cagggaggacgcucucug

SEQ ID NO: 1243119 - RNA, 17 nt, Human
cagggaggacgcucucu

SEQ ID NO: 1243120 - RNA, 19 nt, Human
cagggaggacgcucucugg

SEQ ID NO: 1243121 - RNA, 17 nt, Human
cagggagcugggcuucc

SEQ ID NO: 1243122 - RNA, 12 nt, Human
cagggagggccu

SEQ ID NO: 1243123 - RNA, 13 nt, Human
cagggagggccug

SEQ ID NO: 1243124 - RNA, 17 nt, Human
cagggaggcccugugcc

SEQ ID NO: 1243125 - RNA, 12 nt, Human
cagggaggccga

SEQ ID NO: 1243126 - RNA, 15 nt, Human
cagggaggccgaagc

SEQ ID NO: 1243127 - RNA, 23 nt, Human
cagggaggccgaagcuaacaggg

SEQ ID NO: 1243128 - RNA, 13 nt, Human
cagggaggcuggu

SEQ ID NO: 1243129 - RNA, 14 nt, Human
caggccucagggcu

SEQ ID NO: 1243130 - RNA, 16 nt, Human
caggccucagggcucc

SEQ ID NO: 1243131 - RNA, 20 nt, Human
caggccugccuguucccauu

SEQ ID NO: 1243132 - RNA, 15 nt, Human
caggcgccccuuccc

SEQ ID NO: 1243133 - RNA, 23 nt, Human
caggccugaaagaggcugaggcc

SEQ ID NO: 1243134 - RNA, 20 nt, Human
caggccuagaggccugacug

SEQ ID NO: 1243135 - RNA, 17 nt, Human
caggccucagggcuccu

SEQ ID NO: 1243136 - RNA, 16 nt, Human
cagcuccaagaauuuc

SEQ ID NO: 1243137 - RNA, 17 nt, Human
cagcuccaaccugcaaa

SEQ ID NO: 1243138 - RNA, 20 nt, Human
cagcuccaaccugcaaagau

SEQ ID NO: 1243139 - RNA, 19 nt, Human
cagcuccaagaauuucuag

SEQ ID NO: 1243140 - RNA, 23 nt, Human
cagcuccaaccugcaaagaucug

SEQ ID NO: 1243141 - RNA, 13 nt, Human
cagcuccacccug

SEQ ID NO: 1243142 - RNA, 15 nt, Human
cagcuccacccuggc

SEQ ID NO: 1243143 - RNA, 21 nt, Human
cagcucccaaggcucugagca

SEQ ID NO: 1243144 - RNA, 16 nt, Human
cagcuccaguuggagu

SEQ ID NO: 1243145 - RNA, 12 nt, Human
cagcucccacaa

SEQ ID NO: 1243146 - RNA, 17 nt, Human
cagcucccacaagccuc

SEQ ID NO: 1243147 - RNA, 17 nt, Human
cagcuccagguggcucu

SEQ ID NO: 1243148 - RNA, 21 nt, Human
cagcuccagguggcucugagg

SEQ ID NO: 1243149 - RNA, 19 nt, Human
cagcugccucuucccucuu

SEQ ID NO: 1243150 - RNA, 22 nt, Human
cagcugccccggccccuccccc

SEQ ID NO: 1243151 - RNA, 19 nt, Human
cagcugccccggccccucc

SEQ ID NO: 1243152 - RNA, 12 nt, Human
cagcugcacuga

SEQ ID NO: 1243153 - RNA, 18 nt, Human
cagcugcacugaugcugc

SEQ ID NO: 1243154 - RNA, 16 nt, Human
cagcugcauuccgcag

SEQ ID NO: 1243155 - RNA, 15 nt, Human
cagcugccaggagca

SEQ ID NO: 1243156 - RNA, 19 nt, Human
cagcugccaggagcacggc

SEQ ID NO: 1243157 - RNA, 11 nt, Human
cagcugccagu

SEQ ID NO: 1243158 - RNA, 15 nt, Human
cagcugccagugucc

SEQ ID NO: 1243159 - RNA, 16 nt, Human
cagcugcccccagagc

SEQ ID NO: 1243160 - RNA, 17 nt, Human
cagcugcccccagagcc

SEQ ID NO: 1243161 - RNA, 18 nt, Human
cagcugcccccagagcca

SEQ ID NO: 1243162 - RNA, 20 nt, Human
cagcugcccccagagccaca

SEQ ID NO: 1243163 - RNA, 22 nt, Human
cagcugcccccagagccacagu

SEQ ID NO: 1243164 - RNA, 21 nt, Human
cagcugcccccagagccacag

SEQ ID NO: 1243165 - RNA, 17 nt, Human
cagcugccccggccccu

SEQ ID NO: 1243166 - RNA, 21 nt, Human
cagcucccacaagccucugcc

SEQ ID NO: 1243167 - RNA, 19 nt, Human
cagcucccacaagccucug

SEQ ID NO: 1243168 - RNA, 19 nt, Human
cagcugcaagguacucugg

SEQ ID NO: 1243169 - RNA, 20 nt, Human
cagcugcaagguacucuggu

SEQ ID NO: 1243170 - RNA, 22 nt, Human
cagcugcaagguacucugguga

SEQ ID NO: 1243171 - RNA, 19 nt, Human
caggaaagcgccuccaacc

SEQ ID NO: 1243172 - RNA, 15 nt, Human
caggaaaggaaucau

SEQ ID NO: 1243173 - RNA, 18 nt, Human
caggaaaggcccagccac

SEQ ID NO: 1243174 - RNA, 20 nt, Human
caggaaagcgccuccaaccc

SEQ ID NO: 1243175 - RNA, 13 nt, Human
cagcuucagugau

SEQ ID NO: 1243176 - RNA, 19 nt, Human
caggaaaggaaucauuucu

SEQ ID NO: 1243177 - RNA, 13 nt, Human
caggaaaugaaaa

SEQ ID NO: 1243178 - RNA, 20 nt, Human
caggaaaugaaaaugucuug

SEQ ID NO: 1243179 - RNA, 21 nt, Human
caggaaaugaaaaugucuugu

SEQ ID NO: 1243180 - RNA, 14 nt, Human
caggaacaaacagg

SEQ ID NO: 1243181 - RNA, 22 nt, Human
caggaacaaacagggcugccuu

SEQ ID NO: 1243182 - RNA, 15 nt, Human
caggaacaaacaggg

SEQ ID NO: 1243183 - RNA, 11 nt, Human
cagcugugccu

SEQ ID NO: 1243184 - RNA, 12 nt, Human
cagcugugccuc

SEQ ID NO: 1243185 - RNA, 13 nt, Human
cagcugugccucg

SEQ ID NO: 1243186 - RNA, 14 nt, Human
cagcugugccucgc

SEQ ID NO: 1243187 - RNA, 12 nt, Human
cagcugccugca

SEQ ID NO: 1243188 - RNA, 16 nt, Human
cagcugucuuuuggag

SEQ ID NO: 1243189 - RNA, 18 nt, Human
cagcugucuuuuggagga

SEQ ID NO: 1243190 - RNA, 17 nt, Human
cagcugucuuuuggagg

SEQ ID NO: 1243191 - RNA, 17 nt, Human
cagcugugccucgcucc

SEQ ID NO: 1243192 - RNA, 20 nt, Human
cagcugugccucgcucccca

SEQ ID NO: 1243193 - RNA, 15 nt, Human
cagcccuucuuucca

SEQ ID NO: 1243194 - RNA, 23 nt, Human
cagcccuuaugcgguuaauuuug

SEQ ID NO: 1243195 - RNA, 16 nt, Human
cagcccuuccaaacuc

SEQ ID NO: 1243196 - RNA, 19 nt, Human
cagcccuucuuuccacaga

SEQ ID NO: 1243197 - RNA, 20 nt, Human
cagcccuucuuuccacagaa

SEQ ID NO: 1243198 - RNA, 16 nt, Human
cagccgagcaggaggc

SEQ ID NO: 1243199 - RNA, 17 nt, Human
cagccgagcaggaggcc

SEQ ID NO: 1243200 - RNA, 18 nt, Human
cagccgagcaggaggccu

SEQ ID NO: 1243201 - RNA, 19 nt, Human
cagccgagcaggaggccua

SEQ ID NO: 1243202 - RNA, 23 nt, Human
cagccgagcaggaggccuaggag

SEQ ID NO: 1243203 - RNA, 21 nt, Human
cagccgagcaggaggccuagg

SEQ ID NO: 1243204 - RNA, 11 nt, Human
cagccgcuugg

SEQ ID NO: 1243205 - RNA, 12 nt, Human
cagccgcuuggc

SEQ ID NO: 1243206 - RNA, 21 nt, Human
cagccgcuuggcgaugccagc

SEQ ID NO: 1243207 - RNA, 13 nt, Human
cagccggcacagg

SEQ ID NO: 1243208 - RNA, 15 nt, Human
cagccggcacagggu

SEQ ID NO: 1243209 - RNA, 17 nt, Human
cagccggcacagggucu

SEQ ID NO: 1243210 - RNA, 18 nt, Human
cagccggcacagggucug

SEQ ID NO: 1243211 - RNA, 23 nt, Human
cagccggcacagggucugcucuu

SEQ ID NO: 1243212 - RNA, 23 nt, Human
cagccgcuuggcgaugccagcca

SEQ ID NO: 1243213 - RNA, 23 nt, Human
cagccucugggggguggccaggc

SEQ ID NO: 1243214 - RNA, 16 nt, Human
cagccugagcaacucu

SEQ ID NO: 1243215 - RNA, 20 nt, Human
cagccugagcaacucuugau

SEQ ID NO: 1243216 - RNA, 22 nt, Human
cagccugagcgacagugagacu

SEQ ID NO: 1243217 - RNA, 19 nt, Human
cagccugagcgacagugag

SEQ ID NO: 1243218 - RNA, 18 nt, Human
cagccugagcgacaguga

SEQ ID NO: 1243219 - RNA, 22 nt, Human
cagccugaaccccagggcugua

SEQ ID NO: 1243220 - RNA, 20 nt, Human
cagccugaaccccagggcug

SEQ ID NO: 1243221 - RNA, 19 nt, Human
cagcgucggucugugcccc

SEQ ID NO: 1243222 - RNA, 15 nt, Human
cagcgugcuuuaaaa

SEQ ID NO: 1243223 - RNA, 21 nt, Human
cagccugagcaacucuugauu

SEQ ID NO: 1243224 - RNA, 22 nt, Human
cagcggugggaccuagggaggc

SEQ ID NO: 1243225 - RNA, 19 nt, Human
cagcggugggaccuaggga

SEQ ID NO: 1243226 - RNA, 15 nt, Human
cagcguccuccucug

SEQ ID NO: 1243227 - RNA, 16 nt, Human
cagcguccuccucugu

SEQ ID NO: 1243228 - RNA, 18 nt, Human
cagcguccuccucuguga

SEQ ID NO: 1243229 - RNA, 18 nt, Human
cagcgucggucugugccc

SEQ ID NO: 1243230 - RNA, 22 nt, Human
cagcacagccucuuagaugcag

SEQ ID NO: 1243231 - RNA, 19 nt, Human
cagcacacagggcagugag

SEQ ID NO: 1243232 - RNA, 22 nt, Human
cagcaccggaccagccuggccc

SEQ ID NO: 1243233 - RNA, 13 nt, Human
cagcacagccaac

SEQ ID NO: 1243234 - RNA, 15 nt, Human
cagcaccggaccagc

SEQ ID NO: 1243235 - RNA, 17 nt, Human
cagcaccggaccagccu

SEQ ID NO: 1243236 - RNA, 18 nt, Human
cagcaccggaccagccug

SEQ ID NO: 1243237 - RNA, 19 nt, Human
cagcaccggaccagccugg

SEQ ID NO: 1243238 - RNA, 20 nt, Human
cagcaccggaccagccuggc

SEQ ID NO: 1243239 - RNA, 21 nt, Human
cagcaccggaccagccuggcc

SEQ ID NO: 1243240 - RNA, 16 nt, Human
cagcaccguucugugc

SEQ ID NO: 1243241 - RNA, 17 nt, Human
cagcaccguucugugca

SEQ ID NO: 1243242 - RNA, 18 nt, Human
cagcaccguucugugcac

SEQ ID NO: 1243243 - RNA, 16 nt, Human
cagauaugauucaaau

SEQ ID NO: 1243244 - RNA, 17 nt, Human
cagauaugauucaaaug

SEQ ID NO: 1243245 - RNA, 19 nt, Human
cagauaugauucaaauguc

SEQ ID NO: 1243246 - RNA, 15 nt, Human
cagauauuugucaug

SEQ ID NO: 1243247 - RNA, 22 nt, Human
cagaggggccugccaccuggac

SEQ ID NO: 1243248 - RNA, 21 nt, Human
cagaggggccugccaccugga

SEQ ID NO: 1243249 - RNA, 14 nt, Human
cagaggggccugcc

SEQ ID NO: 1243250 - RNA, 17 nt, Human
cagaggggccugccacc

SEQ ID NO: 1243251 - RNA, 20 nt, Human
cagaggggccugccaccugg

SEQ ID NO: 1243252 - RNA, 23 nt, Human
cagagcuucccugacucauucug

SEQ ID NO: 1243253 - RNA, 10 nt, Human
cagagggcug

SEQ ID NO: 1243254 - RNA, 11 nt, Human
cagagggcugg

SEQ ID NO: 1243255 - RNA, 12 nt, Human
cagagggcugga

SEQ ID NO: 1243256 - RNA, 13 nt, Human
cagagggcuggag

SEQ ID NO: 1243257 - RNA, 14 nt, Human
cagagggcuggagg

SEQ ID NO: 1243258 - RNA, 15 nt, Human
cagagggcuggaggc

SEQ ID NO: 1243259 - RNA, 17 nt, Human
cagagggcuggaggccc

SEQ ID NO: 1243260 - RNA, 18 nt, Human
cagagggcuggaggccca

SEQ ID NO: 1243261 - RNA, 19 nt, Human
cagagggcuggaggcccag

SEQ ID NO: 1243262 - RNA, 20 nt, Human
cagagggcuggaggcccagg

SEQ ID NO: 1243263 - RNA, 16 nt, Human
cagaggggcagaggcc

SEQ ID NO: 1243264 - RNA, 21 nt, Human
cagagggcuggaggcccaggc

SEQ ID NO: 1243265 - RNA, 11 nt, Human
cagagcuggug

SEQ ID NO: 1243266 - RNA, 12 nt, Human
cagagcuggugc

SEQ ID NO: 1243267 - RNA, 13 nt, Human
cagagcuggugcg

SEQ ID NO: 1243268 - RNA, 18 nt, Human
cagagcuggugcggcugg

SEQ ID NO: 1243269 - RNA, 19 nt, Human
cagagcuggugcggcuggc

SEQ ID NO: 1243270 - RNA, 20 nt, Human
cagagcuggugcggcuggcc

SEQ ID NO: 1243271 - RNA, 21 nt, Human
cagagcuggugcggcuggcca

SEQ ID NO: 1243272 - RNA, 22 nt, Human
cagagcuggugcggcuggccau

SEQ ID NO: 1243273 - RNA, 23 nt, Human
cagagcuggugcggcuggccaug

SEQ ID NO: 1243274 - RNA, 13 nt, Human
cagagcuucccug

SEQ ID NO: 1243275 - RNA, 14 nt, Human
cagagcuucccuga

SEQ ID NO: 1243276 - RNA, 18 nt, Human
cagagcuucccugacuca

SEQ ID NO: 1243277 - RNA, 17 nt, Human
auuccagagcacugcuc

SEQ ID NO: 1243278 - RNA, 20 nt, Human
auucaggaaaaggccugggg

SEQ ID NO: 1243279 - RNA, 17 nt, Human
auuccagccaucaccuu

SEQ ID NO: 1243280 - RNA, 21 nt, Human
auuccagagaguggcuccucc

SEQ ID NO: 1243281 - RNA, 19 nt, Human
auuccagagaguggcuccu

SEQ ID NO: 1243282 - RNA, 13 nt, Human
auuccagccccuc

SEQ ID NO: 1243283 - RNA, 14 nt, Human
auuccagccccucu

SEQ ID NO: 1243284 - RNA, 17 nt, Human
auuccagccccucuggu

SEQ ID NO: 1243285 - RNA, 17 nt, Human
auucccagagcaaaaua

SEQ ID NO: 1243286 - RNA, 19 nt, Human
auucccagagcaaaauaau

SEQ ID NO: 1243287 - RNA, 19 nt, Human
auucccagguaggccaagg

SEQ ID NO: 1243288 - RNA, 23 nt, Human
auucccagguaggccaagguguc

SEQ ID NO: 1243289 - RNA, 13 nt, Human
auucccccagugc

SEQ ID NO: 1243290 - RNA, 23 nt, Human
auuccccgucucugguuccuccc

SEQ ID NO: 1243291 - RNA, 13 nt, Human
auuccccucugcu

SEQ ID NO: 1243292 - RNA, 15 nt, Human
auuccccucugcugc

SEQ ID NO: 1243293 - RNA, 22 nt, Human
auuccccucugcugcugucccu

SEQ ID NO: 1243294 - RNA, 15 nt, Human
auucccgcaguggga

SEQ ID NO: 1243295 - RNA, 16 nt, Human
auucccguuuugucac

SEQ ID NO: 1243296 - RNA, 18 nt, Human
auucccguuuugucacuu

SEQ ID NO: 1243297 - RNA, 21 nt, Human
auucccguuuugucacuuuuu

SEQ ID NO: 1243298 - RNA, 23 nt, Human
auucccguuuugucacuuuuucu

SEQ ID NO: 1243299 - RNA, 17 nt, Human
auucccuagaaacuucc

SEQ ID NO: 1243300 - RNA, 20 nt, Human
auucccuagaaacuuccaaa

SEQ ID NO: 1243301 - RNA, 21 nt, Human
auucccuagaaacuuccaaau

SEQ ID NO: 1243302 - RNA, 18 nt, Human
auucuaacggucuguucu

SEQ ID NO: 1243303 - RNA, 12 nt, Human
auucuaagacuu

SEQ ID NO: 1243304 - RNA, 20 nt, Human
auucuaagacuuacucuaag

SEQ ID NO: 1243305 - RNA, 22 nt, Human
auucuaagacuuacucuaagau

SEQ ID NO: 1243306 - RNA, 15 nt, Human
auucuaagugaaauu

SEQ ID NO: 1243307 - RNA, 23 nt, Human
auucuaagacuuacucuaagauc

SEQ ID NO: 1243308 - RNA, 23 nt, Human
auucuaaugaugaucaauuauag

SEQ ID NO: 1243309 - RNA, 20 nt, Human
auucacauuguauucagagu

SEQ ID NO: 1243310 - RNA, 13 nt, Human
auucacauuguau

SEQ ID NO: 1243311 - RNA, 23 nt, Human
auucagaaccccaacuacugugu

SEQ ID NO: 1243312 - RNA, 14 nt, Human
auucagaagaaaaa

SEQ ID NO: 1243313 - RNA, 16 nt, Human
auucagaagaaaaaga

SEQ ID NO: 1243314 - RNA, 17 nt, Human
auucagaagaaaaagaa

SEQ ID NO: 1243315 - RNA, 18 nt, Human
auucagaagaaaaagaag

SEQ ID NO: 1243316 - RNA, 13 nt, Human
auucagacagaug

SEQ ID NO: 1243317 - RNA, 22 nt, Human
auucaggaagcagcuuucccca

SEQ ID NO: 1243318 - RNA, 18 nt, Human
auucaggaaaaggccugg

SEQ ID NO: 1243319 - RNA, 19 nt, Human
auucaggaaaaggccuggg

SEQ ID NO: 1243320 - RNA, 21 nt, Human
auucaggaaaaggccuggggu

SEQ ID NO: 1243321 - RNA, 14 nt, Human
auucagacagauga

SEQ ID NO: 1243322 - RNA, 20 nt, Human
auucagacagaugaggcuuu

SEQ ID NO: 1243323 - RNA, 17 nt, Human
auucaggaaaaggccug

SEQ ID NO: 1243324 - RNA, 16 nt, Human
auuauuauucuucaua

SEQ ID NO: 1243325 - RNA, 15 nt, Human
auuauuauuuguguu

SEQ ID NO: 1243326 - RNA, 21 nt, Human
auuauuugagaagcugcucaa

SEQ ID NO: 1243327 - RNA, 13 nt, Human
auuauuugagaag

SEQ ID NO: 1243328 - RNA, 11 nt, Human
auuauuugcau

SEQ ID NO: 1243329 - RNA, 12 nt, Human
auuauuuugaug

SEQ ID NO: 1243330 - RNA, 12 nt, Human
auuauuuuguga

SEQ ID NO: 1243331 - RNA, 23 nt, Human
auucacaguucuuugggccagac

SEQ ID NO: 1243332 - RNA, 17 nt, Human
auucacaucuaaccuca

SEQ ID NO: 1243333 - RNA, 20 nt, Human
auucacaucuaaccucaucu

SEQ ID NO: 1243334 - RNA, 18 nt, Human
auucacaucgcagauucu

SEQ ID NO: 1243335 - RNA, 15 nt, Human
auucacaucucauuu

SEQ ID NO: 1243336 - RNA, 16 nt, Human
auucacaucucauuuu

SEQ ID NO: 1243337 - RNA, 15 nt, Human
auuauuauuuggccc

SEQ ID NO: 1243338 - RNA, 15 nt, Human
auuauuauucuucau

SEQ ID NO: 1243339 - RNA, 19 nt, Human
auuauuacuuguaaauaua

SEQ ID NO: 1243340 - RNA, 20 nt, Human
auuauuacuuguaaauauaa

SEQ ID NO: 1243341 - RNA, 23 nt, Human
auuauuacuuguaaauauaaaga

SEQ ID NO: 1243342 - RNA, 22 nt, Human
auuauuacuuguaaauauaaag

SEQ ID NO: 1243343 - RNA, 14 nt, Human
auuauuacuuuugc

SEQ ID NO: 1243344 - RNA, 15 nt, Human
auuauuacuuuugcu

SEQ ID NO: 1243345 - RNA, 23 nt, Human
auuauuagaaucaaacauuuuga

SEQ ID NO: 1243346 - RNA, 17 nt, Human
auuauuagaaucaaaca

SEQ ID NO: 1243347 - RNA, 22 nt, Human
auuauuaguuuugauuuaaugu

SEQ ID NO: 1243348 - RNA, 20 nt, Human
auuauuacuuauuuuugaca

SEQ ID NO: 1243349 - RNA, 21 nt, Human
auuauuacuuauuuuugacag

SEQ ID NO: 1243350 - RNA, 13 nt, Human
auuauuacuugua

SEQ ID NO: 1243351 - RNA, 14 nt, Human
auuauuacuuguaa

SEQ ID NO: 1243352 - RNA, 16 nt, Human
auuauuacuuguaaau

SEQ ID NO: 1243353 - RNA, 17 nt, Human
auuauuacuuguaaaua

SEQ ID NO: 1243354 - RNA, 15 nt, Human
auuauauuuauuacu

SEQ ID NO: 1243355 - RNA, 18 nt, Human
auuauauuuauuacugua

SEQ ID NO: 1243356 - RNA, 23 nt, Human
auuauauuucuauuuuauuauga

SEQ ID NO: 1243357 - RNA, 22 nt, Human
auuauauuucuauuuuauuaug

SEQ ID NO: 1243358 - RNA, 13 nt, Human
auuaucuaauuua

SEQ ID NO: 1243359 - RNA, 14 nt, Human
auuaucuaauuuau

SEQ ID NO: 1243360 - RNA, 18 nt, Human
auuauauguucagauuau

SEQ ID NO: 1243361 - RNA, 16 nt, Human
auuauacuuguaauua

SEQ ID NO: 1243362 - RNA, 17 nt, Human
auuauacuuguaauuau

SEQ ID NO: 1243363 - RNA, 17 nt, Human
auuauauguuguaagca

SEQ ID NO: 1243364 - RNA, 18 nt, Human
auuauacuuguaauuaug

SEQ ID NO: 1243365 - RNA, 14 nt, Human
auuauacgcuggca

SEQ ID NO: 1243366 - RNA, 14 nt, Human
auuauacuuguaau

SEQ ID NO: 1243367 - RNA, 19 nt, Human
auuauacccccugcaaagc

SEQ ID NO: 1243368 - RNA, 18 nt, Human
auuauaccaaaauguugc

SEQ ID NO: 1243369 - RNA, 19 nt, Human
auuauaccaaaauguugcu

SEQ ID NO: 1243370 - RNA, 20 nt, Human
auuauaccaaaauguugcug

SEQ ID NO: 1243371 - RNA, 15 nt, Human
auuauaccaaaaugu

SEQ ID NO: 1243372 - RNA, 16 nt, Human
auuauaccaaaauguu

SEQ ID NO: 1243373 - RNA, 14 nt, Human
auuauauuaugaag

SEQ ID NO: 1243374 - RNA, 20 nt, Human
auuauauuauuaguuuugau

SEQ ID NO: 1243375 - RNA, 15 nt, Human
auuauauuuacaaau

SEQ ID NO: 1243376 - RNA, 11 nt, Human
uuuguggaaaa

SEQ ID NO: 1243377 - RNA, 12 nt, Human
auuaguuauaua

SEQ ID NO: 1243378 - RNA, 12 nt, Human
auuaguuuccuu

SEQ ID NO: 1243379 - RNA, 17 nt, Human
auuaguuuccuuuuuaa

SEQ ID NO: 1243380 - RNA, 18 nt, Human
auuaguuuccuuuuuaau

SEQ ID NO: 1243381 - RNA, 11 nt, Human
auuaguuuuaa

SEQ ID NO: 1243382 - RNA, 16 nt, Human
auuaguuuuaaaauga

SEQ ID NO: 1243383 - RNA, 20 nt, Human
auuaguuuccuuuuuaauau

SEQ ID NO: 1243384 - RNA, 20 nt, Human
auuauacuuguaauuaugga

SEQ ID NO: 1243385 - RNA, 20 nt, Human
auucuucccuaucuuugcca

SEQ ID NO: 1243386 - RNA, 12 nt, Human
auucuuccuagu

SEQ ID NO: 1243387 - RNA, 21 nt, Human
auucuucccuaucuuugccac

SEQ ID NO: 1243388 - RNA, 17 nt, Human
auucuuccuaguuuucu

SEQ ID NO: 1243389 - RNA, 19 nt, Human
auucuuccuaguuuucucc

SEQ ID NO: 1243390 - RNA, 13 nt, Human
auucuuccaucug

SEQ ID NO: 1243391 - RNA, 14 nt, Human
auucuuccaucuga

SEQ ID NO: 1243392 - RNA, 15 nt, Human
auucuuccaucugau

SEQ ID NO: 1243393 - RNA, 23 nt, Human
auucuuccaucugauugugaugu

SEQ ID NO: 1243394 - RNA, 19 nt, Human
auugaaaaaauagagccug

SEQ ID NO: 1243395 - RNA, 22 nt, Human
auugaaaaaauagagccugagg

SEQ ID NO: 1243396 - RNA, 14 nt, Human
auugaaaaaauaga

SEQ ID NO: 1243397 - RNA, 18 nt, Human
auugaaaaaauagagccu

SEQ ID NO: 1243398 - RNA, 14 nt, Human
auugaaauguaagg

SEQ ID NO: 1243399 - RNA, 17 nt, Human
auugacacuuaaaaaug

SEQ ID NO: 1243400 - RNA, 15 nt, Human
auugacacuuaaaaa

SEQ ID NO: 1243401 - RNA, 17 nt, Human
auugacaacacccauuu

SEQ ID NO: 1243402 - RNA, 12 nt, Human
auugacacagaa

SEQ ID NO: 1243403 - RNA, 14 nt, Human
auugacacagaaaa

SEQ ID NO: 1243404 - RNA, 23 nt, Human
auugaaccuuugugcccuaucac

SEQ ID NO: 1243405 - RNA, 18 nt, Human
auugaaccuuugugcccu

SEQ ID NO: 1243406 - RNA, 17 nt, Human
auugacaacaguuacau

SEQ ID NO: 1243407 - RNA, 20 nt, Human
auugacacuuaaaaaugguu

SEQ ID NO: 1243408 - RNA, 19 nt, Human
auugacacuuaaaaauggu

SEQ ID NO: 1243409 - RNA, 17 nt, Human
auugacacagaaaaugu

SEQ ID NO: 1243410 - RNA, 18 nt, Human
auugacacaguaccauuu

SEQ ID NO: 1243411 - RNA, 22 nt, Human
auugacgacaagugcugaacag

SEQ ID NO: 1243412 - RNA, 21 nt, Human
auugacgacaagugcugaaca

SEQ ID NO: 1243413 - RNA, 14 nt, Human
auugaccuggaugg

SEQ ID NO: 1243414 - RNA, 11 nt, Human
auugacuucuu

SEQ ID NO: 1243415 - RNA, 14 nt, Human
auugacuuguauau

SEQ ID NO: 1243416 - RNA, 22 nt, Human
auugacuuuccccaccagaugc

SEQ ID NO: 1243417 - RNA, 19 nt, Human
auucugccuuugccaggug

SEQ ID NO: 1243418 - RNA, 16 nt, Human
auucugccuuugccag

SEQ ID NO: 1243419 - RNA, 15 nt, Human
auucugccucucuag

SEQ ID NO: 1243420 - RNA, 16 nt, Human
auucugccucucuagg

SEQ ID NO: 1243421 - RNA, 17 nt, Human
auucugccucucuagga

SEQ ID NO: 1243422 - RNA, 22 nt, Human
auucucauuggaaauuuagcau

SEQ ID NO: 1243423 - RNA, 23 nt, Human
auucucauuggaaauuuagcauu

SEQ ID NO: 1243424 - RNA, 13 nt, Human
auucuccacagca

SEQ ID NO: 1243425 - RNA, 14 nt, Human
auucuccacagcaa

SEQ ID NO: 1243426 - RNA, 16 nt, Human
auucuccacagcaacc

SEQ ID NO: 1243427 - RNA, 22 nt, Human
auucucaugccucagccuccug

SEQ ID NO: 1243428 - RNA, 12 nt, Human
auucucauuaaa

SEQ ID NO: 1243429 - RNA, 19 nt, Human
auucucauuaaaagaauau

SEQ ID NO: 1243430 - RNA, 18 nt, Human
auucucauuaaaagaaua

SEQ ID NO: 1243431 - RNA, 11 nt, Human
auucucauugg

SEQ ID NO: 1243432 - RNA, 21 nt, Human
auucucauuggaaauuuagca

SEQ ID NO: 1243433 - RNA, 15 nt, Human
auucuagcuuugagc

SEQ ID NO: 1243434 - RNA, 14 nt, Human
auuuuguuuauaag

SEQ ID NO: 1243435 - RNA, 18 nt, Human
auuuuguuuuuccuucca

SEQ ID NO: 1243436 - RNA, 21 nt, Human
auuuuuauuuuugcugagacu

SEQ ID NO: 1243437 - RNA, 22 nt, Human
auuuuucaauagcacauaugga

SEQ ID NO: 1243438 - RNA, 21 nt, Human
auuuuuccaacuacuaauaga

SEQ ID NO: 1243439 - RNA, 10 nt, Human
auuuuuccua

SEQ ID NO: 1243440 - RNA, 20 nt, Human
auuuuuccuccacugaacua

SEQ ID NO: 1243441 - RNA, 12 nt, Human
auuuuucuaacu

SEQ ID NO: 1243442 - RNA, 19 nt, Human
auuuuucuaacuacaaagg

SEQ ID NO: 1243443 - RNA, 15 nt, Human
auuuuucacuucaaa

SEQ ID NO: 1243444 - RNA, 17 nt, Human
auuuuucagagaauaga

SEQ ID NO: 1243445 - RNA, 20 nt, Human
auuuuucaauagcacauaug

SEQ ID NO: 1243446 - RNA, 15 nt, Human
auuuuucauccuaaa

SEQ ID NO: 1243447 - RNA, 18 nt, Human
auuuuucaugauaaugaa

SEQ ID NO: 1243448 - RNA, 19 nt, Human
auuuuucaugauuuugaaa

SEQ ID NO: 1243449 - RNA, 13 nt, Human
auuuuuccaacua

SEQ ID NO: 1243450 - RNA, 14 nt, Human
auuuuucuucuuga

SEQ ID NO: 1243451 - RNA, 15 nt, Human
auuuuucuuuaacug

SEQ ID NO: 1243452 - RNA, 16 nt, Human
auuuuucuuuaacugc

SEQ ID NO: 1243453 - RNA, 13 nt, Human
auuuuucuuuaca

SEQ ID NO: 1243454 - RNA, 14 nt, Human
auuuuucuuuacaa

SEQ ID NO: 1243455 - RNA, 15 nt, Human
auuuuucuuuacaaa

SEQ ID NO: 1243456 - RNA, 16 nt, Human
auuuuucuuuacaaaa

SEQ ID NO: 1243457 - RNA, 15 nt, Human
auuuuugacaguguu

SEQ ID NO: 1243458 - RNA, 21 nt, Human
auuuuugauaaagccucaagg

SEQ ID NO: 1243459 - RNA, 21 nt, Human
auuuuugauacuaagcauuga

SEQ ID NO: 1243460 - RNA, 19 nt, Human
auuuuugauacuaagcauu

SEQ ID NO: 1243461 - RNA, 12 nt, Human
auuuuugccucu

SEQ ID NO: 1243462 - RNA, 18 nt, Human
auuuuugccucuuccagu

SEQ ID NO: 1243463 - RNA, 21 nt, Human
auuuuugccucuuccagucuu

SEQ ID NO: 1243464 - RNA, 15 nt, Human
auuuuugcugagacu

SEQ ID NO: 1243465 - RNA, 23 nt, Human
auuuuuggaagaggacuccuuaa

SEQ ID NO: 1243466 - RNA, 17 nt, Human
auuuuuggagguuuauu

SEQ ID NO: 1243467 - RNA, 19 nt, Human
auuuuuggagguuuauuac

SEQ ID NO: 1243468 - RNA, 21 nt, Human
auuuuuggggggaguaaagaa

SEQ ID NO: 1243469 - RNA, 19 nt, Human
auuuuuggcagucugaauu

SEQ ID NO: 1243470 - RNA, 18 nt, Human
auuuuuggucauuguaau

SEQ ID NO: 1243471 - RNA, 18 nt, Human
auuuuuggagguuuauua

SEQ ID NO: 1243472 - RNA, 19 nt, Human
auuuuuugaaaagcagaca

SEQ ID NO: 1243473 - RNA, 16 nt, Human
auuuuuugaaaagcag

SEQ ID NO: 1243474 - RNA, 20 nt, Human
auuuuuucucuaggaaauau

SEQ ID NO: 1243475 - RNA, 23 nt, Human
auuuuuucucuaggaaauauuua

SEQ ID NO: 1243476 - RNA, 22 nt, Human
auuuuuugggcagcaauuuaaa

SEQ ID NO: 1243477 - RNA, 14 nt, Human
auuuuuuguauaau

SEQ ID NO: 1243478 - RNA, 15 nt, Human
auuuuuuguauaauu

SEQ ID NO: 1243479 - RNA, 18 nt, Human
auuuuuuguuaaaugauu

SEQ ID NO: 1243480 - RNA, 16 nt, Human
auuuuuuguauaauug

SEQ ID NO: 1243481 - RNA, 12 nt, Human
auuuuuuguuga

SEQ ID NO: 1243482 - RNA, 14 nt, Human
auuuuuuguugaca

SEQ ID NO: 1243483 - RNA, 16 nt, Human
auuuuuuguugacauu

SEQ ID NO: 1243484 - RNA, 21 nt, Human
auuuuuuguugacauuagucu

SEQ ID NO: 1243485 - RNA, 17 nt, Human
auuuuuuguugacauua

SEQ ID NO: 1243486 - RNA, 19 nt, Human
auuuuuuacagcugccugc

SEQ ID NO: 1243487 - RNA, 15 nt, Human
auuuuuuaauuauua

SEQ ID NO: 1243488 - RNA, 20 nt, Human
auuuuuuaauuauuauuuau

SEQ ID NO: 1243489 - RNA, 13 nt, Human
auuuuuuaggaaa

SEQ ID NO: 1243490 - RNA, 14 nt, Human
auuuuuuaggaaau

SEQ ID NO: 1243491 - RNA, 17 nt, Human
auuuuuuauaaaauaca

SEQ ID NO: 1243492 - RNA, 21 nt, Human
auuuuuuaagugaaaauauag

SEQ ID NO: 1243493 - RNA, 14 nt, Human
auuuuuuaauaauu

SEQ ID NO: 1243494 - RNA, 16 nt, Human
auuuuuuagugacuaa

SEQ ID NO: 1243495 - RNA, 16 nt, Human
auuuuuuaucaugcau

SEQ ID NO: 1243496 - RNA, 21 nt, Human
auuuuuuaucaugcauguccu

SEQ ID NO: 1243497 - RNA, 15 nt, Human
auuuuuucaguauua

SEQ ID NO: 1243498 - RNA, 22 nt, Human
auuuuuucaguauuauauguac

SEQ ID NO: 1243499 - RNA, 12 nt, Human
auuuuuuccaaa

SEQ ID NO: 1243500 - RNA, 13 nt, Human
auuuuuuccaaaa

SEQ ID NO: 1243501 - RNA, 23 nt, Human
auuuuuuccaaaaucucccauuu

SEQ ID NO: 1243502 - RNA, 14 nt, Human
auuuuuuccaaaau

SEQ ID NO: 1243503 - RNA, 20 nt, Human
auuuuuuccuucaaaguuua

SEQ ID NO: 1243504 - RNA, 21 nt, Human
auuuuuuccuucaaaguuuaa

SEQ ID NO: 1243505 - RNA, 23 nt, Human
auuuuuuccuucaaaguuuaaua

SEQ ID NO: 1243506 - RNA, 22 nt, Human
auuuuugugauuuugugauuga

SEQ ID NO: 1243507 - RNA, 15 nt, Human
auuuuuguaguagcg

SEQ ID NO: 1243508 - RNA, 12 nt, Human
auuuuuguaauu

SEQ ID NO: 1243509 - RNA, 18 nt, Human
auuuuuuaaauugaauuc

SEQ ID NO: 1243510 - RNA, 13 nt, Human
auuuuuuaaauuc

SEQ ID NO: 1243511 - RNA, 21 nt, Human
auuuuuguuuuguuuuuacaa

SEQ ID NO: 1243512 - RNA, 14 nt, Human
auuuuuuaaaaaag

SEQ ID NO: 1243513 - RNA, 17 nt, Human
auuuuuuaaaaaagcuu

SEQ ID NO: 1243514 - RNA, 18 nt, Human
auuuuuuaaaaaagcuua

SEQ ID NO: 1243515 - RNA, 19 nt, Human
auuuuuuaaaaaagcuuaa

SEQ ID NO: 1243516 - RNA, 20 nt, Human
auuuuuuaaaaaagcuuaaa

SEQ ID NO: 1243517 - RNA, 15 nt, Human
auuuuuuaaaaagca

SEQ ID NO: 1243518 - RNA, 16 nt, Human
auuuuuuaaaaagcaa

SEQ ID NO: 1243519 - RNA, 18 nt, Human
auuuuuuaaaaagcaaaa

SEQ ID NO: 1243520 - RNA, 17 nt, Human
auuuuaauaaacacucu

SEQ ID NO: 1243521 - RNA, 16 nt, Human
auuuuaauaaacacuc

SEQ ID NO: 1243522 - RNA, 15 nt, Human
auuuuaauaaacacu

SEQ ID NO: 1243523 - RNA, 15 nt, Human
auuuuaauaaaaaua

SEQ ID NO: 1243524 - RNA, 18 nt, Human
auuuuaauaaaaauaauu

SEQ ID NO: 1243525 - RNA, 12 nt, Human
auuuuaauaaug

SEQ ID NO: 1243526 - RNA, 13 nt, Human
auuuuaauaauau

SEQ ID NO: 1243527 - RNA, 15 nt, Human
auuuucuauaauuua

SEQ ID NO: 1243528 - RNA, 14 nt, Human
auuuucuauaauuu

SEQ ID NO: 1243529 - RNA, 18 nt, Human
auuuuccuggugccaauu

SEQ ID NO: 1243530 - RNA, 22 nt, Human
auuuuccuggugccaauuucaa

SEQ ID NO: 1243531 - RNA, 14 nt, Human
auuuugaugaacaa

SEQ ID NO: 1243532 - RNA, 23 nt, Human
auuuuccuggugccaauuucaag

SEQ ID NO: 1243533 - RNA, 16 nt, Human
auuuuccuguccucuu

SEQ ID NO: 1243534 - RNA, 19 nt, Human
auuuuccuguccucuuuca

SEQ ID NO: 1243535 - RNA, 21 nt, Human
auuuuccuguccucuuucagc

SEQ ID NO: 1243536 - RNA, 22 nt, Human
auuuuccuguccucuuucagcu

SEQ ID NO: 1243537 - RNA, 23 nt, Human
auuuuccuguccucuuucagcuc

SEQ ID NO: 1243538 - RNA, 19 nt, Human
auuuuccuguugucaagaa

SEQ ID NO: 1243539 - RNA, 17 nt, Human
auuuugauguaaagaug

SEQ ID NO: 1243540 - RNA, 18 nt, Human
auuuugauguaaagaugu

SEQ ID NO: 1243541 - RNA, 20 nt, Human
auuuugccaagggcauaaau

SEQ ID NO: 1243542 - RNA, 14 nt, Human
auuuugcuggaaua

SEQ ID NO: 1243543 - RNA, 18 nt, Human
auuuugccagugggaacu

SEQ ID NO: 1243544 - RNA, 19 nt, Human
auuuugccaagggcauaaa

SEQ ID NO: 1243545 - RNA, 13 nt, Human
auuuugcaaagau

SEQ ID NO: 1243546 - RNA, 16 nt, Human
auuuugcaaagauuua

SEQ ID NO: 1243547 - RNA, 21 nt, Human
auuuugcaaagauuuaaucug

SEQ ID NO: 1243548 - RNA, 21 nt, Human
auuuugcaaucccuuaauauc

SEQ ID NO: 1243549 - RNA, 18 nt, Human
auuuugcaaggugcauuu

SEQ ID NO: 1243550 - RNA, 17 nt, Human
auuuuguguuuaggaac

SEQ ID NO: 1243551 - RNA, 18 nt, Human
auuuugugaugcaaauaa

SEQ ID NO: 1243552 - RNA, 16 nt, Human
auuuuguuucagugca

SEQ ID NO: 1243553 - RNA, 15 nt, Human
auuuuguuuaaauua

SEQ ID NO: 1243554 - RNA, 11 nt, Human
auuuuguuuac

SEQ ID NO: 1243555 - RNA, 12 nt, Human
auuuuguuuaca

SEQ ID NO: 1243556 - RNA, 19 nt, Human
auuuuguugcuguuuugau

SEQ ID NO: 1243557 - RNA, 23 nt, Human
auuuuguugcuguuuugauuugu

SEQ ID NO: 1243558 - RNA, 15 nt, Human
auuuuguuggcauag

SEQ ID NO: 1243559 - RNA, 21 nt, Human
auuuuguuggcauagcucugg

SEQ ID NO: 1243560 - RNA, 17 nt, Human
auuuugugaugcaaaua

SEQ ID NO: 1243561 - RNA, 23 nt, Human
auuuugugguuuucgagauuauc

SEQ ID NO: 1243562 - RNA, 16 nt, Human
auuuuguguaagaaau

SEQ ID NO: 1243563 - RNA, 17 nt, Human
auuuuguguaagaaaua

SEQ ID NO: 1243564 - RNA, 18 nt, Human
auuuuguguaagaaauac

SEQ ID NO: 1243565 - RNA, 20 nt, Human
auuuuguguaagaaauacag

SEQ ID NO: 1243566 - RNA, 12 nt, Human
auuuuggaauuu

SEQ ID NO: 1243567 - RNA, 11 nt, Human
auuuuggaauu

SEQ ID NO: 1243568 - RNA, 20 nt, Human
auuuuguaaacucaaaauau

SEQ ID NO: 1243569 - RNA, 18 nt, Human
auuuuguaacgaagacac

SEQ ID NO: 1243570 - RNA, 19 nt, Human
auuuuguaacgaagacaca

SEQ ID NO: 1243571 - RNA, 17 nt, Human
auuuuguaacuuucucu

SEQ ID NO: 1243572 - RNA, 12 nt, Human
auuuuguaaguu

SEQ ID NO: 1243573 - RNA, 14 nt, Human
auuuuguaauaaua

SEQ ID NO: 1243574 - RNA, 19 nt, Human
auuuuguaauaauaaagaa

SEQ ID NO: 1243575 - RNA, 22 nt, Human
auuuuguaauaauaaagaauag

SEQ ID NO: 1243576 - RNA, 20 nt, Human
auuuuguaauguaucaaaua

SEQ ID NO: 1243577 - RNA, 23 nt, Human
auuuuguaauguaucaaauacau

SEQ ID NO: 1243578 - RNA, 16 nt, Human
auuuuguaucuugaug

SEQ ID NO: 1243579 - RNA, 19 nt, Human
auuuuguauuguuucaauu

SEQ ID NO: 1243580 - RNA, 14 nt, Human
auuuuggaauuugc

SEQ ID NO: 1243581 - RNA, 22 nt, Human
auuuguaguguuggagaagaac

SEQ ID NO: 1243582 - RNA, 14 nt, Human
auuuguauaaaaua

SEQ ID NO: 1243583 - RNA, 15 nt, Human
auuuguauaaaauaa

SEQ ID NO: 1243584 - RNA, 19 nt, Human
auuugucaugcugggauuu

SEQ ID NO: 1243585 - RNA, 23 nt, Human
auuuguaacccacugagaggaca

SEQ ID NO: 1243586 - RNA, 12 nt, Human
auuuguaaaucu

SEQ ID NO: 1243587 - RNA, 16 nt, Human
auuuguaaaucugcca

SEQ ID NO: 1243588 - RNA, 17 nt, Human
auuuguaaaucugccac

SEQ ID NO: 1243589 - RNA, 17 nt, Human
auuugggagacauguga

SEQ ID NO: 1243590 - RNA, 19 nt, Human
auuugggagacaugugaca

SEQ ID NO: 1243591 - RNA, 19 nt, Human
auuugggccugcuccagac

SEQ ID NO: 1243592 - RNA, 21 nt, Human
auuugggccugcuccagaccu

SEQ ID NO: 1243593 - RNA, 22 nt, Human
auuugggccugcuccagaccug

SEQ ID NO: 1243594 - RNA, 23 nt, Human
auuugggccugcuccagaccuga

SEQ ID NO: 1243595 - RNA, 15 nt, Human
auuugacuuuucugu

SEQ ID NO: 1243596 - RNA, 22 nt, Human
auuugacuuuucuguaauucag

SEQ ID NO: 1243597 - RNA, 16 nt, Human
auuugacuuuucugua

SEQ ID NO: 1243598 - RNA, 19 nt, Human
auuuggcuugacaaaggca

SEQ ID NO: 1243599 - RNA, 14 nt, Human
auuugggaagugaa

SEQ ID NO: 1243600 - RNA, 18 nt, Human
auuugggaagugaagacu

SEQ ID NO: 1243601 - RNA, 23 nt, Human
auuuuaaaagaaugauuaugaau

SEQ ID NO: 1243602 - RNA, 18 nt, Human
auuuuaaaauagcguucu

SEQ ID NO: 1243603 - RNA, 20 nt, Human
auuuuaaaauagcguucuug

SEQ ID NO: 1243604 - RNA, 22 nt, Human
auuuuaaaauagcguucuugua

SEQ ID NO: 1243605 - RNA, 23 nt, Human
auuuuaaaauagcguucuuguaa

SEQ ID NO: 1243606 - RNA, 13 nt, Human
auuuuaaaaucag

SEQ ID NO: 1243607 - RNA, 22 nt, Human
auuuuaaccuaugauauuuucu

SEQ ID NO: 1243608 - RNA, 21 nt, Human
auuugugaagguggaaauaaa

SEQ ID NO: 1243609 - RNA, 18 nt, Human
auuugugaagguggaaau

SEQ ID NO: 1243610 - RNA, 16 nt, Human
auuuuaaaagaaugau

SEQ ID NO: 1243611 - RNA, 23 nt, Human
auuugugaagguggaaauaaacu

SEQ ID NO: 1243612 - RNA, 23 nt, Human
auuugugaaaugauggugaaagu

SEQ ID NO: 1243613 - RNA, 17 nt, Human
auuucuaggacugaauu

SEQ ID NO: 1243614 - RNA, 18 nt, Human
auuucuaggacugaauua

SEQ ID NO: 1243615 - RNA, 14 nt, Human
auuucccucucuca

SEQ ID NO: 1243616 - RNA, 20 nt, Human
auuucccuuccuuccucucc

SEQ ID NO: 1243617 - RNA, 16 nt, Human
auuucccuuccuuccu

SEQ ID NO: 1243618 - RNA, 20 nt, Human
auuucccuacauuaaacaug

SEQ ID NO: 1243619 - RNA, 17 nt, Human
auuucccuacauuaaac

SEQ ID NO: 1243620 - RNA, 15 nt, Human
auuucccuacauuaa

SEQ ID NO: 1243621 - RNA, 20 nt, Human
auuucuaggacugaauuaug

SEQ ID NO: 1243622 - RNA, 23 nt, Human
auuucuaggacugaauuaugaaa

SEQ ID NO: 1243623 - RNA, 11 nt, Human
auuucuaggua

SEQ ID NO: 1243624 - RNA, 20 nt, Human
auuucuagguaggaaaugug

SEQ ID NO: 1243625 - RNA, 19 nt, Human
auuucuagguaggaaaugu

SEQ ID NO: 1243626 - RNA, 18 nt, Human
auuugaaacacuuugcau

SEQ ID NO: 1243627 - RNA, 20 nt, Human
auuucuugagguaaaagcau

SEQ ID NO: 1243628 - RNA, 17 nt, Human
auuucuauagccaaaaa

SEQ ID NO: 1243629 - RNA, 19 nt, Human
auuucuuccuaccaaguca

SEQ ID NO: 1243630 - RNA, 20 nt, Human
auuucuuccuaccaagucaa

SEQ ID NO: 1243631 - RNA, 23 nt, Human
auuucuuccuaccaagucaaacu

SEQ ID NO: 1243632 - RNA, 14 nt, Human
auuucuucuuacca

SEQ ID NO: 1243633 - RNA, 14 nt, Human
auuuauuuuaauaa

SEQ ID NO: 1243634 - RNA, 17 nt, Human
auuuauuuuaauaaugu

SEQ ID NO: 1243635 - RNA, 23 nt, Human
auuucauuuuucaauagcacaua

SEQ ID NO: 1243636 - RNA, 16 nt, Human
auuuauuugaaugauu

SEQ ID NO: 1243637 - RNA, 12 nt, Human
auuuauuuccuc

SEQ ID NO: 1243638 - RNA, 17 nt, Human
auuuauuuccucccucu

SEQ ID NO: 1243639 - RNA, 15 nt, Human
auuuauuuccucccu

SEQ ID NO: 1243640 - RNA, 13 nt, Human
auuuauuugaaug

SEQ ID NO: 1243641 - RNA, 21 nt, Human
auuuauuugaaugauuuuucu

SEQ ID NO: 1243642 - RNA, 14 nt, Human
auuuauuuaaaaua

SEQ ID NO: 1243643 - RNA, 16 nt, Human
auuuauuuaaaauagc

SEQ ID NO: 1243644 - RNA, 19 nt, Human
auuuccaacucgaaucugu

SEQ ID NO: 1243645 - RNA, 20 nt, Human
auuuccaacucgaaucugug

SEQ ID NO: 1243646 - RNA, 18 nt, Human
auuucccaacacaaagau

SEQ ID NO: 1243647 - RNA, 19 nt, Human
auuucccaacacaaagauu

SEQ ID NO: 1243648 - RNA, 12 nt, Human
auuucccaggac

SEQ ID NO: 1243649 - RNA, 13 nt, Human
auuucccaggacc

SEQ ID NO: 1243650 - RNA, 14 nt, Human
auuucccaggaccc

SEQ ID NO: 1243651 - RNA, 16 nt, Human
auuucccaggacccug

SEQ ID NO: 1243652 - RNA, 19 nt, Human
auuucccaggacccugaag

SEQ ID NO: 1243653 - RNA, 19 nt, Human
auuggcaccgaagcccaga

SEQ ID NO: 1243654 - RNA, 18 nt, Human
auuggcaccgaagcccag

SEQ ID NO: 1243655 - RNA, 20 nt, Human
auuggcaccuaauccaggca

SEQ ID NO: 1243656 - RNA, 14 nt, Human
auuggauuuccuaa

SEQ ID NO: 1243657 - RNA, 15 nt, Human
auuggauuuccuaau

SEQ ID NO: 1243658 - RNA, 22 nt, Human
auuggauuuccuaauacuguca

SEQ ID NO: 1243659 - RNA, 23 nt, Human
auuggauuuccuaauacugucau

SEQ ID NO: 1243660 - RNA, 18 nt, Human
auugggagcuugggaaug

SEQ ID NO: 1243661 - RNA, 21 nt, Human
auugggagcuugggaauggau

SEQ ID NO: 1243662 - RNA, 18 nt, Human
auugguaaagaauggaag

SEQ ID NO: 1243663 - RNA, 19 nt, Human
auuggguuuuuggacuucu

SEQ ID NO: 1243664 - RNA, 22 nt, Human
auuggguuuuuggacuucuggg

SEQ ID NO: 1243665 - RNA, 15 nt, Human
auugguuuaaagaaa

SEQ ID NO: 1243666 - RNA, 17 nt, Human
auugguuuaaagaaagu

SEQ ID NO: 1243667 - RNA, 18 nt, Human
auugguuuaaagaaagug

SEQ ID NO: 1243668 - RNA, 19 nt, Human
auuggacaguaaaauccac

SEQ ID NO: 1243669 - RNA, 13 nt, Human
auuggaaacaagu

SEQ ID NO: 1243670 - RNA, 18 nt, Human
auuggaauguucucagau

SEQ ID NO: 1243671 - RNA, 17 nt, Human
auuggacaaagaaccuu

SEQ ID NO: 1243672 - RNA, 14 nt, Human
auuggacccuucca

SEQ ID NO: 1243673 - RNA, 22 nt, Human
auuggauauuuuuuacuuuaga

SEQ ID NO: 1243674 - RNA, 11 nt, Human
auuggauauuu

SEQ ID NO: 1243675 - RNA, 13 nt, Human
auugacuuuuuau

SEQ ID NO: 1243676 - RNA, 18 nt, Human
auugacuuuuuauggcac

SEQ ID NO: 1243677 - RNA, 13 nt, Human
auugauuguauug

SEQ ID NO: 1243678 - RNA, 16 nt, Human
auugauuguauuguug

SEQ ID NO: 1243679 - RNA, 21 nt, Human
auugcuuuguauuguauauua

SEQ ID NO: 1243680 - RNA, 19 nt, Human
auuguuuuacaauaguucu

SEQ ID NO: 1243681 - RNA, 14 nt, Human
auuguuuuacaaua

SEQ ID NO: 1243682 - RNA, 13 nt, Human
auuguuuuacaau

SEQ ID NO: 1243683 - RNA, 16 nt, Human
auuguggguguuaauu

SEQ ID NO: 1243684 - RNA, 18 nt, Human
auuguuuuacaauaguuc

SEQ ID NO: 1243685 - RNA, 17 nt, Human
auuguuuuacaauaguu

SEQ ID NO: 1243686 - RNA, 15 nt, Human
auuguuuuacaauag

SEQ ID NO: 1243687 - RNA, 18 nt, Human
auuuaaaccgcuaaaaga

SEQ ID NO: 1243688 - RNA, 19 nt, Human
auuuaaaccgcuaaaagaa

SEQ ID NO: 1243689 - RNA, 20 nt, Human
auuuaaaccgcuaaaagaaa

SEQ ID NO: 1243690 - RNA, 21 nt, Human
auuuaaaccgcuaaaagaaac

SEQ ID NO: 1243691 - RNA, 22 nt, Human
auuuaaaccgcuaaaagaaacu

SEQ ID NO: 1243692 - RNA, 23 nt, Human
auuuaaaccgcuaaaagaaacuu

SEQ ID NO: 1243693 - RNA, 24 nt, Human
auuuaaaccgcuaaaagaaacuuu

SEQ ID NO: 1243694 - RNA, 12 nt, Human
auuuaaacuaua

SEQ ID NO: 1243695 - RNA, 19 nt, Human
auuuaaacuauaagcaaga

SEQ ID NO: 1243696 - RNA, 20 nt, Human
auuuaaacuauaagcaagaa

SEQ ID NO: 1243697 - RNA, 19 nt, Human
auuuaaagaacacccuaua

SEQ ID NO: 1243698 - RNA, 13 nt, Human
auugucuagugaa

SEQ ID NO: 1243699 - RNA, 15 nt, Human
auuguccuuuugcaa

SEQ ID NO: 1243700 - RNA, 16 nt, Human
auuguccuuuugcaaa

SEQ ID NO: 1243701 - RNA, 18 nt, Human
auuguccuuuugcaaaga

SEQ ID NO: 1243702 - RNA, 17 nt, Human
auuguccuuuugcaaag

SEQ ID NO: 1243703 - RNA, 12 nt, Human
auugucucagag

SEQ ID NO: 1243704 - RNA, 14 nt, Human
auugucucagagca

SEQ ID NO: 1243705 - RNA, 20 nt, Human
auuguggggaugaugaaaua

SEQ ID NO: 1243706 - RNA, 21 nt, Human
auuguggggaugaugaaauaa

SEQ ID NO: 1243707 - RNA, 17 nt, Human
uuugaaauuaugugaca

SEQ ID NO: 1243708 - RNA, 15 nt, Human
uuugaaauuauguga

SEQ ID NO: 1243709 - RNA, 18 nt, Human
uuugaaauuaaccucuca

SEQ ID NO: 1243710 - RNA, 16 nt, Human
uuugaaauuauguaaa

SEQ ID NO: 1243711 - RNA, 17 nt, Human
uuugaaauuauguaaau

SEQ ID NO: 1243712 - RNA, 22 nt, Human
uuugaaauuaugugacauuuua

SEQ ID NO: 1243713 - RNA, 21 nt, Human
uuugaaauuauguaaauuaug

SEQ ID NO: 1243714 - RNA, 15 nt, Human
auggggcaggccacc

SEQ ID NO: 1243715 - RNA, 17 nt, Human
auggggcaggccaccug

SEQ ID NO: 1243716 - RNA, 23 nt, Human
auggggcaggccaccuggcucuc

SEQ ID NO: 1243717 - RNA, 21 nt, Human
auggggcauccucuuuuucca

SEQ ID NO: 1243718 - RNA, 23 nt, Human
uuucuuuuuacccauuuguucau

SEQ ID NO: 1243719 - RNA, 15 nt, Human
uuucuuuuuugauau

SEQ ID NO: 1243720 - RNA, 16 nt, Human
uuugaaaaaaaauaaa

SEQ ID NO: 1243721 - RNA, 15 nt, Human
uuugaaaaagcgaaa

SEQ ID NO: 1243722 - RNA, 23 nt, Human
uuugaaaaagcgaaaaaaucagg

SEQ ID NO: 1243723 - RNA, 20 nt, Human
uuugaaaaagcgaaaaaauc

SEQ ID NO: 1243724 - RNA, 17 nt, Human
uuugaaaacauguuuau

SEQ ID NO: 1243725 - RNA, 19 nt, Human
uuugaaaacauguuuauuu

SEQ ID NO: 1243726 - RNA, 14 nt, Human
auggggguuucacc

SEQ ID NO: 1243727 - RNA, 14 nt, Human
auggggguaaaguu

SEQ ID NO: 1243728 - RNA, 15 nt, Human
augggguggaaggca

SEQ ID NO: 1243729 - RNA, 12 nt, Human
auggguagggua

SEQ ID NO: 1243730 - RNA, 16 nt, Human
auggguaggguaaauc

SEQ ID NO: 1243731 - RNA, 17 nt, Human
auggguaggguaaauca

SEQ ID NO: 1243732 - RNA, 12 nt, Human
augggucacagg

SEQ ID NO: 1243733 - RNA, 14 nt, Human
augggucacaggaa

SEQ ID NO: 1243734 - RNA, 13 nt, Human
augggucacagga

SEQ ID NO: 1243735 - RNA, 17 nt, Human
augggggcacugaggac

SEQ ID NO: 1243736 - RNA, 18 nt, Human
augggggaacucagaucc

SEQ ID NO: 1243737 - RNA, 19 nt, Human
augggggaacucagaucca

SEQ ID NO: 1243738 - RNA, 21 nt, Human
augggggaacucagauccagg

SEQ ID NO: 1243739 - RNA, 18 nt, Human
augggggagggggcagaa

SEQ ID NO: 1243740 - RNA, 13 nt, Human
auggggccagauc

SEQ ID NO: 1243741 - RNA, 14 nt, Human
auggggccagaucc

SEQ ID NO: 1243742 - RNA, 15 nt, Human
auggggccagaucca

SEQ ID NO: 1243743 - RNA, 19 nt, Human
auggggccagauccagccu

SEQ ID NO: 1243744 - RNA, 21 nt, Human
auggggccagauccagccugg

SEQ ID NO: 1243745 - RNA, 22 nt, Human
auggggccagauccagccuggg

SEQ ID NO: 1243746 - RNA, 21 nt, Human
augggggaaagcaaagcacag

SEQ ID NO: 1243747 - RNA, 23 nt, Human
augggggaaagcaaagcacagag

SEQ ID NO: 1243748 - RNA, 19 nt, Human
auggcuaacuuacaaagau

SEQ ID NO: 1243749 - RNA, 18 nt, Human
augggaugguggagggcc

SEQ ID NO: 1243750 - RNA, 17 nt, Human
augggauucuggacagg

SEQ ID NO: 1243751 - RNA, 14 nt, Human
augggauucuggac

SEQ ID NO: 1243752 - RNA, 21 nt, Human
uuucucccccauguucugucc

SEQ ID NO: 1243753 - RNA, 17 nt, Human
uuucugcacuauaugca

SEQ ID NO: 1243754 - RNA, 14 nt, Human
uuucugcacuauau

SEQ ID NO: 1243755 - RNA, 17 nt, Human
uuucuguauaaaugucu

SEQ ID NO: 1243756 - RNA, 17 nt, Human
uuucuguauauacuuuu

SEQ ID NO: 1243757 - RNA, 14 nt, Human
uuucuguaccaguu

SEQ ID NO: 1243758 - RNA, 15 nt, Human
uuucuguaccaguua

SEQ ID NO: 1243759 - RNA, 15 nt, Human
uuucugguucuaaca

SEQ ID NO: 1243760 - RNA, 21 nt, Human
uuucugguuguuaugugauca

SEQ ID NO: 1243761 - RNA, 22 nt, Human
uuucugguucuuguguuggcug

SEQ ID NO: 1243762 - RNA, 22 nt, Human
uuucuguaagaaaccuacugcc

SEQ ID NO: 1243763 - RNA, 19 nt, Human
uuucuguaauucagguuuu

SEQ ID NO: 1243764 - RNA, 23 nt, Human
uuucuguaauucagguuuuuccu

SEQ ID NO: 1243765 - RNA, 23 nt, Human
uuucugggagacagaaaacaugu

SEQ ID NO: 1243766 - RNA, 23 nt, Human
uuucugggcaccggggccucgga

SEQ ID NO: 1243767 - RNA, 16 nt, Human
uuucugggauaaguaa

SEQ ID NO: 1243768 - RNA, 19 nt, Human
uuucugggcugucuauucu

SEQ ID NO: 1243769 - RNA, 21 nt, Human
uuucugggcugucuauucuag

SEQ ID NO: 1243770 - RNA, 15 nt, Human
uuucugguggucugu

SEQ ID NO: 1243771 - RNA, 17 nt, Human
uuucugguggucuguug

SEQ ID NO: 1243772 - RNA, 20 nt, Human
uuucugguggucuguuggca

SEQ ID NO: 1243773 - RNA, 17 nt, Human
uuucugugccugaauau

SEQ ID NO: 1243774 - RNA, 9 nt, Human
uuucuguuc

SEQ ID NO: 1243775 - RNA, 12 nt, Human
uuucuguuccaa

SEQ ID NO: 1243776 - RNA, 14 nt, Human
uuucuguuccaaau

SEQ ID NO: 1243777 - RNA, 15 nt, Human
uuucuguuccaaauu

SEQ ID NO: 1243778 - RNA, 16 nt, Human
uuucuguuccaaauuc

SEQ ID NO: 1243779 - RNA, 20 nt, Human
uuucuguuccaaauucaguu

SEQ ID NO: 1243780 - RNA, 22 nt, Human
uuucuguuccaaauucaguuuc

SEQ ID NO: 1243781 - RNA, 14 nt, Human
uuucuguucuaguu

SEQ ID NO: 1243782 - RNA, 13 nt, Human
uuucuuucuuucu

SEQ ID NO: 1243783 - RNA, 20 nt, Human
uuucuuugaaaaaaaauaaa

SEQ ID NO: 1243784 - RNA, 21 nt, Human
uuucuuugaaaaaaaauaaau

SEQ ID NO: 1243785 - RNA, 13 nt, Human
uuucuuugaauaa

SEQ ID NO: 1243786 - RNA, 15 nt, Human
uuucuuugaauaaau

SEQ ID NO: 1243787 - RNA, 14 nt, Human
uuucuuugaauaaa

SEQ ID NO: 1243788 - RNA, 13 nt, Human
auguaaauauuuu

SEQ ID NO: 1243789 - RNA, 15 nt, Human
auguaaauauuuuaa

SEQ ID NO: 1243790 - RNA, 19 nt, Human
auguaaauauuuuaaagaa

SEQ ID NO: 1243791 - RNA, 20 nt, Human
auguaaauauuuuaaagaau

SEQ ID NO: 1243792 - RNA, 21 nt, Human
auguaaauauuuuaaagaauu

SEQ ID NO: 1243793 - RNA, 23 nt, Human
auguaaauauuuuaaagaauugu

SEQ ID NO: 1243794 - RNA, 20 nt, Human
auguaaaggagucaaaacua

SEQ ID NO: 1243795 - RNA, 16 nt, Human
auguaaagugauauuu

SEQ ID NO: 1243796 - RNA, 17 nt, Human
auguaaauaauacauua

SEQ ID NO: 1243797 - RNA, 21 nt, Human
auguaaaugucucacugagca

SEQ ID NO: 1243798 - RNA, 23 nt, Human
auguaaaugucucacugagcacu

SEQ ID NO: 1243799 - RNA, 19 nt, Human
auguaaaugucucacugag

SEQ ID NO: 1243800 - RNA, 18 nt, Human
auguaaaugucucacuga

SEQ ID NO: 1243801 - RNA, 14 nt, Human
auguaaauuaugua

SEQ ID NO: 1243802 - RNA, 23 nt, Human
auguaaauuaucaggcaaauuug

SEQ ID NO: 1243803 - RNA, 12 nt, Human
auguaaauuugu

SEQ ID NO: 1243804 - RNA, 13 nt, Human
auguaaauuugua

SEQ ID NO: 1243805 - RNA, 14 nt, Human
auguacauuaauua

SEQ ID NO: 1243806 - RNA, 20 nt, Human
auguaaaacauuuauuuuga

SEQ ID NO: 1243807 - RNA, 21 nt, Human
auguaaaacauuuauuuugac

SEQ ID NO: 1243808 - RNA, 17 nt, Human
auguaaaagaaaaucca

SEQ ID NO: 1243809 - RNA, 21 nt, Human
auguaaaagguauuaaauuga

SEQ ID NO: 1243810 - RNA, 12 nt, Human
auguaaaaucuu

SEQ ID NO: 1243811 - RNA, 13 nt, Human
auguaaaaucuug

SEQ ID NO: 1243812 - RNA, 14 nt, Human
auguaaaaucuugu

SEQ ID NO: 1243813 - RNA, 15 nt, Human
auguaaaaucuuguc

SEQ ID NO: 1243814 - RNA, 16 nt, Human
auguaaaaucuuguca

SEQ ID NO: 1243815 - RNA, 20 nt, Human
auguaaaaucuugucaugug

SEQ ID NO: 1243816 - RNA, 21 nt, Human
auguaaaaucuugucaugugu

SEQ ID NO: 1243817 - RNA, 22 nt, Human
auguaaaaucuugucaugugua

SEQ ID NO: 1243818 - RNA, 23 nt, Human
auguaaaaucuugucauguguau

SEQ ID NO: 1243819 - RNA, 14 nt, Human
auguaaacugugca

SEQ ID NO: 1243820 - RNA, 19 nt, Human
auguaaacuguuucuuuaa

SEQ ID NO: 1243821 - RNA, 20 nt, Human
auguaaacuguuucuuuaaa

SEQ ID NO: 1243822 - RNA, 22 nt, Human
auguaaacuguuucuuuaaaau

SEQ ID NO: 1243823 - RNA, 19 nt, Human
auguaaagaacauaaauaa

SEQ ID NO: 1243824 - RNA, 13 nt, Human
auguaaagacaaa

SEQ ID NO: 1243825 - RNA, 19 nt, Human
auguaaagacaaaaaacua

SEQ ID NO: 1243826 - RNA, 14 nt, Human
auguaaagauauuu

SEQ ID NO: 1243827 - RNA, 21 nt, Human
auguaaagauauuuuuaucuu

SEQ ID NO: 1243828 - RNA, 17 nt, Human
auguaaagaucaauaaa

SEQ ID NO: 1243829 - RNA, 13 nt, Human
auguaaagccaug

SEQ ID NO: 1243830 - RNA, 14 nt, Human
auguaaagccaugc

SEQ ID NO: 1243831 - RNA, 14 nt, Human
auguaaagcuuguc

SEQ ID NO: 1243832 - RNA, 16 nt, Human
auguaaagcuugucug

SEQ ID NO: 1243833 - RNA, 13 nt, Human
augguuguacaua

SEQ ID NO: 1243834 - RNA, 21 nt, Human
augguuuacauccuucacugc

SEQ ID NO: 1243835 - RNA, 13 nt, Human
augguuucagcac

SEQ ID NO: 1243836 - RNA, 14 nt, Human
augguuucagcacu

SEQ ID NO: 1243837 - RNA, 22 nt, Human
augguuucagcacuagccaaac

SEQ ID NO: 1243838 - RNA, 21 nt, Human
augguucccuugaugaagaag

SEQ ID NO: 1243839 - RNA, 19 nt, Human
augguuccccuguucacuc

SEQ ID NO: 1243840 - RNA, 20 nt, Human
augguuccccuguucacucu

SEQ ID NO: 1243841 - RNA, 18 nt, Human
augguucuggcuguuuga

SEQ ID NO: 1243842 - RNA, 19 nt, Human
augguucuggcuguuugag

SEQ ID NO: 1243843 - RNA, 15 nt, Human
augguuucagcacua

SEQ ID NO: 1243844 - RNA, 14 nt, Human
augguuuucuccaa

SEQ ID NO: 1243845 - RNA, 20 nt, Human
augguuuucuccaagagcua

SEQ ID NO: 1243846 - RNA, 21 nt, Human
augguuuucuccaagagcuac

SEQ ID NO: 1243847 - RNA, 17 nt, Human
augguuuuugagauauu

SEQ ID NO: 1243848 - RNA, 18 nt, Human
augguuuuugagauauua

SEQ ID NO: 1243849 - RNA, 13 nt, Human
auguaaaacauuu

SEQ ID NO: 1243850 - RNA, 14 nt, Human
auguaaaacauuua

SEQ ID NO: 1243851 - RNA, 15 nt, Human
auguaaaacauuuau

SEQ ID NO: 1243852 - RNA, 14 nt, Human
auggugaugaaaug

SEQ ID NO: 1243853 - RNA, 17 nt, Human
augggugcccacagugu

SEQ ID NO: 1243854 - RNA, 16 nt, Human
auggugaugaaaugua

SEQ ID NO: 1243855 - RNA, 17 nt, Human
auggugaugaaauguaa

SEQ ID NO: 1243856 - RNA, 19 nt, Human
auggugcauuacgugggca

SEQ ID NO: 1243857 - RNA, 14 nt, Human
auggugccccagga

SEQ ID NO: 1243858 - RNA, 20 nt, Human
auggugccuaguauugacaa

SEQ ID NO: 1243859 - RNA, 21 nt, Human
auggugccuaguauugacaaa

SEQ ID NO: 1243860 - RNA, 19 nt, Human
auggugccuaguauugaca

SEQ ID NO: 1243861 - RNA, 16 nt, Human
auggugccuaguauug

SEQ ID NO: 1243862 - RNA, 15 nt, Human
auggugccccaggac

SEQ ID NO: 1243863 - RNA, 16 nt, Human
auggugccccaggacc

SEQ ID NO: 1243864 - RNA, 17 nt, Human
auggugccccaggacca

SEQ ID NO: 1243865 - RNA, 18 nt, Human
auggugccccaggaccag

SEQ ID NO: 1243866 - RNA, 19 nt, Human
auggugccccaggaccagc

SEQ ID NO: 1243867 - RNA, 20 nt, Human
auggugccccaggaccagcu

SEQ ID NO: 1243868 - RNA, 21 nt, Human
auggugccccaggaccagcuc

SEQ ID NO: 1243869 - RNA, 22 nt, Human
auggugccccaggaccagcuca

SEQ ID NO: 1243870 - RNA, 20 nt, Human
augguggacucgccuguaau

SEQ ID NO: 1243871 - RNA, 13 nt, Human
augguggagggcc

SEQ ID NO: 1243872 - RNA, 14 nt, Human
augguggagggcca

SEQ ID NO: 1243873 - RNA, 19 nt, Human
augguggaugauccccacg

SEQ ID NO: 1243874 - RNA, 22 nt, Human
augguggaugauccccacgcca

SEQ ID NO: 1243875 - RNA, 14 nt, Human
auggugccuucauu

SEQ ID NO: 1243876 - RNA, 16 nt, Human
auggugccuucauuug

SEQ ID NO: 1243877 - RNA, 13 nt, Human
auggugcugggag

SEQ ID NO: 1243878 - RNA, 15 nt, Human
augguguucuccugc

SEQ ID NO: 1243879 - RNA, 18 nt, Human
auggugucucuucuuuag

SEQ ID NO: 1243880 - RNA, 16 nt, Human
augguguagaacacua

SEQ ID NO: 1243881 - RNA, 18 nt, Human
augguguagaacacuaau

SEQ ID NO: 1243882 - RNA, 19 nt, Human
augguguagaacacuaauu

SEQ ID NO: 1243883 - RNA, 22 nt, Human
augguguagaacacuaauucau

SEQ ID NO: 1243884 - RNA, 22 nt, Human
augguguucuccugcugcuccc

SEQ ID NO: 1243885 - RNA, 13 nt, Human
augguuaacuaau

SEQ ID NO: 1243886 - RNA, 18 nt, Human
augguuaagaguccaaga

SEQ ID NO: 1243887 - RNA, 23 nt, Human
augguuaagaguccaagaaucca

SEQ ID NO: 1243888 - RNA, 17 nt, Human
augguuaccaugucuuu

SEQ ID NO: 1243889 - RNA, 22 nt, Human
augguuaccaugucuuucucuc

SEQ ID NO: 1243890 - RNA, 20 nt, Human
augguucagaauuaaacuuu

SEQ ID NO: 1243891 - RNA, 21 nt, Human
augguucagaauuaaacuuuu

SEQ ID NO: 1243892 - RNA, 15 nt, Human
uuugugaauuaggcu

SEQ ID NO: 1243893 - RNA, 22 nt, Human
uuugugaauuaggcuguaacua

SEQ ID NO: 1243894 - RNA, 20 nt, Human
uuugugaagguggaaauaaa

SEQ ID NO: 1243895 - RNA, 18 nt, Human
uuugugaauagaacucug

SEQ ID NO: 1243896 - RNA, 17 nt, Human
uuugugaagcaaaauuu

SEQ ID NO: 1243897 - RNA, 22 nt, Human
uuugugaaaugauggugaaagu

SEQ ID NO: 1243898 - RNA, 14 nt, Human
uuuguaaugaaaac

SEQ ID NO: 1243899 - RNA, 13 nt, Human
uuuguaaugaaaa

SEQ ID NO: 1243900 - RNA, 21 nt, Human
uuuguaauaauaaagaauagc

SEQ ID NO: 1243901 - RNA, 23 nt, Human
uuuguaaugucuugagcucuauu

SEQ ID NO: 1243902 - RNA, 14 nt, Human
uuuguaauuaaaag

SEQ ID NO: 1243903 - RNA, 23 nt, Human
uuuguaauuaaaagcaaaucauu

SEQ ID NO: 1243904 - RNA, 22 nt, Human
uuuguaauuaaaagcaaaucau

SEQ ID NO: 1243905 - RNA, 12 nt, Human
uuuguauaaaag

SEQ ID NO: 1243906 - RNA, 14 nt, Human
uuuguaguugaaua

SEQ ID NO: 1243907 - RNA, 15 nt, Human
uuuguaguugaauau

SEQ ID NO: 1243908 - RNA, 19 nt, Human
uuuguaguguuggagaaga

SEQ ID NO: 1243909 - RNA, 21 nt, Human
uuuguaguguuggagaagaac

SEQ ID NO: 1243910 - RNA, 18 nt, Human
augugacauuuuacauua

SEQ ID NO: 1243911 - RNA, 19 nt, Human
augugaccacucugucuug

SEQ ID NO: 1243912 - RNA, 12 nt, Human
augugacucuuu

SEQ ID NO: 1243913 - RNA, 16 nt, Human
augugacucuuuccaa

SEQ ID NO: 1243914 - RNA, 16 nt, Human
augugacauuuuacau

SEQ ID NO: 1243915 - RNA, 16 nt, Human
augucucuuccuggua

SEQ ID NO: 1243916 - RNA, 15 nt, Human
augucucuuccuggu

SEQ ID NO: 1243917 - RNA, 13 nt, Human
augucucuucuga

SEQ ID NO: 1243918 - RNA, 16 nt, Human
augucucuucugagcu

SEQ ID NO: 1243919 - RNA, 17 nt, Human
augucucuucugagcua

SEQ ID NO: 1243920 - RNA, 21 nt, Human
augugacucuuuccaaccggc

SEQ ID NO: 1243921 - RNA, 15 nt, Human
augugcaaguuuauc

SEQ ID NO: 1243922 - RNA, 13 nt, Human
augugcaauagaa

SEQ ID NO: 1243923 - RNA, 18 nt, Human
augugcaauagaagguga

SEQ ID NO: 1243924 - RNA, 19 nt, Human
uuuguaauaauaaagaaua

SEQ ID NO: 1243925 - RNA, 14 nt, Human
augugauguucuaa

SEQ ID NO: 1243926 - RNA, 15 nt, Human
augugauguucuaag

SEQ ID NO: 1243927 - RNA, 16 nt, Human
augugauguucuaagg

SEQ ID NO: 1243928 - RNA, 17 nt, Human
augugauguucuaaggc

SEQ ID NO: 1243929 - RNA, 19 nt, Human
augugauguucuaaggcuc

SEQ ID NO: 1243930 - RNA, 20 nt, Human
augugauguucuaaggcucu

SEQ ID NO: 1243931 - RNA, 21 nt, Human
augugauguucuaaggcucug

SEQ ID NO: 1243932 - RNA, 14 nt, Human
augugauuguggaa

SEQ ID NO: 1243933 - RNA, 15 nt, Human
augugauuguggaau

SEQ ID NO: 1243934 - RNA, 17 nt, Human
augugauuguggaaugg

SEQ ID NO: 1243935 - RNA, 22 nt, Human
augugauuguggaauggagauu

SEQ ID NO: 1243936 - RNA, 13 nt, Human
uuuggcaggugca

SEQ ID NO: 1243937 - RNA, 23 nt, Human
uuuggcaucccugggccuugggc

SEQ ID NO: 1243938 - RNA, 18 nt, Human
auguaugagguacaaccu

SEQ ID NO: 1243939 - RNA, 15 nt, Human
auguaugcauguugu

SEQ ID NO: 1243940 - RNA, 19 nt, Human
auguaugcauguugucuaa

SEQ ID NO: 1243941 - RNA, 16 nt, Human
uuuggcaucccugggc

SEQ ID NO: 1243942 - RNA, 18 nt, Human
uuuggcaucccugggccu

SEQ ID NO: 1243943 - RNA, 22 nt, Human
auguauuacaguggggaaugaa

SEQ ID NO: 1243944 - RNA, 12 nt, Human
auguauguuacc

SEQ ID NO: 1243945 - RNA, 13 nt, Human
auguauguuacca

SEQ ID NO: 1243946 - RNA, 14 nt, Human
auguauguuaccaa

SEQ ID NO: 1243947 - RNA, 17 nt, Human
auguccacugguucuuc

SEQ ID NO: 1243948 - RNA, 15 nt, Human
augucagugcugaug

SEQ ID NO: 1243949 - RNA, 12 nt, Human
auguccaggaaa

SEQ ID NO: 1243950 - RNA, 16 nt, Human
auguccugccuauuau

SEQ ID NO: 1243951 - RNA, 20 nt, Human
auguccugccuauuaucugu

SEQ ID NO: 1243952 - RNA, 21 nt, Human
auguccugccuauuaucuguc

SEQ ID NO: 1243953 - RNA, 22 nt, Human
auguccugccuauuaucuguca

SEQ ID NO: 1243954 - RNA, 13 nt, Human
auguccuguaaag

SEQ ID NO: 1243955 - RNA, 13 nt, Human
augucgccucugc

SEQ ID NO: 1243956 - RNA, 14 nt, Human
augucgccucugca

SEQ ID NO: 1243957 - RNA, 14 nt, Human
auguccuguaaagg

SEQ ID NO: 1243958 - RNA, 16 nt, Human
auguccuucugagccc

SEQ ID NO: 1243959 - RNA, 15 nt, Human
augucgccucugcau

SEQ ID NO: 1243960 - RNA, 18 nt, Human
augucucacugagcacug

SEQ ID NO: 1243961 - RNA, 15 nt, Human
augucucacugagca

SEQ ID NO: 1243962 - RNA, 14 nt, Human
augucucacugagc

SEQ ID NO: 1243963 - RNA, 23 nt, Human
auguccuugugaugugcacguaa

SEQ ID NO: 1243964 - RNA, 17 nt, Human
augucucaggucccugc

SEQ ID NO: 1243965 - RNA, 22 nt, Human
augucucaggucccugcagggc

SEQ ID NO: 1243966 - RNA, 17 nt, Human
augucucugagcauuag

SEQ ID NO: 1243967 - RNA, 22 nt, Human
augucucacugagcacuguuuu

SEQ ID NO: 1243968 - RNA, 14 nt, Human
augucuccuaagca

SEQ ID NO: 1243969 - RNA, 20 nt, Human
augucucacugagcacuguu

SEQ ID NO: 1243970 - RNA, 19 nt, Human
augucucacugagcacugu

SEQ ID NO: 1243971 - RNA, 15 nt, Human
augucuccuaagcac

SEQ ID NO: 1243972 - RNA, 18 nt, Human
augucuccuaagcaccug

SEQ ID NO: 1243973 - RNA, 20 nt, Human
augucuccuaagcaccugua

SEQ ID NO: 1243974 - RNA, 16 nt, Human
auguaccguaggcuuu

SEQ ID NO: 1243975 - RNA, 16 nt, Human
auguacccaccgggcc

SEQ ID NO: 1243976 - RNA, 20 nt, Human
auguacccaccgggccacuc

SEQ ID NO: 1243977 - RNA, 15 nt, Human
auguaccauguacau

SEQ ID NO: 1243978 - RNA, 21 nt, Human
auguaccauguacaugaagaa

SEQ ID NO: 1243979 - RNA, 21 nt, Human
auguacccaccgggccacucc

SEQ ID NO: 1243980 - RNA, 17 nt, Human
auguacccucugaaaua

SEQ ID NO: 1243981 - RNA, 18 nt, Human
auguacccucugaaauac

SEQ ID NO: 1243982 - RNA, 18 nt, Human
auguacggauuuucaguu

SEQ ID NO: 1243983 - RNA, 16 nt, Human
auguacuucaugcugu

SEQ ID NO: 1243984 - RNA, 15 nt, Human
auguacugcauuauu

SEQ ID NO: 1243985 - RNA, 19 nt, Human
auguacuguauauuacaga

SEQ ID NO: 1243986 - RNA, 20 nt, Human
auguacugcauuauuugaga

SEQ ID NO: 1243987 - RNA, 13 nt, Human
auguacugcauua

SEQ ID NO: 1243988 - RNA, 18 nt, Human
auguacugagccuuguaa

SEQ ID NO: 1243989 - RNA, 19 nt, Human
auguagauaacaagaccuc

SEQ ID NO: 1243990 - RNA, 19 nt, Human
auguagaggagaaacugga

SEQ ID NO: 1243991 - RNA, 17 nt, Human
auguagaggagaaacug

SEQ ID NO: 1243992 - RNA, 13 nt, Human
auguagaggagaa

SEQ ID NO: 1243993 - RNA, 12 nt, Human
auguagaggaga

SEQ ID NO: 1243994 - RNA, 14 nt, Human
auguagaaaauuug

SEQ ID NO: 1243995 - RNA, 19 nt, Human
auguagccccucuccugga

SEQ ID NO: 1243996 - RNA, 12 nt, Human
auguagcucuuu

SEQ ID NO: 1243997 - RNA, 22 nt, Human
auguagcucuuugucagggagu

SEQ ID NO: 1243998 - RNA, 22 nt, Human
auguaggaaagaccauuuuucc

SEQ ID NO: 1243999 - RNA, 14 nt, Human
auguaggaaguagg

SEQ ID NO: 1244000 - RNA, 21 nt, Human
auguagcucuuugucagggag

SEQ ID NO: 1244001 - RNA, 12 nt, Human
auguaggaggga

SEQ ID NO: 1244002 - RNA, 21 nt, Human
auguagcaaaauacaugacau

SEQ ID NO: 1244003 - RNA, 14 nt, Human
auguagcaugcuug

SEQ ID NO: 1244004 - RNA, 19 nt, Human
auguagcaugcuuguugca

SEQ ID NO: 1244005 - RNA, 20 nt, Human
uuugacauugcguuugaccu

SEQ ID NO: 1244006 - RNA, 18 nt, Human
uuugacaguguugaaaau

SEQ ID NO: 1244007 - RNA, 19 nt, Human
uuugacaguguugaaaaug

SEQ ID NO: 1244008 - RNA, 13 nt, Human
uuugacaguguuu

SEQ ID NO: 1244009 - RNA, 13 nt, Human
auguaggagggac

SEQ ID NO: 1244010 - RNA, 12 nt, Human
auguaguaacac

SEQ ID NO: 1244011 - RNA, 13 nt, Human
auguaguaacacu

SEQ ID NO: 1244012 - RNA, 14 nt, Human
auguaguaacacua

SEQ ID NO: 1244013 - RNA, 15 nt, Human
auguaguaacacuaa

SEQ ID NO: 1244014 - RNA, 16 nt, Human
auguaguaacacuaau

SEQ ID NO: 1244015 - RNA, 17 nt, Human
auguaguaacacuaaua

SEQ ID NO: 1244016 - RNA, 22 nt, Human
auguaguaacacuaauauauuu

SEQ ID NO: 1244017 - RNA, 13 nt, Human
auguaguaauuga

SEQ ID NO: 1244018 - RNA, 16 nt, Human
auguaguaauugacau

SEQ ID NO: 1244019 - RNA, 17 nt, Human
auguaguaauugacaug

SEQ ID NO: 1244020 - RNA, 18 nt, Human
auguaguaauugacaugu

SEQ ID NO: 1244021 - RNA, 20 nt, Human
auguaguaacacuaauauau

SEQ ID NO: 1244022 - RNA, 14 nt, Human
uuugcaagccagau

SEQ ID NO: 1244023 - RNA, 23 nt, Human
uuugcaaccaggaacagcaaaug

SEQ ID NO: 1244024 - RNA, 17 nt, Human
uuugcaacuuaauacuc

SEQ ID NO: 1244025 - RNA, 20 nt, Human
uuugcaagggaaaagucucu

SEQ ID NO: 1244026 - RNA, 21 nt, Human
uuugcaagggaaaagucucuu

SEQ ID NO: 1244027 - RNA, 21 nt, Human
uuugcaaggugcauuuuuacu

SEQ ID NO: 1244028 - RNA, 14 nt, Human
uuugccucaaauaa

SEQ ID NO: 1244029 - RNA, 15 nt, Human
uuugauucauaguaa

SEQ ID NO: 1244030 - RNA, 20 nt, Human
uuugauucauaguaacuucu

SEQ ID NO: 1244031 - RNA, 14 nt, Human
uuugcaaagugcaa

SEQ ID NO: 1244032 - RNA, 14 nt, Human
uuugcaaccaggaa

SEQ ID NO: 1244033 - RNA, 15 nt, Human
uuugcaaccaggaac

SEQ ID NO: 1244034 - RNA, 14 nt, Human
uuugcaaccucgcu

SEQ ID NO: 1244035 - RNA, 23 nt, Human
uuugccucaaauaaaaagugcuu

SEQ ID NO: 1244036 - RNA, 17 nt, Human
uuugccucuuccagucu

SEQ ID NO: 1244037 - RNA, 12 nt, Human
uuugccuguaac

SEQ ID NO: 1244038 - RNA, 21 nt, Human
uuugccuguaacaagccagau

SEQ ID NO: 1244039 - RNA, 13 nt, Human
uuugccuguaaca

SEQ ID NO: 1244040 - RNA, 14 nt, Human
uuugccuguaacaa

SEQ ID NO: 1244041 - RNA, 18 nt, Human
uuugcucuucaagaaauc

SEQ ID NO: 1244042 - RNA, 20 nt, Human
uuugcucuucaagaaaucug

SEQ ID NO: 1244043 - RNA, 17 nt, Human
uuugcugacccucccca

SEQ ID NO: 1244044 - RNA, 19 nt, Human
uuugcugacccuccccaaa

SEQ ID NO: 1244045 - RNA, 21 nt, Human
uuugcugacccuccccaaagg

SEQ ID NO: 1244046 - RNA, 12 nt, Human
uuugcugagacu

SEQ ID NO: 1244047 - RNA, 19 nt, Human
uuugcugagcauguacuga

SEQ ID NO: 1244048 - RNA, 20 nt, Human
uuugcugcuaauauuuuccu

SEQ ID NO: 1244049 - RNA, 22 nt, Human
uuugcugcugcccauguuucaa

SEQ ID NO: 1244050 - RNA, 15 nt, Human
uuugcuggaauaagu

SEQ ID NO: 1244051 - RNA, 17 nt, Human
uuuggcaaugccaucau

SEQ ID NO: 1244052 - RNA, 16 nt, Human
uuuggcaauuuugugg

SEQ ID NO: 1244053 - RNA, 19 nt, Human
uuugaccuuuuauguagua

SEQ ID NO: 1244054 - RNA, 19 nt, Human
uuugacuagaugauggaug

SEQ ID NO: 1244055 - RNA, 12 nt, Human
uuugacucuuuu

SEQ ID NO: 1244056 - RNA, 20 nt, Human
uuugauguaaagauguucug

SEQ ID NO: 1244057 - RNA, 12 nt, Human
uuugauguaaua

SEQ ID NO: 1244058 - RNA, 15 nt, Human
uuugauguuccuucc

SEQ ID NO: 1244059 - RNA, 17 nt, Human
uuugauguuccuuccag

SEQ ID NO: 1244060 - RNA, 20 nt, Human
uuuaaauacagucuuccauu

SEQ ID NO: 1244061 - RNA, 18 nt, Human
uuuaaauauaugcuaagu

SEQ ID NO: 1244062 - RNA, 13 nt, Human
uuuaaguauuuag

SEQ ID NO: 1244063 - RNA, 18 nt, Human
uuuaaguauuuagguuuu

SEQ ID NO: 1244064 - RNA, 15 nt, Human
uuuaagucucucgua

SEQ ID NO: 1244065 - RNA, 15 nt, Human
uuuaagugaaaaugg

SEQ ID NO: 1244066 - RNA, 17 nt, Human
uuuaagugaaaaugguc

SEQ ID NO: 1244067 - RNA, 23 nt, Human
uuuaauuauuauuuauauaugua

SEQ ID NO: 1244068 - RNA, 14 nt, Human
uuuaauuauuauuc

SEQ ID NO: 1244069 - RNA, 23 nt, Human
uuuaauuauuauucuucauaaca

SEQ ID NO: 1244070 - RNA, 14 nt, Human
uuuaauuaauuggg

SEQ ID NO: 1244071 - RNA, 22 nt, Human
uuuaauuaauugggccagcuuu

SEQ ID NO: 1244072 - RNA, 20 nt, Human
uuuaauuaauugggccagcu

SEQ ID NO: 1244073 - RNA, 20 nt, Human
uuuaauguauaguaaaucac

SEQ ID NO: 1244074 - RNA, 16 nt, Human
uuuaauguuuaaaaca

SEQ ID NO: 1244075 - RNA, 17 nt, Human
uuuaauguuuaaaacau

SEQ ID NO: 1244076 - RNA, 21 nt, Human
uuuaauguuuaaaacaucauu

SEQ ID NO: 1244077 - RNA, 13 nt, Human
augcagcucaaga

SEQ ID NO: 1244078 - RNA, 15 nt, Human
augcagcuguggcag

SEQ ID NO: 1244079 - RNA, 15 nt, Human
augcagcuuauacga

SEQ ID NO: 1244080 - RNA, 21 nt, Human
augcagcuuauacgaaauaau

SEQ ID NO: 1244081 - RNA, 16 nt, Human
augcagcuuauacgaa

SEQ ID NO: 1244082 - RNA, 17 nt, Human
augcagcaucuaaguaa

SEQ ID NO: 1244083 - RNA, 22 nt, Human
uuuaauuuaguaaaccaauccu

SEQ ID NO: 1244084 - RNA, 18 nt, Human
uuuaauuuaguaaaccaa

SEQ ID NO: 1244085 - RNA, 16 nt, Human
uuuaauuugaaauaug

SEQ ID NO: 1244086 - RNA, 15 nt, Human
uuuacaaaaauauaa

SEQ ID NO: 1244087 - RNA, 16 nt, Human
uuuacaaaaauauaaa

SEQ ID NO: 1244088 - RNA, 18 nt, Human
uuuacaaaacaaacucau

SEQ ID NO: 1244089 - RNA, 19 nt, Human
uuuacaaaacuacaugaga

SEQ ID NO: 1244090 - RNA, 13 nt, Human
uuuacaaacugaa

SEQ ID NO: 1244091 - RNA, 14 nt, Human
uuuacaaacugaag

SEQ ID NO: 1244092 - RNA, 16 nt, Human
uuuacaaacugaagag

SEQ ID NO: 1244093 - RNA, 15 nt, Human
uuuacaaacugaaga

SEQ ID NO: 1244094 - RNA, 21 nt, Human
uuuacaaauguuaaaaugugu

SEQ ID NO: 1244095 - RNA, 20 nt, Human
uuuacaaauguuaaaaugug

SEQ ID NO: 1244096 - RNA, 13 nt, Human
augcaguucugaa

SEQ ID NO: 1244097 - RNA, 15 nt, Human
augcauuugggucca

SEQ ID NO: 1244098 - RNA, 17 nt, Human
augcauuuggguccagg

SEQ ID NO: 1244099 - RNA, 18 nt, Human
augcauuuggguccagga

SEQ ID NO: 1244100 - RNA, 19 nt, Human
augcauuuggguccaggag

SEQ ID NO: 1244101 - RNA, 20 nt, Human
augcauuuggguccaggagg

SEQ ID NO: 1244102 - RNA, 22 nt, Human
augcauuuggguccaggaggaa

SEQ ID NO: 1244103 - RNA, 17 nt, Human
augccaaaaaaaaauac

SEQ ID NO: 1244104 - RNA, 18 nt, Human
augccaaaaaaaaauaca

SEQ ID NO: 1244105 - RNA, 19 nt, Human
augccaaaaaaaaauacau

SEQ ID NO: 1244106 - RNA, 17 nt, Human
augccaauauuaaaucu

SEQ ID NO: 1244107 - RNA, 22 nt, Human
augccaauuagcaauugacugu

SEQ ID NO: 1244108 - RNA, 16 nt, Human
augccacaaggacuuc

SEQ ID NO: 1244109 - RNA, 19 nt, Human
augccacaaggacuuccug

SEQ ID NO: 1244110 - RNA, 13 nt, Human
augccacagcccu

SEQ ID NO: 1244111 - RNA, 14 nt, Human
augccacagcccug

SEQ ID NO: 1244112 - RNA, 15 nt, Human
augccacagcccugu

SEQ ID NO: 1244113 - RNA, 17 nt, Human
augccacagcccuguca

SEQ ID NO: 1244114 - RNA, 18 nt, Human
augccacagcccugucag

SEQ ID NO: 1244115 - RNA, 19 nt, Human
augccacagcccugucagc

SEQ ID NO: 1244116 - RNA, 15 nt, Human
augccacauucaaaa

SEQ ID NO: 1244117 - RNA, 14 nt, Human
augccaugaugccu

SEQ ID NO: 1244118 - RNA, 12 nt, Human
augccacauuca

SEQ ID NO: 1244119 - RNA, 16 nt, Human
augccauuuguacuga

SEQ ID NO: 1244120 - RNA, 14 nt, Human
augcccuggaucca

SEQ ID NO: 1244121 - RNA, 23 nt, Human
augcccugcucugaacacgaagc

SEQ ID NO: 1244122 - RNA, 12 nt, Human
augcccugugca

SEQ ID NO: 1244123 - RNA, 13 nt, Human
augcccugugcaa

SEQ ID NO: 1244124 - RNA, 23 nt, Human
augcccugugcaaccucuuggcc

SEQ ID NO: 1244125 - RNA, 16 nt, Human
augccucagccuccug

SEQ ID NO: 1244126 - RNA, 19 nt, Human
augccgauauacucuagau

SEQ ID NO: 1244127 - RNA, 12 nt, Human
augcccuucacu

SEQ ID NO: 1244128 - RNA, 16 nt, Human
augcccuucuccuuau

SEQ ID NO: 1244129 - RNA, 21 nt, Human
augcgguuauaaaaaaugguu

SEQ ID NO: 1244130 - RNA, 21 nt, Human
augcguauuauaccaaaaugu

SEQ ID NO: 1244131 - RNA, 14 nt, Human
augcgguagccagc

SEQ ID NO: 1244132 - RNA, 15 nt, Human
augcgguagccagca

SEQ ID NO: 1244133 - RNA, 18 nt, Human
augcgguagccagcacac

SEQ ID NO: 1244134 - RNA, 20 nt, Human
augcgguagccagcacacag

SEQ ID NO: 1244135 - RNA, 21 nt, Human
augcgguagccagcacacagg

SEQ ID NO: 1244136 - RNA, 19 nt, Human
augcgguuaauuuugaagu

SEQ ID NO: 1244137 - RNA, 14 nt, Human
augccucccugagc

SEQ ID NO: 1244138 - RNA, 19 nt, Human
augauugaauuauauguuc

SEQ ID NO: 1244139 - RNA, 22 nt, Human
augauucugauguacucuaaau

SEQ ID NO: 1244140 - RNA, 15 nt, Human
augauuacuggccuu

SEQ ID NO: 1244141 - RNA, 19 nt, Human
augauuacuggccuuuuuc

SEQ ID NO: 1244142 - RNA, 22 nt, Human
augauuacuggccuuuuucauu

SEQ ID NO: 1244143 - RNA, 22 nt, Human
augauuagaaauuaccugugga

SEQ ID NO: 1244144 - RNA, 22 nt, Human
augauucuauuuauauguacau

SEQ ID NO: 1244145 - RNA, 23 nt, Human
augauucuauuuauauguacaug

SEQ ID NO: 1244146 - RNA, 15 nt, Human
augcaaccauuugaa

SEQ ID NO: 1244147 - RNA, 20 nt, Human
augcacccucauacacagaa

SEQ ID NO: 1244148 - RNA, 14 nt, Human
augcaccuaaagaa

SEQ ID NO: 1244149 - RNA, 15 nt, Human
augcaccuaaagaaa

SEQ ID NO: 1244150 - RNA, 16 nt, Human
augcaccuaaagaaaa

SEQ ID NO: 1244151 - RNA, 18 nt, Human
augcaccuaaagaaaaac

SEQ ID NO: 1244152 - RNA, 23 nt, Human
augcaccuaaagaaaaacaaacu

SEQ ID NO: 1244153 - RNA, 20 nt, Human
uuguuuugcacacuuugcca

SEQ ID NO: 1244154 - RNA, 22 nt, Human
uuguuuuggcugaaauucuccu

SEQ ID NO: 1244155 - RNA, 14 nt, Human
uuguuuuggaugcc

SEQ ID NO: 1244156 - RNA, 17 nt, Human
uuuaaaaauagacacuc

SEQ ID NO: 1244157 - RNA, 18 nt, Human
uuuaaaaaucuuaaugua

SEQ ID NO: 1244158 - RNA, 14 nt, Human
uuuaaagaaagugu

SEQ ID NO: 1244159 - RNA, 16 nt, Human
uuuaaagaaaguguau

SEQ ID NO: 1244160 - RNA, 17 nt, Human
uuuaaagaagaaaaaaa

SEQ ID NO: 1244161 - RNA, 13 nt, Human
uuuaaagaauugu

SEQ ID NO: 1244162 - RNA, 12 nt, Human
uuuaaagaauug

SEQ ID NO: 1244163 - RNA, 18 nt, Human
uuuaaagacaauguuaaa

SEQ ID NO: 1244164 - RNA, 13 nt, Human
uuuaaagagucua

SEQ ID NO: 1244165 - RNA, 15 nt, Human
uuuaaagagucuaga

SEQ ID NO: 1244166 - RNA, 16 nt, Human
uuuaaagagucuagau

SEQ ID NO: 1244167 - RNA, 17 nt, Human
uuuaaagagucuagauu

SEQ ID NO: 1244168 - RNA, 18 nt, Human
uuuaaagagucuagauuc

SEQ ID NO: 1244169 - RNA, 21 nt, Human
uuuaaagagucuagauucaaa

SEQ ID NO: 1244170 - RNA, 23 nt, Human
uuuaaagagucuagauucaaagg

SEQ ID NO: 1244171 - RNA, 12 nt, Human
uuuaaagauuuu

SEQ ID NO: 1244172 - RNA, 18 nt, Human
uuuaaagucucaguuucu

SEQ ID NO: 1244173 - RNA, 22 nt, Human
uuuaaagugacuaauggcauga

SEQ ID NO: 1244174 - RNA, 22 nt, Human
uuuaaaguuaguaucuuuugau

SEQ ID NO: 1244175 - RNA, 15 nt, Human
uuuaaaguucaaacu

SEQ ID NO: 1244176 - RNA, 17 nt, Human
uuuaaaguuguuugugc

SEQ ID NO: 1244177 - RNA, 23 nt, Human
augauacuucgacacuguucuua

SEQ ID NO: 1244178 - RNA, 17 nt, Human
augauaugcuuguaacu

SEQ ID NO: 1244179 - RNA, 23 nt, Human
augauaugcuuguaacuaaaaua

SEQ ID NO: 1244180 - RNA, 21 nt, Human
augauccaacuaaugccuuac

SEQ ID NO: 1244181 - RNA, 21 nt, Human
augauacuugaaaauuaacau

SEQ ID NO: 1244182 - RNA, 16 nt, Human
augauacuucgacacu

SEQ ID NO: 1244183 - RNA, 18 nt, Human
augauacuucgacacugu

SEQ ID NO: 1244184 - RNA, 17 nt, Human
augauacuugaaaauua

SEQ ID NO: 1244185 - RNA, 17 nt, Human
augauacagcagagcua

SEQ ID NO: 1244186 - RNA, 15 nt, Human
augauacauccaaag

SEQ ID NO: 1244187 - RNA, 19 nt, Human
augauacuaauaaacuaau

SEQ ID NO: 1244188 - RNA, 14 nt, Human
augauuaaguaaug

SEQ ID NO: 1244189 - RNA, 18 nt, Human
augauuaaguaaugauaa

SEQ ID NO: 1244190 - RNA, 14 nt, Human
augauuacuggccu

SEQ ID NO: 1244191 - RNA, 18 nt, Human
augauccccacgccacag

SEQ ID NO: 1244192 - RNA, 19 nt, Human
augauccccacgccacagc

SEQ ID NO: 1244193 - RNA, 23 nt, Human
augauccccacgccacagcccuu

SEQ ID NO: 1244194 - RNA, 13 nt, Human
augaucccugugu

SEQ ID NO: 1244195 - RNA, 15 nt, Human
augauaacuggaaac

SEQ ID NO: 1244196 - RNA, 12 nt, Human
uuguugacauua

SEQ ID NO: 1244197 - RNA, 12 nt, Human
uuguugacauuc

SEQ ID NO: 1244198 - RNA, 15 nt, Human
uuguugacauucuga

SEQ ID NO: 1244199 - RNA, 16 nt, Human
uuguugacauucugaa

SEQ ID NO: 1244200 - RNA, 17 nt, Human
uuguugacauucugaau

SEQ ID NO: 1244201 - RNA, 20 nt, Human
uuguugacauucugaaugcu

SEQ ID NO: 1244202 - RNA, 18 nt, Human
uuguugagcuauugcugu

SEQ ID NO: 1244203 - RNA, 15 nt, Human
augauaauagauucu

SEQ ID NO: 1244204 - RNA, 19 nt, Human
augauaauagauucucuug

SEQ ID NO: 1244205 - RNA, 15 nt, Human
augauaaugaacaga

SEQ ID NO: 1244206 - RNA, 12 nt, Human
augauaaugaac

SEQ ID NO: 1244207 - RNA, 17 nt, Human
uuguuccccacuggagc

SEQ ID NO: 1244208 - RNA, 16 nt, Human
uuguuccccacuggag

SEQ ID NO: 1244209 - RNA, 14 nt, Human
uuguucuuguauuu

SEQ ID NO: 1244210 - RNA, 15 nt, Human
uuguucuuguauuua

SEQ ID NO: 1244211 - RNA, 22 nt, Human
uuguugaaaaaguuuguuuuug

SEQ ID NO: 1244212 - RNA, 16 nt, Human
uuguugaaaaaguuug

SEQ ID NO: 1244213 - RNA, 19 nt, Human
uuguucauauuaagaauga

SEQ ID NO: 1244214 - RNA, 17 nt, Human
uuguucauauuaagaau

SEQ ID NO: 1244215 - RNA, 21 nt, Human
uuguuccaaauacuaaugaaa

SEQ ID NO: 1244216 - RNA, 18 nt, Human
uuuaucaugugaaaucau

SEQ ID NO: 1244217 - RNA, 14 nt, Human
uuuaucauucaagu

SEQ ID NO: 1244218 - RNA, 15 nt, Human
uuuaucauucaagug

SEQ ID NO: 1244219 - RNA, 17 nt, Human
uuuaucauucaagugua

SEQ ID NO: 1244220 - RNA, 12 nt, Human
uuuaucauuuuc

SEQ ID NO: 1244221 - RNA, 17 nt, Human
uuuaucaugugaaauca

SEQ ID NO: 1244222 - RNA, 16 nt, Human
uuuaucaugcaugucc

SEQ ID NO: 1244223 - RNA, 22 nt, Human
uuuaucaugcauguccuguaaa

SEQ ID NO: 1244224 - RNA, 23 nt, Human
uuuaucaugcauguccuguaaag

SEQ ID NO: 1244225 - RNA, 21 nt, Human
uuuaucaaacccuagccuugc

SEQ ID NO: 1244226 - RNA, 22 nt, Human
uuuaucaaacccuagccuugcu

SEQ ID NO: 1244227 - RNA, 19 nt, Human
uuuauauuguaaauauugu

SEQ ID NO: 1244228 - RNA, 14 nt, Human
uuuauauuguaaau

SEQ ID NO: 1244229 - RNA, 16 nt, Human
uuuauauuguaaauau

SEQ ID NO: 1244230 - RNA, 14 nt, Human
uuuauauuuaaaug

SEQ ID NO: 1244231 - RNA, 16 nt, Human
uuuauauuacacuaca

SEQ ID NO: 1244232 - RNA, 22 nt, Human
uuuauauugauaagaucuuuua

SEQ ID NO: 1244233 - RNA, 13 nt, Human
augcuaagugaaa

SEQ ID NO: 1244234 - RNA, 13 nt, Human
uuuauauguugua

SEQ ID NO: 1244235 - RNA, 15 nt, Human
augcuaagagaagua

SEQ ID NO: 1244236 - RNA, 16 nt, Human
augcuaagagaaguag

SEQ ID NO: 1244237 - RNA, 17 nt, Human
augcuaagagaaguaga

SEQ ID NO: 1244238 - RNA, 22 nt, Human
augcuaagagaaguagaaauca

SEQ ID NO: 1244239 - RNA, 18 nt, Human
augcuaagagaaguagaa

SEQ ID NO: 1244240 - RNA, 16 nt, Human
augcuaagacucagug

SEQ ID NO: 1244241 - RNA, 19 nt, Human
augcuaacaucuaaaaaua

SEQ ID NO: 1244242 - RNA, 14 nt, Human
augcuaacaucuaa

SEQ ID NO: 1244243 - RNA, 16 nt, Human
augcuaacaucuaaaa

SEQ ID NO: 1244244 - RNA, 17 nt, Human
augcuaacaucuaaaaa

SEQ ID NO: 1244245 - RNA, 16 nt, Human
augcuccaagauucua

SEQ ID NO: 1244246 - RNA, 17 nt, Human
augcuccaagauucuag

SEQ ID NO: 1244247 - RNA, 18 nt, Human
augcuccaagauucuaga

SEQ ID NO: 1244248 - RNA, 19 nt, Human
augcuccaagauucuagau

SEQ ID NO: 1244249 - RNA, 22 nt, Human
augcuccagauuagagccugua

SEQ ID NO: 1244250 - RNA, 20 nt, Human
augcuccaagauucuagaug

SEQ ID NO: 1244251 - RNA, 13 nt, Human
augcuagguucua

SEQ ID NO: 1244252 - RNA, 14 nt, Human
augcuagguucuac

SEQ ID NO: 1244253 - RNA, 13 nt, Human
augcuaucucugu

SEQ ID NO: 1244254 - RNA, 19 nt, Human
uuuauuaaucuuaguguau

SEQ ID NO: 1244255 - RNA, 12 nt, Human
uuuauuaaugca

SEQ ID NO: 1244256 - RNA, 17 nt, Human
uuuauuaaugcacuuuc

SEQ ID NO: 1244257 - RNA, 16 nt, Human
uuuauuaauaaacauu

SEQ ID NO: 1244258 - RNA, 21 nt, Human
uuuauuaauaaacauucuauc

SEQ ID NO: 1244259 - RNA, 19 nt, Human
uuuauuaauauauauuauc

SEQ ID NO: 1244260 - RNA, 17 nt, Human
uuuauuaauauauauua

SEQ ID NO: 1244261 - RNA, 13 nt, Human
uuuauuaaucuua

SEQ ID NO: 1244262 - RNA, 22 nt, Human
augcuagaacucccuuucaaca

SEQ ID NO: 1244263 - RNA, 21 nt, Human
augcuagaacucccuuucaac

SEQ ID NO: 1244264 - RNA, 20 nt, Human
augcuagaacucccuuucaa

SEQ ID NO: 1244265 - RNA, 17 nt, Human
augcuguucaugaaaga

SEQ ID NO: 1244266 - RNA, 20 nt, Human
augcugugcgcccagggcug

SEQ ID NO: 1244267 - RNA, 21 nt, Human
augcuguggcaugggugaaga

SEQ ID NO: 1244268 - RNA, 18 nt, Human
augcugugcgcccagggc

SEQ ID NO: 1244269 - RNA, 21 nt, Human
augcugcuggggaagacagug

SEQ ID NO: 1244270 - RNA, 20 nt, Human
augcugcuggggaagacagu

SEQ ID NO: 1244271 - RNA, 13 nt, Human
augcugcugggga

SEQ ID NO: 1244272 - RNA, 14 nt, Human
augcugcuggggaa

SEQ ID NO: 1244273 - RNA, 16 nt, Human
augcugcuggggaaga

SEQ ID NO: 1244274 - RNA, 17 nt, Human
augcugcuggggaagac

SEQ ID NO: 1244275 - RNA, 18 nt, Human
augcugcuggggaagaca

SEQ ID NO: 1244276 - RNA, 19 nt, Human
augcugcuggggaagacag

SEQ ID NO: 1244277 - RNA, 16 nt, Human
augcuucccuuuccug

SEQ ID NO: 1244278 - RNA, 15 nt, Human
augcuuccucccagc

SEQ ID NO: 1244279 - RNA, 15 nt, Human
augcuucuaaguaaa

SEQ ID NO: 1244280 - RNA, 19 nt, Human
augcuucuaaguaaauaca

SEQ ID NO: 1244281 - RNA, 23 nt, Human
augcuguucaugaaagauucaau

SEQ ID NO: 1244282 - RNA, 14 nt, Human
augcugugugacuc

SEQ ID NO: 1244283 - RNA, 19 nt, Human
augcuguucaugaaagauu

SEQ ID NO: 1244284 - RNA, 20 nt, Human
augcuucuaaguaaauacaa

SEQ ID NO: 1244285 - RNA, 21 nt, Human
augcuucuaaguaaauacaau

SEQ ID NO: 1244286 - RNA, 22 nt, Human
augcuucuaaguaaauacaauu

SEQ ID NO: 1244287 - RNA, 23 nt, Human
augcuucuaaguaaauacaauuu

SEQ ID NO: 1244288 - RNA, 13 nt, Human
uuucaaaagaaag

SEQ ID NO: 1244289 - RNA, 18 nt, Human
uuucaaaaccuuuugaaa

SEQ ID NO: 1244290 - RNA, 12 nt, Human
uuucaaaaccag

SEQ ID NO: 1244291 - RNA, 13 nt, Human
uuucaaaaccagg

SEQ ID NO: 1244292 - RNA, 17 nt, Human
uuuauuuuucauuuagu

SEQ ID NO: 1244293 - RNA, 22 nt, Human
uuuauuuuuccauuuacaacaa

SEQ ID NO: 1244294 - RNA, 17 nt, Human
uuuauuuuucuugucuu

SEQ ID NO: 1244295 - RNA, 12 nt, Human
uuuauuuuucau

SEQ ID NO: 1244296 - RNA, 20 nt, Human
uuuauuuuguguuuaggaac

SEQ ID NO: 1244297 - RNA, 22 nt, Human
uuucaaaauuguuacaaauugu

SEQ ID NO: 1244298 - RNA, 16 nt, Human
uuucaaacauauauaa

SEQ ID NO: 1244299 - RNA, 21 nt, Human
uuucaaaaccagguccaauga

SEQ ID NO: 1244300 - RNA, 12 nt, Human
uuucaaaaugcu

SEQ ID NO: 1244301 - RNA, 13 nt, Human
uuucaaaaugcuu

SEQ ID NO: 1244302 - RNA, 15 nt, Human
uuucaaaaugcuuuu

SEQ ID NO: 1244303 - RNA, 17 nt, Human
uuucaaacauauauaac

SEQ ID NO: 1244304 - RNA, 22 nt, Human
auggacacuacacccagcaaua

SEQ ID NO: 1244305 - RNA, 13 nt, Human
auggacuaucugu

SEQ ID NO: 1244306 - RNA, 17 nt, Human
auggacuaucugucugg

SEQ ID NO: 1244307 - RNA, 20 nt, Human
auggacuaucugucuggugg

SEQ ID NO: 1244308 - RNA, 21 nt, Human
auggacuaucugucugguggc

SEQ ID NO: 1244309 - RNA, 22 nt, Human
auggacuaucugucugguggcc

SEQ ID NO: 1244310 - RNA, 19 nt, Human
auggacacuacacccagca

SEQ ID NO: 1244311 - RNA, 18 nt, Human
auggacacuacacccagc

SEQ ID NO: 1244312 - RNA, 17 nt, Human
auggacacuacacccag

SEQ ID NO: 1244313 - RNA, 16 nt, Human
auggacacuacaccca

SEQ ID NO: 1244314 - RNA, 15 nt, Human
auggacacuacaccc

SEQ ID NO: 1244315 - RNA, 13 nt, Human
auggacaauggac

SEQ ID NO: 1244316 - RNA, 15 nt, Human
auggacaauggaccg

SEQ ID NO: 1244317 - RNA, 19 nt, Human
uuucccggacuuagaaaac

SEQ ID NO: 1244318 - RNA, 19 nt, Human
auggaauuuugcaaagauu

SEQ ID NO: 1244319 - RNA, 14 nt, Human
auggacugcucagg

SEQ ID NO: 1244320 - RNA, 16 nt, Human
auggacucuguccuga

SEQ ID NO: 1244321 - RNA, 15 nt, Human
auggacucuguccug

SEQ ID NO: 1244322 - RNA, 13 nt, Human
auggacucugucc

SEQ ID NO: 1244323 - RNA, 14 nt, Human
auggacucuguccu

SEQ ID NO: 1244324 - RNA, 13 nt, Human
auggagaaggaag

SEQ ID NO: 1244325 - RNA, 12 nt, Human
auggagaaggaa

SEQ ID NO: 1244326 - RNA, 16 nt, Human
auggagaaagcugacu

SEQ ID NO: 1244327 - RNA, 23 nt, Human
auggagaaagcugacuuggcugg

SEQ ID NO: 1244328 - RNA, 12 nt, Human
auggagaaagcu

SEQ ID NO: 1244329 - RNA, 13 nt, Human
auggagaaagcug

SEQ ID NO: 1244330 - RNA, 14 nt, Human
auggagaaagcuga

SEQ ID NO: 1244331 - RNA, 15 nt, Human
auggagaaagcugac

SEQ ID NO: 1244332 - RNA, 17 nt, Human
uuucaacagugaagaca

SEQ ID NO: 1244333 - RNA, 20 nt, Human
uuucaacagugaagacagaa

SEQ ID NO: 1244334 - RNA, 21 nt, Human
uuucauuaauacagggcauuu

SEQ ID NO: 1244335 - RNA, 19 nt, Human
uuucaacagugaagacaga

SEQ ID NO: 1244336 - RNA, 13 nt, Human
uuucaaagaugcu

SEQ ID NO: 1244337 - RNA, 14 nt, Human
uuucaaagaugcug

SEQ ID NO: 1244338 - RNA, 19 nt, Human
uuucaaagaugcugugagu

SEQ ID NO: 1244339 - RNA, 17 nt, Human
uuucaaagcuuuuucca

SEQ ID NO: 1244340 - RNA, 19 nt, Human
uuucaaauagggucuaacu

SEQ ID NO: 1244341 - RNA, 20 nt, Human
uuucaaauagggucuaacuc

SEQ ID NO: 1244342 - RNA, 21 nt, Human
uuucaaauuggagcuucaugg

SEQ ID NO: 1244343 - RNA, 18 nt, Human
uuucccccuagccugccu

SEQ ID NO: 1244344 - RNA, 19 nt, Human
uuuccaugcguguuucuga

SEQ ID NO: 1244345 - RNA, 23 nt, Human
uuuccaugcacccucauacacag

SEQ ID NO: 1244346 - RNA, 19 nt, Human
uuuccauccauggccagca

SEQ ID NO: 1244347 - RNA, 12 nt, Human
uuuccaucuuua

SEQ ID NO: 1244348 - RNA, 15 nt, Human
auggagaaggaaggc

SEQ ID NO: 1244349 - RNA, 14 nt, Human
auggagaaggaagg

SEQ ID NO: 1244350 - RNA, 18 nt, Human
auggagacugucucaaga

SEQ ID NO: 1244351 - RNA, 14 nt, Human
auggcacuaguauu

SEQ ID NO: 1244352 - RNA, 16 nt, Human
auggcacuaguauuuc

SEQ ID NO: 1244353 - RNA, 19 nt, Human
auggcagauguaggaggga

SEQ ID NO: 1244354 - RNA, 20 nt, Human
auggcagauguaggagggac

SEQ ID NO: 1244355 - RNA, 21 nt, Human
auggcagauguaggagggacu

SEQ ID NO: 1244356 - RNA, 11 nt, Human
auggcagcagg

SEQ ID NO: 1244357 - RNA, 13 nt, Human
auggcagcagggg

SEQ ID NO: 1244358 - RNA, 17 nt, Human
auggcaggaaggcuugu

SEQ ID NO: 1244359 - RNA, 18 nt, Human
auggcagcuuuuaaaaga

SEQ ID NO: 1244360 - RNA, 15 nt, Human
auggcagggggcugc

SEQ ID NO: 1244361 - RNA, 16 nt, Human
auggcagggggcugcu

SEQ ID NO: 1244362 - RNA, 17 nt, Human
auggcagggggcugcug

SEQ ID NO: 1244363 - RNA, 19 nt, Human
auggcagggggcugcugcu

SEQ ID NO: 1244364 - RNA, 20 nt, Human
auggcagggggcugcugcug

SEQ ID NO: 1244365 - RNA, 22 nt, Human
auggcagggggcugcugcuggg

SEQ ID NO: 1244366 - RNA, 17 nt, Human
auggcaggggguggaau

SEQ ID NO: 1244367 - RNA, 24 nt, Human
auggcaggggguggaauuauuacu

SEQ ID NO: 1244368 - RNA, 15 nt, Human
auggcaguuauauuu

SEQ ID NO: 1244369 - RNA, 16 nt, Human
auggcauaaccugucu

SEQ ID NO: 1244370 - RNA, 17 nt, Human
auggcauaaccugucuc

SEQ ID NO: 1244371 - RNA, 16 nt, Human
auggcauccuccagcc

SEQ ID NO: 1244372 - RNA, 15 nt, Human
auggcaugagaaaua

SEQ ID NO: 1244373 - RNA, 17 nt, Human
auggcaugagaaauaca

SEQ ID NO: 1244374 - RNA, 18 nt, Human
auggcaugagaaauacaa

SEQ ID NO: 1244375 - RNA, 22 nt, Human
auggccauggaguguacaagua

SEQ ID NO: 1244376 - RNA, 15 nt, Human
auggcccauccugug

SEQ ID NO: 1244377 - RNA, 14 nt, Human
auggccccagcaca

SEQ ID NO: 1244378 - RNA, 15 nt, Human
auggccccagcacag

SEQ ID NO: 1244379 - RNA, 17 nt, Human
auggccccagcacagcu

SEQ ID NO: 1244380 - RNA, 18 nt, Human
auggccccagcacagcuu

SEQ ID NO: 1244381 - RNA, 20 nt, Human
auggccccagcacagcuuga

SEQ ID NO: 1244382 - RNA, 18 nt, Human
augggagggaggcucagg

SEQ ID NO: 1244383 - RNA, 21 nt, Human
augggagcugguuagaaaugc

SEQ ID NO: 1244384 - RNA, 23 nt, Human
augggaggcucacccccuucucc

SEQ ID NO: 1244385 - RNA, 21 nt, Human
augggaggccuuucccuaagc

SEQ ID NO: 1244386 - RNA, 20 nt, Human
augggagcugguuagaaaug

SEQ ID NO: 1244387 - RNA, 22 nt, Human
augggagcugguuagaaaugca

SEQ ID NO: 1244388 - RNA, 17 nt, Human
augggagacccuugaca

SEQ ID NO: 1244389 - RNA, 18 nt, Human
augggagacccuugacac

SEQ ID NO: 1244390 - RNA, 12 nt, Human
auggcucccagg

SEQ ID NO: 1244391 - RNA, 19 nt, Human
auggcuauguuuuuaaugu

SEQ ID NO: 1244392 - RNA, 13 nt, Human
auggcuauuuuau

SEQ ID NO: 1244393 - RNA, 19 nt, Human
auggcuaagcaaaauguga

SEQ ID NO: 1244394 - RNA, 20 nt, Human
auggcguaaguacagagaag

SEQ ID NO: 1244395 - RNA, 21 nt, Human
auggcguaaguacagagaagc

SEQ ID NO: 1244396 - RNA, 23 nt, Human
auggcguaaguacagagaagcca

SEQ ID NO: 1244397 - RNA, 22 nt, Human
auggcguaaguacagagaagcc

SEQ ID NO: 1244398 - RNA, 11 nt, Human
auggccccucu

SEQ ID NO: 1244399 - RNA, 18 nt, Human
auggccccucugaccugc

SEQ ID NO: 1244400 - RNA, 23 nt, Human
auggccccucugaccugcacugg

SEQ ID NO: 1244401 - RNA, 17 nt, Human
auggcguaaguacagag

SEQ ID NO: 1244402 - RNA, 18 nt, Human
auggcguaaguacagaga

SEQ ID NO: 1244403 - RNA, 19 nt, Human
auggcguaaguacagagaa

SEQ ID NO: 1244404 - RNA, 17 nt, Human
aucaggguuaguauugu

SEQ ID NO: 1244405 - RNA, 16 nt, Human
aucaggcuuuuguuuc

SEQ ID NO: 1244406 - RNA, 18 nt, Human
aucagggaggucauuuug

SEQ ID NO: 1244407 - RNA, 20 nt, Human
aucagggguaggaauggaaa

SEQ ID NO: 1244408 - RNA, 23 nt, Human
aucagguaacuaacugcauacac

SEQ ID NO: 1244409 - RNA, 16 nt, Human
aucagguccucagaga

SEQ ID NO: 1244410 - RNA, 20 nt, Human
aucagguccucagagaauuu

SEQ ID NO: 1244411 - RNA, 19 nt, Human
aucaggccuagaggccuga

SEQ ID NO: 1244412 - RNA, 14 nt, Human
aucaggccuagagg

SEQ ID NO: 1244413 - RNA, 14 nt, Human
aucaggcuuucuua

SEQ ID NO: 1244414 - RNA, 22 nt, Human
aucaggcuuucuuaaagugaga

SEQ ID NO: 1244415 - RNA, 14 nt, Human
aucaggcuuucuuu

SEQ ID NO: 1244416 - RNA, 22 nt, Human
aucaggcuuucuuuuuuuucuu

SEQ ID NO: 1244417 - RNA, 22 nt, Human
aucagaauagccacauuuggaa

SEQ ID NO: 1244418 - RNA, 19 nt, Human
aucagaauaucacagaaaa

SEQ ID NO: 1244419 - RNA, 22 nt, Human
aucagaugcuccaagauucuag

SEQ ID NO: 1244420 - RNA, 23 nt, Human
aucagaugcuccaagauucuaga

SEQ ID NO: 1244421 - RNA, 21 nt, Human
aucagcaaaccggggccuacu

SEQ ID NO: 1244422 - RNA, 13 nt, Human
uucuaggacugaa

SEQ ID NO: 1244423 - RNA, 14 nt, Human
uucuaggacugaau

SEQ ID NO: 1244424 - RNA, 22 nt, Human
uucuagcuuaucuacuuccaaa

SEQ ID NO: 1244425 - RNA, 11 nt, Human
uucuaggaaaa

SEQ ID NO: 1244426 - RNA, 16 nt, Human
uucuaggaaaauaaaa

SEQ ID NO: 1244427 - RNA, 12 nt, Human
uucuaggaaaau

SEQ ID NO: 1244428 - RNA, 16 nt, Human
uucuaggacugaauua

SEQ ID NO: 1244429 - RNA, 23 nt, Human
uucuaggacugaauuaugaaacu

SEQ ID NO: 1244430 - RNA, 18 nt, Human
uucucacaggucccaaau

SEQ ID NO: 1244431 - RNA, 18 nt, Human
uucucacuccuaccuggu

SEQ ID NO: 1244432 - RNA, 16 nt, Human
uucucaggacacaggc

SEQ ID NO: 1244433 - RNA, 18 nt, Human
uucucaggacacaggccu

SEQ ID NO: 1244434 - RNA, 19 nt, Human
uucucaggacacaggccug

SEQ ID NO: 1244435 - RNA, 20 nt, Human
uucucaggacacaggccugu

SEQ ID NO: 1244436 - RNA, 22 nt, Human
uucucaggacacaggccugugu

SEQ ID NO: 1244437 - RNA, 23 nt, Human
uucucaggacacaggccugugua

SEQ ID NO: 1244438 - RNA, 16 nt, Human
uucucacuccuaccug

SEQ ID NO: 1244439 - RNA, 15 nt, Human
uucucacuaauuugu

SEQ ID NO: 1244440 - RNA, 15 nt, Human
uucucacuaaaucuu

SEQ ID NO: 1244441 - RNA, 22 nt, Human
aucacuugucaauaaaauccau

SEQ ID NO: 1244442 - RNA, 21 nt, Human
aucacuuguacaaaauaaaca

SEQ ID NO: 1244443 - RNA, 16 nt, Human
aucacuuucucaguuu

SEQ ID NO: 1244444 - RNA, 18 nt, Human
aucacuuucucaguuuuc

SEQ ID NO: 1244445 - RNA, 18 nt, Human
aucagaaguuucucagcu

SEQ ID NO: 1244446 - RNA, 19 nt, Human
aucagaagucaucuugcua

SEQ ID NO: 1244447 - RNA, 19 nt, Human
aucagaauagccacauuug

SEQ ID NO: 1244448 - RNA, 16 nt, Human
uucucagguguugcca

SEQ ID NO: 1244449 - RNA, 17 nt, Human
uucucagguguugccaa

SEQ ID NO: 1244450 - RNA, 19 nt, Human
uucucagguguugccaaau

SEQ ID NO: 1244451 - RNA, 14 nt, Human
aucacuuguacaaa

SEQ ID NO: 1244452 - RNA, 16 nt, Human
aucacuuguacaaaau

SEQ ID NO: 1244453 - RNA, 17 nt, Human
aucacuuguacaaaaua

SEQ ID NO: 1244454 - RNA, 18 nt, Human
aucacuuguacaaaauaa

SEQ ID NO: 1244455 - RNA, 13 nt, Human
uucuaaaguaaaa

SEQ ID NO: 1244456 - RNA, 18 nt, Human
uucggccccauguaucuc

SEQ ID NO: 1244457 - RNA, 13 nt, Human
uucuaaaggucca

SEQ ID NO: 1244458 - RNA, 16 nt, Human
uucuaaagguccacag

SEQ ID NO: 1244459 - RNA, 12 nt, Human
uucuaaaugaau

SEQ ID NO: 1244460 - RNA, 15 nt, Human
uucuaaaugaauguu

SEQ ID NO: 1244461 - RNA, 18 nt, Human
uucuaaaugaauguuuac

SEQ ID NO: 1244462 - RNA, 21 nt, Human
uucuaaaugaauguuuacacu

SEQ ID NO: 1244463 - RNA, 15 nt, Human
uucggccuccauccu

SEQ ID NO: 1244464 - RNA, 17 nt, Human
uucggccccauguaucu

SEQ ID NO: 1244465 - RNA, 16 nt, Human
aucacugcucacacug

SEQ ID NO: 1244466 - RNA, 14 nt, Human
uucggccuccaucc

SEQ ID NO: 1244467 - RNA, 19 nt, Human
uucggacaguuuauuuguu

SEQ ID NO: 1244468 - RNA, 20 nt, Human
uucggacaguuuauuuguug

SEQ ID NO: 1244469 - RNA, 14 nt, Human
uucgcucuuugaga

SEQ ID NO: 1244470 - RNA, 22 nt, Human
uucgcuucuugccucugugcug

SEQ ID NO: 1244471 - RNA, 23 nt, Human
uucggaaagaagaaggugggagg

SEQ ID NO: 1244472 - RNA, 16 nt, Human
uucuagcgcaguuuuu

SEQ ID NO: 1244473 - RNA, 12 nt, Human
uucuagaugauu

SEQ ID NO: 1244474 - RNA, 22 nt, Human
uucuagaugauuaaauaagauu

SEQ ID NO: 1244475 - RNA, 23 nt, Human
uucuaagaagugaaaaucuacac

SEQ ID NO: 1244476 - RNA, 12 nt, Human
uucuaagacuca

SEQ ID NO: 1244477 - RNA, 13 nt, Human
uucuaagacucaa

SEQ ID NO: 1244478 - RNA, 16 nt, Human
uucuaagacucaaaug

SEQ ID NO: 1244479 - RNA, 20 nt, Human
uucuaagacucaaauguucu

SEQ ID NO: 1244480 - RNA, 21 nt, Human
uucuaagacucaaauguucua

SEQ ID NO: 1244481 - RNA, 22 nt, Human
uucuaagacucaaauguucuaa

SEQ ID NO: 1244482 - RNA, 20 nt, Human
uucuaagacuuacucuaaga

SEQ ID NO: 1244483 - RNA, 17 nt, Human
uucuaagacuuuacuua

SEQ ID NO: 1244484 - RNA, 21 nt, Human
uucuaagacuuacucuaagau

SEQ ID NO: 1244485 - RNA, 20 nt, Human
uucuaaggccuaggauucua

SEQ ID NO: 1244486 - RNA, 21 nt, Human
uucuaaggccuaggauucuaa

SEQ ID NO: 1244487 - RNA, 22 nt, Human
uucuaaggccuaggauucuaaa

SEQ ID NO: 1244488 - RNA, 12 nt, Human
uucuaaggcucu

SEQ ID NO: 1244489 - RNA, 13 nt, Human
uucuaaggcucug

SEQ ID NO: 1244490 - RNA, 16 nt, Human
uucuaaggcucugaga

SEQ ID NO: 1244491 - RNA, 17 nt, Human
uucuaaggcucugagag

SEQ ID NO: 1244492 - RNA, 18 nt, Human
uucuaaggcucugagagu

SEQ ID NO: 1244493 - RNA, 20 nt, Human
uucuaaggcucugagagucu

SEQ ID NO: 1244494 - RNA, 20 nt, Human
uucuaagguccgguguucua

SEQ ID NO: 1244495 - RNA, 21 nt, Human
uucuaagguccgguguucuaa

SEQ ID NO: 1244496 - RNA, 23 nt, Human
uucuaagguccgguguucuaaga

SEQ ID NO: 1244497 - RNA, 24 nt, Human
uucuagaucagaugcuccaagauu

SEQ ID NO: 1244498 - RNA, 20 nt, Human
uuccuaaauauauuuuaaga

SEQ ID NO: 1244499 - RNA, 15 nt, Human
uuccguguccacccc

SEQ ID NO: 1244500 - RNA, 17 nt, Human
uuccguguccaccccca

SEQ ID NO: 1244501 - RNA, 16 nt, Human
uuccuaauuccacagc

SEQ ID NO: 1244502 - RNA, 17 nt, Human
uuccuaauuccacagcu

SEQ ID NO: 1244503 - RNA, 18 nt, Human
uuccuaauuccacagcug

SEQ ID NO: 1244504 - RNA, 14 nt, Human
uuccucugagccuu

SEQ ID NO: 1244505 - RNA, 17 nt, Human
uuccucugagccuuggg

SEQ ID NO: 1244506 - RNA, 21 nt, Human
uuccucugaggcugaaauuca

SEQ ID NO: 1244507 - RNA, 11 nt, Human
uuccucugccc

SEQ ID NO: 1244508 - RNA, 20 nt, Human
uuccucugcccuuccugcag

SEQ ID NO: 1244509 - RNA, 15 nt, Human
uuccugaacaggaua

SEQ ID NO: 1244510 - RNA, 15 nt, Human
uuccugaagaaccag

SEQ ID NO: 1244511 - RNA, 16 nt, Human
uuccugaagaaccagu

SEQ ID NO: 1244512 - RNA, 19 nt, Human
uuccugaagaaccaguccc

SEQ ID NO: 1244513 - RNA, 19 nt, Human
uuccguagguuauuuucag

SEQ ID NO: 1244514 - RNA, 20 nt, Human
uucccucacucgucuccccc

SEQ ID NO: 1244515 - RNA, 21 nt, Human
uucccucacucgucuccccca

SEQ ID NO: 1244516 - RNA, 19 nt, Human
uucccucccagaggagcca

SEQ ID NO: 1244517 - RNA, 22 nt, Human
uuccggauccuaagcaucuaag

SEQ ID NO: 1244518 - RNA, 22 nt, Human
uuccggcauggacaauggaccg

SEQ ID NO: 1244519 - RNA, 13 nt, Human
uuccggccccucc

SEQ ID NO: 1244520 - RNA, 17 nt, Human
uuccggccccuccccuc

SEQ ID NO: 1244521 - RNA, 21 nt, Human
uuccggccccuccccuccaaa

SEQ ID NO: 1244522 - RNA, 18 nt, Human
uuccggccccuccccucc

SEQ ID NO: 1244523 - RNA, 21 nt, Human
uuccgucaccacgacuggcca

SEQ ID NO: 1244524 - RNA, 18 nt, Human
uuccgugacgucacugga

SEQ ID NO: 1244525 - RNA, 21 nt, Human
uucccucaccuuggcaccaga

SEQ ID NO: 1244526 - RNA, 16 nt, Human
uucccgcucagcccuc

SEQ ID NO: 1244527 - RNA, 18 nt, Human
uucccgcucagcccuccc

SEQ ID NO: 1244528 - RNA, 21 nt, Human
uucccgcucagcccucccugc

SEQ ID NO: 1244529 - RNA, 22 nt, Human
uucccgcucagcccucccugcc

SEQ ID NO: 1244530 - RNA, 15 nt, Human
auagcaaaagaagaa

SEQ ID NO: 1244531 - RNA, 16 nt, Human
auagcaaaagaagaag

SEQ ID NO: 1244532 - RNA, 17 nt, Human
auagcaaaagaagaagu

SEQ ID NO: 1244533 - RNA, 18 nt, Human
auagcaaaagaagaaguu

SEQ ID NO: 1244534 - RNA, 19 nt, Human
auagcaaaagaagaaguuu

SEQ ID NO: 1244535 - RNA, 13 nt, Human
auagcaaagaauu

SEQ ID NO: 1244536 - RNA, 14 nt, Human
auagcaaagaauug

SEQ ID NO: 1244537 - RNA, 15 nt, Human
auagcaaagaauuga

SEQ ID NO: 1244538 - RNA, 16 nt, Human
aucaaggguacacugc

SEQ ID NO: 1244539 - RNA, 18 nt, Human
aucaaggccuuauuggaa

SEQ ID NO: 1244540 - RNA, 22 nt, Human
aucaaggccuuauuggaaagca

SEQ ID NO: 1244541 - RNA, 20 nt, Human
aucaccuuagaccaccaagc

SEQ ID NO: 1244542 - RNA, 22 nt, Human
aucaaucuuuaaaccaauugcu

SEQ ID NO: 1244543 - RNA, 21 nt, Human
aucaaucuguaaaacuaagaa

SEQ ID NO: 1244544 - RNA, 16 nt, Human
aucaaucuugcaugua

SEQ ID NO: 1244545 - RNA, 17 nt, Human
aucaaucuugcauguaa

SEQ ID NO: 1244546 - RNA, 18 nt, Human
aucaaucuugcauguaac

SEQ ID NO: 1244547 - RNA, 19 nt, Human
aucaccuuagaccaccaag

SEQ ID NO: 1244548 - RNA, 14 nt, Human
aucacgcuuuccug

SEQ ID NO: 1244549 - RNA, 18 nt, Human
aucacgcuuuccugaauc

SEQ ID NO: 1244550 - RNA, 18 nt, Human
aucacgcuuuuugaaaaa

SEQ ID NO: 1244551 - RNA, 15 nt, Human
aucacugaguuuucc

SEQ ID NO: 1244552 - RNA, 16 nt, Human
aucacugaguuuucca

SEQ ID NO: 1244553 - RNA, 17 nt, Human
aucacugaguuuuccau

SEQ ID NO: 1244554 - RNA, 18 nt, Human
aucacugaguuuuccaug

SEQ ID NO: 1244555 - RNA, 15 nt, Human
uuccugugcacagcc

SEQ ID NO: 1244556 - RNA, 14 nt, Human
uuccugugcacagc

SEQ ID NO: 1244557 - RNA, 21 nt, Human
uuccuguggauguaaagugau

SEQ ID NO: 1244558 - RNA, 13 nt, Human
uuccuguggcucc

SEQ ID NO: 1244559 - RNA, 19 nt, Human
uuccuguccucuuucagcu

SEQ ID NO: 1244560 - RNA, 20 nt, Human
uuccuguccucuuucagcuc

SEQ ID NO: 1244561 - RNA, 24 nt, Human
uuccuguccucuuucagcuccuga

SEQ ID NO: 1244562 - RNA, 21 nt, Human
uuccuguccucuuucagcucc

SEQ ID NO: 1244563 - RNA, 19 nt, Human
uuccugucuuauccuccac

SEQ ID NO: 1244564 - RNA, 14 nt, Human
auauuuuuaucuuu

SEQ ID NO: 1244565 - RNA, 15 nt, Human
auauuuuuaucuuua

SEQ ID NO: 1244566 - RNA, 20 nt, Human
auauuuuuaucuuuauauga

SEQ ID NO: 1244567 - RNA, 22 nt, Human
auauuuuuaucuuuauaugaag

SEQ ID NO: 1244568 - RNA, 14 nt, Human
aucaacagauaaau

SEQ ID NO: 1244569 - RNA, 16 nt, Human
aucaacaaaaauuguc

SEQ ID NO: 1244570 - RNA, 21 nt, Human
aucaaauuuguaggguuucua

SEQ ID NO: 1244571 - RNA, 14 nt, Human
aucaacauuucuca

SEQ ID NO: 1244572 - RNA, 18 nt, Human
auauuuuuuguuaaauga

SEQ ID NO: 1244573 - RNA, 20 nt, Human
auauuuuuuguuaaaugauu

SEQ ID NO: 1244574 - RNA, 22 nt, Human
aucaaauguuuaaucauauaaa

SEQ ID NO: 1244575 - RNA, 20 nt, Human
uugaaauuaugugacauuuu

SEQ ID NO: 1244576 - RNA, 17 nt, Human
uugaaauuaugugacau

SEQ ID NO: 1244577 - RNA, 18 nt, Human
uugaaauuaaccucucac

SEQ ID NO: 1244578 - RNA, 21 nt, Human
uugaaauguaaggcuguguaa

SEQ ID NO: 1244579 - RNA, 20 nt, Human
uugaaauuaagaaggcaaaa

SEQ ID NO: 1244580 - RNA, 21 nt, Human
uugaaagggguugugaagagg

SEQ ID NO: 1244581 - RNA, 21 nt, Human
uugaaagguuuuuuuucaguu

SEQ ID NO: 1244582 - RNA, 22 nt, Human
uugaaagguuuuuuuucaguug

SEQ ID NO: 1244583 - RNA, 11 nt, Human
uugaaauguaa

SEQ ID NO: 1244584 - RNA, 17 nt, Human
uugaaauguaaggcugu

SEQ ID NO: 1244585 - RNA, 20 nt, Human
uugaaauguaaggcugugua

SEQ ID NO: 1244586 - RNA, 17 nt, Human
uugaaauuguauuacaa

SEQ ID NO: 1244587 - RNA, 19 nt, Human
uugaacccgggaggcagag

SEQ ID NO: 1244588 - RNA, 18 nt, Human
uugaaauugaaccuuugu

SEQ ID NO: 1244589 - RNA, 18 nt, Human
uugaaccugaugaaaaua

SEQ ID NO: 1244590 - RNA, 20 nt, Human
uugaaccugaugaaaauaaa

SEQ ID NO: 1244591 - RNA, 19 nt, Human
uugaaccugaugaaaauaa

SEQ ID NO: 1244592 - RNA, 17 nt, Human
uugaaccuuugugcccu

SEQ ID NO: 1244593 - RNA, 19 nt, Human
uugaaccuuugugcccuau

SEQ ID NO: 1244594 - RNA, 16 nt, Human
uugaacguuuucuaau

SEQ ID NO: 1244595 - RNA, 17 nt, Human
uugaacguuuucuaauu

SEQ ID NO: 1244596 - RNA, 18 nt, Human
uugaacguuuucuaauug

SEQ ID NO: 1244597 - RNA, 19 nt, Human
uugaacguuuucuaauugc

SEQ ID NO: 1244598 - RNA, 20 nt, Human
uugaacguuuucuaauugcu

SEQ ID NO: 1244599 - RNA, 21 nt, Human
uugaacguuuucuaauugcuu

SEQ ID NO: 1244600 - RNA, 17 nt, Human
auccgacugcuuuggac

SEQ ID NO: 1244601 - RNA, 14 nt, Human
auccuaaacaucau

SEQ ID NO: 1244602 - RNA, 17 nt, Human
auccuaagcaucuaagu

SEQ ID NO: 1244603 - RNA, 18 nt, Human
auccuacaagacacagug

SEQ ID NO: 1244604 - RNA, 19 nt, Human
auccuacaagacacaguga

SEQ ID NO: 1244605 - RNA, 13 nt, Human
auccuaaagaaca

SEQ ID NO: 1244606 - RNA, 16 nt, Human
auccuaaagaacaaag

SEQ ID NO: 1244607 - RNA, 18 nt, Human
auccuaaagaacaaagua

SEQ ID NO: 1244608 - RNA, 14 nt, Human
auccgccaauauua

SEQ ID NO: 1244609 - RNA, 13 nt, Human
auccggaaagaag

SEQ ID NO: 1244610 - RNA, 22 nt, Human
auccggcaacaucaacccgagu

SEQ ID NO: 1244611 - RNA, 21 nt, Human
auccgucuuuggccuccucca

SEQ ID NO: 1244612 - RNA, 17 nt, Human
auccgugccucuuuuua

SEQ ID NO: 1244613 - RNA, 20 nt, Human
auccgugccucuuuuuaaag

SEQ ID NO: 1244614 - RNA, 16 nt, Human
auccuagauccuaagg

SEQ ID NO: 1244615 - RNA, 11 nt, Human
auccuccucau

SEQ ID NO: 1244616 - RNA, 11 nt, Human
auccuccuccc

SEQ ID NO: 1244617 - RNA, 14 nt, Human
auccuacccccugu

SEQ ID NO: 1244618 - RNA, 21 nt, Human
auccuaccacaaugcagugcc

SEQ ID NO: 1244619 - RNA, 22 nt, Human
auccuaccacaaugcagugccu

SEQ ID NO: 1244620 - RNA, 18 nt, Human
auccuaagcaucuaaguu

SEQ ID NO: 1244621 - RNA, 16 nt, Human
auccuacccccugugc

SEQ ID NO: 1244622 - RNA, 15 nt, Human
auccuagauccuaag

SEQ ID NO: 1244623 - RNA, 16 nt, Human
uucuuuguaaugaaaa

SEQ ID NO: 1244624 - RNA, 22 nt, Human
uucuuugguuucccaagagcua

SEQ ID NO: 1244625 - RNA, 18 nt, Human
uucuuuuugggagagacu

SEQ ID NO: 1244626 - RNA, 15 nt, Human
uucuuuguaaugaaa

SEQ ID NO: 1244627 - RNA, 13 nt, Human
uucuuugggccag

SEQ ID NO: 1244628 - RNA, 14 nt, Human
uucuuuuuuuguga

SEQ ID NO: 1244629 - RNA, 23 nt, Human
uucuuuuuugauauagaaguaua

SEQ ID NO: 1244630 - RNA, 19 nt, Human
uucuuuuugggagagacuu

SEQ ID NO: 1244631 - RNA, 21 nt, Human
uucuuuuugggagagacuugu

SEQ ID NO: 1244632 - RNA, 23 nt, Human
uucuuuuuguagcuggggcuuug

SEQ ID NO: 1244633 - RNA, 22 nt, Human
uucuuuuuugauauagaaguau

SEQ ID NO: 1244634 - RNA, 23 nt, Human
uucuuuuuuggccaucugcuccu

SEQ ID NO: 1244635 - RNA, 16 nt, Human
uucuuuuuuuagagaa

SEQ ID NO: 1244636 - RNA, 20 nt, Human
uucuucugaacucaaacuga

SEQ ID NO: 1244637 - RNA, 23 nt, Human
uucuucugaacucaaacugagga

SEQ ID NO: 1244638 - RNA, 14 nt, Human
uucuucuucucguc

SEQ ID NO: 1244639 - RNA, 16 nt, Human
uucuucuugaggggaa

SEQ ID NO: 1244640 - RNA, 16 nt, Human
uucuuuggaaaguaca

SEQ ID NO: 1244641 - RNA, 20 nt, Human
uucuuuggaaaguacacucu

SEQ ID NO: 1244642 - RNA, 21 nt, Human
aucccaucgucucggccuuca

SEQ ID NO: 1244643 - RNA, 23 nt, Human
aucccaucgucucggccuucaca

SEQ ID NO: 1244644 - RNA, 11 nt, Human
aucccucaucu

SEQ ID NO: 1244645 - RNA, 13 nt, Human
uucuuaacuucuu

SEQ ID NO: 1244646 - RNA, 16 nt, Human
uucuuaacuucuugcu

SEQ ID NO: 1244647 - RNA, 17 nt, Human
uucuuaacuucuugcuu

SEQ ID NO: 1244648 - RNA, 13 nt, Human
uucuucugaacuc

SEQ ID NO: 1244649 - RNA, 13 nt, Human
auccaucaggcca

SEQ ID NO: 1244650 - RNA, 14 nt, Human
auccaucaucaugu

SEQ ID NO: 1244651 - RNA, 18 nt, Human
auccauauugagucaaau

SEQ ID NO: 1244652 - RNA, 20 nt, Human
auccauauugagucaaaugg

SEQ ID NO: 1244653 - RNA, 18 nt, Human
auccaguuuugucaaugc

SEQ ID NO: 1244654 - RNA, 16 nt, Human
auccagugauccuuac

SEQ ID NO: 1244655 - RNA, 21 nt, Human
auccagugauccuuacaaguu

SEQ ID NO: 1244656 - RNA, 16 nt, Human
auccaguucaugagaa

SEQ ID NO: 1244657 - RNA, 15 nt, Human
auccacauuucuaaa

SEQ ID NO: 1244658 - RNA, 16 nt, Human
auccacauuucuaaaa

SEQ ID NO: 1244659 - RNA, 14 nt, Human
aucccagcugccua

SEQ ID NO: 1244660 - RNA, 13 nt, Human
aucccagcugccu

SEQ ID NO: 1244661 - RNA, 24 nt, Human
aucccagcccccugaccacucaga

SEQ ID NO: 1244662 - RNA, 19 nt, Human
aucccagcccccugaccac

SEQ ID NO: 1244663 - RNA, 20 nt, Human
aucccaaaguuguuguaacc

SEQ ID NO: 1244664 - RNA, 22 nt, Human
aucccaaaguuguuguaaccug

SEQ ID NO: 1244665 - RNA, 14 nt, Human
aucccagcccccug

SEQ ID NO: 1244666 - RNA, 16 nt, Human
aucccagcccccugac

SEQ ID NO: 1244667 - RNA, 16 nt, Human
aucccaaaggacagcc

SEQ ID NO: 1244668 - RNA, 20 nt, Human
aucccaaaggacagccgccu

SEQ ID NO: 1244669 - RNA, 15 nt, Human
aucccaaaguuguug

SEQ ID NO: 1244670 - RNA, 21 nt, Human
auccaagcaccaccaaacaca

SEQ ID NO: 1244671 - RNA, 23 nt, Human
aucauuuuaugucaagggcagcu

SEQ ID NO: 1244672 - RNA, 14 nt, Human
aucauuuuauguca

SEQ ID NO: 1244673 - RNA, 22 nt, Human
aucauuuugcaaucccuuaaua

SEQ ID NO: 1244674 - RNA, 15 nt, Human
uucugggccugacca

SEQ ID NO: 1244675 - RNA, 16 nt, Human
uucugggcuucaucug

SEQ ID NO: 1244676 - RNA, 17 nt, Human
uucuggggcaggcuggg

SEQ ID NO: 1244677 - RNA, 18 nt, Human
uucuggggcaggcugggc

SEQ ID NO: 1244678 - RNA, 19 nt, Human
uucuggggcaggcugggcc

SEQ ID NO: 1244679 - RNA, 20 nt, Human
uucuggggcaggcugggcca

SEQ ID NO: 1244680 - RNA, 21 nt, Human
uucuggggcaggcugggccau

SEQ ID NO: 1244681 - RNA, 17 nt, Human
uucuccuuucacaaccu

SEQ ID NO: 1244682 - RNA, 12 nt, Human
uucucuaggaaa

SEQ ID NO: 1244683 - RNA, 20 nt, Human
uucucuuccuuuuaucagua

SEQ ID NO: 1244684 - RNA, 13 nt, Human
uucucuugccuca

SEQ ID NO: 1244685 - RNA, 14 nt, Human
aucagguuuuuccc

SEQ ID NO: 1244686 - RNA, 14 nt, Human
aucaguaaauaacu

SEQ ID NO: 1244687 - RNA, 18 nt, Human
aucaguaaauaacuggaa

SEQ ID NO: 1244688 - RNA, 17 nt, Human
aucaguaagagguguua

SEQ ID NO: 1244689 - RNA, 23 nt, Human
aucaguaagagguguuauuugga

SEQ ID NO: 1244690 - RNA, 16 nt, Human
aucaguaguucacaua

SEQ ID NO: 1244691 - RNA, 23 nt, Human
uucuccugcugcucccucagacu

SEQ ID NO: 1244692 - RNA, 23 nt, Human
aucaguaguucacauacaaauca

SEQ ID NO: 1244693 - RNA, 16 nt, Human
uucuccugcugcuccc

SEQ ID NO: 1244694 - RNA, 19 nt, Human
uucuccugcugcucccuca

SEQ ID NO: 1244695 - RNA, 20 nt, Human
uucuccugcugcucccucag

SEQ ID NO: 1244696 - RNA, 21 nt, Human
uucuccugcugcucccucaga

SEQ ID NO: 1244697 - RNA, 22 nt, Human
uucuccugcugcucccucagac

SEQ ID NO: 1244698 - RNA, 10 nt, Human
uucuccugga

SEQ ID NO: 1244699 - RNA, 14 nt, Human
uucugccuggagac

SEQ ID NO: 1244700 - RNA, 15 nt, Human
uucuggcuguuugag

SEQ ID NO: 1244701 - RNA, 14 nt, Human
uucugggagggcag

SEQ ID NO: 1244702 - RNA, 21 nt, Human
uucugggagggcagcagggcu

SEQ ID NO: 1244703 - RNA, 17 nt, Human
uucucuugggaacugaa

SEQ ID NO: 1244704 - RNA, 22 nt, Human
uucucuugggaacugaacucac

SEQ ID NO: 1244705 - RNA, 19 nt, Human
uucucuuguauaagauccu

SEQ ID NO: 1244706 - RNA, 16 nt, Human
uucugaacucaaacug

SEQ ID NO: 1244707 - RNA, 17 nt, Human
uucugaacucaaacuga

SEQ ID NO: 1244708 - RNA, 18 nt, Human
uucugaacucaaacugag

SEQ ID NO: 1244709 - RNA, 22 nt, Human
uucugaacucaaacugaggaau

SEQ ID NO: 1244710 - RNA, 13 nt, Human
uucugccaggaga

SEQ ID NO: 1244711 - RNA, 16 nt, Human
uucugcccccugcaga

SEQ ID NO: 1244712 - RNA, 15 nt, Human
uucugcccugcccac

SEQ ID NO: 1244713 - RNA, 19 nt, Human
uucugcccccugcagaacc

SEQ ID NO: 1244714 - RNA, 14 nt, Human
aucucauuuccaag

SEQ ID NO: 1244715 - RNA, 16 nt, Human
aucucauugcuuacaa

SEQ ID NO: 1244716 - RNA, 17 nt, Human
aucucauugcuuacaag

SEQ ID NO: 1244717 - RNA, 14 nt, Human
aucucauuggaccc

SEQ ID NO: 1244718 - RNA, 15 nt, Human
aucucauuggacccu

SEQ ID NO: 1244719 - RNA, 19 nt, Human
aucucauuggacccuucca

SEQ ID NO: 1244720 - RNA, 20 nt, Human
aucucauuggacccuuccau

SEQ ID NO: 1244721 - RNA, 22 nt, Human
aucucaguaugaauuauucaau

SEQ ID NO: 1244722 - RNA, 18 nt, Human
aucucaguaugaauuauu

SEQ ID NO: 1244723 - RNA, 21 nt, Human
aucucaugccccuggcuggga

SEQ ID NO: 1244724 - RNA, 23 nt, Human
aucucaugccccuggcugggacg

SEQ ID NO: 1244725 - RNA, 13 nt, Human
aucuacuuccaaa

SEQ ID NO: 1244726 - RNA, 15 nt, Human
aucuacuuccaaacu

SEQ ID NO: 1244727 - RNA, 19 nt, Human
aucuacuuccaaacuaauu

SEQ ID NO: 1244728 - RNA, 19 nt, Human
aucuacuucuguaauugug

SEQ ID NO: 1244729 - RNA, 20 nt, Human
aucuacuucuguaauugugu

SEQ ID NO: 1244730 - RNA, 23 nt, Human
aucuacuucuguaauugugugga

SEQ ID NO: 1244731 - RNA, 19 nt, Human
aucuacuuuuacucauaag

SEQ ID NO: 1244732 - RNA, 21 nt, Human
aucuagaacacaggcaaaauc

SEQ ID NO: 1244733 - RNA, 17 nt, Human
aucuagaggcuuccuuc

SEQ ID NO: 1244734 - RNA, 19 nt, Human
aucuagaggcuuccuucau

SEQ ID NO: 1244735 - RNA, 23 nt, Human
aucuagaggcuuccuucauuucc

SEQ ID NO: 1244736 - RNA, 15 nt, Human
aucuccacuccagau

SEQ ID NO: 1244737 - RNA, 21 nt, Human
aucucuucuggguuccuuccu

SEQ ID NO: 1244738 - RNA, 17 nt, Human
aucucuucuuaauguac

SEQ ID NO: 1244739 - RNA, 13 nt, Human
aucucuucuuaau

SEQ ID NO: 1244740 - RNA, 15 nt, Human
aucuccaagcagcuu

SEQ ID NO: 1244741 - RNA, 17 nt, Human
aucuccaagcagcuuag

SEQ ID NO: 1244742 - RNA, 23 nt, Human
aucuccaagcagcuuagaguugg

SEQ ID NO: 1244743 - RNA, 20 nt, Human
aucucuucuuaauguacaua

SEQ ID NO: 1244744 - RNA, 14 nt, Human
aucucuucuuuuaa

SEQ ID NO: 1244745 - RNA, 22 nt, Human
aucucuucuuaauguacauagu

SEQ ID NO: 1244746 - RNA, 19 nt, Human
aucucuucuuaauguacau

SEQ ID NO: 1244747 - RNA, 18 nt, Human
aucucuucuuaauguaca

SEQ ID NO: 1244748 - RNA, 22 nt, Human
uugcaagggaaaagucucuugu

SEQ ID NO: 1244749 - RNA, 23 nt, Human
uugcauauaagggaaguaguuau

SEQ ID NO: 1244750 - RNA, 22 nt, Human
uugcaucacuuaacggaccaaa

SEQ ID NO: 1244751 - RNA, 14 nt, Human
uugcauugaacaca

SEQ ID NO: 1244752 - RNA, 15 nt, Human
uugcauugaacacaa

SEQ ID NO: 1244753 - RNA, 18 nt, Human
uugcauugaacacaaacu

SEQ ID NO: 1244754 - RNA, 22 nt, Human
uugcauugaacacaaacuguaa

SEQ ID NO: 1244755 - RNA, 23 nt, Human
uugcauugaacacaaacuguaaa

SEQ ID NO: 1244756 - RNA, 21 nt, Human
uugcauugaccgcgacuaauu

SEQ ID NO: 1244757 - RNA, 13 nt, Human
uugcauugacuuu

SEQ ID NO: 1244758 - RNA, 19 nt, Human
uugcauugacuuuccccac

SEQ ID NO: 1244759 - RNA, 15 nt, Human
uugcauuuaaaacag

SEQ ID NO: 1244760 - RNA, 20 nt, Human
uugcauuuaaaacagacacu

SEQ ID NO: 1244761 - RNA, 21 nt, Human
uugcauuuaaaacagacacug

SEQ ID NO: 1244762 - RNA, 12 nt, Human
aucugaauuuuu

SEQ ID NO: 1244763 - RNA, 14 nt, Human
aucugaauuuuuaa

SEQ ID NO: 1244764 - RNA, 18 nt, Human
aucugaauuuuuaaacaa

SEQ ID NO: 1244765 - RNA, 19 nt, Human
aucugaauuuuuaaacaag

SEQ ID NO: 1244766 - RNA, 20 nt, Human
aucugaauuuuuaaacaagu

SEQ ID NO: 1244767 - RNA, 12 nt, Human
aucugacccagu

SEQ ID NO: 1244768 - RNA, 13 nt, Human
aucugacccagug

SEQ ID NO: 1244769 - RNA, 13 nt, Human
uugauuaaagaug

SEQ ID NO: 1244770 - RNA, 14 nt, Human
uugauuaaagauga

SEQ ID NO: 1244771 - RNA, 14 nt, Human
uugauuacagugca

SEQ ID NO: 1244772 - RNA, 17 nt, Human
uugauuacagugcagug

SEQ ID NO: 1244773 - RNA, 21 nt, Human
uugauuauccauauugaguca

SEQ ID NO: 1244774 - RNA, 15 nt, Human
uugauuauucagugu

SEQ ID NO: 1244775 - RNA, 17 nt, Human
uugauuauucaguguca

SEQ ID NO: 1244776 - RNA, 13 nt, Human
uugcaagggaaaa

SEQ ID NO: 1244777 - RNA, 19 nt, Human
uugcaagggaaaagucucu

SEQ ID NO: 1244778 - RNA, 18 nt, Human
uugacuuauaguacauga

SEQ ID NO: 1244779 - RNA, 13 nt, Human
uugacuuucccca

SEQ ID NO: 1244780 - RNA, 19 nt, Human
uugacuuuccccaccagau

SEQ ID NO: 1244781 - RNA, 23 nt, Human
uugacuuuccccaccagaugcug

SEQ ID NO: 1244782 - RNA, 22 nt, Human
uugacuuuccccaccagaugcu

SEQ ID NO: 1244783 - RNA, 16 nt, Human
uugagucaaaaaaucu

SEQ ID NO: 1244784 - RNA, 14 nt, Human
uugagucugugcca

SEQ ID NO: 1244785 - RNA, 16 nt, Human
uugagauguguucaca

SEQ ID NO: 1244786 - RNA, 23 nt, Human
uugagagaaauaugaagaacuga

SEQ ID NO: 1244787 - RNA, 21 nt, Human
uugagauggagucuugcucug

SEQ ID NO: 1244788 - RNA, 20 nt, Human
uugaguugguuacuucauau

SEQ ID NO: 1244789 - RNA, 11 nt, Human
uugaguuuguc

SEQ ID NO: 1244790 - RNA, 23 nt, Human
uugaguuugucgcucaugugugc

SEQ ID NO: 1244791 - RNA, 14 nt, Human
uugaguuuucagug

SEQ ID NO: 1244792 - RNA, 19 nt, Human
uugaguuuucaguggggca

SEQ ID NO: 1244793 - RNA, 15 nt, Human
uugauacuaagcauu

SEQ ID NO: 1244794 - RNA, 13 nt, Human
uugauaccccccu

SEQ ID NO: 1244795 - RNA, 15 nt, Human
uugauaccccccucu

SEQ ID NO: 1244796 - RNA, 22 nt, Human
aucuaauaucccagaaaaagua

SEQ ID NO: 1244797 - RNA, 16 nt, Human
aucuaauauggccaca

SEQ ID NO: 1244798 - RNA, 23 nt, Human
aucuaauauggccacaguagucu

SEQ ID NO: 1244799 - RNA, 18 nt, Human
aucuacacuccagugaga

SEQ ID NO: 1244800 - RNA, 19 nt, Human
aucuacacuccagugagac

SEQ ID NO: 1244801 - RNA, 14 nt, Human
aucuacacacggug

SEQ ID NO: 1244802 - RNA, 17 nt, Human
uugaagggaaauuucag

SEQ ID NO: 1244803 - RNA, 11 nt, Human
uugaaggcuua

SEQ ID NO: 1244804 - RNA, 12 nt, Human
uugaaggcuuaa

SEQ ID NO: 1244805 - RNA, 13 nt, Human
uugaagccuuugu

SEQ ID NO: 1244806 - RNA, 15 nt, Human
uugaagccacugccu

SEQ ID NO: 1244807 - RNA, 12 nt, Human
uugaaggcaaaa

SEQ ID NO: 1244808 - RNA, 15 nt, Human
uugaaggcaaaauug

SEQ ID NO: 1244809 - RNA, 17 nt, Human
uugaaggcaaaauugca

SEQ ID NO: 1244810 - RNA, 13 nt, Human
uugaaucacagua

SEQ ID NO: 1244811 - RNA, 14 nt, Human
uugaaucaauaaua

SEQ ID NO: 1244812 - RNA, 22 nt, Human
uugaaucaauaauauauuuucu

SEQ ID NO: 1244813 - RNA, 15 nt, Human
uugaauacuuugaau

SEQ ID NO: 1244814 - RNA, 17 nt, Human
uugaauacuuugaaugu

SEQ ID NO: 1244815 - RNA, 18 nt, Human
uugaauacuuugaaugug

SEQ ID NO: 1244816 - RNA, 23 nt, Human
uugaauauuauuccucaaaaaau

SEQ ID NO: 1244817 - RNA, 10 nt, Human
uugaaucaau

SEQ ID NO: 1244818 - RNA, 13 nt, Human
uugaauaaauguc

SEQ ID NO: 1244819 - RNA, 14 nt, Human
uugaauaaauguca

SEQ ID NO: 1244820 - RNA, 15 nt, Human
uugaauaaggaaaug

SEQ ID NO: 1244821 - RNA, 17 nt, Human
uugaauaaaugucacuu

SEQ ID NO: 1244822 - RNA, 23 nt, Human
uugaaucaauaauauauuuucug

SEQ ID NO: 1244823 - RNA, 15 nt, Human
uugaaucacaugaau

SEQ ID NO: 1244824 - RNA, 15 nt, Human
uugaauccucucucu

SEQ ID NO: 1244825 - RNA, 21 nt, Human
auccucuccacagcugccucu

SEQ ID NO: 1244826 - RNA, 13 nt, Human
auccucucuuccu

SEQ ID NO: 1244827 - RNA, 15 nt, Human
auccucucuuccucu

SEQ ID NO: 1244828 - RNA, 16 nt, Human
auccucucuuccucuu

SEQ ID NO: 1244829 - RNA, 17 nt, Human
auccucucuuccucuuc

SEQ ID NO: 1244830 - RNA, 18 nt, Human
auccucugagugugacca

SEQ ID NO: 1244831 - RNA, 20 nt, Human
auccucucuuccucuucccc

SEQ ID NO: 1244832 - RNA, 17 nt, Human
auccucuggagccagcc

SEQ ID NO: 1244833 - RNA, 14 nt, Human
auccuccucccacc

SEQ ID NO: 1244834 - RNA, 11 nt, Human
auccuccugca

SEQ ID NO: 1244835 - RNA, 13 nt, Human
auccucuggcuug

SEQ ID NO: 1244836 - RNA, 20 nt, Human
auccucuguaaacuuuuugu

SEQ ID NO: 1244837 - RNA, 19 nt, Human
aucuaaaaauagacuuaaa

SEQ ID NO: 1244838 - RNA, 18 nt, Human
aucguucucucuuugcau

SEQ ID NO: 1244839 - RNA, 14 nt, Human
aucguugcccccau

SEQ ID NO: 1244840 - RNA, 14 nt, Human
aucguuuucuuaaa

SEQ ID NO: 1244841 - RNA, 17 nt, Human
aucguuuucuuaaagug

SEQ ID NO: 1244842 - RNA, 18 nt, Human
aucguuuucuuaaagugc

SEQ ID NO: 1244843 - RNA, 14 nt, Human
aucuuauaauuuaa

SEQ ID NO: 1244844 - RNA, 14 nt, Human
aucuuauaauuguu

SEQ ID NO: 1244845 - RNA, 16 nt, Human
aucuuauaauuguucu

SEQ ID NO: 1244846 - RNA, 17 nt, Human
aucuugaugucuuuguu

SEQ ID NO: 1244847 - RNA, 24 nt, Human
aucuugcaccccaaagcuuuccug

SEQ ID NO: 1244848 - RNA, 24 nt, Human
aucuugcaguaucggcacuguaca

SEQ ID NO: 1244849 - RNA, 13 nt, Human
aucuugcauguaa

SEQ ID NO: 1244850 - RNA, 22 nt, Human
aucuugcaguaucggcacugua

SEQ ID NO: 1244851 - RNA, 21 nt, Human
aucuugcaguaucggcacugu

SEQ ID NO: 1244852 - RNA, 14 nt, Human
aucuugcauguaac

SEQ ID NO: 1244853 - RNA, 18 nt, Human
aucuugcauuaugcaauu

SEQ ID NO: 1244854 - RNA, 19 nt, Human
aucuugcccgcucaggcug

SEQ ID NO: 1244855 - RNA, 14 nt, Human
aucuugcuaccagu

SEQ ID NO: 1244856 - RNA, 16 nt, Human
aucuugcuaccaguau

SEQ ID NO: 1244857 - RNA, 19 nt, Human
aucuugcuaccaguauuua

SEQ ID NO: 1244858 - RNA, 23 nt, Human
aucuugcuaccaguauuuagaag

SEQ ID NO: 1244859 - RNA, 20 nt, Human
aucuugguugaugccaaaaa

SEQ ID NO: 1244860 - RNA, 21 nt, Human
aucuugguugaugccaaaaaa

SEQ ID NO: 1244861 - RNA, 21 nt, Human
aucuugguuugccuuccagaa

SEQ ID NO: 1244862 - RNA, 22 nt, Human
aucugucuguggcaaaaguuua

SEQ ID NO: 1244863 - RNA, 19 nt, Human
aucuguuugagaaagucag

SEQ ID NO: 1244864 - RNA, 14 nt, Human
aucuguuugagaaa

SEQ ID NO: 1244865 - RNA, 13 nt, Human
aucuguuugagaa

SEQ ID NO: 1244866 - RNA, 15 nt, Human
aucuguuugagaaag

SEQ ID NO: 1244867 - RNA, 17 nt, Human
aucuguuuugaaggcaa

SEQ ID NO: 1244868 - RNA, 18 nt, Human
aucuguuuugaaggcaaa

SEQ ID NO: 1244869 - RNA, 19 nt, Human
aucuguuuugaaggcaaaa

SEQ ID NO: 1244870 - RNA, 13 nt, Human
aucuuaguguaug

SEQ ID NO: 1244871 - RNA, 14 nt, Human
aucuuaguguauga

SEQ ID NO: 1244872 - RNA, 15 nt, Human
aucuuaguguaugau

SEQ ID NO: 1244873 - RNA, 16 nt, Human
aucuuaguguaugauu

SEQ ID NO: 1244874 - RNA, 19 nt, Human
aucuuaguguaugauuacu

SEQ ID NO: 1244875 - RNA, 12 nt, Human
uugcuccuugac

SEQ ID NO: 1244876 - RNA, 11 nt, Human
uugcuccuccu

SEQ ID NO: 1244877 - RNA, 16 nt, Human
uugcucauauuuccca

SEQ ID NO: 1244878 - RNA, 13 nt, Human
uugcucacccagu

SEQ ID NO: 1244879 - RNA, 12 nt, Human
uugcucacccag

SEQ ID NO: 1244880 - RNA, 19 nt, Human
uugcucacccagugcccuc

SEQ ID NO: 1244881 - RNA, 12 nt, Human
uugcuucuuucu

SEQ ID NO: 1244882 - RNA, 17 nt, Human
uugcuucuuucuagaaa

SEQ ID NO: 1244883 - RNA, 20 nt, Human
uugcuucuuucuagaaagag

SEQ ID NO: 1244884 - RNA, 14 nt, Human
aucuugguuugccu

SEQ ID NO: 1244885 - RNA, 17 nt, Human
aucuugguuugccuucc

SEQ ID NO: 1244886 - RNA, 20 nt, Human
aucuugguuugccuuccaga

SEQ ID NO: 1244887 - RNA, 11 nt, Human
aucuugucaug

SEQ ID NO: 1244888 - RNA, 12 nt, Human
aucuugucaugu

SEQ ID NO: 1244889 - RNA, 14 nt, Human
aucuugucaugugu

SEQ ID NO: 1244890 - RNA, 15 nt, Human
aucuugucaugugua

SEQ ID NO: 1244891 - RNA, 16 nt, Human
aucuugucauguguau

SEQ ID NO: 1244892 - RNA, 17 nt, Human
aucuugucauguguaua

SEQ ID NO: 1244893 - RNA, 14 nt, Human
aucuuguccccaac

SEQ ID NO: 1244894 - RNA, 17 nt, Human
aucuuguccccaacacc

SEQ ID NO: 1244895 - RNA, 19 nt, Human
aucuugucauguguauaaa

SEQ ID NO: 1244896 - RNA, 12 nt, Human
uugcuauucugu

SEQ ID NO: 1244897 - RNA, 13 nt, Human
uugcuauucuguc

SEQ ID NO: 1244898 - RNA, 14 nt, Human
uugcuauucugucc

SEQ ID NO: 1244899 - RNA, 15 nt, Human
uugcuauucuguccc

SEQ ID NO: 1244900 - RNA, 16 nt, Human
uugcuauucugucccu

SEQ ID NO: 1244901 - RNA, 17 nt, Human
uugcuauucugucccua

SEQ ID NO: 1244902 - RNA, 19 nt, Human
uugcuauucugucccuagg

SEQ ID NO: 1244903 - RNA, 20 nt, Human
uugcauuuauauguaccgua

SEQ ID NO: 1244904 - RNA, 15 nt, Human
uugcauuuauaugua

SEQ ID NO: 1244905 - RNA, 22 nt, Human
uugcauuuaaaacagacacugg

SEQ ID NO: 1244906 - RNA, 14 nt, Human
uugcauuuguuuau

SEQ ID NO: 1244907 - RNA, 20 nt, Human
uugcauuuguuuauguaauu

SEQ ID NO: 1244908 - RNA, 22 nt, Human
uugcauuuguuuuguuuacaga

SEQ ID NO: 1244909 - RNA, 18 nt, Human
uugcauuuguuuuguuua

SEQ ID NO: 1244910 - RNA, 18 nt, Human
uugccaaaaagugaaaua

SEQ ID NO: 1244911 - RNA, 19 nt, Human
uugccaaaaagugaaauaa

SEQ ID NO: 1244912 - RNA, 23 nt, Human
uugccaaaaagugaaauaaugug

SEQ ID NO: 1244913 - RNA, 15 nt, Human
aucugccacaaaaac

SEQ ID NO: 1244914 - RNA, 16 nt, Human
aucugccaagggccga

SEQ ID NO: 1244915 - RNA, 15 nt, Human
aucugcccaccucag

SEQ ID NO: 1244916 - RNA, 23 nt, Human
aucugcccaccucagccucccaa

SEQ ID NO: 1244917 - RNA, 15 nt, Human
aucugcgugugugca

SEQ ID NO: 1244918 - RNA, 18 nt, Human
aucugcuaccaaaacagu

SEQ ID NO: 1244919 - RNA, 17 nt, Human
aucugcgugacaauaaa

SEQ ID NO: 1244920 - RNA, 21 nt, Human
aucugcgugacaauaaaacau

SEQ ID NO: 1244921 - RNA, 22 nt, Human
aucugcgugacaauaaaacauu

SEQ ID NO: 1244922 - RNA, 23 nt, Human
aucugcgugacaauaaaacauua

SEQ ID NO: 1244923 - RNA, 16 nt, Human
aucugcgugacaauaa

SEQ ID NO: 1244924 - RNA, 18 nt, Human
aucugccucucuuguaau

SEQ ID NO: 1244925 - RNA, 15 nt, Human
aucugccucucuugu

SEQ ID NO: 1244926 - RNA, 12 nt, Human
aucugccucccu

SEQ ID NO: 1244927 - RNA, 18 nt, Human
aucuguauacccucuguu

SEQ ID NO: 1244928 - RNA, 14 nt, Human
aucugucugguggc

SEQ ID NO: 1244929 - RNA, 16 nt, Human
aucugucugguggccc

SEQ ID NO: 1244930 - RNA, 15 nt, Human
aucugucuguggcaa

SEQ ID NO: 1244931 - RNA, 19 nt, Human
aucugucuguggcaaaagu

SEQ ID NO: 1244932 - RNA, 15 nt, Human
aucuguccucagccu

SEQ ID NO: 1244933 - RNA, 16 nt, Human
aucuguccucagccuu

SEQ ID NO: 1244934 - RNA, 17 nt, Human
aucuguccucagccuug

SEQ ID NO: 1244935 - RNA, 18 nt, Human
aucuguccucagccuugc

SEQ ID NO: 1244936 - RNA, 21 nt, Human
aucuguccucagccuugccag

SEQ ID NO: 1244937 - RNA, 19 nt, Human
aucugucugccaaccuaaa

SEQ ID NO: 1244938 - RNA, 23 nt, Human
aucugucugccaaccuaaaacuc

SEQ ID NO: 1244939 - RNA, 22 nt, Human
aucugucugccaaccuaaaacu

SEQ ID NO: 1244940 - RNA, 15 nt, Human
aucugucccccuuua

SEQ ID NO: 1244941 - RNA, 18 nt, Human
aucugucccccuuuagau

SEQ ID NO: 1244942 - RNA, 14 nt, Human
aucuguccucagcc

SEQ ID NO: 1244943 - RNA, 22 nt, Human
augaacuugaggacacaugucc

SEQ ID NO: 1244944 - RNA, 21 nt, Human
augaacuugaggacacauguc

SEQ ID NO: 1244945 - RNA, 20 nt, Human
augaacuugaggacacaugu

SEQ ID NO: 1244946 - RNA, 19 nt, Human
augaagaccuuuuucugca

SEQ ID NO: 1244947 - RNA, 19 nt, Human
augaacuugaggacacaug

SEQ ID NO: 1244948 - RNA, 18 nt, Human
augaacuugaggacacau

SEQ ID NO: 1244949 - RNA, 17 nt, Human
augaacuugaggacaca

SEQ ID NO: 1244950 - RNA, 16 nt, Human
augaacuugaggacac

SEQ ID NO: 1244951 - RNA, 18 nt, Human
augaacuuguaaaggaau

SEQ ID NO: 1244952 - RNA, 16 nt, Human
augaauauuuaguguu

SEQ ID NO: 1244953 - RNA, 16 nt, Human
augaagagauuuuuca

SEQ ID NO: 1244954 - RNA, 11 nt, Human
augaagaggag

SEQ ID NO: 1244955 - RNA, 20 nt, Human
augaagagauuuuucaugau

SEQ ID NO: 1244956 - RNA, 22 nt, Human
augaagaccuuuuucugcacua

SEQ ID NO: 1244957 - RNA, 21 nt, Human
augaagaccuuuuucugcacu

SEQ ID NO: 1244958 - RNA, 24 nt, Human
augaagaccuuuuucugcacuaua

SEQ ID NO: 1244959 - RNA, 15 nt, Human
augaacuugaggaca

SEQ ID NO: 1244960 - RNA, 13 nt, Human
augaacuugagga

SEQ ID NO: 1244961 - RNA, 13 nt, Human
augaaauuccauu

SEQ ID NO: 1244962 - RNA, 21 nt, Human
augaaaugugcacuuuauccu

SEQ ID NO: 1244963 - RNA, 13 nt, Human
aucuuuuguauua

SEQ ID NO: 1244964 - RNA, 16 nt, Human
aucuuuuguauuaaga

SEQ ID NO: 1244965 - RNA, 16 nt, Human
augaaaguauuaaaau

SEQ ID NO: 1244966 - RNA, 15 nt, Human
augaauuacauuugu

SEQ ID NO: 1244967 - RNA, 16 nt, Human
augaauguaaauuugu

SEQ ID NO: 1244968 - RNA, 19 nt, Human
augaauguaaauuuguacu

SEQ ID NO: 1244969 - RNA, 21 nt, Human
augaauguaaauuuguacuau

SEQ ID NO: 1244970 - RNA, 20 nt, Human
augaaugcuuaaagaauuca

SEQ ID NO: 1244971 - RNA, 21 nt, Human
augaaugcuuaaagaauucaa

SEQ ID NO: 1244972 - RNA, 12 nt, Human
augaauguaaau

SEQ ID NO: 1244973 - RNA, 13 nt, Human
augaauguaaauu

SEQ ID NO: 1244974 - RNA, 15 nt, Human
augaauguaaauuug

SEQ ID NO: 1244975 - RNA, 21 nt, Human
augaauauuuaguguucauaa

SEQ ID NO: 1244976 - RNA, 23 nt, Human
augaauggcuaagcaaaauguga

SEQ ID NO: 1244977 - RNA, 16 nt, Human
augaauuacauuugua

SEQ ID NO: 1244978 - RNA, 17 nt, Human
augaauuacauuuguau

SEQ ID NO: 1244979 - RNA, 22 nt, Human
uuggggaagagagccugcagga

SEQ ID NO: 1244980 - RNA, 23 nt, Human
uuggggaagagagccugcaggau

SEQ ID NO: 1244981 - RNA, 18 nt, Human
uuggggaagggccugccc

SEQ ID NO: 1244982 - RNA, 14 nt, Human
uuggggacacaugu

SEQ ID NO: 1244983 - RNA, 20 nt, Human
uuggggacacauguauuugg

SEQ ID NO: 1244984 - RNA, 21 nt, Human
uuggggaguuaagaccuggca

SEQ ID NO: 1244985 - RNA, 14 nt, Human
uuggugagaaccug

SEQ ID NO: 1244986 - RNA, 17 nt, Human
uuggggaguuaagaccu

SEQ ID NO: 1244987 - RNA, 19 nt, Human
uuggggaguuaagaccugg

SEQ ID NO: 1244988 - RNA, 20 nt, Human
uuggggaguuaagaccuggc

SEQ ID NO: 1244989 - RNA, 16 nt, Human
uuggugauuccgcagu

SEQ ID NO: 1244990 - RNA, 20 nt, Human
uuggugauuccgcagugaga

SEQ ID NO: 1244991 - RNA, 22 nt, Human
uuggugcacagcacaaauuagu

SEQ ID NO: 1244992 - RNA, 16 nt, Human
uuggugcacagcacaa

SEQ ID NO: 1244993 - RNA, 11 nt, Human
uuggagacaga

SEQ ID NO: 1244994 - RNA, 22 nt, Human
uuggagacugucuggccccccu

SEQ ID NO: 1244995 - RNA, 15 nt, Human
uuggagaguuuccug

SEQ ID NO: 1244996 - RNA, 16 nt, Human
uuggagaguuuccuga

SEQ ID NO: 1244997 - RNA, 18 nt, Human
uuggagaguuuccugaaa

SEQ ID NO: 1244998 - RNA, 13 nt, Human
uuggagucacucu

SEQ ID NO: 1244999 - RNA, 23 nt, Human
uuggaguccccucaccuccucua

SEQ ID NO: 1245000 - RNA, 21 nt, Human
uuggagucacucuuaugcugu

SEQ ID NO: 1245001 - RNA, 19 nt, Human
uuggccgcuguaugucuua

SEQ ID NO: 1245002 - RNA, 16 nt, Human
uuggccucucucuagg

SEQ ID NO: 1245003 - RNA, 17 nt, Human
uuggccugaucagacca

SEQ ID NO: 1245004 - RNA, 16 nt, Human
uuggcuauuuaaaacu

SEQ ID NO: 1245005 - RNA, 17 nt, Human
uuggcuauuuaaaacuu

SEQ ID NO: 1245006 - RNA, 14 nt, Human
aucuuuucauacau

SEQ ID NO: 1245007 - RNA, 23 nt, Human
aucuuuugauaugcauauuuguu

SEQ ID NO: 1245008 - RNA, 22 nt, Human
aucuuuuguauuaagaaaggaa

SEQ ID NO: 1245009 - RNA, 18 nt, Human
uuggcucacacucgacau

SEQ ID NO: 1245010 - RNA, 17 nt, Human
uuggcucgaaucucugu

SEQ ID NO: 1245011 - RNA, 20 nt, Human
uuggcucgaaucucugugcc

SEQ ID NO: 1245012 - RNA, 21 nt, Human
uuggcucgaaucucugugccu

SEQ ID NO: 1245013 - RNA, 21 nt, Human
aucuuugaaagguuagagaau

SEQ ID NO: 1245014 - RNA, 22 nt, Human
aucuuugaaagguuagagaaua

SEQ ID NO: 1245015 - RNA, 16 nt, Human
aucuuugaaauuaugu

SEQ ID NO: 1245016 - RNA, 17 nt, Human
aucuuugaaauuaugua

SEQ ID NO: 1245017 - RNA, 19 nt, Human
aucuuugaaauuauguaaa

SEQ ID NO: 1245018 - RNA, 20 nt, Human
aucuuugaaauuauguaaau

SEQ ID NO: 1245019 - RNA, 14 nt, Human
auaauuuuaaaugu

SEQ ID NO: 1245020 - RNA, 14 nt, Human
auaauuuuaaauuc

SEQ ID NO: 1245021 - RNA, 17 nt, Human
auaauuugaauuuuaug

SEQ ID NO: 1245022 - RNA, 21 nt, Human
uuagauguuccaguaaucuaa

SEQ ID NO: 1245023 - RNA, 22 nt, Human
uuagauguuccaguaaucuaau

SEQ ID NO: 1245024 - RNA, 13 nt, Human
uuagauguucuaa

SEQ ID NO: 1245025 - RNA, 20 nt, Human
uuagauguucuaagucuuuc

SEQ ID NO: 1245026 - RNA, 22 nt, Human
uuagauguucuaagucuuucca

SEQ ID NO: 1245027 - RNA, 13 nt, Human
auaauuuuaaaug

SEQ ID NO: 1245028 - RNA, 12 nt, Human
auaauuuuaaau

SEQ ID NO: 1245029 - RNA, 12 nt, Human
auaauuucuaau

SEQ ID NO: 1245030 - RNA, 14 nt, Human
auaauuucuaaugu

SEQ ID NO: 1245031 - RNA, 15 nt, Human
auaauuuuaaacaaa

SEQ ID NO: 1245032 - RNA, 14 nt, Human
auaauuuagauggu

SEQ ID NO: 1245033 - RNA, 20 nt, Human
auaauuuaguuucauauaaa

SEQ ID NO: 1245034 - RNA, 17 nt, Human
auaauuuaguuucauau

SEQ ID NO: 1245035 - RNA, 20 nt, Human
auaauucaggaagcagcuuu

SEQ ID NO: 1245036 - RNA, 22 nt, Human
auaauucacuguacuaucaggu

SEQ ID NO: 1245037 - RNA, 23 nt, Human
auaauucacauuguauucagagu

SEQ ID NO: 1245038 - RNA, 14 nt, Human
auaaucuuucacag

SEQ ID NO: 1245039 - RNA, 21 nt, Human
auaaucuuucacaggggacag

SEQ ID NO: 1245040 - RNA, 20 nt, Human
auaaucuucugccuucucau

SEQ ID NO: 1245041 - RNA, 11 nt, Human
auaagauucua

SEQ ID NO: 1245042 - RNA, 12 nt, Human
auaagauucuaa

SEQ ID NO: 1245043 - RNA, 17 nt, Human
auaagcagguggaucua

SEQ ID NO: 1245044 - RNA, 22 nt, Human
auaagcagguggaucuauuuca

SEQ ID NO: 1245045 - RNA, 14 nt, Human
auaagcaucauuau

SEQ ID NO: 1245046 - RNA, 15 nt, Human
auaagcaucauuauu

SEQ ID NO: 1245047 - RNA, 19 nt, Human
auaagcaucauuauuuaug

SEQ ID NO: 1245048 - RNA, 17 nt, Human
auaagcaucauuauuua

SEQ ID NO: 1245049 - RNA, 14 nt, Human
auaagccagacauc

SEQ ID NO: 1245050 - RNA, 19 nt, Human
auaauauauuuuaaauauu

SEQ ID NO: 1245051 - RNA, 13 nt, Human
auaauauauuuuc

SEQ ID NO: 1245052 - RNA, 17 nt, Human
auaaucuuauaauuguu

SEQ ID NO: 1245053 - RNA, 14 nt, Human
auaaucuucugccu

SEQ ID NO: 1245054 - RNA, 15 nt, Human
auaaucuucugccuu

SEQ ID NO: 1245055 - RNA, 17 nt, Human
auaaucuucugccuucu

SEQ ID NO: 1245056 - RNA, 15 nt, Human
auaauauauuuucug

SEQ ID NO: 1245057 - RNA, 18 nt, Human
auaauauuuuuaauauau

SEQ ID NO: 1245058 - RNA, 14 nt, Human
uuaggguuaugauu

SEQ ID NO: 1245059 - RNA, 16 nt, Human
uuaggguuaugauuaa

SEQ ID NO: 1245060 - RNA, 17 nt, Human
uuagggcaccagggguu

SEQ ID NO: 1245061 - RNA, 19 nt, Human
uuagauuaagaaauagaca

SEQ ID NO: 1245062 - RNA, 15 nt, Human
uuagauuaagaaaua

SEQ ID NO: 1245063 - RNA, 14 nt, Human
uuaguaaucauauu

SEQ ID NO: 1245064 - RNA, 13 nt, Human
uuaguaaucauau

SEQ ID NO: 1245065 - RNA, 19 nt, Human
uuagguucuaaaguucuaa

SEQ ID NO: 1245066 - RNA, 20 nt, Human
uuagguucuaaaguucuaag

SEQ ID NO: 1245067 - RNA, 22 nt, Human
uuagguucuaaaguucuaagau

SEQ ID NO: 1245068 - RNA, 17 nt, Human
uuagguaauuuuuuuca

SEQ ID NO: 1245069 - RNA, 23 nt, Human
uuagguaagaaguuuuaaaaagc

SEQ ID NO: 1245070 - RNA, 14 nt, Human
uuagguuaggacuu

SEQ ID NO: 1245071 - RNA, 12 nt, Human
uuagguucuaaa

SEQ ID NO: 1245072 - RNA, 13 nt, Human
uuagguucuaaag

SEQ ID NO: 1245073 - RNA, 14 nt, Human
uuagguucuaaagu

SEQ ID NO: 1245074 - RNA, 16 nt, Human
uuagguucuaaaguuc

SEQ ID NO: 1245075 - RNA, 18 nt, Human
uuagguucuaaaguucua

SEQ ID NO: 1245076 - RNA, 22 nt, Human
uuauaaaaauaaaaaacacugg

SEQ ID NO: 1245077 - RNA, 21 nt, Human
uuauaaaaauaaaaaacacug

SEQ ID NO: 1245078 - RNA, 15 nt, Human
uuauaaaaaaugguu

SEQ ID NO: 1245079 - RNA, 18 nt, Human
uuauaaaaaaugguucag

SEQ ID NO: 1245080 - RNA, 19 nt, Human
uuauaaaaagguguuuuga

SEQ ID NO: 1245081 - RNA, 17 nt, Human
uuauaaaaaaugguuca

SEQ ID NO: 1245082 - RNA, 16 nt, Human
uuauaaaaguguucau

SEQ ID NO: 1245083 - RNA, 12 nt, Human
uuauaaaagugu

SEQ ID NO: 1245084 - RNA, 19 nt, Human
uuaguacuccccuccuuga

SEQ ID NO: 1245085 - RNA, 17 nt, Human
uuaguaauaccucuaau

SEQ ID NO: 1245086 - RNA, 16 nt, Human
uuaguaauaccucuaa

SEQ ID NO: 1245087 - RNA, 14 nt, Human
uuaguaauaccucu

SEQ ID NO: 1245088 - RNA, 14 nt, Human
uuaguacaaaguuu

SEQ ID NO: 1245089 - RNA, 17 nt, Human
uuaguacaaaguuucaa

SEQ ID NO: 1245090 - RNA, 15 nt, Human
uuauaaaaauaaaaa

SEQ ID NO: 1245091 - RNA, 14 nt, Human
uuauaaaaaauggu

SEQ ID NO: 1245092 - RNA, 17 nt, Human
uuaguagagacaggguu

SEQ ID NO: 1245093 - RNA, 12 nt, Human
auaaaugcaaau

SEQ ID NO: 1245094 - RNA, 14 nt, Human
auaaaugcaaauaa

SEQ ID NO: 1245095 - RNA, 13 nt, Human
auaaaugcaaaua

SEQ ID NO: 1245096 - RNA, 16 nt, Human
auaaaugauucuuagu

SEQ ID NO: 1245097 - RNA, 18 nt, Human
auaaaugauucuuaguga

SEQ ID NO: 1245098 - RNA, 13 nt, Human
auaaauugcuccu

SEQ ID NO: 1245099 - RNA, 16 nt, Human
auaaauugcuccuuga

SEQ ID NO: 1245100 - RNA, 19 nt, Human
auaaauugauuuuuauaaa

SEQ ID NO: 1245101 - RNA, 21 nt, Human
auaaauugcacaccuuggaau

SEQ ID NO: 1245102 - RNA, 13 nt, Human
auaaauugcucaa

SEQ ID NO: 1245103 - RNA, 18 nt, Human
uuaauuuuuccaacuacu

SEQ ID NO: 1245104 - RNA, 13 nt, Human
uuaauuuuuccua

SEQ ID NO: 1245105 - RNA, 12 nt, Human
uuaauuuuugau

SEQ ID NO: 1245106 - RNA, 13 nt, Human
uuaauuuuugaua

SEQ ID NO: 1245107 - RNA, 15 nt, Human
uuaauuuuugauacu

SEQ ID NO: 1245108 - RNA, 16 nt, Human
uuacaaacugaagagu

SEQ ID NO: 1245109 - RNA, 18 nt, Human
uuacaaagcccuuuuaua

SEQ ID NO: 1245110 - RNA, 13 nt, Human
uuacaaacugaag

SEQ ID NO: 1245111 - RNA, 16 nt, Human
uuacaaaucagaaguc

SEQ ID NO: 1245112 - RNA, 17 nt, Human
uuacaaaucagaaguca

SEQ ID NO: 1245113 - RNA, 22 nt, Human
uuacaaaucagaagucaucuug

SEQ ID NO: 1245114 - RNA, 21 nt, Human
uuacaaaugaaaaauuccacu

SEQ ID NO: 1245115 - RNA, 15 nt, Human
auaaaucugacccag

SEQ ID NO: 1245116 - RNA, 16 nt, Human
auaaaucugacccagu

SEQ ID NO: 1245117 - RNA, 18 nt, Human
auaaaucugacccagugc

SEQ ID NO: 1245118 - RNA, 19 nt, Human
auaaaucugacccagugcc

SEQ ID NO: 1245119 - RNA, 17 nt, Human
uuacaguggggaaugaa

SEQ ID NO: 1245120 - RNA, 17 nt, Human
uuacaguaggagcccag

SEQ ID NO: 1245121 - RNA, 14 nt, Human
uuacagugcagugc

SEQ ID NO: 1245122 - RNA, 12 nt, Human
uuacaguguuua

SEQ ID NO: 1245123 - RNA, 11 nt, Human
uuacaguucug

SEQ ID NO: 1245124 - RNA, 12 nt, Human
uuacaguucugu

SEQ ID NO: 1245125 - RNA, 13 nt, Human
uuacaguucugug

SEQ ID NO: 1245126 - RNA, 14 nt, Human
uuacaguucugugg

SEQ ID NO: 1245127 - RNA, 22 nt, Human
uuacaguucugugguuucaugu

SEQ ID NO: 1245128 - RNA, 21 nt, Human
uuaccaggcaccaaaagaagu

SEQ ID NO: 1245129 - RNA, 23 nt, Human
uuaccaggcaccaaaagaaguaa

SEQ ID NO: 1245130 - RNA, 12 nt, Human
auaacuccuccc

SEQ ID NO: 1245131 - RNA, 14 nt, Human
auaacuccucccag

SEQ ID NO: 1245132 - RNA, 16 nt, Human
auaacuccucccaggg

SEQ ID NO: 1245133 - RNA, 18 nt, Human
auaacuccucccaggguu

SEQ ID NO: 1245134 - RNA, 22 nt, Human
auaacuccucccaggguuuuaa

SEQ ID NO: 1245135 - RNA, 18 nt, Human
auaaauugcuccuugaca

SEQ ID NO: 1245136 - RNA, 17 nt, Human
auaaauuguacagccgg

SEQ ID NO: 1245137 - RNA, 15 nt, Human
auaacuauguugaua

SEQ ID NO: 1245138 - RNA, 15 nt, Human
auaacuccucauugu

SEQ ID NO: 1245139 - RNA, 17 nt, Human
auaacuccucauuguaa

SEQ ID NO: 1245140 - RNA, 23 nt, Human
auaacuuuuuuuuuucuuuauaa

SEQ ID NO: 1245141 - RNA, 19 nt, Human
auaagauccuagauccuaa

SEQ ID NO: 1245142 - RNA, 13 nt, Human
auaagaucuuuua

SEQ ID NO: 1245143 - RNA, 15 nt, Human
auaagaucuuuuauu

SEQ ID NO: 1245144 - RNA, 17 nt, Human
auaagaucuuuuauuuu

SEQ ID NO: 1245145 - RNA, 20 nt, Human
auaagaucuuuuauuuugcc

SEQ ID NO: 1245146 - RNA, 13 nt, Human
auaagaaacuuuu

SEQ ID NO: 1245147 - RNA, 14 nt, Human
auaagaaacuuuuu

SEQ ID NO: 1245148 - RNA, 22 nt, Human
auaagaaacuuuuuuauuuaaa

SEQ ID NO: 1245149 - RNA, 21 nt, Human
auaagaaacuuuuuuauuuaa

SEQ ID NO: 1245150 - RNA, 11 nt, Human
auaagaaagcc

SEQ ID NO: 1245151 - RNA, 13 nt, Human
auaagaaagccug

SEQ ID NO: 1245152 - RNA, 14 nt, Human
auaagaaagccuga

SEQ ID NO: 1245153 - RNA, 15 nt, Human
auaagaaagccugag

SEQ ID NO: 1245154 - RNA, 18 nt, Human
auaagauauuuuucauga

SEQ ID NO: 1245155 - RNA, 17 nt, Human
uuacugucuuuuuucua

SEQ ID NO: 1245156 - RNA, 20 nt, Human
uuacuggccuuuuucauuua

SEQ ID NO: 1245157 - RNA, 23 nt, Human
uuagaaucaaacauuuugaaagu

SEQ ID NO: 1245158 - RNA, 19 nt, Human
uuagaauauuaucuucaua

SEQ ID NO: 1245159 - RNA, 17 nt, Human
uuagaaucaaacauuuu

SEQ ID NO: 1245160 - RNA, 18 nt, Human
uuagaaucaaacauuuug

SEQ ID NO: 1245161 - RNA, 20 nt, Human
uuagaaucaaacauuuugaa

SEQ ID NO: 1245162 - RNA, 12 nt, Human
uuagaauuauuu

SEQ ID NO: 1245163 - RNA, 13 nt, Human
uuagaauuauuua

SEQ ID NO: 1245164 - RNA, 15 nt, Human
uuagaauuauuuaaa

SEQ ID NO: 1245165 - RNA, 16 nt, Human
uuagaauuauuuaaac

SEQ ID NO: 1245166 - RNA, 20 nt, Human
uuacugcuuaauucaaauaa

SEQ ID NO: 1245167 - RNA, 14 nt, Human
uuacugcucugaga

SEQ ID NO: 1245168 - RNA, 15 nt, Human
uuacugcucugagaa

SEQ ID NO: 1245169 - RNA, 13 nt, Human
uuacuggccuuuu

SEQ ID NO: 1245170 - RNA, 16 nt, Human
uuacuggccuuuuuca

SEQ ID NO: 1245171 - RNA, 18 nt, Human
uuacuggccuuuuucauu

SEQ ID NO: 1245172 - RNA, 23 nt, Human
uuacuguacagacagaaaaaacu

SEQ ID NO: 1245173 - RNA, 19 nt, Human
uuacuccugugggagccuc

SEQ ID NO: 1245174 - RNA, 12 nt, Human
uuacucuaagau

SEQ ID NO: 1245175 - RNA, 14 nt, Human
uuacucuaagaucu

SEQ ID NO: 1245176 - RNA, 19 nt, Human
uuacucuaagaucuuagau

SEQ ID NO: 1245177 - RNA, 21 nt, Human
uuacucuaagaucuuagauuc

SEQ ID NO: 1245178 - RNA, 22 nt, Human
uuacucuaagaucuuagauucu

SEQ ID NO: 1245179 - RNA, 24 nt, Human
uuacuccaaaacuucguuuaauga

SEQ ID NO: 1245180 - RNA, 16 nt, Human
uuacucaguaauuugu

SEQ ID NO: 1245181 - RNA, 21 nt, Human
uuaccaguauuuaacuucuga

SEQ ID NO: 1245182 - RNA, 18 nt, Human
uuaccagugccuuaaacu

SEQ ID NO: 1245183 - RNA, 19 nt, Human
uuaccaguugccuuuuauc

SEQ ID NO: 1245184 - RNA, 14 nt, Human
uuaccaguugccuu

SEQ ID NO: 1245185 - RNA, 14 nt, Human
uuaccauguaaugg

SEQ ID NO: 1245186 - RNA, 17 nt, Human
uuaaucuuuaauuuuac

SEQ ID NO: 1245187 - RNA, 17 nt, Human
uuaaucuuugaaagguu

SEQ ID NO: 1245188 - RNA, 13 nt, Human
uuaaucuuuaauu

SEQ ID NO: 1245189 - RNA, 19 nt, Human
uuaaucuuaguguaugauu

SEQ ID NO: 1245190 - RNA, 21 nt, Human
uuaaucuuaguguaugauuac

SEQ ID NO: 1245191 - RNA, 14 nt, Human
uuaauuuauuauua

SEQ ID NO: 1245192 - RNA, 14 nt, Human
uuaauuuaugcaga

SEQ ID NO: 1245193 - RNA, 13 nt, Human
uuaauuugaaaua

SEQ ID NO: 1245194 - RNA, 15 nt, Human
uuaauuugaaauaug

SEQ ID NO: 1245195 - RNA, 18 nt, Human
uuaauuuuuauuucuucc

SEQ ID NO: 1245196 - RNA, 13 nt, Human
uuaauuuuuccaa

SEQ ID NO: 1245197 - RNA, 15 nt, Human
uuaauuuuuccaacu

SEQ ID NO: 1245198 - RNA, 20 nt, Human
uuaauuuugaagugcuguuu

SEQ ID NO: 1245199 - RNA, 23 nt, Human
uuaauuuugaagugcuguuuauu

SEQ ID NO: 1245200 - RNA, 15 nt, Human
uuaauuuuaguuuuu

SEQ ID NO: 1245201 - RNA, 17 nt, Human
uuaauuuuaguuuuuca

SEQ ID NO: 1245202 - RNA, 21 nt, Human
uuaauuuuaguuuuucauuaa

SEQ ID NO: 1245203 - RNA, 23 nt, Human
uuaauuuuauuuuuuauaaaaua

SEQ ID NO: 1245204 - RNA, 13 nt, Human
uuaauuuuccugg

SEQ ID NO: 1245205 - RNA, 19 nt, Human
uuaauuuugaagugcuguu

SEQ ID NO: 1245206 - RNA, 16 nt, Human
uuaauuugguuuucac

SEQ ID NO: 1245207 - RNA, 22 nt, Human
uuaagacgaaacauuuguucua

SEQ ID NO: 1245208 - RNA, 22 nt, Human
uuaagagagucuauuuacggaa

SEQ ID NO: 1245209 - RNA, 22 nt, Human
uuaagaccuacuguucuaaagc

SEQ ID NO: 1245210 - RNA, 17 nt, Human
uuaagacuugacagugg

SEQ ID NO: 1245211 - RNA, 13 nt, Human
uuaagacuugaca

SEQ ID NO: 1245212 - RNA, 17 nt, Human
uuaaguuucucugcaga

SEQ ID NO: 1245213 - RNA, 14 nt, Human
uuaauaaaaauaau

SEQ ID NO: 1245214 - RNA, 11 nt, Human
uuaauaaaaga

SEQ ID NO: 1245215 - RNA, 12 nt, Human
uuaauaaaagaa

SEQ ID NO: 1245216 - RNA, 14 nt, Human
uuaauaaaagaaaa

SEQ ID NO: 1245217 - RNA, 20 nt, Human
uuaauaaaagaaaauuacaa

SEQ ID NO: 1245218 - RNA, 20 nt, Human
uuaauccgccaauauuagua

SEQ ID NO: 1245219 - RNA, 12 nt, Human
uuaauccaaugg

SEQ ID NO: 1245220 - RNA, 19 nt, Human
uuaaucauauaaauagaau

SEQ ID NO: 1245221 - RNA, 17 nt, Human
uuaaucauauaaauaga

SEQ ID NO: 1245222 - RNA, 16 nt, Human
uuaaucauauaaauag

SEQ ID NO: 1245223 - RNA, 15 nt, Human
uuaaucauauaaaua

SEQ ID NO: 1245224 - RNA, 15 nt, Human
uuaaucaucaagaga

SEQ ID NO: 1245225 - RNA, 16 nt, Human
uuaaucaucaagagaa

SEQ ID NO: 1245226 - RNA, 17 nt, Human
uuaaucaucaagagaau

SEQ ID NO: 1245227 - RNA, 13 nt, Human
uuaaucauauaaa

SEQ ID NO: 1245228 - RNA, 17 nt, Human
uuaaucagauagauauu

SEQ ID NO: 1245229 - RNA, 22 nt, Human
uuaaucaguucauuagaaauau

SEQ ID NO: 1245230 - RNA, 20 nt, Human
uuaaucagguccucagagaa

SEQ ID NO: 1245231 - RNA, 17 nt, Human
uuaauaaaagaaaauua

SEQ ID NO: 1245232 - RNA, 15 nt, Human
aguuuuuuuuauaca

SEQ ID NO: 1245233 - RNA, 21 nt, Human
aguuuuuugaaauuaugugac

SEQ ID NO: 1245234 - RNA, 20 nt, Human
aguuuuuucuuccuuuucac

SEQ ID NO: 1245235 - RNA, 23 nt, Human
aguuuuuucuuccuuuucacugc

SEQ ID NO: 1245236 - RNA, 22 nt, Human
aguuuuuugaaaaugggcucaa

SEQ ID NO: 1245237 - RNA, 23 nt, Human
aguuuuuucaucuucaguugucu

SEQ ID NO: 1245238 - RNA, 20 nt, Human
aguuuuuucaucuucaguug

SEQ ID NO: 1245239 - RNA, 21 nt, Human
aguuuuuuacuuuuguuuauu

SEQ ID NO: 1245240 - RNA, 17 nt, Human
aguuuuuuauuaugcau

SEQ ID NO: 1245241 - RNA, 12 nt, Human
aguuuuuucauc

SEQ ID NO: 1245242 - RNA, 13 nt, Human
aguuuuuucaucu

SEQ ID NO: 1245243 - RNA, 14 nt, Human
aguuuuuucaucuu

SEQ ID NO: 1245244 - RNA, 15 nt, Human
aguuuuuaaacauca

SEQ ID NO: 1245245 - RNA, 9 nt, Human
aguuuuuca

SEQ ID NO: 1245246 - RNA, 18 nt, Human
aguuuuucauuaaauaaa

SEQ ID NO: 1245247 - RNA, 20 nt, Human
aguuuuucauuaaauaaauu

SEQ ID NO: 1245248 - RNA, 22 nt, Human
aguuuuucauuaaauaaauuug

SEQ ID NO: 1245249 - RNA, 19 nt, Human
aguuuuguguuuguuguag

SEQ ID NO: 1245250 - RNA, 21 nt, Human
aguuuuguguuuguuguagau

SEQ ID NO: 1245251 - RNA, 22 nt, Human
aguuuuguguuuguuguagauu

SEQ ID NO: 1245252 - RNA, 12 nt, Human
aguuuuaucauu

SEQ ID NO: 1245253 - RNA, 13 nt, Human
aguuuuaucauuu

SEQ ID NO: 1245254 - RNA, 14 nt, Human
aguuuuaucauuuu

SEQ ID NO: 1245255 - RNA, 12 nt, Human
aguuuuguguuu

SEQ ID NO: 1245256 - RNA, 16 nt, Human
aguuuuguguuuguug

SEQ ID NO: 1245257 - RNA, 16 nt, Human
aguuuuauaugcuucu

SEQ ID NO: 1245258 - RNA, 14 nt, Human
aguuuuauauauua

SEQ ID NO: 1245259 - RNA, 16 nt, Human
aguuuuauauauuaua

SEQ ID NO: 1245260 - RNA, 20 nt, Human
aguuuuauauauuauaugga

SEQ ID NO: 1245261 - RNA, 21 nt, Human
aguuuuauauauuauauggaa

SEQ ID NO: 1245262 - RNA, 19 nt, Human
aguuuuacuuuuaaacugu

SEQ ID NO: 1245263 - RNA, 20 nt, Human
aguuuuacuuuuaaacugug

SEQ ID NO: 1245264 - RNA, 12 nt, Human
aguuuuauauau

SEQ ID NO: 1245265 - RNA, 13 nt, Human
aguuuuauauauu

SEQ ID NO: 1245266 - RNA, 20 nt, Human
auaaaagccuguuuaagaga

SEQ ID NO: 1245267 - RNA, 19 nt, Human
aguuuuuuuuuucuugucu

SEQ ID NO: 1245268 - RNA, 15 nt, Human
auaaaaggaagccaa

SEQ ID NO: 1245269 - RNA, 17 nt, Human
auaaaaggaagccaaag

SEQ ID NO: 1245270 - RNA, 23 nt, Human
aguuuuuugaaauuaugugacau

SEQ ID NO: 1245271 - RNA, 18 nt, Human
aguuuuuuuuuucuuguc

SEQ ID NO: 1245272 - RNA, 15 nt, Human
aguuuuuuguaccaa

SEQ ID NO: 1245273 - RNA, 22 nt, Human
aguuuuuuuuuucuugucuaua

SEQ ID NO: 1245274 - RNA, 22 nt, Human
auaaaagggacugagaaauuua

SEQ ID NO: 1245275 - RNA, 19 nt, Human
auaaaaggaagccaaagag

SEQ ID NO: 1245276 - RNA, 20 nt, Human
auaaaaggaagccaaagagu

SEQ ID NO: 1245277 - RNA, 19 nt, Human
uuaagacgaaacauuuguu

SEQ ID NO: 1245278 - RNA, 20 nt, Human
uuaagaccuacuguucuaaa

SEQ ID NO: 1245279 - RNA, 21 nt, Human
uuaagaccuacuguucuaaag

SEQ ID NO: 1245280 - RNA, 11 nt, Human
uuaagaccugg

SEQ ID NO: 1245281 - RNA, 14 nt, Human
uuaagaccuggcag

SEQ ID NO: 1245282 - RNA, 18 nt, Human
uuaagaccuggcagcucu

SEQ ID NO: 1245283 - RNA, 18 nt, Human
uuaagacauuuuuggaag

SEQ ID NO: 1245284 - RNA, 15 nt, Human
uuaagaaugaucuga

SEQ ID NO: 1245285 - RNA, 16 nt, Human
uuaagacaugauuucc

SEQ ID NO: 1245286 - RNA, 23 nt, Human
uuaagacauuuuuggaaggggac

SEQ ID NO: 1245287 - RNA, 18 nt, Human
uuaagacaugauuuccuu

SEQ ID NO: 1245288 - RNA, 18 nt, Human
uuaagaccuacuguucua

SEQ ID NO: 1245289 - RNA, 18 nt, Human
uuaagaaggcaaaaaugu

SEQ ID NO: 1245290 - RNA, 10 nt, Human
uuaagaauau

SEQ ID NO: 1245291 - RNA, 20 nt, Human
uuaagaauaucuguaauggu

SEQ ID NO: 1245292 - RNA, 19 nt, Human
uuaagaaugaucugauuga

SEQ ID NO: 1245293 - RNA, 19 nt, Human
uuaagaauugaguaauggu

SEQ ID NO: 1245294 - RNA, 20 nt, Human
uuaagacacugaaaaaucua

SEQ ID NO: 1245295 - RNA, 20 nt, Human
aguuuaaauuguaauaggcg

SEQ ID NO: 1245296 - RNA, 17 nt, Human
aguuuaaauuguaauag

SEQ ID NO: 1245297 - RNA, 15 nt, Human
aguuagcuuuaacuu

SEQ ID NO: 1245298 - RNA, 20 nt, Human
aguuagcuuuaacuuaaaua

SEQ ID NO: 1245299 - RNA, 22 nt, Human
aguuagcuuuaacuuaaauagu

SEQ ID NO: 1245300 - RNA, 21 nt, Human
aguuagcuuuaacuuaaauag

SEQ ID NO: 1245301 - RNA, 20 nt, Human
aguuuaccaguugccuuuua

SEQ ID NO: 1245302 - RNA, 15 nt, Human
aguuuagcuggaaaa

SEQ ID NO: 1245303 - RNA, 14 nt, Human
aguuuaccuuguau

SEQ ID NO: 1245304 - RNA, 20 nt, Human
aguuuaccuuguauacugua

SEQ ID NO: 1245305 - RNA, 16 nt, Human
aguuuagcuggaaaag

SEQ ID NO: 1245306 - RNA, 14 nt, Human
aguuuagcucugag

SEQ ID NO: 1245307 - RNA, 12 nt, Human
uuaaaaaagaua

SEQ ID NO: 1245308 - RNA, 13 nt, Human
uuaaaaaagauaa

SEQ ID NO: 1245309 - RNA, 15 nt, Human
uuaaaaaagauaaac

SEQ ID NO: 1245310 - RNA, 17 nt, Human
uuaaaaaagauaaacac

SEQ ID NO: 1245311 - RNA, 18 nt, Human
uuaaaaaagauaaacaca

SEQ ID NO: 1245312 - RNA, 21 nt, Human
uuaaaaaagauaaacacaaga

SEQ ID NO: 1245313 - RNA, 21 nt, Human
uuaaaaaagcuuaaaacuuug

SEQ ID NO: 1245314 - RNA, 12 nt, Human
uuaaaaaagcuu

SEQ ID NO: 1245315 - RNA, 19 nt, Human
uuaaaaaagcuuaaaacuu

SEQ ID NO: 1245316 - RNA, 17 nt, Human
uuaaaccaucucccugg

SEQ ID NO: 1245317 - RNA, 18 nt, Human
uuaaaccaucucccuggu

SEQ ID NO: 1245318 - RNA, 21 nt, Human
uuaaaccaucucccuggugcu

SEQ ID NO: 1245319 - RNA, 22 nt, Human
uuaaaccaucucccuggugcuu

SEQ ID NO: 1245320 - RNA, 17 nt, Human
uuaaaauguaugcaugu

SEQ ID NO: 1245321 - RNA, 14 nt, Human
uuaaaccaucuccc

SEQ ID NO: 1245322 - RNA, 15 nt, Human
uuaaaccaucucccu

SEQ ID NO: 1245323 - RNA, 17 nt, Human
uuaaaauguaagauuau

SEQ ID NO: 1245324 - RNA, 24 nt, Human
uuaaaauguaagauuauagauucu

SEQ ID NO: 1245325 - RNA, 14 nt, Human
uuaaaauguaugca

SEQ ID NO: 1245326 - RNA, 19 nt, Human
uuaaaauguaugcauguug

SEQ ID NO: 1245327 - RNA, 19 nt, Human
uuaaaaugagaaaucuaaa

SEQ ID NO: 1245328 - RNA, 12 nt, Human
uuaaaaugagaa

SEQ ID NO: 1245329 - RNA, 16 nt, Human
uuaaaauguaaagcca

SEQ ID NO: 1245330 - RNA, 17 nt, Human
uuaaaauguaaagccau

SEQ ID NO: 1245331 - RNA, 20 nt, Human
uuaaaaaugguuuaaauggu

SEQ ID NO: 1245332 - RNA, 12 nt, Human
uuaaaauccuca

SEQ ID NO: 1245333 - RNA, 13 nt, Human
uuaaaauccucaa

SEQ ID NO: 1245334 - RNA, 23 nt, Human
uuaaaccaucucccuggugcuua

SEQ ID NO: 1245335 - RNA, 23 nt, Human
uuaaaguuaguaucuuuugauau

SEQ ID NO: 1245336 - RNA, 14 nt, Human
uuaaaguucaaacu

SEQ ID NO: 1245337 - RNA, 15 nt, Human
uuaaaguucaaacuc

SEQ ID NO: 1245338 - RNA, 15 nt, Human
uuaaaguuguuugug

SEQ ID NO: 1245339 - RNA, 17 nt, Human
uuaaauuuuuuuuacau

SEQ ID NO: 1245340 - RNA, 16 nt, Human
uuaaauuuuuuuuaca

SEQ ID NO: 1245341 - RNA, 15 nt, Human
aguuuauauuuaacu

SEQ ID NO: 1245342 - RNA, 16 nt, Human
aguuuauauuuaacuc

SEQ ID NO: 1245343 - RNA, 18 nt, Human
aguuuauauuuaacucuc

SEQ ID NO: 1245344 - RNA, 18 nt, Human
aguuuaucaguaaauaac

SEQ ID NO: 1245345 - RNA, 19 nt, Human
aguuuaucaguaaauaacu

SEQ ID NO: 1245346 - RNA, 14 nt, Human
aguuuaucauucaa

SEQ ID NO: 1245347 - RNA, 15 nt, Human
aguuuaucauucaag

SEQ ID NO: 1245348 - RNA, 16 nt, Human
aguuuaucauucaagu

SEQ ID NO: 1245349 - RNA, 17 nt, Human
aguuuaucauucaagug

SEQ ID NO: 1245350 - RNA, 18 nt, Human
uuaaauuuuuuguugaca

SEQ ID NO: 1245351 - RNA, 16 nt, Human
uuaaauuuuuuguuga

SEQ ID NO: 1245352 - RNA, 15 nt, Human
aguuuguugaaacac

SEQ ID NO: 1245353 - RNA, 13 nt, Human
aguuuguuuuugc

SEQ ID NO: 1245354 - RNA, 22 nt, Human
aguuuuaaaaagccaguuuggg

SEQ ID NO: 1245355 - RNA, 13 nt, Human
aguuuuaacugug

SEQ ID NO: 1245356 - RNA, 18 nt, Human
aguuuuaacuguggauau

SEQ ID NO: 1245357 - RNA, 14 nt, Human
aguuugugugucuu

SEQ ID NO: 1245358 - RNA, 15 nt, Human
aguuugugugucuua

SEQ ID NO: 1245359 - RNA, 16 nt, Human
aguuugugugucuuaa

SEQ ID NO: 1245360 - RNA, 22 nt, Human
aguuugugugucuuaauuauua

SEQ ID NO: 1245361 - RNA, 14 nt, Human
aguuuguguguugu

SEQ ID NO: 1245362 - RNA, 21 nt, Human
aguuuguguguugucucuuga

SEQ ID NO: 1245363 - RNA, 13 nt, Human
aguuucucagcuc

SEQ ID NO: 1245364 - RNA, 15 nt, Human
aguuucucagcuccc

SEQ ID NO: 1245365 - RNA, 23 nt, Human
aguuucucugcagaaacuacuga

SEQ ID NO: 1245366 - RNA, 14 nt, Human
aguuucugaguuuu

SEQ ID NO: 1245367 - RNA, 17 nt, Human
aguuucugaguuuuacc

SEQ ID NO: 1245368 - RNA, 18 nt, Human
aguuucugaguuuuacca

SEQ ID NO: 1245369 - RNA, 19 nt, Human
aguuucugaguuuuaccaa

SEQ ID NO: 1245370 - RNA, 20 nt, Human
aguuucugaguuuuaccaaa

SEQ ID NO: 1245371 - RNA, 13 nt, Human
aguuuauuuguug

SEQ ID NO: 1245372 - RNA, 16 nt, Human
aguuuauuuguugaga

SEQ ID NO: 1245373 - RNA, 18 nt, Human
aguuucuaaacuggagac

SEQ ID NO: 1245374 - RNA, 19 nt, Human
aguuucuaaacuggagacu

SEQ ID NO: 1245375 - RNA, 20 nt, Human
aguuucuaaacuggagacug

SEQ ID NO: 1245376 - RNA, 14 nt, Human
aguuucuaagauuc

SEQ ID NO: 1245377 - RNA, 15 nt, Human
aguuucuaagauucu

SEQ ID NO: 1245378 - RNA, 16 nt, Human
aguuucuaagauucua

SEQ ID NO: 1245379 - RNA, 17 nt, Human
aguuucuaagauucuaa

SEQ ID NO: 1245380 - RNA, 18 nt, Human
aguuucuaagauucuaaa

SEQ ID NO: 1245381 - RNA, 19 nt, Human
aguuucuaagauucuaaag

SEQ ID NO: 1245382 - RNA, 20 nt, Human
aguuucuaagauucuaaagg

SEQ ID NO: 1245383 - RNA, 11 nt, Human
aguuucuaagg

SEQ ID NO: 1245384 - RNA, 12 nt, Human
aguuucuaaggu

SEQ ID NO: 1245385 - RNA, 23 nt, Human
aguuucuaagguccgguguucua

SEQ ID NO: 1245386 - RNA, 12 nt, Human
auagauucuaaa

SEQ ID NO: 1245387 - RNA, 13 nt, Human
auagauucuaaag

SEQ ID NO: 1245388 - RNA, 14 nt, Human
auagauucuaaaga

SEQ ID NO: 1245389 - RNA, 15 nt, Human
auagauucuaaagau

SEQ ID NO: 1245390 - RNA, 16 nt, Human
auagauucuaaagauu

SEQ ID NO: 1245391 - RNA, 19 nt, Human
auagauucucuuguauaag

SEQ ID NO: 1245392 - RNA, 18 nt, Human
auagauucuaaagauucu

SEQ ID NO: 1245393 - RNA, 14 nt, Human
auagauuguccuuu

SEQ ID NO: 1245394 - RNA, 20 nt, Human
auagauuguccuuuugcaaa

SEQ ID NO: 1245395 - RNA, 21 nt, Human
auagauuguccuuuugcaaag

SEQ ID NO: 1245396 - RNA, 14 nt, Human
auagaugucuuuuc

SEQ ID NO: 1245397 - RNA, 17 nt, Human
auagaugucuuuuccca

SEQ ID NO: 1245398 - RNA, 12 nt, Human
auagauguuuga

SEQ ID NO: 1245399 - RNA, 13 nt, Human
auagaugucuuuu

SEQ ID NO: 1245400 - RNA, 23 nt, Human
auagaugcuggcccagggcccag

SEQ ID NO: 1245401 - RNA, 22 nt, Human
auagaugggggaaagcaaagca

SEQ ID NO: 1245402 - RNA, 14 nt, Human
auagaguguuauca

SEQ ID NO: 1245403 - RNA, 20 nt, Human
auagauaagaguagaaacug

SEQ ID NO: 1245404 - RNA, 21 nt, Human
auagauaaaacaucuuugaaa

SEQ ID NO: 1245405 - RNA, 20 nt, Human
auagauaaaacaucuuugaa

SEQ ID NO: 1245406 - RNA, 21 nt, Human
auagauacccuacgcugucca

SEQ ID NO: 1245407 - RNA, 15 nt, Human
auagaugcuggccca

SEQ ID NO: 1245408 - RNA, 16 nt, Human
auagaugcuggcccag

SEQ ID NO: 1245409 - RNA, 17 nt, Human
auagaugcuggcccagg

SEQ ID NO: 1245410 - RNA, 20 nt, Human
auagaugcuggcccagggcc

SEQ ID NO: 1245411 - RNA, 22 nt, Human
auagagcuagcuaaucucuaca

SEQ ID NO: 1245412 - RNA, 13 nt, Human
auagagcuguauu

SEQ ID NO: 1245413 - RNA, 22 nt, Human
auagaggauggucuuacagcag

SEQ ID NO: 1245414 - RNA, 18 nt, Human
auagauaggucagugcaa

SEQ ID NO: 1245415 - RNA, 14 nt, Human
auagagacgggacu

SEQ ID NO: 1245416 - RNA, 16 nt, Human
auagagacuugggaau

SEQ ID NO: 1245417 - RNA, 18 nt, Human
auagacccacaagaggca

SEQ ID NO: 1245418 - RNA, 17 nt, Human
auagaccuuuucauuug

SEQ ID NO: 1245419 - RNA, 15 nt, Human
auagacuuaaaucuc

SEQ ID NO: 1245420 - RNA, 19 nt, Human
auagagccgggugucccca

SEQ ID NO: 1245421 - RNA, 20 nt, Human
auagagccggguguccccaa

SEQ ID NO: 1245422 - RNA, 13 nt, Human
auagagccugagg

SEQ ID NO: 1245423 - RNA, 15 nt, Human
auagagccugaggga

SEQ ID NO: 1245424 - RNA, 14 nt, Human
auagagcuguauua

SEQ ID NO: 1245425 - RNA, 14 nt, Human
auagaacaaggcug

SEQ ID NO: 1245426 - RNA, 16 nt, Human
auacuguaguauucuu

SEQ ID NO: 1245427 - RNA, 19 nt, Human
auacuguauauucaggacu

SEQ ID NO: 1245428 - RNA, 19 nt, Human
auacuguauuuuguauugu

SEQ ID NO: 1245429 - RNA, 13 nt, Human
auagaaguaaaaa

SEQ ID NO: 1245430 - RNA, 18 nt, Human
auagaaguauaaagaauu

SEQ ID NO: 1245431 - RNA, 13 nt, Human
auagaaggugaug

SEQ ID NO: 1245432 - RNA, 14 nt, Human
auagaaguuuagau

SEQ ID NO: 1245433 - RNA, 18 nt, Human
auagaacucugaaaugaa

SEQ ID NO: 1245434 - RNA, 14 nt, Human
auagaacugaauga

SEQ ID NO: 1245435 - RNA, 18 nt, Human
auagaacuggauuuucag

SEQ ID NO: 1245436 - RNA, 22 nt, Human
auagaauaaaauuuuuaaucuu

SEQ ID NO: 1245437 - RNA, 12 nt, Human
auagaauaaagg

SEQ ID NO: 1245438 - RNA, 17 nt, Human
auagaauaaaggcaguu

SEQ ID NO: 1245439 - RNA, 18 nt, Human
auagaauaaaggcaguuu

SEQ ID NO: 1245440 - RNA, 19 nt, Human
auagaauaaaggcaguuuu

SEQ ID NO: 1245441 - RNA, 19 nt, Human
auagaauaaaauuuuuaau

SEQ ID NO: 1245442 - RNA, 14 nt, Human
auagaauaaaauuu

SEQ ID NO: 1245443 - RNA, 17 nt, Human
auagaauuaacacauga

SEQ ID NO: 1245444 - RNA, 17 nt, Human
auagaauguaaaugucu

SEQ ID NO: 1245445 - RNA, 15 nt, Human
auagaauguaaaugu

SEQ ID NO: 1245446 - RNA, 14 nt, Human
auagaauguaaaug

SEQ ID NO: 1245447 - RNA, 13 nt, Human
auagaaugacagu

SEQ ID NO: 1245448 - RNA, 18 nt, Human
auagaaugguaucaauaa

SEQ ID NO: 1245449 - RNA, 20 nt, Human
auagaauaaaggcaguuuuc

SEQ ID NO: 1245450 - RNA, 22 nt, Human
auagaauaaaggcaguuuucua

SEQ ID NO: 1245451 - RNA, 12 nt, Human
auagacacgcac

SEQ ID NO: 1245452 - RNA, 22 nt, Human
auagacacuccccgaagucuuu

SEQ ID NO: 1245453 - RNA, 21 nt, Human
auagacaauugagguaaguuu

SEQ ID NO: 1245454 - RNA, 19 nt, Human
auagacaaauagaaaaugg

SEQ ID NO: 1245455 - RNA, 13 nt, Human
auagacagaagaa

SEQ ID NO: 1245456 - RNA, 14 nt, Human
auagacagaagaaa

SEQ ID NO: 1245457 - RNA, 16 nt, Human
auagacagaagaaaca

SEQ ID NO: 1245458 - RNA, 17 nt, Human
auagacagaagaaacaa

SEQ ID NO: 1245459 - RNA, 19 nt, Human
auagacagaagaaacaagg

SEQ ID NO: 1245460 - RNA, 15 nt, Human
auagacagcaugaga

SEQ ID NO: 1245461 - RNA, 18 nt, Human
auagacagaagaaacaag

SEQ ID NO: 1245462 - RNA, 14 nt, Human
auagacaauugagg

SEQ ID NO: 1245463 - RNA, 16 nt, Human
auagacaaauagaaaa

SEQ ID NO: 1245464 - RNA, 17 nt, Human
auagacaaauagaaaau

SEQ ID NO: 1245465 - RNA, 20 nt, Human
auagaauguaaaugucucac

SEQ ID NO: 1245466 - RNA, 19 nt, Human
auagaauguaaaugucuca

SEQ ID NO: 1245467 - RNA, 22 nt, Human
auagaauuauaacuggaaagaa

SEQ ID NO: 1245468 - RNA, 13 nt, Human
auacuggcacaga

SEQ ID NO: 1245469 - RNA, 15 nt, Human
auacuggcacagagg

SEQ ID NO: 1245470 - RNA, 14 nt, Human
auacuggccuggac

SEQ ID NO: 1245471 - RNA, 15 nt, Human
auacuggccuggacu

SEQ ID NO: 1245472 - RNA, 19 nt, Human
auacugcgacuuucugccu

SEQ ID NO: 1245473 - RNA, 20 nt, Human
auacugcgacuuucugccug

SEQ ID NO: 1245474 - RNA, 22 nt, Human
auacugcgacuuucugccugga

SEQ ID NO: 1245475 - RNA, 15 nt, Human
auacugcuacagcaa

SEQ ID NO: 1245476 - RNA, 19 nt, Human
auacugcuacagcaauuuc

SEQ ID NO: 1245477 - RNA, 22 nt, Human
auacugcuacagcaauuucuaa

SEQ ID NO: 1245478 - RNA, 12 nt, Human
auacugcugaga

SEQ ID NO: 1245479 - RNA, 18 nt, Human
auacugcugagauacaua

SEQ ID NO: 1245480 - RNA, 19 nt, Human
auacugcugagauacauac

SEQ ID NO: 1245481 - RNA, 21 nt, Human
auacugcugagauacauacag

SEQ ID NO: 1245482 - RNA, 10 nt, Human
auacugcuug

SEQ ID NO: 1245483 - RNA, 22 nt, Human
auacugcugagauacauacaga

SEQ ID NO: 1245484 - RNA, 15 nt, Human
auacugcuuggagcu

SEQ ID NO: 1245485 - RNA, 20 nt, Human
auacugcuuggagcugagca

SEQ ID NO: 1245486 - RNA, 21 nt, Human
auacugcuuggagcugagcaa

SEQ ID NO: 1245487 - RNA, 14 nt, Human
auacuggaaagcuu

SEQ ID NO: 1245488 - RNA, 17 nt, Human
auacugccacuaaccuu

SEQ ID NO: 1245489 - RNA, 15 nt, Human
auacugcauacuuuu

SEQ ID NO: 1245490 - RNA, 21 nt, Human
auacugcauacuuuuuaaaug

SEQ ID NO: 1245491 - RNA, 17 nt, Human
auacugagaaaaccugu

SEQ ID NO: 1245492 - RNA, 14 nt, Human
auacucuuucugua

SEQ ID NO: 1245493 - RNA, 15 nt, Human
auacucuuucuguau

SEQ ID NO: 1245494 - RNA, 16 nt, Human
auacucuuucuguaua

SEQ ID NO: 1245495 - RNA, 17 nt, Human
auacucuuucuguauau

SEQ ID NO: 1245496 - RNA, 22 nt, Human
auacucuuucuguauauacuuu

SEQ ID NO: 1245497 - RNA, 23 nt, Human
auacucuuucuguauauacuuuu

SEQ ID NO: 1245498 - RNA, 15 nt, Human
auacugaacaucuga

SEQ ID NO: 1245499 - RNA, 20 nt, Human
auacugaacaucugaguccu

SEQ ID NO: 1245500 - RNA, 23 nt, Human
auacugaacaucugaguccugga

SEQ ID NO: 1245501 - RNA, 22 nt, Human
auacugaacaucugaguccugg

SEQ ID NO: 1245502 - RNA, 14 nt, Human
auacucuuauaucu

SEQ ID NO: 1245503 - RNA, 18 nt, Human
auacucuuauaucuauau

SEQ ID NO: 1245504 - RNA, 18 nt, Human
auacucuuauagacaaca

SEQ ID NO: 1245505 - RNA, 20 nt, Human
auacucucaccauuuggauc

SEQ ID NO: 1245506 - RNA, 17 nt, Human
auacucauuuuucauga

SEQ ID NO: 1245507 - RNA, 17 nt, Human
auacucuagaugaaguu

SEQ ID NO: 1245508 - RNA, 23 nt, Human
auacucuagaugaaguuuuacau

SEQ ID NO: 1245509 - RNA, 16 nt, Human
auacucauuaggaugg

SEQ ID NO: 1245510 - RNA, 16 nt, Human
uuauuccuccugcuca

SEQ ID NO: 1245511 - RNA, 20 nt, Human
uuauuccuccugcucauauu

SEQ ID NO: 1245512 - RNA, 18 nt, Human
uuauucccuuccugccag

SEQ ID NO: 1245513 - RNA, 17 nt, Human
uuauuccagaaugcugu

SEQ ID NO: 1245514 - RNA, 20 nt, Human
uuauuccagaaugcuguaca

SEQ ID NO: 1245515 - RNA, 22 nt, Human
uuauuccagaaugcuguacauc

SEQ ID NO: 1245516 - RNA, 13 nt, Human
uuauuccaugacu

SEQ ID NO: 1245517 - RNA, 16 nt, Human
uuauuccaugacugcu

SEQ ID NO: 1245518 - RNA, 23 nt, Human
uuauuccaugacugcuugcccua

SEQ ID NO: 1245519 - RNA, 20 nt, Human
uuauuccccauucuuccuag

SEQ ID NO: 1245520 - RNA, 13 nt, Human
uuauucccuuccu

SEQ ID NO: 1245521 - RNA, 23 nt, Human
uuauucccuuccugccagccccu

SEQ ID NO: 1245522 - RNA, 16 nt, Human
uuauuaguauuguugu

SEQ ID NO: 1245523 - RNA, 19 nt, Human
uuauuaguauuguuguccu

SEQ ID NO: 1245524 - RNA, 18 nt, Human
uuauuaguauuguugucc

SEQ ID NO: 1245525 - RNA, 14 nt, Human
uuauuauauuuaca

SEQ ID NO: 1245526 - RNA, 19 nt, Human
uuauguuaaaacugggaca

SEQ ID NO: 1245527 - RNA, 17 nt, Human
uuauguuaaaucaauaa

SEQ ID NO: 1245528 - RNA, 22 nt, Human
uuauguuaagggaagaauucca

SEQ ID NO: 1245529 - RNA, 13 nt, Human
uuauguuauauau

SEQ ID NO: 1245530 - RNA, 15 nt, Human
uuauguuauauauaa

SEQ ID NO: 1245531 - RNA, 16 nt, Human
uuauguuauauauaaa

SEQ ID NO: 1245532 - RNA, 17 nt, Human
uuauguuauauauaaau

SEQ ID NO: 1245533 - RNA, 18 nt, Human
uuauguuauauauaaaua

SEQ ID NO: 1245534 - RNA, 21 nt, Human
uuauuauaaucuuauaauugu

SEQ ID NO: 1245535 - RNA, 22 nt, Human
uuauuauaaucuuauaauuguu

SEQ ID NO: 1245536 - RNA, 15 nt, Human
uuauuauauuuacaa

SEQ ID NO: 1245537 - RNA, 13 nt, Human
uuauuaugaagaa

SEQ ID NO: 1245538 - RNA, 12 nt, Human
uuauucauaauu

SEQ ID NO: 1245539 - RNA, 13 nt, Human
uuauucaguguca

SEQ ID NO: 1245540 - RNA, 14 nt, Human
uuauucagugucac

SEQ ID NO: 1245541 - RNA, 15 nt, Human
uuauucauaugcaua

SEQ ID NO: 1245542 - RNA, 16 nt, Human
uuauucauaugcauau

SEQ ID NO: 1245543 - RNA, 14 nt, Human
uuauucauaugcau

SEQ ID NO: 1245544 - RNA, 15 nt, Human
uuauucagggaagga

SEQ ID NO: 1245545 - RNA, 17 nt, Human
uuauucaauuuauuuga

SEQ ID NO: 1245546 - RNA, 18 nt, Human
uuauucaauuuauuugaa

SEQ ID NO: 1245547 - RNA, 20 nt, Human
uuauucaauuuauuugaaug

SEQ ID NO: 1245548 - RNA, 21 nt, Human
uuauucaauuuauuugaauga

SEQ ID NO: 1245549 - RNA, 20 nt, Human
uuauucacuuuuauuuagca

SEQ ID NO: 1245550 - RNA, 14 nt, Human
uuauucacaaaaau

SEQ ID NO: 1245551 - RNA, 22 nt, Human
uuauuauuuguguuuuaauuua

SEQ ID NO: 1245552 - RNA, 14 nt, Human
uuauuaugcauuau

SEQ ID NO: 1245553 - RNA, 16 nt, Human
uuauuauuauuuuuua

SEQ ID NO: 1245554 - RNA, 13 nt, Human
uuaugugaaacau

SEQ ID NO: 1245555 - RNA, 17 nt, Human
uuaugucuguggauuuu

SEQ ID NO: 1245556 - RNA, 11 nt, Human
uuaugucuggg

SEQ ID NO: 1245557 - RNA, 20 nt, Human
uuauguauugugcaaugugu

SEQ ID NO: 1245558 - RNA, 14 nt, Human
uuauguauugugca

SEQ ID NO: 1245559 - RNA, 15 nt, Human
uuaugucucuucuga

SEQ ID NO: 1245560 - RNA, 22 nt, Human
uuauguaaauuaucaggcaaau

SEQ ID NO: 1245561 - RNA, 17 nt, Human
uuauguaaauuauguaa

SEQ ID NO: 1245562 - RNA, 13 nt, Human
uuauguaauuuca

SEQ ID NO: 1245563 - RNA, 11 nt, Human
uuauguaauuu

SEQ ID NO: 1245564 - RNA, 13 nt, Human
uuauguagcucuu

SEQ ID NO: 1245565 - RNA, 16 nt, Human
uuauguagcucuuugu

SEQ ID NO: 1245566 - RNA, 15 nt, Human
uuauguaguaauuga

SEQ ID NO: 1245567 - RNA, 16 nt, Human
uuauguaguaauugac

SEQ ID NO: 1245568 - RNA, 19 nt, Human
uuauguaguaauugacaug

SEQ ID NO: 1245569 - RNA, 18 nt, Human
uuauguagcucuuuguca

SEQ ID NO: 1245570 - RNA, 11 nt, Human
uuauguaguuu

SEQ ID NO: 1245571 - RNA, 21 nt, Human
uuauguaguuuuuauauguug

SEQ ID NO: 1245572 - RNA, 20 nt, Human
uuaugugacauuuuacauua

SEQ ID NO: 1245573 - RNA, 22 nt, Human
uuaugugccagauuuaugcaua

SEQ ID NO: 1245574 - RNA, 19 nt, Human
uuaugugacauuuuacauu

SEQ ID NO: 1245575 - RNA, 14 nt, Human
uuaugugacauuuu

SEQ ID NO: 1245576 - RNA, 15 nt, Human
uuaugugaaacaugu

SEQ ID NO: 1245577 - RNA, 16 nt, Human
uuaugugaucaugugu

SEQ ID NO: 1245578 - RNA, 16 nt, Human
uuaugugguuuuagau

SEQ ID NO: 1245579 - RNA, 18 nt, Human
uuaugugguuuuagauuu

SEQ ID NO: 1245580 - RNA, 19 nt, Human
uuaugugguuuuagauuuu

SEQ ID NO: 1245581 - RNA, 20 nt, Human
uuaugugguuuuagauuuuc

SEQ ID NO: 1245582 - RNA, 11 nt, Human
uuaugggucac

SEQ ID NO: 1245583 - RNA, 13 nt, Human
uuaugggucacag

SEQ ID NO: 1245584 - RNA, 15 nt, Human
uuaugggucacagga

SEQ ID NO: 1245585 - RNA, 21 nt, Human
uuaugguaacugcuuucuguu

SEQ ID NO: 1245586 - RNA, 22 nt, Human
uuaugguaacugcuuucuguuc

SEQ ID NO: 1245587 - RNA, 23 nt, Human
uuaugguaacugcuuucuguucc

SEQ ID NO: 1245588 - RNA, 18 nt, Human
uuaugauaauagauucuc

SEQ ID NO: 1245589 - RNA, 13 nt, Human
uuaugaucuggcc

SEQ ID NO: 1245590 - RNA, 21 nt, Human
uuaugaucuggcccuugcuua

SEQ ID NO: 1245591 - RNA, 19 nt, Human
uuaugauuaaguaaugaua

SEQ ID NO: 1245592 - RNA, 18 nt, Human
uuaugaugugcuuaacag

SEQ ID NO: 1245593 - RNA, 17 nt, Human
uuaugaugugcuuaaca

SEQ ID NO: 1245594 - RNA, 16 nt, Human
uuaugaugugcuuaac

SEQ ID NO: 1245595 - RNA, 14 nt, Human
uuaugaugugcuua

SEQ ID NO: 1245596 - RNA, 13 nt, Human
uuaugaugugcuu

SEQ ID NO: 1245597 - RNA, 11 nt, Human
uuaugaugugc

SEQ ID NO: 1245598 - RNA, 22 nt, Human
uuaugauuaaguaaugauaacu

SEQ ID NO: 1245599 - RNA, 23 nt, Human
uuaugggaaccccuucauccucu

SEQ ID NO: 1245600 - RNA, 16 nt, Human
uuaucccagcugccua

SEQ ID NO: 1245601 - RNA, 18 nt, Human
uuaugaaaaagaagaauc

SEQ ID NO: 1245602 - RNA, 19 nt, Human
uuaugaaaaagaagaaucu

SEQ ID NO: 1245603 - RNA, 14 nt, Human
uuaugaaacuuuug

SEQ ID NO: 1245604 - RNA, 17 nt, Human
uuaugaaacuuuuggaa

SEQ ID NO: 1245605 - RNA, 18 nt, Human
uuaugaaacuuuuggaag

SEQ ID NO: 1245606 - RNA, 20 nt, Human
uuaugaagcuuuuaugugaa

SEQ ID NO: 1245607 - RNA, 22 nt, Human
uuaugaagaaggugaauagcca

SEQ ID NO: 1245608 - RNA, 19 nt, Human
uuaugaaacuuuuggaagg

SEQ ID NO: 1245609 - RNA, 19 nt, Human
uuaugaaauucacccccuu

SEQ ID NO: 1245610 - RNA, 18 nt, Human
uuaucaccgugggcuccc

SEQ ID NO: 1245611 - RNA, 12 nt, Human
uuaucauuuuca

SEQ ID NO: 1245612 - RNA, 16 nt, Human
uuaucauuuucaaaau

SEQ ID NO: 1245613 - RNA, 17 nt, Human
uuauccauauugaguca

SEQ ID NO: 1245614 - RNA, 19 nt, Human
uuauccauauugagucaaa

SEQ ID NO: 1245615 - RNA, 23 nt, Human
uuaucccaaaguuguuguaaccu

SEQ ID NO: 1245616 - RNA, 13 nt, Human
uuaucccagcugc

SEQ ID NO: 1245617 - RNA, 15 nt, Human
uuaucccagcugccu

SEQ ID NO: 1245618 - RNA, 15 nt, Human
uuaucccucaccugu

SEQ ID NO: 1245619 - RNA, 17 nt, Human
uuaucccucaccuguag

SEQ ID NO: 1245620 - RNA, 20 nt, Human
uuaucccucaccuguagcag

SEQ ID NO: 1245621 - RNA, 16 nt, Human
uuaugauaauagauuc

SEQ ID NO: 1245622 - RNA, 17 nt, Human
uuaugauaauagauucu

SEQ ID NO: 1245623 - RNA, 22 nt, Human
uuaugauagcaaauggccucau

SEQ ID NO: 1245624 - RNA, 20 nt, Human
uuaugauacuugaaaauuaa

SEQ ID NO: 1245625 - RNA, 16 nt, Human
uuaugacuauguaaac

SEQ ID NO: 1245626 - RNA, 15 nt, Human
uuaugacuauguaaa

SEQ ID NO: 1245627 - RNA, 15 nt, Human
uuaugacugccaaga

SEQ ID NO: 1245628 - RNA, 13 nt, Human
uuaugagaaacuu

SEQ ID NO: 1245629 - RNA, 22 nt, Human
uuaugagaaacuuaaauguuau

SEQ ID NO: 1245630 - RNA, 15 nt, Human
uuaugagaaagccuu

SEQ ID NO: 1245631 - RNA, 18 nt, Human
uuaugagcucuucauguu

SEQ ID NO: 1245632 - RNA, 14 nt, Human
uuaugaauuacauu

SEQ ID NO: 1245633 - RNA, 17 nt, Human
uuaugaaugugaagccu

SEQ ID NO: 1245634 - RNA, 18 nt, Human
uuaugaaugugaagccuu

SEQ ID NO: 1245635 - RNA, 16 nt, Human
uuaugaauuacauuug

SEQ ID NO: 1245636 - RNA, 17 nt, Human
uuaugaauuacauuugu

SEQ ID NO: 1245637 - RNA, 21 nt, Human
uuaugaauuacauuuguauaa

SEQ ID NO: 1245638 - RNA, 24 nt, Human
uuaugacaguaauuguguuuacau

SEQ ID NO: 1245639 - RNA, 16 nt, Human
uuaugacaguaauugu

SEQ ID NO: 1245640 - RNA, 15 nt, Human
uuaugacaguaauug

SEQ ID NO: 1245641 - RNA, 13 nt, Human
uuaugacaguaau

SEQ ID NO: 1245642 - RNA, 19 nt, Human
uuaugaaugugaagccuuc

SEQ ID NO: 1245643 - RNA, 20 nt, Human
uuaugaaugugaagccuucc

SEQ ID NO: 1245644 - RNA, 16 nt, Human
uuaugacaucacuugu

SEQ ID NO: 1245645 - RNA, 18 nt, Human
uuaugacaucacuuguac

SEQ ID NO: 1245646 - RNA, 21 nt, Human
uuaugacaucacuuguacaaa

SEQ ID NO: 1245647 - RNA, 23 nt, Human
uuaugacaucacuuguacaaaau

SEQ ID NO: 1245648 - RNA, 21 nt, Human
auacaggaugaugacuaugga

SEQ ID NO: 1245649 - RNA, 17 nt, Human
auacaggagauucucuu

SEQ ID NO: 1245650 - RNA, 16 nt, Human
auacaggaaacaguug

SEQ ID NO: 1245651 - RNA, 19 nt, Human
auacagucuuccauuugca

SEQ ID NO: 1245652 - RNA, 20 nt, Human
auacagucuuccauuugcaa

SEQ ID NO: 1245653 - RNA, 23 nt, Human
auacagagaagucacagggcagu

SEQ ID NO: 1245654 - RNA, 13 nt, Human
auacagauauauu

SEQ ID NO: 1245655 - RNA, 14 nt, Human
auacagauauauuu

SEQ ID NO: 1245656 - RNA, 17 nt, Human
auacagaucaucuugga

SEQ ID NO: 1245657 - RNA, 18 nt, Human
auacagauauauuuucuu

SEQ ID NO: 1245658 - RNA, 13 nt, Human
auacaggaaacag

SEQ ID NO: 1245659 - RNA, 14 nt, Human
auacaggaaacagu

SEQ ID NO: 1245660 - RNA, 15 nt, Human
auacaggaaacaguu

SEQ ID NO: 1245661 - RNA, 22 nt, Human
auacauguaauucuaccaaggu

SEQ ID NO: 1245662 - RNA, 22 nt, Human
auacaugcuaagagaaguagaa

SEQ ID NO: 1245663 - RNA, 18 nt, Human
auacaugcuaagagaagu

SEQ ID NO: 1245664 - RNA, 18 nt, Human
auacauagggauaugcgu

SEQ ID NO: 1245665 - RNA, 17 nt, Human
auacauacagaauuacu

SEQ ID NO: 1245666 - RNA, 12 nt, Human
auacauacagaa

SEQ ID NO: 1245667 - RNA, 15 nt, Human
auacauacuaugaaa

SEQ ID NO: 1245668 - RNA, 22 nt, Human
uuauaaacuuuuuucuuacugu

SEQ ID NO: 1245669 - RNA, 19 nt, Human
uuauaaauacugcaaauca

SEQ ID NO: 1245670 - RNA, 15 nt, Human
uuauaaauauauuua

SEQ ID NO: 1245671 - RNA, 16 nt, Human
uuauaaacuuuuuucu

SEQ ID NO: 1245672 - RNA, 12 nt, Human
uuauaaacuuuu

SEQ ID NO: 1245673 - RNA, 14 nt, Human
auacagagaaguca

SEQ ID NO: 1245674 - RNA, 15 nt, Human
auacagagaagucac

SEQ ID NO: 1245675 - RNA, 14 nt, Human
auacaaguuucauc

SEQ ID NO: 1245676 - RNA, 13 nt, Human
auacaaguuucau

SEQ ID NO: 1245677 - RNA, 12 nt, Human
auacaagacugc

SEQ ID NO: 1245678 - RNA, 14 nt, Human
auacagaacucuuu

SEQ ID NO: 1245679 - RNA, 15 nt, Human
auacagaacucuuuc

SEQ ID NO: 1245680 - RNA, 16 nt, Human
auacagaacucuuuca

SEQ ID NO: 1245681 - RNA, 18 nt, Human
auacagaacucuuucaaa

SEQ ID NO: 1245682 - RNA, 20 nt, Human
auacagaacucuuucaaaac

SEQ ID NO: 1245683 - RNA, 23 nt, Human
auacagaacucuuucaaaaccuu

SEQ ID NO: 1245684 - RNA, 20 nt, Human
auacagaauuacuguaacug

SEQ ID NO: 1245685 - RNA, 18 nt, Human
auacgugggcauucaaau

SEQ ID NO: 1245686 - RNA, 19 nt, Human
auacgugggcauucaaaug

SEQ ID NO: 1245687 - RNA, 14 nt, Human
auacgcucagcuca

SEQ ID NO: 1245688 - RNA, 21 nt, Human
auacgcucagcucauccaugc

SEQ ID NO: 1245689 - RNA, 23 nt, Human
auacgcucagcucauccaugccu

SEQ ID NO: 1245690 - RNA, 21 nt, Human
auacgcuggcaacacagaggc

SEQ ID NO: 1245691 - RNA, 13 nt, Human
auacggugggggu

SEQ ID NO: 1245692 - RNA, 16 nt, Human
auacgagagcagaggu

SEQ ID NO: 1245693 - RNA, 17 nt, Human
auacgagagcagagguc

SEQ ID NO: 1245694 - RNA, 20 nt, Human
auacgagagcagaggucucc

SEQ ID NO: 1245695 - RNA, 19 nt, Human
auacgagagcagaggucuc

SEQ ID NO: 1245696 - RNA, 17 nt, Human
auaccacgcuagggcug

SEQ ID NO: 1245697 - RNA, 14 nt, Human
auaccacucuguaa

SEQ ID NO: 1245698 - RNA, 15 nt, Human
auaccacucuguaau

SEQ ID NO: 1245699 - RNA, 17 nt, Human
auaccacucuguaauug

SEQ ID NO: 1245700 - RNA, 18 nt, Human
auaccacucuguaauugc

SEQ ID NO: 1245701 - RNA, 19 nt, Human
auaccacucuguaauugca

SEQ ID NO: 1245702 - RNA, 14 nt, Human
auacgaaauaauug

SEQ ID NO: 1245703 - RNA, 15 nt, Human
auacgaaauaauugu

SEQ ID NO: 1245704 - RNA, 18 nt, Human
auacgaaauaauuguugu

SEQ ID NO: 1245705 - RNA, 19 nt, Human
auacgaaauaauuguuguu

SEQ ID NO: 1245706 - RNA, 21 nt, Human
auacgaaauaauuguuguucu

SEQ ID NO: 1245707 - RNA, 16 nt, Human
auacgacaguacacug

SEQ ID NO: 1245708 - RNA, 19 nt, Human
uuauauuugaaauauugac

SEQ ID NO: 1245709 - RNA, 21 nt, Human
auacuauuaaaaagguuuaca

SEQ ID NO: 1245710 - RNA, 15 nt, Human
uuauauuuugcaguu

SEQ ID NO: 1245711 - RNA, 15 nt, Human
uuaucaaaacuuucu

SEQ ID NO: 1245712 - RNA, 19 nt, Human
uuaucacacaaagcagaau

SEQ ID NO: 1245713 - RNA, 13 nt, Human
uuaucacacaaag

SEQ ID NO: 1245714 - RNA, 14 nt, Human
auacuauaguacca

SEQ ID NO: 1245715 - RNA, 14 nt, Human
auacuauauuuaug

SEQ ID NO: 1245716 - RNA, 19 nt, Human
auacuaaaaagaagugcug

SEQ ID NO: 1245717 - RNA, 21 nt, Human
auacuagggagccauuugaga

SEQ ID NO: 1245718 - RNA, 16 nt, Human
auacuaugaaauaugu

SEQ ID NO: 1245719 - RNA, 15 nt, Human
auacuauauuuuagg

SEQ ID NO: 1245720 - RNA, 19 nt, Human
auacuauguggaugugaca

SEQ ID NO: 1245721 - RNA, 23 nt, Human
auacuauguggaugugacagugg

SEQ ID NO: 1245722 - RNA, 22 nt, Human
auacuauuaaaaagguuuacag

SEQ ID NO: 1245723 - RNA, 15 nt, Human
auacgguggggguag

SEQ ID NO: 1245724 - RNA, 13 nt, Human
auacuaaaaagaa

SEQ ID NO: 1245725 - RNA, 17 nt, Human
auacuaaaaagaagugc

SEQ ID NO: 1245726 - RNA, 16 nt, Human
aguggggaaugaagau

SEQ ID NO: 1245727 - RNA, 16 nt, Human
agugggcuugauucug

SEQ ID NO: 1245728 - RNA, 22 nt, Human
agugggcuugauucugcaguaa

SEQ ID NO: 1245729 - RNA, 15 nt, Human
aguggggacagagca

SEQ ID NO: 1245730 - RNA, 14 nt, Human
aguggggaggggcu

SEQ ID NO: 1245731 - RNA, 21 nt, Human
aguggcagcccagccagcguc

SEQ ID NO: 1245732 - RNA, 12 nt, Human
aguggggguggg

SEQ ID NO: 1245733 - RNA, 16 nt, Human
aguggggguggggggu

SEQ ID NO: 1245734 - RNA, 19 nt, Human
aguggggguggggguaggg

SEQ ID NO: 1245735 - RNA, 18 nt, Human
agugggguuaucucugug

SEQ ID NO: 1245736 - RNA, 19 nt, Human
agugggguuaucucugugu

SEQ ID NO: 1245737 - RNA, 20 nt, Human
agugggguggugucagaccc

SEQ ID NO: 1245738 - RNA, 20 nt, Human
agugggguuaucucuguguu

SEQ ID NO: 1245739 - RNA, 13 nt, Human
aguggacucaggg

SEQ ID NO: 1245740 - RNA, 16 nt, Human
aguggacucagggcag

SEQ ID NO: 1245741 - RNA, 17 nt, Human
aguggauggaaggggcu

SEQ ID NO: 1245742 - RNA, 16 nt, Human
aguggaugcugggucc

SEQ ID NO: 1245743 - RNA, 22 nt, Human
aguggacuggccucaaagcaag

SEQ ID NO: 1245744 - RNA, 13 nt, Human
aguggcagcccag

SEQ ID NO: 1245745 - RNA, 14 nt, Human
aguggcagcccagc

SEQ ID NO: 1245746 - RNA, 15 nt, Human
aguggcagcccagcc

SEQ ID NO: 1245747 - RNA, 16 nt, Human
aguggcagcccagcca

SEQ ID NO: 1245748 - RNA, 17 nt, Human
aguggcagcccagccag

SEQ ID NO: 1245749 - RNA, 20 nt, Human
aguggcagcccagccagcgu

SEQ ID NO: 1245750 - RNA, 18 nt, Human
uguuacaaauuguagaag

SEQ ID NO: 1245751 - RNA, 17 nt, Human
uguuacaaauuguagaa

SEQ ID NO: 1245752 - RNA, 13 nt, Human
uguuaauauugau

SEQ ID NO: 1245753 - RNA, 18 nt, Human
uguuacacuuuuuggaag

SEQ ID NO: 1245754 - RNA, 22 nt, Human
uguuaaguugauggugaugaaa

SEQ ID NO: 1245755 - RNA, 17 nt, Human
uguuaaguuauagugaa

SEQ ID NO: 1245756 - RNA, 21 nt, Human
uguuaaguuauagugaauacu

SEQ ID NO: 1245757 - RNA, 16 nt, Human
uguuaauaaucucaca

SEQ ID NO: 1245758 - RNA, 19 nt, Human
uguuaauauugauuuauua

SEQ ID NO: 1245759 - RNA, 23 nt, Human
uguguuaccugaaaacacugugc

SEQ ID NO: 1245760 - RNA, 23 nt, Human
uguguuacuaaaaaaaagaugaa

SEQ ID NO: 1245761 - RNA, 16 nt, Human
uguuaacugagugccu

SEQ ID NO: 1245762 - RNA, 22 nt, Human
uguuaacugagugccuuuuggu

SEQ ID NO: 1245763 - RNA, 12 nt, Human
uguuaacugaau

SEQ ID NO: 1245764 - RNA, 14 nt, Human
uguuaacugaauac

SEQ ID NO: 1245765 - RNA, 15 nt, Human
uguuaacugaauacc

SEQ ID NO: 1245766 - RNA, 17 nt, Human
uguuaacugaauaccac

SEQ ID NO: 1245767 - RNA, 18 nt, Human
uguuaacugaauaccacu

SEQ ID NO: 1245768 - RNA, 22 nt, Human
uguuaacugaauaccacucugu

SEQ ID NO: 1245769 - RNA, 15 nt, Human
uguuaagacuugaca

SEQ ID NO: 1245770 - RNA, 17 nt, Human
uguuaagacuugacagu

SEQ ID NO: 1245771 - RNA, 20 nt, Human
uguuaagacuugacagugga

SEQ ID NO: 1245772 - RNA, 17 nt, Human
uguguguugauacuguu

SEQ ID NO: 1245773 - RNA, 19 nt, Human
uguguguugauacuguugc

SEQ ID NO: 1245774 - RNA, 20 nt, Human
uguguguugauacuguugca

SEQ ID NO: 1245775 - RNA, 21 nt, Human
uguguguugauacuguugcac

SEQ ID NO: 1245776 - RNA, 18 nt, Human
uguguguugucucuugag

SEQ ID NO: 1245777 - RNA, 15 nt, Human
ugugucuaagauucu

SEQ ID NO: 1245778 - RNA, 14 nt, Human
ugugucugcucagu

SEQ ID NO: 1245779 - RNA, 14 nt, Human
ugugucuuaauuau

SEQ ID NO: 1245780 - RNA, 16 nt, Human
ugugucuuaauuauua

SEQ ID NO: 1245781 - RNA, 16 nt, Human
uguguccaaaacugcc

SEQ ID NO: 1245782 - RNA, 17 nt, Human
uguguccacgacugucu

SEQ ID NO: 1245783 - RNA, 18 nt, Human
uguguccacgacugucuc

SEQ ID NO: 1245784 - RNA, 19 nt, Human
uguguccacgacugucucc

SEQ ID NO: 1245785 - RNA, 20 nt, Human
uguguccaugcgcucagggc

SEQ ID NO: 1245786 - RNA, 21 nt, Human
ugugucccagaagaugacuga

SEQ ID NO: 1245787 - RNA, 23 nt, Human
ugugucccagaagaugacugagg

SEQ ID NO: 1245788 - RNA, 19 nt, Human
ugugucccaugaucccugu

SEQ ID NO: 1245789 - RNA, 20 nt, Human
ugugucccaugaucccugug

SEQ ID NO: 1245790 - RNA, 16 nt, Human
ugugucccccucuguc

SEQ ID NO: 1245791 - RNA, 18 nt, Human
ugugucccccucugucca

SEQ ID NO: 1245792 - RNA, 21 nt, Human
ugugucccccucuguccaggc

SEQ ID NO: 1245793 - RNA, 17 nt, Human
uguguccugacacugca

SEQ ID NO: 1245794 - RNA, 14 nt, Human
uguguccugacacu

SEQ ID NO: 1245795 - RNA, 14 nt, Human
uguguccugguucc

SEQ ID NO: 1245796 - RNA, 20 nt, Human
uguggucacaggaaguagag

SEQ ID NO: 1245797 - RNA, 15 nt, Human
uguggucacagcugu

SEQ ID NO: 1245798 - RNA, 23 nt, Human
uguggucacagcggaggugugga

SEQ ID NO: 1245799 - RNA, 23 nt, Human
uguggucacagcuguauagcugc

SEQ ID NO: 1245800 - RNA, 18 nt, Human
ugugguuuucgagauuau

SEQ ID NO: 1245801 - RNA, 19 nt, Human
ugugguuuucuuuugccau

SEQ ID NO: 1245802 - RNA, 21 nt, Human
ugugguuuucuuuugccauga

SEQ ID NO: 1245803 - RNA, 20 nt, Human
ugugguuuucuuuugccaug

SEQ ID NO: 1245804 - RNA, 17 nt, Human
uguguccaaaaccgcca

SEQ ID NO: 1245805 - RNA, 19 nt, Human
uguguccaaaaccgccagc

SEQ ID NO: 1245806 - RNA, 21 nt, Human
uguguccaaaaccgccagcuc

SEQ ID NO: 1245807 - RNA, 23 nt, Human
uguguccaaaaccgccagcucug

SEQ ID NO: 1245808 - RNA, 16 nt, Human
agugcccuccaggaua

SEQ ID NO: 1245809 - RNA, 12 nt, Human
agugcccucucc

SEQ ID NO: 1245810 - RNA, 16 nt, Human
agugccauuaacaaau

SEQ ID NO: 1245811 - RNA, 23 nt, Human
agugccaguauuuuaaaauagcg

SEQ ID NO: 1245812 - RNA, 18 nt, Human
agugcccccacugaccag

SEQ ID NO: 1245813 - RNA, 20 nt, Human
uguggguuuuuauuuccuau

SEQ ID NO: 1245814 - RNA, 21 nt, Human
agugcccucucccacccucuu

SEQ ID NO: 1245815 - RNA, 22 nt, Human
agugcccucucccacccucuuc

SEQ ID NO: 1245816 - RNA, 13 nt, Human
agugcccucuccc

SEQ ID NO: 1245817 - RNA, 15 nt, Human
agugcccucucccac

SEQ ID NO: 1245818 - RNA, 18 nt, Human
agugcccucucccacccu

SEQ ID NO: 1245819 - RNA, 19 nt, Human
agugcccucucccacccuc

SEQ ID NO: 1245820 - RNA, 23 nt, Human
agugcccucucccacccucuucc

SEQ ID NO: 1245821 - RNA, 20 nt, Human
ugugguaagcaacauggcuu

SEQ ID NO: 1245822 - RNA, 21 nt, Human
ugugguacaagcauucugucu

SEQ ID NO: 1245823 - RNA, 21 nt, Human
ugugguaagcaacauggcuuu

SEQ ID NO: 1245824 - RNA, 12 nt, Human
ugugguacagag

SEQ ID NO: 1245825 - RNA, 13 nt, Human
ugugguacagaga

SEQ ID NO: 1245826 - RNA, 14 nt, Human
ugugguacagagaa

SEQ ID NO: 1245827 - RNA, 15 nt, Human
ugugguacagagaag

SEQ ID NO: 1245828 - RNA, 16 nt, Human
ugugguacagagaagc

SEQ ID NO: 1245829 - RNA, 17 nt, Human
ugugguacagagaagcc

SEQ ID NO: 1245830 - RNA, 18 nt, Human
ugugguacagagaagcca

SEQ ID NO: 1245831 - RNA, 19 nt, Human
ugugguacagagaagccag

SEQ ID NO: 1245832 - RNA, 20 nt, Human
ugugguacagagaagccagc

SEQ ID NO: 1245833 - RNA, 21 nt, Human
ugugguacagagaagccagcu

SEQ ID NO: 1245834 - RNA, 19 nt, Human
ugugguacaugguguuugu

SEQ ID NO: 1245835 - RNA, 23 nt, Human
ugugguacagagaagccagcuug

SEQ ID NO: 1245836 - RNA, 16 nt, Human
ugugguacaugguguu

SEQ ID NO: 1245837 - RNA, 20 nt, Human
uguuaugacuauguaaacua

SEQ ID NO: 1245838 - RNA, 18 nt, Human
uguuaugacuauguaaac

SEQ ID NO: 1245839 - RNA, 17 nt, Human
uguuaugacuauguaaa

SEQ ID NO: 1245840 - RNA, 16 nt, Human
uguuaugacuauguaa

SEQ ID NO: 1245841 - RNA, 10 nt, Human
uguuccaaau

SEQ ID NO: 1245842 - RNA, 22 nt, Human
uguuaucuucucaaguucuaag

SEQ ID NO: 1245843 - RNA, 23 nt, Human
uguuaucuucucaaguucuaaga

SEQ ID NO: 1245844 - RNA, 12 nt, Human
uguuccugcugc

SEQ ID NO: 1245845 - RNA, 13 nt, Human
uguuccugcugcu

SEQ ID NO: 1245846 - RNA, 16 nt, Human
uguuccugcugcuguc

SEQ ID NO: 1245847 - RNA, 17 nt, Human
uguuccaaauucaguuu

SEQ ID NO: 1245848 - RNA, 18 nt, Human
uguuccaaauucaguuuc

SEQ ID NO: 1245849 - RNA, 19 nt, Human
uguuccaaauucaguuuca

SEQ ID NO: 1245850 - RNA, 20 nt, Human
uguuccaaauucaguuucau

SEQ ID NO: 1245851 - RNA, 22 nt, Human
uguuccaaauucaguuucauaa

SEQ ID NO: 1245852 - RNA, 21 nt, Human
uguuccaaauucaguuucaua

SEQ ID NO: 1245853 - RNA, 19 nt, Human
uguuccuuaagucagaaca

SEQ ID NO: 1245854 - RNA, 22 nt, Human
uguuccuuccagugucauuucu

SEQ ID NO: 1245855 - RNA, 17 nt, Human
uguuccuucccugugcc

SEQ ID NO: 1245856 - RNA, 18 nt, Human
uguuccuucccugugccu

SEQ ID NO: 1245857 - RNA, 19 nt, Human
uguuccuuccgcuuggagc

SEQ ID NO: 1245858 - RNA, 20 nt, Human
uguucgcauggucacacacu

SEQ ID NO: 1245859 - RNA, 22 nt, Human
uguucgcauggucacacacuga

SEQ ID NO: 1245860 - RNA, 23 nt, Human
uguucgcauggucacacacugau

SEQ ID NO: 1245861 - RNA, 19 nt, Human
uguucgggccaaggaccug

SEQ ID NO: 1245862 - RNA, 22 nt, Human
uguucgggccaaggaccugaga

SEQ ID NO: 1245863 - RNA, 13 nt, Human
uguucuaaagcuc

SEQ ID NO: 1245864 - RNA, 14 nt, Human
uguucuaaagcucu

SEQ ID NO: 1245865 - RNA, 16 nt, Human
uguucuaaagcucuga

SEQ ID NO: 1245866 - RNA, 17 nt, Human
agugugaccaaaaguua

SEQ ID NO: 1245867 - RNA, 19 nt, Human
agugugaccaaaaguuaca

SEQ ID NO: 1245868 - RNA, 14 nt, Human
agugugaccaggca

SEQ ID NO: 1245869 - RNA, 22 nt, Human
agugugaccaaaaguuacaugu

SEQ ID NO: 1245870 - RNA, 15 nt, Human
agugugaggccaggg

SEQ ID NO: 1245871 - RNA, 15 nt, Human
agugguaucuugcag

SEQ ID NO: 1245872 - RNA, 23 nt, Human
aguggguuuuuuaguugaauuuu

SEQ ID NO: 1245873 - RNA, 19 nt, Human
agugguaaaaaggccuccu

SEQ ID NO: 1245874 - RNA, 17 nt, Human
agugguaagcuaugucc

SEQ ID NO: 1245875 - RNA, 18 nt, Human
agugugaggccagggcag

SEQ ID NO: 1245876 - RNA, 14 nt, Human
agugugccuucucu

SEQ ID NO: 1245877 - RNA, 17 nt, Human
agugugcggcugugugu

SEQ ID NO: 1245878 - RNA, 20 nt, Human
agugugcgugguggucccug

SEQ ID NO: 1245879 - RNA, 22 nt, Human
agugugcgugguggucccuggg

SEQ ID NO: 1245880 - RNA, 23 nt, Human
agugugcgugguggucccugggu

SEQ ID NO: 1245881 - RNA, 22 nt, Human
agugugcuucuguuaucaaaca

SEQ ID NO: 1245882 - RNA, 14 nt, Human
aguguggacucugg

SEQ ID NO: 1245883 - RNA, 15 nt, Human
aguguggaggccacu

SEQ ID NO: 1245884 - RNA, 19 nt, Human
aguguguguuuuucauaaa

SEQ ID NO: 1245885 - RNA, 18 nt, Human
aguguguguuuuucauaa

SEQ ID NO: 1245886 - RNA, 21 nt, Human
aguguuccccuuccacugagg

SEQ ID NO: 1245887 - RNA, 14 nt, Human
aguguucccuaucc

SEQ ID NO: 1245888 - RNA, 15 nt, Human
aguguucccuaucca

SEQ ID NO: 1245889 - RNA, 16 nt, Human
aguguuccccuuccac

SEQ ID NO: 1245890 - RNA, 16 nt, Human
aguguugaaaauguuc

SEQ ID NO: 1245891 - RNA, 17 nt, Human
aguguugaaaauguuca

SEQ ID NO: 1245892 - RNA, 23 nt, Human
aguguucccuauccaaucaaucu

SEQ ID NO: 1245893 - RNA, 22 nt, Human
aguguucccuauccaaucaauc

SEQ ID NO: 1245894 - RNA, 19 nt, Human
aguguucugucugacuuuc

SEQ ID NO: 1245895 - RNA, 23 nt, Human
aguuacuaucaugucaaacguga

SEQ ID NO: 1245896 - RNA, 11 nt, Human
aguuagcacca

SEQ ID NO: 1245897 - RNA, 18 nt, Human
aguuagcuaauaaaaagc

SEQ ID NO: 1245898 - RNA, 15 nt, Human
uguugcauagaauaa

SEQ ID NO: 1245899 - RNA, 19 nt, Human
uguugccaaauauguccug

SEQ ID NO: 1245900 - RNA, 20 nt, Human
uguugccaaauauguccugg

SEQ ID NO: 1245901 - RNA, 22 nt, Human
uguugccaaauauguccugggg

SEQ ID NO: 1245902 - RNA, 23 nt, Human
uguugccaaauauguccuggggu

SEQ ID NO: 1245903 - RNA, 18 nt, Human
uguugccaagcuccaagc

SEQ ID NO: 1245904 - RNA, 20 nt, Human
uguugccaagcuccaagccc

SEQ ID NO: 1245905 - RNA, 15 nt, Human
uguucuaagaaguga

SEQ ID NO: 1245906 - RNA, 18 nt, Human
uguucuaaagcucugaca

SEQ ID NO: 1245907 - RNA, 19 nt, Human
uguucuaaagcucugacau

SEQ ID NO: 1245908 - RNA, 16 nt, Human
uguucuaaccuuuaca

SEQ ID NO: 1245909 - RNA, 13 nt, Human
uguucuaagaugu

SEQ ID NO: 1245910 - RNA, 14 nt, Human
uguucuaagaugug

SEQ ID NO: 1245911 - RNA, 22 nt, Human
uguucuaagaugugauauucua

SEQ ID NO: 1245912 - RNA, 16 nt, Human
uguucuaagaugugau

SEQ ID NO: 1245913 - RNA, 12 nt, Human
uguucuaaggcu

SEQ ID NO: 1245914 - RNA, 14 nt, Human
uguucuaaggcucu

SEQ ID NO: 1245915 - RNA, 14 nt, Human
uguugcacgugugu

SEQ ID NO: 1245916 - RNA, 21 nt, Human
uguugcacguguguuuuucua

SEQ ID NO: 1245917 - RNA, 22 nt, Human
uguugcccacagcuguaugauu

SEQ ID NO: 1245918 - RNA, 17 nt, Human
uguugccaguuguccuc

SEQ ID NO: 1245919 - RNA, 19 nt, Human
uguugccaguuguccuccu

SEQ ID NO: 1245920 - RNA, 18 nt, Human
uguugccaguuguccucc

SEQ ID NO: 1245921 - RNA, 21 nt, Human
aguguguggcuuucagagccu

SEQ ID NO: 1245922 - RNA, 18 nt, Human
agugccagcaccugccca

SEQ ID NO: 1245923 - RNA, 18 nt, Human
agugccacuuaauguaug

SEQ ID NO: 1245924 - RNA, 20 nt, Human
agugccacuuaauguauguu

SEQ ID NO: 1245925 - RNA, 21 nt, Human
agugccacuuaauguauguua

SEQ ID NO: 1245926 - RNA, 22 nt, Human
agugcauuuaugagcucuucau

SEQ ID NO: 1245927 - RNA, 17 nt, Human
agugcacuaauguguaa

SEQ ID NO: 1245928 - RNA, 21 nt, Human
agugcacuaauguguaagaca

SEQ ID NO: 1245929 - RNA, 21 nt, Human
agugcacugaaagucacggcu

SEQ ID NO: 1245930 - RNA, 14 nt, Human
agugcaaggaccua

SEQ ID NO: 1245931 - RNA, 16 nt, Human
agugcacuugcuggaa

SEQ ID NO: 1245932 - RNA, 20 nt, Human
agugcacuugcuggaagacg

SEQ ID NO: 1245933 - RNA, 18 nt, Human
agugcacuugcuggaaga

SEQ ID NO: 1245934 - RNA, 20 nt, Human
agugcaauaaaucugaccca

SEQ ID NO: 1245935 - RNA, 21 nt, Human
agugcaauaaaucugacccag

SEQ ID NO: 1245936 - RNA, 22 nt, Human
agugcaauaaaucugacccagu

SEQ ID NO: 1245937 - RNA, 23 nt, Human
agugcaauaaaucugacccagug

SEQ ID NO: 1245938 - RNA, 23 nt, Human
agugcaguggcaucaucucagcu

SEQ ID NO: 1245939 - RNA, 23 nt, Human
agugcaguccugaucagagccgu

SEQ ID NO: 1245940 - RNA, 23 nt, Human
agugcaguggcgugaucucagcu

SEQ ID NO: 1245941 - RNA, 23 nt, Human
agugcaguggcgcgaucucagcu

SEQ ID NO: 1245942 - RNA, 17 nt, Human
agugcaguuauuugcuu

SEQ ID NO: 1245943 - RNA, 15 nt, Human
agugcaguuauuugc

SEQ ID NO: 1245944 - RNA, 23 nt, Human
agugcauagcuacuaaaaucagu

SEQ ID NO: 1245945 - RNA, 19 nt, Human
agugcagaaugcuccucca

SEQ ID NO: 1245946 - RNA, 14 nt, Human
agugcaaauuguca

SEQ ID NO: 1245947 - RNA, 21 nt, Human
agugauuuuuaugccaccuga

SEQ ID NO: 1245948 - RNA, 13 nt, Human
agugcaacacugg

SEQ ID NO: 1245949 - RNA, 16 nt, Human
agugcaacacuggucu

SEQ ID NO: 1245950 - RNA, 21 nt, Human
agugcaacacuggucugcugu

SEQ ID NO: 1245951 - RNA, 16 nt, Human
agugauuuuuaugcca

SEQ ID NO: 1245952 - RNA, 20 nt, Human
agugauuuuuaugccaccug

SEQ ID NO: 1245953 - RNA, 20 nt, Human
agugauagucuuuugcuuuu

SEQ ID NO: 1245954 - RNA, 21 nt, Human
agugauagucuuuugcuuuug

SEQ ID NO: 1245955 - RNA, 14 nt, Human
agugauauaaauca

SEQ ID NO: 1245956 - RNA, 15 nt, Human
agugaguuuuuuagu

SEQ ID NO: 1245957 - RNA, 19 nt, Human
agugaguuuuuuagugcgu

SEQ ID NO: 1245958 - RNA, 15 nt, Human
agugauagucuuuug

SEQ ID NO: 1245959 - RNA, 17 nt, Human
agugauagucuuuugcu

SEQ ID NO: 1245960 - RNA, 14 nt, Human
uguggauucuuuaa

SEQ ID NO: 1245961 - RNA, 21 nt, Human
ugugcucaggagcccugggag

SEQ ID NO: 1245962 - RNA, 19 nt, Human
ugugccuauugcuagagcu

SEQ ID NO: 1245963 - RNA, 21 nt, Human
ugugcucuccauucugcuccu

SEQ ID NO: 1245964 - RNA, 16 nt, Human
ugugauucaaucugua

SEQ ID NO: 1245965 - RNA, 20 nt, Human
ugugauucaaucuguaaacu

SEQ ID NO: 1245966 - RNA, 22 nt, Human
ugugauucaaucuguaaacugu

SEQ ID NO: 1245967 - RNA, 23 nt, Human
ugugauucagaaaauguucuguu

SEQ ID NO: 1245968 - RNA, 20 nt, Human
ugugauucagaaaauguucu

SEQ ID NO: 1245969 - RNA, 14 nt, Human
ugugauuggccugu

SEQ ID NO: 1245970 - RNA, 15 nt, Human
ugugauuggccugua

SEQ ID NO: 1245971 - RNA, 17 nt, Human
ugugauuggccuguaga

SEQ ID NO: 1245972 - RNA, 12 nt, Human
ugugcccucugg

SEQ ID NO: 1245973 - RNA, 13 nt, Human
ugugcccucuggg

SEQ ID NO: 1245974 - RNA, 14 nt, Human
ugugcccucugggc

SEQ ID NO: 1245975 - RNA, 15 nt, Human
ugugcccucugggcu

SEQ ID NO: 1245976 - RNA, 17 nt, Human
ugugcccucugggcucu

SEQ ID NO: 1245977 - RNA, 21 nt, Human
ugugcccucugggcucugagu

SEQ ID NO: 1245978 - RNA, 18 nt, Human
ugugcccucugggcucug

SEQ ID NO: 1245979 - RNA, 22 nt, Human
ugugccuauugcuagagcuccu

SEQ ID NO: 1245980 - RNA, 21 nt, Human
uguggaucaaauccagccugc

SEQ ID NO: 1245981 - RNA, 19 nt, Human
uguggaucaaccaucgcuu

SEQ ID NO: 1245982 - RNA, 20 nt, Human
uguggaucaaccaucgcuuu

SEQ ID NO: 1245983 - RNA, 17 nt, Human
uguggaucagagaugca

SEQ ID NO: 1245984 - RNA, 14 nt, Human
uguggaucagagau

SEQ ID NO: 1245985 - RNA, 19 nt, Human
ugugcugugcuauggugcu

SEQ ID NO: 1245986 - RNA, 12 nt, Human
ugugcugugugu

SEQ ID NO: 1245987 - RNA, 15 nt, Human
ugugcugugugugac

SEQ ID NO: 1245988 - RNA, 18 nt, Human
agugacuuuggcugcaug

SEQ ID NO: 1245989 - RNA, 17 nt, Human
agugacuucugagaucu

SEQ ID NO: 1245990 - RNA, 15 nt, Human
agugacuucugagau

SEQ ID NO: 1245991 - RNA, 16 nt, Human
agugacuuguguccca

SEQ ID NO: 1245992 - RNA, 18 nt, Human
agugacuugugucccaug

SEQ ID NO: 1245993 - RNA, 18 nt, Human
agugacucuauauagcug

SEQ ID NO: 1245994 - RNA, 12 nt, Human
agugacuucuga

SEQ ID NO: 1245995 - RNA, 13 nt, Human
agugacuucugag

SEQ ID NO: 1245996 - RNA, 14 nt, Human
agugacuucugaga

SEQ ID NO: 1245997 - RNA, 12 nt, Human
agugagaggcug

SEQ ID NO: 1245998 - RNA, 11 nt, Human
agugagccuga

SEQ ID NO: 1245999 - RNA, 21 nt, Human
agugagccugaauuuuguugc

SEQ ID NO: 1246000 - RNA, 18 nt, Human
agucuuucacauuuaaau

SEQ ID NO: 1246001 - RNA, 21 nt, Human
agugaacaaauuuacagagac

SEQ ID NO: 1246002 - RNA, 16 nt, Human
agucuuucacauuuaa

SEQ ID NO: 1246003 - RNA, 23 nt, Human
agugaacaaauuuacagagacag

SEQ ID NO: 1246004 - RNA, 22 nt, Human
agugaacaaauuuacagagaca

SEQ ID NO: 1246005 - RNA, 18 nt, Human
agugaacuuaguccuguu

SEQ ID NO: 1246006 - RNA, 16 nt, Human
agugacuaauggcaug

SEQ ID NO: 1246007 - RNA, 17 nt, Human
agugacuaauggcauga

SEQ ID NO: 1246008 - RNA, 20 nt, Human
agucugaaccuauuucuuaa

SEQ ID NO: 1246009 - RNA, 15 nt, Human
agucugaacagcugu

SEQ ID NO: 1246010 - RNA, 16 nt, Human
agucugaacagcugua

SEQ ID NO: 1246011 - RNA, 18 nt, Human
agucugaacagcuguaau

SEQ ID NO: 1246012 - RNA, 21 nt, Human
agucucuucuccacuggaugg

SEQ ID NO: 1246013 - RNA, 19 nt, Human
agucucuucuccacuggau

SEQ ID NO: 1246014 - RNA, 20 nt, Human
agucucgucucuuuuacccu

SEQ ID NO: 1246015 - RNA, 14 nt, Human
agucucuaauucua

SEQ ID NO: 1246016 - RNA, 21 nt, Human
ugugagaagugaaugcuggga

SEQ ID NO: 1246017 - RNA, 22 nt, Human
ugugagaagugaaugcugggac

SEQ ID NO: 1246018 - RNA, 23 nt, Human
ugugagaagugaaugcugggacu

SEQ ID NO: 1246019 - RNA, 24 nt, Human
ugugagaagugaaugcugggacuc

SEQ ID NO: 1246020 - RNA, 18 nt, Human
ugugacuucagcucuguu

SEQ ID NO: 1246021 - RNA, 19 nt, Human
ugugacuucagcucuguuu

SEQ ID NO: 1246022 - RNA, 17 nt, Human
ugugacuggcuaaagcu

SEQ ID NO: 1246023 - RNA, 20 nt, Human
ugugacuggcuaaagcucga

SEQ ID NO: 1246024 - RNA, 18 nt, Human
ugugacuggcuaaagcuc

SEQ ID NO: 1246025 - RNA, 23 nt, Human
ugugacuucuauuuuaaagacaa

SEQ ID NO: 1246026 - RNA, 16 nt, Human
ugugacuuuugugaaa

SEQ ID NO: 1246027 - RNA, 13 nt, Human
ugucucaugccag

SEQ ID NO: 1246028 - RNA, 15 nt, Human
ugucuccauggcccu

SEQ ID NO: 1246029 - RNA, 13 nt, Human
ugucuccuaagca

SEQ ID NO: 1246030 - RNA, 16 nt, Human
ugucuccuaagcaccu

SEQ ID NO: 1246031 - RNA, 21 nt, Human
ugucuccuaagcaccuguaau

SEQ ID NO: 1246032 - RNA, 16 nt, Human
ugucuccuaccucugc

SEQ ID NO: 1246033 - RNA, 14 nt, Human
agucaccagagacu

SEQ ID NO: 1246034 - RNA, 17 nt, Human
aguauuuuaaaauagcg

SEQ ID NO: 1246035 - RNA, 20 nt, Human
aguauuuuagugaacuugaa

SEQ ID NO: 1246036 - RNA, 18 nt, Human
aguauuuuagugaacuug

SEQ ID NO: 1246037 - RNA, 13 nt, Human
aguauuuucuaaa

SEQ ID NO: 1246038 - RNA, 21 nt, Human
aguauuuuccuguugucaaga

SEQ ID NO: 1246039 - RNA, 17 nt, Human
aguauuuugcuggaaua

SEQ ID NO: 1246040 - RNA, 19 nt, Human
aguauuuagaagccaacua

SEQ ID NO: 1246041 - RNA, 16 nt, Human
aguauuucaaauugga

SEQ ID NO: 1246042 - RNA, 20 nt, Human
aguauuucaaauuggagcuu

SEQ ID NO: 1246043 - RNA, 13 nt, Human
aguauuuguuaau

SEQ ID NO: 1246044 - RNA, 14 nt, Human
aguauuuguuaauu

SEQ ID NO: 1246045 - RNA, 15 nt, Human
aguauuuguuaauuu

SEQ ID NO: 1246046 - RNA, 18 nt, Human
aguauuuguuaauuuaga

SEQ ID NO: 1246047 - RNA, 16 nt, Human
aguauuuuaaaauagc

SEQ ID NO: 1246048 - RNA, 19 nt, Human
uguauauuacaaugaucac

SEQ ID NO: 1246049 - RNA, 19 nt, Human
uguauauuaagguguggcu

SEQ ID NO: 1246050 - RNA, 13 nt, Human
uguauauuguaau

SEQ ID NO: 1246051 - RNA, 14 nt, Human
uguauauuguaauu

SEQ ID NO: 1246052 - RNA, 17 nt, Human
uguauauuguaauuuaa

SEQ ID NO: 1246053 - RNA, 20 nt, Human
uguauauuguguuuguguau

SEQ ID NO: 1246054 - RNA, 19 nt, Human
aguauuaaaauguaugcau

SEQ ID NO: 1246055 - RNA, 13 nt, Human
aguauuaaaaugu

SEQ ID NO: 1246056 - RNA, 14 nt, Human
aguauuaaaaugua

SEQ ID NO: 1246057 - RNA, 15 nt, Human
aguauuaaaauguau

SEQ ID NO: 1246058 - RNA, 18 nt, Human
aguauuaaaauguaugca

SEQ ID NO: 1246059 - RNA, 20 nt, Human
aguauuccagaccugaagaa

SEQ ID NO: 1246060 - RNA, 19 nt, Human
aguauaagacuacugaauc

SEQ ID NO: 1246061 - RNA, 15 nt, Human
aguauaccugauuuu

SEQ ID NO: 1246062 - RNA, 23 nt, Human
aguauacuagggagccauuugag

SEQ ID NO: 1246063 - RNA, 24 nt, Human
ugucagauccaggagcuccagugu

SEQ ID NO: 1246064 - RNA, 18 nt, Human
ugucagauccaggagcuc

SEQ ID NO: 1246065 - RNA, 20 nt, Human
ugucagauccaggagcucca

SEQ ID NO: 1246066 - RNA, 21 nt, Human
ugucagauccaggagcuccag

SEQ ID NO: 1246067 - RNA, 23 nt, Human
ugucauuugcuggagcucugccc

SEQ ID NO: 1246068 - RNA, 16 nt, Human
ugucagcagggacugu

SEQ ID NO: 1246069 - RNA, 16 nt, Human
uguccaaaacugccuc

SEQ ID NO: 1246070 - RNA, 11 nt, Human
uguccaaagag

SEQ ID NO: 1246071 - RNA, 17 nt, Human
uguccaaagaggcugcc

SEQ ID NO: 1246072 - RNA, 19 nt, Human
uguccaaagaggcugcccc

SEQ ID NO: 1246073 - RNA, 20 nt, Human
uguccaaagaggcugccccu

SEQ ID NO: 1246074 - RNA, 21 nt, Human
uguccaaagaggcugccccuc

SEQ ID NO: 1246075 - RNA, 14 nt, Human
uguccaacuggccc

SEQ ID NO: 1246076 - RNA, 19 nt, Human
uguccaacuggcccuauuu

SEQ ID NO: 1246077 - RNA, 14 nt, Human
uguccaauccuaug

SEQ ID NO: 1246078 - RNA, 22 nt, Human
uguccagacagagcccugugag

SEQ ID NO: 1246079 - RNA, 21 nt, Human
uguccagacagagcccuguga

SEQ ID NO: 1246080 - RNA, 17 nt, Human
ugucccgauuguaacuc

SEQ ID NO: 1246081 - RNA, 16 nt, Human
ugucccgauuguaacu

SEQ ID NO: 1246082 - RNA, 11 nt, Human
uguccagcucc

SEQ ID NO: 1246083 - RNA, 15 nt, Human
agucuauuuacggaa

SEQ ID NO: 1246084 - RNA, 20 nt, Human
agucuauuuacggaacucaa

SEQ ID NO: 1246085 - RNA, 22 nt, Human
agucuaucaaccccagacacug

SEQ ID NO: 1246086 - RNA, 23 nt, Human
agucuaucaaccccagacacugg

SEQ ID NO: 1246087 - RNA, 18 nt, Human
agucuaucaaucaacuua

SEQ ID NO: 1246088 - RNA, 11 nt, Human
agucuaccaau

SEQ ID NO: 1246089 - RNA, 21 nt, Human
agucuaccaaccuguucaagu

SEQ ID NO: 1246090 - RNA, 19 nt, Human
agucucacuuugucgccca

SEQ ID NO: 1246091 - RNA, 19 nt, Human
agucucagaaugucauuuu

SEQ ID NO: 1246092 - RNA, 11 nt, Human
agucucagcua

SEQ ID NO: 1246093 - RNA, 18 nt, Human
agucucagcuaagcucac

SEQ ID NO: 1246094 - RNA, 13 nt, Human
agucucagcuaag

SEQ ID NO: 1246095 - RNA, 11 nt, Human
ugucucaucca

SEQ ID NO: 1246096 - RNA, 16 nt, Human
ugucucauccaucauc

SEQ ID NO: 1246097 - RNA, 17 nt, Human
ugucucauccaucauca

SEQ ID NO: 1246098 - RNA, 21 nt, Human
ugucucauccaucaucaugug

SEQ ID NO: 1246099 - RNA, 21 nt, Human
ugucucaugccaguaacaggc

SEQ ID NO: 1246100 - RNA, 12 nt, Human
agucggauuaga

SEQ ID NO: 1246101 - RNA, 18 nt, Human
agucguacagaaagcugc

SEQ ID NO: 1246102 - RNA, 17 nt, Human
agucguccuuacuccug

SEQ ID NO: 1246103 - RNA, 19 nt, Human
agucguccuuacuccugug

SEQ ID NO: 1246104 - RNA, 20 nt, Human
agucguccuuacuccugugg

SEQ ID NO: 1246105 - RNA, 22 nt, Human
agucguccuuacuccuguggga

SEQ ID NO: 1246106 - RNA, 21 nt, Human
agucguccuuacuccuguggg

SEQ ID NO: 1246107 - RNA, 23 nt, Human
agucuaaagauggaguuucuaag

SEQ ID NO: 1246108 - RNA, 21 nt, Human
agucuaaagcugguuuaaugu

SEQ ID NO: 1246109 - RNA, 20 nt, Human
agucuaaagcugguuuaaug

SEQ ID NO: 1246110 - RNA, 16 nt, Human
agucccccugccccag

SEQ ID NO: 1246111 - RNA, 16 nt, Human
aguccccucaccuccu

SEQ ID NO: 1246112 - RNA, 20 nt, Human
aguccuacaagcuaaaauua

SEQ ID NO: 1246113 - RNA, 15 nt, Human
aguccuaucugggcu

SEQ ID NO: 1246114 - RNA, 16 nt, Human
aguccuaucugggcuu

SEQ ID NO: 1246115 - RNA, 19 nt, Human
aguccuaucugggcuuccu

SEQ ID NO: 1246116 - RNA, 20 nt, Human
aguccuaucugggcuuccug

SEQ ID NO: 1246117 - RNA, 22 nt, Human
aguccuaucugggcuuccugga

SEQ ID NO: 1246118 - RNA, 23 nt, Human
aguccuaucugggcuuccuggag

SEQ ID NO: 1246119 - RNA, 24 nt, Human
aguccuaucugggcuuccuggagc

SEQ ID NO: 1246120 - RNA, 14 nt, Human
agucaggaaagaga

SEQ ID NO: 1246121 - RNA, 15 nt, Human
agucaggaaagagaa

SEQ ID NO: 1246122 - RNA, 22 nt, Human
agucagaacagcagacucagcu

SEQ ID NO: 1246123 - RNA, 12 nt, Human
agucagaacagc

SEQ ID NO: 1246124 - RNA, 14 nt, Human
agucagaacagcag

SEQ ID NO: 1246125 - RNA, 15 nt, Human
agucagaacagcaga

SEQ ID NO: 1246126 - RNA, 17 nt, Human
agucagaacagcagacu

SEQ ID NO: 1246127 - RNA, 12 nt, Human
agucacugcucu

SEQ ID NO: 1246128 - RNA, 23 nt, Human
agucacuggucuguuugcauuug

SEQ ID NO: 1246129 - RNA, 14 nt, Human
ugucgccucugcau

SEQ ID NO: 1246130 - RNA, 16 nt, Human
ugucccuuaaacaaaa

SEQ ID NO: 1246131 - RNA, 14 nt, Human
ugucgcucaugugu

SEQ ID NO: 1246132 - RNA, 15 nt, Human
ugucgcucaugugug

SEQ ID NO: 1246133 - RNA, 16 nt, Human
ugucgcucaugugugc

SEQ ID NO: 1246134 - RNA, 22 nt, Human
ugucgcucaugugugcaacagg

SEQ ID NO: 1246135 - RNA, 15 nt, Human
ugucgcugcuucgug

SEQ ID NO: 1246136 - RNA, 12 nt, Human
ugucgcugcuuc

SEQ ID NO: 1246137 - RNA, 17 nt, Human
agucccaggcugagccu

SEQ ID NO: 1246138 - RNA, 18 nt, Human
agucccaggcugagccuc

SEQ ID NO: 1246139 - RNA, 19 nt, Human
agucccaggcugagccuca

SEQ ID NO: 1246140 - RNA, 20 nt, Human
agucccaggcugagccucag

SEQ ID NO: 1246141 - RNA, 18 nt, Human
aguccccauugaggcuug

SEQ ID NO: 1246142 - RNA, 14 nt, Human
agucccaagcggug

SEQ ID NO: 1246143 - RNA, 19 nt, Human
agucccaagcggugucucu

SEQ ID NO: 1246144 - RNA, 20 nt, Human
agucccaagcggugucucuc

SEQ ID NO: 1246145 - RNA, 13 nt, Human
agucauaauugca

SEQ ID NO: 1246146 - RNA, 17 nt, Human
agucauaauugcauuga

SEQ ID NO: 1246147 - RNA, 14 nt, Human
agucauaccaauga

SEQ ID NO: 1246148 - RNA, 17 nt, Human
agucauaccaaugaaaa

SEQ ID NO: 1246149 - RNA, 23 nt, Human
agucauaccaaugaaaaaaugua

SEQ ID NO: 1246150 - RNA, 16 nt, Human
agucauagguuaauau

SEQ ID NO: 1246151 - RNA, 22 nt, Human
agucauagguuaauauuuaaga

SEQ ID NO: 1246152 - RNA, 20 nt, Human
agucauauauaucacccaga

SEQ ID NO: 1246153 - RNA, 23 nt, Human
aguaccaguaggggcuuauaaua

SEQ ID NO: 1246154 - RNA, 14 nt, Human
aguaccagacuaga

SEQ ID NO: 1246155 - RNA, 20 nt, Human
aguagauugcagaaaauucu

SEQ ID NO: 1246156 - RNA, 15 nt, Human
aguaccaaucauuuu

SEQ ID NO: 1246157 - RNA, 16 nt, Human
aguaccaaucauuuua

SEQ ID NO: 1246158 - RNA, 15 nt, Human
aguagauuuuccaaa

SEQ ID NO: 1246159 - RNA, 21 nt, Human
aguagcaauuauggaaaaaaa

SEQ ID NO: 1246160 - RNA, 23 nt, Human
aguagcacaaguuauuuaaaucu

SEQ ID NO: 1246161 - RNA, 14 nt, Human
aguagcagugauug

SEQ ID NO: 1246162 - RNA, 22 nt, Human
aguagcagugauugucuuaaua

SEQ ID NO: 1246163 - RNA, 22 nt, Human
uguagggagggcggcaggggcc

SEQ ID NO: 1246164 - RNA, 21 nt, Human
uguaggggaggggcuccuuuc

SEQ ID NO: 1246165 - RNA, 23 nt, Human
uguaggggaggggcuccuuucca

SEQ ID NO: 1246166 - RNA, 13 nt, Human
uguaggguuucua

SEQ ID NO: 1246167 - RNA, 22 nt, Human
uguaggggaggggcuccuuucc

SEQ ID NO: 1246168 - RNA, 20 nt, Human
uguagugauuuuuaugccac

SEQ ID NO: 1246169 - RNA, 21 nt, Human
uguagugauuuuuaugccacc

SEQ ID NO: 1246170 - RNA, 17 nt, Human
uguaguguuggagaaga

SEQ ID NO: 1246171 - RNA, 18 nt, Human
uguaguguuggagaagaa

SEQ ID NO: 1246172 - RNA, 19 nt, Human
uguaguguuggagaagaac

SEQ ID NO: 1246173 - RNA, 15 nt, Human
uguauaguuaacaca

SEQ ID NO: 1246174 - RNA, 16 nt, Human
uguauaguuaacacac

SEQ ID NO: 1246175 - RNA, 17 nt, Human
uguauaguuaacacacu

SEQ ID NO: 1246176 - RNA, 14 nt, Human
uguauaguucacgu

SEQ ID NO: 1246177 - RNA, 15 nt, Human
uguauauuacaauga

SEQ ID NO: 1246178 - RNA, 14 nt, Human
uguauauuacaaug

SEQ ID NO: 1246179 - RNA, 16 nt, Human
uguauauuaaggugug

SEQ ID NO: 1246180 - RNA, 20 nt, Human
uguauauauuauuauaaucu

SEQ ID NO: 1246181 - RNA, 14 nt, Human
uguauauauuauua

SEQ ID NO: 1246182 - RNA, 12 nt, Human
uguauauacuuu

SEQ ID NO: 1246183 - RNA, 13 nt, Human
uguauauacuuuu

SEQ ID NO: 1246184 - RNA, 15 nt, Human
uguauauauauauau

SEQ ID NO: 1246185 - RNA, 14 nt, Human
aguaaaaaggcuaa

SEQ ID NO: 1246186 - RNA, 16 nt, Human
agguuuuuuuucaguu

SEQ ID NO: 1246187 - RNA, 23 nt, Human
aguaaaaacaaagaaauuaugug

SEQ ID NO: 1246188 - RNA, 16 nt, Human
aguaaaaacaaagaaa

SEQ ID NO: 1246189 - RNA, 17 nt, Human
agguuuuuuuucaguug

SEQ ID NO: 1246190 - RNA, 20 nt, Human
uguacauagugcuaacauga

SEQ ID NO: 1246191 - RNA, 16 nt, Human
uguacaugagaaggaa

SEQ ID NO: 1246192 - RNA, 22 nt, Human
uguacaugaagaagcuaaaucc

SEQ ID NO: 1246193 - RNA, 23 nt, Human
aguaauaccucuaauaguauaaa

SEQ ID NO: 1246194 - RNA, 22 nt, Human
aguaauaccucuaauaguauaa

SEQ ID NO: 1246195 - RNA, 21 nt, Human
aguaauaccucuaauaguaua

SEQ ID NO: 1246196 - RNA, 20 nt, Human
aguaauaccucuaauaguau

SEQ ID NO: 1246197 - RNA, 13 nt, Human
aguaauacaaacu

SEQ ID NO: 1246198 - RNA, 22 nt, Human
aguaauaaaauucaacaaacau

SEQ ID NO: 1246199 - RNA, 15 nt, Human
aguaauaaaauucaa

SEQ ID NO: 1246200 - RNA, 23 nt, Human
aguaauaaaauucaacaaacauu

SEQ ID NO: 1246201 - RNA, 13 nt, Human
aguaaugauaacu

SEQ ID NO: 1246202 - RNA, 12 nt, Human
aguaauccugua

SEQ ID NO: 1246203 - RNA, 19 nt, Human
aguaaucuaauauggccac

SEQ ID NO: 1246204 - RNA, 13 nt, Human
aguaaucugcauu

SEQ ID NO: 1246205 - RNA, 23 nt, Human
aguaaucugcauuauuggaauau

SEQ ID NO: 1246206 - RNA, 12 nt, Human
aguaauuggaaa

SEQ ID NO: 1246207 - RNA, 13 nt, Human
aguaauuggaaag

SEQ ID NO: 1246208 - RNA, 18 nt, Human
aguaauugacaugugcca

SEQ ID NO: 1246209 - RNA, 20 nt, Human
aguaauugacaugugccagg

SEQ ID NO: 1246210 - RNA, 12 nt, Human
aguaauuuagaa

SEQ ID NO: 1246211 - RNA, 14 nt, Human
aguaauuuagaaau

SEQ ID NO: 1246212 - RNA, 23 nt, Human
aguaauuuagaaaucauuuugca

SEQ ID NO: 1246213 - RNA, 23 nt, Human
aguaauuguguuuacauuuuaug

SEQ ID NO: 1246214 - RNA, 22 nt, Human
aguaauuguguuuacauuuuau

SEQ ID NO: 1246215 - RNA, 21 nt, Human
aguaauuguguuuacauuuua

SEQ ID NO: 1246216 - RNA, 18 nt, Human
aguaauuguguuuacauu

SEQ ID NO: 1246217 - RNA, 16 nt, Human
aguaauuguguuuaca

SEQ ID NO: 1246218 - RNA, 22 nt, Human
aguaauugguccgaucuuugac

SEQ ID NO: 1246219 - RNA, 17 nt, Human
aguaauuuagaaaucau

SEQ ID NO: 1246220 - RNA, 12 nt, Human
aguacagagaag

SEQ ID NO: 1246221 - RNA, 13 nt, Human
aguacagagaagc

SEQ ID NO: 1246222 - RNA, 14 nt, Human
aguacagagaagcc

SEQ ID NO: 1246223 - RNA, 15 nt, Human
aguacagagaagcca

SEQ ID NO: 1246224 - RNA, 16 nt, Human
aguacagagaagccau

SEQ ID NO: 1246225 - RNA, 20 nt, Human
aguacagagaagccaucacc

SEQ ID NO: 1246226 - RNA, 17 nt, Human
aguacagagaagccauc

SEQ ID NO: 1246227 - RNA, 13 nt, Human
agguugaaaaaca

SEQ ID NO: 1246228 - RNA, 18 nt, Human
agguucuuguuggugcac

SEQ ID NO: 1246229 - RNA, 17 nt, Human
agguucuuguuggugca

SEQ ID NO: 1246230 - RNA, 18 nt, Human
agguggggagacugggcu

SEQ ID NO: 1246231 - RNA, 20 nt, Human
agguguagccacaccaggau

SEQ ID NO: 1246232 - RNA, 15 nt, Human
aggugucauacagau

SEQ ID NO: 1246233 - RNA, 21 nt, Human
aggugucauacagauuugcaa

SEQ ID NO: 1246234 - RNA, 11 nt, Human
aggugggagga

SEQ ID NO: 1246235 - RNA, 13 nt, Human
aggugggaggaug

SEQ ID NO: 1246236 - RNA, 20 nt, Human
aggugggaggaugugaauug

SEQ ID NO: 1246237 - RNA, 17 nt, Human
aggugcuaauuuguuuu

SEQ ID NO: 1246238 - RNA, 20 nt, Human
aggugcuaauuuguuuugga

SEQ ID NO: 1246239 - RNA, 23 nt, Human
aggugcuaauuuguuuuggauau

SEQ ID NO: 1246240 - RNA, 13 nt, Human
ugggcugcccugg

SEQ ID NO: 1246241 - RNA, 14 nt, Human
ugggcugcccuggu

SEQ ID NO: 1246242 - RNA, 15 nt, Human
ugggcugcccuggug

SEQ ID NO: 1246243 - RNA, 16 nt, Human
ugggcugcccuggugc

SEQ ID NO: 1246244 - RNA, 20 nt, Human
ugggcucugcaauuccccuc

SEQ ID NO: 1246245 - RNA, 22 nt, Human
ugggcucugcaauuccccucug

SEQ ID NO: 1246246 - RNA, 15 nt, Human
ugggcucugaugaaa

SEQ ID NO: 1246247 - RNA, 12 nt, Human
ugggcugaggga

SEQ ID NO: 1246248 - RNA, 16 nt, Human
ugggcugagggagccu

SEQ ID NO: 1246249 - RNA, 20 nt, Human
agguuucacuguguuggcca

SEQ ID NO: 1246250 - RNA, 17 nt, Human
agguuucaaagaugcug

SEQ ID NO: 1246251 - RNA, 22 nt, Human
agguuuaugacaguaauugugu

SEQ ID NO: 1246252 - RNA, 13 nt, Human
agguuucaaagau

SEQ ID NO: 1246253 - RNA, 14 nt, Human
agguuucaaagaug

SEQ ID NO: 1246254 - RNA, 19 nt, Human
agguuucugaguuccugca

SEQ ID NO: 1246255 - RNA, 21 nt, Human
agguuucugaguuccugcaug

SEQ ID NO: 1246256 - RNA, 14 nt, Human
uguaaggcucuaga

SEQ ID NO: 1246257 - RNA, 15 nt, Human
uguaaggcucuagau

SEQ ID NO: 1246258 - RNA, 18 nt, Human
uguaaggcucuagaucau

SEQ ID NO: 1246259 - RNA, 14 nt, Human
uguaaggcugugua

SEQ ID NO: 1246260 - RNA, 20 nt, Human
uguaaggcuguguaagauuu

SEQ ID NO: 1246261 - RNA, 21 nt, Human
uguaaggcuguguaagauuug

SEQ ID NO: 1246262 - RNA, 18 nt, Human
uguaagggccagaaauau

SEQ ID NO: 1246263 - RNA, 19 nt, Human
uguaauucagguuuuuccu

SEQ ID NO: 1246264 - RNA, 13 nt, Human
uguaauucuaaau

SEQ ID NO: 1246265 - RNA, 14 nt, Human
uguaauucuaaaug

SEQ ID NO: 1246266 - RNA, 15 nt, Human
uguaauucuaaauga

SEQ ID NO: 1246267 - RNA, 16 nt, Human
uguaauucuaaaugaa

SEQ ID NO: 1246268 - RNA, 17 nt, Human
uguaauugaauauuauu

SEQ ID NO: 1246269 - RNA, 19 nt, Human
uguaauugaauauuauucc

SEQ ID NO: 1246270 - RNA, 14 nt, Human
uguacauauaagug

SEQ ID NO: 1246271 - RNA, 21 nt, Human
uguacauagugcuaacaugaa

SEQ ID NO: 1246272 - RNA, 18 nt, Human
uguacauaguuauuuauu

SEQ ID NO: 1246273 - RNA, 19 nt, Human
uguacauagugcuaacaug

SEQ ID NO: 1246274 - RNA, 17 nt, Human
uguacauagugcuaaca

SEQ ID NO: 1246275 - RNA, 14 nt, Human
uguacauagugcua

SEQ ID NO: 1246276 - RNA, 17 nt, Human
uguacauaacugaaaau

SEQ ID NO: 1246277 - RNA, 18 nt, Human
uguacauaacugaaaaug

SEQ ID NO: 1246278 - RNA, 19 nt, Human
uguacauaacugaaaaugu

SEQ ID NO: 1246279 - RNA, 15 nt, Human
agguuggcucugcca

SEQ ID NO: 1246280 - RNA, 21 nt, Human
uguacauacccuggccgcccc

SEQ ID NO: 1246281 - RNA, 19 nt, Human
uguacaucuauuuuggauu

SEQ ID NO: 1246282 - RNA, 20 nt, Human
uguacaucuauuuuggauug

SEQ ID NO: 1246283 - RNA, 21 nt, Human
uguacaucuauuuuggauugu

SEQ ID NO: 1246284 - RNA, 23 nt, Human
uguacaucuauuuuggauuguau

SEQ ID NO: 1246285 - RNA, 22 nt, Human
uguacaaaaaaaucuuccaauu

SEQ ID NO: 1246286 - RNA, 13 nt, Human
uguacaaaauaaa

SEQ ID NO: 1246287 - RNA, 21 nt, Human
uguacaaaaaaaucuuccaau

SEQ ID NO: 1246288 - RNA, 17 nt, Human
uguacaaaaaaaucuuc

SEQ ID NO: 1246289 - RNA, 16 nt, Human
uguaauuguguggauu

SEQ ID NO: 1246290 - RNA, 20 nt, Human
uguaauuguguggauucuuu

SEQ ID NO: 1246291 - RNA, 21 nt, Human
uguaauuguguggauucuuua

SEQ ID NO: 1246292 - RNA, 15 nt, Human
uguaauuuuguguaa

SEQ ID NO: 1246293 - RNA, 16 nt, Human
uguaauuuuguguaag

SEQ ID NO: 1246294 - RNA, 20 nt, Human
uguaauuuuguguaagaaau

SEQ ID NO: 1246295 - RNA, 22 nt, Human
uguacaaaauaaacaaauaaca

SEQ ID NO: 1246296 - RNA, 17 nt, Human
uguacaaaauaaacaaa

SEQ ID NO: 1246297 - RNA, 13 nt, Human
uguacauaacuga

SEQ ID NO: 1246298 - RNA, 14 nt, Human
uguacauaacugaa

SEQ ID NO: 1246299 - RNA, 15 nt, Human
uguacauaacugaaa

SEQ ID NO: 1246300 - RNA, 18 nt, Human
ugggaaacaaaaggauaa

SEQ ID NO: 1246301 - RNA, 14 nt, Human
uggcuguuugagau

SEQ ID NO: 1246302 - RNA, 20 nt, Human
ugggaacaccauaggucacc

SEQ ID NO: 1246303 - RNA, 17 nt, Human
ugggaaaaauguaggag

SEQ ID NO: 1246304 - RNA, 16 nt, Human
ugggaaaaauguagga

SEQ ID NO: 1246305 - RNA, 18 nt, Human
ugggaaacuuggcucgaa

SEQ ID NO: 1246306 - RNA, 20 nt, Human
uggcugacuuacaucaugug

SEQ ID NO: 1246307 - RNA, 19 nt, Human
uggcugagauaugaacaua

SEQ ID NO: 1246308 - RNA, 14 nt, Human
uggcugugccucug

SEQ ID NO: 1246309 - RNA, 15 nt, Human
uggcugugccucugc

SEQ ID NO: 1246310 - RNA, 16 nt, Human
uggcugugccucugcc

SEQ ID NO: 1246311 - RNA, 17 nt, Human
uggcugugccucugccu

SEQ ID NO: 1246312 - RNA, 12 nt, Human
uggcugcagccu

SEQ ID NO: 1246313 - RNA, 13 nt, Human
uggcugcagccuc

SEQ ID NO: 1246314 - RNA, 15 nt, Human
uggcugcagccucag

SEQ ID NO: 1246315 - RNA, 16 nt, Human
uggcugcagccucagg

SEQ ID NO: 1246316 - RNA, 17 nt, Human
uggcugcagccucagga

SEQ ID NO: 1246317 - RNA, 20 nt, Human
uggcugcagccucaggacug

SEQ ID NO: 1246318 - RNA, 23 nt, Human
uggcugcagccucaggacuggga

SEQ ID NO: 1246319 - RNA, 14 nt, Human
uggcugcaggaauc

SEQ ID NO: 1246320 - RNA, 16 nt, Human
uggcugcaggaaucuu

SEQ ID NO: 1246321 - RNA, 19 nt, Human
uggcugcaggaaucuuuaa

SEQ ID NO: 1246322 - RNA, 17 nt, Human
uggcuguggcauccaga

SEQ ID NO: 1246323 - RNA, 14 nt, Human
uggcuguggcaggc

SEQ ID NO: 1246324 - RNA, 20 nt, Human
uggcuguggccuaaccugcc

SEQ ID NO: 1246325 - RNA, 22 nt, Human
uggcugugccucugccugucuc

SEQ ID NO: 1246326 - RNA, 18 nt, Human
uggcugugccucugccug

SEQ ID NO: 1246327 - RNA, 19 nt, Human
uggcugugccucugccugu

SEQ ID NO: 1246328 - RNA, 18 nt, Human
uggcuaagcaaaauguga

SEQ ID NO: 1246329 - RNA, 13 nt, Human
aggcuccccuucu

SEQ ID NO: 1246330 - RNA, 14 nt, Human
uggcuaaccaagag

SEQ ID NO: 1246331 - RNA, 13 nt, Human
aggcuccugccac

SEQ ID NO: 1246332 - RNA, 15 nt, Human
aggcucccagggaca

SEQ ID NO: 1246333 - RNA, 15 nt, Human
aggcuccagagggca

SEQ ID NO: 1246334 - RNA, 16 nt, Human
aggcuccagagggcac

SEQ ID NO: 1246335 - RNA, 17 nt, Human
uggcuaacuuacaaaga

SEQ ID NO: 1246336 - RNA, 20 nt, Human
uggcuaacuuacaaagauuc

SEQ ID NO: 1246337 - RNA, 14 nt, Human
uggcuacucugugc

SEQ ID NO: 1246338 - RNA, 15 nt, Human
uggcuacucugugcc

SEQ ID NO: 1246339 - RNA, 16 nt, Human
uggcuacucugugcca

SEQ ID NO: 1246340 - RNA, 17 nt, Human
uggcuacucugugccag

SEQ ID NO: 1246341 - RNA, 18 nt, Human
uggcuacucugugccaga

SEQ ID NO: 1246342 - RNA, 19 nt, Human
uggcuacucugugccagag

SEQ ID NO: 1246343 - RNA, 20 nt, Human
uggcuacucugugccagagc

SEQ ID NO: 1246344 - RNA, 21 nt, Human
uggcuacucugugccagagcc

SEQ ID NO: 1246345 - RNA, 22 nt, Human
uggcuacucugugccagagccu

SEQ ID NO: 1246346 - RNA, 23 nt, Human
uggcuacucugugccagagccug

SEQ ID NO: 1246347 - RNA, 24 nt, Human
uggcuacucugugccagagccugg

SEQ ID NO: 1246348 - RNA, 22 nt, Human
uggcuauagaugucuuuuccca

SEQ ID NO: 1246349 - RNA, 19 nt, Human
uggcucacaugguuuacau

SEQ ID NO: 1246350 - RNA, 17 nt, Human
uggcucacacucgacau

SEQ ID NO: 1246351 - RNA, 17 nt, Human
uggcucacgccuguaau

SEQ ID NO: 1246352 - RNA, 22 nt, Human
uggcucacucagcacuuggccc

SEQ ID NO: 1246353 - RNA, 17 nt, Human
uggcucacucagcacuu

SEQ ID NO: 1246354 - RNA, 19 nt, Human
uggcuauagaugucuuuuc

SEQ ID NO: 1246355 - RNA, 17 nt, Human
uggcuauagaugucuuu

SEQ ID NO: 1246356 - RNA, 18 nt, Human
uggcuauagaugucuuuu

SEQ ID NO: 1246357 - RNA, 21 nt, Human
uggcucacacucgacaugaaa

SEQ ID NO: 1246358 - RNA, 12 nt, Human
uggcucagccag

SEQ ID NO: 1246359 - RNA, 13 nt, Human
uggcucagccagc

SEQ ID NO: 1246360 - RNA, 16 nt, Human
uggcucagccagcacu

SEQ ID NO: 1246361 - RNA, 18 nt, Human
uggcucacucagcacuug

SEQ ID NO: 1246362 - RNA, 19 nt, Human
uggcucuugauaccccccu

SEQ ID NO: 1246363 - RNA, 20 nt, Human
uggcucuugauaccccccuc

SEQ ID NO: 1246364 - RNA, 21 nt, Human
uggcucuugauaccccccucu

SEQ ID NO: 1246365 - RNA, 23 nt, Human
uggcucuugauaccccccucugu

SEQ ID NO: 1246366 - RNA, 16 nt, Human
uggcugaaaggaagcu

SEQ ID NO: 1246367 - RNA, 22 nt, Human
uggcugaaaggaagcugugcgu

SEQ ID NO: 1246368 - RNA, 16 nt, Human
uggcugaaauucuccu

SEQ ID NO: 1246369 - RNA, 18 nt, Human
uggcugaaauucuccugg

SEQ ID NO: 1246370 - RNA, 19 nt, Human
uggcugaaauucuccugga

SEQ ID NO: 1246371 - RNA, 20 nt, Human
uggcugaaauucuccuggag

SEQ ID NO: 1246372 - RNA, 21 nt, Human
uggcugaaauucuccuggagg

SEQ ID NO: 1246373 - RNA, 22 nt, Human
uggcugaaauucuccuggaggu

SEQ ID NO: 1246374 - RNA, 21 nt, Human
uggcugaauagcuucuccaaa

SEQ ID NO: 1246375 - RNA, 18 nt, Human
uggcugacaugaagcugu

SEQ ID NO: 1246376 - RNA, 21 nt, Human
aggcugggucgcccuggacug

SEQ ID NO: 1246377 - RNA, 20 nt, Human
aggcugggucgcccuggacu

SEQ ID NO: 1246378 - RNA, 18 nt, Human
aggcugggucgcccugga

SEQ ID NO: 1246379 - RNA, 15 nt, Human
aggcugggucgcccu

SEQ ID NO: 1246380 - RNA, 10 nt, Human
aggcuggguc

SEQ ID NO: 1246381 - RNA, 20 nt, Human
ugggaaccccuucauccucu

SEQ ID NO: 1246382 - RNA, 22 nt, Human
ugggaaccccuucauccucuga

SEQ ID NO: 1246383 - RNA, 10 nt, Human
aggcugggcc

SEQ ID NO: 1246384 - RNA, 12 nt, Human
aggcugggccau

SEQ ID NO: 1246385 - RNA, 18 nt, Human
aggcugggccauguccaa

SEQ ID NO: 1246386 - RNA, 20 nt, Human
aggcugggccauguccaaag

SEQ ID NO: 1246387 - RNA, 21 nt, Human
aggcugggccauguccaaaga

SEQ ID NO: 1246388 - RNA, 22 nt, Human
aggcugggccauguccaaagag

SEQ ID NO: 1246389 - RNA, 18 nt, Human
agggaaaacauuccaucc

SEQ ID NO: 1246390 - RNA, 16 nt, Human
agggaaaacauuccau

SEQ ID NO: 1246391 - RNA, 15 nt, Human
agggaaaacauucca

SEQ ID NO: 1246392 - RNA, 19 nt, Human
aggcuuuggauuugacauu

SEQ ID NO: 1246393 - RNA, 22 nt, Human
aggcuuuuguuuccuuuuucag

SEQ ID NO: 1246394 - RNA, 21 nt, Human
aggcuuuuuuaucaugugaaa

SEQ ID NO: 1246395 - RNA, 18 nt, Human
aggcuuuuuuaucaugug

SEQ ID NO: 1246396 - RNA, 15 nt, Human
aggcuuuuuuaucau

SEQ ID NO: 1246397 - RNA, 13 nt, Human
aggcuuucucuac

SEQ ID NO: 1246398 - RNA, 13 nt, Human
aggcuuugcccug

SEQ ID NO: 1246399 - RNA, 18 nt, Human
aggcuuugcccugcugcc

SEQ ID NO: 1246400 - RNA, 20 nt, Human
aggcuuugcccugcugcccu

SEQ ID NO: 1246401 - RNA, 14 nt, Human
aggcuuguugugcu

SEQ ID NO: 1246402 - RNA, 16 nt, Human
aggcuuguugugcuuu

SEQ ID NO: 1246403 - RNA, 15 nt, Human
aggcuuguugugcuu

SEQ ID NO: 1246404 - RNA, 22 nt, Human
aggcuuuaugauaauagauucu

SEQ ID NO: 1246405 - RNA, 23 nt, Human
aggcuuuaugauaauagauucuc

SEQ ID NO: 1246406 - RNA, 18 nt, Human
agggaaaauaggcaggaa

SEQ ID NO: 1246407 - RNA, 20 nt, Human
agggaaaauaggcaggaagc

SEQ ID NO: 1246408 - RNA, 18 nt, Human
agggaaaauuauuugcau

SEQ ID NO: 1246409 - RNA, 14 nt, Human
aggcuuaguuugug

SEQ ID NO: 1246410 - RNA, 15 nt, Human
aggcuuaguuugugu

SEQ ID NO: 1246411 - RNA, 19 nt, Human
aggcuucaaaauguuaucu

SEQ ID NO: 1246412 - RNA, 23 nt, Human
aggcuuccacguacugcagccuc

SEQ ID NO: 1246413 - RNA, 14 nt, Human
aggcuuccuucauu

SEQ ID NO: 1246414 - RNA, 16 nt, Human
aggcuuccuucauuuc

SEQ ID NO: 1246415 - RNA, 18 nt, Human
aggcuuccuucauuuccu

SEQ ID NO: 1246416 - RNA, 19 nt, Human
aggcuuccuucauuuccuc

SEQ ID NO: 1246417 - RNA, 23 nt, Human
aggcuucugguugaugccuguga

SEQ ID NO: 1246418 - RNA, 14 nt, Human
aggcuucugcuggg

SEQ ID NO: 1246419 - RNA, 17 nt, Human
aggcuucugcuggggcc

SEQ ID NO: 1246420 - RNA, 18 nt, Human
aggcuucugcuggggccu

SEQ ID NO: 1246421 - RNA, 19 nt, Human
aggcuucugcuggggccug

SEQ ID NO: 1246422 - RNA, 16 nt, Human
aggcuucucucugugg

SEQ ID NO: 1246423 - RNA, 15 nt, Human
aggcuucugagcagc

SEQ ID NO: 1246424 - RNA, 21 nt, Human
aggcuuccuucauuuccuccg

SEQ ID NO: 1246425 - RNA, 21 nt, Human
aggcuucugcuggggccuggg

SEQ ID NO: 1246426 - RNA, 15 nt, Human
aggcuugccugcagg

SEQ ID NO: 1246427 - RNA, 16 nt, Human
aggcuugccugcaggc

SEQ ID NO: 1246428 - RNA, 17 nt, Human
aggcuugccugcaggca

SEQ ID NO: 1246429 - RNA, 21 nt, Human
aggcuugggauuugcugugua

SEQ ID NO: 1246430 - RNA, 17 nt, Human
aggcuuggggcuggaga

SEQ ID NO: 1246431 - RNA, 14 nt, Human
aggcuugguuccuu

SEQ ID NO: 1246432 - RNA, 19 nt, Human
aggcuugguuccuucccaa

SEQ ID NO: 1246433 - RNA, 20 nt, Human
aggcuugguuccuucccaau

SEQ ID NO: 1246434 - RNA, 14 nt, Human
ugggcauucaaaug

SEQ ID NO: 1246435 - RNA, 19 nt, Human
ugggcaaugauggcaauuu

SEQ ID NO: 1246436 - RNA, 15 nt, Human
ugggcaauugucuga

SEQ ID NO: 1246437 - RNA, 14 nt, Human
ugggagggcagcag

SEQ ID NO: 1246438 - RNA, 17 nt, Human
ugggagggcagcagggc

SEQ ID NO: 1246439 - RNA, 18 nt, Human
ugggagggcagcagggcu

SEQ ID NO: 1246440 - RNA, 19 nt, Human
ugggagggcagcagggcua

SEQ ID NO: 1246441 - RNA, 22 nt, Human
ugggcaagcuggcggcuggggu

SEQ ID NO: 1246442 - RNA, 15 nt, Human
ugggcaaagccuagu

SEQ ID NO: 1246443 - RNA, 21 nt, Human
ugggcaaagccuagugaaggc

SEQ ID NO: 1246444 - RNA, 23 nt, Human
ugggaggcucuggagcccacugu

SEQ ID NO: 1246445 - RNA, 17 nt, Human
ugggaggcucuggagcc

SEQ ID NO: 1246446 - RNA, 14 nt, Human
ugggaggcucugga

SEQ ID NO: 1246447 - RNA, 20 nt, Human
ugggaggcucacccccuucu

SEQ ID NO: 1246448 - RNA, 22 nt, Human
ugggaggcucacccccuucucc

SEQ ID NO: 1246449 - RNA, 14 nt, Human
ugggaggcuccccu

SEQ ID NO: 1246450 - RNA, 15 nt, Human
ugggaggcuccccuu

SEQ ID NO: 1246451 - RNA, 19 nt, Human
ugggaggcugagaugggag

SEQ ID NO: 1246452 - RNA, 16 nt, Human
ugggagggaggcucag

SEQ ID NO: 1246453 - RNA, 17 nt, Human
ugggagggaggcucagg

SEQ ID NO: 1246454 - RNA, 22 nt, Human
ugggagggaggcucaggucccu

SEQ ID NO: 1246455 - RNA, 16 nt, Human
ugggagaaaugaaaaa

SEQ ID NO: 1246456 - RNA, 19 nt, Human
ugggagaaaucuggcuucu

SEQ ID NO: 1246457 - RNA, 15 nt, Human
ugggaggaugugaau

SEQ ID NO: 1246458 - RNA, 20 nt, Human
ugggaggccuuucccuaagc

SEQ ID NO: 1246459 - RNA, 13 nt, Human
ugggaggcucacc

SEQ ID NO: 1246460 - RNA, 21 nt, Human
agggagacuggguaggaaaga

SEQ ID NO: 1246461 - RNA, 13 nt, Human
agggagaagcucc

SEQ ID NO: 1246462 - RNA, 20 nt, Human
agggagacacuggccccuca

SEQ ID NO: 1246463 - RNA, 13 nt, Human
agggaaauuucag

SEQ ID NO: 1246464 - RNA, 22 nt, Human
agggaaagcccauaugcuacca

SEQ ID NO: 1246465 - RNA, 13 nt, Human
agggaaagcccau

SEQ ID NO: 1246466 - RNA, 13 nt, Human
agggaaaggccag

SEQ ID NO: 1246467 - RNA, 18 nt, Human
agggaaaggccagcacuc

SEQ ID NO: 1246468 - RNA, 22 nt, Human
agggacuucaggaucaaguccu

SEQ ID NO: 1246469 - RNA, 15 nt, Human
ugggagaaaugaaaa

SEQ ID NO: 1246470 - RNA, 14 nt, Human
ugggacuggccucu

SEQ ID NO: 1246471 - RNA, 16 nt, Human
ugggacuggccucugc

SEQ ID NO: 1246472 - RNA, 17 nt, Human
ugggacuagccuggcuu

SEQ ID NO: 1246473 - RNA, 19 nt, Human
ugggacuagccuggcuugg

SEQ ID NO: 1246474 - RNA, 21 nt, Human
agggagcggccggccagcccc

SEQ ID NO: 1246475 - RNA, 22 nt, Human
agggagcggccggccagccccu

SEQ ID NO: 1246476 - RNA, 14 nt, Human
agggagccuggccc

SEQ ID NO: 1246477 - RNA, 19 nt, Human
agggagcggccggccagcc

SEQ ID NO: 1246478 - RNA, 18 nt, Human
agggagcaucagugcccu

SEQ ID NO: 1246479 - RNA, 10 nt, Human
agggagccaa

SEQ ID NO: 1246480 - RNA, 11 nt, Human
agggagccaag

SEQ ID NO: 1246481 - RNA, 12 nt, Human
agggagccaagg

SEQ ID NO: 1246482 - RNA, 13 nt, Human
agggagccaaggg

SEQ ID NO: 1246483 - RNA, 14 nt, Human
agggagccaaggga

SEQ ID NO: 1246484 - RNA, 15 nt, Human
agggagccaagggau

SEQ ID NO: 1246485 - RNA, 16 nt, Human
agggagccaagggaug

SEQ ID NO: 1246486 - RNA, 17 nt, Human
agggagccaagggaugg

SEQ ID NO: 1246487 - RNA, 20 nt, Human
agggagccaagggauggaca

SEQ ID NO: 1246488 - RNA, 21 nt, Human
agggagccaagggauggacau

SEQ ID NO: 1246489 - RNA, 16 nt, Human
agggagccauguuuca

SEQ ID NO: 1246490 - RNA, 15 nt, Human
agggagccauuugag

SEQ ID NO: 1246491 - RNA, 17 nt, Human
agggagccauuugagag

SEQ ID NO: 1246492 - RNA, 22 nt, Human
agggcuguuauaaucuuucaca

SEQ ID NO: 1246493 - RNA, 18 nt, Human
agggcuguaacugccagg

SEQ ID NO: 1246494 - RNA, 20 nt, Human
agggcuguaacugccaggcu

SEQ ID NO: 1246495 - RNA, 18 nt, Human
agggcugucaucugugca

SEQ ID NO: 1246496 - RNA, 19 nt, Human
agggcugucaucugugcac

SEQ ID NO: 1246497 - RNA, 20 nt, Human
agggcugucaucugugcacu

SEQ ID NO: 1246498 - RNA, 19 nt, Human
agggcuguaacugccaggc

SEQ ID NO: 1246499 - RNA, 18 nt, Human
ugggcucaaccagaaaag

SEQ ID NO: 1246500 - RNA, 15 nt, Human
agggcuggaggccca

SEQ ID NO: 1246501 - RNA, 16 nt, Human
agggcuggaggcccag

SEQ ID NO: 1246502 - RNA, 17 nt, Human
agggcuggaggcccagg

SEQ ID NO: 1246503 - RNA, 18 nt, Human
agggcuggaggcccaggc

SEQ ID NO: 1246504 - RNA, 19 nt, Human
agggcuggaggcccaggcu

SEQ ID NO: 1246505 - RNA, 21 nt, Human
agggcuggaggcccaggcugg

SEQ ID NO: 1246506 - RNA, 17 nt, Human
agggcuggcucaauuga

SEQ ID NO: 1246507 - RNA, 12 nt, Human
agggcuggcugg

SEQ ID NO: 1246508 - RNA, 13 nt, Human
agggcuggcuggc

SEQ ID NO: 1246509 - RNA, 20 nt, Human
agggcuggcuggccucaccc

SEQ ID NO: 1246510 - RNA, 17 nt, Human
agggcuggcuggccuca

SEQ ID NO: 1246511 - RNA, 12 nt, Human
agggcugggagg

SEQ ID NO: 1246512 - RNA, 14 nt, Human
agggcugggaggaa

SEQ ID NO: 1246513 - RNA, 16 nt, Human
agggcugggaggaagg

SEQ ID NO: 1246514 - RNA, 18 nt, Human
agggcugggaggaaggac

SEQ ID NO: 1246515 - RNA, 14 nt, Human
ugggcucagugaag

SEQ ID NO: 1246516 - RNA, 19 nt, Human
ugggcucagugaaguugcu

SEQ ID NO: 1246517 - RNA, 11 nt, Human
ugggcucccug

SEQ ID NO: 1246518 - RNA, 15 nt, Human
ugggcucccugacug

SEQ ID NO: 1246519 - RNA, 19 nt, Human
ugggcucccugacugggag

SEQ ID NO: 1246520 - RNA, 21 nt, Human
ugggcuccggaggacucacca

SEQ ID NO: 1246521 - RNA, 13 nt, Human
ugggcuccuccag

SEQ ID NO: 1246522 - RNA, 15 nt, Human
ugggcuccuccaggg

SEQ ID NO: 1246523 - RNA, 23 nt, Human
ugggcuccuccagggugugugcu

SEQ ID NO: 1246524 - RNA, 18 nt, Human
ugggcuccgugugggaga

SEQ ID NO: 1246525 - RNA, 11 nt, Human
ugggcuccugg

SEQ ID NO: 1246526 - RNA, 12 nt, Human
ugggcuccugga

SEQ ID NO: 1246527 - RNA, 13 nt, Human
ugggcuccuggac

SEQ ID NO: 1246528 - RNA, 18 nt, Human
ugggcuccuggacccccc

SEQ ID NO: 1246529 - RNA, 21 nt, Human
ugggcucugaguaccccugcu

SEQ ID NO: 1246530 - RNA, 11 nt, Human
ugggcucugau

SEQ ID NO: 1246531 - RNA, 13 nt, Human
ugggcucugauga

SEQ ID NO: 1246532 - RNA, 14 nt, Human
ugggcucugaugaa

SEQ ID NO: 1246533 - RNA, 15 nt, Human
agggcuccuauucaa

SEQ ID NO: 1246534 - RNA, 15 nt, Human
agggcuccagccccu

SEQ ID NO: 1246535 - RNA, 20 nt, Human
agggcuccagccccucuugg

SEQ ID NO: 1246536 - RNA, 23 nt, Human
agggcuccagccccucuuggaga

SEQ ID NO: 1246537 - RNA, 11 nt, Human
agggcuccugc

SEQ ID NO: 1246538 - RNA, 12 nt, Human
agggcuccuggg

SEQ ID NO: 1246539 - RNA, 17 nt, Human
agggcugagcucucugu

SEQ ID NO: 1246540 - RNA, 16 nt, Human
agggcugagcugggga

SEQ ID NO: 1246541 - RNA, 18 nt, Human
agggcuccuugugggccu

SEQ ID NO: 1246542 - RNA, 20 nt, Human
agggcugccuucuggccuug

SEQ ID NO: 1246543 - RNA, 20 nt, Human
agggcugcuucccugaagcu

SEQ ID NO: 1246544 - RNA, 19 nt, Human
agggccacaucccacugcc

SEQ ID NO: 1246545 - RNA, 17 nt, Human
agggcccagagcccagc

SEQ ID NO: 1246546 - RNA, 18 nt, Human
agggcccagagcccagcu

SEQ ID NO: 1246547 - RNA, 19 nt, Human
agggcccagagcccagcuc

SEQ ID NO: 1246548 - RNA, 20 nt, Human
agggcccagagcccagcucc

SEQ ID NO: 1246549 - RNA, 21 nt, Human
agggcccagagcccagcucca

SEQ ID NO: 1246550 - RNA, 18 nt, Human
agggccccucuccccagg

SEQ ID NO: 1246551 - RNA, 12 nt, Human
agggccccucuc

SEQ ID NO: 1246552 - RNA, 13 nt, Human
agggccccucucc

SEQ ID NO: 1246553 - RNA, 14 nt, Human
agggcuccagcccc

SEQ ID NO: 1246554 - RNA, 18 nt, Human
agggccacauagaugcug

SEQ ID NO: 1246555 - RNA, 19 nt, Human
agggccccucacccugccu

SEQ ID NO: 1246556 - RNA, 20 nt, Human
agggcagaccacauugcuuu

SEQ ID NO: 1246557 - RNA, 17 nt, Human
agggcacugguggcccg

SEQ ID NO: 1246558 - RNA, 17 nt, Human
agggaguguucccuauc

SEQ ID NO: 1246559 - RNA, 12 nt, Human
agggcagagcug

SEQ ID NO: 1246560 - RNA, 13 nt, Human
agggcagagcugg

SEQ ID NO: 1246561 - RNA, 14 nt, Human
agggcagagcuggu

SEQ ID NO: 1246562 - RNA, 15 nt, Human
agggcagagcuggug

SEQ ID NO: 1246563 - RNA, 17 nt, Human
agggcagagcuggugcg

SEQ ID NO: 1246564 - RNA, 16 nt, Human
agggcagagcuggugc

SEQ ID NO: 1246565 - RNA, 12 nt, Human
agggcagaguga

SEQ ID NO: 1246566 - RNA, 19 nt, Human
agggcagagugagacccag

SEQ ID NO: 1246567 - RNA, 14 nt, Human
agggcaguucgcag

SEQ ID NO: 1246568 - RNA, 16 nt, Human
agggcaguucgcagcc

SEQ ID NO: 1246569 - RNA, 17 nt, Human
agggcaguucgcagcca

SEQ ID NO: 1246570 - RNA, 18 nt, Human
agggcaguucgcagccac

SEQ ID NO: 1246571 - RNA, 19 nt, Human
agggcaguucgcagccacc

SEQ ID NO: 1246572 - RNA, 20 nt, Human
agggcaguucgcagccaccc

SEQ ID NO: 1246573 - RNA, 21 nt, Human
agggcaguucgcagccacccu

SEQ ID NO: 1246574 - RNA, 13 nt, Human
agggccaaagaac

SEQ ID NO: 1246575 - RNA, 23 nt, Human
agggccaaagaaccaaagaagaa

SEQ ID NO: 1246576 - RNA, 16 nt, Human
agggccaaagaaccaa

SEQ ID NO: 1246577 - RNA, 21 nt, Human
agggccaagcccagcacugcu

SEQ ID NO: 1246578 - RNA, 23 nt, Human
agggcaguucgcagccacccuga

SEQ ID NO: 1246579 - RNA, 16 nt, Human
agggcauaaauuauug

SEQ ID NO: 1246580 - RNA, 22 nt, Human
agggcaguucgcagccacccug

SEQ ID NO: 1246581 - RNA, 13 nt, Human
agggagggccugg

SEQ ID NO: 1246582 - RNA, 15 nt, Human
agggagggccugggc

SEQ ID NO: 1246583 - RNA, 23 nt, Human
ugggccaacaaagaacacuaacu

SEQ ID NO: 1246584 - RNA, 16 nt, Human
ugggccaacucaccug

SEQ ID NO: 1246585 - RNA, 13 nt, Human
agggagggagugg

SEQ ID NO: 1246586 - RNA, 12 nt, Human
agggagggcaga

SEQ ID NO: 1246587 - RNA, 16 nt, Human
agggagggcagagcug

SEQ ID NO: 1246588 - RNA, 17 nt, Human
agggagggcagagcugg

SEQ ID NO: 1246589 - RNA, 18 nt, Human
agggagggcagagcuggu

SEQ ID NO: 1246590 - RNA, 19 nt, Human
agggagggcagagcuggug

SEQ ID NO: 1246591 - RNA, 20 nt, Human
agggagggcagagcuggugc

SEQ ID NO: 1246592 - RNA, 21 nt, Human
agggagggcagagcuggugcg

SEQ ID NO: 1246593 - RNA, 12 nt, Human
agggagggcucu

SEQ ID NO: 1246594 - RNA, 13 nt, Human
agggagggcucug

SEQ ID NO: 1246595 - RNA, 14 nt, Human
agggagggcucuga

SEQ ID NO: 1246596 - RNA, 15 nt, Human
agggagggcucugag

SEQ ID NO: 1246597 - RNA, 16 nt, Human
agggagggcucugagg

SEQ ID NO: 1246598 - RNA, 17 nt, Human
agggagggcucugaggc

SEQ ID NO: 1246599 - RNA, 18 nt, Human
agggagggcucugaggcg

SEQ ID NO: 1246600 - RNA, 20 nt, Human
agggagggcucugaggcgcc

SEQ ID NO: 1246601 - RNA, 15 nt, Human
agggagggcugucau

SEQ ID NO: 1246602 - RNA, 13 nt, Human
agggagucugcca

SEQ ID NO: 1246603 - RNA, 14 nt, Human
agggagucugccag

SEQ ID NO: 1246604 - RNA, 23 nt, Human
uggaagugacuuuggcugcaugc

SEQ ID NO: 1246605 - RNA, 17 nt, Human
uggaagugacuuuggcu

SEQ ID NO: 1246606 - RNA, 15 nt, Human
uggaagugacuuugg

SEQ ID NO: 1246607 - RNA, 18 nt, Human
uggaagugaaaacuuugu

SEQ ID NO: 1246608 - RNA, 19 nt, Human
uggaagugaaaacuuugua

SEQ ID NO: 1246609 - RNA, 14 nt, Human
uggaagugcuaauu

SEQ ID NO: 1246610 - RNA, 19 nt, Human
uggaaguggggcgggcuuc

SEQ ID NO: 1246611 - RNA, 19 nt, Human
aggaguuucguuuucaaaa

SEQ ID NO: 1246612 - RNA, 14 nt, Human
aggaguuuggagga

SEQ ID NO: 1246613 - RNA, 16 nt, Human
ugcugcccauguuuca

SEQ ID NO: 1246614 - RNA, 18 nt, Human
ugcugccccaucagugcu

SEQ ID NO: 1246615 - RNA, 19 nt, Human
ugcugccccaucagugcuc

SEQ ID NO: 1246616 - RNA, 21 nt, Human
ugcugccccaucagugcuccc

SEQ ID NO: 1246617 - RNA, 17 nt, Human
ugcugcccauguuucaa

SEQ ID NO: 1246618 - RNA, 23 nt, Human
ugcugcccucccccuccucucca

SEQ ID NO: 1246619 - RNA, 16 nt, Human
uggaacacagaacuga

SEQ ID NO: 1246620 - RNA, 20 nt, Human
uggaacacagaacugaacug

SEQ ID NO: 1246621 - RNA, 14 nt, Human
uggaacaccaggcu

SEQ ID NO: 1246622 - RNA, 15 nt, Human
uggaacaccaggcug

SEQ ID NO: 1246623 - RNA, 15 nt, Human
uggaacacggccaca

SEQ ID NO: 1246624 - RNA, 17 nt, Human
uggaacacggccacauc

SEQ ID NO: 1246625 - RNA, 20 nt, Human
uggaacacuagacaagccag

SEQ ID NO: 1246626 - RNA, 22 nt, Human
uggaacacuagacaagccagaa

SEQ ID NO: 1246627 - RNA, 16 nt, Human
uggaagcuaauuugca

SEQ ID NO: 1246628 - RNA, 17 nt, Human
uggaagcuaauuugcau

SEQ ID NO: 1246629 - RNA, 18 nt, Human
uggaagcuaauuugcauu

SEQ ID NO: 1246630 - RNA, 21 nt, Human
uggaacacuagacaagccaga

SEQ ID NO: 1246631 - RNA, 19 nt, Human
uggaagcuagacacaugaa

SEQ ID NO: 1246632 - RNA, 23 nt, Human
uggaagcuagacacaugaaggua

SEQ ID NO: 1246633 - RNA, 20 nt, Human
uggaagcuagacacaugaag

SEQ ID NO: 1246634 - RNA, 17 nt, Human
uggaagcugcccugccc

SEQ ID NO: 1246635 - RNA, 18 nt, Human
uggaagcugcccugccca

SEQ ID NO: 1246636 - RNA, 17 nt, Human
uggaaguccaauguggc

SEQ ID NO: 1246637 - RNA, 17 nt, Human
uggacaaaauggaauac

SEQ ID NO: 1246638 - RNA, 14 nt, Human
uggacaaaaugacu

SEQ ID NO: 1246639 - RNA, 19 nt, Human
uggacaaaacaagaaagac

SEQ ID NO: 1246640 - RNA, 15 nt, Human
uggacaaagaaccuu

SEQ ID NO: 1246641 - RNA, 15 nt, Human
uggacaaaucacaua

SEQ ID NO: 1246642 - RNA, 21 nt, Human
uggacaaaucacauauuuuaa

SEQ ID NO: 1246643 - RNA, 23 nt, Human
uggacaaaucacauauuuuaaaa

SEQ ID NO: 1246644 - RNA, 14 nt, Human
uggacaaaauggaa

SEQ ID NO: 1246645 - RNA, 23 nt, Human
uggaauuuugcaaagauuuaauc

SEQ ID NO: 1246646 - RNA, 15 nt, Human
uggaauuuugcaaag

SEQ ID NO: 1246647 - RNA, 22 nt, Human
uggaauuuugcaaagauuuaau

SEQ ID NO: 1246648 - RNA, 16 nt, Human
uggacaccugcccugc

SEQ ID NO: 1246649 - RNA, 15 nt, Human
uggacaccugcccug

SEQ ID NO: 1246650 - RNA, 14 nt, Human
uggacaccugcccu

SEQ ID NO: 1246651 - RNA, 13 nt, Human
uggacaccugccc

SEQ ID NO: 1246652 - RNA, 12 nt, Human
uggacaccugcc

SEQ ID NO: 1246653 - RNA, 11 nt, Human
uggacaccugc

SEQ ID NO: 1246654 - RNA, 10 nt, Human
uggacaccug

SEQ ID NO: 1246655 - RNA, 22 nt, Human
uggacaaaucacauauuuuaaa

SEQ ID NO: 1246656 - RNA, 17 nt, Human
uggaauuugccugcugg

SEQ ID NO: 1246657 - RNA, 14 nt, Human
uggaauuugaaaca

SEQ ID NO: 1246658 - RNA, 16 nt, Human
uggaauuugccugcug

SEQ ID NO: 1246659 - RNA, 16 nt, Human
aggcaacuugggaacu

SEQ ID NO: 1246660 - RNA, 18 nt, Human
aggaucuauuuuuggagg

SEQ ID NO: 1246661 - RNA, 19 nt, Human
aggaucuauuuuuggaggu

SEQ ID NO: 1246662 - RNA, 20 nt, Human
aggaucuauuuuuggagguu

SEQ ID NO: 1246663 - RNA, 21 nt, Human
aggaucuauuuuuggagguuu

SEQ ID NO: 1246664 - RNA, 17 nt, Human
aggaucucaccaggcag

SEQ ID NO: 1246665 - RNA, 23 nt, Human
aggaucucaccaggcagccucug

SEQ ID NO: 1246666 - RNA, 18 nt, Human
aggaucucaccaggcagc

SEQ ID NO: 1246667 - RNA, 22 nt, Human
aggaugcuaacaucuaaaaaua

SEQ ID NO: 1246668 - RNA, 23 nt, Human
aggaugcuaacaucuaaaaauag

SEQ ID NO: 1246669 - RNA, 13 nt, Human
aggaugcuuggga

SEQ ID NO: 1246670 - RNA, 12 nt, Human
aggauuggggaa

SEQ ID NO: 1246671 - RNA, 21 nt, Human
aggauuggggaagagagccug

SEQ ID NO: 1246672 - RNA, 17 nt, Human
aggauuuauuuaaaaua

SEQ ID NO: 1246673 - RNA, 19 nt, Human
aggauuucaugauuucauu

SEQ ID NO: 1246674 - RNA, 20 nt, Human
aggauuucaugauuucauuu

SEQ ID NO: 1246675 - RNA, 20 nt, Human
aggauuugguccgucauaac

SEQ ID NO: 1246676 - RNA, 17 nt, Human
uggagccgaggccuacc

SEQ ID NO: 1246677 - RNA, 12 nt, Human
uggagccgaggc

SEQ ID NO: 1246678 - RNA, 12 nt, Human
uggagcugagca

SEQ ID NO: 1246679 - RNA, 21 nt, Human
uggagcuucauggcagaaggc

SEQ ID NO: 1246680 - RNA, 21 nt, Human
uggaggaaaaccaagccgugg

SEQ ID NO: 1246681 - RNA, 23 nt, Human
uggaggaaaaccaagccguggcu

SEQ ID NO: 1246682 - RNA, 12 nt, Human
aggcaauuagac

SEQ ID NO: 1246683 - RNA, 21 nt, Human
aggcaauuagacacuuuggaa

SEQ ID NO: 1246684 - RNA, 16 nt, Human
aggcacaugucagcaa

SEQ ID NO: 1246685 - RNA, 17 nt, Human
aggcaccaaaagaagua

SEQ ID NO: 1246686 - RNA, 20 nt, Human
aggcaccaaaagaaguaaaa

SEQ ID NO: 1246687 - RNA, 18 nt, Human
aggcaccaaaagaaguaa

SEQ ID NO: 1246688 - RNA, 11 nt, Human
aggcaccagga

SEQ ID NO: 1246689 - RNA, 12 nt, Human
aggcaccaggaa

SEQ ID NO: 1246690 - RNA, 13 nt, Human
aggcaccaggaag

SEQ ID NO: 1246691 - RNA, 23 nt, Human
uggagcccacuguacuugcucuu

SEQ ID NO: 1246692 - RNA, 19 nt, Human
uggagcccacuguacuugc

SEQ ID NO: 1246693 - RNA, 16 nt, Human
uggagcccacuguacu

SEQ ID NO: 1246694 - RNA, 16 nt, Human
uggagaagaacugaaa

SEQ ID NO: 1246695 - RNA, 17 nt, Human
uggagaagacccucccc

SEQ ID NO: 1246696 - RNA, 23 nt, Human
uggacaccugcccugcccugcca

SEQ ID NO: 1246697 - RNA, 18 nt, Human
uggacaccugcccugccc

SEQ ID NO: 1246698 - RNA, 17 nt, Human
uggacaccugcccugcc

SEQ ID NO: 1246699 - RNA, 15 nt, Human
uggaccccccuuuca

SEQ ID NO: 1246700 - RNA, 17 nt, Human
uggaccccccuuucaca

SEQ ID NO: 1246701 - RNA, 20 nt, Human
uggaccccccuuucacaggc

SEQ ID NO: 1246702 - RNA, 22 nt, Human
uggaccccccuuucacaggcag

SEQ ID NO: 1246703 - RNA, 23 nt, Human
uggaccccccuuucacaggcagc

SEQ ID NO: 1246704 - RNA, 22 nt, Human
uggacccguucaugggggaggg

SEQ ID NO: 1246705 - RNA, 21 nt, Human
uggacccguucaugggggagg

SEQ ID NO: 1246706 - RNA, 12 nt, Human
uggaccccugca

SEQ ID NO: 1246707 - RNA, 13 nt, Human
uggaccccugcau

SEQ ID NO: 1246708 - RNA, 16 nt, Human
uggaccccugcauugg

SEQ ID NO: 1246709 - RNA, 20 nt, Human
uggacccguucaugggggag

SEQ ID NO: 1246710 - RNA, 19 nt, Human
aggcaguucaaagcaggau

SEQ ID NO: 1246711 - RNA, 18 nt, Human
aggcaguucaaagcagga

SEQ ID NO: 1246712 - RNA, 24 nt, Human
aggcaguuaccauuaaaccaucuc

SEQ ID NO: 1246713 - RNA, 18 nt, Human
aggcaguuaccauuaaac

SEQ ID NO: 1246714 - RNA, 21 nt, Human
aggcaguuaccauuaaaccau

SEQ ID NO: 1246715 - RNA, 22 nt, Human
aggcaguuaccauuaaaccauc

SEQ ID NO: 1246716 - RNA, 23 nt, Human
aggcaguuaccauuaaaccaucu

SEQ ID NO: 1246717 - RNA, 14 nt, Human
aggcagggugcagu

SEQ ID NO: 1246718 - RNA, 20 nt, Human
aggcagcucuaaaugucaau

SEQ ID NO: 1246719 - RNA, 15 nt, Human
aggcagccucugggg

SEQ ID NO: 1246720 - RNA, 16 nt, Human
aggcagccucuggggg

SEQ ID NO: 1246721 - RNA, 22 nt, Human
aggcagccucugggggguggcc

SEQ ID NO: 1246722 - RNA, 21 nt, Human
aggcagccucugggggguggc

SEQ ID NO: 1246723 - RNA, 23 nt, Human
aggcagccgugggccccacccuc

SEQ ID NO: 1246724 - RNA, 13 nt, Human
aggcagccucugg

SEQ ID NO: 1246725 - RNA, 14 nt, Human
aggcagccucuggg

SEQ ID NO: 1246726 - RNA, 14 nt, Human
aggcaccaggaagc

SEQ ID NO: 1246727 - RNA, 15 nt, Human
aggcaccaggaagcc

SEQ ID NO: 1246728 - RNA, 16 nt, Human
aggcaccaggaagccg

SEQ ID NO: 1246729 - RNA, 22 nt, Human
aggcagggaggaggcagagaag

SEQ ID NO: 1246730 - RNA, 17 nt, Human
aggcaggagaaucacuu

SEQ ID NO: 1246731 - RNA, 23 nt, Human
aggcagggaacauggggaggagg

SEQ ID NO: 1246732 - RNA, 16 nt, Human
aggcagggagggccug

SEQ ID NO: 1246733 - RNA, 20 nt, Human
aggcaggaguuucguuuuca

SEQ ID NO: 1246734 - RNA, 21 nt, Human
aggcaggaccuucgggcugug

SEQ ID NO: 1246735 - RNA, 22 nt, Human
aggcaggaccuucgggcugugc

SEQ ID NO: 1246736 - RNA, 23 nt, Human
aggcaggaccuucgggcugugcc

SEQ ID NO: 1246737 - RNA, 18 nt, Human
uggcaucaucucagcuca

SEQ ID NO: 1246738 - RNA, 20 nt, Human
uggcauccagagucccugcc

SEQ ID NO: 1246739 - RNA, 21 nt, Human
uggcauccagagucccugccu

SEQ ID NO: 1246740 - RNA, 22 nt, Human
uggcauccagagucccugccug

SEQ ID NO: 1246741 - RNA, 16 nt, Human
aggccugacugccaag

SEQ ID NO: 1246742 - RNA, 18 nt, Human
aggccuggacuuuccugc

SEQ ID NO: 1246743 - RNA, 19 nt, Human
aggccuggacuuuccugca

SEQ ID NO: 1246744 - RNA, 22 nt, Human
aggccuggacuuuccugcaacu

SEQ ID NO: 1246745 - RNA, 20 nt, Human
aggccguggcugcuguggga

SEQ ID NO: 1246746 - RNA, 15 nt, Human
aggccguggcugcug

SEQ ID NO: 1246747 - RNA, 19 nt, Human
aggccuaauucuaugccug

SEQ ID NO: 1246748 - RNA, 22 nt, Human
aggccuaauucuaugccugucu

SEQ ID NO: 1246749 - RNA, 16 nt, Human
aggccuaccccgcaga

SEQ ID NO: 1246750 - RNA, 19 nt, Human
aggccuaccccgcagacac

SEQ ID NO: 1246751 - RNA, 22 nt, Human
aggccuaccccgcagacaccuu

SEQ ID NO: 1246752 - RNA, 14 nt, Human
aggccuagacucug

SEQ ID NO: 1246753 - RNA, 16 nt, Human
aggccuagacucuguc

SEQ ID NO: 1246754 - RNA, 17 nt, Human
aggccuagacucugucu

SEQ ID NO: 1246755 - RNA, 21 nt, Human
aggccuagacucugucuaccu

SEQ ID NO: 1246756 - RNA, 15 nt, Human
aggccuagaggccug

SEQ ID NO: 1246757 - RNA, 17 nt, Human
aggccuaggaggguccu

SEQ ID NO: 1246758 - RNA, 18 nt, Human
aggccuaggaggguccuc

SEQ ID NO: 1246759 - RNA, 21 nt, Human
aggccuaggaggguccucuga

SEQ ID NO: 1246760 - RNA, 15 nt, Human
aggccuaggauucua

SEQ ID NO: 1246761 - RNA, 16 nt, Human
aggccuaggauucuaa

SEQ ID NO: 1246762 - RNA, 17 nt, Human
aggccuaggauucuaaa

SEQ ID NO: 1246763 - RNA, 15 nt, Human
aggccuaguccugcg

SEQ ID NO: 1246764 - RNA, 17 nt, Human
aggccuaguccugcgaa

SEQ ID NO: 1246765 - RNA, 17 nt, Human
aggccugaaagaggcug

SEQ ID NO: 1246766 - RNA, 21 nt, Human
aggccugaaagaggcugaggc

SEQ ID NO: 1246767 - RNA, 23 nt, Human
aggccugaaagaggcugaggccu

SEQ ID NO: 1246768 - RNA, 14 nt, Human
aggcccgagcagcu

SEQ ID NO: 1246769 - RNA, 18 nt, Human
aggccgggaaaaagccca

SEQ ID NO: 1246770 - RNA, 14 nt, Human
aggccgggaaaaag

SEQ ID NO: 1246771 - RNA, 17 nt, Human
aggccgugacgucuggg

SEQ ID NO: 1246772 - RNA, 20 nt, Human
aggccgugacgucugggugg

SEQ ID NO: 1246773 - RNA, 21 nt, Human
aggccgugacgucuggguggc

SEQ ID NO: 1246774 - RNA, 22 nt, Human
aggccgugacgucuggguggcc

SEQ ID NO: 1246775 - RNA, 13 nt, Human
uggcagcaacaau

SEQ ID NO: 1246776 - RNA, 20 nt, Human
uggcagcaacggcacagcua

SEQ ID NO: 1246777 - RNA, 15 nt, Human
uggcagauguaggag

SEQ ID NO: 1246778 - RNA, 17 nt, Human
uggcagauguaggaggg

SEQ ID NO: 1246779 - RNA, 18 nt, Human
uggcagauguaggaggga

SEQ ID NO: 1246780 - RNA, 19 nt, Human
uggcagauguaggagggac

SEQ ID NO: 1246781 - RNA, 20 nt, Human
uggcagauguaggagggacu

SEQ ID NO: 1246782 - RNA, 17 nt, Human
uggcagccgugccuuca

SEQ ID NO: 1246783 - RNA, 23 nt, Human
uggcaccagacacccaggacuua

SEQ ID NO: 1246784 - RNA, 22 nt, Human
uggcacagccuggcuguggccu

SEQ ID NO: 1246785 - RNA, 14 nt, Human
uggcacaggacaug

SEQ ID NO: 1246786 - RNA, 23 nt, Human
uggcacagagguagucucacugc

SEQ ID NO: 1246787 - RNA, 15 nt, Human
uggcacagggcagug

SEQ ID NO: 1246788 - RNA, 21 nt, Human
uggcacaggaguguccucuuc

SEQ ID NO: 1246789 - RNA, 16 nt, Human
uggcacaggcccccuu

SEQ ID NO: 1246790 - RNA, 16 nt, Human
uggcacagggcagugg

SEQ ID NO: 1246791 - RNA, 20 nt, Human
uggcaccagacacccaggac

SEQ ID NO: 1246792 - RNA, 21 nt, Human
uggcaccagacacccaggacu

SEQ ID NO: 1246793 - RNA, 20 nt, Human
aggcauccuuccucacacca

SEQ ID NO: 1246794 - RNA, 18 nt, Human
aggcauccuuccucacac

SEQ ID NO: 1246795 - RNA, 18 nt, Human
uggcagccgugccuucag

SEQ ID NO: 1246796 - RNA, 19 nt, Human
uggcagccgugccuucagc

SEQ ID NO: 1246797 - RNA, 20 nt, Human
uggcagccgugccuucagcu

SEQ ID NO: 1246798 - RNA, 21 nt, Human
uggcagccgugccuucagcuc

SEQ ID NO: 1246799 - RNA, 22 nt, Human
uggcagccgugccuucagcucu

SEQ ID NO: 1246800 - RNA, 14 nt, Human
aggccagagccaag

SEQ ID NO: 1246801 - RNA, 14 nt, Human
aggccagagcccac

SEQ ID NO: 1246802 - RNA, 15 nt, Human
aggccagagcccacu

SEQ ID NO: 1246803 - RNA, 18 nt, Human
aggccagaggcccccagc

SEQ ID NO: 1246804 - RNA, 17 nt, Human
aggccagagcccacucc

SEQ ID NO: 1246805 - RNA, 14 nt, Human
aggccauucuuucc

SEQ ID NO: 1246806 - RNA, 15 nt, Human
aggccauucuuuccc

SEQ ID NO: 1246807 - RNA, 20 nt, Human
aggccauuccccgucucugg

SEQ ID NO: 1246808 - RNA, 13 nt, Human
aggccauuauugu

SEQ ID NO: 1246809 - RNA, 12 nt, Human
uggcauguguuu

SEQ ID NO: 1246810 - RNA, 20 nt, Human
uggcauguuagcccuuccuc

SEQ ID NO: 1246811 - RNA, 19 nt, Human
uggcauuacagcuggagaa

SEQ ID NO: 1246812 - RNA, 17 nt, Human
uggcauuagaauuauuu

SEQ ID NO: 1246813 - RNA, 12 nt, Human
uggcccugcccu

SEQ ID NO: 1246814 - RNA, 15 nt, Human
uggcccugcaaaagg

SEQ ID NO: 1246815 - RNA, 21 nt, Human
uggcccucuccccugcccccu

SEQ ID NO: 1246816 - RNA, 16 nt, Human
uggcccucuccccugc

SEQ ID NO: 1246817 - RNA, 17 nt, Human
uggcccucuccccugcc

SEQ ID NO: 1246818 - RNA, 18 nt, Human
uggcccucuccccugccc

SEQ ID NO: 1246819 - RNA, 19 nt, Human
uggcccucuccccugcccc

SEQ ID NO: 1246820 - RNA, 11 nt, Human
uggcccagccu

SEQ ID NO: 1246821 - RNA, 12 nt, Human
uggcccagccuu

SEQ ID NO: 1246822 - RNA, 13 nt, Human
uggcccagccuuu

SEQ ID NO: 1246823 - RNA, 21 nt, Human
uggccucugcugauccuccca

SEQ ID NO: 1246824 - RNA, 15 nt, Human
uggccgaguccaagc

SEQ ID NO: 1246825 - RNA, 20 nt, Human
uggcccuuccuggacagcug

SEQ ID NO: 1246826 - RNA, 12 nt, Human
uggccucugcuu

SEQ ID NO: 1246827 - RNA, 13 nt, Human
uggcccugcccug

SEQ ID NO: 1246828 - RNA, 21 nt, Human
uggcccuuaugacugccaaga

SEQ ID NO: 1246829 - RNA, 13 nt, Human
uggcccuuccugg

SEQ ID NO: 1246830 - RNA, 15 nt, Human
uggcccuuccuggac

SEQ ID NO: 1246831 - RNA, 16 nt, Human
uggcccuuccuggaca

SEQ ID NO: 1246832 - RNA, 17 nt, Human
uggcccuuccuggacag

SEQ ID NO: 1246833 - RNA, 18 nt, Human
uggcccuuccuggacagc

SEQ ID NO: 1246834 - RNA, 21 nt, Human
uggcccuuccuggacagcugu

SEQ ID NO: 1246835 - RNA, 19 nt, Human
uggcccuugcuuaccucuc

SEQ ID NO: 1246836 - RNA, 14 nt, Human
uggccucugcuuuc

SEQ ID NO: 1246837 - RNA, 22 nt, Human
uggccugaucagaccacggcuc

SEQ ID NO: 1246838 - RNA, 15 nt, Human
uggccugcaaacugg

SEQ ID NO: 1246839 - RNA, 16 nt, Human
uggccugcaaacuggg

SEQ ID NO: 1246840 - RNA, 17 nt, Human
uggccugcaaacuggga

SEQ ID NO: 1246841 - RNA, 18 nt, Human
uggccugcaaacugggaa

SEQ ID NO: 1246842 - RNA, 19 nt, Human
uggccugcaaacugggaac

SEQ ID NO: 1246843 - RNA, 23 nt, Human
uggccugcaaacugggaaccccu

SEQ ID NO: 1246844 - RNA, 20 nt, Human
uggccugcaaacugggaacc

SEQ ID NO: 1246845 - RNA, 20 nt, Human
uggccugcuaaggucuugga

SEQ ID NO: 1246846 - RNA, 13 nt, Human
uggccuggacugu

SEQ ID NO: 1246847 - RNA, 15 nt, Human
uggccuguagaguug

SEQ ID NO: 1246848 - RNA, 18 nt, Human
uggccuguagaguugcug

SEQ ID NO: 1246849 - RNA, 16 nt, Human
uggccugugucacuca

SEQ ID NO: 1246850 - RNA, 19 nt, Human
uggccuguguucuuccugg

SEQ ID NO: 1246851 - RNA, 19 nt, Human
aggccuugcggcuccucag

SEQ ID NO: 1246852 - RNA, 20 nt, Human
aggccuugcggcuccucagg

SEQ ID NO: 1246853 - RNA, 23 nt, Human
aggccuugcggcuccucagggac

SEQ ID NO: 1246854 - RNA, 22 nt, Human
aggccuugcggcuccucaggga

SEQ ID NO: 1246855 - RNA, 18 nt, Human
aggcgaagcguuguccuc

SEQ ID NO: 1246856 - RNA, 16 nt, Human
aggccuuuuggaaugu

SEQ ID NO: 1246857 - RNA, 19 nt, Human
aggcgagaagggcugcuuc

SEQ ID NO: 1246858 - RNA, 18 nt, Human
aggcgagaagggcugcuu

SEQ ID NO: 1246859 - RNA, 14 nt, Human
aggccuuucccuaa

SEQ ID NO: 1246860 - RNA, 15 nt, Human
aggccuuucccuaag

SEQ ID NO: 1246861 - RNA, 16 nt, Human
aggccuuucccuaagc

SEQ ID NO: 1246862 - RNA, 18 nt, Human
aggccuuucccuaagcca

SEQ ID NO: 1246863 - RNA, 20 nt, Human
aggccuuucccuaagccagc

SEQ ID NO: 1246864 - RNA, 14 nt, Human
aggcgccccuuccc

SEQ ID NO: 1246865 - RNA, 21 nt, Human
aggcgccccaacccguggagg

SEQ ID NO: 1246866 - RNA, 22 nt, Human
aggcgccccaacccguggaggc

SEQ ID NO: 1246867 - RNA, 21 nt, Human
aggcgcacugugacccccagc

SEQ ID NO: 1246868 - RNA, 22 nt, Human
aggcgcacugugacccccagcu

SEQ ID NO: 1246869 - RNA, 16 nt, Human
aggcuauuauuuucac

SEQ ID NO: 1246870 - RNA, 18 nt, Human
aggcuauuauuuucacug

SEQ ID NO: 1246871 - RNA, 19 nt, Human
aggcuauuauuuucacugu

SEQ ID NO: 1246872 - RNA, 11 nt, Human
aggcuauuugu

SEQ ID NO: 1246873 - RNA, 16 nt, Human
aggcuauuuguaaauc

SEQ ID NO: 1246874 - RNA, 17 nt, Human
aggcuauuuguaaaucu

SEQ ID NO: 1246875 - RNA, 21 nt, Human
aggcuauuuguaaaucugcca

SEQ ID NO: 1246876 - RNA, 22 nt, Human
aggcuauuuguaaaucugccac

SEQ ID NO: 1246877 - RNA, 23 nt, Human
aggcucaaacaaugacaaagcag

SEQ ID NO: 1246878 - RNA, 22 nt, Human
aggcuccaccccauccaguuca

SEQ ID NO: 1246879 - RNA, 13 nt, Human
aggcuccagaggg

SEQ ID NO: 1246880 - RNA, 14 nt, Human
aggcuccagagggc

SEQ ID NO: 1246881 - RNA, 22 nt, Human
aggcuccacuuggucugugaga

SEQ ID NO: 1246882 - RNA, 21 nt, Human
aggcuccacuuggucugugag

SEQ ID NO: 1246883 - RNA, 17 nt, Human
aggcuccacuuggucug

SEQ ID NO: 1246884 - RNA, 11 nt, Human
aggcuccacuu

SEQ ID NO: 1246885 - RNA, 18 nt, Human
aggcucagaggguguccu

SEQ ID NO: 1246886 - RNA, 14 nt, Human
aggcucacugguca

SEQ ID NO: 1246887 - RNA, 15 nt, Human
aggcucaaacaauga

SEQ ID NO: 1246888 - RNA, 16 nt, Human
aggcucacccccuucu

SEQ ID NO: 1246889 - RNA, 19 nt, Human
aggcucacccccuucucca

SEQ ID NO: 1246890 - RNA, 21 nt, Human
aggcucacccccuucuccauc

SEQ ID NO: 1246891 - RNA, 23 nt, Human
aggcucacccccuucuccaucca

SEQ ID NO: 1246892 - RNA, 19 nt, Human
aggcucagaggguguccug

SEQ ID NO: 1246893 - RNA, 20 nt, Human
aggcucagaggguguccugc

SEQ ID NO: 1246894 - RNA, 14 nt, Human
aggcucaggcaggg

SEQ ID NO: 1246895 - RNA, 21 nt, Human
aggcucaggcaggggccucca

SEQ ID NO: 1246896 - RNA, 10 nt, Human
aggcucaggu

SEQ ID NO: 1246897 - RNA, 16 nt, Human
aggcucaggucccugg

SEQ ID NO: 1246898 - RNA, 20 nt, Human
aggcucaggcaggggccucc

SEQ ID NO: 1246899 - RNA, 20 nt, Human
agcuggggccaggcuggguc

SEQ ID NO: 1246900 - RNA, 22 nt, Human
agcuggggcuuugauguuccuu

SEQ ID NO: 1246901 - RNA, 14 nt, Human
agcuggggugcagg

SEQ ID NO: 1246902 - RNA, 15 nt, Human
agcuggggugcaggg

SEQ ID NO: 1246903 - RNA, 18 nt, Human
agcuggggugcagggaug

SEQ ID NO: 1246904 - RNA, 22 nt, Human
agcuggggugcagggauguggg

SEQ ID NO: 1246905 - RNA, 17 nt, Human
agcugucuuuuggagga

SEQ ID NO: 1246906 - RNA, 19 nt, Human
agcugucuuuuggaggacg

SEQ ID NO: 1246907 - RNA, 17 nt, Human
agcugugaccucucccc

SEQ ID NO: 1246908 - RNA, 14 nt, Human
agcugugaccugcu

SEQ ID NO: 1246909 - RNA, 15 nt, Human
agcugugaccugcug

SEQ ID NO: 1246910 - RNA, 16 nt, Human
agcugugaccugcuga

SEQ ID NO: 1246911 - RNA, 17 nt, Human
agcugugaccugcugag

SEQ ID NO: 1246912 - RNA, 18 nt, Human
agcugugaccugcugagc

SEQ ID NO: 1246913 - RNA, 19 nt, Human
agcugugaccugcugagcu

SEQ ID NO: 1246914 - RNA, 20 nt, Human
agcugugaccugcugagcuc

SEQ ID NO: 1246915 - RNA, 22 nt, Human
agcugugaccugcugagcucug

SEQ ID NO: 1246916 - RNA, 23 nt, Human
agcugugaccugcugagcucuga

SEQ ID NO: 1246917 - RNA, 19 nt, Human
agcugugacuucuauuuua

SEQ ID NO: 1246918 - RNA, 19 nt, Human
agcugugaguucucccugu

SEQ ID NO: 1246919 - RNA, 10 nt, Human
agcugugcag

SEQ ID NO: 1246920 - RNA, 12 nt, Human
agcugugcaggu

SEQ ID NO: 1246921 - RNA, 18 nt, Human
agcugugcagguggggag

SEQ ID NO: 1246922 - RNA, 19 nt, Human
agcugugcagguggggaga

SEQ ID NO: 1246923 - RNA, 21 nt, Human
ugccuuagaaccuuucuuaca

SEQ ID NO: 1246924 - RNA, 17 nt, Human
ugccuugucacgccaga

SEQ ID NO: 1246925 - RNA, 14 nt, Human
ugccuuagaaccuu

SEQ ID NO: 1246926 - RNA, 17 nt, Human
ugccuuagaaccuuucu

SEQ ID NO: 1246927 - RNA, 15 nt, Human
ugccuuacucuucuu

SEQ ID NO: 1246928 - RNA, 18 nt, Human
ugccuuacucuucuugaa

SEQ ID NO: 1246929 - RNA, 19 nt, Human
ugccuuacucuucuugaaa

SEQ ID NO: 1246930 - RNA, 17 nt, Human
ugccuuuauuuccacug

SEQ ID NO: 1246931 - RNA, 16 nt, Human
ugccuuucaggaucua

SEQ ID NO: 1246932 - RNA, 13 nt, Human
ugccuuguuucau

SEQ ID NO: 1246933 - RNA, 20 nt, Human
ugccuuguuuuuuguuuguu

SEQ ID NO: 1246934 - RNA, 16 nt, Human
ugccuuguuuuuuguu

SEQ ID NO: 1246935 - RNA, 22 nt, Human
ugccuuuuuauuuuuguuuuua

SEQ ID NO: 1246936 - RNA, 20 nt, Human
ugccuuuuuucuguauaaau

SEQ ID NO: 1246937 - RNA, 22 nt, Human
ugccuuuuuucuguauaaaugu

SEQ ID NO: 1246938 - RNA, 23 nt, Human
ugccuuuuuucuguauaaauguc

SEQ ID NO: 1246939 - RNA, 14 nt, Human
ugccuuuuuugauc

SEQ ID NO: 1246940 - RNA, 16 nt, Human
ugcgagagaugugugu

SEQ ID NO: 1246941 - RNA, 17 nt, Human
ugcgagagauguguguu

SEQ ID NO: 1246942 - RNA, 23 nt, Human
ugcgagagauguguguugauacu

SEQ ID NO: 1246943 - RNA, 15 nt, Human
ugcgacuuucugccu

SEQ ID NO: 1246944 - RNA, 16 nt, Human
ugcgacuuucugccug

SEQ ID NO: 1246945 - RNA, 17 nt, Human
ugcgacuuucugccugg

SEQ ID NO: 1246946 - RNA, 18 nt, Human
ugcgacuuucugccugga

SEQ ID NO: 1246947 - RNA, 21 nt, Human
ugcgacuuucugccuggagug

SEQ ID NO: 1246948 - RNA, 12 nt, Human
ugcgagagaugu

SEQ ID NO: 1246949 - RNA, 13 nt, Human
ugcgagagaugug

SEQ ID NO: 1246950 - RNA, 14 nt, Human
ugcgagagaugugu

SEQ ID NO: 1246951 - RNA, 15 nt, Human
ugcgagagaugugug

SEQ ID NO: 1246952 - RNA, 19 nt, Human
agcugccucuucccucuuc

SEQ ID NO: 1246953 - RNA, 15 nt, Human
agcugccucuucccu

SEQ ID NO: 1246954 - RNA, 23 nt, Human
agcugccuccccucuccuuccug

SEQ ID NO: 1246955 - RNA, 20 nt, Human
agcugccuccccucuccuuc

SEQ ID NO: 1246956 - RNA, 21 nt, Human
ugccucucugcaggucccuaa

SEQ ID NO: 1246957 - RNA, 12 nt, Human
ugccucucuagg

SEQ ID NO: 1246958 - RNA, 15 nt, Human
ugccucucuaggacc

SEQ ID NO: 1246959 - RNA, 12 nt, Human
ugccucugagag

SEQ ID NO: 1246960 - RNA, 22 nt, Human
ugccucugagagcaucaggccu

SEQ ID NO: 1246961 - RNA, 11 nt, Human
ugccucugagg

SEQ ID NO: 1246962 - RNA, 20 nt, Human
agcugccuggaagagcagcc

SEQ ID NO: 1246963 - RNA, 21 nt, Human
agcugccuggaagagcagccc

SEQ ID NO: 1246964 - RNA, 13 nt, Human
agcugccuggacc

SEQ ID NO: 1246965 - RNA, 14 nt, Human
agcugccuggaccc

SEQ ID NO: 1246966 - RNA, 15 nt, Human
agcugccugguauau

SEQ ID NO: 1246967 - RNA, 15 nt, Human
agcugccuggacccg

SEQ ID NO: 1246968 - RNA, 14 nt, Human
agcuggacccugac

SEQ ID NO: 1246969 - RNA, 15 nt, Human
agcuggacccugacc

SEQ ID NO: 1246970 - RNA, 17 nt, Human
agcuggacccugaccag

SEQ ID NO: 1246971 - RNA, 15 nt, Human
agcuggaccucacca

SEQ ID NO: 1246972 - RNA, 16 nt, Human
agcuggaccucaccaa

SEQ ID NO: 1246973 - RNA, 17 nt, Human
agcuggggccaggcugg

SEQ ID NO: 1246974 - RNA, 14 nt, Human
agcuggggaccugg

SEQ ID NO: 1246975 - RNA, 15 nt, Human
agcuggggaucccuc

SEQ ID NO: 1246976 - RNA, 22 nt, Human
agcuggggaucccuccccccca

SEQ ID NO: 1246977 - RNA, 13 nt, Human
agcugggccuggu

SEQ ID NO: 1246978 - RNA, 17 nt, Human
agcugggcuaaguaaau

SEQ ID NO: 1246979 - RNA, 15 nt, Human
agcugggcucugcaa

SEQ ID NO: 1246980 - RNA, 15 nt, Human
agcugggccuggucu

SEQ ID NO: 1246981 - RNA, 22 nt, Human
agcugggauuacaggcuccugc

SEQ ID NO: 1246982 - RNA, 23 nt, Human
agcugggauuacaggcuccugcc

SEQ ID NO: 1246983 - RNA, 18 nt, Human
agcugggauuacaggcuc

SEQ ID NO: 1246984 - RNA, 21 nt, Human
agcugggauuacaggcuccug

SEQ ID NO: 1246985 - RNA, 22 nt, Human
agcugggaucacauguggacuu

SEQ ID NO: 1246986 - RNA, 15 nt, Human
agcuggagaagaccc

SEQ ID NO: 1246987 - RNA, 20 nt, Human
ugccucucugcaggucccua

SEQ ID NO: 1246988 - RNA, 19 nt, Human
ugccucucugcaggucccu

SEQ ID NO: 1246989 - RNA, 18 nt, Human
ugccucucugcagguccc

SEQ ID NO: 1246990 - RNA, 16 nt, Human
ugccucucugcagguc

SEQ ID NO: 1246991 - RNA, 12 nt, Human
ugccucucuaca

SEQ ID NO: 1246992 - RNA, 14 nt, Human
agcugccaagagug

SEQ ID NO: 1246993 - RNA, 11 nt, Human
agcugcacuga

SEQ ID NO: 1246994 - RNA, 15 nt, Human
agcugcauuccgcag

SEQ ID NO: 1246995 - RNA, 18 nt, Human
agcugcauuccgcagccc

SEQ ID NO: 1246996 - RNA, 15 nt, Human
ugcccuuucugggca

SEQ ID NO: 1246997 - RNA, 20 nt, Human
ugcccuuguuuggggcagga

SEQ ID NO: 1246998 - RNA, 23 nt, Human
ugcccuuguuuggggcaggagua

SEQ ID NO: 1246999 - RNA, 24 nt, Human
ugcccuuguuuggggcaggaguag

SEQ ID NO: 1247000 - RNA, 16 nt, Human
ugccggggcagccccc

SEQ ID NO: 1247001 - RNA, 16 nt, Human
ugccucauuuuuuucc

SEQ ID NO: 1247002 - RNA, 21 nt, Human
ugccucauuuuuuuccuugca

SEQ ID NO: 1247003 - RNA, 19 nt, Human
agcugauggagaaggaagg

SEQ ID NO: 1247004 - RNA, 16 nt, Human
agcugauuaaaugaca

SEQ ID NO: 1247005 - RNA, 17 nt, Human
agcugauggagaaggaa

SEQ ID NO: 1247006 - RNA, 16 nt, Human
agcugauggagaagga

SEQ ID NO: 1247007 - RNA, 15 nt, Human
agcugauggagaagg

SEQ ID NO: 1247008 - RNA, 14 nt, Human
agcugauggagaag

SEQ ID NO: 1247009 - RNA, 23 nt, Human
agcucugcuauuaggccagcaag

SEQ ID NO: 1247010 - RNA, 12 nt, Human
agcucuguauca

SEQ ID NO: 1247011 - RNA, 22 nt, Human
agcucuguaucaggacccagag

SEQ ID NO: 1247012 - RNA, 23 nt, Human
agcucuguaucaggacccagagg

SEQ ID NO: 1247013 - RNA, 14 nt, Human
agcucuucuccauc

SEQ ID NO: 1247014 - RNA, 18 nt, Human
agcucuucuuaaaguauu

SEQ ID NO: 1247015 - RNA, 21 nt, Human
agcucucaguugcagcccugc

SEQ ID NO: 1247016 - RNA, 17 nt, Human
agcucucaguugcagcc

SEQ ID NO: 1247017 - RNA, 19 nt, Human
agcucuauuaugaauguga

SEQ ID NO: 1247018 - RNA, 22 nt, Human
agcucuaucaccaaggagccaa

SEQ ID NO: 1247019 - RNA, 16 nt, Human
agcucuauuaugaaug

SEQ ID NO: 1247020 - RNA, 21 nt, Human
ugcccucauggccccucugac

SEQ ID NO: 1247021 - RNA, 18 nt, Human
ugcccucauuuuauguca

SEQ ID NO: 1247022 - RNA, 18 nt, Human
agcucuccggucucucuc

SEQ ID NO: 1247023 - RNA, 17 nt, Human
agcucuggacagcccca

SEQ ID NO: 1247024 - RNA, 14 nt, Human
aggaaauauuuauu

SEQ ID NO: 1247025 - RNA, 18 nt, Human
aggaaauauuuauuuuaa

SEQ ID NO: 1247026 - RNA, 24 nt, Human
aggaaagcgccuccaacccuagca

SEQ ID NO: 1247027 - RNA, 13 nt, Human
aggaaagcaagaa

SEQ ID NO: 1247028 - RNA, 15 nt, Human
ugcugagucccaggc

SEQ ID NO: 1247029 - RNA, 18 nt, Human
ugcugagucccaggcuga

SEQ ID NO: 1247030 - RNA, 22 nt, Human
ugcugagucccaggcugagccu

SEQ ID NO: 1247031 - RNA, 15 nt, Human
ugcucuuagcugucu

SEQ ID NO: 1247032 - RNA, 12 nt, Human
ugcucuuagcug

SEQ ID NO: 1247033 - RNA, 13 nt, Human
ugcucugaucccu

SEQ ID NO: 1247034 - RNA, 14 nt, Human
ugcucugaucccuc

SEQ ID NO: 1247035 - RNA, 16 nt, Human
ugcucugaucccucua

SEQ ID NO: 1247036 - RNA, 19 nt, Human
ugcucugaucccucuacag

SEQ ID NO: 1247037 - RNA, 18 nt, Human
ugcucugaugaagaggag

SEQ ID NO: 1247038 - RNA, 19 nt, Human
ugcucugaugaagaggagu

SEQ ID NO: 1247039 - RNA, 16 nt, Human
ugcucugaugcaucag

SEQ ID NO: 1247040 - RNA, 17 nt, Human
ugcucugaugcaucaga

SEQ ID NO: 1247041 - RNA, 14 nt, Human
ugcucugauuuauc

SEQ ID NO: 1247042 - RNA, 18 nt, Human
ugcucugaugcaucagaa

SEQ ID NO: 1247043 - RNA, 17 nt, Human
ugcuaucauuauucgua

SEQ ID NO: 1247044 - RNA, 21 nt, Human
ugcucuguuaauaaucucaca

SEQ ID NO: 1247045 - RNA, 13 nt, Human
ugcucuuaauugc

SEQ ID NO: 1247046 - RNA, 15 nt, Human
ugcucuuaauugcca

SEQ ID NO: 1247047 - RNA, 16 nt, Human
ugcucuuaauugccac

SEQ ID NO: 1247048 - RNA, 21 nt, Human
ugcucuuaauugccaccucua

SEQ ID NO: 1247049 - RNA, 14 nt, Human
ugcucuguagccua

SEQ ID NO: 1247050 - RNA, 23 nt, Human
ugcucugguuguuucuguuccaa

SEQ ID NO: 1247051 - RNA, 18 nt, Human
ugcucugguuguuucugu

SEQ ID NO: 1247052 - RNA, 19 nt, Human
ugcucugguuguuucuguu

SEQ ID NO: 1247053 - RNA, 21 nt, Human
ugcucugguuguuucuguucc

SEQ ID NO: 1247054 - RNA, 23 nt, Human
aggaaugaaauccugcuucagug

SEQ ID NO: 1247055 - RNA, 23 nt, Human
aggaauugacccacaagaaauga

SEQ ID NO: 1247056 - RNA, 19 nt, Human
aggaauugacccacaagaa

SEQ ID NO: 1247057 - RNA, 19 nt, Human
aggaaucugugggucuggg

SEQ ID NO: 1247058 - RNA, 22 nt, Human
aggaaucugugggucugggagu

SEQ ID NO: 1247059 - RNA, 22 nt, Human
aggaaucuuuaaaagaugcuuu

SEQ ID NO: 1247060 - RNA, 16 nt, Human
aggaaucuuuaaaaga

SEQ ID NO: 1247061 - RNA, 17 nt, Human
aggaagagaaggagcag

SEQ ID NO: 1247062 - RNA, 16 nt, Human
aggaagagaaggagca

SEQ ID NO: 1247063 - RNA, 14 nt, Human
aggaagagaaggag

SEQ ID NO: 1247064 - RNA, 12 nt, Human
aggaagagaagg

SEQ ID NO: 1247065 - RNA, 22 nt, Human
aggaauuuuauuuuuuucugaa

SEQ ID NO: 1247066 - RNA, 14 nt, Human
aggaauuuucuuug

SEQ ID NO: 1247067 - RNA, 16 nt, Human
aggaauuuucuuugug

SEQ ID NO: 1247068 - RNA, 14 nt, Human
aggacaaccauucc

SEQ ID NO: 1247069 - RNA, 22 nt, Human
ugcugccacacuucaggcucuu

SEQ ID NO: 1247070 - RNA, 14 nt, Human
ugcugccacugagg

SEQ ID NO: 1247071 - RNA, 15 nt, Human
ugcugccacacuuca

SEQ ID NO: 1247072 - RNA, 16 nt, Human
ugcugccacacuucag

SEQ ID NO: 1247073 - RNA, 19 nt, Human
ugcugccacacuucaggcu

SEQ ID NO: 1247074 - RNA, 14 nt, Human
ugcugcccagccuc

SEQ ID NO: 1247075 - RNA, 16 nt, Human
ugcugcccagccucca

SEQ ID NO: 1247076 - RNA, 21 nt, Human
agcuuauugucuagugaaacu

SEQ ID NO: 1247077 - RNA, 20 nt, Human
agcuuauguuaacugacaag

SEQ ID NO: 1247078 - RNA, 15 nt, Human
agcuuaugaaaagaa

SEQ ID NO: 1247079 - RNA, 16 nt, Human
agcuuaugaaaagaau

SEQ ID NO: 1247080 - RNA, 19 nt, Human
agcuuagcuuuagaaacag

SEQ ID NO: 1247081 - RNA, 18 nt, Human
agcuuauacgaaauaauu

SEQ ID NO: 1247082 - RNA, 20 nt, Human
agcuuauacgaaauaauugu

SEQ ID NO: 1247083 - RNA, 23 nt, Human
agcuuaucuacuuccaaacuaau

SEQ ID NO: 1247084 - RNA, 12 nt, Human
agcuugggaaug

SEQ ID NO: 1247085 - RNA, 14 nt, Human
agcuugggaaugga

SEQ ID NO: 1247086 - RNA, 20 nt, Human
agcuugggaaaggugguguu

SEQ ID NO: 1247087 - RNA, 12 nt, Human
agcuuucugaac

SEQ ID NO: 1247088 - RNA, 15 nt, Human
agcuuucugaacagc

SEQ ID NO: 1247089 - RNA, 16 nt, Human
agcuuucugaacagcu

SEQ ID NO: 1247090 - RNA, 17 nt, Human
agcuuucugaacagcug

SEQ ID NO: 1247091 - RNA, 18 nt, Human
agcuuucugaacagcugg

SEQ ID NO: 1247092 - RNA, 19 nt, Human
agcuuucugaacagcuggu

SEQ ID NO: 1247093 - RNA, 20 nt, Human
agcuuucugaacagcuggug

SEQ ID NO: 1247094 - RNA, 21 nt, Human
agcuuucugaacagcuggugu

SEQ ID NO: 1247095 - RNA, 22 nt, Human
agcuuucugaacagcuggugua

SEQ ID NO: 1247096 - RNA, 17 nt, Human
agcuuaaaauacaagac

SEQ ID NO: 1247097 - RNA, 18 nt, Human
agcuuaaaauacaagacu

SEQ ID NO: 1247098 - RNA, 20 nt, Human
agcuuaaaauacaagacugc

SEQ ID NO: 1247099 - RNA, 22 nt, Human
agcuuagaguuggccauauuua

SEQ ID NO: 1247100 - RNA, 13 nt, Human
agcuuagauuuca

SEQ ID NO: 1247101 - RNA, 15 nt, Human
agcuuagauuucaua

SEQ ID NO: 1247102 - RNA, 16 nt, Human
agcuuagauuucauag

SEQ ID NO: 1247103 - RNA, 18 nt, Human
agcuuagcuuuagaaaca

SEQ ID NO: 1247104 - RNA, 14 nt, Human
agcuguuuucuucu

SEQ ID NO: 1247105 - RNA, 23 nt, Human
agcuguuuuguugacauucugaa

SEQ ID NO: 1247106 - RNA, 14 nt, Human
agcuguuuuguuga

SEQ ID NO: 1247107 - RNA, 12 nt, Human
agcuuaaaacuu

SEQ ID NO: 1247108 - RNA, 13 nt, Human
agcuuaaaacuuu

SEQ ID NO: 1247109 - RNA, 14 nt, Human
agcuuaaaacuuug

SEQ ID NO: 1247110 - RNA, 22 nt, Human
agcuuaaaacuuugaaguuagc

SEQ ID NO: 1247111 - RNA, 16 nt, Human
agcuuaaaacuuugaa

SEQ ID NO: 1247112 - RNA, 13 nt, Human
agcuuaaaauaca

SEQ ID NO: 1247113 - RNA, 14 nt, Human
agcuuaaaauacaa

SEQ ID NO: 1247114 - RNA, 15 nt, Human
agcuuaaaauacaag

SEQ ID NO: 1247115 - RNA, 21 nt, Human
agcuuagcuuuagaaacagug

SEQ ID NO: 1247116 - RNA, 21 nt, Human
agcuuauacgaaauaauuguu

SEQ ID NO: 1247117 - RNA, 17 nt, Human
aggaaaaggccuggggu

SEQ ID NO: 1247118 - RNA, 15 nt, Human
agcuuugacucagga

SEQ ID NO: 1247119 - RNA, 16 nt, Human
agcuuugacucaggag

SEQ ID NO: 1247120 - RNA, 20 nt, Human
agcuuugacucaggagccug

SEQ ID NO: 1247121 - RNA, 21 nt, Human
agcuuugacucaggagccugu

SEQ ID NO: 1247122 - RNA, 13 nt, Human
aggaaaaggccug

SEQ ID NO: 1247123 - RNA, 14 nt, Human
aggaaaaggccugg

SEQ ID NO: 1247124 - RNA, 15 nt, Human
aggaaaaggccuggg

SEQ ID NO: 1247125 - RNA, 16 nt, Human
aggaaaaggccugggg

SEQ ID NO: 1247126 - RNA, 18 nt, Human
aggaaaaggccuggggug

SEQ ID NO: 1247127 - RNA, 15 nt, Human
aggaaacgagacuuu

SEQ ID NO: 1247128 - RNA, 13 nt, Human
aggaaagaaaaca

SEQ ID NO: 1247129 - RNA, 12 nt, Human
aggaaagaaaac

SEQ ID NO: 1247130 - RNA, 22 nt, Human
aggaaacuccugugaccacaac

SEQ ID NO: 1247131 - RNA, 20 nt, Human
aggaaacgagacuuuccauu

SEQ ID NO: 1247132 - RNA, 21 nt, Human
aggaaacucugcauucuagua

SEQ ID NO: 1247133 - RNA, 13 nt, Human
aggaaagagaacu

SEQ ID NO: 1247134 - RNA, 19 nt, Human
aggaaagagaacuuccaga

SEQ ID NO: 1247135 - RNA, 16 nt, Human
ugcuaguaauuggaaa

SEQ ID NO: 1247136 - RNA, 21 nt, Human
ugcuauaacuauguugauaaa

SEQ ID NO: 1247137 - RNA, 11 nt, Human
ugcuaguguga

SEQ ID NO: 1247138 - RNA, 13 nt, Human
ugcuauacugcau

SEQ ID NO: 1247139 - RNA, 17 nt, Human
aggaaagaggaagcaaa

SEQ ID NO: 1247140 - RNA, 14 nt, Human
ugcuaguaauugga

SEQ ID NO: 1247141 - RNA, 15 nt, Human
ugcauaauggucaga

SEQ ID NO: 1247142 - RNA, 17 nt, Human
ugcauaauguuucugga

SEQ ID NO: 1247143 - RNA, 18 nt, Human
ugcauaauguuucuggau

SEQ ID NO: 1247144 - RNA, 22 nt, Human
ugcauaacguauaaaagccugu

SEQ ID NO: 1247145 - RNA, 17 nt, Human
ugcauaacaauuccucu

SEQ ID NO: 1247146 - RNA, 18 nt, Human
ugcauaacaauuccucua

SEQ ID NO: 1247147 - RNA, 19 nt, Human
ugcagugagccgagauugu

SEQ ID NO: 1247148 - RNA, 11 nt, Human
ugcauaaaaug

SEQ ID NO: 1247149 - RNA, 20 nt, Human
ugcaggucccuaauaaagcu

SEQ ID NO: 1247150 - RNA, 19 nt, Human
ugcaggucccuaauaaagc

SEQ ID NO: 1247151 - RNA, 18 nt, Human
ugcaggucccuaauaaag

SEQ ID NO: 1247152 - RNA, 14 nt, Human
ugcagcuuguagcc

SEQ ID NO: 1247153 - RNA, 16 nt, Human
ugcagcuuguagccag

SEQ ID NO: 1247154 - RNA, 17 nt, Human
ugcagcuuguagccagc

SEQ ID NO: 1247155 - RNA, 18 nt, Human
ugcagcuuguagccagcc

SEQ ID NO: 1247156 - RNA, 19 nt, Human
ugcagcuuguagccagccg

SEQ ID NO: 1247157 - RNA, 20 nt, Human
ugcagcuuguagccagccgg

SEQ ID NO: 1247158 - RNA, 21 nt, Human
ugcaggucccuaauaaagcug

SEQ ID NO: 1247159 - RNA, 21 nt, Human
ugcagcuuguagccagccggg

SEQ ID NO: 1247160 - RNA, 14 nt, Human
ugcagugaacuucc

SEQ ID NO: 1247161 - RNA, 19 nt, Human
ugcagugaacuuccagaca

SEQ ID NO: 1247162 - RNA, 14 nt, Human
ugcagugagccgag

SEQ ID NO: 1247163 - RNA, 19 nt, Human
agccugagcgacagugaga

SEQ ID NO: 1247164 - RNA, 22 nt, Human
ugcagcccugcugcugccugcc

SEQ ID NO: 1247165 - RNA, 14 nt, Human
ugcagccgcugagc

SEQ ID NO: 1247166 - RNA, 17 nt, Human
ugcagccggcacagggu

SEQ ID NO: 1247167 - RNA, 18 nt, Human
ugcagccggcacaggguc

SEQ ID NO: 1247168 - RNA, 19 nt, Human
ugcagccggcacagggucu

SEQ ID NO: 1247169 - RNA, 19 nt, Human
ugcagcugagagaaaauaa

SEQ ID NO: 1247170 - RNA, 20 nt, Human
ugcagcuguggcagaguuac

SEQ ID NO: 1247171 - RNA, 22 nt, Human
ugcagcuguggcagaguuacag

SEQ ID NO: 1247172 - RNA, 15 nt, Human
ugcagcuguuuuguu

SEQ ID NO: 1247173 - RNA, 18 nt, Human
ugcagcuguuuuguugac

SEQ ID NO: 1247174 - RNA, 23 nt, Human
ugcagcuguuuuguugacauucu

SEQ ID NO: 1247175 - RNA, 21 nt, Human
ugcagcuguuuuguugacauu

SEQ ID NO: 1247176 - RNA, 16 nt, Human
agccugagcaacucuu

SEQ ID NO: 1247177 - RNA, 21 nt, Human
agccugagcaacucuugauua

SEQ ID NO: 1247178 - RNA, 18 nt, Human
agccugagcgacagugag

SEQ ID NO: 1247179 - RNA, 19 nt, Human
agccugacccucaucuuuc

SEQ ID NO: 1247180 - RNA, 19 nt, Human
agccugaucaccugcccug

SEQ ID NO: 1247181 - RNA, 18 nt, Human
agccugaucaccugcccu

SEQ ID NO: 1247182 - RNA, 14 nt, Human
agccugcaggaucu

SEQ ID NO: 1247183 - RNA, 22 nt, Human
agccugcaggaucucaccaggc

SEQ ID NO: 1247184 - RNA, 23 nt, Human
agccugcaggaucucaccaggca

SEQ ID NO: 1247185 - RNA, 15 nt, Human
agccugcauugagcu

SEQ ID NO: 1247186 - RNA, 22 nt, Human
agccugcauugagcuugcaugc

SEQ ID NO: 1247187 - RNA, 23 nt, Human
agccugcauugagcuugcaugcu

SEQ ID NO: 1247188 - RNA, 12 nt, Human
agccugcccucc

SEQ ID NO: 1247189 - RNA, 13 nt, Human
ugcauacucauua

SEQ ID NO: 1247190 - RNA, 23 nt, Human
ugcaucuccacuuggcauuagcu

SEQ ID NO: 1247191 - RNA, 13 nt, Human
ugcaucucccaga

SEQ ID NO: 1247192 - RNA, 18 nt, Human
ugcaucucccagauaaug

SEQ ID NO: 1247193 - RNA, 17 nt, Human
ugcaucuggagagaaca

SEQ ID NO: 1247194 - RNA, 21 nt, Human
ugcaucuggagagaacagguu

SEQ ID NO: 1247195 - RNA, 18 nt, Human
agcccuucuuuccacaga

SEQ ID NO: 1247196 - RNA, 19 nt, Human
agcccuucuuuccacagaa

SEQ ID NO: 1247197 - RNA, 23 nt, Human
agccguuuguuccccaagacauu

SEQ ID NO: 1247198 - RNA, 18 nt, Human
agccuaaggcuccuguuu

SEQ ID NO: 1247199 - RNA, 19 nt, Human
agccuaaggcuccuguuuu

SEQ ID NO: 1247200 - RNA, 12 nt, Human
agccuaagggau

SEQ ID NO: 1247201 - RNA, 21 nt, Human
agccuaagggauccugccugc

SEQ ID NO: 1247202 - RNA, 16 nt, Human
agccuaagggauccug

SEQ ID NO: 1247203 - RNA, 13 nt, Human
agccuacaggccu

SEQ ID NO: 1247204 - RNA, 14 nt, Human
agccuacaggccuc

SEQ ID NO: 1247205 - RNA, 17 nt, Human
agccuaggccuaguccu

SEQ ID NO: 1247206 - RNA, 19 nt, Human
agccuaggccuaguccugc

SEQ ID NO: 1247207 - RNA, 22 nt, Human
agccuaggccuaguccugcgaa

SEQ ID NO: 1247208 - RNA, 14 nt, Human
agccuagugaaggc

SEQ ID NO: 1247209 - RNA, 23 nt, Human
agccuagugaaggcuucucucug

SEQ ID NO: 1247210 - RNA, 20 nt, Human
agccuagugaaggcuucucu

SEQ ID NO: 1247211 - RNA, 20 nt, Human
agccucaaaacaaaggccua

SEQ ID NO: 1247212 - RNA, 18 nt, Human
agccucaaaacaaaggcc

SEQ ID NO: 1247213 - RNA, 20 nt, Human
ugcagaaagcaucccucacc

SEQ ID NO: 1247214 - RNA, 13 nt, Human
ugcagaaagcauc

SEQ ID NO: 1247215 - RNA, 17 nt, Human
ugcagaaaauucugugc

SEQ ID NO: 1247216 - RNA, 15 nt, Human
ugcagaaacuacuga

SEQ ID NO: 1247217 - RNA, 15 nt, Human
ugcagaacaaaugaa

SEQ ID NO: 1247218 - RNA, 14 nt, Human
ugcagaacaaauga

SEQ ID NO: 1247219 - RNA, 14 nt, Human
ugcagaacacauuu

SEQ ID NO: 1247220 - RNA, 21 nt, Human
ugcagaacacauuucaaauga

SEQ ID NO: 1247221 - RNA, 20 nt, Human
ugcagaaccggagagccagc

SEQ ID NO: 1247222 - RNA, 21 nt, Human
ugcagaaccggagagccagcu

SEQ ID NO: 1247223 - RNA, 17 nt, Human
ugcacucccaccugaca

SEQ ID NO: 1247224 - RNA, 19 nt, Human
ugcacucccaccugacaca

SEQ ID NO: 1247225 - RNA, 18 nt, Human
ugcagaaaauucugugcc

SEQ ID NO: 1247226 - RNA, 18 nt, Human
ugcagaacaaaugaagac

SEQ ID NO: 1247227 - RNA, 15 nt, Human
ugcagacuucccagc

SEQ ID NO: 1247228 - RNA, 22 nt, Human
ugcagacuucccagcuaggaag

SEQ ID NO: 1247229 - RNA, 16 nt, Human
ugcagacuucccagcu

SEQ ID NO: 1247230 - RNA, 13 nt, Human
agcccuucauuug

SEQ ID NO: 1247231 - RNA, 14 nt, Human
agcccuucauuugg

SEQ ID NO: 1247232 - RNA, 21 nt, Human
agcccuuaugcgguuaauuuu

SEQ ID NO: 1247233 - RNA, 22 nt, Human
agcccuuaugcgguuaauuuug

SEQ ID NO: 1247234 - RNA, 19 nt, Human
agcccuuccaugucgccuc

SEQ ID NO: 1247235 - RNA, 22 nt, Human
agcccuuccaugucgccucugc

SEQ ID NO: 1247236 - RNA, 23 nt, Human
agcccuuccaugucgccucugca

SEQ ID NO: 1247237 - RNA, 16 nt, Human
agcagcaacuuguccu

SEQ ID NO: 1247238 - RNA, 18 nt, Human
agcagcaccguucugugc

SEQ ID NO: 1247239 - RNA, 14 nt, Human
ugcacaagaaugga

SEQ ID NO: 1247240 - RNA, 15 nt, Human
ugcacaagaauggau

SEQ ID NO: 1247241 - RNA, 16 nt, Human
ugcacaagaauggauc

SEQ ID NO: 1247242 - RNA, 23 nt, Human
ugcacaagaauggaucacaagau

SEQ ID NO: 1247243 - RNA, 20 nt, Human
ugcacaagaauggaucacaa

SEQ ID NO: 1247244 - RNA, 15 nt, Human
ugcacaauaaaaaug

SEQ ID NO: 1247245 - RNA, 20 nt, Human
ugcacaauaaaaauguuuaa

SEQ ID NO: 1247246 - RNA, 21 nt, Human
ugcacaauaaaaauguuuaac

SEQ ID NO: 1247247 - RNA, 18 nt, Human
ugcacaauaacuccuccc

SEQ ID NO: 1247248 - RNA, 19 nt, Human
ugcacaauaacuccuccca

SEQ ID NO: 1247249 - RNA, 22 nt, Human
ugcacaauaacuccucccaggg

SEQ ID NO: 1247250 - RNA, 21 nt, Human
ugcacaauaacuccucccagg

SEQ ID NO: 1247251 - RNA, 13 nt, Human
ugcacaauguaga

SEQ ID NO: 1247252 - RNA, 14 nt, Human
ugcacaugaacuua

SEQ ID NO: 1247253 - RNA, 21 nt, Human
ugcacaugaacuuagauuuua

SEQ ID NO: 1247254 - RNA, 21 nt, Human
ugcacaugacucggggguggg

SEQ ID NO: 1247255 - RNA, 17 nt, Human
ugcacaugaacuuagau

SEQ ID NO: 1247256 - RNA, 22 nt, Human
ugcaccaagcaggaaaugaaaa

SEQ ID NO: 1247257 - RNA, 12 nt, Human
ugcaccaccaag

SEQ ID NO: 1247258 - RNA, 14 nt, Human
ugcaccaccaagcc

SEQ ID NO: 1247259 - RNA, 15 nt, Human
ugcaccaccaagcca

SEQ ID NO: 1247260 - RNA, 14 nt, Human
ugcaccaagcagga

SEQ ID NO: 1247261 - RNA, 16 nt, Human
ugcaccaccaagccaa

SEQ ID NO: 1247262 - RNA, 18 nt, Human
ugcaccaccaagccaagg

SEQ ID NO: 1247263 - RNA, 19 nt, Human
ugcaccaccaagccaaggg

SEQ ID NO: 1247264 - RNA, 15 nt, Human
ugcacuacugacaug

SEQ ID NO: 1247265 - RNA, 16 nt, Human
ugcacuacugacaugu

SEQ ID NO: 1247266 - RNA, 18 nt, Human
ugcacuacugacaugugg

SEQ ID NO: 1247267 - RNA, 14 nt, Human
ugcacucccaccug

SEQ ID NO: 1247268 - RNA, 15 nt, Human
ugcacucccaccuga

SEQ ID NO: 1247269 - RNA, 14 nt, Human
ugcacguggccucu

SEQ ID NO: 1247270 - RNA, 15 nt, Human
ugcacguggccucuu

SEQ ID NO: 1247271 - RNA, 16 nt, Human
ugcacguggccucuug

SEQ ID NO: 1247272 - RNA, 17 nt, Human
ugcacguggccucuuga

SEQ ID NO: 1247273 - RNA, 17 nt, Human
ugcacuaacagaguggc

SEQ ID NO: 1247274 - RNA, 14 nt, Human
ugcacuacugacau

SEQ ID NO: 1247275 - RNA, 23 nt, Human
ugccacaccccccaccccuagga

SEQ ID NO: 1247276 - RNA, 21 nt, Human
ugccacaccccccaccccuag

SEQ ID NO: 1247277 - RNA, 19 nt, Human
ugccacacgagaaccugaa

SEQ ID NO: 1247278 - RNA, 18 nt, Human
ugccaauauuaaaucugc

SEQ ID NO: 1247279 - RNA, 19 nt, Human
ugccaauauuaaaucugcu

SEQ ID NO: 1247280 - RNA, 19 nt, Human
ugccacaaggacuuccugu

SEQ ID NO: 1247281 - RNA, 22 nt, Human
ugccacacaaggauagaugcug

SEQ ID NO: 1247282 - RNA, 14 nt, Human
ugcauuuccugaca

SEQ ID NO: 1247283 - RNA, 22 nt, Human
ugcauugaacacaaacuguaaa

SEQ ID NO: 1247284 - RNA, 19 nt, Human
ugcauugaacacaaacugu

SEQ ID NO: 1247285 - RNA, 21 nt, Human
ugcauugaacacaaacuguaa

SEQ ID NO: 1247286 - RNA, 16 nt, Human
ugcauucuggauuuua

SEQ ID NO: 1247287 - RNA, 15 nt, Human
ugcauucuucucugu

SEQ ID NO: 1247288 - RNA, 16 nt, Human
ugcauucuucucuguu

SEQ ID NO: 1247289 - RNA, 16 nt, Human
ugcauucuucugagca

SEQ ID NO: 1247290 - RNA, 20 nt, Human
ugcauucuucugagcacugu

SEQ ID NO: 1247291 - RNA, 17 nt, Human
ugcauugaaaagagcug

SEQ ID NO: 1247292 - RNA, 18 nt, Human
ugcauugaaaagagcuga

SEQ ID NO: 1247293 - RNA, 20 nt, Human
ugcauugaaaagagcugaag

SEQ ID NO: 1247294 - RNA, 13 nt, Human
ugcauugaacaca

SEQ ID NO: 1247295 - RNA, 14 nt, Human
ugcauugaacacaa

SEQ ID NO: 1247296 - RNA, 15 nt, Human
ugcauugaacacaaa

SEQ ID NO: 1247297 - RNA, 17 nt, Human
ugcauugaacacaaacu

SEQ ID NO: 1247298 - RNA, 18 nt, Human
ugcauugaacacaaacug

SEQ ID NO: 1247299 - RNA, 10 nt, Human
agccugcuca

SEQ ID NO: 1247300 - RNA, 20 nt, Human
agcgcccacuagacccacug

SEQ ID NO: 1247301 - RNA, 12 nt, Human
agcgccaggcug

SEQ ID NO: 1247302 - RNA, 21 nt, Human
agcgccaggcugaccacagca

SEQ ID NO: 1247303 - RNA, 17 nt, Human
agccugccgagcaaccg

SEQ ID NO: 1247304 - RNA, 21 nt, Human
agccugcgccaccgcccagag

SEQ ID NO: 1247305 - RNA, 22 nt, Human
agcgcccaaaggacgcacugag

SEQ ID NO: 1247306 - RNA, 14 nt, Human
agcgcccagcuccu

SEQ ID NO: 1247307 - RNA, 16 nt, Human
agcgcccagcuccuga

SEQ ID NO: 1247308 - RNA, 19 nt, Human
agcgcuagaggaagcagcc

SEQ ID NO: 1247309 - RNA, 20 nt, Human
agcgcuagaggaagcagcca

SEQ ID NO: 1247310 - RNA, 13 nt, Human
agcgcuaucuccc

SEQ ID NO: 1247311 - RNA, 18 nt, Human
agcgcuaucucccugccu

SEQ ID NO: 1247312 - RNA, 17 nt, Human
agcgcuaucucccugcc

SEQ ID NO: 1247313 - RNA, 14 nt, Human
agcggcagaugggg

SEQ ID NO: 1247314 - RNA, 15 nt, Human
agcggcaucaggcuu

SEQ ID NO: 1247315 - RNA, 13 nt, Human
agcggcaucaggc

SEQ ID NO: 1247316 - RNA, 14 nt, Human
agcggcccugucau

SEQ ID NO: 1247317 - RNA, 11 nt, Human
agcggccggcc

SEQ ID NO: 1247318 - RNA, 18 nt, Human
agcggccggccagccccu

SEQ ID NO: 1247319 - RNA, 22 nt, Human
agcggccggccagccccuggcc

SEQ ID NO: 1247320 - RNA, 18 nt, Human
agcggcccugucauccag

SEQ ID NO: 1247321 - RNA, 23 nt, Human
ugccacugccucuuccucccuca

SEQ ID NO: 1247322 - RNA, 12 nt, Human
ugccacacuuca

SEQ ID NO: 1247323 - RNA, 19 nt, Human
ugccacugccuucgcuucu

SEQ ID NO: 1247324 - RNA, 21 nt, Human
ugccacugccuucgcuucuug

SEQ ID NO: 1247325 - RNA, 22 nt, Human
ugccacugccuucgcuucuugc

SEQ ID NO: 1247326 - RNA, 13 nt, Human
ugccacuggagug

SEQ ID NO: 1247327 - RNA, 19 nt, Human
ugccacuggggaaaacucc

SEQ ID NO: 1247328 - RNA, 14 nt, Human
ugccacuuaaugua

SEQ ID NO: 1247329 - RNA, 17 nt, Human
ugccacuuaauguaugu

SEQ ID NO: 1247330 - RNA, 18 nt, Human
ugccacuuaauguauguu

SEQ ID NO: 1247331 - RNA, 20 nt, Human
ugccacuuaauguauguuac

SEQ ID NO: 1247332 - RNA, 23 nt, Human
ugccacuuaauguauguuaccaa

SEQ ID NO: 1247333 - RNA, 17 nt, Human
ugccagucccccugccc

SEQ ID NO: 1247334 - RNA, 12 nt, Human
ugccacuguugu

SEQ ID NO: 1247335 - RNA, 19 nt, Human
ugccagucccccugcccca

SEQ ID NO: 1247336 - RNA, 20 nt, Human
ugccagucccccugccccag

SEQ ID NO: 1247337 - RNA, 17 nt, Human
ugccauagucuuaacug

SEQ ID NO: 1247338 - RNA, 20 nt, Human
ugccauagucuuaacugguc

SEQ ID NO: 1247339 - RNA, 18 nt, Human
ugccauaugauuuacauu

SEQ ID NO: 1247340 - RNA, 14 nt, Human
ugccauauuaaauu

SEQ ID NO: 1247341 - RNA, 16 nt, Human
ugccauauuaaauuuu

SEQ ID NO: 1247342 - RNA, 23 nt, Human
ugccauauuaaauuuuuuguuga

SEQ ID NO: 1247343 - RNA, 17 nt, Human
agcgugcuuuaaaaaau

SEQ ID NO: 1247344 - RNA, 14 nt, Human
agcguggaggggua

SEQ ID NO: 1247345 - RNA, 20 nt, Human
agcguggagggguaggggcu

SEQ ID NO: 1247346 - RNA, 18 nt, Human
agcguggccuuguucugu

SEQ ID NO: 1247347 - RNA, 22 nt, Human
agcguggccuuguucugucacc

SEQ ID NO: 1247348 - RNA, 17 nt, Human
agcuauauaagacaaga

SEQ ID NO: 1247349 - RNA, 11 nt, Human
agcuauauaag

SEQ ID NO: 1247350 - RNA, 19 nt, Human
agcuauggugucauaggcu

SEQ ID NO: 1247351 - RNA, 15 nt, Human
agcuauuuaaagcau

SEQ ID NO: 1247352 - RNA, 13 nt, Human
agcuauuucaucu

SEQ ID NO: 1247353 - RNA, 14 nt, Human
agcuauuucaucua

SEQ ID NO: 1247354 - RNA, 17 nt, Human
agcuauuucaucuauuu

SEQ ID NO: 1247355 - RNA, 21 nt, Human
agcuauuucaucuauuuuugg

SEQ ID NO: 1247356 - RNA, 23 nt, Human
agcuacucuccccacgagggcug

SEQ ID NO: 1247357 - RNA, 22 nt, Human
agcuacucuccccacgagggcu

SEQ ID NO: 1247358 - RNA, 23 nt, Human
agcuacugccgucagugcugugc

SEQ ID NO: 1247359 - RNA, 15 nt, Human
agcuacugugugugu

SEQ ID NO: 1247360 - RNA, 19 nt, Human
agcuacugugugugugaau

SEQ ID NO: 1247361 - RNA, 20 nt, Human
agcuacugugugugugaaug

SEQ ID NO: 1247362 - RNA, 23 nt, Human
agcuacugugugugugaaugaac

SEQ ID NO: 1247363 - RNA, 15 nt, Human
agcuacuuccuccuc

SEQ ID NO: 1247364 - RNA, 16 nt, Human
agcuacuuccuccucc

SEQ ID NO: 1247365 - RNA, 21 nt, Human
agcuacuuccuccuccccacu

SEQ ID NO: 1247366 - RNA, 22 nt, Human
agcuaguuuuauucuugguuuu

SEQ ID NO: 1247367 - RNA, 18 nt, Human
agcuauaaaaugaauaca

SEQ ID NO: 1247368 - RNA, 22 nt, Human
agcuauaaagcaguauuuuucu

SEQ ID NO: 1247369 - RNA, 13 nt, Human
agcuauuuuucua

SEQ ID NO: 1247370 - RNA, 14 nt, Human
ugccauuaaagaau

SEQ ID NO: 1247371 - RNA, 14 nt, Human
ugccauuaacaaau

SEQ ID NO: 1247372 - RNA, 16 nt, Human
ugccauucacuucaua

SEQ ID NO: 1247373 - RNA, 18 nt, Human
ugcccaaccugcucuccu

SEQ ID NO: 1247374 - RNA, 22 nt, Human
ugcccaaccugcucuccucuug

SEQ ID NO: 1247375 - RNA, 19 nt, Human
ugccauugggguaguugug

SEQ ID NO: 1247376 - RNA, 20 nt, Human
ugcccaacccuucccucacc

SEQ ID NO: 1247377 - RNA, 22 nt, Human
ugcccaacccuucccucaccuu

SEQ ID NO: 1247378 - RNA, 23 nt, Human
ugcccaaccugcucuccucuugc

SEQ ID NO: 1247379 - RNA, 24 nt, Human
ugcccaaccugcucuccucuugcc

SEQ ID NO: 1247380 - RNA, 11 nt, Human
ugccauuguag

SEQ ID NO: 1247381 - RNA, 23 nt, Human
ugcccaagccagaggcuggguuc

SEQ ID NO: 1247382 - RNA, 15 nt, Human
agcuauuugauguaa

SEQ ID NO: 1247383 - RNA, 17 nt, Human
agcuauuugauguaaua

SEQ ID NO: 1247384 - RNA, 20 nt, Human
agcuauuugauguaauacuu

SEQ ID NO: 1247385 - RNA, 12 nt, Human
agcuauuuucca

SEQ ID NO: 1247386 - RNA, 13 nt, Human
agcuauuuuccag

SEQ ID NO: 1247387 - RNA, 13 nt, Human
agcuauuuuguga

SEQ ID NO: 1247388 - RNA, 21 nt, Human
agcuauuuuccaggcuucugc

SEQ ID NO: 1247389 - RNA, 14 nt, Human
agcuauuuuucuaa

SEQ ID NO: 1247390 - RNA, 15 nt, Human
ugcccaggccugccu

SEQ ID NO: 1247391 - RNA, 17 nt, Human
ugcccaggccugccugu

SEQ ID NO: 1247392 - RNA, 17 nt, Human
ugcccccaccccauucc

SEQ ID NO: 1247393 - RNA, 22 nt, Human
ugcccccaccccauucccgcag

SEQ ID NO: 1247394 - RNA, 19 nt, Human
ugcccccaccccauucccg

SEQ ID NO: 1247395 - RNA, 17 nt, Human
ugcccccacugaccaga

SEQ ID NO: 1247396 - RNA, 14 nt, Human
ugcccccagagcca

SEQ ID NO: 1247397 - RNA, 16 nt, Human
ugcccccagagccaca

SEQ ID NO: 1247398 - RNA, 18 nt, Human
ugcccccagagccacagu

SEQ ID NO: 1247399 - RNA, 17 nt, Human
ugcccccagagccacag

SEQ ID NO: 1247400 - RNA, 17 nt, Human
ugccccuacccuggacu

SEQ ID NO: 1247401 - RNA, 19 nt, Human
ugcccuaucacccaacgcu

SEQ ID NO: 1247402 - RNA, 17 nt, Human
ugcccucauggccccuc

SEQ ID NO: 1247403 - RNA, 19 nt, Human
ugcccucauggccccucug

SEQ ID NO: 1247404 - RNA, 23 nt, Human
ugcccucauggccccucugaccu

SEQ ID NO: 1247405 - RNA, 16 nt, Human
ugccccgucccccucu

SEQ ID NO: 1247406 - RNA, 18 nt, Human
ugccccgucccccucugg

SEQ ID NO: 1247407 - RNA, 12 nt, Human
ugccccccagcc

SEQ ID NO: 1247408 - RNA, 18 nt, Human
ugcccccaggguccuggg

SEQ ID NO: 1247409 - RNA, 21 nt, Human
ugcccccaggguccugggagg

SEQ ID NO: 1247410 - RNA, 22 nt, Human
ugcccccaggguccugggagga

SEQ ID NO: 1247411 - RNA, 18 nt, Human
ugcccccauuucugaggu

SEQ ID NO: 1247412 - RNA, 15 nt, Human
ugcccccauuucuga

SEQ ID NO: 1247413 - RNA, 14 nt, Human
ugccccccagccuc

SEQ ID NO: 1247414 - RNA, 15 nt, Human
ugccccccagccucu

SEQ ID NO: 1247415 - RNA, 19 nt, Human
ugccccccagccucuggca

SEQ ID NO: 1247416 - RNA, 20 nt, Human
ugccccccagccucuggcau

SEQ ID NO: 1247417 - RNA, 14 nt, Human
ugcccccugcagga

SEQ ID NO: 1247418 - RNA, 16 nt, Human
ugcccccugcaggaag

SEQ ID NO: 1247419 - RNA, 17 nt, Human
ugcccccugcaggaagg

SEQ ID NO: 1247420 - RNA, 18 nt, Human
ugcccccugcaggaagga

SEQ ID NO: 1247421 - RNA, 21 nt, Human
ugcccccugcaggaaggagcu

SEQ ID NO: 1247422 - RNA, 23 nt, Human
ugcccccugcaggaaggagcugc

SEQ ID NO: 1247423 - RNA, 22 nt, Human
ugcccccugcaggaaggagcug

SEQ ID NO: 1247424 - RNA, 14 nt, Human
agaagcuccaggua

SEQ ID NO: 1247425 - RNA, 13 nt, Human
agaagcugcucaa

SEQ ID NO: 1247426 - RNA, 18 nt, Human
agaagcucagcugcauuc

SEQ ID NO: 1247427 - RNA, 23 nt, Human
agaagcugcucaacuugcaaaau

SEQ ID NO: 1247428 - RNA, 18 nt, Human
agaagcuaagguuuagau

SEQ ID NO: 1247429 - RNA, 13 nt, Human
agaagcucagcug

SEQ ID NO: 1247430 - RNA, 17 nt, Human
agaagcucagcugcauu

SEQ ID NO: 1247431 - RNA, 21 nt, Human
ucuggcagccucccauccagg

SEQ ID NO: 1247432 - RNA, 18 nt, Human
ucuggcauuagaauuauu

SEQ ID NO: 1247433 - RNA, 17 nt, Human
ucuggccaggaagcuuu

SEQ ID NO: 1247434 - RNA, 16 nt, Human
ucuggccaggaagcuu

SEQ ID NO: 1247435 - RNA, 14 nt, Human
ucuggcccaccagg

SEQ ID NO: 1247436 - RNA, 16 nt, Human
ucuggcccaccagggu

SEQ ID NO: 1247437 - RNA, 21 nt, Human
ucuggccaguguuuaaaacuu

SEQ ID NO: 1247438 - RNA, 22 nt, Human
ucuggccccccugguccccucc

SEQ ID NO: 1247439 - RNA, 12 nt, Human
ucuggccccccu

SEQ ID NO: 1247440 - RNA, 10 nt, Human
agaagccugc

SEQ ID NO: 1247441 - RNA, 11 nt, Human
agaagccugca

SEQ ID NO: 1247442 - RNA, 21 nt, Human
agaagccugcauaauguuucu

SEQ ID NO: 1247443 - RNA, 11 nt, Human
agaagccuggg

SEQ ID NO: 1247444 - RNA, 12 nt, Human
agaagccugggg

SEQ ID NO: 1247445 - RNA, 13 nt, Human
agaagccuggggg

SEQ ID NO: 1247446 - RNA, 14 nt, Human
agaagccugggggc

SEQ ID NO: 1247447 - RNA, 17 nt, Human
agaagccugggggccug

SEQ ID NO: 1247448 - RNA, 18 nt, Human
agaagccugggggccugg

SEQ ID NO: 1247449 - RNA, 19 nt, Human
agaagccugggggccuggc

SEQ ID NO: 1247450 - RNA, 20 nt, Human
agaagccugggggccuggcu

SEQ ID NO: 1247451 - RNA, 21 nt, Human
agaagccugggggccuggcug

SEQ ID NO: 1247452 - RNA, 11 nt, Human
agaagccuuca

SEQ ID NO: 1247453 - RNA, 15 nt, Human
agaagccuucaagcu

SEQ ID NO: 1247454 - RNA, 17 nt, Human
agaagccuucaagcucu

SEQ ID NO: 1247455 - RNA, 18 nt, Human
agaagccuucaagcucug

SEQ ID NO: 1247456 - RNA, 19 nt, Human
agaagccuucaagcucuga

SEQ ID NO: 1247457 - RNA, 20 nt, Human
agaagccuucaagcucugag

SEQ ID NO: 1247458 - RNA, 21 nt, Human
agaagccuucaagcucugagg

SEQ ID NO: 1247459 - RNA, 23 nt, Human
agaagccuucaagcucugaggga

SEQ ID NO: 1247460 - RNA, 18 nt, Human
ucuggauuauauuaugaa

SEQ ID NO: 1247461 - RNA, 12 nt, Human
ucuggauuauau

SEQ ID NO: 1247462 - RNA, 18 nt, Human
ucuggauaacuuccacag

SEQ ID NO: 1247463 - RNA, 21 nt, Human
ucuggauaacuuccacagggu

SEQ ID NO: 1247464 - RNA, 23 nt, Human
ucuggauaacuuccacagggucc

SEQ ID NO: 1247465 - RNA, 19 nt, Human
ucuggauuauucugggggc

SEQ ID NO: 1247466 - RNA, 11 nt, Human
ucuggcagcca

SEQ ID NO: 1247467 - RNA, 12 nt, Human
ucuggcagccac

SEQ ID NO: 1247468 - RNA, 13 nt, Human
ucuggcagccaca

SEQ ID NO: 1247469 - RNA, 15 nt, Human
ucuggcagccacacu

SEQ ID NO: 1247470 - RNA, 18 nt, Human
ucuggcagccacacuucu

SEQ ID NO: 1247471 - RNA, 21 nt, Human
ucuggcagccacacuucucag

SEQ ID NO: 1247472 - RNA, 22 nt, Human
ucuggcagccacacuucucagg

SEQ ID NO: 1247473 - RNA, 23 nt, Human
ucuggcagccacacuucucagga

SEQ ID NO: 1247474 - RNA, 16 nt, Human
ucuggcagccucccau

SEQ ID NO: 1247475 - RNA, 13 nt, Human
ucuggaacccaga

SEQ ID NO: 1247476 - RNA, 14 nt, Human
ucuggaacccagac

SEQ ID NO: 1247477 - RNA, 15 nt, Human
ucuggaacccagacu

SEQ ID NO: 1247478 - RNA, 16 nt, Human
ucuggaacccagacuc

SEQ ID NO: 1247479 - RNA, 17 nt, Human
ucuggaacccagacuca

SEQ ID NO: 1247480 - RNA, 18 nt, Human
ucuggaacccagacucag

SEQ ID NO: 1247481 - RNA, 22 nt, Human
ucuggaacccagacucagacau

SEQ ID NO: 1247482 - RNA, 23 nt, Human
ucuggaacccagacucagacauu

SEQ ID NO: 1247483 - RNA, 15 nt, Human
ucuggaaccucagcc

SEQ ID NO: 1247484 - RNA, 16 nt, Human
ucuggaaccucagccu

SEQ ID NO: 1247485 - RNA, 17 nt, Human
ucuggaguauucuauaa

SEQ ID NO: 1247486 - RNA, 21 nt, Human
ucuggagucucacuugucuca

SEQ ID NO: 1247487 - RNA, 16 nt, Human
ucuggaguugaucugg

SEQ ID NO: 1247488 - RNA, 17 nt, Human
ucuggaguugaucugga

SEQ ID NO: 1247489 - RNA, 21 nt, Human
ucuggaguugaucuggaaccc

SEQ ID NO: 1247490 - RNA, 21 nt, Human
agaagaacugaaaucauacuu

SEQ ID NO: 1247491 - RNA, 18 nt, Human
agaagaaagaacggaaga

SEQ ID NO: 1247492 - RNA, 13 nt, Human
agaagaaacaagg

SEQ ID NO: 1247493 - RNA, 16 nt, Human
agaagaaagaacggaa

SEQ ID NO: 1247494 - RNA, 21 nt, Human
agaagaaacaagguuuucagu

SEQ ID NO: 1247495 - RNA, 20 nt, Human
ucugccuucucaugauccaa

SEQ ID NO: 1247496 - RNA, 15 nt, Human
ucugccuuugccagg

SEQ ID NO: 1247497 - RNA, 21 nt, Human
ucugccuuugccaggugacug

SEQ ID NO: 1247498 - RNA, 22 nt, Human
ucugccuuuggggacuuuucuu

SEQ ID NO: 1247499 - RNA, 16 nt, Human
ucugcuacuuugcugc

SEQ ID NO: 1247500 - RNA, 14 nt, Human
ucugcucagcucug

SEQ ID NO: 1247501 - RNA, 16 nt, Human
ucugcucagcucuggg

SEQ ID NO: 1247502 - RNA, 22 nt, Human
ucugcucaguaauuugaggaca

SEQ ID NO: 1247503 - RNA, 12 nt, Human
ucugcucaucau

SEQ ID NO: 1247504 - RNA, 14 nt, Human
ucugcuucucugac

SEQ ID NO: 1247505 - RNA, 16 nt, Human
ucugcuucucugacuu

SEQ ID NO: 1247506 - RNA, 19 nt, Human
ucugcuucucugacuucug

SEQ ID NO: 1247507 - RNA, 22 nt, Human
ucugcuucucugacuucugccu

SEQ ID NO: 1247508 - RNA, 18 nt, Human
ucugcuugauuuuugccu

SEQ ID NO: 1247509 - RNA, 14 nt, Human
ucugcucaucauuc

SEQ ID NO: 1247510 - RNA, 15 nt, Human
ucugcucaucauucu

SEQ ID NO: 1247511 - RNA, 18 nt, Human
ucugcucaucauucucug

SEQ ID NO: 1247512 - RNA, 22 nt, Human
ucugcucaucauucucugucuc

SEQ ID NO: 1247513 - RNA, 23 nt, Human
ucugcucaucauucucugucuca

SEQ ID NO: 1247514 - RNA, 13 nt, Human
ucugcuguagaaa

SEQ ID NO: 1247515 - RNA, 12 nt, Human
ucugcuguagaa

SEQ ID NO: 1247516 - RNA, 14 nt, Human
ucugcuguuccagu

SEQ ID NO: 1247517 - RNA, 15 nt, Human
ucugcuguuccagug

SEQ ID NO: 1247518 - RNA, 16 nt, Human
ucugcuguuccagugg

SEQ ID NO: 1247519 - RNA, 21 nt, Human
ucugaggggcuaccaggaaag

SEQ ID NO: 1247520 - RNA, 20 nt, Human
ucugaggggcuaccaggaaa

SEQ ID NO: 1247521 - RNA, 19 nt, Human
ucugaggggcuaccaggaa

SEQ ID NO: 1247522 - RNA, 14 nt, Human
ucugagguccugag

SEQ ID NO: 1247523 - RNA, 15 nt, Human
ucugagguccugagc

SEQ ID NO: 1247524 - RNA, 16 nt, Human
ucugagguccugagca

SEQ ID NO: 1247525 - RNA, 17 nt, Human
ucugagguccugagcac

SEQ ID NO: 1247526 - RNA, 18 nt, Human
ucugagguccugagcacu

SEQ ID NO: 1247527 - RNA, 19 nt, Human
ucugagguccugagcacug

SEQ ID NO: 1247528 - RNA, 20 nt, Human
ucugagguccugagcacugc

SEQ ID NO: 1247529 - RNA, 23 nt, Human
ucugacuuucuuuuuugauauag

SEQ ID NO: 1247530 - RNA, 22 nt, Human
ucugagaaaagcuuugaacccu

SEQ ID NO: 1247531 - RNA, 16 nt, Human
ucugauacagaaaagu

SEQ ID NO: 1247532 - RNA, 17 nt, Human
ucugauacagaaaaguu

SEQ ID NO: 1247533 - RNA, 21 nt, Human
ucugagguccugagcacugcc

SEQ ID NO: 1247534 - RNA, 22 nt, Human
ucugauaggguuugugacaggg

SEQ ID NO: 1247535 - RNA, 21 nt, Human
ucugauaggguuugugacagg

SEQ ID NO: 1247536 - RNA, 15 nt, Human
ucugaucaaggccuu

SEQ ID NO: 1247537 - RNA, 14 nt, Human
ucugaccuccauga

SEQ ID NO: 1247538 - RNA, 18 nt, Human
ucugaccugcacugggga

SEQ ID NO: 1247539 - RNA, 21 nt, Human
ucugacuguuuccaucaaggg

SEQ ID NO: 1247540 - RNA, 12 nt, Human
ucugacuucugc

SEQ ID NO: 1247541 - RNA, 14 nt, Human
ucugacuucugccu

SEQ ID NO: 1247542 - RNA, 15 nt, Human
ucugacuucugccug

SEQ ID NO: 1247543 - RNA, 16 nt, Human
ucugacuucugccugg

SEQ ID NO: 1247544 - RNA, 17 nt, Human
ucugacuucugccugga

SEQ ID NO: 1247545 - RNA, 19 nt, Human
ucugacuucugccuggaga

SEQ ID NO: 1247546 - RNA, 20 nt, Human
ucugacuucugccuggagac

SEQ ID NO: 1247547 - RNA, 20 nt, Human
ucugacuuucuuuuuugaua

SEQ ID NO: 1247548 - RNA, 13 nt, Human
agaacguggucag

SEQ ID NO: 1247549 - RNA, 15 nt, Human
agaacucccuuucaa

SEQ ID NO: 1247550 - RNA, 14 nt, Human
agaacucccuuuca

SEQ ID NO: 1247551 - RNA, 13 nt, Human
agaacucucugga

SEQ ID NO: 1247552 - RNA, 21 nt, Human
agaacucucuggaagccccug

SEQ ID NO: 1247553 - RNA, 16 nt, Human
agaacucucuggaagc

SEQ ID NO: 1247554 - RNA, 14 nt, Human
agaacucuuucaaa

SEQ ID NO: 1247555 - RNA, 15 nt, Human
agaacugaaugagaa

SEQ ID NO: 1247556 - RNA, 13 nt, Human
agaagaaaaagaa

SEQ ID NO: 1247557 - RNA, 15 nt, Human
agaagaaaaagaagc

SEQ ID NO: 1247558 - RNA, 19 nt, Human
agaagaaaagguucuuacu

SEQ ID NO: 1247559 - RNA, 15 nt, Human
ucugcagauaaacag

SEQ ID NO: 1247560 - RNA, 19 nt, Human
ucugcagacuucccagcua

SEQ ID NO: 1247561 - RNA, 12 nt, Human
ucugcagagcag

SEQ ID NO: 1247562 - RNA, 23 nt, Human
ucugcacuugcgguuccggcaug

SEQ ID NO: 1247563 - RNA, 16 nt, Human
ucugcagacuucccag

SEQ ID NO: 1247564 - RNA, 18 nt, Human
ucugcagacuucccagcu

SEQ ID NO: 1247565 - RNA, 14 nt, Human
agaaauuguauauu

SEQ ID NO: 1247566 - RNA, 16 nt, Human
agaaauuguauauugu

SEQ ID NO: 1247567 - RNA, 17 nt, Human
agaaauuguauauugua

SEQ ID NO: 1247568 - RNA, 20 nt, Human
agaaauuguauauuguaauu

SEQ ID NO: 1247569 - RNA, 21 nt, Human
agaaauuguauauuguaauuu

SEQ ID NO: 1247570 - RNA, 13 nt, Human
agaaauuuaaacu

SEQ ID NO: 1247571 - RNA, 16 nt, Human
agaaauuuaaacuaua

SEQ ID NO: 1247572 - RNA, 20 nt, Human
agaaauuuaaacuauaagca

SEQ ID NO: 1247573 - RNA, 17 nt, Human
agaaauuuaauucagaa

SEQ ID NO: 1247574 - RNA, 24 nt, Human
agaaauuuaaacuauaagcaagaa

SEQ ID NO: 1247575 - RNA, 18 nt, Human
agaaccggagagccagcu

SEQ ID NO: 1247576 - RNA, 19 nt, Human
agaaccguagaugauuuca

SEQ ID NO: 1247577 - RNA, 14 nt, Human
agaaccuaauucaa

SEQ ID NO: 1247578 - RNA, 15 nt, Human
agaaccuaauucaau

SEQ ID NO: 1247579 - RNA, 19 nt, Human
agaaccuaauucaauucaa

SEQ ID NO: 1247580 - RNA, 22 nt, Human
acuuuuuuuuuuuaagaguaaa

SEQ ID NO: 1247581 - RNA, 23 nt, Human
acuuuuuuucuguaccaguuaau

SEQ ID NO: 1247582 - RNA, 20 nt, Human
acuuuuuuucuguaccaguu

SEQ ID NO: 1247583 - RNA, 21 nt, Human
acuuuuuuucuguaccaguua

SEQ ID NO: 1247584 - RNA, 17 nt, Human
acuuuuugcagcuuucu

SEQ ID NO: 1247585 - RNA, 13 nt, Human
acuuuuugcauuu

SEQ ID NO: 1247586 - RNA, 15 nt, Human
acuuuuugcagcuuu

SEQ ID NO: 1247587 - RNA, 13 nt, Human
acuuuuugcagcu

SEQ ID NO: 1247588 - RNA, 12 nt, Human
acuuuuugcagc

SEQ ID NO: 1247589 - RNA, 15 nt, Human
acuuuuugaggcaaa

SEQ ID NO: 1247590 - RNA, 16 nt, Human
acuuuuugaggcaaaa

SEQ ID NO: 1247591 - RNA, 23 nt, Human
acuuuuuguucugguccuuuuug

SEQ ID NO: 1247592 - RNA, 19 nt, Human
acuuuuugaggcaaaagaa

SEQ ID NO: 1247593 - RNA, 18 nt, Human
acuuuuuguucugguccu

SEQ ID NO: 1247594 - RNA, 15 nt, Human
acuuuuuuauuuaaa

SEQ ID NO: 1247595 - RNA, 23 nt, Human
acuuuuuuauuuaaaaaacuaaa

SEQ ID NO: 1247596 - RNA, 14 nt, Human
acuuuuggcauuuu

SEQ ID NO: 1247597 - RNA, 17 nt, Human
acuuuggggcuaauuua

SEQ ID NO: 1247598 - RNA, 19 nt, Human
acuuugguaccagauaacu

SEQ ID NO: 1247599 - RNA, 16 nt, Human
acuuugguaccagaua

SEQ ID NO: 1247600 - RNA, 17 nt, Human
acuuugguaccagauaa

SEQ ID NO: 1247601 - RNA, 17 nt, Human
acuuuuguaagacaaag

SEQ ID NO: 1247602 - RNA, 12 nt, Human
acuuuuguaaga

SEQ ID NO: 1247603 - RNA, 12 nt, Human
acuuuugugaaa

SEQ ID NO: 1247604 - RNA, 22 nt, Human
acuuuugugaauuaggcuguaa

SEQ ID NO: 1247605 - RNA, 15 nt, Human
acuuuuuauugauuu

SEQ ID NO: 1247606 - RNA, 11 nt, Human
acuuuuucuga

SEQ ID NO: 1247607 - RNA, 12 nt, Human
acuuuuucugau

SEQ ID NO: 1247608 - RNA, 17 nt, Human
acuuuggcugcaugcga

SEQ ID NO: 1247609 - RNA, 14 nt, Human
acuuuggcugcaug

SEQ ID NO: 1247610 - RNA, 19 nt, Human
acuuuggcuuauaauucuu

SEQ ID NO: 1247611 - RNA, 21 nt, Human
acuuuggcuuauaauucuuuc

SEQ ID NO: 1247612 - RNA, 22 nt, Human
acuuuggcuuauaauucuuuca

SEQ ID NO: 1247613 - RNA, 23 nt, Human
acuuuggcuuauaauucuuucaa

SEQ ID NO: 1247614 - RNA, 21 nt, Human
acuuugacuuuuugcauuuaa

SEQ ID NO: 1247615 - RNA, 23 nt, Human
acuuguuggcguaggcuacagag

SEQ ID NO: 1247616 - RNA, 22 nt, Human
acuuguuggcguaggcuacaga

SEQ ID NO: 1247617 - RNA, 16 nt, Human
acuuguuucugaucua

SEQ ID NO: 1247618 - RNA, 15 nt, Human
acuuugacuuuuugc

SEQ ID NO: 1247619 - RNA, 20 nt, Human
acuuugacuuuuugcauuua

SEQ ID NO: 1247620 - RNA, 23 nt, Human
acuugugucccaugaucccugug

SEQ ID NO: 1247621 - RNA, 19 nt, Human
acuuguugauuaauggaaa

SEQ ID NO: 1247622 - RNA, 21 nt, Human
acuuguugauuaauggaaaug

SEQ ID NO: 1247623 - RNA, 22 nt, Human
acuugugucccuaauguguuua

SEQ ID NO: 1247624 - RNA, 14 nt, Human
acuugugucucugu

SEQ ID NO: 1247625 - RNA, 16 nt, Human
acuugugucucugugc

SEQ ID NO: 1247626 - RNA, 21 nt, Human
acuugugucucugugcuuuua

SEQ ID NO: 1247627 - RNA, 22 nt, Human
acuugugucucugugcuuuuaa

SEQ ID NO: 1247628 - RNA, 11 nt, Human
acuugugucug

SEQ ID NO: 1247629 - RNA, 20 nt, Human
ucuccguuagcuccuguggc

SEQ ID NO: 1247630 - RNA, 16 nt, Human
ucuccguuagcuccug

SEQ ID NO: 1247631 - RNA, 17 nt, Human
ucuccguuagcuccugu

SEQ ID NO: 1247632 - RNA, 18 nt, Human
ucuccguuagcuccugug

SEQ ID NO: 1247633 - RNA, 19 nt, Human
ucuccguuagcuccugugg

SEQ ID NO: 1247634 - RNA, 19 nt, Human
ucuccauugugccuaaguc

SEQ ID NO: 1247635 - RNA, 21 nt, Human
ucuccauucugcuccuucccc

SEQ ID NO: 1247636 - RNA, 16 nt, Human
acuguauauuacagau

SEQ ID NO: 1247637 - RNA, 18 nt, Human
ucuccauucugcuccuuc

SEQ ID NO: 1247638 - RNA, 14 nt, Human
acuguagcucuaaa

SEQ ID NO: 1247639 - RNA, 19 nt, Human
acuguagcucuaaaaucug

SEQ ID NO: 1247640 - RNA, 15 nt, Human
acuguagcuuuggaa

SEQ ID NO: 1247641 - RNA, 15 nt, Human
acuguaggcacacuu

SEQ ID NO: 1247642 - RNA, 13 nt, Human
acuguagggaggg

SEQ ID NO: 1247643 - RNA, 16 nt, Human
acuguaguaaauaaug

SEQ ID NO: 1247644 - RNA, 18 nt, Human
acuguaguaaauaaugcu

SEQ ID NO: 1247645 - RNA, 19 nt, Human
acuguaguaaauaaugcuu

SEQ ID NO: 1247646 - RNA, 20 nt, Human
acuguaguaaauaaugcuuu

SEQ ID NO: 1247647 - RNA, 21 nt, Human
acuguaguaaauaaugcuuug

SEQ ID NO: 1247648 - RNA, 22 nt, Human
acuguaguaaauaaugcuuuga

SEQ ID NO: 1247649 - RNA, 13 nt, Human
acuguaguucuaa

SEQ ID NO: 1247650 - RNA, 15 nt, Human
acuguaguucuaaga

SEQ ID NO: 1247651 - RNA, 16 nt, Human
acuguaguucuaagac

SEQ ID NO: 1247652 - RNA, 17 nt, Human
acuguaguucuaagacu

SEQ ID NO: 1247653 - RNA, 18 nt, Human
ucucccaaaaaacuacuu

SEQ ID NO: 1247654 - RNA, 18 nt, Human
ucucccaaagugcuggga

SEQ ID NO: 1247655 - RNA, 19 nt, Human
ucucccaacucuugcacag

SEQ ID NO: 1247656 - RNA, 22 nt, Human
ucucccaacucuugcacaguca

SEQ ID NO: 1247657 - RNA, 19 nt, Human
ucucccaggcaaggcugug

SEQ ID NO: 1247658 - RNA, 13 nt, Human
ucucccaggcagg

SEQ ID NO: 1247659 - RNA, 20 nt, Human
ucucccaggcaaggcugugg

SEQ ID NO: 1247660 - RNA, 12 nt, Human
ucucccaggccc

SEQ ID NO: 1247661 - RNA, 13 nt, Human
ucucccaggcccc

SEQ ID NO: 1247662 - RNA, 14 nt, Human
ucucccaggcccca

SEQ ID NO: 1247663 - RNA, 17 nt, Human
ucucccaggccccauga

SEQ ID NO: 1247664 - RNA, 20 nt, Human
ucucccaggccccaugaccu

SEQ ID NO: 1247665 - RNA, 21 nt, Human
ucucccaggccccaugaccuc

SEQ ID NO: 1247666 - RNA, 23 nt, Human
ucucccaggccccaugaccucca

SEQ ID NO: 1247667 - RNA, 11 nt, Human
ucucccaguug

SEQ ID NO: 1247668 - RNA, 13 nt, Human
agaaacccugcac

SEQ ID NO: 1247669 - RNA, 21 nt, Human
agaaaccagcuuccuucagag

SEQ ID NO: 1247670 - RNA, 19 nt, Human
agaaaccagcuuccuucag

SEQ ID NO: 1247671 - RNA, 20 nt, Human
agaaaccagcuuccuucaga

SEQ ID NO: 1247672 - RNA, 22 nt, Human
agaaaccagcuuccuucagaga

SEQ ID NO: 1247673 - RNA, 19 nt, Human
agaaaacuuguauuaugug

SEQ ID NO: 1247674 - RNA, 13 nt, Human
agaaaccagcuuc

SEQ ID NO: 1247675 - RNA, 14 nt, Human
agaaaccagcuucc

SEQ ID NO: 1247676 - RNA, 15 nt, Human
agaaaccagcuuccu

SEQ ID NO: 1247677 - RNA, 16 nt, Human
agaaaccagcuuccuu

SEQ ID NO: 1247678 - RNA, 20 nt, Human
agaaaacaugcagaacaaau

SEQ ID NO: 1247679 - RNA, 13 nt, Human
agaaaacauguuu

SEQ ID NO: 1247680 - RNA, 22 nt, Human
agaaaacaggcacugcccuggu

SEQ ID NO: 1247681 - RNA, 15 nt, Human
agaaaacaugccucu

SEQ ID NO: 1247682 - RNA, 16 nt, Human
agaaaaccagcucagc

SEQ ID NO: 1247683 - RNA, 21 nt, Human
agaaaaccagcucagcacugc

SEQ ID NO: 1247684 - RNA, 20 nt, Human
agaaaaccagcucagcacug

SEQ ID NO: 1247685 - RNA, 19 nt, Human
agaaaacccuugggccaga

SEQ ID NO: 1247686 - RNA, 20 nt, Human
agaaaacccuugggccagaa

SEQ ID NO: 1247687 - RNA, 22 nt, Human
agaaaacccuugggccagaagu

SEQ ID NO: 1247688 - RNA, 16 nt, Human
agaaaaccuuucuuca

SEQ ID NO: 1247689 - RNA, 20 nt, Human
agaaagaacggaagaagaga

SEQ ID NO: 1247690 - RNA, 18 nt, Human
agaaacugaggaauuuuc

SEQ ID NO: 1247691 - RNA, 15 nt, Human
agaaacugcagggaa

SEQ ID NO: 1247692 - RNA, 22 nt, Human
agaaagaagacaaacuuugcau

SEQ ID NO: 1247693 - RNA, 15 nt, Human
agaaacuggaacucu

SEQ ID NO: 1247694 - RNA, 13 nt, Human
agaaacuggaacu

SEQ ID NO: 1247695 - RNA, 23 nt, Human
agaaaccuacugcccaggcacug

SEQ ID NO: 1247696 - RNA, 15 nt, Human
agaaaccuacugccc

SEQ ID NO: 1247697 - RNA, 16 nt, Human
agaaaccuacugccca

SEQ ID NO: 1247698 - RNA, 13 nt, Human
agaaacugaggaa

SEQ ID NO: 1247699 - RNA, 16 nt, Human
agaaacugaggaauuu

SEQ ID NO: 1247700 - RNA, 19 nt, Human
agaaaacaaggaugaauua

SEQ ID NO: 1247701 - RNA, 20 nt, Human
agaaaacaggcacugcccug

SEQ ID NO: 1247702 - RNA, 23 nt, Human
agaaaacauaaucuucugccuuc

SEQ ID NO: 1247703 - RNA, 17 nt, Human
agaaaaauauauacuaa

SEQ ID NO: 1247704 - RNA, 20 nt, Human
agaaaaauaaagaaaagaug

SEQ ID NO: 1247705 - RNA, 19 nt, Human
agaaaaauaugaccacacu

SEQ ID NO: 1247706 - RNA, 13 nt, Human
agaaaaauaaaga

SEQ ID NO: 1247707 - RNA, 14 nt, Human
agaaaaauaaagaa

SEQ ID NO: 1247708 - RNA, 16 nt, Human
agaaaaauauguacca

SEQ ID NO: 1247709 - RNA, 14 nt, Human
ucucuucuuaaugu

SEQ ID NO: 1247710 - RNA, 16 nt, Human
ucucuuuauacagcug

SEQ ID NO: 1247711 - RNA, 17 nt, Human
ucucuuuauacagcugu

SEQ ID NO: 1247712 - RNA, 19 nt, Human
ucucuuuaugucuguggau

SEQ ID NO: 1247713 - RNA, 12 nt, Human
ucucuuuccaug

SEQ ID NO: 1247714 - RNA, 14 nt, Human
ucucuuucccuggu

SEQ ID NO: 1247715 - RNA, 16 nt, Human
ucucuuucccuggucc

SEQ ID NO: 1247716 - RNA, 17 nt, Human
ucucuuucccugguccc

SEQ ID NO: 1247717 - RNA, 19 nt, Human
ucucuuucccuggucccuu

SEQ ID NO: 1247718 - RNA, 12 nt, Human
ucucuuucuguc

SEQ ID NO: 1247719 - RNA, 18 nt, Human
ucucuucuuaauguacau

SEQ ID NO: 1247720 - RNA, 22 nt, Human
ucucugcccuugaucagcccca

SEQ ID NO: 1247721 - RNA, 22 nt, Human
ucucugcccuaaugcgcaggcu

SEQ ID NO: 1247722 - RNA, 11 nt, Human
ucucugcccua

SEQ ID NO: 1247723 - RNA, 20 nt, Human
ucucugcccuugaucagccc

SEQ ID NO: 1247724 - RNA, 17 nt, Human
ucucuggccuucggccu

SEQ ID NO: 1247725 - RNA, 16 nt, Human
ucucuggccuucggcc

SEQ ID NO: 1247726 - RNA, 23 nt, Human
ucucugcucugcgugucaccugu

SEQ ID NO: 1247727 - RNA, 21 nt, Human
ucucuucuggguuccuuccuc

SEQ ID NO: 1247728 - RNA, 22 nt, Human
ucucugcucugcgugucaccug

SEQ ID NO: 1247729 - RNA, 18 nt, Human
ucucugcucugcguguca

SEQ ID NO: 1247730 - RNA, 21 nt, Human
ucucugcucugcgugucaccu

SEQ ID NO: 1247731 - RNA, 21 nt, Human
ucucuucugagcuauuucauc

SEQ ID NO: 1247732 - RNA, 22 nt, Human
ucucuucugagcuauuucaucu

SEQ ID NO: 1247733 - RNA, 18 nt, Human
ucucuucuggguuccuuc

SEQ ID NO: 1247734 - RNA, 19 nt, Human
ucucuucuggguuccuucc

SEQ ID NO: 1247735 - RNA, 20 nt, Human
ucucuucuggguuccuuccu

SEQ ID NO: 1247736 - RNA, 13 nt, Human
ucuccuuccugug

SEQ ID NO: 1247737 - RNA, 14 nt, Human
ucuccuuccugugu

SEQ ID NO: 1247738 - RNA, 21 nt, Human
ucuccuucaugacagccucca

SEQ ID NO: 1247739 - RNA, 16 nt, Human
ucuccuuccugugugu

SEQ ID NO: 1247740 - RNA, 22 nt, Human
ucucuccacuuucagcugucuu

SEQ ID NO: 1247741 - RNA, 15 nt, Human
ucucuccuuguucug

SEQ ID NO: 1247742 - RNA, 19 nt, Human
ucucuccuuguucugauaa

SEQ ID NO: 1247743 - RNA, 14 nt, Human
ucucugccagugac

SEQ ID NO: 1247744 - RNA, 15 nt, Human
ucucugccagugaca

SEQ ID NO: 1247745 - RNA, 21 nt, Human
ucucugccagugacagacagg

SEQ ID NO: 1247746 - RNA, 12 nt, Human
ucucugcccaac

SEQ ID NO: 1247747 - RNA, 13 nt, Human
ucucugcccaacc

SEQ ID NO: 1247748 - RNA, 20 nt, Human
ucuguuuuauaauuuuguga

SEQ ID NO: 1247749 - RNA, 16 nt, Human
ucuguuuuaaaaaccu

SEQ ID NO: 1247750 - RNA, 18 nt, Human
ucuguuuuauaauuuugu

SEQ ID NO: 1247751 - RNA, 13 nt, Human
ucuguucuaguuu

SEQ ID NO: 1247752 - RNA, 15 nt, Human
ucuguucuaguuuuu

SEQ ID NO: 1247753 - RNA, 20 nt, Human
ucuguucuaguuuuuuacuu

SEQ ID NO: 1247754 - RNA, 13 nt, Human
ucuguuugcugug

SEQ ID NO: 1247755 - RNA, 18 nt, Human
ucuguuugcuguggaacu

SEQ ID NO: 1247756 - RNA, 14 nt, Human
ucuguuuuacaagu

SEQ ID NO: 1247757 - RNA, 12 nt, Human
agaauugugguu

SEQ ID NO: 1247758 - RNA, 22 nt, Human
agaauugugguuuauauauuua

SEQ ID NO: 1247759 - RNA, 23 nt, Human
agaauugugguuuauauauuuaa

SEQ ID NO: 1247760 - RNA, 19 nt, Human
agaauugugucagacuguu

SEQ ID NO: 1247761 - RNA, 23 nt, Human
agaauugugucagacuguuuagu

SEQ ID NO: 1247762 - RNA, 20 nt, Human
agaauugugucagacuguuu

SEQ ID NO: 1247763 - RNA, 16 nt, Human
agaauuguugagauac

SEQ ID NO: 1247764 - RNA, 17 nt, Human
agaauuguugagauacu

SEQ ID NO: 1247765 - RNA, 23 nt, Human
agaauuguuggggguuuuuuugg

SEQ ID NO: 1247766 - RNA, 13 nt, Human
agaauuucuagga

SEQ ID NO: 1247767 - RNA, 21 nt, Human
agaauuucuaggacugaauua

SEQ ID NO: 1247768 - RNA, 21 nt, Human
agaauuucuaccauuucagag

SEQ ID NO: 1247769 - RNA, 16 nt, Human
agaauuucuaccauuu

SEQ ID NO: 1247770 - RNA, 20 nt, Human
agaauuucuaccauuucaga

SEQ ID NO: 1247771 - RNA, 21 nt, Human
agaauuguuggggguuuuuuu

SEQ ID NO: 1247772 - RNA, 14 nt, Human
agaauuuaguguau

SEQ ID NO: 1247773 - RNA, 17 nt, Human
ucuguucauuccuccag

SEQ ID NO: 1247774 - RNA, 16 nt, Human
ucuguucauuccucca

SEQ ID NO: 1247775 - RNA, 12 nt, Human
ucugugcugugu

SEQ ID NO: 1247776 - RNA, 13 nt, Human
ucugugcuggcca

SEQ ID NO: 1247777 - RNA, 12 nt, Human
ucuguuccacau

SEQ ID NO: 1247778 - RNA, 19 nt, Human
ucuguuccaaauucaguuu

SEQ ID NO: 1247779 - RNA, 22 nt, Human
ucuguuccaaauucaguuucau

SEQ ID NO: 1247780 - RNA, 23 nt, Human
ucuguuccaaauucaguuucaua

SEQ ID NO: 1247781 - RNA, 18 nt, Human
ucuguucauuuccucaaa

SEQ ID NO: 1247782 - RNA, 12 nt, Human
ucuguuccaaau

SEQ ID NO: 1247783 - RNA, 13 nt, Human
ucuguuccaaaug

SEQ ID NO: 1247784 - RNA, 13 nt, Human
ucuguuccaaauu

SEQ ID NO: 1247785 - RNA, 14 nt, Human
ucuguuccaaauuc

SEQ ID NO: 1247786 - RNA, 17 nt, Human
ucuguuccaaauucagu

SEQ ID NO: 1247787 - RNA, 20 nt, Human
ucuguucuacauagaugcuu

SEQ ID NO: 1247788 - RNA, 24 nt, Human
ucuguccaggcacugcugcccagc

SEQ ID NO: 1247789 - RNA, 20 nt, Human
ucugugccccuuccgccacu

SEQ ID NO: 1247790 - RNA, 15 nt, Human
ucugugccugaauau

SEQ ID NO: 1247791 - RNA, 17 nt, Human
ucugugccugaauauuu

SEQ ID NO: 1247792 - RNA, 16 nt, Human
ucugugccuucgucuu

SEQ ID NO: 1247793 - RNA, 17 nt, Human
ucugugccuuguuuuuu

SEQ ID NO: 1247794 - RNA, 18 nt, Human
ucugugccccuuccgcca

SEQ ID NO: 1247795 - RNA, 15 nt, Human
ucuguauaaaugucu

SEQ ID NO: 1247796 - RNA, 20 nt, Human
ucuguauaaaugucuuuaau

SEQ ID NO: 1247797 - RNA, 15 nt, Human
ucuguagguugcaca

SEQ ID NO: 1247798 - RNA, 16 nt, Human
ucuguagguugcacac

SEQ ID NO: 1247799 - RNA, 17 nt, Human
ucuguagguugcacacu

SEQ ID NO: 1247800 - RNA, 18 nt, Human
ucuguagguugcacacuu

SEQ ID NO: 1247801 - RNA, 19 nt, Human
ucuguagguugcacacuuu

SEQ ID NO: 1247802 - RNA, 20 nt, Human
ucuguagguugcacacuuug

SEQ ID NO: 1247803 - RNA, 21 nt, Human
ucuguagguugcacacuuugg

SEQ ID NO: 1247804 - RNA, 23 nt, Human
ucuguagguugcacacuuuggua

SEQ ID NO: 1247805 - RNA, 14 nt, Human
ucuggucucgaacu

SEQ ID NO: 1247806 - RNA, 22 nt, Human
ucuguaggccaguaguucucaa

SEQ ID NO: 1247807 - RNA, 23 nt, Human
ucuguaggccaguaguucucaaa

SEQ ID NO: 1247808 - RNA, 22 nt, Human
ucuguagggauuuuuggcuaca

SEQ ID NO: 1247809 - RNA, 20 nt, Human
ucuguaggguaauuaguaac

SEQ ID NO: 1247810 - RNA, 13 nt, Human
ucugucagcugca

SEQ ID NO: 1247811 - RNA, 14 nt, Human
ucugucagcugcaa

SEQ ID NO: 1247812 - RNA, 13 nt, Human
ucugucagucaca

SEQ ID NO: 1247813 - RNA, 17 nt, Human
ucugucagucacagcca

SEQ ID NO: 1247814 - RNA, 19 nt, Human
ucugucagucacagccacc

SEQ ID NO: 1247815 - RNA, 12 nt, Human
ucugucaguucu

SEQ ID NO: 1247816 - RNA, 21 nt, Human
agaaggaaggcagggaggagg

SEQ ID NO: 1247817 - RNA, 20 nt, Human
agaaggaaggcagggaggag

SEQ ID NO: 1247818 - RNA, 17 nt, Human
ucuggggagcaggcagc

SEQ ID NO: 1247819 - RNA, 19 nt, Human
ucuggggagcaggcagcca

SEQ ID NO: 1247820 - RNA, 21 nt, Human
ucuggggagcaggcagccagc

SEQ ID NO: 1247821 - RNA, 22 nt, Human
ucuggggagcaggcagccagca

SEQ ID NO: 1247822 - RNA, 19 nt, Human
ucuggggagcgggucugcu

SEQ ID NO: 1247823 - RNA, 23 nt, Human
ucuggggagcgggucugcuccca

SEQ ID NO: 1247824 - RNA, 17 nt, Human
ucuggggcaggcugggc

SEQ ID NO: 1247825 - RNA, 18 nt, Human
ucuggggcaggcugggcc

SEQ ID NO: 1247826 - RNA, 19 nt, Human
ucuggggcaggcugggcca

SEQ ID NO: 1247827 - RNA, 20 nt, Human
ucuggggcaggcugggccau

SEQ ID NO: 1247828 - RNA, 21 nt, Human
ucuggggcaggcugggccaug

SEQ ID NO: 1247829 - RNA, 19 nt, Human
agaaggaaggcagggagga

SEQ ID NO: 1247830 - RNA, 17 nt, Human
agaaggaaggcagggag

SEQ ID NO: 1247831 - RNA, 11 nt, Human
agaaggaaggc

SEQ ID NO: 1247832 - RNA, 21 nt, Human
agaaggaaaauuuuagcgugc

SEQ ID NO: 1247833 - RNA, 16 nt, Human
ucuggguuccuuccuc

SEQ ID NO: 1247834 - RNA, 13 nt, Human
ucuggguggcccu

SEQ ID NO: 1247835 - RNA, 22 nt, Human
ucuggguggcucacucagcacu

SEQ ID NO: 1247836 - RNA, 14 nt, Human
ucuggguggcucac

SEQ ID NO: 1247837 - RNA, 13 nt, Human
ucugguccuuuuu

SEQ ID NO: 1247838 - RNA, 15 nt, Human
ucuggucgcuccugc

SEQ ID NO: 1247839 - RNA, 17 nt, Human
ucuggucgcuccugccc

SEQ ID NO: 1247840 - RNA, 18 nt, Human
ucugggugcuacugggga

SEQ ID NO: 1247841 - RNA, 19 nt, Human
ucugggugcuacuggggaa

SEQ ID NO: 1247842 - RNA, 20 nt, Human
agacagaaucucagucuguc

SEQ ID NO: 1247843 - RNA, 18 nt, Human
agacagaaucucgcucug

SEQ ID NO: 1247844 - RNA, 22 nt, Human
agacagaaucucgcucugucgc

SEQ ID NO: 1247845 - RNA, 22 nt, Human
agacacuccccgaagucuuuug

SEQ ID NO: 1247846 - RNA, 23 nt, Human
agacacuccccgaagucuuuugu

SEQ ID NO: 1247847 - RNA, 18 nt, Human
agacacugaaaaaucuaa

SEQ ID NO: 1247848 - RNA, 14 nt, Human
agacagacuagaag

SEQ ID NO: 1247849 - RNA, 22 nt, Human
agacagcuucucauccugcagg

SEQ ID NO: 1247850 - RNA, 23 nt, Human
agacagcuucucauccugcaggc

SEQ ID NO: 1247851 - RNA, 17 nt, Human
agaauuugauaugugaa

SEQ ID NO: 1247852 - RNA, 17 nt, Human
agaauuugagugcucug

SEQ ID NO: 1247853 - RNA, 18 nt, Human
agaauuugauaugugaac

SEQ ID NO: 1247854 - RNA, 19 nt, Human
agaauuugauaugugaaca

SEQ ID NO: 1247855 - RNA, 20 nt, Human
agaauuugauaugugaacag

SEQ ID NO: 1247856 - RNA, 21 nt, Human
agaauuugauaugugaacagu

SEQ ID NO: 1247857 - RNA, 18 nt, Human
agaauuugagugcucuga

SEQ ID NO: 1247858 - RNA, 13 nt, Human
agacaccaaaguu

SEQ ID NO: 1247859 - RNA, 14 nt, Human
agacaccaaaguuc

SEQ ID NO: 1247860 - RNA, 15 nt, Human
agacaccaaaguucu

SEQ ID NO: 1247861 - RNA, 16 nt, Human
agacaccaaaguucua

SEQ ID NO: 1247862 - RNA, 17 nt, Human
agacaccaaaguucuaa

SEQ ID NO: 1247863 - RNA, 18 nt, Human
agacaccaaaguucuaau

SEQ ID NO: 1247864 - RNA, 12 nt, Human
agacacccagga

SEQ ID NO: 1247865 - RNA, 13 nt, Human
agacacccaggac

SEQ ID NO: 1247866 - RNA, 14 nt, Human
agacacccaggacu

SEQ ID NO: 1247867 - RNA, 15 nt, Human
agacacccaggacuu

SEQ ID NO: 1247868 - RNA, 16 nt, Human
agacacccaggacuua

SEQ ID NO: 1247869 - RNA, 17 nt, Human
agacaccguucauucag

SEQ ID NO: 1247870 - RNA, 19 nt, Human
agacaccguucauucaggc

SEQ ID NO: 1247871 - RNA, 20 nt, Human
agacacuccccgaagucuuu

SEQ ID NO: 1247872 - RNA, 19 nt, Human
ucuuaauauguucuuuuaa

SEQ ID NO: 1247873 - RNA, 18 nt, Human
agacaguauauaacuaac

SEQ ID NO: 1247874 - RNA, 23 nt, Human
agacaggguuucaccauguugcc

SEQ ID NO: 1247875 - RNA, 22 nt, Human
agacagggaauuaggcccccau

SEQ ID NO: 1247876 - RNA, 22 nt, Human
agacaggucccuccccuucucu

SEQ ID NO: 1247877 - RNA, 15 nt, Human
agacaggcucuuagc

SEQ ID NO: 1247878 - RNA, 20 nt, Human
agacaggcucuuagcagcuu

SEQ ID NO: 1247879 - RNA, 15 nt, Human
agacaggcuggaaga

SEQ ID NO: 1247880 - RNA, 22 nt, Human
agacaggcuggaagauagcugu

SEQ ID NO: 1247881 - RNA, 21 nt, Human
agacagggaauuaggccccca

SEQ ID NO: 1247882 - RNA, 19 nt, Human
agacagggucaaaguguuu

SEQ ID NO: 1247883 - RNA, 22 nt, Human
ucuuagaugcaguucugaagaa

SEQ ID NO: 1247884 - RNA, 12 nt, Human
ucuuaauuauua

SEQ ID NO: 1247885 - RNA, 20 nt, Human
ucuuaauuauuauuuguguu

SEQ ID NO: 1247886 - RNA, 21 nt, Human
ucuucccuggaaaccuuccac

SEQ ID NO: 1247887 - RNA, 16 nt, Human
ucuucccucucugcag

SEQ ID NO: 1247888 - RNA, 22 nt, Human
ucuuccauauggauccacuggc

SEQ ID NO: 1247889 - RNA, 22 nt, Human
ucuuccaguuugcuuugcccuu

SEQ ID NO: 1247890 - RNA, 18 nt, Human
ucuuccagucuuccugac

SEQ ID NO: 1247891 - RNA, 21 nt, Human
ucuuccagucuuccugacacu

SEQ ID NO: 1247892 - RNA, 20 nt, Human
ucuuccaguuugcuuugccc

SEQ ID NO: 1247893 - RNA, 17 nt, Human
ucuucaaaaugagcccu

SEQ ID NO: 1247894 - RNA, 16 nt, Human
ucuuauuuuuuucuau

SEQ ID NO: 1247895 - RNA, 14 nt, Human
ucuucaaaugccug

SEQ ID NO: 1247896 - RNA, 17 nt, Human
ucuucaccauuuggcaa

SEQ ID NO: 1247897 - RNA, 16 nt, Human
ucuucaccaaaucuug

SEQ ID NO: 1247898 - RNA, 20 nt, Human
ucuugaugccuggcggggug

SEQ ID NO: 1247899 - RNA, 13 nt, Human
ucuugaugcaugc

SEQ ID NO: 1247900 - RNA, 21 nt, Human
ucuugaugcaugcacuguucc

SEQ ID NO: 1247901 - RNA, 14 nt, Human
ucuugaugccuggc

SEQ ID NO: 1247902 - RNA, 12 nt, Human
ucuugaugacca

SEQ ID NO: 1247903 - RNA, 23 nt, Human
agaccugauccuggaggcccagu

SEQ ID NO: 1247904 - RNA, 23 nt, Human
ucuugaucaguuaagaaauuuca

SEQ ID NO: 1247905 - RNA, 18 nt, Human
ucuugaucaguuaagaaa

SEQ ID NO: 1247906 - RNA, 14 nt, Human
ucuugcuuucuuug

SEQ ID NO: 1247907 - RNA, 12 nt, Human
ucuuggagaagu

SEQ ID NO: 1247908 - RNA, 16 nt, Human
ucuuggagaagucuca

SEQ ID NO: 1247909 - RNA, 17 nt, Human
ucuuggagaagucucag

SEQ ID NO: 1247910 - RNA, 21 nt, Human
ucuuggaacauuggaauguuc

SEQ ID NO: 1247911 - RNA, 15 nt, Human
ucuuggaacuugccu

SEQ ID NO: 1247912 - RNA, 20 nt, Human
ucuuggaacuugccugccuu

SEQ ID NO: 1247913 - RNA, 16 nt, Human
ucuuggaacuugccug

SEQ ID NO: 1247914 - RNA, 15 nt, Human
ucuuggacaaaucac

SEQ ID NO: 1247915 - RNA, 12 nt, Human
agaccugccccu

SEQ ID NO: 1247916 - RNA, 17 nt, Human
agacuaucuuacuauuu

SEQ ID NO: 1247917 - RNA, 13 nt, Human
agaccugccccuc

SEQ ID NO: 1247918 - RNA, 18 nt, Human
agaccugauccuggaggc

SEQ ID NO: 1247919 - RNA, 19 nt, Human
agaccugauccuggaggcc

SEQ ID NO: 1247920 - RNA, 21 nt, Human
agaccugauccuggaggccca

SEQ ID NO: 1247921 - RNA, 22 nt, Human
agaccugauccuggaggcccag

SEQ ID NO: 1247922 - RNA, 18 nt, Human
agaccuacuguucuaaag

SEQ ID NO: 1247923 - RNA, 19 nt, Human
agaccuacuguucuaaagc

SEQ ID NO: 1247924 - RNA, 16 nt, Human
agaccugagaauguau

SEQ ID NO: 1247925 - RNA, 14 nt, Human
agaccugauccugg

SEQ ID NO: 1247926 - RNA, 15 nt, Human
agaccugauccugga

SEQ ID NO: 1247927 - RNA, 16 nt, Human
agaccugauccuggag

SEQ ID NO: 1247928 - RNA, 12 nt, Human
agacccugcccu

SEQ ID NO: 1247929 - RNA, 20 nt, Human
ucuuccggccccuccccucc

SEQ ID NO: 1247930 - RNA, 23 nt, Human
ucuuccggccccuccccuccaaa

SEQ ID NO: 1247931 - RNA, 21 nt, Human
ucuuccuaccaagucaaacuu

SEQ ID NO: 1247932 - RNA, 20 nt, Human
ucuuccuaccaagucaaacu

SEQ ID NO: 1247933 - RNA, 17 nt, Human
ucuuccuaccuauccca

SEQ ID NO: 1247934 - RNA, 17 nt, Human
ucuuccuacuggucucu

SEQ ID NO: 1247935 - RNA, 20 nt, Human
ucuuccuacuggucucucua

SEQ ID NO: 1247936 - RNA, 19 nt, Human
ucuuccuaguuuucuccuc

SEQ ID NO: 1247937 - RNA, 21 nt, Human
ucuuccuaguuuucuccuccc

SEQ ID NO: 1247938 - RNA, 23 nt, Human
ucuuccuaguuuucuccucccag

SEQ ID NO: 1247939 - RNA, 12 nt, Human
ucuuccucagcc

SEQ ID NO: 1247940 - RNA, 13 nt, Human
ucuuccucagcca

SEQ ID NO: 1247941 - RNA, 15 nt, Human
ucuuccucagccagc

SEQ ID NO: 1247942 - RNA, 14 nt, Human
ucuuccucagccag

SEQ ID NO: 1247943 - RNA, 18 nt, Human
agacaugucuguucuaca

SEQ ID NO: 1247944 - RNA, 20 nt, Human
agacaugucuguucuacaua

SEQ ID NO: 1247945 - RNA, 12 nt, Human
agacaugugaca

SEQ ID NO: 1247946 - RNA, 13 nt, Human
agacaugugacau

SEQ ID NO: 1247947 - RNA, 14 nt, Human
agacaugugacauu

SEQ ID NO: 1247948 - RNA, 15 nt, Human
agacaugugacauuu

SEQ ID NO: 1247949 - RNA, 16 nt, Human
agacaugugacauuua

SEQ ID NO: 1247950 - RNA, 17 nt, Human
agacaugugacauuuau

SEQ ID NO: 1247951 - RNA, 12 nt, Human
agacccuggagg

SEQ ID NO: 1247952 - RNA, 14 nt, Human
agacccuggaggcc

SEQ ID NO: 1247953 - RNA, 21 nt, Human
agacccuuauugcuguccugg

SEQ ID NO: 1247954 - RNA, 18 nt, Human
agacccuugacaccugcu

SEQ ID NO: 1247955 - RNA, 22 nt, Human
agacccuuucuucagcucugaa

SEQ ID NO: 1247956 - RNA, 22 nt, Human
agacccuuauugcuguccugga

SEQ ID NO: 1247957 - RNA, 19 nt, Human
agaccuaaucucuguaaag

SEQ ID NO: 1247958 - RNA, 21 nt, Human
agaccuaaucucuguaaagcu

SEQ ID NO: 1247959 - RNA, 11 nt, Human
agaccuacagg

SEQ ID NO: 1247960 - RNA, 14 nt, Human
agaccuacaggggg

SEQ ID NO: 1247961 - RNA, 19 nt, Human
agaccuacagggggucugg

SEQ ID NO: 1247962 - RNA, 21 nt, Human
agaccuacagggggucuggcu

SEQ ID NO: 1247963 - RNA, 23 nt, Human
agaccuacagggggucuggcugg

SEQ ID NO: 1247964 - RNA, 22 nt, Human
agaccuacagggggucuggcug

SEQ ID NO: 1247965 - RNA, 15 nt, Human
agaccuacuguucua

SEQ ID NO: 1247966 - RNA, 16 nt, Human
agaccuacuguucuaa

SEQ ID NO: 1247967 - RNA, 17 nt, Human
agaccuacuguucuaaa

SEQ ID NO: 1247968 - RNA, 20 nt, Human
ucuuuaaaauuacaacuaag

SEQ ID NO: 1247969 - RNA, 15 nt, Human
ucuuuaaaauuacaa

SEQ ID NO: 1247970 - RNA, 20 nt, Human
ucuuuaaaauguaaagccau

SEQ ID NO: 1247971 - RNA, 23 nt, Human
ucuuuaaagugacuaauggcaug

SEQ ID NO: 1247972 - RNA, 14 nt, Human
ucuuuaaaguucuu

SEQ ID NO: 1247973 - RNA, 20 nt, Human
ucuuggagaagucucagcua

SEQ ID NO: 1247974 - RNA, 19 nt, Human
ucuuggagaagucucagcu

SEQ ID NO: 1247975 - RNA, 23 nt, Human
ucuuggagcugugaguucucccu

SEQ ID NO: 1247976 - RNA, 14 nt, Human
ucuuggagcuguga

SEQ ID NO: 1247977 - RNA, 15 nt, Human
ucuuggagcugugag

SEQ ID NO: 1247978 - RNA, 14 nt, Human
ucuuuacaaaacaa

SEQ ID NO: 1247979 - RNA, 22 nt, Human
ucuuuacaaaacaaacucauuc

SEQ ID NO: 1247980 - RNA, 23 nt, Human
ucuuuacaaaacaaacucauuca

SEQ ID NO: 1247981 - RNA, 12 nt, Human
ucuuuacuuuua

SEQ ID NO: 1247982 - RNA, 11 nt, Human
ucuuuagaaca

SEQ ID NO: 1247983 - RNA, 20 nt, Human
ucuuuagauagcccuguccu

SEQ ID NO: 1247984 - RNA, 23 nt, Human
ucuuuagauagcccuguccuggu

SEQ ID NO: 1247985 - RNA, 21 nt, Human
ucuuuagauagcccuguccug

SEQ ID NO: 1247986 - RNA, 18 nt, Human
agacucggaaucuauuuu

SEQ ID NO: 1247987 - RNA, 12 nt, Human
agacucuaagaa

SEQ ID NO: 1247988 - RNA, 18 nt, Human
agagacacacugaagaag

SEQ ID NO: 1247989 - RNA, 20 nt, Human
agagacacacugaagaagca

SEQ ID NO: 1247990 - RNA, 13 nt, Human
agagaccagggcu

SEQ ID NO: 1247991 - RNA, 14 nt, Human
agagaccagggcuc

SEQ ID NO: 1247992 - RNA, 19 nt, Human
agagaccagggcuccagcc

SEQ ID NO: 1247993 - RNA, 20 nt, Human
agagaccagggcuccagccc

SEQ ID NO: 1247994 - RNA, 15 nt, Human
ucuuugggccagaca

SEQ ID NO: 1247995 - RNA, 16 nt, Human
ucuuugggccagacau

SEQ ID NO: 1247996 - RNA, 20 nt, Human
ucuuugggccagacaugcca

SEQ ID NO: 1247997 - RNA, 16 nt, Human
ucuuuggggugccccu

SEQ ID NO: 1247998 - RNA, 17 nt, Human
agagacacacugaagaa

SEQ ID NO: 1247999 - RNA, 21 nt, Human
agagaaugcccuucuccuuau

SEQ ID NO: 1248000 - RNA, 15 nt, Human
agagaaugagagaca

SEQ ID NO: 1248001 - RNA, 22 nt, Human
agacuuugcuaaagacaugaag

SEQ ID NO: 1248002 - RNA, 19 nt, Human
agacuucaagcauggcuau

SEQ ID NO: 1248003 - RNA, 22 nt, Human
agacuucaagcauggcuauuuu

SEQ ID NO: 1248004 - RNA, 12 nt, Human
agacuugacagu

SEQ ID NO: 1248005 - RNA, 13 nt, Human
agacuugacagug

SEQ ID NO: 1248006 - RNA, 14 nt, Human
agacuugacagugg

SEQ ID NO: 1248007 - RNA, 15 nt, Human
agacuugacagugga

SEQ ID NO: 1248008 - RNA, 21 nt, Human
agacuuggauucuuuccauuu

SEQ ID NO: 1248009 - RNA, 15 nt, Human
agacuuggauucuuu

SEQ ID NO: 1248010 - RNA, 16 nt, Human
agacucuaagaaagaa

SEQ ID NO: 1248011 - RNA, 17 nt, Human
agacucuaagaaagaac

SEQ ID NO: 1248012 - RNA, 18 nt, Human
agacugucuggccccccu

SEQ ID NO: 1248013 - RNA, 16 nt, Human
agacugugauucagaa

SEQ ID NO: 1248014 - RNA, 17 nt, Human
agacugugauucagaaa

SEQ ID NO: 1248015 - RNA, 16 nt, Human
agacugugugugcccu

SEQ ID NO: 1248016 - RNA, 17 nt, Human
agacugugugugcccuc

SEQ ID NO: 1248017 - RNA, 18 nt, Human
agacugugugugcccucu

SEQ ID NO: 1248018 - RNA, 19 nt, Human
agacugugugugcccucug

SEQ ID NO: 1248019 - RNA, 20 nt, Human
agacugugugugcccucugg

SEQ ID NO: 1248020 - RNA, 22 nt, Human
agacugugugugcccucugggc

SEQ ID NO: 1248021 - RNA, 23 nt, Human
agacugugugugcccucugggcu

SEQ ID NO: 1248022 - RNA, 21 nt, Human
agaggcgcaugaauuugugaa

SEQ ID NO: 1248023 - RNA, 11 nt, Human
agaggcaccag

SEQ ID NO: 1248024 - RNA, 13 nt, Human
agaggcaccagga

SEQ ID NO: 1248025 - RNA, 14 nt, Human
agaggcaccaggaa

SEQ ID NO: 1248026 - RNA, 18 nt, Human
agaggcaccugucccaga

SEQ ID NO: 1248027 - RNA, 17 nt, Human
agaggcaccaggaagcc

SEQ ID NO: 1248028 - RNA, 19 nt, Human
agaggccuuuuggaaugug

SEQ ID NO: 1248029 - RNA, 21 nt, Human
agagggacgccugggggugcc

SEQ ID NO: 1248030 - RNA, 15 nt, Human
agagggacgccuggg

SEQ ID NO: 1248031 - RNA, 15 nt, Human
agaggugaccccagg

SEQ ID NO: 1248032 - RNA, 16 nt, Human
agaggugaccccaggg

SEQ ID NO: 1248033 - RNA, 17 nt, Human
agaggugaccccagggc

SEQ ID NO: 1248034 - RNA, 18 nt, Human
agaggugaccccagggca

SEQ ID NO: 1248035 - RNA, 23 nt, Human
agaggugaccccagggcacagga

SEQ ID NO: 1248036 - RNA, 24 nt, Human
agaggugaccccagggcacaggag

SEQ ID NO: 1248037 - RNA, 17 nt, Human
agaggugagaaauuuaa

SEQ ID NO: 1248038 - RNA, 16 nt, Human
agaggugagaaauuua

SEQ ID NO: 1248039 - RNA, 12 nt, Human
agagggaaugug

SEQ ID NO: 1248040 - RNA, 13 nt, Human
agagggaauguga

SEQ ID NO: 1248041 - RNA, 14 nt, Human
agagggaaugugaa

SEQ ID NO: 1248042 - RNA, 15 nt, Human
agagggaaugugaaa

SEQ ID NO: 1248043 - RNA, 16 nt, Human
agagggaaugugaaau

SEQ ID NO: 1248044 - RNA, 12 nt, Human
agagggacagau

SEQ ID NO: 1248045 - RNA, 18 nt, Human
agagggaaugugaaauuu

SEQ ID NO: 1248046 - RNA, 18 nt, Human
ugaagauguagaggagaa

SEQ ID NO: 1248047 - RNA, 16 nt, Human
ugaagauucuuuccca

SEQ ID NO: 1248048 - RNA, 21 nt, Human
ugaagauucuuucccaauuca

SEQ ID NO: 1248049 - RNA, 13 nt, Human
ugaagcagccucu

SEQ ID NO: 1248050 - RNA, 15 nt, Human
ugaagcagccucucc

SEQ ID NO: 1248051 - RNA, 20 nt, Human
ugaagcagccucuccccagg

SEQ ID NO: 1248052 - RNA, 15 nt, Human
agagguggaaaaaca

SEQ ID NO: 1248053 - RNA, 13 nt, Human
agaggugggccag

SEQ ID NO: 1248054 - RNA, 21 nt, Human
agaggugggccagucugugga

SEQ ID NO: 1248055 - RNA, 19 nt, Human
ugaagcagguucccaagcu

SEQ ID NO: 1248056 - RNA, 20 nt, Human
ugaagcagguucccaagcuc

SEQ ID NO: 1248057 - RNA, 21 nt, Human
ugaagccaugaguuccagaaa

SEQ ID NO: 1248058 - RNA, 15 nt, Human
ugaagcccucccagg

SEQ ID NO: 1248059 - RNA, 15 nt, Human
ugaagcuguugugug

SEQ ID NO: 1248060 - RNA, 16 nt, Human
ugaagcuguuguguga

SEQ ID NO: 1248061 - RNA, 19 nt, Human
ugaagcuguugugugaggu

SEQ ID NO: 1248062 - RNA, 22 nt, Human
ugaagaagcaccaaucaugaau

SEQ ID NO: 1248063 - RNA, 23 nt, Human
ugaagaacugcaggcccuggccu

SEQ ID NO: 1248064 - RNA, 14 nt, Human
ugaagaagauggua

SEQ ID NO: 1248065 - RNA, 20 nt, Human
ugaagaagcaccaaucauga

SEQ ID NO: 1248066 - RNA, 15 nt, Human
ucuuuguaaugaaaa

SEQ ID NO: 1248067 - RNA, 13 nt, Human
ucuuuguaaugaa

SEQ ID NO: 1248068 - RNA, 16 nt, Human
ucuuuguaaugaaaac

SEQ ID NO: 1248069 - RNA, 12 nt, Human
ucuuuguaauga

SEQ ID NO: 1248070 - RNA, 13 nt, Human
agagcuggcucug

SEQ ID NO: 1248071 - RNA, 15 nt, Human
agagcuggcucugag

SEQ ID NO: 1248072 - RNA, 16 nt, Human
agagcuggcucugagc

SEQ ID NO: 1248073 - RNA, 11 nt, Human
agagcuggugc

SEQ ID NO: 1248074 - RNA, 15 nt, Human
agagcuucuggcacu

SEQ ID NO: 1248075 - RNA, 17 nt, Human
agagcuucccugacuca

SEQ ID NO: 1248076 - RNA, 20 nt, Human
agagcuucccugacucauuc

SEQ ID NO: 1248077 - RNA, 13 nt, Human
agagcuucccuga

SEQ ID NO: 1248078 - RNA, 16 nt, Human
agagcuucccugacuc

SEQ ID NO: 1248079 - RNA, 19 nt, Human
agagcuucuguugcugccu

SEQ ID NO: 1248080 - RNA, 20 nt, Human
agagcuucuguugcugccuc

SEQ ID NO: 1248081 - RNA, 21 nt, Human
agagcuucuguugcugccuca

SEQ ID NO: 1248082 - RNA, 22 nt, Human
agagcuucuguugcugccucau

SEQ ID NO: 1248083 - RNA, 18 nt, Human
ugaagguggaaauaaacu

SEQ ID NO: 1248084 - RNA, 19 nt, Human
ugaaggugcugacggccag

SEQ ID NO: 1248085 - RNA, 20 nt, Human
ugaaggugcugacggccagg

SEQ ID NO: 1248086 - RNA, 22 nt, Human
ugaaggugauuuaagggcccag

SEQ ID NO: 1248087 - RNA, 16 nt, Human
ugaagcuuuuauguga

SEQ ID NO: 1248088 - RNA, 21 nt, Human
ugaaggugaaacauuuucucc

SEQ ID NO: 1248089 - RNA, 15 nt, Human
ugaaggugcugacgg

SEQ ID NO: 1248090 - RNA, 15 nt, Human
ugaagguuguggccu

SEQ ID NO: 1248091 - RNA, 18 nt, Human
ugaagguuguggccuuug

SEQ ID NO: 1248092 - RNA, 21 nt, Human
ugaauauacagcaggugcuca

SEQ ID NO: 1248093 - RNA, 15 nt, Human
ugaaugcauaaaaug

SEQ ID NO: 1248094 - RNA, 16 nt, Human
ugaaugcauaaaaugu

SEQ ID NO: 1248095 - RNA, 15 nt, Human
ugaaugccacugccu

SEQ ID NO: 1248096 - RNA, 21 nt, Human
ugaaugccacugccuucgcuu

SEQ ID NO: 1248097 - RNA, 22 nt, Human
ugaaugccacugccuucgcuuc

SEQ ID NO: 1248098 - RNA, 23 nt, Human
ugaaugcuucuaaguaaauacaa

SEQ ID NO: 1248099 - RNA, 17 nt, Human
ugaaugcuucuaaguaa

SEQ ID NO: 1248100 - RNA, 18 nt, Human
agagucuauuuacggaac

SEQ ID NO: 1248101 - RNA, 14 nt, Human
agagucuagauucu

SEQ ID NO: 1248102 - RNA, 14 nt, Human
agagugaagggaag

SEQ ID NO: 1248103 - RNA, 22 nt, Human
agagugaagggaagagacagcc

SEQ ID NO: 1248104 - RNA, 16 nt, Human
agagugaauucccuca

SEQ ID NO: 1248105 - RNA, 22 nt, Human
agagugaacaaauuuacagaga

SEQ ID NO: 1248106 - RNA, 15 nt, Human
agagucuagauucaa

SEQ ID NO: 1248107 - RNA, 17 nt, Human
agagucuagauucaaag

SEQ ID NO: 1248108 - RNA, 19 nt, Human
agagucuagauucaaaggu

SEQ ID NO: 1248109 - RNA, 21 nt, Human
agagucuagauucaaagguuc

SEQ ID NO: 1248110 - RNA, 22 nt, Human
agagucuagauucaaagguucu

SEQ ID NO: 1248111 - RNA, 23 nt, Human
agagucuagauucaaagguucua

SEQ ID NO: 1248112 - RNA, 15 nt, Human
agagucuagauucuc

SEQ ID NO: 1248113 - RNA, 23 nt, Human
ugaauggccuucauaucauccac

SEQ ID NO: 1248114 - RNA, 20 nt, Human
ugaauggcuauguuuuuaau

SEQ ID NO: 1248115 - RNA, 21 nt, Human
ugaauggcuauguuuuuaaug

SEQ ID NO: 1248116 - RNA, 12 nt, Human
agagucuaaaga

SEQ ID NO: 1248117 - RNA, 13 nt, Human
agagucuaaagau

SEQ ID NO: 1248118 - RNA, 14 nt, Human
agagucuaaagaug

SEQ ID NO: 1248119 - RNA, 17 nt, Human
agagucuaaagauggag

SEQ ID NO: 1248120 - RNA, 22 nt, Human
agagucuaaagauggaguuucu

SEQ ID NO: 1248121 - RNA, 23 nt, Human
agagucuaaagauggaguuucua

SEQ ID NO: 1248122 - RNA, 11 nt, Human
agagucuagau

SEQ ID NO: 1248123 - RNA, 12 nt, Human
agagucuagauu

SEQ ID NO: 1248124 - RNA, 13 nt, Human
agagucuagauuc

SEQ ID NO: 1248125 - RNA, 18 nt, Human
agauaagguaaaaugcca

SEQ ID NO: 1248126 - RNA, 18 nt, Human
agauaauucuagcuuuga

SEQ ID NO: 1248127 - RNA, 19 nt, Human
agauaaugugauauuauac

SEQ ID NO: 1248128 - RNA, 19 nt, Human
agauaauuaccuacucugg

SEQ ID NO: 1248129 - RNA, 12 nt, Human
agauaauuauaa

SEQ ID NO: 1248130 - RNA, 13 nt, Human
agauaaucccugu

SEQ ID NO: 1248131 - RNA, 16 nt, Human
agauaaucuagaacac

SEQ ID NO: 1248132 - RNA, 23 nt, Human
agauaaucuagaacacaggcaaa

SEQ ID NO: 1248133 - RNA, 12 nt, Human
agauaaugugaa

SEQ ID NO: 1248134 - RNA, 13 nt, Human
agauaaugugaaa

SEQ ID NO: 1248135 - RNA, 18 nt, Human
agauaaugugaaaauggu

SEQ ID NO: 1248136 - RNA, 20 nt, Human
agauaaacguggauguuacu

SEQ ID NO: 1248137 - RNA, 12 nt, Human
agauaaacauua

SEQ ID NO: 1248138 - RNA, 14 nt, Human
agauaaacauuauu

SEQ ID NO: 1248139 - RNA, 14 nt, Human
agauaaacacaaga

SEQ ID NO: 1248140 - RNA, 15 nt, Human
agauaaacacaagau

SEQ ID NO: 1248141 - RNA, 17 nt, Human
agagugaauucccucac

SEQ ID NO: 1248142 - RNA, 18 nt, Human
agagugagacucagucuu

SEQ ID NO: 1248143 - RNA, 22 nt, Human
agagugagagacauuaacucau

SEQ ID NO: 1248144 - RNA, 13 nt, Human
agagugagagaca

SEQ ID NO: 1248145 - RNA, 12 nt, Human
agaguuuuggga

SEQ ID NO: 1248146 - RNA, 14 nt, Human
agauaauucacugu

SEQ ID NO: 1248147 - RNA, 18 nt, Human
agauacagaacucuuuca

SEQ ID NO: 1248148 - RNA, 20 nt, Human
agauacagaacucuuucaaa

SEQ ID NO: 1248149 - RNA, 14 nt, Human
agauaccagcgagg

SEQ ID NO: 1248150 - RNA, 19 nt, Human
agauaccagcgaggaggcu

SEQ ID NO: 1248151 - RNA, 21 nt, Human
agauaccagcgaggaggcucc

SEQ ID NO: 1248152 - RNA, 23 nt, Human
agauaccagcgaggaggcuccag

SEQ ID NO: 1248153 - RNA, 22 nt, Human
agauacccuacgcuguccagaa

SEQ ID NO: 1248154 - RNA, 23 nt, Human
agauacccuacgcuguccagaaa

SEQ ID NO: 1248155 - RNA, 17 nt, Human
agauauuuuuaucuuua

SEQ ID NO: 1248156 - RNA, 19 nt, Human
agauauuuuuaucuuuaua

SEQ ID NO: 1248157 - RNA, 20 nt, Human
agauauuuuuaucuuuauau

SEQ ID NO: 1248158 - RNA, 21 nt, Human
agauauuuuuaucuuuauaug

SEQ ID NO: 1248159 - RNA, 12 nt, Human
agauauuuuuca

SEQ ID NO: 1248160 - RNA, 13 nt, Human
agauauuuuucau

SEQ ID NO: 1248161 - RNA, 16 nt, Human
agauauuuuucaugau

SEQ ID NO: 1248162 - RNA, 19 nt, Human
agauauuuuucaugauuuu

SEQ ID NO: 1248163 - RNA, 19 nt, Human
agauauuuuuccauuuuuu

SEQ ID NO: 1248164 - RNA, 11 nt, Human
agaucacuuuc

SEQ ID NO: 1248165 - RNA, 21 nt, Human
agaucauugugaaauuauuca

SEQ ID NO: 1248166 - RNA, 14 nt, Human
ugaccacagcacag

SEQ ID NO: 1248167 - RNA, 18 nt, Human
agauccaaaagaagcccc

SEQ ID NO: 1248168 - RNA, 23 nt, Human
agauccaaaagaagcccccagcu

SEQ ID NO: 1248169 - RNA, 21 nt, Human
agauccaaaagaagcccccag

SEQ ID NO: 1248170 - RNA, 12 nt, Human
ugaccacacucc

SEQ ID NO: 1248171 - RNA, 17 nt, Human
ugaccacacuccagcug

SEQ ID NO: 1248172 - RNA, 19 nt, Human
ugaccacacuccagcuggg

SEQ ID NO: 1248173 - RNA, 20 nt, Human
ugaccacacuccagcuggga

SEQ ID NO: 1248174 - RNA, 13 nt, Human
agauccagccugg

SEQ ID NO: 1248175 - RNA, 14 nt, Human
agauccagccuggg

SEQ ID NO: 1248176 - RNA, 13 nt, Human
agauccaggacua

SEQ ID NO: 1248177 - RNA, 12 nt, Human
agauccaggacu

SEQ ID NO: 1248178 - RNA, 16 nt, Human
agaugauggaugccaa

SEQ ID NO: 1248179 - RNA, 19 nt, Human
agaugauggaugccaauau

SEQ ID NO: 1248180 - RNA, 18 nt, Human
agaugauuaaauaagauu

SEQ ID NO: 1248181 - RNA, 19 nt, Human
agaugauuaaauaagauuc

SEQ ID NO: 1248182 - RNA, 20 nt, Human
agaugauuaaauaagauucu

SEQ ID NO: 1248183 - RNA, 21 nt, Human
agaugauuaaauaagauucua

SEQ ID NO: 1248184 - RNA, 22 nt, Human
agaugauuaaauaagauucuaa

SEQ ID NO: 1248185 - RNA, 20 nt, Human
agaugauuucaguucuagga

SEQ ID NO: 1248186 - RNA, 23 nt, Human
agaugauuucaguucuaggaaaa

SEQ ID NO: 1248187 - RNA, 16 nt, Human
ugacauuuuacauuaa

SEQ ID NO: 1248188 - RNA, 15 nt, Human
ugacauuuuacauua

SEQ ID NO: 1248189 - RNA, 15 nt, Human
ugaccaaaaguuaca

SEQ ID NO: 1248190 - RNA, 16 nt, Human
ugaccaaaaguuacau

SEQ ID NO: 1248191 - RNA, 22 nt, Human
ugaccaaaaguuacauguuugc

SEQ ID NO: 1248192 - RNA, 23 nt, Human
ugaccaaaaguuacauguuugca

SEQ ID NO: 1248193 - RNA, 14 nt, Human
ugaccaaaguccuu

SEQ ID NO: 1248194 - RNA, 16 nt, Human
ugaccaaaguccuuuu

SEQ ID NO: 1248195 - RNA, 14 nt, Human
ugacauuuuacauu

SEQ ID NO: 1248196 - RNA, 12 nt, Human
ugacauuuuaca

SEQ ID NO: 1248197 - RNA, 22 nt, Human
ugacauuguagagcuucuggca

SEQ ID NO: 1248198 - RNA, 18 nt, Human
ugacauuguagagcuucu

SEQ ID NO: 1248199 - RNA, 21 nt, Human
ugacaguauuauacgcuggca

SEQ ID NO: 1248200 - RNA, 18 nt, Human
ugacaguccgucaaaaca

SEQ ID NO: 1248201 - RNA, 22 nt, Human
ugacaguccgucaaaacagauu

SEQ ID NO: 1248202 - RNA, 19 nt, Human
ugacauucugaaugcuucu

SEQ ID NO: 1248203 - RNA, 20 nt, Human
ugacauucugaaugcuucua

SEQ ID NO: 1248204 - RNA, 15 nt, Human
ugacauugcguuuga

SEQ ID NO: 1248205 - RNA, 19 nt, Human
ugacauugcguuugaccuu

SEQ ID NO: 1248206 - RNA, 15 nt, Human
ugacaguaauugugu

SEQ ID NO: 1248207 - RNA, 14 nt, Human
ugacaguaauugug

SEQ ID NO: 1248208 - RNA, 22 nt, Human
ugacaguaauuguguuuacauu

SEQ ID NO: 1248209 - RNA, 21 nt, Human
ugacaguaauuguguuuacau

SEQ ID NO: 1248210 - RNA, 20 nt, Human
ugacaguaauuguguuuaca

SEQ ID NO: 1248211 - RNA, 22 nt, Human
ugacaguauuauacgcuggcaa

SEQ ID NO: 1248212 - RNA, 18 nt, Human
agaucacuuucucaguuu

SEQ ID NO: 1248213 - RNA, 19 nt, Human
agaucacuuucucaguuuu

SEQ ID NO: 1248214 - RNA, 23 nt, Human
agaucacuuucucaguuuucaua

SEQ ID NO: 1248215 - RNA, 18 nt, Human
agaucagaugcuccaaga

SEQ ID NO: 1248216 - RNA, 22 nt, Human
agaucagaugcuccaagauucu

SEQ ID NO: 1248217 - RNA, 20 nt, Human
agaucagcaaaccggggccu

SEQ ID NO: 1248218 - RNA, 23 nt, Human
agaucagaugcuccaagauucua

SEQ ID NO: 1248219 - RNA, 19 nt, Human
ugaauuuaauaaucuguag

SEQ ID NO: 1248220 - RNA, 15 nt, Human
ugaauuuagugagca

SEQ ID NO: 1248221 - RNA, 21 nt, Human
ugaauuuagugagcauaggug

SEQ ID NO: 1248222 - RNA, 17 nt, Human
ugaauuuagugagcaua

SEQ ID NO: 1248223 - RNA, 18 nt, Human
agauguguucacaaugga

SEQ ID NO: 1248224 - RNA, 15 nt, Human
agauguguucacaau

SEQ ID NO: 1248225 - RNA, 13 nt, Human
agauguguguuga

SEQ ID NO: 1248226 - RNA, 15 nt, Human
agauguguguugaua

SEQ ID NO: 1248227 - RNA, 17 nt, Human
agauguguguugauacu

SEQ ID NO: 1248228 - RNA, 18 nt, Human
agauguguguugauacug

SEQ ID NO: 1248229 - RNA, 19 nt, Human
agauguguguugauacugu

SEQ ID NO: 1248230 - RNA, 20 nt, Human
agauguguguugauacuguu

SEQ ID NO: 1248231 - RNA, 21 nt, Human
agauguguguugauacuguug

SEQ ID NO: 1248232 - RNA, 22 nt, Human
agauguguguugauacuguugc

SEQ ID NO: 1248233 - RNA, 23 nt, Human
ugacccagugcccccacugacca

SEQ ID NO: 1248234 - RNA, 17 nt, Human
ugacccagugcccccac

SEQ ID NO: 1248235 - RNA, 18 nt, Human
ugacccagugcccccacu

SEQ ID NO: 1248236 - RNA, 16 nt, Human
ugacccagugccccca

SEQ ID NO: 1248237 - RNA, 23 nt, Human
agauguguguugauacuguugca

SEQ ID NO: 1248238 - RNA, 24 nt, Human
agauguguguugauacuguugcac

SEQ ID NO: 1248239 - RNA, 19 nt, Human
ugaccccucauagcccuca

SEQ ID NO: 1248240 - RNA, 20 nt, Human
ugaccccucauagcccucac

SEQ ID NO: 1248241 - RNA, 22 nt, Human
ugacccccaaccaaguggcucc

SEQ ID NO: 1248242 - RNA, 22 nt, Human
ugaccccagggcacaggagcua

SEQ ID NO: 1248243 - RNA, 14 nt, Human
ugacccccagcucc

SEQ ID NO: 1248244 - RNA, 17 nt, Human
ugaccccucauagcccu

SEQ ID NO: 1248245 - RNA, 23 nt, Human
ugaccccucauagcccucacccu

SEQ ID NO: 1248246 - RNA, 11 nt, Human
agaugcuuuua

SEQ ID NO: 1248247 - RNA, 20 nt, Human
agaugcuuuuaacagagucu

SEQ ID NO: 1248248 - RNA, 18 nt, Human
agaugcuuuuaacagagu

SEQ ID NO: 1248249 - RNA, 18 nt, Human
agauggaaaauucauuuu

SEQ ID NO: 1248250 - RNA, 22 nt, Human
agauggaaaauucauuuuuuaa

SEQ ID NO: 1248251 - RNA, 23 nt, Human
agaugcuagaacucccuuucaac

SEQ ID NO: 1248252 - RNA, 13 nt, Human
agaugcuccaaga

SEQ ID NO: 1248253 - RNA, 15 nt, Human
agaugcuccaagauu

SEQ ID NO: 1248254 - RNA, 18 nt, Human
agaugcuccaagauucua

SEQ ID NO: 1248255 - RNA, 19 nt, Human
agaugcuccaagauucuag

SEQ ID NO: 1248256 - RNA, 20 nt, Human
agaugcuccaagauucuaga

SEQ ID NO: 1248257 - RNA, 21 nt, Human
agaugcuccaagauucuagau

SEQ ID NO: 1248258 - RNA, 22 nt, Human
agaugcuccaagauucuagaug

SEQ ID NO: 1248259 - RNA, 23 nt, Human
agaugcuccaagauucuagauga

SEQ ID NO: 1248260 - RNA, 14 nt, Human
agaugucuauauug

SEQ ID NO: 1248261 - RNA, 23 nt, Human
agauguccaucagaugacaagaa

SEQ ID NO: 1248262 - RNA, 21 nt, Human
agauguccaucagaugacaag

SEQ ID NO: 1248263 - RNA, 23 nt, Human
agaugucauuuaguucagcaucc

SEQ ID NO: 1248264 - RNA, 17 nt, Human
agaugcuuuuugaucua

SEQ ID NO: 1248265 - RNA, 13 nt, Human
agauggaguuucu

SEQ ID NO: 1248266 - RNA, 14 nt, Human
agauggaguuucua

SEQ ID NO: 1248267 - RNA, 15 nt, Human
agauggaguuucuaa

SEQ ID NO: 1248268 - RNA, 16 nt, Human
agauggaguuucuaag

SEQ ID NO: 1248269 - RNA, 17 nt, Human
agauggaguuucuaagg

SEQ ID NO: 1248270 - RNA, 18 nt, Human
agauggaguuucuaaggu

SEQ ID NO: 1248271 - RNA, 14 nt, Human
agauggcacuuuga

SEQ ID NO: 1248272 - RNA, 23 nt, Human
agauuauauauauuuuuuucuga

SEQ ID NO: 1248273 - RNA, 20 nt, Human
agauuauaggcaccuaccac

SEQ ID NO: 1248274 - RNA, 23 nt, Human
agauuauagauucuaaagauucu

SEQ ID NO: 1248275 - RNA, 15 nt, Human
agauuaucguuuucu

SEQ ID NO: 1248276 - RNA, 16 nt, Human
agauuaucguuuucuu

SEQ ID NO: 1248277 - RNA, 17 nt, Human
agauuaucguuuucuua

SEQ ID NO: 1248278 - RNA, 19 nt, Human
agauuaucguuuucuuaaa

SEQ ID NO: 1248279 - RNA, 22 nt, Human
ugacuugggcacccccagccug

SEQ ID NO: 1248280 - RNA, 14 nt, Human
agauucaaagguuc

SEQ ID NO: 1248281 - RNA, 15 nt, Human
agauucaaagguucu

SEQ ID NO: 1248282 - RNA, 16 nt, Human
agauucaaagguucua

SEQ ID NO: 1248283 - RNA, 17 nt, Human
agauucaaagguucuag

SEQ ID NO: 1248284 - RNA, 18 nt, Human
agauucaaagguucuagg

SEQ ID NO: 1248285 - RNA, 19 nt, Human
agauucaaagguucuaggu

SEQ ID NO: 1248286 - RNA, 21 nt, Human
agauucaaugccccugaauuu

SEQ ID NO: 1248287 - RNA, 16 nt, Human
agauucaaucccagga

SEQ ID NO: 1248288 - RNA, 22 nt, Human
agauucaaugccccugaauuua

SEQ ID NO: 1248289 - RNA, 21 nt, Human
agauucaaagguucuagguuu

SEQ ID NO: 1248290 - RNA, 22 nt, Human
ugacuugaagacuuacagcaaa

SEQ ID NO: 1248291 - RNA, 18 nt, Human
ugacuucugccuggagac

SEQ ID NO: 1248292 - RNA, 12 nt, Human
ugacuuggcugg

SEQ ID NO: 1248293 - RNA, 13 nt, Human
ugacuuggcuggu

SEQ ID NO: 1248294 - RNA, 15 nt, Human
ugacuuggcuggugu

SEQ ID NO: 1248295 - RNA, 16 nt, Human
ugacuuggcuggugug

SEQ ID NO: 1248296 - RNA, 21 nt, Human
ugacuuggcuggugugguaca

SEQ ID NO: 1248297 - RNA, 17 nt, Human
ugacuugggcaccccca

SEQ ID NO: 1248298 - RNA, 19 nt, Human
ugacuugggcacccccagc

SEQ ID NO: 1248299 - RNA, 21 nt, Human
ugacuugggcacccccagccu

SEQ ID NO: 1248300 - RNA, 23 nt, Human
ugacuugggcacccccagccugg

SEQ ID NO: 1248301 - RNA, 12 nt, Human
ugacuuguauau

SEQ ID NO: 1248302 - RNA, 19 nt, Human
ugacuuguauauuuuaaga

SEQ ID NO: 1248303 - RNA, 15 nt, Human
ugacuugugucccau

SEQ ID NO: 1248304 - RNA, 13 nt, Human
ugacuucugagau

SEQ ID NO: 1248305 - RNA, 12 nt, Human
ugacuucugccu

SEQ ID NO: 1248306 - RNA, 13 nt, Human
ugacuucugccug

SEQ ID NO: 1248307 - RNA, 15 nt, Human
ugacuucugccugga

SEQ ID NO: 1248308 - RNA, 16 nt, Human
ugacuucugccuggag

SEQ ID NO: 1248309 - RNA, 15 nt, Human
ugacuguuuccauca

SEQ ID NO: 1248310 - RNA, 14 nt, Human
ugacugucugggga

SEQ ID NO: 1248311 - RNA, 22 nt, Human
ugacugucuggggagcgggucu

SEQ ID NO: 1248312 - RNA, 21 nt, Human
ugacugugguagccagcaucg

SEQ ID NO: 1248313 - RNA, 13 nt, Human
ugacugucacugu

SEQ ID NO: 1248314 - RNA, 16 nt, Human
ugacugucacuguucc

SEQ ID NO: 1248315 - RNA, 17 nt, Human
ugacugucacuguuccu

SEQ ID NO: 1248316 - RNA, 12 nt, Human
ugacugucuggg

SEQ ID NO: 1248317 - RNA, 12 nt, Human
ugacucaggagc

SEQ ID NO: 1248318 - RNA, 14 nt, Human
ugacucaggagccu

SEQ ID NO: 1248319 - RNA, 15 nt, Human
ugacucaggagccug

SEQ ID NO: 1248320 - RNA, 19 nt, Human
ugacucaggagccugugac

SEQ ID NO: 1248321 - RNA, 21 nt, Human
ugacucaggagccugugacau

SEQ ID NO: 1248322 - RNA, 13 nt, Human
ugacucagggcuc

SEQ ID NO: 1248323 - RNA, 14 nt, Human
ugacucagggcucc

SEQ ID NO: 1248324 - RNA, 15 nt, Human
ugacucagggcuccu

SEQ ID NO: 1248325 - RNA, 17 nt, Human
ugacucagggcuccugg

SEQ ID NO: 1248326 - RNA, 18 nt, Human
ugacucagggcuccuggg

SEQ ID NO: 1248327 - RNA, 19 nt, Human
ugacucagggcuccugggu

SEQ ID NO: 1248328 - RNA, 20 nt, Human
ugacucauucugaaggagcc

SEQ ID NO: 1248329 - RNA, 14 nt, Human
agauuuuccugaaa

SEQ ID NO: 1248330 - RNA, 19 nt, Human
agauuuucagcaaacucuu

SEQ ID NO: 1248331 - RNA, 21 nt, Human
agcaacaauuuaugaauugaa

SEQ ID NO: 1248332 - RNA, 12 nt, Human
agcaacauggcu

SEQ ID NO: 1248333 - RNA, 13 nt, Human
agcaacauggcuu

SEQ ID NO: 1248334 - RNA, 15 nt, Human
agcaacauucauagu

SEQ ID NO: 1248335 - RNA, 14 nt, Human
agcaacauggcuuu

SEQ ID NO: 1248336 - RNA, 14 nt, Human
agcaaccccaggcu

SEQ ID NO: 1248337 - RNA, 15 nt, Human
agcaaccccaggcug

SEQ ID NO: 1248338 - RNA, 16 nt, Human
agcaaccccaggcuga

SEQ ID NO: 1248339 - RNA, 14 nt, Human
agauuuaugcauau

SEQ ID NO: 1248340 - RNA, 16 nt, Human
agauuuaauauuacag

SEQ ID NO: 1248341 - RNA, 18 nt, Human
agauuuaauauuacagau

SEQ ID NO: 1248342 - RNA, 20 nt, Human
agauuuaaucugccaagggc

SEQ ID NO: 1248343 - RNA, 16 nt, Human
agauuuaccacuugug

SEQ ID NO: 1248344 - RNA, 13 nt, Human
agauuguccuuuu

SEQ ID NO: 1248345 - RNA, 20 nt, Human
agauuguccuuuugcaaaga

SEQ ID NO: 1248346 - RNA, 23 nt, Human
agauuuaauauaaaguuuuauau

SEQ ID NO: 1248347 - RNA, 21 nt, Human
agauugugccccugcacucca

SEQ ID NO: 1248348 - RNA, 16 nt, Human
agauugugccccugca

SEQ ID NO: 1248349 - RNA, 22 nt, Human
agauucacuuaacaaacaaauu

SEQ ID NO: 1248350 - RNA, 14 nt, Human
agauugguguuuuu

SEQ ID NO: 1248351 - RNA, 19 nt, Human
agauugguguuuuuuucua

SEQ ID NO: 1248352 - RNA, 20 nt, Human
agauugguguuuuuuucuau

SEQ ID NO: 1248353 - RNA, 14 nt, Human
agauuuauuaaaga

SEQ ID NO: 1248354 - RNA, 15 nt, Human
agauuuauuaaagaa

SEQ ID NO: 1248355 - RNA, 16 nt, Human
agauuuauuaaagaaa

SEQ ID NO: 1248356 - RNA, 17 nt, Human
agauuuauuaaagaaaa

SEQ ID NO: 1248357 - RNA, 18 nt, Human
agauuuauuaaagaaaaa

SEQ ID NO: 1248358 - RNA, 15 nt, Human
agauuuauuccuuug

SEQ ID NO: 1248359 - RNA, 16 nt, Human
agauuuauuccuuugu

SEQ ID NO: 1248360 - RNA, 17 nt, Human
agauuuauuccuuuguu

SEQ ID NO: 1248361 - RNA, 19 nt, Human
agauuuauuaaagaaaaaa

SEQ ID NO: 1248362 - RNA, 17 nt, Human
agauuuggcuugacaaa

SEQ ID NO: 1248363 - RNA, 15 nt, Human
ugagguaaguuuuuu

SEQ ID NO: 1248364 - RNA, 17 nt, Human
ugagguacugagaguga

SEQ ID NO: 1248365 - RNA, 23 nt, Human
ugagggucuguagguugcacacu

SEQ ID NO: 1248366 - RNA, 22 nt, Human
ugagggucuguagguugcacac

SEQ ID NO: 1248367 - RNA, 22 nt, Human
ugagguacugagagugaacaaa

SEQ ID NO: 1248368 - RNA, 19 nt, Human
ugagguacaaccuguucug

SEQ ID NO: 1248369 - RNA, 24 nt, Human
agcagauucagaaaugaggccaug

SEQ ID NO: 1248370 - RNA, 17 nt, Human
agcagcaacuuguccua

SEQ ID NO: 1248371 - RNA, 23 nt, Human
agcagagcugauggagaaggaag

SEQ ID NO: 1248372 - RNA, 22 nt, Human
agcagagcugauggagaaggaa

SEQ ID NO: 1248373 - RNA, 21 nt, Human
agcagagcugauggagaagga

SEQ ID NO: 1248374 - RNA, 19 nt, Human
agcagagcugauggagaag

SEQ ID NO: 1248375 - RNA, 17 nt, Human
agcagagcugauggaga

SEQ ID NO: 1248376 - RNA, 18 nt, Human
agcagagcuagguggaaa

SEQ ID NO: 1248377 - RNA, 13 nt, Human
agcagaggucucc

SEQ ID NO: 1248378 - RNA, 14 nt, Human
agcagaggggcuga

SEQ ID NO: 1248379 - RNA, 20 nt, Human
agcagaggggcagaggccca

SEQ ID NO: 1248380 - RNA, 19 nt, Human
ugaggggcuaccaggaaag

SEQ ID NO: 1248381 - RNA, 17 nt, Human
ugaggggcuaccaggaa

SEQ ID NO: 1248382 - RNA, 16 nt, Human
ugaggggcuaccagga

SEQ ID NO: 1248383 - RNA, 20 nt, Human
ugagggggggcucccugggg

SEQ ID NO: 1248384 - RNA, 13 nt, Human
ugagggguuccuc

SEQ ID NO: 1248385 - RNA, 15 nt, Human
ugagggguuccuccc

SEQ ID NO: 1248386 - RNA, 16 nt, Human
ugagggguuccucccc

SEQ ID NO: 1248387 - RNA, 17 nt, Human
ugagggguuccuccccu

SEQ ID NO: 1248388 - RNA, 22 nt, Human
ugagggguuccuccccuccagc

SEQ ID NO: 1248389 - RNA, 14 nt, Human
ugaggguaaguauu

SEQ ID NO: 1248390 - RNA, 18 nt, Human
ugagggguuccuccccuc

SEQ ID NO: 1248391 - RNA, 15 nt, Human
ugagggucuguaggu

SEQ ID NO: 1248392 - RNA, 18 nt, Human
ugagggucuguagguugc

SEQ ID NO: 1248393 - RNA, 18 nt, Human
ugaggggaagcuagucuu

SEQ ID NO: 1248394 - RNA, 13 nt, Human
ugaggggaccagg

SEQ ID NO: 1248395 - RNA, 14 nt, Human
ugaggggaccagga

SEQ ID NO: 1248396 - RNA, 15 nt, Human
ugaggggaccaggag

SEQ ID NO: 1248397 - RNA, 16 nt, Human
ugaggggaccaggagu

SEQ ID NO: 1248398 - RNA, 18 nt, Human
ugaggggaccaggagugg

SEQ ID NO: 1248399 - RNA, 22 nt, Human
ugaggggaccaggagugggugg

SEQ ID NO: 1248400 - RNA, 11 nt, Human
ugagggcaguc

SEQ ID NO: 1248401 - RNA, 18 nt, Human
ugagggcaguucgcagcc

SEQ ID NO: 1248402 - RNA, 19 nt, Human
ugagggcaguucgcagcca

SEQ ID NO: 1248403 - RNA, 20 nt, Human
ugagggcaguucgcagccac

SEQ ID NO: 1248404 - RNA, 21 nt, Human
ugagggcaguucgcagccacc

SEQ ID NO: 1248405 - RNA, 23 nt, Human
ugagggcaguucgcagccacccu

SEQ ID NO: 1248406 - RNA, 15 nt, Human
ugagggauuaucuuu

SEQ ID NO: 1248407 - RNA, 12 nt, Human
ugagggcagcag

SEQ ID NO: 1248408 - RNA, 13 nt, Human
ugagggcagcagc

SEQ ID NO: 1248409 - RNA, 14 nt, Human
ugagggcagcagcc

SEQ ID NO: 1248410 - RNA, 15 nt, Human
ugagggcagcagcca

SEQ ID NO: 1248411 - RNA, 16 nt, Human
ugagggcagcagccag

SEQ ID NO: 1248412 - RNA, 17 nt, Human
ugagggcagcagccagc

SEQ ID NO: 1248413 - RNA, 18 nt, Human
ugagggcagcagccagcc

SEQ ID NO: 1248414 - RNA, 20 nt, Human
ugagggcagcagccagcccu

SEQ ID NO: 1248415 - RNA, 21 nt, Human
ugagggcagcagccagcccug

SEQ ID NO: 1248416 - RNA, 22 nt, Human
ugagggcagcagccagcccugc

SEQ ID NO: 1248417 - RNA, 23 nt, Human
ugagggcagcagccagcccugcc

SEQ ID NO: 1248418 - RNA, 23 nt, Human
ugaggcccuccacaccugcggcc

SEQ ID NO: 1248419 - RNA, 16 nt, Human
ugaggccuagacucug

SEQ ID NO: 1248420 - RNA, 12 nt, Human
ugaggcccucca

SEQ ID NO: 1248421 - RNA, 13 nt, Human
ugaggcccuccac

SEQ ID NO: 1248422 - RNA, 17 nt, Human
ugaggcccuccacaccu

SEQ ID NO: 1248423 - RNA, 18 nt, Human
ugaggcccuccacaccug

SEQ ID NO: 1248424 - RNA, 19 nt, Human
ugaggcccuccacaccugc

SEQ ID NO: 1248425 - RNA, 21 nt, Human
ugaggcccuccacaccugcgg

SEQ ID NO: 1248426 - RNA, 22 nt, Human
ugaggcccuccacaccugcggc

SEQ ID NO: 1248427 - RNA, 14 nt, Human
ugagcuaggaauug

SEQ ID NO: 1248428 - RNA, 13 nt, Human
ugagcuuucugaa

SEQ ID NO: 1248429 - RNA, 14 nt, Human
ugagcuuucugaac

SEQ ID NO: 1248430 - RNA, 16 nt, Human
ugagcuuucugaacag

SEQ ID NO: 1248431 - RNA, 17 nt, Human
ugagcuuucugaacagc

SEQ ID NO: 1248432 - RNA, 18 nt, Human
ugagcuuucugaacagcu

SEQ ID NO: 1248433 - RNA, 19 nt, Human
ugagcuuucugaacagcug

SEQ ID NO: 1248434 - RNA, 20 nt, Human
ugagcuuucugaacagcugg

SEQ ID NO: 1248435 - RNA, 22 nt, Human
ugagcuuucugaacagcuggug

SEQ ID NO: 1248436 - RNA, 23 nt, Human
ugagcuuucugaacagcuggugu

SEQ ID NO: 1248437 - RNA, 16 nt, Human
ugagcuacaaaugcau

SEQ ID NO: 1248438 - RNA, 15 nt, Human
ugagcgugacacuca

SEQ ID NO: 1248439 - RNA, 21 nt, Human
ugagcuaaauaaagauauugu

SEQ ID NO: 1248440 - RNA, 24 nt, Human
ugagcuacugccgucagugcugug

SEQ ID NO: 1248441 - RNA, 21 nt, Human
ugagcuacugccgucagugcu

SEQ ID NO: 1248442 - RNA, 16 nt, Human
ugagcuagaacccucu

SEQ ID NO: 1248443 - RNA, 18 nt, Human
ugagcuagaacccucugu

SEQ ID NO: 1248444 - RNA, 17 nt, Human
ugagcuagaacccucug

SEQ ID NO: 1248445 - RNA, 14 nt, Human
ugagcuacaaaugc

SEQ ID NO: 1248446 - RNA, 13 nt, Human
ugagcuacaaaug

SEQ ID NO: 1248447 - RNA, 13 nt, Human
ugagccuuguaau

SEQ ID NO: 1248448 - RNA, 16 nt, Human
ugagccuuuucccucu

SEQ ID NO: 1248449 - RNA, 22 nt, Human
ugagcgaggagaugcuccuugg

SEQ ID NO: 1248450 - RNA, 23 nt, Human
ugagcgaggagaugcuccuuggg

SEQ ID NO: 1248451 - RNA, 21 nt, Human
ugagcgaguggagucugccac

SEQ ID NO: 1248452 - RNA, 23 nt, Human
ugagcgaguggagucugccaccc

SEQ ID NO: 1248453 - RNA, 12 nt, Human
ugagcgccagga

SEQ ID NO: 1248454 - RNA, 18 nt, Human
ugagcgccuccauccaag

SEQ ID NO: 1248455 - RNA, 23 nt, Human
ugagcgccuccauccaaggccag

SEQ ID NO: 1248456 - RNA, 20 nt, Human
ugagcgccuccauccaaggc

SEQ ID NO: 1248457 - RNA, 18 nt, Human
ugaggaacggaucagaug

SEQ ID NO: 1248458 - RNA, 18 nt, Human
ugaggaaagcaagaauca

SEQ ID NO: 1248459 - RNA, 19 nt, Human
ugaggaaagcauguauuca

SEQ ID NO: 1248460 - RNA, 13 nt, Human
ugaggccagacca

SEQ ID NO: 1248461 - RNA, 21 nt, Human
ugaggccacuguguuccuucc

SEQ ID NO: 1248462 - RNA, 12 nt, Human
ugaggccagccu

SEQ ID NO: 1248463 - RNA, 13 nt, Human
ugaggccagccug

SEQ ID NO: 1248464 - RNA, 14 nt, Human
ugaggccagccugg

SEQ ID NO: 1248465 - RNA, 15 nt, Human
ugaggccagccuggc

SEQ ID NO: 1248466 - RNA, 16 nt, Human
ugaggccagccuggcc

SEQ ID NO: 1248467 - RNA, 17 nt, Human
ugaggccagccuggccu

SEQ ID NO: 1248468 - RNA, 18 nt, Human
ugaggccagccuggccuc

SEQ ID NO: 1248469 - RNA, 20 nt, Human
ugaggccagccuggccuccu

SEQ ID NO: 1248470 - RNA, 21 nt, Human
ugaggccagccuggccuccug

SEQ ID NO: 1248471 - RNA, 22 nt, Human
ugaggccagccuggccuccugc

SEQ ID NO: 1248472 - RNA, 13 nt, Human
ugaggccagggca

SEQ ID NO: 1248473 - RNA, 14 nt, Human
ugaggccagggcag

SEQ ID NO: 1248474 - RNA, 15 nt, Human
ugaggccagggcaga

SEQ ID NO: 1248475 - RNA, 16 nt, Human
ugaggccagggcagag

SEQ ID NO: 1248476 - RNA, 14 nt, Human
ugaggccauggacu

SEQ ID NO: 1248477 - RNA, 20 nt, Human
ugaggccauggacucugucc

SEQ ID NO: 1248478 - RNA, 23 nt, Human
ugaggccauggacucuguccuga

SEQ ID NO: 1248479 - RNA, 16 nt, Human
ugaggacacaugucca

SEQ ID NO: 1248480 - RNA, 15 nt, Human
ugaggacagaugccu

SEQ ID NO: 1248481 - RNA, 18 nt, Human
ugaggacagaugccuccu

SEQ ID NO: 1248482 - RNA, 20 nt, Human
ugaggacagaugccuccuuc

SEQ ID NO: 1248483 - RNA, 15 nt, Human
ugaggacacugauau

SEQ ID NO: 1248484 - RNA, 15 nt, Human
ugaggacacaugucc

SEQ ID NO: 1248485 - RNA, 14 nt, Human
ugaggacacauguc

SEQ ID NO: 1248486 - RNA, 13 nt, Human
ugaggacacaugu

SEQ ID NO: 1248487 - RNA, 12 nt, Human
ugaggacacaug

SEQ ID NO: 1248488 - RNA, 20 nt, Human
ugaggccacacucagcacaa

SEQ ID NO: 1248489 - RNA, 23 nt, Human
ugaggccacacucagcacaaggc

SEQ ID NO: 1248490 - RNA, 16 nt, Human
ugaggccacccagagg

SEQ ID NO: 1248491 - RNA, 15 nt, Human
ugaggccacuguguu

SEQ ID NO: 1248492 - RNA, 12 nt, Human
ugaggccacacu

SEQ ID NO: 1248493 - RNA, 13 nt, Human
ugaggccacacuc

SEQ ID NO: 1248494 - RNA, 19 nt, Human
ugaggccacacucagcaca

SEQ ID NO: 1248495 - RNA, 15 nt, Human
ugaggaauuucaccu

SEQ ID NO: 1248496 - RNA, 21 nt, Human
ugaggaauuucaccuguaaac

SEQ ID NO: 1248497 - RNA, 22 nt, Human
ugaggaauuucaccuguaaacc

SEQ ID NO: 1248498 - RNA, 13 nt, Human
ugaggaauuuucu

SEQ ID NO: 1248499 - RNA, 14 nt, Human
ugaggaauuuucuu

SEQ ID NO: 1248500 - RNA, 18 nt, Human
ugaggaauuuucuuugug

SEQ ID NO: 1248501 - RNA, 19 nt, Human
ugaggacaaccauuccaga

SEQ ID NO: 1248502 - RNA, 20 nt, Human
ugaggacaaccauuccagac

SEQ ID NO: 1248503 - RNA, 13 nt, Human
ugaggacaagaga

SEQ ID NO: 1248504 - RNA, 22 nt, Human
ugaggacaagagaaaaaagcca

SEQ ID NO: 1248505 - RNA, 15 nt, Human
agcacagugaucaag

SEQ ID NO: 1248506 - RNA, 16 nt, Human
agcacagcuuagauuu

SEQ ID NO: 1248507 - RNA, 18 nt, Human
agcacagcuuagauuuca

SEQ ID NO: 1248508 - RNA, 20 nt, Human
agcacagcuuagauuucaua

SEQ ID NO: 1248509 - RNA, 16 nt, Human
agcacauauggaauuu

SEQ ID NO: 1248510 - RNA, 22 nt, Human
agcacagccucuuagaugcagu

SEQ ID NO: 1248511 - RNA, 12 nt, Human
agcacagcccuu

SEQ ID NO: 1248512 - RNA, 12 nt, Human
agcacagccuag

SEQ ID NO: 1248513 - RNA, 16 nt, Human
agcaccaaucaugaau

SEQ ID NO: 1248514 - RNA, 17 nt, Human
agcaccaaaucaaaauc

SEQ ID NO: 1248515 - RNA, 18 nt, Human
agcaccaaaucaaaaucu

SEQ ID NO: 1248516 - RNA, 22 nt, Human
agcaccaaaucaaaaucucucc

SEQ ID NO: 1248517 - RNA, 22 nt, Human
agcaccaccaaacacaguguau

SEQ ID NO: 1248518 - RNA, 20 nt, Human
agcacaucucaacaggccuc

SEQ ID NO: 1248519 - RNA, 15 nt, Human
agcacaucucaacag

SEQ ID NO: 1248520 - RNA, 16 nt, Human
agcacaucucaacagg

SEQ ID NO: 1248521 - RNA, 19 nt, Human
agcacaucucaacaggccu

SEQ ID NO: 1248522 - RNA, 23 nt, Human
agcacaucucaacaggccucagg

SEQ ID NO: 1248523 - RNA, 15 nt, Human
agcaaguucgucugu

SEQ ID NO: 1248524 - RNA, 21 nt, Human
agcacagcagccccugcacaa

SEQ ID NO: 1248525 - RNA, 13 nt, Human
agcacagcagccu

SEQ ID NO: 1248526 - RNA, 15 nt, Human
agcacagcagccugg

SEQ ID NO: 1248527 - RNA, 23 nt, Human
agcacagcagccuggggcuggcc

SEQ ID NO: 1248528 - RNA, 12 nt, Human
agcacagccaac

SEQ ID NO: 1248529 - RNA, 13 nt, Human
agcacagccaaca

SEQ ID NO: 1248530 - RNA, 23 nt, Human
agcacagccaacacgcaccugcc

SEQ ID NO: 1248531 - RNA, 18 nt, Human
agcaaguucgucuguugu

SEQ ID NO: 1248532 - RNA, 10 nt, Human
agcacagcag

SEQ ID NO: 1248533 - RNA, 12 nt, Human
agcacagcagcc

SEQ ID NO: 1248534 - RNA, 22 nt, Human
ugagccagggucuccagaaagc

SEQ ID NO: 1248535 - RNA, 13 nt, Human
ugagccagggucu

SEQ ID NO: 1248536 - RNA, 21 nt, Human
ugagcaacgcuauuccagcug

SEQ ID NO: 1248537 - RNA, 16 nt, Human
ugagcaacucuugauu

SEQ ID NO: 1248538 - RNA, 18 nt, Human
ugagcaacucuugauuau

SEQ ID NO: 1248539 - RNA, 16 nt, Human
ugagcaaauguggcuc

SEQ ID NO: 1248540 - RNA, 18 nt, Human
ugagcaaauguggcuccu

SEQ ID NO: 1248541 - RNA, 19 nt, Human
ugagcaaauguggcuccug

SEQ ID NO: 1248542 - RNA, 15 nt, Human
agcaaccguggcccu

SEQ ID NO: 1248543 - RNA, 16 nt, Human
agcaaccguggcccuu

SEQ ID NO: 1248544 - RNA, 19 nt, Human
agcaaccguggcccuuccu

SEQ ID NO: 1248545 - RNA, 20 nt, Human
agcaaccguggcccuuccug

SEQ ID NO: 1248546 - RNA, 21 nt, Human
agcaaccguggcccuuccugg

SEQ ID NO: 1248547 - RNA, 22 nt, Human
agcaaccguggcccuuccugga

SEQ ID NO: 1248548 - RNA, 15 nt, Human
agcaaccucaguaau

SEQ ID NO: 1248549 - RNA, 23 nt, Human
agcaaccguggcccuuccuggac

SEQ ID NO: 1248550 - RNA, 15 nt, Human
agcaaccuguagagu

SEQ ID NO: 1248551 - RNA, 17 nt, Human
ugagcacagccuagggc

SEQ ID NO: 1248552 - RNA, 15 nt, Human
ugagccaccacgccc

SEQ ID NO: 1248553 - RNA, 14 nt, Human
ugagccaccgugcc

SEQ ID NO: 1248554 - RNA, 16 nt, Human
ugagcaucuguccccc

SEQ ID NO: 1248555 - RNA, 21 nt, Human
ugagcacuguuuucuagugua

SEQ ID NO: 1248556 - RNA, 15 nt, Human
ugagcacuguuuucu

SEQ ID NO: 1248557 - RNA, 14 nt, Human
ugagcacuguuuuc

SEQ ID NO: 1248558 - RNA, 22 nt, Human
ugagcacuguuuucuaguguau

SEQ ID NO: 1248559 - RNA, 13 nt, Human
ugagcacuguuuu

SEQ ID NO: 1248560 - RNA, 22 nt, Human
ugagcacuguuuauacacugug

SEQ ID NO: 1248561 - RNA, 19 nt, Human
ugagcacugccaggaggga

SEQ ID NO: 1248562 - RNA, 15 nt, Human
ugagcacuguuuaua

SEQ ID NO: 1248563 - RNA, 17 nt, Human
ugagcacugccaggagg

SEQ ID NO: 1248564 - RNA, 18 nt, Human
ugagcacugccaggaggg

SEQ ID NO: 1248565 - RNA, 22 nt, Human
ugagcacugccaggagggacaa

SEQ ID NO: 1248566 - RNA, 13 nt, Human
ugagcacugccag

SEQ ID NO: 1248567 - RNA, 14 nt, Human
ugagcacugccagg

SEQ ID NO: 1248568 - RNA, 15 nt, Human
ugagcacugccagga

SEQ ID NO: 1248569 - RNA, 16 nt, Human
ugagcacugccaggag

SEQ ID NO: 1248570 - RNA, 18 nt, Human
ugagccaccgugccuggc

SEQ ID NO: 1248571 - RNA, 19 nt, Human
ugagccaccgugccuggcc

SEQ ID NO: 1248572 - RNA, 20 nt, Human
ugagccaccgugccuggcca

SEQ ID NO: 1248573 - RNA, 21 nt, Human
ugagccaccgugccuggccac

SEQ ID NO: 1248574 - RNA, 11 nt, Human
agcagacauuu

SEQ ID NO: 1248575 - RNA, 22 nt, Human
agcagaccaccccgccugcccu

SEQ ID NO: 1248576 - RNA, 13 nt, Human
agcagacuacagc

SEQ ID NO: 1248577 - RNA, 17 nt, Human
agcagacuacagcuggg

SEQ ID NO: 1248578 - RNA, 22 nt, Human
agcagacuacagcuggggugca

SEQ ID NO: 1248579 - RNA, 23 nt, Human
agcagacuacagcuggggugcag

SEQ ID NO: 1248580 - RNA, 16 nt, Human
agcagacucagcucug

SEQ ID NO: 1248581 - RNA, 19 nt, Human
agcagacucagcucugaca

SEQ ID NO: 1248582 - RNA, 20 nt, Human
agcagacucagcucugacau

SEQ ID NO: 1248583 - RNA, 14 nt, Human
agcagacagagcca

SEQ ID NO: 1248584 - RNA, 15 nt, Human
agcagacagagccag

SEQ ID NO: 1248585 - RNA, 16 nt, Human
agcagacagagccagg

SEQ ID NO: 1248586 - RNA, 17 nt, Human
agcagacagagccagga

SEQ ID NO: 1248587 - RNA, 18 nt, Human
agcagacagagccaggag

SEQ ID NO: 1248588 - RNA, 19 nt, Human
agcagacagagccaggaga

SEQ ID NO: 1248589 - RNA, 12 nt, Human
agcagacaggcc

SEQ ID NO: 1248590 - RNA, 21 nt, Human
agcagacaguguuuucuggga

SEQ ID NO: 1248591 - RNA, 23 nt, Human
agcagacagagccaggagaagcu

SEQ ID NO: 1248592 - RNA, 20 nt, Human
ugagcgacagugagacucug

SEQ ID NO: 1248593 - RNA, 16 nt, Human
ugagcgacagugagac

SEQ ID NO: 1248594 - RNA, 14 nt, Human
ugagcgacagugag

SEQ ID NO: 1248595 - RNA, 13 nt, Human
ugagcgacaguga

SEQ ID NO: 1248596 - RNA, 21 nt, Human
agcacuuuagaauaugccuug

SEQ ID NO: 1248597 - RNA, 14 nt, Human
agcacuuuagaaua

SEQ ID NO: 1248598 - RNA, 21 nt, Human
agcacuuguggguuuuuguuu

SEQ ID NO: 1248599 - RNA, 15 nt, Human
agcacuuggcccuuc

SEQ ID NO: 1248600 - RNA, 16 nt, Human
agcacuuguccagcug

SEQ ID NO: 1248601 - RNA, 20 nt, Human
agcacuuuagaauaugccuu

SEQ ID NO: 1248602 - RNA, 15 nt, Human
agcagaaaacccuug

SEQ ID NO: 1248603 - RNA, 21 nt, Human
agcagaaaacccuugggccag

SEQ ID NO: 1248604 - RNA, 22 nt, Human
agcagaaaacccuugggccaga

SEQ ID NO: 1248605 - RNA, 14 nt, Human
agcagaaagugccu

SEQ ID NO: 1248606 - RNA, 15 nt, Human
agcagaaagugccuu

SEQ ID NO: 1248607 - RNA, 18 nt, Human
agcagaaagugccuuuca

SEQ ID NO: 1248608 - RNA, 19 nt, Human
agcagaaagugccuuucag

SEQ ID NO: 1248609 - RNA, 20 nt, Human
agcagaaagugccuuucagg

SEQ ID NO: 1248610 - RNA, 23 nt, Human
agcagaaagugccuuucaggauc

SEQ ID NO: 1248611 - RNA, 18 nt, Human
agcagaaauccaagcacc

SEQ ID NO: 1248612 - RNA, 21 nt, Human
agcagaaagugccuuucagga

SEQ ID NO: 1248613 - RNA, 14 nt, Human
agcagaacagugau

SEQ ID NO: 1248614 - RNA, 23 nt, Human
agcagaacugcuauuuuucaucc

SEQ ID NO: 1248615 - RNA, 14 nt, Human
agcagaagcagcaa

SEQ ID NO: 1248616 - RNA, 13 nt, Human
agcagaagcagca

SEQ ID NO: 1248617 - RNA, 17 nt, Human
agcagaaggggagaugg

SEQ ID NO: 1248618 - RNA, 23 nt, Human
agcagaaggggagauggacgaca

SEQ ID NO: 1248619 - RNA, 10 nt, Human
agcaccaggg

SEQ ID NO: 1248620 - RNA, 12 nt, Human
agcaccagggaa

SEQ ID NO: 1248621 - RNA, 13 nt, Human
agcaccagggaag

SEQ ID NO: 1248622 - RNA, 14 nt, Human
agcaccaagcaugu

SEQ ID NO: 1248623 - RNA, 14 nt, Human
agcaccagaaugua

SEQ ID NO: 1248624 - RNA, 15 nt, Human
agcaccugcugucug

SEQ ID NO: 1248625 - RNA, 14 nt, Human
agcaccugcugucu

SEQ ID NO: 1248626 - RNA, 17 nt, Human
agcacgaaauguuauuu

SEQ ID NO: 1248627 - RNA, 18 nt, Human
agcacgaaauguuauuuu

SEQ ID NO: 1248628 - RNA, 17 nt, Human
agcacgacaguggaugc

SEQ ID NO: 1248629 - RNA, 14 nt, Human
agcacuuggcccuu

SEQ ID NO: 1248630 - RNA, 22 nt, Human
agcacuuggggguucaggcccg

SEQ ID NO: 1248631 - RNA, 16 nt, Human
acuguaaggcaaucau

SEQ ID NO: 1248632 - RNA, 14 nt, Human
acuggggcaggggc

SEQ ID NO: 1248633 - RNA, 15 nt, Human
acugggcaugagggg

SEQ ID NO: 1248634 - RNA, 19 nt, Human
acuggggaaaacuccaccu

SEQ ID NO: 1248635 - RNA, 15 nt, Human
acuggggaaacuggc

SEQ ID NO: 1248636 - RNA, 18 nt, Human
acuggggaaacuggccau

SEQ ID NO: 1248637 - RNA, 15 nt, Human
acuggggacuuggcc

SEQ ID NO: 1248638 - RNA, 17 nt, Human
acuggggacuuggccuc

SEQ ID NO: 1248639 - RNA, 18 nt, Human
acuggggacuuggccucu

SEQ ID NO: 1248640 - RNA, 13 nt, Human
acuggggagcccg

SEQ ID NO: 1248641 - RNA, 17 nt, Human
acuggggagcccgucuc

SEQ ID NO: 1248642 - RNA, 21 nt, Human
acuggggagcccgucucagug

SEQ ID NO: 1248643 - RNA, 19 nt, Human
acuggggacuuggccucuc

SEQ ID NO: 1248644 - RNA, 16 nt, Human
ucgcuccucaaccccu

SEQ ID NO: 1248645 - RNA, 18 nt, Human
ucgcuccucaaccccucc

SEQ ID NO: 1248646 - RNA, 19 nt, Human
ucgcuccucaaccccuccc

SEQ ID NO: 1248647 - RNA, 22 nt, Human
ucgcuccucaaccccuccccuc

SEQ ID NO: 1248648 - RNA, 14 nt, Human
ucgcuccugcccac

SEQ ID NO: 1248649 - RNA, 15 nt, Human
ucgcuccugcagccc

SEQ ID NO: 1248650 - RNA, 15 nt, Human
acugggagcccccag

SEQ ID NO: 1248651 - RNA, 17 nt, Human
acugggagcccccagcc

SEQ ID NO: 1248652 - RNA, 18 nt, Human
acugggagcccccagccu

SEQ ID NO: 1248653 - RNA, 19 nt, Human
acugggagcccccagccug

SEQ ID NO: 1248654 - RNA, 20 nt, Human
acugggagcccccagccugu

SEQ ID NO: 1248655 - RNA, 21 nt, Human
acugggagcccccagccuguc

SEQ ID NO: 1248656 - RNA, 12 nt, Human
acugggaggcuc

SEQ ID NO: 1248657 - RNA, 17 nt, Human
acugggaggcuccccuu

SEQ ID NO: 1248658 - RNA, 13 nt, Human
acugggcaaugau

SEQ ID NO: 1248659 - RNA, 18 nt, Human
acugggcaaugauggcaa

SEQ ID NO: 1248660 - RNA, 23 nt, Human
acugggcaugagggguuccuccc

SEQ ID NO: 1248661 - RNA, 22 nt, Human
acuguaaucuuauuuaggaagu

SEQ ID NO: 1248662 - RNA, 19 nt, Human
acuguaaucuuauuuagga

SEQ ID NO: 1248663 - RNA, 16 nt, Human
acuguaaguugggcuu

SEQ ID NO: 1248664 - RNA, 22 nt, Human
acuguacaaaaaaaucuuccaa

SEQ ID NO: 1248665 - RNA, 19 nt, Human
acuguacaaaaaaaucuuc

SEQ ID NO: 1248666 - RNA, 17 nt, Human
acuguacaaaaaaaucu

SEQ ID NO: 1248667 - RNA, 13 nt, Human
acuguacagcugg

SEQ ID NO: 1248668 - RNA, 14 nt, Human
acuguacagcuggc

SEQ ID NO: 1248669 - RNA, 18 nt, Human
acuguacagcuggcucua

SEQ ID NO: 1248670 - RNA, 17 nt, Human
acuguacagugucuuuu

SEQ ID NO: 1248671 - RNA, 21 nt, Human
acuguacagugucuuuuuuug

SEQ ID NO: 1248672 - RNA, 11 nt, Human
acuguacagug

SEQ ID NO: 1248673 - RNA, 12 nt, Human
acuguacagugu

SEQ ID NO: 1248674 - RNA, 15 nt, Human
acuguacagugucuu

SEQ ID NO: 1248675 - RNA, 16 nt, Human
acuguacagugucuuu

SEQ ID NO: 1248676 - RNA, 13 nt, Human
acuguacuccucc

SEQ ID NO: 1248677 - RNA, 14 nt, Human
acuguacuccuccc

SEQ ID NO: 1248678 - RNA, 15 nt, Human
acuguacuccuccca

SEQ ID NO: 1248679 - RNA, 18 nt, Human
acuguagaaugauuucau

SEQ ID NO: 1248680 - RNA, 19 nt, Human
acuguagaaugauuucaug

SEQ ID NO: 1248681 - RNA, 20 nt, Human
acuguagaaugauuucaugc

SEQ ID NO: 1248682 - RNA, 20 nt, Human
uccuuucacaaccuucugug

SEQ ID NO: 1248683 - RNA, 16 nt, Human
uccuuucacaaccuuc

SEQ ID NO: 1248684 - RNA, 18 nt, Human
uccuuucacaaccuucug

SEQ ID NO: 1248685 - RNA, 19 nt, Human
uccuuucacaaccuucugu

SEQ ID NO: 1248686 - RNA, 16 nt, Human
uccuuuagguaagaag

SEQ ID NO: 1248687 - RNA, 19 nt, Human
uccuuucauauaguuagcu

SEQ ID NO: 1248688 - RNA, 14 nt, Human
ucgaggaguaacaa

SEQ ID NO: 1248689 - RNA, 20 nt, Human
ucgaggaguaacaauacaaa

SEQ ID NO: 1248690 - RNA, 17 nt, Human
ucgaggaguaacaauac

SEQ ID NO: 1248691 - RNA, 21 nt, Human
ucgcuccccacucugcucuga

SEQ ID NO: 1248692 - RNA, 20 nt, Human
ucgcuccccacucugcucug

SEQ ID NO: 1248693 - RNA, 12 nt, Human
ucgccuucccca

SEQ ID NO: 1248694 - RNA, 23 nt, Human
ucgccuuucccaggugcuacacc

SEQ ID NO: 1248695 - RNA, 22 nt, Human
ucgagaucccaacacugccagc

SEQ ID NO: 1248696 - RNA, 23 nt, Human
ucgagaucccaacacugccagca

SEQ ID NO: 1248697 - RNA, 19 nt, Human
ucgagauuaucguuuucuu

SEQ ID NO: 1248698 - RNA, 20 nt, Human
ucgagauuaucguuuucuua

SEQ ID NO: 1248699 - RNA, 17 nt, Human
ucgagcagcauuuuauu

SEQ ID NO: 1248700 - RNA, 22 nt, Human
ucgacacuguucuuagcucaau

SEQ ID NO: 1248701 - RNA, 13 nt, Human
ucgaccugccucg

SEQ ID NO: 1248702 - RNA, 23 nt, Human
ucgacucugugcuggccagcgag

SEQ ID NO: 1248703 - RNA, 20 nt, Human
ucgacucugugcuggccagc

SEQ ID NO: 1248704 - RNA, 14 nt, Human
uccuucccugcugu

SEQ ID NO: 1248705 - RNA, 18 nt, Human
uccuuccaaugucuggag

SEQ ID NO: 1248706 - RNA, 14 nt, Human
uccuucccucucug

SEQ ID NO: 1248707 - RNA, 19 nt, Human
uccuucccugugccuccuc

SEQ ID NO: 1248708 - RNA, 16 nt, Human
uccuucccuuuucugu

SEQ ID NO: 1248709 - RNA, 17 nt, Human
uccuucccuuuucuguu

SEQ ID NO: 1248710 - RNA, 15 nt, Human
uccuucauuuccucc

SEQ ID NO: 1248711 - RNA, 20 nt, Human
uccuuccaaugucuggagac

SEQ ID NO: 1248712 - RNA, 14 nt, Human
uccuucccauggag

SEQ ID NO: 1248713 - RNA, 12 nt, Human
uccuucccucuc

SEQ ID NO: 1248714 - RNA, 16 nt, Human
uccuuccucugagccu

SEQ ID NO: 1248715 - RNA, 21 nt, Human
uccuuccucacaccaggcuug

SEQ ID NO: 1248716 - RNA, 16 nt, Human
uccuuccgcuuggagc

SEQ ID NO: 1248717 - RNA, 23 nt, Human
uccuuccgcuuggagcuauuuuc

SEQ ID NO: 1248718 - RNA, 23 nt, Human
uccuuccuaaauuuuccuguccu

SEQ ID NO: 1248719 - RNA, 16 nt, Human
uccuuccucacaccag

SEQ ID NO: 1248720 - RNA, 17 nt, Human
uccuuccucugagccuu

SEQ ID NO: 1248721 - RNA, 16 nt, Human
uccuuccucugaggcu

SEQ ID NO: 1248722 - RNA, 10 nt, Human
uccuuccugc

SEQ ID NO: 1248723 - RNA, 12 nt, Human
uccuuccugccc

SEQ ID NO: 1248724 - RNA, 14 nt, Human
uccuuccugcccca

SEQ ID NO: 1248725 - RNA, 13 nt, Human
uccuucagccuga

SEQ ID NO: 1248726 - RNA, 19 nt, Human
uccuucaugacagccucca

SEQ ID NO: 1248727 - RNA, 11 nt, Human
uccuucauuuc

SEQ ID NO: 1248728 - RNA, 14 nt, Human
uccuucauuuccuc

SEQ ID NO: 1248729 - RNA, 15 nt, Human
uccuucagcacuuua

SEQ ID NO: 1248730 - RNA, 18 nt, Human
uccuucagcacuuuagaa

SEQ ID NO: 1248731 - RNA, 22 nt, Human
uccuucagagagcagugcuuuu

SEQ ID NO: 1248732 - RNA, 14 nt, Human
uccuucagauuugg

SEQ ID NO: 1248733 - RNA, 13 nt, Human
uccuucagagagc

SEQ ID NO: 1248734 - RNA, 19 nt, Human
uccuucagagagcagugcu

SEQ ID NO: 1248735 - RNA, 20 nt, Human
uccuucagagagcagugcuu

SEQ ID NO: 1248736 - RNA, 21 nt, Human
uccuucagagagcagugcuuu

SEQ ID NO: 1248737 - RNA, 23 nt, Human
uccuucagagagcagugcuuuug

SEQ ID NO: 1248738 - RNA, 17 nt, Human
acuggcucuccuggccc

SEQ ID NO: 1248739 - RNA, 15 nt, Human
acuggcucuccuggc

SEQ ID NO: 1248740 - RNA, 23 nt, Human
acuggccucugcugauccuccca

SEQ ID NO: 1248741 - RNA, 21 nt, Human
acuggcauggauauaguuuua

SEQ ID NO: 1248742 - RNA, 23 nt, Human
acuggcauggauauaguuuuacu

SEQ ID NO: 1248743 - RNA, 18 nt, Human
acuggccuuuuucauuua

SEQ ID NO: 1248744 - RNA, 19 nt, Human
acuggcgacacguagcagc

SEQ ID NO: 1248745 - RNA, 15 nt, Human
acuggcggggggccc

SEQ ID NO: 1248746 - RNA, 21 nt, Human
acuggcaggcaggcucccagg

SEQ ID NO: 1248747 - RNA, 21 nt, Human
acugcucuccuccaccucaac

SEQ ID NO: 1248748 - RNA, 15 nt, Human
acugcucuccuccac

SEQ ID NO: 1248749 - RNA, 12 nt, Human
acugcucugaug

SEQ ID NO: 1248750 - RNA, 15 nt, Human
acugcucccaccucc

SEQ ID NO: 1248751 - RNA, 16 nt, Human
acugcucccaccuccu

SEQ ID NO: 1248752 - RNA, 19 nt, Human
acugcucccaccuccugac

SEQ ID NO: 1248753 - RNA, 18 nt, Human
acugcucccaccuccuga

SEQ ID NO: 1248754 - RNA, 12 nt, Human
acugcucugaga

SEQ ID NO: 1248755 - RNA, 13 nt, Human
acugcucugagaa

SEQ ID NO: 1248756 - RNA, 18 nt, Human
acugcugagauacauaca

SEQ ID NO: 1248757 - RNA, 19 nt, Human
acugcugagauacauacag

SEQ ID NO: 1248758 - RNA, 20 nt, Human
acugcugagauacauacaga

SEQ ID NO: 1248759 - RNA, 22 nt, Human
acugcugagauacauacagaau

SEQ ID NO: 1248760 - RNA, 12 nt, Human
acugcugccacu

SEQ ID NO: 1248761 - RNA, 13 nt, Human
acugcugccacug

SEQ ID NO: 1248762 - RNA, 12 nt, Human
acugcuauuuuu

SEQ ID NO: 1248763 - RNA, 21 nt, Human
acugcuauuuuucauccuaaa

SEQ ID NO: 1248764 - RNA, 23 nt, Human
acugcgcccuuaacugcauccag

SEQ ID NO: 1248765 - RNA, 19 nt, Human
acugcgacuuucugccugg

SEQ ID NO: 1248766 - RNA, 21 nt, Human
acugcgacuuucugccuggag

SEQ ID NO: 1248767 - RNA, 22 nt, Human
acugcgacuuucugccuggagu

SEQ ID NO: 1248768 - RNA, 23 nt, Human
acugcgacuuucugccuggagug

SEQ ID NO: 1248769 - RNA, 13 nt, Human
acugccuuugacc

SEQ ID NO: 1248770 - RNA, 15 nt, Human
acugcgacuuucugc

SEQ ID NO: 1248771 - RNA, 17 nt, Human
acugcgacuuucugccu

SEQ ID NO: 1248772 - RNA, 18 nt, Human
acugcgacuuucugccug

SEQ ID NO: 1248773 - RNA, 11 nt, Human
acugccuuuga

SEQ ID NO: 1248774 - RNA, 22 nt, Human
acugccuucucaacuccaaacu

SEQ ID NO: 1248775 - RNA, 18 nt, Human
acugcuuggagcugagca

SEQ ID NO: 1248776 - RNA, 13 nt, Human
acugcuuggagcu

SEQ ID NO: 1248777 - RNA, 16 nt, Human
acugcuuggagcugag

SEQ ID NO: 1248778 - RNA, 13 nt, Human
acugcuggcugcc

SEQ ID NO: 1248779 - RNA, 14 nt, Human
acugcuggcugccu

SEQ ID NO: 1248780 - RNA, 22 nt, Human
acugcuggagaggccccagccg

SEQ ID NO: 1248781 - RNA, 23 nt, Human
acugcuugaacuaggcugagcaa

SEQ ID NO: 1248782 - RNA, 14 nt, Human
acugcuugaggaaa

SEQ ID NO: 1248783 - RNA, 15 nt, Human
acugcuugaggaaaa

SEQ ID NO: 1248784 - RNA, 18 nt, Human
acugcuugaggaaaacaa

SEQ ID NO: 1248785 - RNA, 16 nt, Human
acugcuugcccuaagc

SEQ ID NO: 1248786 - RNA, 20 nt, Human
acugcuugcccuaagcagaa

SEQ ID NO: 1248787 - RNA, 22 nt, Human
acugcuugcccuaagcagaaag

SEQ ID NO: 1248788 - RNA, 16 nt, Human
acugcugcccagccuc

SEQ ID NO: 1248789 - RNA, 18 nt, Human
acugcugcccagccucca

SEQ ID NO: 1248790 - RNA, 21 nt, Human
acugcugcccagccuccaagc

SEQ ID NO: 1248791 - RNA, 14 nt, Human
acugcugccacuga

SEQ ID NO: 1248792 - RNA, 17 nt, Human
acugcugccacugaggg

SEQ ID NO: 1248793 - RNA, 12 nt, Human
acugcuggcugc

SEQ ID NO: 1248794 - RNA, 16 nt, Human
acugcuggagaggccc

SEQ ID NO: 1248795 - RNA, 21 nt, Human
acugcuggagaggccccagcc

SEQ ID NO: 1248796 - RNA, 16 nt, Human
acugcaaccucugccu

SEQ ID NO: 1248797 - RNA, 15 nt, Human
acugcaaccuucacc

SEQ ID NO: 1248798 - RNA, 14 nt, Human
acugcacaauaacu

SEQ ID NO: 1248799 - RNA, 21 nt, Human
acugcacaauaacuccuccca

SEQ ID NO: 1248800 - RNA, 20 nt, Human
acugcacaauaacuccuccc

SEQ ID NO: 1248801 - RNA, 16 nt, Human
acugcacagugcaucu

SEQ ID NO: 1248802 - RNA, 18 nt, Human
acugcacagugcaucuca

SEQ ID NO: 1248803 - RNA, 22 nt, Human
acugcacagugcaucucagccc

SEQ ID NO: 1248804 - RNA, 20 nt, Human
uccugaguagcugggauuac

SEQ ID NO: 1248805 - RNA, 13 nt, Human
uccugaguagcug

SEQ ID NO: 1248806 - RNA, 15 nt, Human
uccugaguggugcca

SEQ ID NO: 1248807 - RNA, 15 nt, Human
uccugagugcuugcu

SEQ ID NO: 1248808 - RNA, 14 nt, Human
uccugaucagagcc

SEQ ID NO: 1248809 - RNA, 20 nt, Human
uccugcaccggggccugggc

SEQ ID NO: 1248810 - RNA, 18 nt, Human
uccugcaacucaaggacu

SEQ ID NO: 1248811 - RNA, 17 nt, Human
uccugcaacucaaggac

SEQ ID NO: 1248812 - RNA, 21 nt, Human
uccugcaccggggccugggca

SEQ ID NO: 1248813 - RNA, 21 nt, Human
uccugcacuuacuugcuuauu

SEQ ID NO: 1248814 - RNA, 17 nt, Human
uccugcagaccacgccc

SEQ ID NO: 1248815 - RNA, 13 nt, Human
uccugcagcccca

SEQ ID NO: 1248816 - RNA, 12 nt, Human
uccugcagcccc

SEQ ID NO: 1248817 - RNA, 13 nt, Human
uccugcggguggg

SEQ ID NO: 1248818 - RNA, 14 nt, Human
uccugcgggugggg

SEQ ID NO: 1248819 - RNA, 17 nt, Human
uccugcuaaaacaauga

SEQ ID NO: 1248820 - RNA, 20 nt, Human
uccugcuaacggugcucagg

SEQ ID NO: 1248821 - RNA, 18 nt, Human
uccugcuaaguuaauguu

SEQ ID NO: 1248822 - RNA, 15 nt, Human
uccugcucauauugu

SEQ ID NO: 1248823 - RNA, 16 nt, Human
uccugcucauauugug

SEQ ID NO: 1248824 - RNA, 22 nt, Human
uccugcaggcaggaacaaacag

SEQ ID NO: 1248825 - RNA, 17 nt, Human
uccugcaggcaggaaca

SEQ ID NO: 1248826 - RNA, 14 nt, Human
acugaggaucagag

SEQ ID NO: 1248827 - RNA, 15 nt, Human
acugaggaccagcca

SEQ ID NO: 1248828 - RNA, 20 nt, Human
acugaggaauuuucuuugug

SEQ ID NO: 1248829 - RNA, 22 nt, Human
acugaggggaggggagcauggg

SEQ ID NO: 1248830 - RNA, 17 nt, Human
acugaggggaggggagc

SEQ ID NO: 1248831 - RNA, 12 nt, Human
acugagggcagu

SEQ ID NO: 1248832 - RNA, 14 nt, Human
uccucuccccagcc

SEQ ID NO: 1248833 - RNA, 15 nt, Human
uccucuccccagccc

SEQ ID NO: 1248834 - RNA, 16 nt, Human
uccucuccccagccca

SEQ ID NO: 1248835 - RNA, 17 nt, Human
uccucuccccagcccag

SEQ ID NO: 1248836 - RNA, 18 nt, Human
uccucuccccagcccaga

SEQ ID NO: 1248837 - RNA, 19 nt, Human
uccucuccccagcccagag

SEQ ID NO: 1248838 - RNA, 20 nt, Human
uccucuccccagcccagaga

SEQ ID NO: 1248839 - RNA, 17 nt, Human
acugaggaauuucaccu

SEQ ID NO: 1248840 - RNA, 19 nt, Human
acugaggaauuucaccugu

SEQ ID NO: 1248841 - RNA, 16 nt, Human
acugaggaauuuucuu

SEQ ID NO: 1248842 - RNA, 20 nt, Human
acugcaaccuccaccucgca

SEQ ID NO: 1248843 - RNA, 18 nt, Human
acugcaaccuccaccucc

SEQ ID NO: 1248844 - RNA, 17 nt, Human
acugcaaccuccaccuc

SEQ ID NO: 1248845 - RNA, 16 nt, Human
acugcaaccuccaccu

SEQ ID NO: 1248846 - RNA, 20 nt, Human
acugcaaccuucgccaccug

SEQ ID NO: 1248847 - RNA, 23 nt, Human
acugcaaccuucgccaccugggu

SEQ ID NO: 1248848 - RNA, 15 nt, Human
acugagugggaagcc

SEQ ID NO: 1248849 - RNA, 16 nt, Human
acugagugggaagccc

SEQ ID NO: 1248850 - RNA, 18 nt, Human
acugaguuuuccauggca

SEQ ID NO: 1248851 - RNA, 22 nt, Human
acugcaaaucaggcuuuuguuu

SEQ ID NO: 1248852 - RNA, 13 nt, Human
acugaguuuucca

SEQ ID NO: 1248853 - RNA, 13 nt, Human
acugcaaccucca

SEQ ID NO: 1248854 - RNA, 14 nt, Human
acugcaaccuccac

SEQ ID NO: 1248855 - RNA, 16 nt, Human
acugagugccuuuugg

SEQ ID NO: 1248856 - RNA, 12 nt, Human
acugagugacuc

SEQ ID NO: 1248857 - RNA, 23 nt, Human
acugagugacucuauauagcuga

SEQ ID NO: 1248858 - RNA, 13 nt, Human
acugagugggaag

SEQ ID NO: 1248859 - RNA, 14 nt, Human
acugagugggaagc

SEQ ID NO: 1248860 - RNA, 20 nt, Human
acugaggggggauccaguuu

SEQ ID NO: 1248861 - RNA, 24 nt, Human
acugagggugaguuggcuuaccug

SEQ ID NO: 1248862 - RNA, 21 nt, Human
acugagguucauggauuuucc

SEQ ID NO: 1248863 - RNA, 23 nt, Human
acugagggcagucgauagagcug

SEQ ID NO: 1248864 - RNA, 16 nt, Human
uccugggcccucucug

SEQ ID NO: 1248865 - RNA, 17 nt, Human
uccugggcccucucugc

SEQ ID NO: 1248866 - RNA, 21 nt, Human
uccugggcccucucugcucug

SEQ ID NO: 1248867 - RNA, 23 nt, Human
uccugggcccucucugcucugcg

SEQ ID NO: 1248868 - RNA, 12 nt, Human
uccugggccugc

SEQ ID NO: 1248869 - RNA, 18 nt, Human
uccuggggaaccugaccc

SEQ ID NO: 1248870 - RNA, 19 nt, Human
uccuggggaaccugacccc

SEQ ID NO: 1248871 - RNA, 13 nt, Human
uccugggccugca

SEQ ID NO: 1248872 - RNA, 15 nt, Human
uccugggccugcaga

SEQ ID NO: 1248873 - RNA, 16 nt, Human
uccugggccugcagaa

SEQ ID NO: 1248874 - RNA, 21 nt, Human
uccuggggguucuuucuuccu

SEQ ID NO: 1248875 - RNA, 22 nt, Human
uccuggggguucuuucuuccuc

SEQ ID NO: 1248876 - RNA, 23 nt, Human
uccuggggguucuuucuuccucu

SEQ ID NO: 1248877 - RNA, 18 nt, Human
uccugugacuucagcucu

SEQ ID NO: 1248878 - RNA, 20 nt, Human
uccugugaaugccacugccu

SEQ ID NO: 1248879 - RNA, 22 nt, Human
uccugugaaugccacugccuuc

SEQ ID NO: 1248880 - RNA, 14 nt, Human
uccugugcacagcc

SEQ ID NO: 1248881 - RNA, 13 nt, Human
uccugugcacagc

SEQ ID NO: 1248882 - RNA, 18 nt, Human
uccugugcucagcccuga

SEQ ID NO: 1248883 - RNA, 15 nt, Human
uccugugcucagccc

SEQ ID NO: 1248884 - RNA, 16 nt, Human
uccugugcucagcccu

SEQ ID NO: 1248885 - RNA, 12 nt, Human
uccuguggcccc

SEQ ID NO: 1248886 - RNA, 22 nt, Human
uccuguggccccacccugggcc

SEQ ID NO: 1248887 - RNA, 23 nt, Human
uccuguggccccacccugggccc

SEQ ID NO: 1248888 - RNA, 12 nt, Human
uccuguggcucc

SEQ ID NO: 1248889 - RNA, 14 nt, Human
uccuguggcucccu

SEQ ID NO: 1248890 - RNA, 13 nt, Human
uccugugggagcc

SEQ ID NO: 1248891 - RNA, 14 nt, Human
uccugugggagccu

SEQ ID NO: 1248892 - RNA, 15 nt, Human
uccugugggagccuc

SEQ ID NO: 1248893 - RNA, 16 nt, Human
uccugugggagccucg

SEQ ID NO: 1248894 - RNA, 18 nt, Human
uccugugggagccucgca

SEQ ID NO: 1248895 - RNA, 23 nt, Human
uccugggguauaaaacuuuccuc

SEQ ID NO: 1248896 - RNA, 13 nt, Human
uccuggguggcua

SEQ ID NO: 1248897 - RNA, 15 nt, Human
uccuggguggcuacu

SEQ ID NO: 1248898 - RNA, 17 nt, Human
uccuggguggcuacucu

SEQ ID NO: 1248899 - RNA, 22 nt, Human
uccuggguggcuacucugugcc

SEQ ID NO: 1248900 - RNA, 24 nt, Human
uccuggguggcuacucugugccag

SEQ ID NO: 1248901 - RNA, 23 nt, Human
uccuggguggcuacucugugcca

SEQ ID NO: 1248902 - RNA, 17 nt, Human
uccuggguuuuguauuc

SEQ ID NO: 1248903 - RNA, 20 nt, Human
uccuggguuuuguauucucu

SEQ ID NO: 1248904 - RNA, 21 nt, Human
uccuggguuuuguauucucug

SEQ ID NO: 1248905 - RNA, 22 nt, Human
uccuggguuuuguauucucuga

SEQ ID NO: 1248906 - RNA, 23 nt, Human
uccuggguuuuguauucucugag

SEQ ID NO: 1248907 - RNA, 13 nt, Human
uccugguagaaua

SEQ ID NO: 1248908 - RNA, 16 nt, Human
uccuggucaccuagga

SEQ ID NO: 1248909 - RNA, 14 nt, Human
uccugucuuauccu

SEQ ID NO: 1248910 - RNA, 21 nt, Human
uccugucuuauccuccaccgu

SEQ ID NO: 1248911 - RNA, 16 nt, Human
uccugugaaugccacu

SEQ ID NO: 1248912 - RNA, 12 nt, Human
acugcaggcccu

SEQ ID NO: 1248913 - RNA, 13 nt, Human
acugcaggcccug

SEQ ID NO: 1248914 - RNA, 14 nt, Human
acugcaggcccugg

SEQ ID NO: 1248915 - RNA, 15 nt, Human
acugcaggcccuggc

SEQ ID NO: 1248916 - RNA, 16 nt, Human
acugcaggcccuggcc

SEQ ID NO: 1248917 - RNA, 16 nt, Human
acugcagggacugcca

SEQ ID NO: 1248918 - RNA, 10 nt, Human
acugcaggga

SEQ ID NO: 1248919 - RNA, 23 nt, Human
acugcagggaaaauuauuugcau

SEQ ID NO: 1248920 - RNA, 17 nt, Human
acugcaggcccuggccu

SEQ ID NO: 1248921 - RNA, 18 nt, Human
acugcaggcccuggccuc

SEQ ID NO: 1248922 - RNA, 19 nt, Human
acugcaggcccuggccucc

SEQ ID NO: 1248923 - RNA, 22 nt, Human
acugcaggcccuggccuccccu

SEQ ID NO: 1248924 - RNA, 17 nt, Human
acugcagggacugccag

SEQ ID NO: 1248925 - RNA, 18 nt, Human
acugcagggacugccagu

SEQ ID NO: 1248926 - RNA, 17 nt, Human
uccuguuuugcacagcc

SEQ ID NO: 1248927 - RNA, 18 nt, Human
uccuuaaaauguaagauu

SEQ ID NO: 1248928 - RNA, 15 nt, Human
uccuguguggagagg

SEQ ID NO: 1248929 - RNA, 16 nt, Human
uccuguguggagaggg

SEQ ID NO: 1248930 - RNA, 18 nt, Human
uccuguguggagagggaa

SEQ ID NO: 1248931 - RNA, 22 nt, Human
uccuguguggagagggaaugug

SEQ ID NO: 1248932 - RNA, 22 nt, Human
uccuguguguccaaaacugccu

SEQ ID NO: 1248933 - RNA, 21 nt, Human
uccuguguggagagggaaugu

SEQ ID NO: 1248934 - RNA, 12 nt, Human
uccuguguguua

SEQ ID NO: 1248935 - RNA, 18 nt, Human
uccuguguguuaagcucu

SEQ ID NO: 1248936 - RNA, 19 nt, Human
uccuguguguuaagcucug

SEQ ID NO: 1248937 - RNA, 20 nt, Human
uccuguguguuaagcucugc

SEQ ID NO: 1248938 - RNA, 21 nt, Human
uccuguguguuaagcucugcu

SEQ ID NO: 1248939 - RNA, 22 nt, Human
uccuguguguuaagcucugcua

SEQ ID NO: 1248940 - RNA, 14 nt, Human
uccuguguuuguga

SEQ ID NO: 1248941 - RNA, 15 nt, Human
uccuguucacaccag

SEQ ID NO: 1248942 - RNA, 13 nt, Human
uccuguugggaga

SEQ ID NO: 1248943 - RNA, 14 nt, Human
uccuguugggagag

SEQ ID NO: 1248944 - RNA, 17 nt, Human
uccuguugucaagaaua

SEQ ID NO: 1248945 - RNA, 21 nt, Human
uccuguugggagagggcgcag

SEQ ID NO: 1248946 - RNA, 18 nt, Human
uccuguuuccuagcugug

SEQ ID NO: 1248947 - RNA, 13 nt, Human
uccuguuugucua

SEQ ID NO: 1248948 - RNA, 17 nt, Human
uccuguuugucuacaua

SEQ ID NO: 1248949 - RNA, 21 nt, Human
uccuguuuugcacagccaaau

SEQ ID NO: 1248950 - RNA, 14 nt, Human
uccuguuuuucaca

SEQ ID NO: 1248951 - RNA, 23 nt, Human
acucuuauaucuauauuuuacau

SEQ ID NO: 1248952 - RNA, 22 nt, Human
acucugcuucucugacuucugc

SEQ ID NO: 1248953 - RNA, 15 nt, Human
acucugcuugauuuu

SEQ ID NO: 1248954 - RNA, 16 nt, Human
acucugcuugauuuuu

SEQ ID NO: 1248955 - RNA, 18 nt, Human
acucugcuugauuuuugc

SEQ ID NO: 1248956 - RNA, 13 nt, Human
acucugcuuguua

SEQ ID NO: 1248957 - RNA, 12 nt, Human
acucugcagccu

SEQ ID NO: 1248958 - RNA, 13 nt, Human
acucugcagccuc

SEQ ID NO: 1248959 - RNA, 14 nt, Human
acucugcagccuca

SEQ ID NO: 1248960 - RNA, 15 nt, Human
acucugcagccucag

SEQ ID NO: 1248961 - RNA, 17 nt, Human
acucugcagccucagag

SEQ ID NO: 1248962 - RNA, 16 nt, Human
acucugcagccucaga

SEQ ID NO: 1248963 - RNA, 16 nt, Human
acucugcauucuagua

SEQ ID NO: 1248964 - RNA, 17 nt, Human
acucugcuucucugacu

SEQ ID NO: 1248965 - RNA, 18 nt, Human
acucugcuucucugacuu

SEQ ID NO: 1248966 - RNA, 20 nt, Human
acucugcuucucugacuucu

SEQ ID NO: 1248967 - RNA, 21 nt, Human
acucugcuucucugacuucug

SEQ ID NO: 1248968 - RNA, 21 nt, Human
acucuccccacgagggcuggc

SEQ ID NO: 1248969 - RNA, 21 nt, Human
acucucuuauugccucacuuc

SEQ ID NO: 1248970 - RNA, 23 nt, Human
acucucuuauugccucacuucag

SEQ ID NO: 1248971 - RNA, 13 nt, Human
acucugacaacag

SEQ ID NO: 1248972 - RNA, 16 nt, Human
acucugaaaugaagau

SEQ ID NO: 1248973 - RNA, 19 nt, Human
acucuccccacgagggcug

SEQ ID NO: 1248974 - RNA, 20 nt, Human
acucuccccacgagggcugg

SEQ ID NO: 1248975 - RNA, 22 nt, Human
acucuccccacgagggcuggcu

SEQ ID NO: 1248976 - RNA, 23 nt, Human
acucgcuagcaguggcaggcaga

SEQ ID NO: 1248977 - RNA, 17 nt, Human
acucggaaucuauuuuc

SEQ ID NO: 1248978 - RNA, 22 nt, Human
acucggcagcccuuccaaacuc

SEQ ID NO: 1248979 - RNA, 21 nt, Human
acucggccucccaaagugcug

SEQ ID NO: 1248980 - RNA, 22 nt, Human
acucggccucccaaagugcugg

SEQ ID NO: 1248981 - RNA, 12 nt, Human
acucgguuucuc

SEQ ID NO: 1248982 - RNA, 21 nt, Human
uccuagcacagauggccagcc

SEQ ID NO: 1248983 - RNA, 20 nt, Human
uccuagcacagauggccagc

SEQ ID NO: 1248984 - RNA, 20 nt, Human
uccuaggcuccaccccaucc

SEQ ID NO: 1248985 - RNA, 22 nt, Human
uccuaggcuccaccccauccag

SEQ ID NO: 1248986 - RNA, 14 nt, Human
acucgcuagcagug

SEQ ID NO: 1248987 - RNA, 16 nt, Human
acucgcuagcaguggc

SEQ ID NO: 1248988 - RNA, 18 nt, Human
acucgcuagcaguggcag

SEQ ID NO: 1248989 - RNA, 16 nt, Human
uccuccccuccuccug

SEQ ID NO: 1248990 - RNA, 18 nt, Human
uccuccccuccuccugga

SEQ ID NO: 1248991 - RNA, 20 nt, Human
uccuccccuccuccuggacu

SEQ ID NO: 1248992 - RNA, 22 nt, Human
uccuccccuccuccuggacucc

SEQ ID NO: 1248993 - RNA, 13 nt, Human
uccuccccuggag

SEQ ID NO: 1248994 - RNA, 15 nt, Human
uccuccccuggaggg

SEQ ID NO: 1248995 - RNA, 14 nt, Human
uccuccccuggagg

SEQ ID NO: 1248996 - RNA, 16 nt, Human
uccucagccagccucg

SEQ ID NO: 1248997 - RNA, 12 nt, Human
uccucagccuga

SEQ ID NO: 1248998 - RNA, 14 nt, Human
uccucagccugaac

SEQ ID NO: 1248999 - RNA, 11 nt, Human
uccucagccuu

SEQ ID NO: 1249000 - RNA, 21 nt, Human
uccucagccugaaccccaggg

SEQ ID NO: 1249001 - RNA, 18 nt, Human
uccucagccuugccagag

SEQ ID NO: 1249002 - RNA, 15 nt, Human
uccucuccacugccu

SEQ ID NO: 1249003 - RNA, 16 nt, Human
uccucuccacugccuu

SEQ ID NO: 1249004 - RNA, 12 nt, Human
uccucuccacug

SEQ ID NO: 1249005 - RNA, 13 nt, Human
uccucuccacugc

SEQ ID NO: 1249006 - RNA, 14 nt, Human
uccucuccacugcc

SEQ ID NO: 1249007 - RNA, 21 nt, Human
acucuuaugcuguacccaguu

SEQ ID NO: 1249008 - RNA, 15 nt, Human
uccucaaagaaagug

SEQ ID NO: 1249009 - RNA, 16 nt, Human
uccucaaagaaagugu

SEQ ID NO: 1249010 - RNA, 18 nt, Human
uccucaaagaaaguguau

SEQ ID NO: 1249011 - RNA, 19 nt, Human
uccucaaagaaaguguauu

SEQ ID NO: 1249012 - RNA, 17 nt, Human
uccucaacacccaacug

SEQ ID NO: 1249013 - RNA, 22 nt, Human
uccucaaccccuccccuccauc

SEQ ID NO: 1249014 - RNA, 17 nt, Human
uccucaagaaauaaaag

SEQ ID NO: 1249015 - RNA, 23 nt, Human
uccucaagaaauaaaaggaagcc

SEQ ID NO: 1249016 - RNA, 19 nt, Human
uccucaaccccuccccucc

SEQ ID NO: 1249017 - RNA, 12 nt, Human
uccucaauccag

SEQ ID NO: 1249018 - RNA, 13 nt, Human
uccucaauccagc

SEQ ID NO: 1249019 - RNA, 14 nt, Human
uccucaauccagcu

SEQ ID NO: 1249020 - RNA, 14 nt, Human
uccucacuguaucc

SEQ ID NO: 1249021 - RNA, 16 nt, Human
uccucagacucuaaga

SEQ ID NO: 1249022 - RNA, 21 nt, Human
uccucagacucuaagaaagaa

SEQ ID NO: 1249023 - RNA, 11 nt, Human
uccucagcccc

SEQ ID NO: 1249024 - RNA, 10 nt, Human
uccucagcca

SEQ ID NO: 1249025 - RNA, 12 nt, Human
uccucagccagc

SEQ ID NO: 1249026 - RNA, 13 nt, Human
uccucagccagcc

SEQ ID NO: 1249027 - RNA, 15 nt, Human
uccucagccagccuc

SEQ ID NO: 1249028 - RNA, 17 nt, Human
uccucagagaauuucua

SEQ ID NO: 1249029 - RNA, 20 nt, Human
uccucagagaauuucuacca

SEQ ID NO: 1249030 - RNA, 17 nt, Human
uccucagacucuaagaa

SEQ ID NO: 1249031 - RNA, 13 nt, Human
uccucacccccag

SEQ ID NO: 1249032 - RNA, 16 nt, Human
uccucacccccagcuu

SEQ ID NO: 1249033 - RNA, 20 nt, Human
uccucacccccagcuuugcu

SEQ ID NO: 1249034 - RNA, 18 nt, Human
acuccugaccucaaguga

SEQ ID NO: 1249035 - RNA, 14 nt, Human
acuccugaccucag

SEQ ID NO: 1249036 - RNA, 15 nt, Human
acuccugaccucagg

SEQ ID NO: 1249037 - RNA, 16 nt, Human
acuccugaccucaggc

SEQ ID NO: 1249038 - RNA, 16 nt, Human
acuccuagcuguccuu

SEQ ID NO: 1249039 - RNA, 23 nt, Human
acuccuagcuguccuuuuuccuc

SEQ ID NO: 1249040 - RNA, 16 nt, Human
acuccuaggaaaauac

SEQ ID NO: 1249041 - RNA, 17 nt, Human
acuccugaccucaggca

SEQ ID NO: 1249042 - RNA, 19 nt, Human
acuccagugagacagcucu

SEQ ID NO: 1249043 - RNA, 21 nt, Human
acuccaggcccaaggcucccg

SEQ ID NO: 1249044 - RNA, 16 nt, Human
acuccaggcccaaggc

SEQ ID NO: 1249045 - RNA, 17 nt, Human
acuccaggcccaaggcu

SEQ ID NO: 1249046 - RNA, 19 nt, Human
acuccaggcccaaggcucc

SEQ ID NO: 1249047 - RNA, 14 nt, Human
acuccuaccuggua

SEQ ID NO: 1249048 - RNA, 20 nt, Human
acuccagcuggguuggaaaa

SEQ ID NO: 1249049 - RNA, 13 nt, Human
acuccaggcccaa

SEQ ID NO: 1249050 - RNA, 14 nt, Human
acuccaggcccaag

SEQ ID NO: 1249051 - RNA, 14 nt, Human
acuccacacugcac

SEQ ID NO: 1249052 - RNA, 16 nt, Human
acuccacacugcacaa

SEQ ID NO: 1249053 - RNA, 21 nt, Human
acuccacacugcacaauaacu

SEQ ID NO: 1249054 - RNA, 17 nt, Human
acuccacacugcacaau

SEQ ID NO: 1249055 - RNA, 14 nt, Human
acuccaacucuucc

SEQ ID NO: 1249056 - RNA, 15 nt, Human
acuccaagcccagcc

SEQ ID NO: 1249057 - RNA, 17 nt, Human
acuccaagcccagccca

SEQ ID NO: 1249058 - RNA, 18 nt, Human
acuccaagcccagcccau

SEQ ID NO: 1249059 - RNA, 12 nt, Human
acuccacacugc

SEQ ID NO: 1249060 - RNA, 13 nt, Human
acuccacacugca

SEQ ID NO: 1249061 - RNA, 21 nt, Human
acucaucuagguaaauuacag

SEQ ID NO: 1249062 - RNA, 17 nt, Human
acucaucuuucccuccu

SEQ ID NO: 1249063 - RNA, 18 nt, Human
acucaucuuucccuccuu

SEQ ID NO: 1249064 - RNA, 21 nt, Human
acucaucuuucccuccuuggu

SEQ ID NO: 1249065 - RNA, 20 nt, Human
acucaucuuucccuccuugg

SEQ ID NO: 1249066 - RNA, 15 nt, Human
acucaugugacucuu

SEQ ID NO: 1249067 - RNA, 16 nt, Human
acucaugugacucuuu

SEQ ID NO: 1249068 - RNA, 16 nt, Human
acucaugcauuguccu

SEQ ID NO: 1249069 - RNA, 17 nt, Human
acucaugcauuguccuc

SEQ ID NO: 1249070 - RNA, 17 nt, Human
acucaugugacucuuuc

SEQ ID NO: 1249071 - RNA, 18 nt, Human
acucaucuagguaaauua

SEQ ID NO: 1249072 - RNA, 16 nt, Human
acucaucuagguaaau

SEQ ID NO: 1249073 - RNA, 23 nt, Human
ucccucauuccaccuucccaugc

SEQ ID NO: 1249074 - RNA, 21 nt, Human
ucccucaucugucccuccggg

SEQ ID NO: 1249075 - RNA, 14 nt, Human
ucccucaccuucug

SEQ ID NO: 1249076 - RNA, 15 nt, Human
ucccucaccuuggca

SEQ ID NO: 1249077 - RNA, 21 nt, Human
ucccucaccuuggcaccagac

SEQ ID NO: 1249078 - RNA, 20 nt, Human
ucccucaccuuggcaccaga

SEQ ID NO: 1249079 - RNA, 16 nt, Human
ucccucagugcccuca

SEQ ID NO: 1249080 - RNA, 15 nt, Human
ucccucaccuucuga

SEQ ID NO: 1249081 - RNA, 16 nt, Human
ucccucaucugucccu

SEQ ID NO: 1249082 - RNA, 16 nt, Human
uccguucacaugugug

SEQ ID NO: 1249083 - RNA, 23 nt, Human
uccgucaaaacagauuguuugca

SEQ ID NO: 1249084 - RNA, 16 nt, Human
uccgucaaaacagauu

SEQ ID NO: 1249085 - RNA, 14 nt, Human
uccguccccugccc

SEQ ID NO: 1249086 - RNA, 18 nt, Human
uccguccccugcccaugc

SEQ ID NO: 1249087 - RNA, 17 nt, Human
ucccuuugcccagaaag

SEQ ID NO: 1249088 - RNA, 12 nt, Human
uccuagcacaga

SEQ ID NO: 1249089 - RNA, 15 nt, Human
uccuagcacagaugg

SEQ ID NO: 1249090 - RNA, 16 nt, Human
uccuagcacagauggc

SEQ ID NO: 1249091 - RNA, 13 nt, Human
uccuagauccuaa

SEQ ID NO: 1249092 - RNA, 14 nt, Human
uccuagauccuaag

SEQ ID NO: 1249093 - RNA, 13 nt, Human
uccuagaugcucu

SEQ ID NO: 1249094 - RNA, 23 nt, Human
uccuagauccuaagggucgaaag

SEQ ID NO: 1249095 - RNA, 13 nt, Human
uccguuggccacu

SEQ ID NO: 1249096 - RNA, 15 nt, Human
uccguuggccacucc

SEQ ID NO: 1249097 - RNA, 16 nt, Human
uccgugccucuuuuua

SEQ ID NO: 1249098 - RNA, 21 nt, Human
uccuaaacaucauucauuuuu

SEQ ID NO: 1249099 - RNA, 23 nt, Human
uccuaaacugagacaaugccuug

SEQ ID NO: 1249100 - RNA, 17 nt, Human
uccuaaagaacaaagua

SEQ ID NO: 1249101 - RNA, 23 nt, Human
acuccugcacacgcuccuuccuc

SEQ ID NO: 1249102 - RNA, 14 nt, Human
ucccuguaaccucu

SEQ ID NO: 1249103 - RNA, 18 nt, Human
ucccuguaaccucuucag

SEQ ID NO: 1249104 - RNA, 19 nt, Human
ucccuguaaccucuucaga

SEQ ID NO: 1249105 - RNA, 22 nt, Human
ucccuguaaccucuucagaggc

SEQ ID NO: 1249106 - RNA, 23 nt, Human
ucccuguaaccucuucagaggcc

SEQ ID NO: 1249107 - RNA, 15 nt, Human
ucccuguaacuugau

SEQ ID NO: 1249108 - RNA, 12 nt, Human
ucccuguaacuu

SEQ ID NO: 1249109 - RNA, 17 nt, Human
ucccuguguugucucua

SEQ ID NO: 1249110 - RNA, 15 nt, Human
ucccuguuccccaga

SEQ ID NO: 1249111 - RNA, 16 nt, Human
ucccuguuccccagag

SEQ ID NO: 1249112 - RNA, 18 nt, Human
ucccuguuccccagagaa

SEQ ID NO: 1249113 - RNA, 17 nt, Human
ucccuguuccccagaga

SEQ ID NO: 1249114 - RNA, 22 nt, Human
ucccuguuucuuccacagugcc

SEQ ID NO: 1249115 - RNA, 11 nt, Human
ucccuucaacc

SEQ ID NO: 1249116 - RNA, 21 nt, Human
ucccuucaaccauuccccaug

SEQ ID NO: 1249117 - RNA, 22 nt, Human
ucccuucaaccauuccccaugg

SEQ ID NO: 1249118 - RNA, 15 nt, Human
ucccuuguagcuccu

SEQ ID NO: 1249119 - RNA, 16 nt, Human
ucccuuguagcuccuc

SEQ ID NO: 1249120 - RNA, 15 nt, Human
ucccuuguauccccu

SEQ ID NO: 1249121 - RNA, 16 nt, Human
ucccuuguauccccug

SEQ ID NO: 1249122 - RNA, 21 nt, Human
ucccuuguauccccugcaggc

SEQ ID NO: 1249123 - RNA, 19 nt, Human
ucccuuguauccccugcag

SEQ ID NO: 1249124 - RNA, 14 nt, Human
ucccucacccaucc

SEQ ID NO: 1249125 - RNA, 12 nt, Human
ucccucaccugu

SEQ ID NO: 1249126 - RNA, 13 nt, Human
ucccucaccugua

SEQ ID NO: 1249127 - RNA, 14 nt, Human
ucccucaccuguag

SEQ ID NO: 1249128 - RNA, 20 nt, Human
ucccucaccuguagcagcca

SEQ ID NO: 1249129 - RNA, 18 nt, Human
ucccucacccauccuaga

SEQ ID NO: 1249130 - RNA, 12 nt, Human
ucccucacccau

SEQ ID NO: 1249131 - RNA, 14 nt, Human
ucccucacaagugg

SEQ ID NO: 1249132 - RNA, 19 nt, Human
ucccucaaccucauccucu

SEQ ID NO: 1249133 - RNA, 13 nt, Human
ucccucacaagug

SEQ ID NO: 1249134 - RNA, 18 nt, Human
ucccucaaccucauccuc

SEQ ID NO: 1249135 - RNA, 18 nt, Human
ucccggagguuggguggg

SEQ ID NO: 1249136 - RNA, 15 nt, Human
ucccgauuguaacuc

SEQ ID NO: 1249137 - RNA, 19 nt, Human
ucccgcagugggagcaaac

SEQ ID NO: 1249138 - RNA, 20 nt, Human
ucccgcagugggagcaaacu

SEQ ID NO: 1249139 - RNA, 13 nt, Human
ucccgcucagccc

SEQ ID NO: 1249140 - RNA, 14 nt, Human
ucccgcucagcccu

SEQ ID NO: 1249141 - RNA, 15 nt, Human
ucccgcucagcccuc

SEQ ID NO: 1249142 - RNA, 16 nt, Human
ucccgcucagcccucc

SEQ ID NO: 1249143 - RNA, 20 nt, Human
ucccgcucagcccucccugc

SEQ ID NO: 1249144 - RNA, 20 nt, Human
uccccuugaggucucagccc

SEQ ID NO: 1249145 - RNA, 21 nt, Human
uccccuugaggucucagcccc

SEQ ID NO: 1249146 - RNA, 20 nt, Human
uccccuucuccccugcacug

SEQ ID NO: 1249147 - RNA, 18 nt, Human
uccccuucuccccugcac

SEQ ID NO: 1249148 - RNA, 13 nt, Human
uccccuucucugu

SEQ ID NO: 1249149 - RNA, 18 nt, Human
uccccuugaacucuucac

SEQ ID NO: 1249150 - RNA, 17 nt, Human
uccccuugaggucucag

SEQ ID NO: 1249151 - RNA, 18 nt, Human
uccccuugaggucucagc

SEQ ID NO: 1249152 - RNA, 19 nt, Human
uccccuugaggucucagcc

SEQ ID NO: 1249153 - RNA, 23 nt, Human
acucaaccuuaagaccuacuguu

SEQ ID NO: 1249154 - RNA, 23 nt, Human
acucaagaagugaagaaugcaca

SEQ ID NO: 1249155 - RNA, 17 nt, Human
acucaagaagugaagaa

SEQ ID NO: 1249156 - RNA, 15 nt, Human
uccccucaccuccuc

SEQ ID NO: 1249157 - RNA, 17 nt, Human
uccccucaccuccucua

SEQ ID NO: 1249158 - RNA, 19 nt, Human
uccccuccaaaaugugccu

SEQ ID NO: 1249159 - RNA, 18 nt, Human
acuauaugcaaacagggu

SEQ ID NO: 1249160 - RNA, 14 nt, Human
acuauaugcaaaca

SEQ ID NO: 1249161 - RNA, 13 nt, Human
acuauauguaugg

SEQ ID NO: 1249162 - RNA, 13 nt, Human
acuauaugcaaac

SEQ ID NO: 1249163 - RNA, 17 nt, Human
uccccagggaagcagca

SEQ ID NO: 1249164 - RNA, 19 nt, Human
uccccagggaagcagcagc

SEQ ID NO: 1249165 - RNA, 20 nt, Human
uccccagggaagcagcagcc

SEQ ID NO: 1249166 - RNA, 21 nt, Human
uccccagggaagcagcagccu

SEQ ID NO: 1249167 - RNA, 23 nt, Human
uccccagggaagcagcagccucg

SEQ ID NO: 1249168 - RNA, 15 nt, Human
uccccacgagggcug

SEQ ID NO: 1249169 - RNA, 16 nt, Human
uccccacgagggcugg

SEQ ID NO: 1249170 - RNA, 17 nt, Human
uccccacgagggcuggc

SEQ ID NO: 1249171 - RNA, 20 nt, Human
uccccacgagggcuggcugg

SEQ ID NO: 1249172 - RNA, 14 nt, Human
uccccacgccacag

SEQ ID NO: 1249173 - RNA, 15 nt, Human
uccccacgccacagc

SEQ ID NO: 1249174 - RNA, 16 nt, Human
uccccacgccacagcc

SEQ ID NO: 1249175 - RNA, 17 nt, Human
uccccacgccacagccc

SEQ ID NO: 1249176 - RNA, 16 nt, Human
uccccaggcaccucac

SEQ ID NO: 1249177 - RNA, 22 nt, Human
uccccacgccacagcccuuuug

SEQ ID NO: 1249178 - RNA, 19 nt, Human
uccccacgccacagcccuu

SEQ ID NO: 1249179 - RNA, 22 nt, Human
acuaugaaguuuuuuuuauaca

SEQ ID NO: 1249180 - RNA, 16 nt, Human
acuaugaaaagcuaga

SEQ ID NO: 1249181 - RNA, 19 nt, Human
acuaugaaaagcuagaauu

SEQ ID NO: 1249182 - RNA, 20 nt, Human
acuaugaaaagcuagaauug

SEQ ID NO: 1249183 - RNA, 21 nt, Human
acuaugaaaagcuagaauuga

SEQ ID NO: 1249184 - RNA, 16 nt, Human
acuaugaaaaugcugg

SEQ ID NO: 1249185 - RNA, 18 nt, Human
acuaugaaaaugcuggcu

SEQ ID NO: 1249186 - RNA, 18 nt, Human
acuaucccggcugcccuu

SEQ ID NO: 1249187 - RNA, 20 nt, Human
acuaucuuacuauuucacaa

SEQ ID NO: 1249188 - RNA, 16 nt, Human
acuaucuuggugaauu

SEQ ID NO: 1249189 - RNA, 18 nt, Human
acuaucuuucagcuccag

SEQ ID NO: 1249190 - RNA, 22 nt, Human
acuaucaugucaaacgugaaaa

SEQ ID NO: 1249191 - RNA, 17 nt, Human
acuaucaucuuauucag

SEQ ID NO: 1249192 - RNA, 16 nt, Human
acuaucccggcugccc

SEQ ID NO: 1249193 - RNA, 17 nt, Human
acuaucccggcugcccu

SEQ ID NO: 1249194 - RNA, 22 nt, Human
acuauuaaaaagguuuacagaa

SEQ ID NO: 1249195 - RNA, 22 nt, Human
acuauuaggugcaauuucaagg

SEQ ID NO: 1249196 - RNA, 18 nt, Human
acuauuauccccauuucu

SEQ ID NO: 1249197 - RNA, 22 nt, Human
acucaaauguucuaaguuucua

SEQ ID NO: 1249198 - RNA, 19 nt, Human
uccagccuggggcugaggc

SEQ ID NO: 1249199 - RNA, 17 nt, Human
uccagccuggggucugg

SEQ ID NO: 1249200 - RNA, 14 nt, Human
uccagcggcccugu

SEQ ID NO: 1249201 - RNA, 15 nt, Human
uccagcuagugaccc

SEQ ID NO: 1249202 - RNA, 20 nt, Human
uccagcuagugacccacaug

SEQ ID NO: 1249203 - RNA, 22 nt, Human
acguuuagcugacaaaauacuu

SEQ ID NO: 1249204 - RNA, 23 nt, Human
acguuuaagccaaaacaauguuu

SEQ ID NO: 1249205 - RNA, 19 nt, Human
acguuuaagccaaaacaau

SEQ ID NO: 1249206 - RNA, 17 nt, Human
acguuuagcugacaaaa

SEQ ID NO: 1249207 - RNA, 14 nt, Human
acguuuuauaagca

SEQ ID NO: 1249208 - RNA, 21 nt, Human
acguuuuauaagcaucauuau

SEQ ID NO: 1249209 - RNA, 20 nt, Human
acguuuuauaagcaucauua

SEQ ID NO: 1249210 - RNA, 12 nt, Human
acguuuucuaau

SEQ ID NO: 1249211 - RNA, 13 nt, Human
acguuuucuaauu

SEQ ID NO: 1249212 - RNA, 16 nt, Human
acguuuucuaauugcu

SEQ ID NO: 1249213 - RNA, 17 nt, Human
acguuuucuaauugcuu

SEQ ID NO: 1249214 - RNA, 18 nt, Human
acguuuucuaauugcuua

SEQ ID NO: 1249215 - RNA, 19 nt, Human
acguuuucuaauugcuuau

SEQ ID NO: 1249216 - RNA, 13 nt, Human
acuaaaaauacaa

SEQ ID NO: 1249217 - RNA, 15 nt, Human
acuaaaaaaaagaug

SEQ ID NO: 1249218 - RNA, 16 nt, Human
acuaaaaaaaagauga

SEQ ID NO: 1249219 - RNA, 19 nt, Human
acuaaaacaaagccacuuu

SEQ ID NO: 1249220 - RNA, 17 nt, Human
acuaaaaaaaagaugaa

SEQ ID NO: 1249221 - RNA, 21 nt, Human
acuaaccauguguuauguuuu

SEQ ID NO: 1249222 - RNA, 16 nt, Human
acuaaaacaaagccac

SEQ ID NO: 1249223 - RNA, 14 nt, Human
acuaaaauaauuuu

SEQ ID NO: 1249224 - RNA, 15 nt, Human
acuaaaauaauuuug

SEQ ID NO: 1249225 - RNA, 16 nt, Human
acuaaaauaauuuugu

SEQ ID NO: 1249226 - RNA, 17 nt, Human
acuaaaauaauuuugua

SEQ ID NO: 1249227 - RNA, 19 nt, Human
acuaaaauaauuuuguaau

SEQ ID NO: 1249228 - RNA, 20 nt, Human
acuaaaauaauuuuguaaug

SEQ ID NO: 1249229 - RNA, 14 nt, Human
acuaaaauauuuau

SEQ ID NO: 1249230 - RNA, 18 nt, Human
acuaaacacgugacacaa

SEQ ID NO: 1249231 - RNA, 17 nt, Human
acuaaacucuuaccaua

SEQ ID NO: 1249232 - RNA, 13 nt, Human
acuaaacuuaauu

SEQ ID NO: 1249233 - RNA, 16 nt, Human
acuaaagccaaacaua

SEQ ID NO: 1249234 - RNA, 17 nt, Human
acuaaagccaaacauau

SEQ ID NO: 1249235 - RNA, 23 nt, Human
acuaaagccaaacauauauauac

SEQ ID NO: 1249236 - RNA, 12 nt, Human
acuaaagccuuu

SEQ ID NO: 1249237 - RNA, 22 nt, Human
acuaaaguuagaaaguugauuu

SEQ ID NO: 1249238 - RNA, 22 nt, Human
ucccaguuggagcuccagccug

SEQ ID NO: 1249239 - RNA, 21 nt, Human
ucccaguuggagcuccagccu

SEQ ID NO: 1249240 - RNA, 17 nt, Human
ucccauagccaggaaac

SEQ ID NO: 1249241 - RNA, 13 nt, Human
ucccaucgcuguc

SEQ ID NO: 1249242 - RNA, 22 nt, Human
ucccaucgucucggccuucaca

SEQ ID NO: 1249243 - RNA, 20 nt, Human
ucccaucgucucggccuuca

SEQ ID NO: 1249244 - RNA, 13 nt, Human
ucccaucuaggga

SEQ ID NO: 1249245 - RNA, 18 nt, Human
ucccauuuuggaauuugc

SEQ ID NO: 1249246 - RNA, 19 nt, Human
uccccaaaagcgugagcuu

SEQ ID NO: 1249247 - RNA, 14 nt, Human
uccccaaaggcuuu

SEQ ID NO: 1249248 - RNA, 22 nt, Human
uccccaaaggcuuugcccugcu

SEQ ID NO: 1249249 - RNA, 23 nt, Human
uccccaaaggcuuugcccugcug

SEQ ID NO: 1249250 - RNA, 15 nt, Human
uccccaacagcgccc

SEQ ID NO: 1249251 - RNA, 16 nt, Human
uccccaacagcgccca

SEQ ID NO: 1249252 - RNA, 17 nt, Human
uccccaacagcgcccaa

SEQ ID NO: 1249253 - RNA, 20 nt, Human
uccccaacagcgcccaaagg

SEQ ID NO: 1249254 - RNA, 18 nt, Human
uccccaacauguaauaag

SEQ ID NO: 1249255 - RNA, 15 nt, Human
uccccaagccuggca

SEQ ID NO: 1249256 - RNA, 14 nt, Human
uccccaacugacca

SEQ ID NO: 1249257 - RNA, 19 nt, Human
uccccaacugaccaccuuu

SEQ ID NO: 1249258 - RNA, 16 nt, Human
uccccaacccccaacu

SEQ ID NO: 1249259 - RNA, 18 nt, Human
uccccaacugaccaccuu

SEQ ID NO: 1249260 - RNA, 22 nt, Human
uccccaaguacaaccacaccca

SEQ ID NO: 1249261 - RNA, 15 nt, Human
acuacagucaggaaa

SEQ ID NO: 1249262 - RNA, 20 nt, Human
acuacaugagaacaaacaga

SEQ ID NO: 1249263 - RNA, 12 nt, Human
acuacaugcacu

SEQ ID NO: 1249264 - RNA, 14 nt, Human
acuacaugcacuug

SEQ ID NO: 1249265 - RNA, 13 nt, Human
acuacauucauuu

SEQ ID NO: 1249266 - RNA, 18 nt, Human
ucccaggggcucccuccg

SEQ ID NO: 1249267 - RNA, 14 nt, Human
ucccaggguuuuaa

SEQ ID NO: 1249268 - RNA, 18 nt, Human
ucccaggguuuuaacuuu

SEQ ID NO: 1249269 - RNA, 19 nt, Human
ucccaggguuuuaacuuug

SEQ ID NO: 1249270 - RNA, 20 nt, Human
ucccaggguuuuaacuuugu

SEQ ID NO: 1249271 - RNA, 15 nt, Human
ucccagguguuaaca

SEQ ID NO: 1249272 - RNA, 21 nt, Human
ucccagguguuaacauuccaa

SEQ ID NO: 1249273 - RNA, 22 nt, Human
ucccagguguuaacauuccaag

SEQ ID NO: 1249274 - RNA, 23 nt, Human
ucccagguguuaacauuccaaga

SEQ ID NO: 1249275 - RNA, 15 nt, Human
ucccagguuggcucu

SEQ ID NO: 1249276 - RNA, 16 nt, Human
ucccagguuggcucug

SEQ ID NO: 1249277 - RNA, 15 nt, Human
ucaugcauggaaauu

SEQ ID NO: 1249278 - RNA, 18 nt, Human
ucaugcauguccuguaaa

SEQ ID NO: 1249279 - RNA, 16 nt, Human
ucaugcauuguccucu

SEQ ID NO: 1249280 - RNA, 17 nt, Human
ucaugauaaugaacaga

SEQ ID NO: 1249281 - RNA, 21 nt, Human
ucaugauaaugaacagaacau

SEQ ID NO: 1249282 - RNA, 13 nt, Human
ucaugauccaacu

SEQ ID NO: 1249283 - RNA, 16 nt, Human
ucaugaggagauucug

SEQ ID NO: 1249284 - RNA, 20 nt, Human
ucaugaggagauucugccuu

SEQ ID NO: 1249285 - RNA, 21 nt, Human
ucaugaggagauucugccuuu

SEQ ID NO: 1249286 - RNA, 23 nt, Human
ucaugaggagauucugccuuugc

SEQ ID NO: 1249287 - RNA, 22 nt, Human
ucaugaggagauucugccuuug

SEQ ID NO: 1249288 - RNA, 18 nt, Human
ucaugagugaauaaaugu

SEQ ID NO: 1249289 - RNA, 17 nt, Human
ucaugauaauucagcag

SEQ ID NO: 1249290 - RNA, 12 nt, Human
ucaugccagcua

SEQ ID NO: 1249291 - RNA, 21 nt, Human
ucaugccagcuacuuccuccu

SEQ ID NO: 1249292 - RNA, 23 nt, Human
ucaugccagcuacuuccuccucc

SEQ ID NO: 1249293 - RNA, 15 nt, Human
ucaugaccaguaaag

SEQ ID NO: 1249294 - RNA, 14 nt, Human
ucaugaccaguaaa

SEQ ID NO: 1249295 - RNA, 14 nt, Human
ucaugacagccucc

SEQ ID NO: 1249296 - RNA, 22 nt, Human
ucaugaauuaguuuuauaugcu

SEQ ID NO: 1249297 - RNA, 16 nt, Human
ucaugugaaaucauuc

SEQ ID NO: 1249298 - RNA, 17 nt, Human
ucaugugucccagaaga

SEQ ID NO: 1249299 - RNA, 18 nt, Human
ucaugugucccagaagau

SEQ ID NO: 1249300 - RNA, 20 nt, Human
ucaugugugcaacaggguau

SEQ ID NO: 1249301 - RNA, 22 nt, Human
ucaugugucccagaagaugacu

SEQ ID NO: 1249302 - RNA, 12 nt, Human
ucaugugugucc

SEQ ID NO: 1249303 - RNA, 14 nt, Human
ucaugugaaaucau

SEQ ID NO: 1249304 - RNA, 21 nt, Human
ucauguuaguaauaccucuaa

SEQ ID NO: 1249305 - RNA, 19 nt, Human
ucauguuaguaauaccucu

SEQ ID NO: 1249306 - RNA, 18 nt, Human
ucauguuaguaauaccuc

SEQ ID NO: 1249307 - RNA, 15 nt, Human
ucauguuaguuaccu

SEQ ID NO: 1249308 - RNA, 19 nt, Human
ucauguuaguuaccuuaua

SEQ ID NO: 1249309 - RNA, 23 nt, Human
ucauguuaguuaccuuauaguua

SEQ ID NO: 1249310 - RNA, 17 nt, Human
ucauguuaguaauaccu

SEQ ID NO: 1249311 - RNA, 14 nt, Human
ucauguuaguaaua

SEQ ID NO: 1249312 - RNA, 22 nt, Human
ucauguuaaauaggcggggcuu

SEQ ID NO: 1249313 - RNA, 16 nt, Human
ucauguguguccacga

SEQ ID NO: 1249314 - RNA, 21 nt, Human
ucauguguguccacgacuguc

SEQ ID NO: 1249315 - RNA, 23 nt, Human
ucauguguguccacgacugucuc

SEQ ID NO: 1249316 - RNA, 12 nt, Human
ucauguguguua

SEQ ID NO: 1249317 - RNA, 17 nt, Human
ucauguugaagccacug

SEQ ID NO: 1249318 - RNA, 14 nt, Human
ucauguuuaagaaa

SEQ ID NO: 1249319 - RNA, 16 nt, Human
ucauguuuaagaaauu

SEQ ID NO: 1249320 - RNA, 15 nt, Human
ucauguuuuugauca

SEQ ID NO: 1249321 - RNA, 12 nt, Human
ucauguuuuuga

SEQ ID NO: 1249322 - RNA, 12 nt, Human
ucauuaaauaaa

SEQ ID NO: 1249323 - RNA, 15 nt, Human
ucauuaaauggggcu

SEQ ID NO: 1249324 - RNA, 13 nt, Human
ucauuaaauaaau

SEQ ID NO: 1249325 - RNA, 14 nt, Human
ucauuaaauaaauu

SEQ ID NO: 1249326 - RNA, 19 nt, Human
ucauuaaauaaauuugacu

SEQ ID NO: 1249327 - RNA, 17 nt, Human
ucauuccuucagauuug

SEQ ID NO: 1249328 - RNA, 12 nt, Human
accucucaauau

SEQ ID NO: 1249329 - RNA, 21 nt, Human
accucuccccuggaacugucu

SEQ ID NO: 1249330 - RNA, 19 nt, Human
accucuagguccccauacu

SEQ ID NO: 1249331 - RNA, 19 nt, Human
accucuaauaguauaaacc

SEQ ID NO: 1249332 - RNA, 21 nt, Human
accucuaaauucuuucauuuu

SEQ ID NO: 1249333 - RNA, 15 nt, Human
accucuaacagcacc

SEQ ID NO: 1249334 - RNA, 16 nt, Human
accucuaacagcacca

SEQ ID NO: 1249335 - RNA, 20 nt, Human
accucuaauaguauaaaccc

SEQ ID NO: 1249336 - RNA, 17 nt, Human
accucuaauaguauaaa

SEQ ID NO: 1249337 - RNA, 16 nt, Human
accucuaauaguauaa

SEQ ID NO: 1249338 - RNA, 12 nt, Human
accucuaauagu

SEQ ID NO: 1249339 - RNA, 19 nt, Human
accucuaacagcaccaaau

SEQ ID NO: 1249340 - RNA, 21 nt, Human
accucugacagcagcaucucu

SEQ ID NO: 1249341 - RNA, 13 nt, Human
accucugacagca

SEQ ID NO: 1249342 - RNA, 14 nt, Human
accucugacagcag

SEQ ID NO: 1249343 - RNA, 15 nt, Human
accucugacagcagc

SEQ ID NO: 1249344 - RNA, 17 nt, Human
accucugacagcagcau

SEQ ID NO: 1249345 - RNA, 19 nt, Human
accucugacagcagcaucu

SEQ ID NO: 1249346 - RNA, 20 nt, Human
accucugacagcagcaucuc

SEQ ID NO: 1249347 - RNA, 18 nt, Human
accucuaaauucuuucau

SEQ ID NO: 1249348 - RNA, 18 nt, Human
accucgcuggacucucag

SEQ ID NO: 1249349 - RNA, 15 nt, Human
accucgggccugcug

SEQ ID NO: 1249350 - RNA, 23 nt, Human
accucgcccagcggcaucaggcu

SEQ ID NO: 1249351 - RNA, 14 nt, Human
accucgcuggacuc

SEQ ID NO: 1249352 - RNA, 16 nt, Human
accucgcuggacucuc

SEQ ID NO: 1249353 - RNA, 14 nt, Human
ucauuggaaauuua

SEQ ID NO: 1249354 - RNA, 15 nt, Human
ucauuggaaauuuag

SEQ ID NO: 1249355 - RNA, 19 nt, Human
ucauuggaaauuuagcauu

SEQ ID NO: 1249356 - RNA, 21 nt, Human
ucauuggaaauuuagcauugu

SEQ ID NO: 1249357 - RNA, 16 nt, Human
ucauuguaaacaaacu

SEQ ID NO: 1249358 - RNA, 13 nt, Human
ucauuguaaucac

SEQ ID NO: 1249359 - RNA, 22 nt, Human
accuccuuucaucacacugggu

SEQ ID NO: 1249360 - RNA, 19 nt, Human
accuccuuucaucacacug

SEQ ID NO: 1249361 - RNA, 23 nt, Human
ucauucgcuacuaugauuuaauu

SEQ ID NO: 1249362 - RNA, 15 nt, Human
ucauucguucugugg

SEQ ID NO: 1249363 - RNA, 13 nt, Human
ucauugcuuacaa

SEQ ID NO: 1249364 - RNA, 12 nt, Human
accggaccaucu

SEQ ID NO: 1249365 - RNA, 15 nt, Human
accggacuuuucugc

SEQ ID NO: 1249366 - RNA, 16 nt, Human
accggacuuuucugca

SEQ ID NO: 1249367 - RNA, 19 nt, Human
accggagaguggggguggg

SEQ ID NO: 1249368 - RNA, 18 nt, Human
accguggcccuuccugga

SEQ ID NO: 1249369 - RNA, 19 nt, Human
accguggcccuuccuggac

SEQ ID NO: 1249370 - RNA, 20 nt, Human
accguggcccuuccuggaca

SEQ ID NO: 1249371 - RNA, 22 nt, Human
accguggcccuuccuggacagc

SEQ ID NO: 1249372 - RNA, 16 nt, Human
accgugggcagggagc

SEQ ID NO: 1249373 - RNA, 18 nt, Human
accgugggcagggagcgg

SEQ ID NO: 1249374 - RNA, 15 nt, Human
accggaccagccugg

SEQ ID NO: 1249375 - RNA, 16 nt, Human
accggaccagccuggc

SEQ ID NO: 1249376 - RNA, 18 nt, Human
accggaccagccuggccc

SEQ ID NO: 1249377 - RNA, 23 nt, Human
accgcccagcggcuugccugccu

SEQ ID NO: 1249378 - RNA, 11 nt, Human
accgcccccuc

SEQ ID NO: 1249379 - RNA, 12 nt, Human
accgcccccucc

SEQ ID NO: 1249380 - RNA, 14 nt, Human
accgcccccuccuc

SEQ ID NO: 1249381 - RNA, 19 nt, Human
accgcccccuccucuagcu

SEQ ID NO: 1249382 - RNA, 19 nt, Human
accgcccccugucucucag

SEQ ID NO: 1249383 - RNA, 20 nt, Human
accgcccagcggcuugccug

SEQ ID NO: 1249384 - RNA, 20 nt, Human
accgagucucuucuccacug

SEQ ID NO: 1249385 - RNA, 21 nt, Human
accgagucucuucuccacugg

SEQ ID NO: 1249386 - RNA, 24 nt, Human
accgagucucuucuccacuggaug

SEQ ID NO: 1249387 - RNA, 12 nt, Human
accgccagcucu

SEQ ID NO: 1249388 - RNA, 13 nt, Human
accgccagcucug

SEQ ID NO: 1249389 - RNA, 14 nt, Human
accgccagcucugu

SEQ ID NO: 1249390 - RNA, 16 nt, Human
accgccagcucuguuc

SEQ ID NO: 1249391 - RNA, 21 nt, Human
accgccagcucuguucuuccu

SEQ ID NO: 1249392 - RNA, 17 nt, Human
acccuuuucaugauuuu

SEQ ID NO: 1249393 - RNA, 19 nt, Human
acccuuuuggguuucugcc

SEQ ID NO: 1249394 - RNA, 22 nt, Human
acccuuugcugugaggcugucc

SEQ ID NO: 1249395 - RNA, 23 nt, Human
acccuuugcugugaggcuguccu

SEQ ID NO: 1249396 - RNA, 23 nt, Human
acccuuugugugcucuccauucu

SEQ ID NO: 1249397 - RNA, 19 nt, Human
acccuuugugugcucucca

SEQ ID NO: 1249398 - RNA, 11 nt, Human
acccuuuucau

SEQ ID NO: 1249399 - RNA, 12 nt, Human
acccuuuuccag

SEQ ID NO: 1249400 - RNA, 22 nt, Human
ucauauuaagaaugaucugauu

SEQ ID NO: 1249401 - RNA, 18 nt, Human
ucauauuaagaaugaucu

SEQ ID NO: 1249402 - RNA, 17 nt, Human
ucauauuaagaaugauc

SEQ ID NO: 1249403 - RNA, 15 nt, Human
ucauauuaagaauga

SEQ ID NO: 1249404 - RNA, 14 nt, Human
ucauauuaagaaug

SEQ ID NO: 1249405 - RNA, 12 nt, Human
accgaagcccag

SEQ ID NO: 1249406 - RNA, 13 nt, Human
accgaagcccaga

SEQ ID NO: 1249407 - RNA, 18 nt, Human
accgaagcccagaggguc

SEQ ID NO: 1249408 - RNA, 15 nt, Human
accgaaugugucuuu

SEQ ID NO: 1249409 - RNA, 16 nt, Human
accgaaugugucuuua

SEQ ID NO: 1249410 - RNA, 22 nt, Human
accgaaugugucuuuagauagc

SEQ ID NO: 1249411 - RNA, 19 nt, Human
accgaaugugucuuuagau

SEQ ID NO: 1249412 - RNA, 12 nt, Human
accuagauuuuu

SEQ ID NO: 1249413 - RNA, 20 nt, Human
accuaauccaggcagaucca

SEQ ID NO: 1249414 - RNA, 21 nt, Human
accuaauccaggcagauccag

SEQ ID NO: 1249415 - RNA, 11 nt, Human
accuaauccaa

SEQ ID NO: 1249416 - RNA, 15 nt, Human
accuaauccaggcag

SEQ ID NO: 1249417 - RNA, 17 nt, Human
accuaacucuucuuuca

SEQ ID NO: 1249418 - RNA, 18 nt, Human
accuaacucuucuuucau

SEQ ID NO: 1249419 - RNA, 21 nt, Human
accuaagauuacaaaucagaa

SEQ ID NO: 1249420 - RNA, 16 nt, Human
accguguuggucugua

SEQ ID NO: 1249421 - RNA, 22 nt, Human
accguguuggucuguacugauu

SEQ ID NO: 1249422 - RNA, 14 nt, Human
accgugggcucccu

SEQ ID NO: 1249423 - RNA, 16 nt, Human
accgugggcucccuga

SEQ ID NO: 1249424 - RNA, 14 nt, Human
accguucugugcac

SEQ ID NO: 1249425 - RNA, 13 nt, Human
accguugucucau

SEQ ID NO: 1249426 - RNA, 21 nt, Human
accuagauguauaacuaggag

SEQ ID NO: 1249427 - RNA, 13 nt, Human
accuagauuuaau

SEQ ID NO: 1249428 - RNA, 14 nt, Human
accuagcagcaccg

SEQ ID NO: 1249429 - RNA, 21 nt, Human
accuagcagcaccguucugug

SEQ ID NO: 1249430 - RNA, 22 nt, Human
accuagcagcaccguucugugc

SEQ ID NO: 1249431 - RNA, 23 nt, Human
accuagcagcaccguucugugca

SEQ ID NO: 1249432 - RNA, 17 nt, Human
accuagauuuaauauaa

SEQ ID NO: 1249433 - RNA, 21 nt, Human
accuagcgggauggggcuccc

SEQ ID NO: 1249434 - RNA, 18 nt, Human
accuagcugaauguuuuu

SEQ ID NO: 1249435 - RNA, 19 nt, Human
accuagcugaauguuuuuc

SEQ ID NO: 1249436 - RNA, 20 nt, Human
accuagcugaauguuuuucu

SEQ ID NO: 1249437 - RNA, 21 nt, Human
accuagcugaauguuuuucua

SEQ ID NO: 1249438 - RNA, 22 nt, Human
accuagcugaauguuuuucuaa

SEQ ID NO: 1249439 - RNA, 23 nt, Human
accuagcugaauguuuuucuaaa

SEQ ID NO: 1249440 - RNA, 18 nt, Human
accuagcuggcucuguga

SEQ ID NO: 1249441 - RNA, 15 nt, Human
accuauaccuguguu

SEQ ID NO: 1249442 - RNA, 18 nt, Human
accuauaccuguguuucu

SEQ ID NO: 1249443 - RNA, 17 nt, Human
accuaucccaccuccau

SEQ ID NO: 1249444 - RNA, 14 nt, Human
accuaucccaccuc

SEQ ID NO: 1249445 - RNA, 19 nt, Human
accuaugauauuuucugug

SEQ ID NO: 1249446 - RNA, 12 nt, Human
accuaugucauu

SEQ ID NO: 1249447 - RNA, 15 nt, Human
accuaugucauuuca

SEQ ID NO: 1249448 - RNA, 16 nt, Human
accuaugucauuucau

SEQ ID NO: 1249449 - RNA, 18 nt, Human
accuaugucauuucauuu

SEQ ID NO: 1249450 - RNA, 19 nt, Human
accuaugucauuucauuuc

SEQ ID NO: 1249451 - RNA, 13 nt, Human
accucaauguccc

SEQ ID NO: 1249452 - RNA, 20 nt, Human
accucaauuuucacuguguc

SEQ ID NO: 1249453 - RNA, 23 nt, Human
accucaagugaucugcccaccuc

SEQ ID NO: 1249454 - RNA, 19 nt, Human
accucaaucagucucagaa

SEQ ID NO: 1249455 - RNA, 21 nt, Human
accucaaucagucucagaaug

SEQ ID NO: 1249456 - RNA, 16 nt, Human
accucaagcugcaucu

SEQ ID NO: 1249457 - RNA, 19 nt, Human
accucaagugaucugccca

SEQ ID NO: 1249458 - RNA, 18 nt, Human
accucaauuuucacugug

SEQ ID NO: 1249459 - RNA, 15 nt, Human
accucaccaacuccu

SEQ ID NO: 1249460 - RNA, 16 nt, Human
accucaccaacuccua

SEQ ID NO: 1249461 - RNA, 17 nt, Human
accucaccaacuccuag

SEQ ID NO: 1249462 - RNA, 17 nt, Human
accucaccaagcugcug

SEQ ID NO: 1249463 - RNA, 19 nt, Human
accucaccaacuccuaguu

SEQ ID NO: 1249464 - RNA, 20 nt, Human
accucagauggcagcuuuua

SEQ ID NO: 1249465 - RNA, 21 nt, Human
accucagauggcagcuuuuaa

SEQ ID NO: 1249466 - RNA, 22 nt, Human
accucagauggcagcuuuuaaa

SEQ ID NO: 1249467 - RNA, 13 nt, Human
accucagaaguaa

SEQ ID NO: 1249468 - RNA, 17 nt, Human
accucagaccccggggu

SEQ ID NO: 1249469 - RNA, 20 nt, Human
accucagaaguaaaggaauu

SEQ ID NO: 1249470 - RNA, 14 nt, Human
accucagauggcag

SEQ ID NO: 1249471 - RNA, 15 nt, Human
accucagauggcagc

SEQ ID NO: 1249472 - RNA, 16 nt, Human
accucagauggcagcu

SEQ ID NO: 1249473 - RNA, 18 nt, Human
accucagauggcagcuuu

SEQ ID NO: 1249474 - RNA, 19 nt, Human
accucagauggcagcuuuu

SEQ ID NO: 1249475 - RNA, 19 nt, Human
accuccuauggguugucac

SEQ ID NO: 1249476 - RNA, 13 nt, Human
accuccucagccu

SEQ ID NO: 1249477 - RNA, 14 nt, Human
accuccucagccug

SEQ ID NO: 1249478 - RNA, 15 nt, Human
accuccucagccuga

SEQ ID NO: 1249479 - RNA, 23 nt, Human
accuccucagccugaaccccagg

SEQ ID NO: 1249480 - RNA, 20 nt, Human
ucauuuuagggguagcauuu

SEQ ID NO: 1249481 - RNA, 20 nt, Human
ucauuuuaacaucugagaaa

SEQ ID NO: 1249482 - RNA, 13 nt, Human
ucauuuuaauuau

SEQ ID NO: 1249483 - RNA, 14 nt, Human
ucauuuuaauuauu

SEQ ID NO: 1249484 - RNA, 15 nt, Human
ucauuuguuggaaug

SEQ ID NO: 1249485 - RNA, 12 nt, Human
ucauuuguuuaa

SEQ ID NO: 1249486 - RNA, 13 nt, Human
ucauuuguuuaaa

SEQ ID NO: 1249487 - RNA, 17 nt, Human
ucauuuguuuaaaaagg

SEQ ID NO: 1249488 - RNA, 21 nt, Human
ucauuuguuuaaaaaggcagu

SEQ ID NO: 1249489 - RNA, 22 nt, Human
ucauuuuaacaucugagaaaag

SEQ ID NO: 1249490 - RNA, 18 nt, Human
ucauuugugccagaaugc

SEQ ID NO: 1249491 - RNA, 18 nt, Human
ucauuuguggguuuuuau

SEQ ID NO: 1249492 - RNA, 15 nt, Human
ucauuugcuuuggaa

SEQ ID NO: 1249493 - RNA, 14 nt, Human
ucauuugcuuugga

SEQ ID NO: 1249494 - RNA, 22 nt, Human
ucauuuguggguuuuuauuucc

SEQ ID NO: 1249495 - RNA, 23 nt, Human
ucauuuguggguuuuuauuuccu

SEQ ID NO: 1249496 - RNA, 23 nt, Human
uccaaagucucuggaauuugaaa

SEQ ID NO: 1249497 - RNA, 13 nt, Human
uccaaagucucua

SEQ ID NO: 1249498 - RNA, 14 nt, Human
uccaaagucucuaa

SEQ ID NO: 1249499 - RNA, 17 nt, Human
uccaaagucucuaauuc

SEQ ID NO: 1249500 - RNA, 18 nt, Human
uccaaagucucuaauucu

SEQ ID NO: 1249501 - RNA, 15 nt, Human
ucauuuuuuuccuug

SEQ ID NO: 1249502 - RNA, 18 nt, Human
ucauuuuuuuccuugcaa

SEQ ID NO: 1249503 - RNA, 14 nt, Human
ucauuuuaugucaa

SEQ ID NO: 1249504 - RNA, 15 nt, Human
ucauuuuauguuaag

SEQ ID NO: 1249505 - RNA, 16 nt, Human
ucauuuuuuaaaaaag

SEQ ID NO: 1249506 - RNA, 18 nt, Human
accuggaagcauuuguuu

SEQ ID NO: 1249507 - RNA, 23 nt, Human
accuggaagcauuuguuucuacu

SEQ ID NO: 1249508 - RNA, 19 nt, Human
accugcucuccucuugcca

SEQ ID NO: 1249509 - RNA, 16 nt, Human
accugcugaccugugc

SEQ ID NO: 1249510 - RNA, 18 nt, Human
accugcugaccugugcac

SEQ ID NO: 1249511 - RNA, 17 nt, Human
accugcugaccugugca

SEQ ID NO: 1249512 - RNA, 11 nt, Human
accugcugagc

SEQ ID NO: 1249513 - RNA, 12 nt, Human
accugcugagcu

SEQ ID NO: 1249514 - RNA, 13 nt, Human
accugcugagcuc

SEQ ID NO: 1249515 - RNA, 14 nt, Human
accugcugagcucu

SEQ ID NO: 1249516 - RNA, 15 nt, Human
accugcugagcucug

SEQ ID NO: 1249517 - RNA, 16 nt, Human
accugcugagcucuga

SEQ ID NO: 1249518 - RNA, 17 nt, Human
accugcugagcucugag

SEQ ID NO: 1249519 - RNA, 15 nt, Human
accugcuuuucaaug

SEQ ID NO: 1249520 - RNA, 16 nt, Human
accugcuuuucaaugu

SEQ ID NO: 1249521 - RNA, 19 nt, Human
accugcuuuucaauguguu

SEQ ID NO: 1249522 - RNA, 18 nt, Human
accuggaacuuggggagu

SEQ ID NO: 1249523 - RNA, 18 nt, Human
accugcucuccucuugcc

SEQ ID NO: 1249524 - RNA, 17 nt, Human
accugcucuccucuugc

SEQ ID NO: 1249525 - RNA, 18 nt, Human
accugaauaaagaaugaa

SEQ ID NO: 1249526 - RNA, 15 nt, Human
accugaaggguugac

SEQ ID NO: 1249527 - RNA, 16 nt, Human
accugaaugcucugua

SEQ ID NO: 1249528 - RNA, 21 nt, Human
uccaacuaucucauuuccaag

SEQ ID NO: 1249529 - RNA, 22 nt, Human
uccaacuaaugccuuacucuuc

SEQ ID NO: 1249530 - RNA, 20 nt, Human
uccaacuacuaauagaauaa

SEQ ID NO: 1249531 - RNA, 21 nt, Human
uccaacuacuaauagaauaaa

SEQ ID NO: 1249532 - RNA, 23 nt, Human
uccaacuacuaauagaauaaagg

SEQ ID NO: 1249533 - RNA, 18 nt, Human
uccaagcuccaucuccac

SEQ ID NO: 1249534 - RNA, 22 nt, Human
uccaagcucacuccccaacccc

SEQ ID NO: 1249535 - RNA, 14 nt, Human
uccaaaugcagcuu

SEQ ID NO: 1249536 - RNA, 15 nt, Human
uccaaaugcagcuuu

SEQ ID NO: 1249537 - RNA, 17 nt, Human
uccaaauacuaaugaaa

SEQ ID NO: 1249538 - RNA, 17 nt, Human
uccaacaccaagcacag

SEQ ID NO: 1249539 - RNA, 21 nt, Human
uccaacaccaagcacagcagc

SEQ ID NO: 1249540 - RNA, 23 nt, Human
uccaacaccaagcacagcagccu

SEQ ID NO: 1249541 - RNA, 15 nt, Human
uccaacaguuuaaug

SEQ ID NO: 1249542 - RNA, 18 nt, Human
uccaacaguuuaaugaag

SEQ ID NO: 1249543 - RNA, 21 nt, Human
uccaacaguuuaaugaagauc

SEQ ID NO: 1249544 - RNA, 23 nt, Human
uccaacaguuuaaugaagaucua

SEQ ID NO: 1249545 - RNA, 20 nt, Human
uccaacaucacagcccagcc

SEQ ID NO: 1249546 - RNA, 15 nt, Human
uccaacuaaugccuu

SEQ ID NO: 1249547 - RNA, 19 nt, Human
uccaacuaaugccuuacuc

SEQ ID NO: 1249548 - RNA, 12 nt, Human
uccaagcuggga

SEQ ID NO: 1249549 - RNA, 22 nt, Human
uccaagcugggagauucaaggg

SEQ ID NO: 1249550 - RNA, 14 nt, Human
uccaaguuaaaugu

SEQ ID NO: 1249551 - RNA, 15 nt, Human
uccaaguuaaaugua

SEQ ID NO: 1249552 - RNA, 16 nt, Human
uccaaguuaaauguag

SEQ ID NO: 1249553 - RNA, 17 nt, Human
uccaaguuaaauguaga

SEQ ID NO: 1249554 - RNA, 22 nt, Human
uccaaguuguucgggccaagga

SEQ ID NO: 1249555 - RNA, 17 nt, Human
uccaaguuguucgggcc

SEQ ID NO: 1249556 - RNA, 19 nt, Human
uccaaucaaucuugcaugu

SEQ ID NO: 1249557 - RNA, 21 nt, Human
uccaaucaaucuugcauguaa

SEQ ID NO: 1249558 - RNA, 20 nt, Human
uccaaucaaucuugcaugua

SEQ ID NO: 1249559 - RNA, 15 nt, Human
uccacagggucccac

SEQ ID NO: 1249560 - RNA, 16 nt, Human
uccacagggucccaca

SEQ ID NO: 1249561 - RNA, 17 nt, Human
uccacagggucccacag

SEQ ID NO: 1249562 - RNA, 18 nt, Human
uccacagggucccacagc

SEQ ID NO: 1249563 - RNA, 20 nt, Human
uccacagggucccacagcca

SEQ ID NO: 1249564 - RNA, 21 nt, Human
uccacagggucccacagccac

SEQ ID NO: 1249565 - RNA, 14 nt, Human
uccacaggucuaga

SEQ ID NO: 1249566 - RNA, 15 nt, Human
uccacaggucuagac

SEQ ID NO: 1249567 - RNA, 16 nt, Human
uccacaggucuagacu

SEQ ID NO: 1249568 - RNA, 17 nt, Human
uccacaggucuagacua

SEQ ID NO: 1249569 - RNA, 19 nt, Human
uccaccaaaugugcuuuga

SEQ ID NO: 1249570 - RNA, 15 nt, Human
uccacauuucuaaaa

SEQ ID NO: 1249571 - RNA, 13 nt, Human
uccacauuucuaa

SEQ ID NO: 1249572 - RNA, 14 nt, Human
uccacauuucuaaa

SEQ ID NO: 1249573 - RNA, 16 nt, Human
uccacauuucuaaaau

SEQ ID NO: 1249574 - RNA, 14 nt, Human
accuuccacccagu

SEQ ID NO: 1249575 - RNA, 15 nt, Human
accuuccagaaauac

SEQ ID NO: 1249576 - RNA, 23 nt, Human
accuuccagaaauacuacugugu

SEQ ID NO: 1249577 - RNA, 13 nt, Human
accuuccagcucc

SEQ ID NO: 1249578 - RNA, 14 nt, Human
accuuccagcuccu

SEQ ID NO: 1249579 - RNA, 20 nt, Human
accuuccaugucaagauuca

SEQ ID NO: 1249580 - RNA, 17 nt, Human
accuuccagcuccugua

SEQ ID NO: 1249581 - RNA, 12 nt, Human
accuuccaccca

SEQ ID NO: 1249582 - RNA, 22 nt, Human
accuuauaguuacuguguaauu

SEQ ID NO: 1249583 - RNA, 23 nt, Human
accuuauaguuacuguguaauua

SEQ ID NO: 1249584 - RNA, 15 nt, Human
accuucuccccagcu

SEQ ID NO: 1249585 - RNA, 18 nt, Human
accuucuccccagcuccc

SEQ ID NO: 1249586 - RNA, 19 nt, Human
accuucuccccagcuccca

SEQ ID NO: 1249587 - RNA, 21 nt, Human
accuucuccccagcucccagg

SEQ ID NO: 1249588 - RNA, 23 nt, Human
accuucuccccagcucccaggac

SEQ ID NO: 1249589 - RNA, 22 nt, Human
accuucuccccagcucccagga

SEQ ID NO: 1249590 - RNA, 14 nt, Human
accuucuccccagc

SEQ ID NO: 1249591 - RNA, 12 nt, Human
accuucuguggc

SEQ ID NO: 1249592 - RNA, 13 nt, Human
accuucuguggcu

SEQ ID NO: 1249593 - RNA, 15 nt, Human
accuucuguggcuca

SEQ ID NO: 1249594 - RNA, 16 nt, Human
accuucuguggcucac

SEQ ID NO: 1249595 - RNA, 23 nt, Human
accuugaaaaaaaacaguggauc

SEQ ID NO: 1249596 - RNA, 16 nt, Human
accuugaaaaaaaaca

SEQ ID NO: 1249597 - RNA, 18 nt, Human
accuugaaaaaaaacagu

SEQ ID NO: 1249598 - RNA, 14 nt, Human
accuuagaauacag

SEQ ID NO: 1249599 - RNA, 14 nt, Human
accuuagccugccc

SEQ ID NO: 1249600 - RNA, 21 nt, Human
accuuagcuggcauuacagcu

SEQ ID NO: 1249601 - RNA, 22 nt, Human
accuuagcuggcauuacagcug

SEQ ID NO: 1249602 - RNA, 17 nt, Human
accuuagugcaguuauu

SEQ ID NO: 1249603 - RNA, 12 nt, Human
accuuauaguua

SEQ ID NO: 1249604 - RNA, 14 nt, Human
accuuauaguuacu

SEQ ID NO: 1249605 - RNA, 18 nt, Human
accuuauaguuacugugu

SEQ ID NO: 1249606 - RNA, 19 nt, Human
accuuauaguuacugugua

SEQ ID NO: 1249607 - RNA, 20 nt, Human
accuuauaguuacuguguaa

SEQ ID NO: 1249608 - RNA, 21 nt, Human
accuuagugcaguuauuugcu

SEQ ID NO: 1249609 - RNA, 22 nt, Human
accuggucacaggacucugccu

SEQ ID NO: 1249610 - RNA, 23 nt, Human
accuggucacaggacucugccuc

SEQ ID NO: 1249611 - RNA, 14 nt, Human
accuggucucuccu

SEQ ID NO: 1249612 - RNA, 16 nt, Human
accuggugcugccucu

SEQ ID NO: 1249613 - RNA, 12 nt, Human
accuuaagaccu

SEQ ID NO: 1249614 - RNA, 22 nt, Human
accuuaagaccuacuguucuaa

SEQ ID NO: 1249615 - RNA, 15 nt, Human
accuuaauuuauuau

SEQ ID NO: 1249616 - RNA, 14 nt, Human
accuuaauuuauua

SEQ ID NO: 1249617 - RNA, 16 nt, Human
uccacucuuucuuuca

SEQ ID NO: 1249618 - RNA, 15 nt, Human
uccacucuuucuuuc

SEQ ID NO: 1249619 - RNA, 13 nt, Human
uccacucuuucuu

SEQ ID NO: 1249620 - RNA, 21 nt, Human
uccacucugcuucucugacuu

SEQ ID NO: 1249621 - RNA, 23 nt, Human
uccacucugcuucucugacuucu

SEQ ID NO: 1249622 - RNA, 24 nt, Human
uccacucugcuucucugacuucug

SEQ ID NO: 1249623 - RNA, 12 nt, Human
uccacucugcuu

SEQ ID NO: 1249624 - RNA, 14 nt, Human
uccacucugcuucu

SEQ ID NO: 1249625 - RNA, 15 nt, Human
uccacucugcuucuc

SEQ ID NO: 1249626 - RNA, 19 nt, Human
uccacucugcuucucugac

SEQ ID NO: 1249627 - RNA, 20 nt, Human
uccacucugcuucucugacu

SEQ ID NO: 1249628 - RNA, 15 nt, Human
uccacugagggcagu

SEQ ID NO: 1249629 - RNA, 14 nt, Human
uccagaagugugac

SEQ ID NO: 1249630 - RNA, 15 nt, Human
uccagaagugugacu

SEQ ID NO: 1249631 - RNA, 20 nt, Human
uccagaagugugacuggcua

SEQ ID NO: 1249632 - RNA, 19 nt, Human
uccagaagugugacuggcu

SEQ ID NO: 1249633 - RNA, 13 nt, Human
uccagaaugcugu

SEQ ID NO: 1249634 - RNA, 15 nt, Human
uccagaaugcuguac

SEQ ID NO: 1249635 - RNA, 16 nt, Human
uccagaaugcuguaca

SEQ ID NO: 1249636 - RNA, 17 nt, Human
uccagaaugcuguacau

SEQ ID NO: 1249637 - RNA, 22 nt, Human
accuugaaaaaaaacaguggau

SEQ ID NO: 1249638 - RNA, 15 nt, Human
uccacguacugcagc

SEQ ID NO: 1249639 - RNA, 17 nt, Human
uccacguacugcagccu

SEQ ID NO: 1249640 - RNA, 18 nt, Human
uccacguacugcagccuc

SEQ ID NO: 1249641 - RNA, 19 nt, Human
uccacguucugcucaucau

SEQ ID NO: 1249642 - RNA, 20 nt, Human
uccacguucugcucaucauu

SEQ ID NO: 1249643 - RNA, 21 nt, Human
uccacguucugcucaucauuc

SEQ ID NO: 1249644 - RNA, 15 nt, Human
uccagaccccuggcu

SEQ ID NO: 1249645 - RNA, 16 nt, Human
uccagaccccuggcuu

SEQ ID NO: 1249646 - RNA, 17 nt, Human
uccagaccccuggcuuu

SEQ ID NO: 1249647 - RNA, 18 nt, Human
uccagaccccuggcuuuu

SEQ ID NO: 1249648 - RNA, 23 nt, Human
uccagaccccuggcuuuucacug

SEQ ID NO: 1249649 - RNA, 20 nt, Human
uccagccugagcgacaguga

SEQ ID NO: 1249650 - RNA, 21 nt, Human
uccagccugagcgacagugag

SEQ ID NO: 1249651 - RNA, 11 nt, Human
uccagccugac

SEQ ID NO: 1249652 - RNA, 13 nt, Human
uccagccugacau

SEQ ID NO: 1249653 - RNA, 21 nt, Human
uccagccugacaucaaaaaag

SEQ ID NO: 1249654 - RNA, 16 nt, Human
ucaggaagagaaggag

SEQ ID NO: 1249655 - RNA, 15 nt, Human
ucaggaagagaagga

SEQ ID NO: 1249656 - RNA, 22 nt, Human
ucaggaacguuuagcugacaaa

SEQ ID NO: 1249657 - RNA, 23 nt, Human
ucaggaacguuuagcugacaaaa

SEQ ID NO: 1249658 - RNA, 18 nt, Human
ucaggaacguuuagcuga

SEQ ID NO: 1249659 - RNA, 16 nt, Human
ucagccugggcgcugg

SEQ ID NO: 1249660 - RNA, 19 nt, Human
ucagccugggcgcuggucc

SEQ ID NO: 1249661 - RNA, 18 nt, Human
ucaggaaccgaggcaggg

SEQ ID NO: 1249662 - RNA, 20 nt, Human
ucagccuggccagacacagg

SEQ ID NO: 1249663 - RNA, 13 nt, Human
ucagccugggcgc

SEQ ID NO: 1249664 - RNA, 20 nt, Human
ucaggaagagaaggagcaga

SEQ ID NO: 1249665 - RNA, 20 nt, Human
ucaggcauuggauauuuuuu

SEQ ID NO: 1249666 - RNA, 19 nt, Human
ucaggcccuuauuuucaag

SEQ ID NO: 1249667 - RNA, 22 nt, Human
ucaggcccccgccuuggccugu

SEQ ID NO: 1249668 - RNA, 16 nt, Human
ucaggcccggcagggc

SEQ ID NO: 1249669 - RNA, 21 nt, Human
ucaggcccggcagggcgggca

SEQ ID NO: 1249670 - RNA, 12 nt, Human
ucaggcccaggc

SEQ ID NO: 1249671 - RNA, 15 nt, Human
ucaggcccaggcacu

SEQ ID NO: 1249672 - RNA, 20 nt, Human
ucaggcccccaccuggcuca

SEQ ID NO: 1249673 - RNA, 21 nt, Human
ucaggcccccaccuggcucac

SEQ ID NO: 1249674 - RNA, 19 nt, Human
ucaggcccccgccuuggcc

SEQ ID NO: 1249675 - RNA, 20 nt, Human
ucaggcccccgccuuggccu

SEQ ID NO: 1249676 - RNA, 21 nt, Human
acccuccaccgcagaaggaag

SEQ ID NO: 1249677 - RNA, 20 nt, Human
acccuccaccgcagaaggaa

SEQ ID NO: 1249678 - RNA, 18 nt, Human
acccuccaccgcagaagg

SEQ ID NO: 1249679 - RNA, 15 nt, Human
acccuccagagacaa

SEQ ID NO: 1249680 - RNA, 11 nt, Human
acccuccuggc

SEQ ID NO: 1249681 - RNA, 13 nt, Human
acccuccuggcuc

SEQ ID NO: 1249682 - RNA, 15 nt, Human
ucaggguaggcugga

SEQ ID NO: 1249683 - RNA, 21 nt, Human
accccuugucgccccucccuc

SEQ ID NO: 1249684 - RNA, 13 nt, Human
accccuuucccac

SEQ ID NO: 1249685 - RNA, 14 nt, Human
accccuuucccacc

SEQ ID NO: 1249686 - RNA, 17 nt, Human
accccuuucccacccca

SEQ ID NO: 1249687 - RNA, 16 nt, Human
accccuuucccacccc

SEQ ID NO: 1249688 - RNA, 19 nt, Human
accccuuucuagaccaaua

SEQ ID NO: 1249689 - RNA, 21 nt, Human
accccuuucuagaccaauaaa

SEQ ID NO: 1249690 - RNA, 16 nt, Human
acccgaggcugagaau

SEQ ID NO: 1249691 - RNA, 21 nt, Human
acccgagucauucguucugug

SEQ ID NO: 1249692 - RNA, 23 nt, Human
acccucuggagggguguggcucc

SEQ ID NO: 1249693 - RNA, 14 nt, Human
acccucuguuccuu

SEQ ID NO: 1249694 - RNA, 20 nt, Human
acccucuguuccuucccugu

SEQ ID NO: 1249695 - RNA, 21 nt, Human
acccucuguuccuucccugug

SEQ ID NO: 1249696 - RNA, 13 nt, Human
acccucuucaugg

SEQ ID NO: 1249697 - RNA, 16 nt, Human
acccucuuccuacugg

SEQ ID NO: 1249698 - RNA, 15 nt, Human
acccucuuccuacug

SEQ ID NO: 1249699 - RNA, 15 nt, Human
acccuuauugcuguc

SEQ ID NO: 1249700 - RNA, 17 nt, Human
acccuuauugcuguccu

SEQ ID NO: 1249701 - RNA, 21 nt, Human
acccuuauugcuguccuggag

SEQ ID NO: 1249702 - RNA, 19 nt, Human
acccuuauugcuguccugg

SEQ ID NO: 1249703 - RNA, 14 nt, Human
acccuucucccacu

SEQ ID NO: 1249704 - RNA, 15 nt, Human
acccuucucccacuc

SEQ ID NO: 1249705 - RNA, 16 nt, Human
acccuucucccacucu

SEQ ID NO: 1249706 - RNA, 17 nt, Human
acccuucucccacucuc

SEQ ID NO: 1249707 - RNA, 18 nt, Human
acccuucucccacucucc

SEQ ID NO: 1249708 - RNA, 20 nt, Human
acccuucucccacucuccua

SEQ ID NO: 1249709 - RNA, 15 nt, Human
ucagccccaccccag

SEQ ID NO: 1249710 - RNA, 18 nt, Human
ucagccccaccccagggc

SEQ ID NO: 1249711 - RNA, 19 nt, Human
ucagccccaccccagggca

SEQ ID NO: 1249712 - RNA, 18 nt, Human
ucagccccacccuggccu

SEQ ID NO: 1249713 - RNA, 23 nt, Human
ucagccccaccccagggcagcca

SEQ ID NO: 1249714 - RNA, 16 nt, Human
ucagccccgcguggaa

SEQ ID NO: 1249715 - RNA, 18 nt, Human
ucagcccucccugccccu

SEQ ID NO: 1249716 - RNA, 19 nt, Human
ucagcccucccugccccuc

SEQ ID NO: 1249717 - RNA, 13 nt, Human
ucagcccugagga

SEQ ID NO: 1249718 - RNA, 14 nt, Human
ucagcccugcacca

SEQ ID NO: 1249719 - RNA, 20 nt, Human
acccagguuggagugcagug

SEQ ID NO: 1249720 - RNA, 17 nt, Human
acccaguaacucaucug

SEQ ID NO: 1249721 - RNA, 18 nt, Human
acccaguaacucaucugu

SEQ ID NO: 1249722 - RNA, 16 nt, Human
acccaguccacaaaau

SEQ ID NO: 1249723 - RNA, 17 nt, Human
acccagguuaagaaaau

SEQ ID NO: 1249724 - RNA, 19 nt, Human
acccagguuggagugcagu

SEQ ID NO: 1249725 - RNA, 14 nt, Human
acccaggacaggau

SEQ ID NO: 1249726 - RNA, 11 nt, Human
acccaggacag

SEQ ID NO: 1249727 - RNA, 10 nt, Human
acccaggaca

SEQ ID NO: 1249728 - RNA, 14 nt, Human
acccaggacaagca

SEQ ID NO: 1249729 - RNA, 16 nt, Human
acccaggacaagcaug

SEQ ID NO: 1249730 - RNA, 17 nt, Human
acccaggacaagcaugg

SEQ ID NO: 1249731 - RNA, 20 nt, Human
acccagcucccuucuucccu

SEQ ID NO: 1249732 - RNA, 15 nt, Human
ucagcccugcaccau

SEQ ID NO: 1249733 - RNA, 14 nt, Human
ucagauucccagag

SEQ ID NO: 1249734 - RNA, 15 nt, Human
ucagauggcagcuuu

SEQ ID NO: 1249735 - RNA, 16 nt, Human
ucagauggcagcuuuu

SEQ ID NO: 1249736 - RNA, 17 nt, Human
ucagauggcagcuuuua

SEQ ID NO: 1249737 - RNA, 18 nt, Human
ucagauggcagcuuuuaa

SEQ ID NO: 1249738 - RNA, 18 nt, Human
ucagaagaaaaagaagca

SEQ ID NO: 1249739 - RNA, 17 nt, Human
ucagaagaaaaagaagc

SEQ ID NO: 1249740 - RNA, 15 nt, Human
ucagaacuagaauuu

SEQ ID NO: 1249741 - RNA, 21 nt, Human
ucagaacucaaauggggccag

SEQ ID NO: 1249742 - RNA, 22 nt, Human
ucagaacucaaauggggccaga

SEQ ID NO: 1249743 - RNA, 13 nt, Human
ucagaagaaaaag

SEQ ID NO: 1249744 - RNA, 16 nt, Human
ucagaagaaaaagaag

SEQ ID NO: 1249745 - RNA, 19 nt, Human
ucagccuggcuucaaauug

SEQ ID NO: 1249746 - RNA, 15 nt, Human
accccuggcuuuuca

SEQ ID NO: 1249747 - RNA, 17 nt, Human
accccuggcuuuucacu

SEQ ID NO: 1249748 - RNA, 13 nt, Human
accccuguuucug

SEQ ID NO: 1249749 - RNA, 12 nt, Human
accccuggcuuu

SEQ ID NO: 1249750 - RNA, 17 nt, Human
acccccgucaagaguga

SEQ ID NO: 1249751 - RNA, 13 nt, Human
acccccucacccc

SEQ ID NO: 1249752 - RNA, 13 nt, Human
acccccagccugg

SEQ ID NO: 1249753 - RNA, 14 nt, Human
acccccagccuggg

SEQ ID NO: 1249754 - RNA, 15 nt, Human
acccccagccugggc

SEQ ID NO: 1249755 - RNA, 16 nt, Human
acccccagccugggcc

SEQ ID NO: 1249756 - RNA, 17 nt, Human
acccccagccugggccu

SEQ ID NO: 1249757 - RNA, 21 nt, Human
accccauggugcuaggaagag

SEQ ID NO: 1249758 - RNA, 13 nt, Human
accccauucccgc

SEQ ID NO: 1249759 - RNA, 14 nt, Human
accccauucccgca

SEQ ID NO: 1249760 - RNA, 15 nt, Human
accccauucccgcag

SEQ ID NO: 1249761 - RNA, 15 nt, Human
acccagugcccccac

SEQ ID NO: 1249762 - RNA, 18 nt, Human
acccagugcccccacuga

SEQ ID NO: 1249763 - RNA, 22 nt, Human
acccagugcccccacugaccag

SEQ ID NO: 1249764 - RNA, 19 nt, Human
accccauggagcugggcua

SEQ ID NO: 1249765 - RNA, 22 nt, Human
accccauggcagugggaaaaau

SEQ ID NO: 1249766 - RNA, 15 nt, Human
acccccaggaccaga

SEQ ID NO: 1249767 - RNA, 16 nt, Human
acccccagcuuugcua

SEQ ID NO: 1249768 - RNA, 12 nt, Human
acccccagcuca

SEQ ID NO: 1249769 - RNA, 13 nt, Human
acccccagcucaa

SEQ ID NO: 1249770 - RNA, 20 nt, Human
acccccagcucaauggacug

SEQ ID NO: 1249771 - RNA, 21 nt, Human
acccccagcucaauggacugg

SEQ ID NO: 1249772 - RNA, 18 nt, Human
acccccagcuccggccug

SEQ ID NO: 1249773 - RNA, 14 nt, Human
acccccagcuuugc

SEQ ID NO: 1249774 - RNA, 14 nt, Human
accccccaagcugu

SEQ ID NO: 1249775 - RNA, 15 nt, Human
acccccggcagcagc

SEQ ID NO: 1249776 - RNA, 17 nt, Human
acccccucaccccucca

SEQ ID NO: 1249777 - RNA, 19 nt, Human
accacuuguguuuugcaag

SEQ ID NO: 1249778 - RNA, 23 nt, Human
accacuuguguuuugcaagccag

SEQ ID NO: 1249779 - RNA, 18 nt, Human
accagagaaaaagggagg

SEQ ID NO: 1249780 - RNA, 20 nt, Human
accagagaaaaagggagggg

SEQ ID NO: 1249781 - RNA, 15 nt, Human
accacuuucuuauuu

SEQ ID NO: 1249782 - RNA, 15 nt, Human
accagagagaguugu

SEQ ID NO: 1249783 - RNA, 13 nt, Human
accagccuggccc

SEQ ID NO: 1249784 - RNA, 14 nt, Human
accagccuggccca

SEQ ID NO: 1249785 - RNA, 12 nt, Human
ucaccuccucua

SEQ ID NO: 1249786 - RNA, 22 nt, Human
ucaccuccucuaagguugggca

SEQ ID NO: 1249787 - RNA, 13 nt, Human
ucaccucccccau

SEQ ID NO: 1249788 - RNA, 15 nt, Human
ucaccucccccaucu

SEQ ID NO: 1249789 - RNA, 14 nt, Human
accaggccaccucc

SEQ ID NO: 1249790 - RNA, 17 nt, Human
accaggccaccucccca

SEQ ID NO: 1249791 - RNA, 19 nt, Human
accaggcaacuugggaacu

SEQ ID NO: 1249792 - RNA, 17 nt, Human
accaggauagagacugg

SEQ ID NO: 1249793 - RNA, 17 nt, Human
accaggcaccaaaagaa

SEQ ID NO: 1249794 - RNA, 19 nt, Human
accaggcaccaaaagaagu

SEQ ID NO: 1249795 - RNA, 20 nt, Human
accaggcaccaaaagaagua

SEQ ID NO: 1249796 - RNA, 16 nt, Human
accaggaguggguggg

SEQ ID NO: 1249797 - RNA, 20 nt, Human
accaggaguggguggggagu

SEQ ID NO: 1249798 - RNA, 14 nt, Human
accaggauagagac

SEQ ID NO: 1249799 - RNA, 16 nt, Human
accaggauagagacug

SEQ ID NO: 1249800 - RNA, 19 nt, Human
accaggauagagacuggaa

SEQ ID NO: 1249801 - RNA, 15 nt, Human
accaggcaccaggca

SEQ ID NO: 1249802 - RNA, 21 nt, Human
accaggcaccaaaagaaguaa

SEQ ID NO: 1249803 - RNA, 17 nt, Human
accaggcagccucuggg

SEQ ID NO: 1249804 - RNA, 20 nt, Human
accaggcagccucugggggg

SEQ ID NO: 1249805 - RNA, 21 nt, Human
accaggcagccucuggggggu

SEQ ID NO: 1249806 - RNA, 12 nt, Human
accaggccaccu

SEQ ID NO: 1249807 - RNA, 23 nt, Human
accagcgaggaggcuccagaggg

SEQ ID NO: 1249808 - RNA, 21 nt, Human
accacugcccccugcugccau

SEQ ID NO: 1249809 - RNA, 14 nt, Human
accacucuguaauu

SEQ ID NO: 1249810 - RNA, 14 nt, Human
accacugaaaaaau

SEQ ID NO: 1249811 - RNA, 15 nt, Human
accacugaaaaaaua

SEQ ID NO: 1249812 - RNA, 16 nt, Human
accacugaaaaaauau

SEQ ID NO: 1249813 - RNA, 17 nt, Human
accacugaaaaaauaua

SEQ ID NO: 1249814 - RNA, 19 nt, Human
accacugaaaaaauauaug

SEQ ID NO: 1249815 - RNA, 19 nt, Human
accacugcagaagacagua

SEQ ID NO: 1249816 - RNA, 14 nt, Human
accacugcagaaga

SEQ ID NO: 1249817 - RNA, 12 nt, Human
accacucagaga

SEQ ID NO: 1249818 - RNA, 20 nt, Human
accacucagagacaugcaga

SEQ ID NO: 1249819 - RNA, 13 nt, Human
accacucagagac

SEQ ID NO: 1249820 - RNA, 14 nt, Human
accacucagagaca

SEQ ID NO: 1249821 - RNA, 12 nt, Human
accacucuggca

SEQ ID NO: 1249822 - RNA, 13 nt, Human
accacucuggcag

SEQ ID NO: 1249823 - RNA, 14 nt, Human
accacucuggcagc

SEQ ID NO: 1249824 - RNA, 15 nt, Human
accacucuggcagcc

SEQ ID NO: 1249825 - RNA, 16 nt, Human
accacucuggcagcca

SEQ ID NO: 1249826 - RNA, 17 nt, Human
accacucuggcagccac

SEQ ID NO: 1249827 - RNA, 18 nt, Human
accacucuggcagccaca

SEQ ID NO: 1249828 - RNA, 20 nt, Human
accacucuggcagccacacu

SEQ ID NO: 1249829 - RNA, 12 nt, Human
accacucuguaa

SEQ ID NO: 1249830 - RNA, 15 nt, Human
accacagcacagcca

SEQ ID NO: 1249831 - RNA, 16 nt, Human
accacagcacagccaa

SEQ ID NO: 1249832 - RNA, 16 nt, Human
accacagccagcaccu

SEQ ID NO: 1249833 - RNA, 17 nt, Human
accacagccagcaccug

SEQ ID NO: 1249834 - RNA, 19 nt, Human
uauuucaucauucacuuca

SEQ ID NO: 1249835 - RNA, 17 nt, Human
uauuucaugaaaauugu

SEQ ID NO: 1249836 - RNA, 21 nt, Human
uauuucaggcauuggauauuu

SEQ ID NO: 1249837 - RNA, 13 nt, Human
uauuucauguuuu

SEQ ID NO: 1249838 - RNA, 21 nt, Human
uauuucauguuuuugaucaaa

SEQ ID NO: 1249839 - RNA, 23 nt, Human
uauuucaucaugauaauucagca

SEQ ID NO: 1249840 - RNA, 19 nt, Human
acccagaaugagacaucca

SEQ ID NO: 1249841 - RNA, 20 nt, Human
acccagaaugagacauccag

SEQ ID NO: 1249842 - RNA, 18 nt, Human
acccagaaugagacaucc

SEQ ID NO: 1249843 - RNA, 22 nt, Human
acccacuuuaaaauaucuacau

SEQ ID NO: 1249844 - RNA, 17 nt, Human
acccagacauaaaggaa

SEQ ID NO: 1249845 - RNA, 15 nt, Human
acccagacauaaagg

SEQ ID NO: 1249846 - RNA, 14 nt, Human
ucagaacagcagac

SEQ ID NO: 1249847 - RNA, 23 nt, Human
ucagaacagcagacucagcucug

SEQ ID NO: 1249848 - RNA, 19 nt, Human
acccacuugcuuuuaaaau

SEQ ID NO: 1249849 - RNA, 13 nt, Human
acccaacgcucca

SEQ ID NO: 1249850 - RNA, 16 nt, Human
acccaacgcuccaaag

SEQ ID NO: 1249851 - RNA, 22 nt, Human
acccaagaugggcaucuuuugu

SEQ ID NO: 1249852 - RNA, 17 nt, Human
acccacuucugcacuug

SEQ ID NO: 1249853 - RNA, 21 nt, Human
acccaaauguucaucaaugaa

SEQ ID NO: 1249854 - RNA, 23 nt, Human
acccaaccacaucccacucacaa

SEQ ID NO: 1249855 - RNA, 18 nt, Human
acccaaaaggcagaagca

SEQ ID NO: 1249856 - RNA, 15 nt, Human
accauuccccauggg

SEQ ID NO: 1249857 - RNA, 14 nt, Human
accaugauuccuuu

SEQ ID NO: 1249858 - RNA, 16 nt, Human
accaguugccuuuuau

SEQ ID NO: 1249859 - RNA, 17 nt, Human
accaugacgcaaagaga

SEQ ID NO: 1249860 - RNA, 13 nt, Human
accauugugcauu

SEQ ID NO: 1249861 - RNA, 23 nt, Human
accauuuuguuauugacuaacag

SEQ ID NO: 1249862 - RNA, 13 nt, Human
accauuuccucag

SEQ ID NO: 1249863 - RNA, 15 nt, Human
accauuuccucagac

SEQ ID NO: 1249864 - RNA, 15 nt, Human
acccaaaaggcagaa

SEQ ID NO: 1249865 - RNA, 13 nt, Human
acccaaaaggcag

SEQ ID NO: 1249866 - RNA, 11 nt, Human
accauuucaga

SEQ ID NO: 1249867 - RNA, 14 nt, Human
accauuucagagag

SEQ ID NO: 1249868 - RNA, 20 nt, Human
accauuucagagaggccuuu

SEQ ID NO: 1249869 - RNA, 19 nt, Human
accauuuccucagacucua

SEQ ID NO: 1249870 - RNA, 21 nt, Human
ucacuguagaaugauuucaug

SEQ ID NO: 1249871 - RNA, 20 nt, Human
ucacugcacagugcaucuca

SEQ ID NO: 1249872 - RNA, 22 nt, Human
ucacugcacagugcaucucagc

SEQ ID NO: 1249873 - RNA, 24 nt, Human
ucacugcacagugcaucucagccc

SEQ ID NO: 1249874 - RNA, 20 nt, Human
ucacugucuuuaauucugua

SEQ ID NO: 1249875 - RNA, 16 nt, Human
ucaccuggcccugcuu

SEQ ID NO: 1249876 - RNA, 19 nt, Human
ucaccuggcccugcuuccu

SEQ ID NO: 1249877 - RNA, 23 nt, Human
ucaccuggcccugcuuccugcuu

SEQ ID NO: 1249878 - RNA, 13 nt, Human
ucaccuggaagca

SEQ ID NO: 1249879 - RNA, 22 nt, Human
ucaccuggacuuaagcaucugg

SEQ ID NO: 1249880 - RNA, 19 nt, Human
ucaccuggaagcauuuguu

SEQ ID NO: 1249881 - RNA, 12 nt, Human
ucaccuggcccu

SEQ ID NO: 1249882 - RNA, 13 nt, Human
ucaccuggcccug

SEQ ID NO: 1249883 - RNA, 14 nt, Human
ucaccuggcccugc

SEQ ID NO: 1249884 - RNA, 12 nt, Human
accagugccuua

SEQ ID NO: 1249885 - RNA, 14 nt, Human
accaguugcugcuu

SEQ ID NO: 1249886 - RNA, 24 nt, Human
accaugaagagauuuuucaugauu

SEQ ID NO: 1249887 - RNA, 12 nt, Human
accaguugccuu

SEQ ID NO: 1249888 - RNA, 13 nt, Human
accaguugccuuu

SEQ ID NO: 1249889 - RNA, 14 nt, Human
accaguugccuuuu

SEQ ID NO: 1249890 - RNA, 15 nt, Human
accaguugccuuuua

SEQ ID NO: 1249891 - RNA, 21 nt, Human
accaguucucauggguggcac

SEQ ID NO: 1249892 - RNA, 15 nt, Human
accaguugcagucac

SEQ ID NO: 1249893 - RNA, 20 nt, Human
accaguugcagucacucuag

SEQ ID NO: 1249894 - RNA, 21 nt, Human
accaguugcagucacucuagu

SEQ ID NO: 1249895 - RNA, 12 nt, Human
accaguuaauuu

SEQ ID NO: 1249896 - RNA, 13 nt, Human
accaguuaauuuu

SEQ ID NO: 1249897 - RNA, 14 nt, Human
accaguuaauuuuu

SEQ ID NO: 1249898 - RNA, 16 nt, Human
accaguuaauuuuucc

SEQ ID NO: 1249899 - RNA, 16 nt, Human
accaguucucaugggu

SEQ ID NO: 1249900 - RNA, 19 nt, Human
ucacugucuuuaauucugu

SEQ ID NO: 1249901 - RNA, 21 nt, Human
accagggaugaugcaacaucc

SEQ ID NO: 1249902 - RNA, 17 nt, Human
accagggcaucucuggg

SEQ ID NO: 1249903 - RNA, 18 nt, Human
accagggcaucucugggc

SEQ ID NO: 1249904 - RNA, 19 nt, Human
accagggcaucucugggcu

SEQ ID NO: 1249905 - RNA, 20 nt, Human
accagggcaucucugggcug

SEQ ID NO: 1249906 - RNA, 21 nt, Human
accagggcaucucugggcugg

SEQ ID NO: 1249907 - RNA, 22 nt, Human
accagggcaucucugggcugga

SEQ ID NO: 1249908 - RNA, 16 nt, Human
accagggccagccucu

SEQ ID NO: 1249909 - RNA, 17 nt, Human
accagggccagccucua

SEQ ID NO: 1249910 - RNA, 15 nt, Human
accagggcuccagcc

SEQ ID NO: 1249911 - RNA, 16 nt, Human
accagggcuccagccc

SEQ ID NO: 1249912 - RNA, 12 nt, Human
acagcuccuccc

SEQ ID NO: 1249913 - RNA, 14 nt, Human
acagcuccucccac

SEQ ID NO: 1249914 - RNA, 14 nt, Human
acagcuggacccug

SEQ ID NO: 1249915 - RNA, 17 nt, Human
acagcuggacccugacc

SEQ ID NO: 1249916 - RNA, 13 nt, Human
acagcuggcucua

SEQ ID NO: 1249917 - RNA, 16 nt, Human
acagcuggcucuacuu

SEQ ID NO: 1249918 - RNA, 20 nt, Human
acagcuggcucuacuucccc

SEQ ID NO: 1249919 - RNA, 16 nt, Human
acagcuggggugcagg

SEQ ID NO: 1249920 - RNA, 21 nt, Human
acagcuggggugcagggaugu

SEQ ID NO: 1249921 - RNA, 23 nt, Human
acagcuggggugcagggaugugg

SEQ ID NO: 1249922 - RNA, 21 nt, Human
uauguuuucaggcuagaugua

SEQ ID NO: 1249923 - RNA, 21 nt, Human
uauuaaagaaaaaaauguauu

SEQ ID NO: 1249924 - RNA, 14 nt, Human
uauuaaagugcuaa

SEQ ID NO: 1249925 - RNA, 18 nt, Human
uauuaaagugcuaagguu

SEQ ID NO: 1249926 - RNA, 24 nt, Human
uauuaaagugcuaagguucuaagg

SEQ ID NO: 1249927 - RNA, 22 nt, Human
uauuaaagugcuaagguucuaa

SEQ ID NO: 1249928 - RNA, 23 nt, Human
uauuacaguggggaaugaagaua

SEQ ID NO: 1249929 - RNA, 15 nt, Human
uauuacaguguuuau

SEQ ID NO: 1249930 - RNA, 16 nt, Human
uauuacaguguuuauc

SEQ ID NO: 1249931 - RNA, 19 nt, Human
uauuacaguguuuauccuu

SEQ ID NO: 1249932 - RNA, 22 nt, Human
uauuaaagaaaaaaauguauuu

SEQ ID NO: 1249933 - RNA, 13 nt, Human
uauuaaagaaaaa

SEQ ID NO: 1249934 - RNA, 18 nt, Human
uauuaaagaaaaaaaugu

SEQ ID NO: 1249935 - RNA, 20 nt, Human
uauuaaagaaaaaaauguau

SEQ ID NO: 1249936 - RNA, 22 nt, Human
uauuagcccuucuccauggccc

SEQ ID NO: 1249937 - RNA, 16 nt, Human
uauuagugcuuugcca

SEQ ID NO: 1249938 - RNA, 14 nt, Human
uauuaguuuugauu

SEQ ID NO: 1249939 - RNA, 15 nt, Human
uauuacauuuucagu

SEQ ID NO: 1249940 - RNA, 17 nt, Human
uauuaccaaaagucaac

SEQ ID NO: 1249941 - RNA, 15 nt, Human
uauuaccccuuuucg

SEQ ID NO: 1249942 - RNA, 17 nt, Human
uauuagaaucaaacauu

SEQ ID NO: 1249943 - RNA, 21 nt, Human
uauuagaaucaaacauuuuga

SEQ ID NO: 1249944 - RNA, 23 nt, Human
uauuagaaucaaacauuuugaaa

SEQ ID NO: 1249945 - RNA, 22 nt, Human
uauuagaaucaaacauuuugaa

SEQ ID NO: 1249946 - RNA, 15 nt, Human
uauuagagugucuuu

SEQ ID NO: 1249947 - RNA, 18 nt, Human
uauuagagugucuuucca

SEQ ID NO: 1249948 - RNA, 15 nt, Human
uauucagcucaugga

SEQ ID NO: 1249949 - RNA, 11 nt, Human
uauucaauaaa

SEQ ID NO: 1249950 - RNA, 13 nt, Human
uauucagacagau

SEQ ID NO: 1249951 - RNA, 19 nt, Human
uauucagcaccaagcaugu

SEQ ID NO: 1249952 - RNA, 23 nt, Human
uauucagcaccaagcauguccca

SEQ ID NO: 1249953 - RNA, 20 nt, Human
uauucaggacuugaaagaaa

SEQ ID NO: 1249954 - RNA, 20 nt, Human
uauucagggaaggaggagcc

SEQ ID NO: 1249955 - RNA, 23 nt, Human
uauucagggaaggaggagccugu

SEQ ID NO: 1249956 - RNA, 23 nt, Human
uauucauagcagcuuauucacaa

SEQ ID NO: 1249957 - RNA, 16 nt, Human
uauucauaguuuaauu

SEQ ID NO: 1249958 - RNA, 17 nt, Human
uauucauaugcauauuu

SEQ ID NO: 1249959 - RNA, 16 nt, Human
uauucauaugcauauu

SEQ ID NO: 1249960 - RNA, 15 nt, Human
uauucauaugcauau

SEQ ID NO: 1249961 - RNA, 14 nt, Human
uauucauaugcaua

SEQ ID NO: 1249962 - RNA, 13 nt, Human
uauucauaugcau

SEQ ID NO: 1249963 - RNA, 21 nt, Human
uauucauauuuucuuucaaaa

SEQ ID NO: 1249964 - RNA, 17 nt, Human
uauucauccaaguuaaa

SEQ ID NO: 1249965 - RNA, 21 nt, Human
uauucauccaaguuaaaugua

SEQ ID NO: 1249966 - RNA, 21 nt, Human
acaguuaccucugccucagaa

SEQ ID NO: 1249967 - RNA, 13 nt, Human
acaguuacauaau

SEQ ID NO: 1249968 - RNA, 19 nt, Human
acaguuacauaauucacuc

SEQ ID NO: 1249969 - RNA, 19 nt, Human
acaguguugaaaauguuca

SEQ ID NO: 1249970 - RNA, 21 nt, Human
acaguguugaaaauguucaga

SEQ ID NO: 1249971 - RNA, 14 nt, Human
acaguguuuauccu

SEQ ID NO: 1249972 - RNA, 18 nt, Human
acaguguuuauccuuuca

SEQ ID NO: 1249973 - RNA, 21 nt, Human
acaguguuuauccuuucauau

SEQ ID NO: 1249974 - RNA, 20 nt, Human
acaguguuuauccuuucaua

SEQ ID NO: 1249975 - RNA, 18 nt, Human
acagugagacucugucuc

SEQ ID NO: 1249976 - RNA, 14 nt, Human
acagugagacucug

SEQ ID NO: 1249977 - RNA, 13 nt, Human
acagugaagacag

SEQ ID NO: 1249978 - RNA, 14 nt, Human
acagugaagacaga

SEQ ID NO: 1249979 - RNA, 18 nt, Human
acagugaagacagaaguu

SEQ ID NO: 1249980 - RNA, 21 nt, Human
acagugaagacagaaguuugc

SEQ ID NO: 1249981 - RNA, 19 nt, Human
acagugaagacagaaguuu

SEQ ID NO: 1249982 - RNA, 14 nt, Human
acagugacuucuga

SEQ ID NO: 1249983 - RNA, 15 nt, Human
acagugacuucugag

SEQ ID NO: 1249984 - RNA, 17 nt, Human
acagugacuucugagau

SEQ ID NO: 1249985 - RNA, 12 nt, Human
acagugagccug

SEQ ID NO: 1249986 - RNA, 14 nt, Human
acagugagccugaa

SEQ ID NO: 1249987 - RNA, 17 nt, Human
acagugagccugaauuu

SEQ ID NO: 1249988 - RNA, 11 nt, Human
acagugucuuu

SEQ ID NO: 1249989 - RNA, 12 nt, Human
acagugucuuuu

SEQ ID NO: 1249990 - RNA, 14 nt, Human
acagugucuuuuuu

SEQ ID NO: 1249991 - RNA, 21 nt, Human
acagugucuuuuuuuguauag

SEQ ID NO: 1249992 - RNA, 19 nt, Human
acagugucuuuuuuuguau

SEQ ID NO: 1249993 - RNA, 13 nt, Human
acagugugcaagg

SEQ ID NO: 1249994 - RNA, 22 nt, Human
acagugugcaaggcagccgugg

SEQ ID NO: 1249995 - RNA, 20 nt, Human
acagugaaagaaaauaacaa

SEQ ID NO: 1249996 - RNA, 14 nt, Human
acagucuuccauuu

SEQ ID NO: 1249997 - RNA, 19 nt, Human
acagucuuccauuugcaag

SEQ ID NO: 1249998 - RNA, 12 nt, Human
acagucuaaagc

SEQ ID NO: 1249999 - RNA, 15 nt, Human
acagucuaaagcugg

SEQ ID NO: 1250000 - RNA, 14 nt, Human
acagucuaaagcug

SEQ ID NO: 1250001 - RNA, 21 nt, Human
acaguaaaccacugaaaaaau

SEQ ID NO: 1250002 - RNA, 15 nt, Human
acagggccacauaga

SEQ ID NO: 1250003 - RNA, 15 nt, Human
acaguaaaccacuga

SEQ ID NO: 1250004 - RNA, 16 nt, Human
acaguaaaccacugaa

SEQ ID NO: 1250005 - RNA, 17 nt, Human
acaguaaaccacugaaa

SEQ ID NO: 1250006 - RNA, 18 nt, Human
acaguaaaccacugaaaa

SEQ ID NO: 1250007 - RNA, 19 nt, Human
acaguaaaccacugaaaaa

SEQ ID NO: 1250008 - RNA, 20 nt, Human
acaguaaaccacugaaaaaa

SEQ ID NO: 1250009 - RNA, 22 nt, Human
acaguaaaccacugaaaaaaua

SEQ ID NO: 1250010 - RNA, 20 nt, Human
acaguaucucaaacaauuga

SEQ ID NO: 1250011 - RNA, 21 nt, Human
acaguauggcagcuuuccuca

SEQ ID NO: 1250012 - RNA, 19 nt, Human
acaguauggggguuguaaa

SEQ ID NO: 1250013 - RNA, 20 nt, Human
acaguauggggguuguaaau

SEQ ID NO: 1250014 - RNA, 21 nt, Human
acaguauggggguuguaaauu

SEQ ID NO: 1250015 - RNA, 22 nt, Human
acaguauggggguuguaaauug

SEQ ID NO: 1250016 - RNA, 23 nt, Human
acaguauggggguuguaaauugg

SEQ ID NO: 1250017 - RNA, 22 nt, Human
uauucauccaaguuaaauguag

SEQ ID NO: 1250018 - RNA, 20 nt, Human
acagggcaguaccugagggu

SEQ ID NO: 1250019 - RNA, 20 nt, Human
acaguauuauacgcuggcaa

SEQ ID NO: 1250020 - RNA, 12 nt, Human
acaguauugcuc

SEQ ID NO: 1250021 - RNA, 15 nt, Human
acaguauugcucacc

SEQ ID NO: 1250022 - RNA, 16 nt, Human
acaguauugcucaccc

SEQ ID NO: 1250023 - RNA, 22 nt, Human
acaguauugcucacccagugcc

SEQ ID NO: 1250024 - RNA, 14 nt, Human
acaguauuuguaau

SEQ ID NO: 1250025 - RNA, 17 nt, Human
acaguauuuguaauuaa

SEQ ID NO: 1250026 - RNA, 18 nt, Human
acaguauuuguaauuaaa

SEQ ID NO: 1250027 - RNA, 18 nt, Human
acagucaaaaccaaguca

SEQ ID NO: 1250028 - RNA, 17 nt, Human
acaguccgucaaaacag

SEQ ID NO: 1250029 - RNA, 21 nt, Human
acaguccgucaaaacagauug

SEQ ID NO: 1250030 - RNA, 19 nt, Human
uauuguauauuacaaugau

SEQ ID NO: 1250031 - RNA, 17 nt, Human
uauuguauauuacaaug

SEQ ID NO: 1250032 - RNA, 16 nt, Human
uauuguauauuacaau

SEQ ID NO: 1250033 - RNA, 17 nt, Human
uauuguagcauccugga

SEQ ID NO: 1250034 - RNA, 18 nt, Human
uauuguagcauccuggaa

SEQ ID NO: 1250035 - RNA, 20 nt, Human
uauuguagcauccuggaaua

SEQ ID NO: 1250036 - RNA, 21 nt, Human
uauuguagcauccuggaauau

SEQ ID NO: 1250037 - RNA, 13 nt, Human
uauuguauucugg

SEQ ID NO: 1250038 - RNA, 17 nt, Human
uauugucuagugaaacu

SEQ ID NO: 1250039 - RNA, 15 nt, Human
uauuguccauugucc

SEQ ID NO: 1250040 - RNA, 17 nt, Human
uauuguccauuguccaa

SEQ ID NO: 1250041 - RNA, 23 nt, Human
uauugucugaacuugcauuguga

SEQ ID NO: 1250042 - RNA, 17 nt, Human
uauuuaaccucuaaauu

SEQ ID NO: 1250043 - RNA, 18 nt, Human
uauuuaaccucuaaauuc

SEQ ID NO: 1250044 - RNA, 17 nt, Human
uauugugcaauguaaau

SEQ ID NO: 1250045 - RNA, 19 nt, Human
uauuuaacagaaauuguau

SEQ ID NO: 1250046 - RNA, 13 nt, Human
uauuuaacuaauu

SEQ ID NO: 1250047 - RNA, 16 nt, Human
uauuuaacucucuuua

SEQ ID NO: 1250048 - RNA, 23 nt, Human
uauuuaacucucuuuaugucugu

SEQ ID NO: 1250049 - RNA, 11 nt, Human
uauuuaacuga

SEQ ID NO: 1250050 - RNA, 13 nt, Human
uauuuaacugacu

SEQ ID NO: 1250051 - RNA, 13 nt, Human
uauuuaacuucug

SEQ ID NO: 1250052 - RNA, 14 nt, Human
uauuuaacuucuga

SEQ ID NO: 1250053 - RNA, 14 nt, Human
uauuuaauagguuu

SEQ ID NO: 1250054 - RNA, 18 nt, Human
uauuuaauagcaaagaau

SEQ ID NO: 1250055 - RNA, 19 nt, Human
uauuuaauagcaaagaauu

SEQ ID NO: 1250056 - RNA, 20 nt, Human
uauuuaauagcaaagaauug

SEQ ID NO: 1250057 - RNA, 22 nt, Human
uauuuaauagcaaagaauugac

SEQ ID NO: 1250058 - RNA, 17 nt, Human
uauuuaagauaauuaua

SEQ ID NO: 1250059 - RNA, 20 nt, Human
uauuuaagauaauuauaaua

SEQ ID NO: 1250060 - RNA, 13 nt, Human
uauuuaauagcaa

SEQ ID NO: 1250061 - RNA, 14 nt, Human
uauuuauuuuaaua

SEQ ID NO: 1250062 - RNA, 16 nt, Human
uauuuauuuuaauaau

SEQ ID NO: 1250063 - RNA, 18 nt, Human
uauuuauuuuaauaaugu

SEQ ID NO: 1250064 - RNA, 20 nt, Human
uauuuauuuuuuuuaaguau

SEQ ID NO: 1250065 - RNA, 14 nt, Human
uauuucaaauugga

SEQ ID NO: 1250066 - RNA, 18 nt, Human
uauuucaaauuggagcuu

SEQ ID NO: 1250067 - RNA, 16 nt, Human
uauuucaauguuagcc

SEQ ID NO: 1250068 - RNA, 15 nt, Human
uauuucaauguuagc

SEQ ID NO: 1250069 - RNA, 15 nt, Human
uauuucacaacagcc

SEQ ID NO: 1250070 - RNA, 15 nt, Human
uauuucacuggagca

SEQ ID NO: 1250071 - RNA, 14 nt, Human
uauuucacuggagc

SEQ ID NO: 1250072 - RNA, 19 nt, Human
uauuuaguguucauaaaua

SEQ ID NO: 1250073 - RNA, 21 nt, Human
uauuuagaugauaaagagaca

SEQ ID NO: 1250074 - RNA, 19 nt, Human
uauuuagcuugggaaaggu

SEQ ID NO: 1250075 - RNA, 14 nt, Human
uauuuauuuaguau

SEQ ID NO: 1250076 - RNA, 14 nt, Human
uauuuaauucaugu

SEQ ID NO: 1250077 - RNA, 21 nt, Human
uauuuaaugccgauauacucu

SEQ ID NO: 1250078 - RNA, 14 nt, Human
uauuuaaugcugug

SEQ ID NO: 1250079 - RNA, 15 nt, Human
uauuuacgcuuugau

SEQ ID NO: 1250080 - RNA, 19 nt, Human
uauuuacgcuuugauucau

SEQ ID NO: 1250081 - RNA, 22 nt, Human
uauuuacgcuuugauucauagu

SEQ ID NO: 1250082 - RNA, 14 nt, Human
uauuuacauuuaau

SEQ ID NO: 1250083 - RNA, 17 nt, Human
uauuuaccccuccccua

SEQ ID NO: 1250084 - RNA, 13 nt, Human
uauuuaccucagc

SEQ ID NO: 1250085 - RNA, 14 nt, Human
uauuuaccucagcc

SEQ ID NO: 1250086 - RNA, 15 nt, Human
uauuuaccucagccu

SEQ ID NO: 1250087 - RNA, 16 nt, Human
uauuuaccucagccug

SEQ ID NO: 1250088 - RNA, 14 nt, Human
uauuuacgcuuuga

SEQ ID NO: 1250089 - RNA, 17 nt, Human
uauuuaccucagccugg

SEQ ID NO: 1250090 - RNA, 20 nt, Human
uauuuagcaccagggaaggg

SEQ ID NO: 1250091 - RNA, 14 nt, Human
uauuuagauucacu

SEQ ID NO: 1250092 - RNA, 20 nt, Human
uauuuagauucacuuaacaa

SEQ ID NO: 1250093 - RNA, 23 nt, Human
uauuuagaugauaaagagacagu

SEQ ID NO: 1250094 - RNA, 16 nt, Human
uauuggggucugaccc

SEQ ID NO: 1250095 - RNA, 17 nt, Human
uauuggggucugacccc

SEQ ID NO: 1250096 - RNA, 17 nt, Human
uauugguguaagguacu

SEQ ID NO: 1250097 - RNA, 20 nt, Human
uauugguuuaaagaaagugu

SEQ ID NO: 1250098 - RNA, 15 nt, Human
uauuguaaaacaggu

SEQ ID NO: 1250099 - RNA, 15 nt, Human
uauuguaaauauugu

SEQ ID NO: 1250100 - RNA, 20 nt, Human
uauuguaacccugucuggau

SEQ ID NO: 1250101 - RNA, 14 nt, Human
uauugagucaaaug

SEQ ID NO: 1250102 - RNA, 22 nt, Human
uauugacuaacaggccaaagag

SEQ ID NO: 1250103 - RNA, 14 nt, Human
uauugacuuguaua

SEQ ID NO: 1250104 - RNA, 15 nt, Human
uauugacuuguauau

SEQ ID NO: 1250105 - RNA, 17 nt, Human
uauugacuuguauauuu

SEQ ID NO: 1250106 - RNA, 21 nt, Human
uauugacaaaauguuauuucc

SEQ ID NO: 1250107 - RNA, 23 nt, Human
uauugacacagaaaauguugaga

SEQ ID NO: 1250108 - RNA, 13 nt, Human
uauugacacagaa

SEQ ID NO: 1250109 - RNA, 16 nt, Human
uauugacacagaaaau

SEQ ID NO: 1250110 - RNA, 18 nt, Human
uauugacacagaaaaugu

SEQ ID NO: 1250111 - RNA, 20 nt, Human
uauugacacagaaaauguug

SEQ ID NO: 1250112 - RNA, 22 nt, Human
uauugacaaaauguuauuuccc

SEQ ID NO: 1250113 - RNA, 16 nt, Human
uauugacaaaauguua

SEQ ID NO: 1250114 - RNA, 13 nt, Human
uauugacaaaaug

SEQ ID NO: 1250115 - RNA, 12 nt, Human
uauugacaaaau

SEQ ID NO: 1250116 - RNA, 18 nt, Human
uauugaauucauuucacu

SEQ ID NO: 1250117 - RNA, 19 nt, Human
uauugaauucauuucacug

SEQ ID NO: 1250118 - RNA, 18 nt, Human
uauugaauauuuuauauu

SEQ ID NO: 1250119 - RNA, 22 nt, Human
uauucuucucuuccuuuuauca

SEQ ID NO: 1250120 - RNA, 16 nt, Human
uauucuugauguaaaa

SEQ ID NO: 1250121 - RNA, 14 nt, Human
uauucuugguuuuc

SEQ ID NO: 1250122 - RNA, 14 nt, Human
uauucuugauguaa

SEQ ID NO: 1250123 - RNA, 13 nt, Human
uauucuugguuuu

SEQ ID NO: 1250124 - RNA, 22 nt, Human
acaguucggugagcuacaaaug

SEQ ID NO: 1250125 - RNA, 19 nt, Human
acaguucggugagcuacaa

SEQ ID NO: 1250126 - RNA, 23 nt, Human
acaguucggugagcuacaaaugc

SEQ ID NO: 1250127 - RNA, 18 nt, Human
acaguuccccuaugugga

SEQ ID NO: 1250128 - RNA, 20 nt, Human
acaguuccccuauguggaag

SEQ ID NO: 1250129 - RNA, 19 nt, Human
acaguuccccuauguggaa

SEQ ID NO: 1250130 - RNA, 15 nt, Human
acaguuaucuaaguu

SEQ ID NO: 1250131 - RNA, 16 nt, Human
acaguuaucuaaguua

SEQ ID NO: 1250132 - RNA, 17 nt, Human
acaguuaucuaaguuaa

SEQ ID NO: 1250133 - RNA, 23 nt, Human
acaguuaucuaaguuaauuuaaa

SEQ ID NO: 1250134 - RNA, 12 nt, Human
acaguucaagaa

SEQ ID NO: 1250135 - RNA, 20 nt, Human
acaguucaagaaagcuucaa

SEQ ID NO: 1250136 - RNA, 16 nt, Human
acaguucaagaaagcu

SEQ ID NO: 1250137 - RNA, 15 nt, Human
acaguucauauguac

SEQ ID NO: 1250138 - RNA, 21 nt, Human
acaguuccugggaacaucaca

SEQ ID NO: 1250139 - RNA, 13 nt, Human
acaguuccuggga

SEQ ID NO: 1250140 - RNA, 16 nt, Human
acaguucugcucuggu

SEQ ID NO: 1250141 - RNA, 12 nt, Human
acaguucugugg

SEQ ID NO: 1250142 - RNA, 22 nt, Human
acaguucugugguuucauguua

SEQ ID NO: 1250143 - RNA, 21 nt, Human
acaguucugcucugguuguuu

SEQ ID NO: 1250144 - RNA, 17 nt, Human
acaguucuuugggccag

SEQ ID NO: 1250145 - RNA, 18 nt, Human
acaguucuuugggccaga

SEQ ID NO: 1250146 - RNA, 20 nt, Human
acaguucuuugggccagaca

SEQ ID NO: 1250147 - RNA, 19 nt, Human
acaguucuuugggccagac

SEQ ID NO: 1250148 - RNA, 12 nt, Human
uauucucugagc

SEQ ID NO: 1250149 - RNA, 18 nt, Human
uauucucugagcugugca

SEQ ID NO: 1250150 - RNA, 19 nt, Human
uauucucugagcugugcag

SEQ ID NO: 1250151 - RNA, 14 nt, Human
uauucuucauaaca

SEQ ID NO: 1250152 - RNA, 13 nt, Human
uauucuucuagag

SEQ ID NO: 1250153 - RNA, 14 nt, Human
uauucuucuagagu

SEQ ID NO: 1250154 - RNA, 17 nt, Human
uauucuucuagaguuca

SEQ ID NO: 1250155 - RNA, 18 nt, Human
uauucuucuagaguucag

SEQ ID NO: 1250156 - RNA, 13 nt, Human
uauucuucucuuc

SEQ ID NO: 1250157 - RNA, 19 nt, Human
uauucugggggcugcaguu

SEQ ID NO: 1250158 - RNA, 18 nt, Human
uauucugggguauggcgu

SEQ ID NO: 1250159 - RNA, 11 nt, Human
uauucuguccc

SEQ ID NO: 1250160 - RNA, 12 nt, Human
uauucugucccu

SEQ ID NO: 1250161 - RNA, 13 nt, Human
uauucugucccua

SEQ ID NO: 1250162 - RNA, 15 nt, Human
uauucugucccuagg

SEQ ID NO: 1250163 - RNA, 16 nt, Human
uauauugauccagaaa

SEQ ID NO: 1250164 - RNA, 23 nt, Human
acagacugcgauuugucccaggu

SEQ ID NO: 1250165 - RNA, 14 nt, Human
acagacuauuuuua

SEQ ID NO: 1250166 - RNA, 17 nt, Human
acagacuauuuuuagau

SEQ ID NO: 1250167 - RNA, 23 nt, Human
acagacuauuuuuagauuuucuu

SEQ ID NO: 1250168 - RNA, 15 nt, Human
acacuccccgaaguc

SEQ ID NO: 1250169 - RNA, 14 nt, Human
acacucccuugggc

SEQ ID NO: 1250170 - RNA, 14 nt, Human
acagacacuggcau

SEQ ID NO: 1250171 - RNA, 13 nt, Human
acagacagcccuc

SEQ ID NO: 1250172 - RNA, 15 nt, Human
acagacagcccucca

SEQ ID NO: 1250173 - RNA, 16 nt, Human
uaucacccaacgcucc

SEQ ID NO: 1250174 - RNA, 21 nt, Human
uaucacccaacgcuccaaagu

SEQ ID NO: 1250175 - RNA, 18 nt, Human
uaucacugaagcuuuuua

SEQ ID NO: 1250176 - RNA, 22 nt, Human
uaucacuuaaacuugcaucacu

SEQ ID NO: 1250177 - RNA, 18 nt, Human
uaucacauguuuucucug

SEQ ID NO: 1250178 - RNA, 23 nt, Human
uaucaccaaaaaccuauuccacu

SEQ ID NO: 1250179 - RNA, 19 nt, Human
uaucaauaaauagaccauu

SEQ ID NO: 1250180 - RNA, 13 nt, Human
uaucacacacauu

SEQ ID NO: 1250181 - RNA, 19 nt, Human
uaucacacacauugcugug

SEQ ID NO: 1250182 - RNA, 20 nt, Human
uaucacacacauugcuguga

SEQ ID NO: 1250183 - RNA, 12 nt, Human
uaucacauguuu

SEQ ID NO: 1250184 - RNA, 14 nt, Human
uauauuuacaaaug

SEQ ID NO: 1250185 - RNA, 16 nt, Human
uauauugauaagaucu

SEQ ID NO: 1250186 - RNA, 15 nt, Human
uauauuuacaaaugg

SEQ ID NO: 1250187 - RNA, 17 nt, Human
uaucuagguuuaugaca

SEQ ID NO: 1250188 - RNA, 17 nt, Human
uaucuaguuuaauuaau

SEQ ID NO: 1250189 - RNA, 22 nt, Human
uaucucccugccuccugccggc

SEQ ID NO: 1250190 - RNA, 16 nt, Human
uaucucccugccuccu

SEQ ID NO: 1250191 - RNA, 17 nt, Human
uaucuacuuccaaacua

SEQ ID NO: 1250192 - RNA, 22 nt, Human
uaucuacuuuuacucauaagua

SEQ ID NO: 1250193 - RNA, 21 nt, Human
uaucuagguuuaugacaguaa

SEQ ID NO: 1250194 - RNA, 15 nt, Human
uaucuagguuuauga

SEQ ID NO: 1250195 - RNA, 17 nt, Human
uaucuaggcaacauagu

SEQ ID NO: 1250196 - RNA, 22 nt, Human
uauccauauugagucaaauggu

SEQ ID NO: 1250197 - RNA, 16 nt, Human
uaucacuuaaacuugc

SEQ ID NO: 1250198 - RNA, 22 nt, Human
uaucccaaaguuguuguaaccu

SEQ ID NO: 1250199 - RNA, 22 nt, Human
uaucuacuuccaaacuaauuuu

SEQ ID NO: 1250200 - RNA, 22 nt, Human
acagagcgugagcugagcaggc

SEQ ID NO: 1250201 - RNA, 23 nt, Human
acagagcgugagcugagcaggcc

SEQ ID NO: 1250202 - RNA, 14 nt, Human
acagaguggccguc

SEQ ID NO: 1250203 - RNA, 13 nt, Human
acagacuucugaa

SEQ ID NO: 1250204 - RNA, 14 nt, Human
acagacuucugaaa

SEQ ID NO: 1250205 - RNA, 20 nt, Human
acagacuggauguaccacca

SEQ ID NO: 1250206 - RNA, 13 nt, Human
acagagaaaccag

SEQ ID NO: 1250207 - RNA, 15 nt, Human
acagagaaaccagcu

SEQ ID NO: 1250208 - RNA, 14 nt, Human
acagagaaaccagc

SEQ ID NO: 1250209 - RNA, 12 nt, Human
acagagaccaag

SEQ ID NO: 1250210 - RNA, 13 nt, Human
acagagaccaaga

SEQ ID NO: 1250211 - RNA, 14 nt, Human
acagagaccaagau

SEQ ID NO: 1250212 - RNA, 20 nt, Human
acagagacugaauagauaug

SEQ ID NO: 1250213 - RNA, 16 nt, Human
acagagaggacuguag

SEQ ID NO: 1250214 - RNA, 15 nt, Human
acagcuccaagaauu

SEQ ID NO: 1250215 - RNA, 17 nt, Human
acagcuccacccuggcc

SEQ ID NO: 1250216 - RNA, 20 nt, Human
acagcuaaucagcauucuca

SEQ ID NO: 1250217 - RNA, 22 nt, Human
acagcuaaucagcauucucacu

SEQ ID NO: 1250218 - RNA, 23 nt, Human
uauggggaagguuaucagugcuu

SEQ ID NO: 1250219 - RNA, 23 nt, Human
uauggcguaaguacagagaagcc

SEQ ID NO: 1250220 - RNA, 22 nt, Human
uauggcguaaguacagagaagc

SEQ ID NO: 1250221 - RNA, 21 nt, Human
uauggggaagguuaucagugc

SEQ ID NO: 1250222 - RNA, 14 nt, Human
acagccuggcacag

SEQ ID NO: 1250223 - RNA, 12 nt, Human
acagccuggcug

SEQ ID NO: 1250224 - RNA, 15 nt, Human
acagccuggcacagg

SEQ ID NO: 1250225 - RNA, 14 nt, Human
uauggccuguggau

SEQ ID NO: 1250226 - RNA, 22 nt, Human
uauggccugugagcuaggaauu

SEQ ID NO: 1250227 - RNA, 13 nt, Human
uauggccuguguc

SEQ ID NO: 1250228 - RNA, 14 nt, Human
uauggccuguguca

SEQ ID NO: 1250229 - RNA, 17 nt, Human
uauggcguaaguacaga

SEQ ID NO: 1250230 - RNA, 18 nt, Human
uauggcguaaguacagag

SEQ ID NO: 1250231 - RNA, 19 nt, Human
uauggcguaaguacagaga

SEQ ID NO: 1250232 - RNA, 20 nt, Human
uauggcguaaguacagagaa

SEQ ID NO: 1250233 - RNA, 21 nt, Human
uauggcguaaguacagagaag

SEQ ID NO: 1250234 - RNA, 16 nt, Human
uaugcucuuaauugcc

SEQ ID NO: 1250235 - RNA, 18 nt, Human
uaugcucuuaauugccac

SEQ ID NO: 1250236 - RNA, 17 nt, Human
uaugcucuuaauugcca

SEQ ID NO: 1250237 - RNA, 16 nt, Human
uaugaucugucugugg

SEQ ID NO: 1250238 - RNA, 14 nt, Human
uaugaucugucugu

SEQ ID NO: 1250239 - RNA, 21 nt, Human
uaugauggguguuuuuagcag

SEQ ID NO: 1250240 - RNA, 14 nt, Human
uaugauguuaaaaa

SEQ ID NO: 1250241 - RNA, 21 nt, Human
uaugaugugcuuaacagggaa

SEQ ID NO: 1250242 - RNA, 18 nt, Human
uaugauguuaaaaaaaua

SEQ ID NO: 1250243 - RNA, 17 nt, Human
uaugaugugcuuaacag

SEQ ID NO: 1250244 - RNA, 14 nt, Human
uaugaugugcuuaa

SEQ ID NO: 1250245 - RNA, 21 nt, Human
uaugauguauacugccacuaa

SEQ ID NO: 1250246 - RNA, 19 nt, Human
uaugauguauacugccacu

SEQ ID NO: 1250247 - RNA, 15 nt, Human
uaugauaauagauuc

SEQ ID NO: 1250248 - RNA, 14 nt, Human
uaugagucuagaug

SEQ ID NO: 1250249 - RNA, 16 nt, Human
uaugagucuagauguu

SEQ ID NO: 1250250 - RNA, 16 nt, Human
uaugauaauagauucu

SEQ ID NO: 1250251 - RNA, 15 nt, Human
uaucuugaauaaugu

SEQ ID NO: 1250252 - RNA, 22 nt, Human
uaucuugcaguaucggcacugu

SEQ ID NO: 1250253 - RNA, 23 nt, Human
uaucuugcaguaucggcacugua

SEQ ID NO: 1250254 - RNA, 19 nt, Human
uaucuuggacaaaucacau

SEQ ID NO: 1250255 - RNA, 17 nt, Human
uaucuuggacaaaucac

SEQ ID NO: 1250256 - RNA, 17 nt, Human
uaugaggacuugugucu

SEQ ID NO: 1250257 - RNA, 23 nt, Human
uaugaggacuugugucucugugc

SEQ ID NO: 1250258 - RNA, 18 nt, Human
acagaguguggacucugg

SEQ ID NO: 1250259 - RNA, 13 nt, Human
acagaguugauuu

SEQ ID NO: 1250260 - RNA, 16 nt, Human
acagaguugauuuuuu

SEQ ID NO: 1250261 - RNA, 13 nt, Human
acagauaaaaugu

SEQ ID NO: 1250262 - RNA, 16 nt, Human
acagauaaaauguaaa

SEQ ID NO: 1250263 - RNA, 18 nt, Human
acagauaacugaaaauua

SEQ ID NO: 1250264 - RNA, 18 nt, Human
acagcagccccugcacaa

SEQ ID NO: 1250265 - RNA, 14 nt, Human
acagauaacugaaa

SEQ ID NO: 1250266 - RNA, 22 nt, Human
acagcagccuggggcuggccuc

SEQ ID NO: 1250267 - RNA, 15 nt, Human
acagcccaggauacu

SEQ ID NO: 1250268 - RNA, 21 nt, Human
acagcccaggauacuggcaca

SEQ ID NO: 1250269 - RNA, 12 nt, Human
acagccccaccc

SEQ ID NO: 1250270 - RNA, 13 nt, Human
acagccccacccu

SEQ ID NO: 1250271 - RNA, 14 nt, Human
acagccccacccug

SEQ ID NO: 1250272 - RNA, 15 nt, Human
acagccccacccugg

SEQ ID NO: 1250273 - RNA, 20 nt, Human
acagcccaggauacuggcac

SEQ ID NO: 1250274 - RNA, 12 nt, Human
acagccucagaa

SEQ ID NO: 1250275 - RNA, 15 nt, Human
acagccuccccugcc

SEQ ID NO: 1250276 - RNA, 17 nt, Human
acagccuccccugccag

SEQ ID NO: 1250277 - RNA, 18 nt, Human
acagccuccccugccagg

SEQ ID NO: 1250278 - RNA, 19 nt, Human
acagccuccccugccaggg

SEQ ID NO: 1250279 - RNA, 21 nt, Human
acagccuccccugccagggca

SEQ ID NO: 1250280 - RNA, 22 nt, Human
acagccuccccugccagggcag

SEQ ID NO: 1250281 - RNA, 14 nt, Human
uauaauuuugugaa

SEQ ID NO: 1250282 - RNA, 21 nt, Human
uauaagcaucauuauuuaugu

SEQ ID NO: 1250283 - RNA, 17 nt, Human
uauaagcaucauuauuu

SEQ ID NO: 1250284 - RNA, 16 nt, Human
uauaaccagacacaua

SEQ ID NO: 1250285 - RNA, 13 nt, Human
uauaagaaagccu

SEQ ID NO: 1250286 - RNA, 14 nt, Human
uauaagaaagccug

SEQ ID NO: 1250287 - RNA, 15 nt, Human
uauaagaaagccuga

SEQ ID NO: 1250288 - RNA, 12 nt, Human
uauaagacucuc

SEQ ID NO: 1250289 - RNA, 14 nt, Human
uauaagauccuaga

SEQ ID NO: 1250290 - RNA, 18 nt, Human
uauaagauccuagauccu

SEQ ID NO: 1250291 - RNA, 19 nt, Human
uauaagauccuagauccua

SEQ ID NO: 1250292 - RNA, 21 nt, Human
uauaagauccuagauccuaag

SEQ ID NO: 1250293 - RNA, 22 nt, Human
uauaagcaagaaggcaaaaaua

SEQ ID NO: 1250294 - RNA, 15 nt, Human
uauaagcaucauuau

SEQ ID NO: 1250295 - RNA, 16 nt, Human
uauaagcaucauuauu

SEQ ID NO: 1250296 - RNA, 20 nt, Human
acaccuaggcuagggugggg

SEQ ID NO: 1250297 - RNA, 17 nt, Human
acaccuacccuccuuuu

SEQ ID NO: 1250298 - RNA, 23 nt, Human
acaccuaggcuaggguggggaga

SEQ ID NO: 1250299 - RNA, 17 nt, Human
acaccuaugucauuuca

SEQ ID NO: 1250300 - RNA, 20 nt, Human
acaccuaugucauuucauuu

SEQ ID NO: 1250301 - RNA, 18 nt, Human
acaccuauuaucccagcu

SEQ ID NO: 1250302 - RNA, 19 nt, Human
acaccuauuaucccagcug

SEQ ID NO: 1250303 - RNA, 20 nt, Human
acaccuauuaucccagcugc

SEQ ID NO: 1250304 - RNA, 22 nt, Human
acaccuauuaucccagcugccu

SEQ ID NO: 1250305 - RNA, 12 nt, Human
acaccucccagg

SEQ ID NO: 1250306 - RNA, 16 nt, Human
uauaacaguguuuaaa

SEQ ID NO: 1250307 - RNA, 19 nt, Human
uauaaccaacuuuucuauu

SEQ ID NO: 1250308 - RNA, 12 nt, Human
uauagauucuaa

SEQ ID NO: 1250309 - RNA, 13 nt, Human
uauagauucuaaa

SEQ ID NO: 1250310 - RNA, 14 nt, Human
uauagauucuaaag

SEQ ID NO: 1250311 - RNA, 15 nt, Human
uauagauucuaaaga

SEQ ID NO: 1250312 - RNA, 17 nt, Human
uauagauucuaaagauu

SEQ ID NO: 1250313 - RNA, 14 nt, Human
uauacccacccaga

SEQ ID NO: 1250314 - RNA, 14 nt, Human
uauaccaauaaagu

SEQ ID NO: 1250315 - RNA, 19 nt, Human
uauaccaguauaauugagu

SEQ ID NO: 1250316 - RNA, 17 nt, Human
uauaccaaagcacauuu

SEQ ID NO: 1250317 - RNA, 15 nt, Human
uauaccaauaaagug

SEQ ID NO: 1250318 - RNA, 13 nt, Human
uauaccaauaaag

SEQ ID NO: 1250319 - RNA, 12 nt, Human
uauaccaauaaa

SEQ ID NO: 1250320 - RNA, 15 nt, Human
uauaccaaaauguug

SEQ ID NO: 1250321 - RNA, 22 nt, Human
uauaccaaagcacauuuuaaaa

SEQ ID NO: 1250322 - RNA, 19 nt, Human
uauaauuuugugaagcaaa

SEQ ID NO: 1250323 - RNA, 20 nt, Human
uauacaauuaugaagauuua

SEQ ID NO: 1250324 - RNA, 12 nt, Human
uauacacugugu

SEQ ID NO: 1250325 - RNA, 13 nt, Human
uauauaucaaaua

SEQ ID NO: 1250326 - RNA, 14 nt, Human
uauauauauauaug

SEQ ID NO: 1250327 - RNA, 15 nt, Human
uauauauauauguac

SEQ ID NO: 1250328 - RNA, 16 nt, Human
uauauauagcagcuuu

SEQ ID NO: 1250329 - RNA, 15 nt, Human
uauauauauauaaag

SEQ ID NO: 1250330 - RNA, 13 nt, Human
uauauauauauau

SEQ ID NO: 1250331 - RNA, 16 nt, Human
uauauauauauaugua

SEQ ID NO: 1250332 - RNA, 21 nt, Human
uauauauuuuuuucugaaauu

SEQ ID NO: 1250333 - RNA, 22 nt, Human
uauauauuuuuuucugaaauuu

SEQ ID NO: 1250334 - RNA, 23 nt, Human
uauauauuuuuuucugaaauuuc

SEQ ID NO: 1250335 - RNA, 19 nt, Human
uauaucacauguuuucucu

SEQ ID NO: 1250336 - RNA, 13 nt, Human
uauaucacccaga

SEQ ID NO: 1250337 - RNA, 22 nt, Human
uauaucacccagacauaaagga

SEQ ID NO: 1250338 - RNA, 20 nt, Human
uauauccaaaagcuuuuuau

SEQ ID NO: 1250339 - RNA, 14 nt, Human
uauagcuaaguaca

SEQ ID NO: 1250340 - RNA, 17 nt, Human
uauagauuguccuuuug

SEQ ID NO: 1250341 - RNA, 19 nt, Human
uauaggaauugacccacaa

SEQ ID NO: 1250342 - RNA, 14 nt, Human
uauaggaauugacc

SEQ ID NO: 1250343 - RNA, 13 nt, Human
uauaggaauugac

SEQ ID NO: 1250344 - RNA, 20 nt, Human
uauagcucuaauguuugcau

SEQ ID NO: 1250345 - RNA, 16 nt, Human
uauagcucuaauguuu

SEQ ID NO: 1250346 - RNA, 14 nt, Human
uauagcucuaaugu

SEQ ID NO: 1250347 - RNA, 18 nt, Human
uauagcucuaauguuugc

SEQ ID NO: 1250348 - RNA, 11 nt, Human
uauauauaaau

SEQ ID NO: 1250349 - RNA, 12 nt, Human
uauauauaaaua

SEQ ID NO: 1250350 - RNA, 20 nt, Human
uauauauaaucaucaaguaa

SEQ ID NO: 1250351 - RNA, 16 nt, Human
uaguuuuauaugcuuc

SEQ ID NO: 1250352 - RNA, 19 nt, Human
uaguucugcuccagacagg

SEQ ID NO: 1250353 - RNA, 18 nt, Human
uaguucugcuccagacag

SEQ ID NO: 1250354 - RNA, 13 nt, Human
uaguucugccagg

SEQ ID NO: 1250355 - RNA, 16 nt, Human
uaguucuaggcacugu

SEQ ID NO: 1250356 - RNA, 14 nt, Human
uaguucugccagga

SEQ ID NO: 1250357 - RNA, 15 nt, Human
uaguucugcuccaga

SEQ ID NO: 1250358 - RNA, 17 nt, Human
uaguuccugugcacagc

SEQ ID NO: 1250359 - RNA, 21 nt, Human
uaguuccugcuaaaacaauga

SEQ ID NO: 1250360 - RNA, 13 nt, Human
uaguucuaagacu

SEQ ID NO: 1250361 - RNA, 14 nt, Human
uaguucuaagacuc

SEQ ID NO: 1250362 - RNA, 15 nt, Human
uaguucuaagacuca

SEQ ID NO: 1250363 - RNA, 13 nt, Human
uaguucuagaaaa

SEQ ID NO: 1250364 - RNA, 14 nt, Human
uaguucuagaaaaa

SEQ ID NO: 1250365 - RNA, 15 nt, Human
uaguucuagaaaaac

SEQ ID NO: 1250366 - RNA, 16 nt, Human
uaguucuagaaaaaca

SEQ ID NO: 1250367 - RNA, 22 nt, Human
uaguucuagaaaaacaggcacu

SEQ ID NO: 1250368 - RNA, 11 nt, Human
uaguucuagac

SEQ ID NO: 1250369 - RNA, 12 nt, Human
uaguucuagaca

SEQ ID NO: 1250370 - RNA, 23 nt, Human
uaguucuagacauggagguucua

SEQ ID NO: 1250371 - RNA, 15 nt, Human
uaguucuaggcacug

SEQ ID NO: 1250372 - RNA, 19 nt, Human
uaguuccccuguuuauuca

SEQ ID NO: 1250373 - RNA, 23 nt, Human
uaguuccccuguuuauucauaug

SEQ ID NO: 1250374 - RNA, 19 nt, Human
uaguuauacuuauuuguau

SEQ ID NO: 1250375 - RNA, 22 nt, Human
uaguuagcuaauaaaaagcuuu

SEQ ID NO: 1250376 - RNA, 13 nt, Human
uagugaugguucc

SEQ ID NO: 1250377 - RNA, 17 nt, Human
uaguuacuguguaauua

SEQ ID NO: 1250378 - RNA, 18 nt, Human
uaguuacuguguaauuag

SEQ ID NO: 1250379 - RNA, 19 nt, Human
uaguuacuguguaauuagu

SEQ ID NO: 1250380 - RNA, 22 nt, Human
uaguuagccaauauuuuucuua

SEQ ID NO: 1250381 - RNA, 16 nt, Human
uagugacuuguguccc

SEQ ID NO: 1250382 - RNA, 19 nt, Human
uagugaucaaauugugcag

SEQ ID NO: 1250383 - RNA, 16 nt, Human
uagucucuuuaaaagg

SEQ ID NO: 1250384 - RNA, 18 nt, Human
uagucucuuuaaaaggaa

SEQ ID NO: 1250385 - RNA, 22 nt, Human
uagugagcagucaggaaagaga

SEQ ID NO: 1250386 - RNA, 23 nt, Human
uagugacuaaaccauugugcauu

SEQ ID NO: 1250387 - RNA, 22 nt, Human
uagugacuaaaccauugugcau

SEQ ID NO: 1250388 - RNA, 13 nt, Human
uagucaugugacc

SEQ ID NO: 1250389 - RNA, 15 nt, Human
uagucauguuuaucu

SEQ ID NO: 1250390 - RNA, 11 nt, Human
uagucucaguu

SEQ ID NO: 1250391 - RNA, 19 nt, Human
uagucucaguuuguguguc

SEQ ID NO: 1250392 - RNA, 22 nt, Human
uagucucaguuugugugucuua

SEQ ID NO: 1250393 - RNA, 22 nt, Human
acaagcucacagaccuuugaac

SEQ ID NO: 1250394 - RNA, 13 nt, Human
acaagcuucugag

SEQ ID NO: 1250395 - RNA, 15 nt, Human
acaagcuucugagac

SEQ ID NO: 1250396 - RNA, 16 nt, Human
acaagcuucugagacg

SEQ ID NO: 1250397 - RNA, 21 nt, Human
acaaggaagucaaagcaagga

SEQ ID NO: 1250398 - RNA, 21 nt, Human
acaccuacuagucaccagaga

SEQ ID NO: 1250399 - RNA, 18 nt, Human
acaccguucauucaggca

SEQ ID NO: 1250400 - RNA, 13 nt, Human
acacccuguacug

SEQ ID NO: 1250401 - RNA, 22 nt, Human
acacccuguacuguucuguguc

SEQ ID NO: 1250402 - RNA, 14 nt, Human
acaccagggccagc

SEQ ID NO: 1250403 - RNA, 18 nt, Human
acaccagggccagccucu

SEQ ID NO: 1250404 - RNA, 17 nt, Human
acaccagggccagccuc

SEQ ID NO: 1250405 - RNA, 19 nt, Human
acacaugaagguaaauaaa

SEQ ID NO: 1250406 - RNA, 22 nt, Human
acaccaggauagagacuggaac

SEQ ID NO: 1250407 - RNA, 21 nt, Human
acaccaggcuugccugcaggc

SEQ ID NO: 1250408 - RNA, 12 nt, Human
uauaaaagccug

SEQ ID NO: 1250409 - RNA, 13 nt, Human
uaguuuuauucuu

SEQ ID NO: 1250410 - RNA, 22 nt, Human
uaguuuucauccauaacugaac

SEQ ID NO: 1250411 - RNA, 17 nt, Human
uauaaaagccuguuuaa

SEQ ID NO: 1250412 - RNA, 14 nt, Human
uauaaaagccuguu

SEQ ID NO: 1250413 - RNA, 21 nt, Human
uauaaaauaauuuuuauauuu

SEQ ID NO: 1250414 - RNA, 22 nt, Human
uauaaaauaauuuuuauauuug

SEQ ID NO: 1250415 - RNA, 19 nt, Human
uauaaaagccuguuuaaga

SEQ ID NO: 1250416 - RNA, 23 nt, Human
uauaaaauaauuuuuauauuuga

SEQ ID NO: 1250417 - RNA, 22 nt, Human
aauucuuuaaaauuacaacuaa

SEQ ID NO: 1250418 - RNA, 17 nt, Human
aauucuuuaaaauuaca

SEQ ID NO: 1250419 - RNA, 13 nt, Human
aauucuuucaagu

SEQ ID NO: 1250420 - RNA, 17 nt, Human
aauucuuucaauacaga

SEQ ID NO: 1250421 - RNA, 23 nt, Human
aauucuucugaacucaaacugag

SEQ ID NO: 1250422 - RNA, 13 nt, Human
aauucuuccuuug

SEQ ID NO: 1250423 - RNA, 15 nt, Human
aauucuuccuuugua

SEQ ID NO: 1250424 - RNA, 18 nt, Human
aauucuugguugaggaaa

SEQ ID NO: 1250425 - RNA, 19 nt, Human
aauucuugguugaggaaac

SEQ ID NO: 1250426 - RNA, 20 nt, Human
aauucuugguugaggaaaca

SEQ ID NO: 1250427 - RNA, 14 nt, Human
aauucuuucauuuu

SEQ ID NO: 1250428 - RNA, 18 nt, Human
aauucuuucaauacagau

SEQ ID NO: 1250429 - RNA, 19 nt, Human
aauucuuucaauacagaua

SEQ ID NO: 1250430 - RNA, 20 nt, Human
aauucuuucaauacagauau

SEQ ID NO: 1250431 - RNA, 21 nt, Human
aauucuuucaauacagauaua

SEQ ID NO: 1250432 - RNA, 22 nt, Human
aauucuuucaauacagauauau

SEQ ID NO: 1250433 - RNA, 21 nt, Human
aauugacccacaagaaaugaa

SEQ ID NO: 1250434 - RNA, 17 nt, Human
aauugaaguaaacuuuu

SEQ ID NO: 1250435 - RNA, 18 nt, Human
aauugaaguaaacuuuuu

SEQ ID NO: 1250436 - RNA, 19 nt, Human
aauugacccacaagaaaug

SEQ ID NO: 1250437 - RNA, 16 nt, Human
aauugacccacaagaa

SEQ ID NO: 1250438 - RNA, 22 nt, Human
aauugaaagugggcaaaagcuu

SEQ ID NO: 1250439 - RNA, 12 nt, Human
aauugaaaugua

SEQ ID NO: 1250440 - RNA, 13 nt, Human
aauugaaauguaa

SEQ ID NO: 1250441 - RNA, 15 nt, Human
aauugaaauguaagg

SEQ ID NO: 1250442 - RNA, 16 nt, Human
aauugaaauguaaggc

SEQ ID NO: 1250443 - RNA, 24 nt, Human
aauugaaauguaaggcuguguaag

SEQ ID NO: 1250444 - RNA, 12 nt, Human
aauugaaccuuu

SEQ ID NO: 1250445 - RNA, 13 nt, Human
aauugaaccuuug

SEQ ID NO: 1250446 - RNA, 23 nt, Human
aauugaaccuuugugcccuauca

SEQ ID NO: 1250447 - RNA, 21 nt, Human
aauugaaccuuugugcccuau

SEQ ID NO: 1250448 - RNA, 19 nt, Human
aauucuuaugccauauaau

SEQ ID NO: 1250449 - RNA, 12 nt, Human
uacccuggcccc

SEQ ID NO: 1250450 - RNA, 13 nt, Human
uacccuggccccu

SEQ ID NO: 1250451 - RNA, 14 nt, Human
uacccuggccccuc

SEQ ID NO: 1250452 - RNA, 16 nt, Human
uacccuggccccucuc

SEQ ID NO: 1250453 - RNA, 19 nt, Human
uacccuggccccucucccu

SEQ ID NO: 1250454 - RNA, 21 nt, Human
uacccuggccccucucccuug

SEQ ID NO: 1250455 - RNA, 18 nt, Human
uacccuggccgcccccug

SEQ ID NO: 1250456 - RNA, 13 nt, Human
uacccuuggaaau

SEQ ID NO: 1250457 - RNA, 22 nt, Human
uacccuuuucugaccaaagaga

SEQ ID NO: 1250458 - RNA, 17 nt, Human
uacccuuuuucuccagc

SEQ ID NO: 1250459 - RNA, 18 nt, Human
uacccuuuuucuccagcu

SEQ ID NO: 1250460 - RNA, 19 nt, Human
uacccuuuuucuccagcug

SEQ ID NO: 1250461 - RNA, 21 nt, Human
aauucuucccuaucuuugcca

SEQ ID NO: 1250462 - RNA, 13 nt, Human
aauucuucugaac

SEQ ID NO: 1250463 - RNA, 11 nt, Human
aauucuucccu

SEQ ID NO: 1250464 - RNA, 15 nt, Human
aauucuucugaacuc

SEQ ID NO: 1250465 - RNA, 18 nt, Human
aauucuucugaacucaaa

SEQ ID NO: 1250466 - RNA, 21 nt, Human
aauucuugccaaauauaaaua

SEQ ID NO: 1250467 - RNA, 13 nt, Human
uacucacacaggc

SEQ ID NO: 1250468 - RNA, 14 nt, Human
uacucacacaggca

SEQ ID NO: 1250469 - RNA, 21 nt, Human
uacucacacaggcauuuccug

SEQ ID NO: 1250470 - RNA, 20 nt, Human
uacucuuauaucuauauuuu

SEQ ID NO: 1250471 - RNA, 18 nt, Human
uacucuuauagacaacau

SEQ ID NO: 1250472 - RNA, 22 nt, Human
uacucuuauaucuauauuuuac

SEQ ID NO: 1250473 - RNA, 22 nt, Human
uacucuucaguuaagccuuugg

SEQ ID NO: 1250474 - RNA, 17 nt, Human
uacugaaguaaaacaaa

SEQ ID NO: 1250475 - RNA, 16 nt, Human
uacugaaguaaaacaa

SEQ ID NO: 1250476 - RNA, 13 nt, Human
uacugaaucugcu

SEQ ID NO: 1250477 - RNA, 19 nt, Human
uacugaaugucauugaaaa

SEQ ID NO: 1250478 - RNA, 13 nt, Human
uacugacaugugg

SEQ ID NO: 1250479 - RNA, 20 nt, Human
uacugacauguggggccagg

SEQ ID NO: 1250480 - RNA, 14 nt, Human
uacucuucuugaaa

SEQ ID NO: 1250481 - RNA, 17 nt, Human
uacucuucuugaaauuu

SEQ ID NO: 1250482 - RNA, 18 nt, Human
uacucuucuugaaauuuu

SEQ ID NO: 1250483 - RNA, 13 nt, Human
uacucuuucugua

SEQ ID NO: 1250484 - RNA, 18 nt, Human
uacugaacaucugagucc

SEQ ID NO: 1250485 - RNA, 19 nt, Human
uacugaacaucugaguccu

SEQ ID NO: 1250486 - RNA, 21 nt, Human
uacugaacaucugaguccugg

SEQ ID NO: 1250487 - RNA, 20 nt, Human
uacugaacaucugaguccug

SEQ ID NO: 1250488 - RNA, 22 nt, Human
uacuagucaccagagacuuuag

SEQ ID NO: 1250489 - RNA, 12 nt, Human
uacuauuaaaaa

SEQ ID NO: 1250490 - RNA, 22 nt, Human
uacucaagagugguaucuugca

SEQ ID NO: 1250491 - RNA, 23 nt, Human
uacucaagagugguaucuugcag

SEQ ID NO: 1250492 - RNA, 11 nt, Human
uacuauuuaaa

SEQ ID NO: 1250493 - RNA, 12 nt, Human
uacuauuuaaag

SEQ ID NO: 1250494 - RNA, 18 nt, Human
uacucaaaugaguaacau

SEQ ID NO: 1250495 - RNA, 23 nt, Human
uacucaaaugaguaacauuugcu

SEQ ID NO: 1250496 - RNA, 17 nt, Human
uacuauaagaacuuuga

SEQ ID NO: 1250497 - RNA, 19 nt, Human
uacuauguggaugugacag

SEQ ID NO: 1250498 - RNA, 15 nt, Human
uacuauuguuacauu

SEQ ID NO: 1250499 - RNA, 21 nt, Human
uacuagucaccagagacuuua

SEQ ID NO: 1250500 - RNA, 20 nt, Human
uacuagucaccagagacuuu

SEQ ID NO: 1250501 - RNA, 18 nt, Human
uacgugcucugugggucu

SEQ ID NO: 1250502 - RNA, 22 nt, Human
uacguaugucugguucucaauu

SEQ ID NO: 1250503 - RNA, 14 nt, Human
uacguuaccaggca

SEQ ID NO: 1250504 - RNA, 18 nt, Human
uacguaugucugguucuc

SEQ ID NO: 1250505 - RNA, 21 nt, Human
uacguaugucugguucucaau

SEQ ID NO: 1250506 - RNA, 16 nt, Human
uacguauuuaauagca

SEQ ID NO: 1250507 - RNA, 19 nt, Human
uacgugggcauugucuuuu

SEQ ID NO: 1250508 - RNA, 21 nt, Human
uacguagccuaaggcuccugu

SEQ ID NO: 1250509 - RNA, 12 nt, Human
uacguaugucug

SEQ ID NO: 1250510 - RNA, 14 nt, Human
uacguaugucuggu

SEQ ID NO: 1250511 - RNA, 16 nt, Human
aauuugacuuuucugu

SEQ ID NO: 1250512 - RNA, 17 nt, Human
aauuugacuuuucugua

SEQ ID NO: 1250513 - RNA, 18 nt, Human
aauuugacuuuucuguaa

SEQ ID NO: 1250514 - RNA, 18 nt, Human
aauuugagagaaauauga

SEQ ID NO: 1250515 - RNA, 20 nt, Human
aauuugagagaaauaugaag

SEQ ID NO: 1250516 - RNA, 13 nt, Human
aauuugaggacaa

SEQ ID NO: 1250517 - RNA, 20 nt, Human
aauuugaaacacuuugcaua

SEQ ID NO: 1250518 - RNA, 21 nt, Human
aauuucuguguugccaagcuc

SEQ ID NO: 1250519 - RNA, 12 nt, Human
aauuucuuaacu

SEQ ID NO: 1250520 - RNA, 14 nt, Human
uacuucaaauccuu

SEQ ID NO: 1250521 - RNA, 19 nt, Human
uacuucaaauccuugaaga

SEQ ID NO: 1250522 - RNA, 19 nt, Human
aauuugauaugugaacagu

SEQ ID NO: 1250523 - RNA, 12 nt, Human
aauuugaugugg

SEQ ID NO: 1250524 - RNA, 22 nt, Human
aauuugauguggugaaaagcag

SEQ ID NO: 1250525 - RNA, 15 nt, Human
aauuugauaugugaa

SEQ ID NO: 1250526 - RNA, 16 nt, Human
aauuugauaugugaac

SEQ ID NO: 1250527 - RNA, 18 nt, Human
aauuugauaugugaacag

SEQ ID NO: 1250528 - RNA, 14 nt, Human
aauuugaggacaac

SEQ ID NO: 1250529 - RNA, 19 nt, Human
aauuugacuuuucuguaau

SEQ ID NO: 1250530 - RNA, 13 nt, Human
aauuugagugcuc

SEQ ID NO: 1250531 - RNA, 18 nt, Human
aauuuaccuaagauuaca

SEQ ID NO: 1250532 - RNA, 21 nt, Human
aauuuaccuaagauuacaaau

SEQ ID NO: 1250533 - RNA, 13 nt, Human
aauuuaccuaaga

SEQ ID NO: 1250534 - RNA, 14 nt, Human
aauuuaccuaagau

SEQ ID NO: 1250535 - RNA, 16 nt, Human
aauuuaccuaagauua

SEQ ID NO: 1250536 - RNA, 17 nt, Human
aauuuaccuaagauuac

SEQ ID NO: 1250537 - RNA, 16 nt, Human
aauuuagaaaacuuua

SEQ ID NO: 1250538 - RNA, 15 nt, Human
aauuuagaaaacuuu

SEQ ID NO: 1250539 - RNA, 14 nt, Human
aauuuagaaaucau

SEQ ID NO: 1250540 - RNA, 15 nt, Human
aauuuagaaaucauu

SEQ ID NO: 1250541 - RNA, 17 nt, Human
aauuuagaaaucauuuu

SEQ ID NO: 1250542 - RNA, 20 nt, Human
aauuuagaaaucauuuugca

SEQ ID NO: 1250543 - RNA, 21 nt, Human
aauuuagaaaucauuuugcaa

SEQ ID NO: 1250544 - RNA, 17 nt, Human
aauuuagacuucaagca

SEQ ID NO: 1250545 - RNA, 16 nt, Human
aauuuagacuuggauu

SEQ ID NO: 1250546 - RNA, 20 nt, Human
aauuuagacuuggauucuuu

SEQ ID NO: 1250547 - RNA, 13 nt, Human
aauuuagcauugu

SEQ ID NO: 1250548 - RNA, 14 nt, Human
aauuuagcauugua

SEQ ID NO: 1250549 - RNA, 16 nt, Human
aauuuagcauuguagu

SEQ ID NO: 1250550 - RNA, 20 nt, Human
aauuuaguaaaccaauccua

SEQ ID NO: 1250551 - RNA, 18 nt, Human
aauuuauccugaaauuuc

SEQ ID NO: 1250552 - RNA, 19 nt, Human
aauuuauccugaaauuuca

SEQ ID NO: 1250553 - RNA, 23 nt, Human
aauuuauccugaaauuucagauu

SEQ ID NO: 1250554 - RNA, 15 nt, Human
aauuuaguaaaccaa

SEQ ID NO: 1250555 - RNA, 21 nt, Human
aauuuaugaauugaauuaucu

SEQ ID NO: 1250556 - RNA, 23 nt, Human
aauuuaugaauugaauuaucuug

SEQ ID NO: 1250557 - RNA, 16 nt, Human
aauuucuaccauuuca

SEQ ID NO: 1250558 - RNA, 18 nt, Human
aauuucuaccauuucaga

SEQ ID NO: 1250559 - RNA, 15 nt, Human
aauuucuacuuugaa

SEQ ID NO: 1250560 - RNA, 16 nt, Human
aauuucuacuuugaag

SEQ ID NO: 1250561 - RNA, 17 nt, Human
aauuucuacuuugaagu

SEQ ID NO: 1250562 - RNA, 15 nt, Human
aauuuaaauagcuuu

SEQ ID NO: 1250563 - RNA, 22 nt, Human
aauuuaaaguuguuugugccuu

SEQ ID NO: 1250564 - RNA, 16 nt, Human
aauuuaaauagcuuuu

SEQ ID NO: 1250565 - RNA, 15 nt, Human
aauuuaauauuuacu

SEQ ID NO: 1250566 - RNA, 16 nt, Human
aauuuacaucauuucu

SEQ ID NO: 1250567 - RNA, 16 nt, Human
aauuuacaaaaauaua

SEQ ID NO: 1250568 - RNA, 18 nt, Human
aauuuacaaaaauauaaa

SEQ ID NO: 1250569 - RNA, 21 nt, Human
aauuuacaaaaauauaaaaua

SEQ ID NO: 1250570 - RNA, 19 nt, Human
aauuguuuuaucugaauuu

SEQ ID NO: 1250571 - RNA, 22 nt, Human
aauuguuuuaucugaauuuuua

SEQ ID NO: 1250572 - RNA, 19 nt, Human
aauuuaaaauaauuauaua

SEQ ID NO: 1250573 - RNA, 9 nt, Human
aauuuaaac

SEQ ID NO: 1250574 - RNA, 10 nt, Human
aauuuaaaca

SEQ ID NO: 1250575 - RNA, 15 nt, Human
aauuuaaacaccucc

SEQ ID NO: 1250576 - RNA, 19 nt, Human
aauuuaaacaccuccucau

SEQ ID NO: 1250577 - RNA, 22 nt, Human
aauuuaaacuauaagcaagaag

SEQ ID NO: 1250578 - RNA, 11 nt, Human
aauuuaaagca

SEQ ID NO: 1250579 - RNA, 12 nt, Human
aauuuaaagcag

SEQ ID NO: 1250580 - RNA, 19 nt, Human
aauuuaaagcagguucuug

SEQ ID NO: 1250581 - RNA, 22 nt, Human
aauuuaaagcagguucuuguug

SEQ ID NO: 1250582 - RNA, 20 nt, Human
aauuuaaagcagguucuugu

SEQ ID NO: 1250583 - RNA, 23 nt, Human
aauugugugaaagguacuucaaa

SEQ ID NO: 1250584 - RNA, 17 nt, Human
aauugcugacuguagcu

SEQ ID NO: 1250585 - RNA, 18 nt, Human
aauugcugacuguagcuu

SEQ ID NO: 1250586 - RNA, 19 nt, Human
aauugcugacuguagcuuu

SEQ ID NO: 1250587 - RNA, 13 nt, Human
aauugcugcuacu

SEQ ID NO: 1250588 - RNA, 13 nt, Human
uacuguaagaaaa

SEQ ID NO: 1250589 - RNA, 12 nt, Human
aauugcuccuug

SEQ ID NO: 1250590 - RNA, 16 nt, Human
uacuguaacauucagg

SEQ ID NO: 1250591 - RNA, 23 nt, Human
aauugcuauguuuugacauuuuu

SEQ ID NO: 1250592 - RNA, 20 nt, Human
aauuguguuuauaauuuuaa

SEQ ID NO: 1250593 - RNA, 22 nt, Human
aauuguguuuacauuuuauggu

SEQ ID NO: 1250594 - RNA, 21 nt, Human
aauuguguuuacauuuuaugg

SEQ ID NO: 1250595 - RNA, 20 nt, Human
aauuguguuuacauuuuaug

SEQ ID NO: 1250596 - RNA, 19 nt, Human
aauuguguuuacauuuuau

SEQ ID NO: 1250597 - RNA, 14 nt, Human
aauuguguuuacau

SEQ ID NO: 1250598 - RNA, 15 nt, Human
aauuguguggauucu

SEQ ID NO: 1250599 - RNA, 19 nt, Human
aauuguguggauucuuuaa

SEQ ID NO: 1250600 - RNA, 23 nt, Human
aauugugugugaugugaagccaa

SEQ ID NO: 1250601 - RNA, 12 nt, Human
aauuguuguucu

SEQ ID NO: 1250602 - RNA, 13 nt, Human
aauuguuguucug

SEQ ID NO: 1250603 - RNA, 14 nt, Human
aauuguuguucugu

SEQ ID NO: 1250604 - RNA, 15 nt, Human
aauuguuguucuguu

SEQ ID NO: 1250605 - RNA, 16 nt, Human
aauuguuguucuguua

SEQ ID NO: 1250606 - RNA, 17 nt, Human
aauuguuguucuguuaa

SEQ ID NO: 1250607 - RNA, 23 nt, Human
aauuguuguucuguuaacugaau

SEQ ID NO: 1250608 - RNA, 22 nt, Human
aauuguuguucuguuaacugaa

SEQ ID NO: 1250609 - RNA, 22 nt, Human
uagaagagagagguugaaaaac

SEQ ID NO: 1250610 - RNA, 14 nt, Human
uagaagagagaggu

SEQ ID NO: 1250611 - RNA, 19 nt, Human
uagaacucugaaaugaaga

SEQ ID NO: 1250612 - RNA, 21 nt, Human
uagaacucaaccucuacaggg

SEQ ID NO: 1250613 - RNA, 22 nt, Human
uagaacuuggauguaccugccc

SEQ ID NO: 1250614 - RNA, 21 nt, Human
uacuucaaauccuugaagauu

SEQ ID NO: 1250615 - RNA, 17 nt, Human
uacuucaaaaguuuguu

SEQ ID NO: 1250616 - RNA, 22 nt, Human
uacuucaaaaguuuguuugcuu

SEQ ID NO: 1250617 - RNA, 16 nt, Human
uacuucaugcugucua

SEQ ID NO: 1250618 - RNA, 14 nt, Human
uagaacuagccaaa

SEQ ID NO: 1250619 - RNA, 15 nt, Human
uagaacucccuuuca

SEQ ID NO: 1250620 - RNA, 23 nt, Human
uagaacucaaccucuacaggguu

SEQ ID NO: 1250621 - RNA, 23 nt, Human
uagaagucacauuccugaacagg

SEQ ID NO: 1250622 - RNA, 22 nt, Human
uagaagccccguuauaacuccu

SEQ ID NO: 1250623 - RNA, 12 nt, Human
uagaagccugca

SEQ ID NO: 1250624 - RNA, 17 nt, Human
uagaauugaguguuuaa

SEQ ID NO: 1250625 - RNA, 20 nt, Human
uagaauugaguguuuaaagu

SEQ ID NO: 1250626 - RNA, 19 nt, Human
uagaauuugauaugugaac

SEQ ID NO: 1250627 - RNA, 17 nt, Human
uagacaaauagaaaaug

SEQ ID NO: 1250628 - RNA, 20 nt, Human
uagacaaauagaaaaugguc

SEQ ID NO: 1250629 - RNA, 19 nt, Human
uagacaaauagaaaauggu

SEQ ID NO: 1250630 - RNA, 13 nt, Human
uagacaagccaga

SEQ ID NO: 1250631 - RNA, 19 nt, Human
uagaauugaguguuuaaag

SEQ ID NO: 1250632 - RNA, 13 nt, Human
uagaauugcauug

SEQ ID NO: 1250633 - RNA, 14 nt, Human
uagaauugcauuga

SEQ ID NO: 1250634 - RNA, 15 nt, Human
uagaauugcauugac

SEQ ID NO: 1250635 - RNA, 18 nt, Human
uagacaauugagguaagu

SEQ ID NO: 1250636 - RNA, 14 nt, Human
uagacagcaugaga

SEQ ID NO: 1250637 - RNA, 15 nt, Human
uagacaauugaggua

SEQ ID NO: 1250638 - RNA, 22 nt, Human
uagacaaguccagccuggcaag

SEQ ID NO: 1250639 - RNA, 14 nt, Human
uagacaagccagaa

SEQ ID NO: 1250640 - RNA, 15 nt, Human
uagacaagccagaac

SEQ ID NO: 1250641 - RNA, 19 nt, Human
uagacaagccagaacuuga

SEQ ID NO: 1250642 - RNA, 19 nt, Human
aauuuuuauauuugaaaua

SEQ ID NO: 1250643 - RNA, 17 nt, Human
aauuuuaaacaaagguu

SEQ ID NO: 1250644 - RNA, 14 nt, Human
aauuuuaaacaaag

SEQ ID NO: 1250645 - RNA, 19 nt, Human
aauuuuaaccuaugauauu

SEQ ID NO: 1250646 - RNA, 15 nt, Human
aauuuuuauuucuuc

SEQ ID NO: 1250647 - RNA, 22 nt, Human
aauuuuuauuuuugcugagacu

SEQ ID NO: 1250648 - RNA, 17 nt, Human
aauuuguaaugucuuga

SEQ ID NO: 1250649 - RNA, 18 nt, Human
aauuuguaaugucuugag

SEQ ID NO: 1250650 - RNA, 20 nt, Human
aauuuguaaugucuugagcu

SEQ ID NO: 1250651 - RNA, 17 nt, Human
aauuuguaggguuucua

SEQ ID NO: 1250652 - RNA, 19 nt, Human
aauuuguacuauuuaacug

SEQ ID NO: 1250653 - RNA, 17 nt, Human
aauuuguuuuggauaua

SEQ ID NO: 1250654 - RNA, 19 nt, Human
aauuuuuucucuaggaaau

SEQ ID NO: 1250655 - RNA, 21 nt, Human
aauuuuuuaagugaaaauaua

SEQ ID NO: 1250656 - RNA, 18 nt, Human
aauuuuuuaucaugcaug

SEQ ID NO: 1250657 - RNA, 20 nt, Human
aauuuuuuaucaugcauguc

SEQ ID NO: 1250658 - RNA, 13 nt, Human
aauuuuuuucacc

SEQ ID NO: 1250659 - RNA, 22 nt, Human
aauuuuuucucuaggaaauauu

SEQ ID NO: 1250660 - RNA, 17 nt, Human
aauuuuuuauaaaagug

SEQ ID NO: 1250661 - RNA, 14 nt, Human
aauuuuuguauuuu

SEQ ID NO: 1250662 - RNA, 15 nt, Human
aauuuuuuaaaaagc

SEQ ID NO: 1250663 - RNA, 14 nt, Human
aauuuuuccaacua

SEQ ID NO: 1250664 - RNA, 20 nt, Human
aauuuuuccaacuacuaaua

SEQ ID NO: 1250665 - RNA, 19 nt, Human
acaaaaaaaaaauuugcca

SEQ ID NO: 1250666 - RNA, 20 nt, Human
aauuuuuuucaccuagauuu

SEQ ID NO: 1250667 - RNA, 20 nt, Human
aauuuuuuuccuuaccuuuu

SEQ ID NO: 1250668 - RNA, 14 nt, Human
acaaaaaaaucuuc

SEQ ID NO: 1250669 - RNA, 13 nt, Human
acaaaaacaggua

SEQ ID NO: 1250670 - RNA, 20 nt, Human
acaaaaacagguauauacuu

SEQ ID NO: 1250671 - RNA, 19 nt, Human
acaaaaaaaucuuccaauu

SEQ ID NO: 1250672 - RNA, 14 nt, Human
acaaaaaaaaauuu

SEQ ID NO: 1250673 - RNA, 19 nt, Human
uagcauuuguguugaagag

SEQ ID NO: 1250674 - RNA, 21 nt, Human
uagcauuguagugcuuugaga

SEQ ID NO: 1250675 - RNA, 18 nt, Human
uagcauuguaaaagcauu

SEQ ID NO: 1250676 - RNA, 19 nt, Human
uagcauuguaaaagcauuu

SEQ ID NO: 1250677 - RNA, 24 nt, Human
uagcauuguaaaauuauuucauga

SEQ ID NO: 1250678 - RNA, 18 nt, Human
acaaauguuaaaaugugu

SEQ ID NO: 1250679 - RNA, 20 nt, Human
acaaauguuaaaauguguug

SEQ ID NO: 1250680 - RNA, 19 nt, Human
acaaauguuaaaauguguu

SEQ ID NO: 1250681 - RNA, 15 nt, Human
acaaauuaguuauau

SEQ ID NO: 1250682 - RNA, 15 nt, Human
acaaauuaucuuaaa

SEQ ID NO: 1250683 - RNA, 17 nt, Human
acaaauuauuaaugaaa

SEQ ID NO: 1250684 - RNA, 18 nt, Human
acaaauucugucucugga

SEQ ID NO: 1250685 - RNA, 15 nt, Human
acaacaaccugguca

SEQ ID NO: 1250686 - RNA, 14 nt, Human
acaacaauccuucu

SEQ ID NO: 1250687 - RNA, 13 nt, Human
acaacacccauuu

SEQ ID NO: 1250688 - RNA, 14 nt, Human
acaagaagaagggc

SEQ ID NO: 1250689 - RNA, 15 nt, Human
acaagaagcauuuug

SEQ ID NO: 1250690 - RNA, 17 nt, Human
acaagaagcauuuugua

SEQ ID NO: 1250691 - RNA, 18 nt, Human
acaagaagcauuuuguaa

SEQ ID NO: 1250692 - RNA, 20 nt, Human
acaagaagccacagaccuag

SEQ ID NO: 1250693 - RNA, 22 nt, Human
acaagaauacuacuuaugaaau

SEQ ID NO: 1250694 - RNA, 13 nt, Human
acaagaauggauc

SEQ ID NO: 1250695 - RNA, 14 nt, Human
acaagaauggauca

SEQ ID NO: 1250696 - RNA, 18 nt, Human
acaagcacuaaacaaaga

SEQ ID NO: 1250697 - RNA, 21 nt, Human
acaagcauucugucuugaagg

SEQ ID NO: 1250698 - RNA, 19 nt, Human
acaagagaagcauucucau

SEQ ID NO: 1250699 - RNA, 23 nt, Human
acaagaauggaucacaagaugga

SEQ ID NO: 1250700 - RNA, 15 nt, Human
acaagagcacuacau

SEQ ID NO: 1250701 - RNA, 21 nt, Human
acaagagcacuacauucauuu

SEQ ID NO: 1250702 - RNA, 23 nt, Human
acaagcauggucccacaucccug

SEQ ID NO: 1250703 - RNA, 22 nt, Human
acaagccagaacuugacccuga

SEQ ID NO: 1250704 - RNA, 14 nt, Human
acaagccagaacuu

SEQ ID NO: 1250705 - RNA, 14 nt, Human
acaagcuaaaauua

SEQ ID NO: 1250706 - RNA, 21 nt, Human
uagcaugucgucaaagcugaa

SEQ ID NO: 1250707 - RNA, 16 nt, Human
uagcaccagggaaggg

SEQ ID NO: 1250708 - RNA, 13 nt, Human
uagcaccagggaa

SEQ ID NO: 1250709 - RNA, 14 nt, Human
uagcaccagggaag

SEQ ID NO: 1250710 - RNA, 17 nt, Human
uagcacagauggccagc

SEQ ID NO: 1250711 - RNA, 20 nt, Human
uagaugcaguucugaagaag

SEQ ID NO: 1250712 - RNA, 21 nt, Human
uagauuuuacaugaaguauuu

SEQ ID NO: 1250713 - RNA, 22 nt, Human
uagauuuuacaugaaguauuuu

SEQ ID NO: 1250714 - RNA, 12 nt, Human
uagauuuuccaa

SEQ ID NO: 1250715 - RNA, 13 nt, Human
uagauuuuccaaa

SEQ ID NO: 1250716 - RNA, 13 nt, Human
uagauuuucugcu

SEQ ID NO: 1250717 - RNA, 14 nt, Human
uagauuuucugguu

SEQ ID NO: 1250718 - RNA, 17 nt, Human
uagauuuucugguucua

SEQ ID NO: 1250719 - RNA, 19 nt, Human
uagauuuucugguucuaac

SEQ ID NO: 1250720 - RNA, 21 nt, Human
uagauuuucugguucuaacau

SEQ ID NO: 1250721 - RNA, 22 nt, Human
uagauuuucugguucuaacauu

SEQ ID NO: 1250722 - RNA, 15 nt, Human
uagaggaagcagcca

SEQ ID NO: 1250723 - RNA, 19 nt, Human
uagaggagaaacuggaacu

SEQ ID NO: 1250724 - RNA, 14 nt, Human
uagaucagaugcuc

SEQ ID NO: 1250725 - RNA, 17 nt, Human
uagaugcaguucugaag

SEQ ID NO: 1250726 - RNA, 19 nt, Human
uagaugcaguucugaagaa

SEQ ID NO: 1250727 - RNA, 18 nt, Human
uagaucagaugcuccaag

SEQ ID NO: 1250728 - RNA, 19 nt, Human
uagaucagaugcuccaaga

SEQ ID NO: 1250729 - RNA, 20 nt, Human
uagaucagaugcuccaagau

SEQ ID NO: 1250730 - RNA, 23 nt, Human
uagaucagaugcuccaagauucu

SEQ ID NO: 1250731 - RNA, 14 nt, Human
uagaucauaaggcu

SEQ ID NO: 1250732 - RNA, 15 nt, Human
uagaucauaaggcuu

SEQ ID NO: 1250733 - RNA, 21 nt, Human
uagaucauaaggcuucaaaau

SEQ ID NO: 1250734 - RNA, 18 nt, Human
acaaaaagaaaagaaaau

SEQ ID NO: 1250735 - RNA, 14 nt, Human
acaaaaagaaaaga

SEQ ID NO: 1250736 - RNA, 22 nt, Human
acaaaaacagguauauacuuug

SEQ ID NO: 1250737 - RNA, 14 nt, Human
uagagcacugccac

SEQ ID NO: 1250738 - RNA, 17 nt, Human
uagagcacugccaccag

SEQ ID NO: 1250739 - RNA, 16 nt, Human
uagagcacugccacca

SEQ ID NO: 1250740 - RNA, 17 nt, Human
uagagcagacuacagcu

SEQ ID NO: 1250741 - RNA, 16 nt, Human
uagagcagacuacagc

SEQ ID NO: 1250742 - RNA, 16 nt, Human
uagagcaggacugaug

SEQ ID NO: 1250743 - RNA, 17 nt, Human
uagagcaggacugaugu

SEQ ID NO: 1250744 - RNA, 23 nt, Human
uagagcaggacugaugucuccua

SEQ ID NO: 1250745 - RNA, 15 nt, Human
uagagcuucuggcac

SEQ ID NO: 1250746 - RNA, 20 nt, Human
uagagcuguauuaagccacu

SEQ ID NO: 1250747 - RNA, 23 nt, Human
uagagcagggauuaaccucugca

SEQ ID NO: 1250748 - RNA, 14 nt, Human
uagagcuccucccu

SEQ ID NO: 1250749 - RNA, 23 nt, Human
uaccccaccucccucaaccucau

SEQ ID NO: 1250750 - RNA, 21 nt, Human
uaccccagacuagauguagua

SEQ ID NO: 1250751 - RNA, 22 nt, Human
uaccccagacuagauguaguau

SEQ ID NO: 1250752 - RNA, 18 nt, Human
uaccccaauuucggauuu

SEQ ID NO: 1250753 - RNA, 20 nt, Human
uaccccauggagcugggcua

SEQ ID NO: 1250754 - RNA, 16 nt, Human
uacccccagcugugcu

SEQ ID NO: 1250755 - RNA, 15 nt, Human
uaccccccucugucu

SEQ ID NO: 1250756 - RNA, 14 nt, Human
uaccaguugccuuu

SEQ ID NO: 1250757 - RNA, 16 nt, Human
uaccaguugccuuuua

SEQ ID NO: 1250758 - RNA, 16 nt, Human
uaccauauacagcuca

SEQ ID NO: 1250759 - RNA, 19 nt, Human
uaccaguugccuuuuaucc

SEQ ID NO: 1250760 - RNA, 20 nt, Human
uaccaucacugaguuuucca

SEQ ID NO: 1250761 - RNA, 17 nt, Human
uaccaucacugaguuuu

SEQ ID NO: 1250762 - RNA, 17 nt, Human
uaccacugcugauauuu

SEQ ID NO: 1250763 - RNA, 20 nt, Human
uaccacugcugauauuuucu

SEQ ID NO: 1250764 - RNA, 19 nt, Human
uaccagagaaaaagggagg

SEQ ID NO: 1250765 - RNA, 22 nt, Human
uaccacugcugauauuuucucu

SEQ ID NO: 1250766 - RNA, 21 nt, Human
uaccacugcugauauuuucuc

SEQ ID NO: 1250767 - RNA, 13 nt, Human
uaccagaaagcag

SEQ ID NO: 1250768 - RNA, 15 nt, Human
uacauuuaaaacauu

SEQ ID NO: 1250769 - RNA, 16 nt, Human
uacauuuaaaacauua

SEQ ID NO: 1250770 - RNA, 19 nt, Human
uacauuuaaaacauuaaaa

SEQ ID NO: 1250771 - RNA, 20 nt, Human
uacauuuaaaacauuaaaau

SEQ ID NO: 1250772 - RNA, 11 nt, Human
uacauuuaaua

SEQ ID NO: 1250773 - RNA, 15 nt, Human
uacauuuacaaacug

SEQ ID NO: 1250774 - RNA, 16 nt, Human
uacauuuacaaacuga

SEQ ID NO: 1250775 - RNA, 17 nt, Human
uacauuuacaaacugaa

SEQ ID NO: 1250776 - RNA, 18 nt, Human
uacauuuacaaacugaag

SEQ ID NO: 1250777 - RNA, 20 nt, Human
uacauuuauaguuguaacua

SEQ ID NO: 1250778 - RNA, 19 nt, Human
uaccccuuacaaaugaaaa

SEQ ID NO: 1250779 - RNA, 17 nt, Human
uaccccgcagacaccuu

SEQ ID NO: 1250780 - RNA, 12 nt, Human
uacccuccuggc

SEQ ID NO: 1250781 - RNA, 15 nt, Human
uacccuccuggcucu

SEQ ID NO: 1250782 - RNA, 22 nt, Human
uacccucuucauggauggggga

SEQ ID NO: 1250783 - RNA, 17 nt, Human
uacccucugaaauacau

SEQ ID NO: 1250784 - RNA, 13 nt, Human
uacccugaccugg

SEQ ID NO: 1250785 - RNA, 14 nt, Human
uacccugaccuggc

SEQ ID NO: 1250786 - RNA, 20 nt, Human
uacccugaccuggcccccuc

SEQ ID NO: 1250787 - RNA, 22 nt, Human
uacccugaccuggcccccucag

SEQ ID NO: 1250788 - RNA, 16 nt, Human
uacccugagcugaggc

SEQ ID NO: 1250789 - RNA, 17 nt, Human
uacccugagcugaggca

SEQ ID NO: 1250790 - RNA, 18 nt, Human
uacccugagcugaggcag

SEQ ID NO: 1250791 - RNA, 18 nt, Human
uacccuccuuuuuuuccc

SEQ ID NO: 1250792 - RNA, 13 nt, Human
uacccucucagcu

SEQ ID NO: 1250793 - RNA, 15 nt, Human
uacccucucagcucc

SEQ ID NO: 1250794 - RNA, 16 nt, Human
uacccucucagcucca

SEQ ID NO: 1250795 - RNA, 17 nt, Human
uacccucucagcuccag

SEQ ID NO: 1250796 - RNA, 20 nt, Human
uacccucucagcuccaggug

SEQ ID NO: 1250797 - RNA, 21 nt, Human
uacccucucagcuccaggugg

SEQ ID NO: 1250798 - RNA, 13 nt, Human
uacccucugaaau

SEQ ID NO: 1250799 - RNA, 14 nt, Human
uacccucugaaaua

SEQ ID NO: 1250800 - RNA, 15 nt, Human
uacccucugaaauac

SEQ ID NO: 1250801 - RNA, 16 nt, Human
uacccucugaaauaca

SEQ ID NO: 1250802 - RNA, 12 nt, Human
uacccucuggag

SEQ ID NO: 1250803 - RNA, 14 nt, Human
uacccucuggaggg

SEQ ID NO: 1250804 - RNA, 22 nt, Human
uacccucuggagggguguggcu

SEQ ID NO: 1250805 - RNA, 18 nt, Human
aauguugacaugggacau

SEQ ID NO: 1250806 - RNA, 14 nt, Human
aauguugaauuuug

SEQ ID NO: 1250807 - RNA, 18 nt, Human
aauguugagaaucccaaa

SEQ ID NO: 1250808 - RNA, 19 nt, Human
aauguugauuacagugcag

SEQ ID NO: 1250809 - RNA, 13 nt, Human
aauguugcugaaa

SEQ ID NO: 1250810 - RNA, 14 nt, Human
aauguugcugaaaa

SEQ ID NO: 1250811 - RNA, 13 nt, Human
aaugugaagccuu

SEQ ID NO: 1250812 - RNA, 14 nt, Human
aaugugaagccuuc

SEQ ID NO: 1250813 - RNA, 15 nt, Human
aaugugaagccuucc

SEQ ID NO: 1250814 - RNA, 19 nt, Human
aauuaacaugaauauuuag

SEQ ID NO: 1250815 - RNA, 17 nt, Human
aauguugcugaaaaaug

SEQ ID NO: 1250816 - RNA, 20 nt, Human
aauuaagaaaggauaaaguu

SEQ ID NO: 1250817 - RNA, 15 nt, Human
uacauuguauauaug

SEQ ID NO: 1250818 - RNA, 23 nt, Human
uacauugugggauguucagcacu

SEQ ID NO: 1250819 - RNA, 21 nt, Human
uacauuguuaccucuauauac

SEQ ID NO: 1250820 - RNA, 17 nt, Human
uacauuguuaccucuau

SEQ ID NO: 1250821 - RNA, 13 nt, Human
uacauuguugagc

SEQ ID NO: 1250822 - RNA, 23 nt, Human
uacauuguugagcuauugcuguu

SEQ ID NO: 1250823 - RNA, 19 nt, Human
uacauuagcaguuugcuuu

SEQ ID NO: 1250824 - RNA, 20 nt, Human
uacauuagcaguuugcuuug

SEQ ID NO: 1250825 - RNA, 14 nt, Human
uacauuaaacauga

SEQ ID NO: 1250826 - RNA, 15 nt, Human
uacauuaauuaucua

SEQ ID NO: 1250827 - RNA, 20 nt, Human
uacauuaaacaugacuccau

SEQ ID NO: 1250828 - RNA, 12 nt, Human
uacauuaaacau

SEQ ID NO: 1250829 - RNA, 22 nt, Human
uacauguuugcaccuuucuagu

SEQ ID NO: 1250830 - RNA, 12 nt, Human
uacauguuugca

SEQ ID NO: 1250831 - RNA, 13 nt, Human
uacauguuugcac

SEQ ID NO: 1250832 - RNA, 15 nt, Human
uacauguauugcaca

SEQ ID NO: 1250833 - RNA, 19 nt, Human
uacauguauugcacauugu

SEQ ID NO: 1250834 - RNA, 17 nt, Human
uacauguacugauuacu

SEQ ID NO: 1250835 - RNA, 23 nt, Human
uacauggcuggagcuagaauuug

SEQ ID NO: 1250836 - RNA, 14 nt, Human
uacauggugcuggg

SEQ ID NO: 1250837 - RNA, 17 nt, Human
uacauggugcugggaga

SEQ ID NO: 1250838 - RNA, 23 nt, Human
uacauggugcugggagaggcagc

SEQ ID NO: 1250839 - RNA, 15 nt, Human
uacaugguguuugug

SEQ ID NO: 1250840 - RNA, 16 nt, Human
aauuaaggcauaagaa

SEQ ID NO: 1250841 - RNA, 18 nt, Human
aauuaagggccgauuuaa

SEQ ID NO: 1250842 - RNA, 20 nt, Human
uacaguggggaaugaagaua

SEQ ID NO: 1250843 - RNA, 15 nt, Human
uacauaaguuuagga

SEQ ID NO: 1250844 - RNA, 15 nt, Human
uacagucucgucucu

SEQ ID NO: 1250845 - RNA, 18 nt, Human
uacagucuuccauuugca

SEQ ID NO: 1250846 - RNA, 19 nt, Human
uacagucuuccauuugcaa

SEQ ID NO: 1250847 - RNA, 20 nt, Human
uacagucuuccauuugcaag

SEQ ID NO: 1250848 - RNA, 22 nt, Human
uacagucuuccauuugcaaggg

SEQ ID NO: 1250849 - RNA, 19 nt, Human
uacagucuucuuacuugga

SEQ ID NO: 1250850 - RNA, 14 nt, Human
uacagcaaauccuu

SEQ ID NO: 1250851 - RNA, 20 nt, Human
uacaguauggggguuguaaa

SEQ ID NO: 1250852 - RNA, 21 nt, Human
uacaguauggggguuguaaau

SEQ ID NO: 1250853 - RNA, 22 nt, Human
uacaguauggggguuguaaauu

SEQ ID NO: 1250854 - RNA, 14 nt, Human
uacagucuaaagcu

SEQ ID NO: 1250855 - RNA, 15 nt, Human
uacagucuaaagcug

SEQ ID NO: 1250856 - RNA, 17 nt, Human
uacagucucgucucuuu

SEQ ID NO: 1250857 - RNA, 22 nt, Human
uacagcaacaauuuaugaauug

SEQ ID NO: 1250858 - RNA, 19 nt, Human
uacagcaacaauuuaugaa

SEQ ID NO: 1250859 - RNA, 20 nt, Human
uacagcaacaauuuaugaau

SEQ ID NO: 1250860 - RNA, 19 nt, Human
aauguaugcauguugucua

SEQ ID NO: 1250861 - RNA, 13 nt, Human
aauguaugcaugu

SEQ ID NO: 1250862 - RNA, 16 nt, Human
aauguaucauagaaau

SEQ ID NO: 1250863 - RNA, 18 nt, Human
aauguaucauagaaaugu

SEQ ID NO: 1250864 - RNA, 19 nt, Human
aauguaucauagaaaugua

SEQ ID NO: 1250865 - RNA, 22 nt, Human
aauguaucauagaaauguaacu

SEQ ID NO: 1250866 - RNA, 21 nt, Human
aauguagaguuuuuaaacauc

SEQ ID NO: 1250867 - RNA, 14 nt, Human
aauguagauaagug

SEQ ID NO: 1250868 - RNA, 15 nt, Human
aauguagauaagugu

SEQ ID NO: 1250869 - RNA, 16 nt, Human
aauguagauaaguguu

SEQ ID NO: 1250870 - RNA, 18 nt, Human
aauguagauaaguguucu

SEQ ID NO: 1250871 - RNA, 22 nt, Human
aauguaggagacuguuuggaaa

SEQ ID NO: 1250872 - RNA, 16 nt, Human
aauguaggcuuaguuu

SEQ ID NO: 1250873 - RNA, 19 nt, Human
aauguaggcuuaguuugug

SEQ ID NO: 1250874 - RNA, 22 nt, Human
aauguaggcuuaguuugugugu

SEQ ID NO: 1250875 - RNA, 23 nt, Human
aauguaguucugcuccagacagg

SEQ ID NO: 1250876 - RNA, 12 nt, Human
uacauacagaau

SEQ ID NO: 1250877 - RNA, 20 nt, Human
uacauacagaauuacuguaa

SEQ ID NO: 1250878 - RNA, 20 nt, Human
uacauaccacgcuagggcug

SEQ ID NO: 1250879 - RNA, 23 nt, Human
uacauaccacgcuagggcuggcu

SEQ ID NO: 1250880 - RNA, 22 nt, Human
uacauacccuggccgcccccug

SEQ ID NO: 1250881 - RNA, 17 nt, Human
uacauacuaugaaauau

SEQ ID NO: 1250882 - RNA, 19 nt, Human
uacauacuaugaaauaugu

SEQ ID NO: 1250883 - RNA, 20 nt, Human
uacauacuaugaaauaugua

SEQ ID NO: 1250884 - RNA, 14 nt, Human
uacauagaugcuua

SEQ ID NO: 1250885 - RNA, 13 nt, Human
aauguaagacaaa

SEQ ID NO: 1250886 - RNA, 16 nt, Human
aauguaagauuauaga

SEQ ID NO: 1250887 - RNA, 19 nt, Human
aauguaagauuauagauuc

SEQ ID NO: 1250888 - RNA, 20 nt, Human
aauguaagauuauagauucu

SEQ ID NO: 1250889 - RNA, 21 nt, Human
aauguaagauuauagauucua

SEQ ID NO: 1250890 - RNA, 22 nt, Human
aauguaagauuauagauucuaa

SEQ ID NO: 1250891 - RNA, 23 nt, Human
aauguaagauuauagauucuaaa

SEQ ID NO: 1250892 - RNA, 16 nt, Human
aaugguuuaaaugguc

SEQ ID NO: 1250893 - RNA, 23 nt, Human
uacaaugaaaaggacuuuauaga

SEQ ID NO: 1250894 - RNA, 15 nt, Human
uacaaguuucaucca

SEQ ID NO: 1250895 - RNA, 16 nt, Human
uacaauaauucuauga

SEQ ID NO: 1250896 - RNA, 20 nt, Human
uacagcaaauccuuugugaa

SEQ ID NO: 1250897 - RNA, 16 nt, Human
uacagagaagccauca

SEQ ID NO: 1250898 - RNA, 18 nt, Human
uacagagaagccaucacc

SEQ ID NO: 1250899 - RNA, 22 nt, Human
uacagagaagccaucaccucag

SEQ ID NO: 1250900 - RNA, 23 nt, Human
uacagagaagccaucaccucaga

SEQ ID NO: 1250901 - RNA, 13 nt, Human
uacagagaagccu

SEQ ID NO: 1250902 - RNA, 14 nt, Human
uacagagaagccuu

SEQ ID NO: 1250903 - RNA, 15 nt, Human
uacagagaagccuuc

SEQ ID NO: 1250904 - RNA, 16 nt, Human
uacagagaagccuuca

SEQ ID NO: 1250905 - RNA, 20 nt, Human
uacagauuuauuccuuuguu

SEQ ID NO: 1250906 - RNA, 21 nt, Human
uacacguauuugaauggccuu

SEQ ID NO: 1250907 - RNA, 19 nt, Human
uacagacuggauguaccac

SEQ ID NO: 1250908 - RNA, 15 nt, Human
uacagagaaaccagc

SEQ ID NO: 1250909 - RNA, 17 nt, Human
uacagagaaaccagcuu

SEQ ID NO: 1250910 - RNA, 18 nt, Human
uacagagaaaccagcuuc

SEQ ID NO: 1250911 - RNA, 20 nt, Human
uacagagaaaccagcuuccu

SEQ ID NO: 1250912 - RNA, 19 nt, Human
uacagagaaaccagcuucc

SEQ ID NO: 1250913 - RNA, 10 nt, Human
uacagagaag

SEQ ID NO: 1250914 - RNA, 11 nt, Human
uacagagaagc

SEQ ID NO: 1250915 - RNA, 12 nt, Human
uacagagaagcc

SEQ ID NO: 1250916 - RNA, 13 nt, Human
uacagagaagcca

SEQ ID NO: 1250917 - RNA, 14 nt, Human
uacagagaagccag

SEQ ID NO: 1250918 - RNA, 15 nt, Human
uacagagaagccagc

SEQ ID NO: 1250919 - RNA, 17 nt, Human
uacagagaagccagcuu

SEQ ID NO: 1250920 - RNA, 18 nt, Human
uacagagaagccagcuug

SEQ ID NO: 1250921 - RNA, 19 nt, Human
uacagagaagccagcuugu

SEQ ID NO: 1250922 - RNA, 20 nt, Human
uacagagaagccagcuuguu

SEQ ID NO: 1250923 - RNA, 21 nt, Human
uacagagaagccagcuuguuu

SEQ ID NO: 1250924 - RNA, 14 nt, Human
uacagagaagccau

SEQ ID NO: 1250925 - RNA, 15 nt, Human
uacagagaagccauc

SEQ ID NO: 1250926 - RNA, 21 nt, Human
aauguacauagugcuaacaug

SEQ ID NO: 1250927 - RNA, 15 nt, Human
aauguacauuaauua

SEQ ID NO: 1250928 - RNA, 22 nt, Human
aauguacccaccgggccacucc

SEQ ID NO: 1250929 - RNA, 14 nt, Human
uacaccuaugucau

SEQ ID NO: 1250930 - RNA, 17 nt, Human
uacaccuaugucauuuc

SEQ ID NO: 1250931 - RNA, 21 nt, Human
uacaccuaugucauuucauuu

SEQ ID NO: 1250932 - RNA, 18 nt, Human
aauguacccaccgggcca

SEQ ID NO: 1250933 - RNA, 16 nt, Human
uacaccuauuauccca

SEQ ID NO: 1250934 - RNA, 18 nt, Human
uacaccuauuaucccagc

SEQ ID NO: 1250935 - RNA, 17 nt, Human
uacacgcuuuugugaug

SEQ ID NO: 1250936 - RNA, 13 nt, Human
uaauucauguugc

SEQ ID NO: 1250937 - RNA, 16 nt, Human
uaauuauaucuaaaau

SEQ ID NO: 1250938 - RNA, 14 nt, Human
uaauucagguuuuu

SEQ ID NO: 1250939 - RNA, 16 nt, Human
uaauucagguuuuucc

SEQ ID NO: 1250940 - RNA, 17 nt, Human
uaauucagguuuuuccu

SEQ ID NO: 1250941 - RNA, 21 nt, Human
uaauucagguuuuuccuuuuu

SEQ ID NO: 1250942 - RNA, 19 nt, Human
uaauucagguuuuuccuuu

SEQ ID NO: 1250943 - RNA, 19 nt, Human
uaauuuacaaaaauauaaa

SEQ ID NO: 1250944 - RNA, 21 nt, Human
uaauuuacaaaaauauaaaau

SEQ ID NO: 1250945 - RNA, 22 nt, Human
uaauuuacaaaaauauaaaaua

SEQ ID NO: 1250946 - RNA, 21 nt, Human
uaauuuaccuaagauuacaaa

SEQ ID NO: 1250947 - RNA, 22 nt, Human
uaauuuaccuaagauuacaaau

SEQ ID NO: 1250948 - RNA, 13 nt, Human
uaauuucuaaugu

SEQ ID NO: 1250949 - RNA, 15 nt, Human
uaauuugacuagaaa

SEQ ID NO: 1250950 - RNA, 16 nt, Human
uaauuugacuagaaaa

SEQ ID NO: 1250951 - RNA, 15 nt, Human
uaauuugagagaaau

SEQ ID NO: 1250952 - RNA, 18 nt, Human
uaauuugaggacaaccau

SEQ ID NO: 1250953 - RNA, 22 nt, Human
uaauuugaggacaaccauucca

SEQ ID NO: 1250954 - RNA, 12 nt, Human
uaauuugcauua

SEQ ID NO: 1250955 - RNA, 16 nt, Human
uaauuugcauuaaauu

SEQ ID NO: 1250956 - RNA, 17 nt, Human
uaauuugcauuaaauuc

SEQ ID NO: 1250957 - RNA, 21 nt, Human
uaauuuuuguauuuuuaguag

SEQ ID NO: 1250958 - RNA, 20 nt, Human
uaauuugcauuaaauucaca

SEQ ID NO: 1250959 - RNA, 16 nt, Human
uacaagccugcacaau

SEQ ID NO: 1250960 - RNA, 20 nt, Human
uacaauaaaaucuugaaaau

SEQ ID NO: 1250961 - RNA, 18 nt, Human
uacaaguuucauccagaa

SEQ ID NO: 1250962 - RNA, 14 nt, Human
uacaaguuucaucc

SEQ ID NO: 1250963 - RNA, 13 nt, Human
uacaaguuagaaa

SEQ ID NO: 1250964 - RNA, 15 nt, Human
uacaaguuagaaaac

SEQ ID NO: 1250965 - RNA, 15 nt, Human
uacaaguuggaguca

SEQ ID NO: 1250966 - RNA, 21 nt, Human
uacaagcauucugucuugaag

SEQ ID NO: 1250967 - RNA, 14 nt, Human
uaauuuuuuuaauu

SEQ ID NO: 1250968 - RNA, 15 nt, Human
uaauuauauguugua

SEQ ID NO: 1250969 - RNA, 16 nt, Human
uaauuauauguuguaa

SEQ ID NO: 1250970 - RNA, 14 nt, Human
uaauuauccaggaa

SEQ ID NO: 1250971 - RNA, 23 nt, Human
uaauuauaccgcuaucauuccaa

SEQ ID NO: 1250972 - RNA, 14 nt, Human
uaauuauauaacug

SEQ ID NO: 1250973 - RNA, 16 nt, Human
uaauuauauaacugua

SEQ ID NO: 1250974 - RNA, 17 nt, Human
uaauuauauaacuguau

SEQ ID NO: 1250975 - RNA, 20 nt, Human
uaauuauauaacuguauuug

SEQ ID NO: 1250976 - RNA, 21 nt, Human
uaauuaugccuuuuuugauca

SEQ ID NO: 1250977 - RNA, 22 nt, Human
uaauuauggagucauuuuuaca

SEQ ID NO: 1250978 - RNA, 17 nt, Human
uaauuauggagucauuu

SEQ ID NO: 1250979 - RNA, 20 nt, Human
uaauuauggagucauuuuua

SEQ ID NO: 1250980 - RNA, 14 nt, Human
uaauucacagugcu

SEQ ID NO: 1250981 - RNA, 21 nt, Human
uaauucacagugcucuuuucu

SEQ ID NO: 1250982 - RNA, 22 nt, Human
uaauucacagugcucuuuucuc

SEQ ID NO: 1250983 - RNA, 20 nt, Human
uaauucacuguacuaucagg

SEQ ID NO: 1250984 - RNA, 20 nt, Human
uaauuauacccccugcaaag

SEQ ID NO: 1250985 - RNA, 13 nt, Human
aaugaaugaaacu

SEQ ID NO: 1250986 - RNA, 13 nt, Human
aaugcaaauaaca

SEQ ID NO: 1250987 - RNA, 14 nt, Human
aaugcaaauaacaa

SEQ ID NO: 1250988 - RNA, 16 nt, Human
aaugcaaauaacaaau

SEQ ID NO: 1250989 - RNA, 17 nt, Human
aaugcaaauaacaaaug

SEQ ID NO: 1250990 - RNA, 13 nt, Human
aaugcaaccauuu

SEQ ID NO: 1250991 - RNA, 17 nt, Human
aaugcaaccauuugaaa

SEQ ID NO: 1250992 - RNA, 18 nt, Human
aaugcaaccauuugaaac

SEQ ID NO: 1250993 - RNA, 15 nt, Human
uaauguaagacaaau

SEQ ID NO: 1250994 - RNA, 13 nt, Human
uaaugaacaaaug

SEQ ID NO: 1250995 - RNA, 14 nt, Human
uaaugaacaaaugg

SEQ ID NO: 1250996 - RNA, 16 nt, Human
uaaugaagaaagugga

SEQ ID NO: 1250997 - RNA, 17 nt, Human
uaaugaagaaaguggaa

SEQ ID NO: 1250998 - RNA, 22 nt, Human
uaaugaagaaaguggaaaacaa

SEQ ID NO: 1250999 - RNA, 23 nt, Human
uaaugaagaaaguggaaaacaag

SEQ ID NO: 1251000 - RNA, 13 nt, Human
uaaugaagaucua

SEQ ID NO: 1251001 - RNA, 14 nt, Human
uaaugaagaucuaa

SEQ ID NO: 1251002 - RNA, 15 nt, Human
uaaugaagaucuaaa

SEQ ID NO: 1251003 - RNA, 17 nt, Human
uaaugaagaucuaaaua

SEQ ID NO: 1251004 - RNA, 16 nt, Human
uaaugaagaucuaaau

SEQ ID NO: 1251005 - RNA, 15 nt, Human
aaugaaugaaugaau

SEQ ID NO: 1251006 - RNA, 16 nt, Human
aaucuugucaugugua

SEQ ID NO: 1251007 - RNA, 14 nt, Human
aaugaaaaaaugua

SEQ ID NO: 1251008 - RNA, 14 nt, Human
aaugaaaaauucca

SEQ ID NO: 1251009 - RNA, 19 nt, Human
aaugaaaaauuccacucaa

SEQ ID NO: 1251010 - RNA, 13 nt, Human
aaucuugaaaaug

SEQ ID NO: 1251011 - RNA, 14 nt, Human
aaucuugaaauuaa

SEQ ID NO: 1251012 - RNA, 17 nt, Human
aaucuugaaauuaagaa

SEQ ID NO: 1251013 - RNA, 22 nt, Human
aaucuugacuacagucaggaaa

SEQ ID NO: 1251014 - RNA, 13 nt, Human
aaucuugcaugua

SEQ ID NO: 1251015 - RNA, 23 nt, Human
aaucuugaucaguuaagaaauuu

SEQ ID NO: 1251016 - RNA, 15 nt, Human
aaucuugcuuucuuu

SEQ ID NO: 1251017 - RNA, 18 nt, Human
aaucuugcuuucuuuguu

SEQ ID NO: 1251018 - RNA, 19 nt, Human
aaucuugguugaugccaaa

SEQ ID NO: 1251019 - RNA, 13 nt, Human
aaucuugguuugc

SEQ ID NO: 1251020 - RNA, 15 nt, Human
aaucuugucaugugu

SEQ ID NO: 1251021 - RNA, 17 nt, Human
aaucuugucauguguau

SEQ ID NO: 1251022 - RNA, 16 nt, Human
aaucuuuuauaggauu

SEQ ID NO: 1251023 - RNA, 13 nt, Human
uaaugugauauua

SEQ ID NO: 1251024 - RNA, 22 nt, Human
uaauccaagcaaaugugaauca

SEQ ID NO: 1251025 - RNA, 19 nt, Human
uaauccaauggguuuuucc

SEQ ID NO: 1251026 - RNA, 20 nt, Human
uaaucauucuuauuucauga

SEQ ID NO: 1251027 - RNA, 22 nt, Human
uaaucauucuuauuucaugaaa

SEQ ID NO: 1251028 - RNA, 17 nt, Human
uaaucuuuaauuuuaca

SEQ ID NO: 1251029 - RNA, 13 nt, Human
uaaucuuucacag

SEQ ID NO: 1251030 - RNA, 15 nt, Human
uaaucuucugccuuc

SEQ ID NO: 1251031 - RNA, 16 nt, Human
uaaucuugaauuguaa

SEQ ID NO: 1251032 - RNA, 22 nt, Human
uaaucuugaauuguaacuguuc

SEQ ID NO: 1251033 - RNA, 14 nt, Human
uaaucuugcuuucu

SEQ ID NO: 1251034 - RNA, 15 nt, Human
uaaucuugcuuucuu

SEQ ID NO: 1251035 - RNA, 20 nt, Human
uaauagaauaaaggcaguuu

SEQ ID NO: 1251036 - RNA, 22 nt, Human
uaauagaauaaaggcaguuuuc

SEQ ID NO: 1251037 - RNA, 16 nt, Human
uaauauuccucaguuc

SEQ ID NO: 1251038 - RNA, 16 nt, Human
uaauauugacuuguau

SEQ ID NO: 1251039 - RNA, 18 nt, Human
uaauauugacuuguauau

SEQ ID NO: 1251040 - RNA, 16 nt, Human
uaauauugauuuauua

SEQ ID NO: 1251041 - RNA, 19 nt, Human
uaaucagggaggucauuuu

SEQ ID NO: 1251042 - RNA, 19 nt, Human
uaaucagguccucagagaa

SEQ ID NO: 1251043 - RNA, 22 nt, Human
uaaucagguccucagagaauuu

SEQ ID NO: 1251044 - RNA, 18 nt, Human
uaauacuugcuuuggaaa

SEQ ID NO: 1251045 - RNA, 17 nt, Human
uaauacuucuugugugu

SEQ ID NO: 1251046 - RNA, 17 nt, Human
uaauagaaaaguauguu

SEQ ID NO: 1251047 - RNA, 14 nt, Human
uaauagaauaaagg

SEQ ID NO: 1251048 - RNA, 16 nt, Human
uaauagaauaaaggca

SEQ ID NO: 1251049 - RNA, 13 nt, Human
uaauaccucccuu

SEQ ID NO: 1251050 - RNA, 21 nt, Human
uaauaccucuaauaguauaaa

SEQ ID NO: 1251051 - RNA, 20 nt, Human
uaauacauuccaacucguau

SEQ ID NO: 1251052 - RNA, 23 nt, Human
uaauaccucuaauaguauaaacc

SEQ ID NO: 1251053 - RNA, 15 nt, Human
uaauacagcugagcu

SEQ ID NO: 1251054 - RNA, 16 nt, Human
uaauacauuauauuuc

SEQ ID NO: 1251055 - RNA, 17 nt, Human
uaauacauuauauuucu

SEQ ID NO: 1251056 - RNA, 16 nt, Human
uaauaccacagcuuuu

SEQ ID NO: 1251057 - RNA, 21 nt, Human
uaauacagcaacaauuuauga

SEQ ID NO: 1251058 - RNA, 22 nt, Human
uaauacagcaacaauuuaugaa

SEQ ID NO: 1251059 - RNA, 23 nt, Human
aauacaucccuuaccugggaaag

SEQ ID NO: 1251060 - RNA, 19 nt, Human
aauacauagggauaugcgu

SEQ ID NO: 1251061 - RNA, 18 nt, Human
uaauacagcaacaauuua

SEQ ID NO: 1251062 - RNA, 19 nt, Human
uaacaaugcuguauuuuaa

SEQ ID NO: 1251063 - RNA, 21 nt, Human
aauacagucuuccauuugcaa

SEQ ID NO: 1251064 - RNA, 16 nt, Human
aauacaguucugcucu

SEQ ID NO: 1251065 - RNA, 17 nt, Human
aauacaguucugcucug

SEQ ID NO: 1251066 - RNA, 22 nt, Human
aauacauaccacgcuagggcug

SEQ ID NO: 1251067 - RNA, 16 nt, Human
aagcuuuuaugugaaa

SEQ ID NO: 1251068 - RNA, 15 nt, Human
guuccccuguucacu

SEQ ID NO: 1251069 - RNA, 17 nt, Human
guuccccuguucacucu

SEQ ID NO: 1251070 - RNA, 19 nt, Human
aaggaaaaaauaacaauga

SEQ ID NO: 1251071 - RNA, 16 nt, Human
aaggaaaaaauaacaa

SEQ ID NO: 1251072 - RNA, 13 nt, Human
aagcucugaggga

SEQ ID NO: 1251073 - RNA, 14 nt, Human
aagcucugcuauua

SEQ ID NO: 1251074 - RNA, 18 nt, Human
aagcuuuccugccccagg

SEQ ID NO: 1251075 - RNA, 21 nt, Human
aagcuuuccugccccaggccu

SEQ ID NO: 1251076 - RNA, 22 nt, Human
aagcuuuccugccccaggccug

SEQ ID NO: 1251077 - RNA, 22 nt, Human
aagcuuuggugagaaccugggu

SEQ ID NO: 1251078 - RNA, 19 nt, Human
aagcuuuggugagaaccug

SEQ ID NO: 1251079 - RNA, 15 nt, Human
aagcucccagggccu

SEQ ID NO: 1251080 - RNA, 23 nt, Human
aagcucccccagcaaagccccca

SEQ ID NO: 1251081 - RNA, 15 nt, Human
aagcucccccagcaa

SEQ ID NO: 1251082 - RNA, 16 nt, Human
aagcuccucuccccag

SEQ ID NO: 1251083 - RNA, 15 nt, Human
aagcucuagaaucug

SEQ ID NO: 1251084 - RNA, 15 nt, Human
aagcucugaagaacu

SEQ ID NO: 1251085 - RNA, 9 nt, Human
aagcucuga

SEQ ID NO: 1251086 - RNA, 12 nt, Human
aagcucugacau

SEQ ID NO: 1251087 - RNA, 11 nt, Human
aagcucugagc

SEQ ID NO: 1251088 - RNA, 12 nt, Human
aagcucugagcu

SEQ ID NO: 1251089 - RNA, 15 nt, Human
aagcucugagcuguc

SEQ ID NO: 1251090 - RNA, 16 nt, Human
aagcucugagcuguca

SEQ ID NO: 1251091 - RNA, 17 nt, Human
guguuuauccuuucaua

SEQ ID NO: 1251092 - RNA, 15 nt, Human
guguuuauccuuuca

SEQ ID NO: 1251093 - RNA, 22 nt, Human
guguuuauccuaucucuccaac

SEQ ID NO: 1251094 - RNA, 22 nt, Human
guguuuaagacauuuuuggaag

SEQ ID NO: 1251095 - RNA, 14 nt, Human
guguuuacauuuua

SEQ ID NO: 1251096 - RNA, 13 nt, Human
guugaauuuuaca

SEQ ID NO: 1251097 - RNA, 16 nt, Human
guucuguuuuguuucg

SEQ ID NO: 1251098 - RNA, 20 nt, Human
guugaauuuuuuuuaacauu

SEQ ID NO: 1251099 - RNA, 21 nt, Human
guugaauuuuuuuuaacauuc

SEQ ID NO: 1251100 - RNA, 23 nt, Human
guugaauuuuuuuuaacauuccu

SEQ ID NO: 1251101 - RNA, 13 nt, Human
guucuguuucaag

SEQ ID NO: 1251102 - RNA, 14 nt, Human
guucuguuucaagg

SEQ ID NO: 1251103 - RNA, 13 nt, Human
guucuguuugcug

SEQ ID NO: 1251104 - RNA, 18 nt, Human
guucuguuucaaggcacu

SEQ ID NO: 1251105 - RNA, 12 nt, Human
guucuguuuugu

SEQ ID NO: 1251106 - RNA, 16 nt, Human
guucugugguuucaug

SEQ ID NO: 1251107 - RNA, 19 nt, Human
guucugugguuucauguua

SEQ ID NO: 1251108 - RNA, 21 nt, Human
guucugugguuucauguuagu

SEQ ID NO: 1251109 - RNA, 13 nt, Human
guucugugucuuu

SEQ ID NO: 1251110 - RNA, 22 nt, Human
guucugugucuuucacagcucc

SEQ ID NO: 1251111 - RNA, 23 nt, Human
guucugugucuuucacagcuccu

SEQ ID NO: 1251112 - RNA, 13 nt, Human
guucuguuaacug

SEQ ID NO: 1251113 - RNA, 14 nt, Human
guucuguuaacuga

SEQ ID NO: 1251114 - RNA, 16 nt, Human
guucuguuaacugaau

SEQ ID NO: 1251115 - RNA, 17 nt, Human
guucuguuaacugaaua

SEQ ID NO: 1251116 - RNA, 18 nt, Human
guucuguuaacugaauac

SEQ ID NO: 1251117 - RNA, 19 nt, Human
guucuguuaacugaauacc

SEQ ID NO: 1251118 - RNA, 21 nt, Human
guucuguuaacugaauaccac

SEQ ID NO: 1251119 - RNA, 13 nt, Human
guugacaugggac

SEQ ID NO: 1251120 - RNA, 12 nt, Human
guugagacagag

SEQ ID NO: 1251121 - RNA, 18 nt, Human
guugacaguucauaugua

SEQ ID NO: 1251122 - RNA, 15 nt, Human
guugagagugugacc

SEQ ID NO: 1251123 - RNA, 17 nt, Human
guugagagugugaccaa

SEQ ID NO: 1251124 - RNA, 18 nt, Human
guugagauaguuuucauc

SEQ ID NO: 1251125 - RNA, 17 nt, Human
guugagauaguuuucau

SEQ ID NO: 1251126 - RNA, 16 nt, Human
guugagcaucuguccc

SEQ ID NO: 1251127 - RNA, 15 nt, Human
guugagccccuggag

SEQ ID NO: 1251128 - RNA, 14 nt, Human
guugagccuuuucc

SEQ ID NO: 1251129 - RNA, 23 nt, Human
guucuccaacaucacagcccagc

SEQ ID NO: 1251130 - RNA, 20 nt, Human
guucucccuguacaguguua

SEQ ID NO: 1251131 - RNA, 18 nt, Human
guucuccguuagcuccug

SEQ ID NO: 1251132 - RNA, 19 nt, Human
guucuccguuagcuccugu

SEQ ID NO: 1251133 - RNA, 21 nt, Human
guucuccguuagcuccugugg

SEQ ID NO: 1251134 - RNA, 12 nt, Human
guucugucacca

SEQ ID NO: 1251135 - RNA, 11 nt, Human
guucugucccu

SEQ ID NO: 1251136 - RNA, 16 nt, Human
guucugucccuugccc

SEQ ID NO: 1251137 - RNA, 18 nt, Human
guucugucccuugccccc

SEQ ID NO: 1251138 - RNA, 11 nt, Human
guucugugcac

SEQ ID NO: 1251139 - RNA, 18 nt, Human
guuccccuguucacucua

SEQ ID NO: 1251140 - RNA, 19 nt, Human
guuccccuguuuauucaua

SEQ ID NO: 1251141 - RNA, 18 nt, Human
guuccccuguuuauucau

SEQ ID NO: 1251142 - RNA, 17 nt, Human
guuccccuguuuauuca

SEQ ID NO: 1251143 - RNA, 13 nt, Human
guuccccuuccac

SEQ ID NO: 1251144 - RNA, 14 nt, Human
guucuaguuuuuua

SEQ ID NO: 1251145 - RNA, 14 nt, Human
guucucaauuccaa

SEQ ID NO: 1251146 - RNA, 17 nt, Human
guucucaauuccaacag

SEQ ID NO: 1251147 - RNA, 21 nt, Human
guucucaauuccaacaguuua

SEQ ID NO: 1251148 - RNA, 21 nt, Human
guucucacacuggucugcugu

SEQ ID NO: 1251149 - RNA, 23 nt, Human
guucucagaaucccuuaacaguu

SEQ ID NO: 1251150 - RNA, 17 nt, Human
guucucagguguugcca

SEQ ID NO: 1251151 - RNA, 19 nt, Human
guucucauggguggcacuc

SEQ ID NO: 1251152 - RNA, 21 nt, Human
guucuccaacaucacagccca

SEQ ID NO: 1251153 - RNA, 22 nt, Human
guucuccaacaucacagcccag

SEQ ID NO: 1251154 - RNA, 20 nt, Human
aaggccugguguuucuugau

SEQ ID NO: 1251155 - RNA, 11 nt, Human
aaggccugggg

SEQ ID NO: 1251156 - RNA, 15 nt, Human
aaggccuggggugac

SEQ ID NO: 1251157 - RNA, 17 nt, Human
aaggccuggggugaccc

SEQ ID NO: 1251158 - RNA, 21 nt, Human
aaggccuggggugacccggca

SEQ ID NO: 1251159 - RNA, 16 nt, Human
aaggcccgagcagcug

SEQ ID NO: 1251160 - RNA, 22 nt, Human
aaggccuggggugacccggcac

SEQ ID NO: 1251161 - RNA, 18 nt, Human
aaggccuucaacccgaga

SEQ ID NO: 1251162 - RNA, 14 nt, Human
aaggcccgagcagc

SEQ ID NO: 1251163 - RNA, 15 nt, Human
aaggccuccuggcug

SEQ ID NO: 1251164 - RNA, 12 nt, Human
guugcugccuca

SEQ ID NO: 1251165 - RNA, 23 nt, Human
guugcugaugaacucuuaaucaa

SEQ ID NO: 1251166 - RNA, 19 nt, Human
guugcuccgccuggccugg

SEQ ID NO: 1251167 - RNA, 22 nt, Human
guugcuccgccuggccuggcca

SEQ ID NO: 1251168 - RNA, 14 nt, Human
guugguugguuuuc

SEQ ID NO: 1251169 - RNA, 12 nt, Human
guugguuuucuu

SEQ ID NO: 1251170 - RNA, 15 nt, Human
guugguuuucuucuu

SEQ ID NO: 1251171 - RNA, 20 nt, Human
guugggagagggcgcaggcc

SEQ ID NO: 1251172 - RNA, 23 nt, Human
guuggggaaacagcaucuccaag

SEQ ID NO: 1251173 - RNA, 18 nt, Human
guuggggaagggccugcc

SEQ ID NO: 1251174 - RNA, 21 nt, Human
guuggggacacauguauuugg

SEQ ID NO: 1251175 - RNA, 16 nt, Human
guuggggucuggcagc

SEQ ID NO: 1251176 - RNA, 17 nt, Human
guuggcuuaccuggccc

SEQ ID NO: 1251177 - RNA, 14 nt, Human
guuggcuuaccugg

SEQ ID NO: 1251178 - RNA, 16 nt, Human
guuggcuuaccuggcc

SEQ ID NO: 1251179 - RNA, 18 nt, Human
guugggacuacaggcgug

SEQ ID NO: 1251180 - RNA, 22 nt, Human
aaggagcaagucagaauagaaa

SEQ ID NO: 1251181 - RNA, 18 nt, Human
aaggaagguggauggccc

SEQ ID NO: 1251182 - RNA, 21 nt, Human
aaggaagucaaagcaaggaaa

SEQ ID NO: 1251183 - RNA, 14 nt, Human
aaggagaaugaauc

SEQ ID NO: 1251184 - RNA, 17 nt, Human
aaggaaggcuccaucuc

SEQ ID NO: 1251185 - RNA, 17 nt, Human
aaggaaggcagggagga

SEQ ID NO: 1251186 - RNA, 12 nt, Human
aaggaaggugga

SEQ ID NO: 1251187 - RNA, 17 nt, Human
aaggaagguggauggcc

SEQ ID NO: 1251188 - RNA, 15 nt, Human
aaggaagcugugcgu

SEQ ID NO: 1251189 - RNA, 19 nt, Human
guugaucuggaacccagac

SEQ ID NO: 1251190 - RNA, 20 nt, Human
aaggaaacaaccaugucauu

SEQ ID NO: 1251191 - RNA, 15 nt, Human
guugaucuggaaccc

SEQ ID NO: 1251192 - RNA, 16 nt, Human
guugaucuggaaccca

SEQ ID NO: 1251193 - RNA, 17 nt, Human
guugaucuggaacccag

SEQ ID NO: 1251194 - RNA, 22 nt, Human
guugaucuggaacccagacuca

SEQ ID NO: 1251195 - RNA, 21 nt, Human
aaggauaaaguugguaaaccu

SEQ ID NO: 1251196 - RNA, 15 nt, Human
aaggaggagccuguc

SEQ ID NO: 1251197 - RNA, 16 nt, Human
aaggaggagccugucc

SEQ ID NO: 1251198 - RNA, 17 nt, Human
aaggaggagccuguccu

SEQ ID NO: 1251199 - RNA, 22 nt, Human
aaggaggagccuguccugccug

SEQ ID NO: 1251200 - RNA, 23 nt, Human
aaggaggauggcauauaauacaa

SEQ ID NO: 1251201 - RNA, 23 nt, Human
aaggauaaaguugguaaaccuuu

SEQ ID NO: 1251202 - RNA, 13 nt, Human
aaggauaaugaau

SEQ ID NO: 1251203 - RNA, 22 nt, Human
aaggaggacccaggacaggauc

SEQ ID NO: 1251204 - RNA, 21 nt, Human
aaggaggacccaggacaggau

SEQ ID NO: 1251205 - RNA, 18 nt, Human
aaggaggacccaggacag

SEQ ID NO: 1251206 - RNA, 17 nt, Human
aaggaggacccaggaca

SEQ ID NO: 1251207 - RNA, 15 nt, Human
aaggaggacccagga

SEQ ID NO: 1251208 - RNA, 14 nt, Human
aaggaggacccagg

SEQ ID NO: 1251209 - RNA, 13 nt, Human
aaggaggacccag

SEQ ID NO: 1251210 - RNA, 23 nt, Human
aaggagcagagcugauggagaag

SEQ ID NO: 1251211 - RNA, 17 nt, Human
aaggagccccauuccug

SEQ ID NO: 1251212 - RNA, 19 nt, Human
aaggagccccauuccuggg

SEQ ID NO: 1251213 - RNA, 20 nt, Human
aaggauagaugcuggcccag

SEQ ID NO: 1251214 - RNA, 22 nt, Human
aaggauaggccuucauuaacaa

SEQ ID NO: 1251215 - RNA, 16 nt, Human
aaggauccggaaagaa

SEQ ID NO: 1251216 - RNA, 17 nt, Human
aaggauccggaaagaag

SEQ ID NO: 1251217 - RNA, 20 nt, Human
aagucacauuccugaacagg

SEQ ID NO: 1251218 - RNA, 19 nt, Human
aagucacagggcaguaccu

SEQ ID NO: 1251219 - RNA, 18 nt, Human
aagucaauguuuucaguu

SEQ ID NO: 1251220 - RNA, 14 nt, Human
aagucacagggcag

SEQ ID NO: 1251221 - RNA, 15 nt, Human
aagucacagggcagu

SEQ ID NO: 1251222 - RNA, 23 nt, Human
aagucacagggcaguaccugagg

SEQ ID NO: 1251223 - RNA, 12 nt, Human
aagucacugcac

SEQ ID NO: 1251224 - RNA, 21 nt, Human
aagucacggcugcgcacugug

SEQ ID NO: 1251225 - RNA, 14 nt, Human
aagucacugcacag

SEQ ID NO: 1251226 - RNA, 14 nt, Human
aagucauaauugca

SEQ ID NO: 1251227 - RNA, 15 nt, Human
aagucauaauugcau

SEQ ID NO: 1251228 - RNA, 19 nt, Human
aagucaaggguaggguggg

SEQ ID NO: 1251229 - RNA, 17 nt, Human
aagucaauguuuucagu

SEQ ID NO: 1251230 - RNA, 13 nt, Human
aagucaaggagaa

SEQ ID NO: 1251231 - RNA, 15 nt, Human
aagucaacuuagcau

SEQ ID NO: 1251232 - RNA, 16 nt, Human
aagucaaccugccuga

SEQ ID NO: 1251233 - RNA, 17 nt, Human
aagucaacaguaaacca

SEQ ID NO: 1251234 - RNA, 19 nt, Human
aagucaacaguaaaccacu

SEQ ID NO: 1251235 - RNA, 21 nt, Human
aagucaacaguaaaccacuga

SEQ ID NO: 1251236 - RNA, 14 nt, Human
aagucaacaguaaa

SEQ ID NO: 1251237 - RNA, 15 nt, Human
aagucaacaguaaac

SEQ ID NO: 1251238 - RNA, 16 nt, Human
aagucaacaguaaacc

SEQ ID NO: 1251239 - RNA, 13 nt, Human
aaguauguucuaa

SEQ ID NO: 1251240 - RNA, 23 nt, Human
aaguauguuagugcaaauuguca

SEQ ID NO: 1251241 - RNA, 20 nt, Human
guuuuauauauuauauggaa

SEQ ID NO: 1251242 - RNA, 17 nt, Human
guuuuuuuguuauuaaa

SEQ ID NO: 1251243 - RNA, 14 nt, Human
guuuuuuucuaaua

SEQ ID NO: 1251244 - RNA, 15 nt, Human
guuuuuuuucaguug

SEQ ID NO: 1251245 - RNA, 12 nt, Human
guuuuuuucuau

SEQ ID NO: 1251246 - RNA, 15 nt, Human
guuuuuuuuuaaaga

SEQ ID NO: 1251247 - RNA, 23 nt, Human
guuuuuuuuuaaaaaagaaacau

SEQ ID NO: 1251248 - RNA, 12 nt, Human
guuuuuuaaguc

SEQ ID NO: 1251249 - RNA, 15 nt, Human
guuuuuuaugcuaau

SEQ ID NO: 1251250 - RNA, 16 nt, Human
guuuuuuaguugaauu

SEQ ID NO: 1251251 - RNA, 11 nt, Human
guuuuuucauc

SEQ ID NO: 1251252 - RNA, 22 nt, Human
guuuuuucaucuucaguugucu

SEQ ID NO: 1251253 - RNA, 21 nt, Human
guuuuuucuuccuuuucacug

SEQ ID NO: 1251254 - RNA, 14 nt, Human
guuuuuugccacag

SEQ ID NO: 1251255 - RNA, 23 nt, Human
guuuuuugccacagcuuuugcaa

SEQ ID NO: 1251256 - RNA, 14 nt, Human
guuuuuuguaccaa

SEQ ID NO: 1251257 - RNA, 20 nt, Human
guuuuuggucuuuuauaauu

SEQ ID NO: 1251258 - RNA, 15 nt, Human
guuuuuguucaaagc

SEQ ID NO: 1251259 - RNA, 13 nt, Human
guuuuucuauuaa

SEQ ID NO: 1251260 - RNA, 15 nt, Human
guuuuucuauuaaaa

SEQ ID NO: 1251261 - RNA, 16 nt, Human
guuuuucuauuaaaag

SEQ ID NO: 1251262 - RNA, 17 nt, Human
guuuuucuauuaaaaga

SEQ ID NO: 1251263 - RNA, 18 nt, Human
guuuuucuauuaaaagac

SEQ ID NO: 1251264 - RNA, 19 nt, Human
guuuuucuauuaaaagacu

SEQ ID NO: 1251265 - RNA, 20 nt, Human
guuuuucuauuaaaagacuc

SEQ ID NO: 1251266 - RNA, 21 nt, Human
guuuuucuauuaaaagacuca

SEQ ID NO: 1251267 - RNA, 22 nt, Human
guuuuucuauuaaaagacucau

SEQ ID NO: 1251268 - RNA, 23 nt, Human
guuuuugaucaaaaacuauuugg

SEQ ID NO: 1251269 - RNA, 15 nt, Human
guuuuugcacauguu

SEQ ID NO: 1251270 - RNA, 18 nt, Human
guuuuugguuuuuaaaac

SEQ ID NO: 1251271 - RNA, 19 nt, Human
aagugacuuuggcugcaug

SEQ ID NO: 1251272 - RNA, 20 nt, Human
aagugaccuauaccuguguu

SEQ ID NO: 1251273 - RNA, 19 nt, Human
aagugacuaauggcaugag

SEQ ID NO: 1251274 - RNA, 20 nt, Human
guuuuucuaaaggaguuuau

SEQ ID NO: 1251275 - RNA, 11 nt, Human
guuuuucuauu

SEQ ID NO: 1251276 - RNA, 12 nt, Human
guuuuucuauua

SEQ ID NO: 1251277 - RNA, 15 nt, Human
aagugaauuugccug

SEQ ID NO: 1251278 - RNA, 16 nt, Human
aagugaauuugccugu

SEQ ID NO: 1251279 - RNA, 20 nt, Human
aagugaauuugccuguaaca

SEQ ID NO: 1251280 - RNA, 17 nt, Human
aagugaauuugccugua

SEQ ID NO: 1251281 - RNA, 22 nt, Human
aagugacauugcaucaaagcau

SEQ ID NO: 1251282 - RNA, 22 nt, Human
aagucuuauauauuguagauaa

SEQ ID NO: 1251283 - RNA, 15 nt, Human
aagugaaugcuggga

SEQ ID NO: 1251284 - RNA, 13 nt, Human
aagucaucuugcu

SEQ ID NO: 1251285 - RNA, 14 nt, Human
aagucaucuugcua

SEQ ID NO: 1251286 - RNA, 20 nt, Human
aagucaucuugcuaccagua

SEQ ID NO: 1251287 - RNA, 23 nt, Human
aagucaucuugcuaccaguauuu

SEQ ID NO: 1251288 - RNA, 15 nt, Human
guuuuauaauuuugu

SEQ ID NO: 1251289 - RNA, 22 nt, Human
guuuuauaauuuugugaagcaa

SEQ ID NO: 1251290 - RNA, 11 nt, Human
guuuuauauau

SEQ ID NO: 1251291 - RNA, 12 nt, Human
guuuuauauauu

SEQ ID NO: 1251292 - RNA, 19 nt, Human
guuuuauauauuauaugga

SEQ ID NO: 1251293 - RNA, 13 nt, Human
guuuuacuuuuaa

SEQ ID NO: 1251294 - RNA, 18 nt, Human
guuuuacuuuuaaacugu

SEQ ID NO: 1251295 - RNA, 21 nt, Human
guuuuacuuuuaaacugugua

SEQ ID NO: 1251296 - RNA, 22 nt, Human
guuuuaacuguggauauuguua

SEQ ID NO: 1251297 - RNA, 14 nt, Human
guuuuaacuuuguu

SEQ ID NO: 1251298 - RNA, 13 nt, Human
guuuuaacuuugu

SEQ ID NO: 1251299 - RNA, 17 nt, Human
guuugcacuaucuuuca

SEQ ID NO: 1251300 - RNA, 23 nt, Human
guuugcauauaagggaaguaguu

SEQ ID NO: 1251301 - RNA, 16 nt, Human
guuugcagucccaagc

SEQ ID NO: 1251302 - RNA, 22 nt, Human
guuugcagguggccaaguuccu

SEQ ID NO: 1251303 - RNA, 15 nt, Human
guuugcacuuccucu

SEQ ID NO: 1251304 - RNA, 14 nt, Human
guuugcacuuccuc

SEQ ID NO: 1251305 - RNA, 21 nt, Human
guuugcagaagggggucucuu

SEQ ID NO: 1251306 - RNA, 19 nt, Human
guuugcaucugaaaauuga

SEQ ID NO: 1251307 - RNA, 15 nt, Human
guuugccuuccagaa

SEQ ID NO: 1251308 - RNA, 18 nt, Human
guuugccuucuacuuuua

SEQ ID NO: 1251309 - RNA, 18 nt, Human
guuucugguggucuguug

SEQ ID NO: 1251310 - RNA, 21 nt, Human
guuucugguggucuguuggca

SEQ ID NO: 1251311 - RNA, 14 nt, Human
guuucuggauuuca

SEQ ID NO: 1251312 - RNA, 14 nt, Human
guuucucagcuccc

SEQ ID NO: 1251313 - RNA, 23 nt, Human
guuucuagguaauuuuuacagaa

SEQ ID NO: 1251314 - RNA, 18 nt, Human
guuucuccaaacugaagc

SEQ ID NO: 1251315 - RNA, 11 nt, Human
guuucuccccc

SEQ ID NO: 1251316 - RNA, 17 nt, Human
guuucucccccauguuc

SEQ ID NO: 1251317 - RNA, 22 nt, Human
guuucucccccauguucugucc

SEQ ID NO: 1251318 - RNA, 16 nt, Human
guuguaaaccaaguga

SEQ ID NO: 1251319 - RNA, 21 nt, Human
guuguaaaguauguauuauuu

SEQ ID NO: 1251320 - RNA, 19 nt, Human
aaggcugagaggagagaga

SEQ ID NO: 1251321 - RNA, 14 nt, Human
guuguaaauuggca

SEQ ID NO: 1251322 - RNA, 16 nt, Human
guuguaaauuggcaug

SEQ ID NO: 1251323 - RNA, 22 nt, Human
guuguaaauuggcauggaaauu

SEQ ID NO: 1251324 - RNA, 14 nt, Human
guuguaaccugcug

SEQ ID NO: 1251325 - RNA, 17 nt, Human
guuguaaccugcuguga

SEQ ID NO: 1251326 - RNA, 16 nt, Human
aaggcugcuguacuga

SEQ ID NO: 1251327 - RNA, 16 nt, Human
aaggcugaugucaauu

SEQ ID NO: 1251328 - RNA, 16 nt, Human
aagggcccuccuuccu

SEQ ID NO: 1251329 - RNA, 12 nt, Human
aagggcccuggg

SEQ ID NO: 1251330 - RNA, 23 nt, Human
aagggccugcccaguugcacuca

SEQ ID NO: 1251331 - RNA, 16 nt, Human
aaggggagcccacugu

SEQ ID NO: 1251332 - RNA, 14 nt, Human
aaggggauuuuuau

SEQ ID NO: 1251333 - RNA, 20 nt, Human
aaggggauuuuuaugucugg

SEQ ID NO: 1251334 - RNA, 20 nt, Human
aaguaaaacaaacaauaccu

SEQ ID NO: 1251335 - RNA, 13 nt, Human
aaguaaaagcaaa

SEQ ID NO: 1251336 - RNA, 21 nt, Human
aaguaaaagcaaaaaagaaaa

SEQ ID NO: 1251337 - RNA, 18 nt, Human
aaguaaaagcaaaaaaga

SEQ ID NO: 1251338 - RNA, 20 nt, Human
aaguaaacuuuuuguucugg

SEQ ID NO: 1251339 - RNA, 17 nt, Human
aaguaaaacaaacaaua

SEQ ID NO: 1251340 - RNA, 12 nt, Human
aaguaaacuuuu

SEQ ID NO: 1251341 - RNA, 12 nt, Human
aaguaaauacaa

SEQ ID NO: 1251342 - RNA, 13 nt, Human
aaguaaauacaau

SEQ ID NO: 1251343 - RNA, 15 nt, Human
aaguaaauacaauuu

SEQ ID NO: 1251344 - RNA, 17 nt, Human
aaguaaauacaauuuuu

SEQ ID NO: 1251345 - RNA, 17 nt, Human
guuucuaagauucuaaa

SEQ ID NO: 1251346 - RNA, 18 nt, Human
guuucuaagauucuaaag

SEQ ID NO: 1251347 - RNA, 19 nt, Human
guuucuaagauucuaaagg

SEQ ID NO: 1251348 - RNA, 20 nt, Human
guuucuaagauucuaaaggu

SEQ ID NO: 1251349 - RNA, 21 nt, Human
guuucuaagauucuaaagguc

SEQ ID NO: 1251350 - RNA, 11 nt, Human
guuucuaaggu

SEQ ID NO: 1251351 - RNA, 22 nt, Human
guuucuaagguccgguguucua

SEQ ID NO: 1251352 - RNA, 11 nt, Human
aagggucaggc

SEQ ID NO: 1251353 - RNA, 12 nt, Human
aagggucaggcc

SEQ ID NO: 1251354 - RNA, 13 nt, Human
aagggucaggccu

SEQ ID NO: 1251355 - RNA, 14 nt, Human
aagggucaggccuu

SEQ ID NO: 1251356 - RNA, 20 nt, Human
aagggucaggccuuugagcu

SEQ ID NO: 1251357 - RNA, 16 nt, Human
aagggucaggccuuug

SEQ ID NO: 1251358 - RNA, 21 nt, Human
aaggguguugggagggugguu

SEQ ID NO: 1251359 - RNA, 14 nt, Human
aaggguugagcugg

SEQ ID NO: 1251360 - RNA, 20 nt, Human
aauaagcuauuugauguaau

SEQ ID NO: 1251361 - RNA, 14 nt, Human
aauaaggaaaagcu

SEQ ID NO: 1251362 - RNA, 15 nt, Human
aauaaggaaaagcuu

SEQ ID NO: 1251363 - RNA, 16 nt, Human
aauaaggcacccaucu

SEQ ID NO: 1251364 - RNA, 12 nt, Human
aauaaggcaggg

SEQ ID NO: 1251365 - RNA, 18 nt, Human
aauaaggcacccaucugu

SEQ ID NO: 1251366 - RNA, 19 nt, Human
aauaagguacaagaagcau

SEQ ID NO: 1251367 - RNA, 14 nt, Human
aauaagguugaaca

SEQ ID NO: 1251368 - RNA, 13 nt, Human
aauaagguuuuaa

SEQ ID NO: 1251369 - RNA, 15 nt, Human
aauaagguacaagaa

SEQ ID NO: 1251370 - RNA, 14 nt, Human
aauaagucaacagu

SEQ ID NO: 1251371 - RNA, 15 nt, Human
aauaagucaacagua

SEQ ID NO: 1251372 - RNA, 16 nt, Human
aauaagucaacaguaa

SEQ ID NO: 1251373 - RNA, 22 nt, Human
aauaagucaacaguaaaccacu

SEQ ID NO: 1251374 - RNA, 14 nt, Human
aauaagcuauuuga

SEQ ID NO: 1251375 - RNA, 16 nt, Human
aauaagcuauuugaug

SEQ ID NO: 1251376 - RNA, 18 nt, Human
aauaagcuauuugaugua

SEQ ID NO: 1251377 - RNA, 21 nt, Human
aauaagcuauuugauguaaua

SEQ ID NO: 1251378 - RNA, 12 nt, Human
aauaagauucua

SEQ ID NO: 1251379 - RNA, 13 nt, Human
aauaagauucuaa

SEQ ID NO: 1251380 - RNA, 14 nt, Human
aauaagauucuaac

SEQ ID NO: 1251381 - RNA, 14 nt, Human
aauaagcaggugga

SEQ ID NO: 1251382 - RNA, 18 nt, Human
aauaagcagguggaucua

SEQ ID NO: 1251383 - RNA, 23 nt, Human
aauaagcagguggaucuauuuca

SEQ ID NO: 1251384 - RNA, 22 nt, Human
aauaacguuuaagccaaaacaa

SEQ ID NO: 1251385 - RNA, 19 nt, Human
aauaacuccucauuguaaa

SEQ ID NO: 1251386 - RNA, 14 nt, Human
aauaacuccuccca

SEQ ID NO: 1251387 - RNA, 16 nt, Human
aauaacuccucccagg

SEQ ID NO: 1251388 - RNA, 17 nt, Human
aauaacuccucccaggg

SEQ ID NO: 1251389 - RNA, 22 nt, Human
aauaacuccucccaggguuuua

SEQ ID NO: 1251390 - RNA, 14 nt, Human
aauaagaucuuuuu

SEQ ID NO: 1251391 - RNA, 19 nt, Human
aauaaauaaggaaaagcuu

SEQ ID NO: 1251392 - RNA, 15 nt, Human
aauaaauauaucuac

SEQ ID NO: 1251393 - RNA, 23 nt, Human
aauaaauauaucuaccccagacu

SEQ ID NO: 1251394 - RNA, 20 nt, Human
aauaaauauccuuuaauuga

SEQ ID NO: 1251395 - RNA, 15 nt, Human
aauaacaauaaaaga

SEQ ID NO: 1251396 - RNA, 22 nt, Human
aauaaauuuuuuauaaaagugu

SEQ ID NO: 1251397 - RNA, 22 nt, Human
aauaacaaaugccaaauuaaaa

SEQ ID NO: 1251398 - RNA, 18 nt, Human
aauaacaaaugccaaauu

SEQ ID NO: 1251399 - RNA, 14 nt, Human
aauaacagauuucu

SEQ ID NO: 1251400 - RNA, 15 nt, Human
aauaacagauuucuc

SEQ ID NO: 1251401 - RNA, 15 nt, Human
aauaaaaaagauccc

SEQ ID NO: 1251402 - RNA, 19 nt, Human
uaaaguguaacaauugugu

SEQ ID NO: 1251403 - RNA, 20 nt, Human
uaaagugcuaagguucuaag

SEQ ID NO: 1251404 - RNA, 21 nt, Human
uaaagugcuaagguucuaagg

SEQ ID NO: 1251405 - RNA, 22 nt, Human
uaaagugcuaagguucuaaggc

SEQ ID NO: 1251406 - RNA, 20 nt, Human
uaaagugacccugcucucac

SEQ ID NO: 1251407 - RNA, 17 nt, Human
uaaagugacccugcucu

SEQ ID NO: 1251408 - RNA, 22 nt, Human
uaaagucuguugauuaaagaug

SEQ ID NO: 1251409 - RNA, 19 nt, Human
uaaagugacuaauggcaug

SEQ ID NO: 1251410 - RNA, 15 nt, Human
uaaagugauauuucc

SEQ ID NO: 1251411 - RNA, 16 nt, Human
uaaagugauauuuccc

SEQ ID NO: 1251412 - RNA, 15 nt, Human
uaaagugccaguauu

SEQ ID NO: 1251413 - RNA, 18 nt, Human
uaaagugccaguauuuua

SEQ ID NO: 1251414 - RNA, 22 nt, Human
uaaagugccaguauuuuaaaau

SEQ ID NO: 1251415 - RNA, 23 nt, Human
uaaagugccaguauuuuaaaaua

SEQ ID NO: 1251416 - RNA, 15 nt, Human
uaaagugcuaagguu

SEQ ID NO: 1251417 - RNA, 16 nt, Human
uaaagugcuaagguuc

SEQ ID NO: 1251418 - RNA, 17 nt, Human
uaaagugcuaagguucu

SEQ ID NO: 1251419 - RNA, 18 nt, Human
uaaagugcuaagguucua

SEQ ID NO: 1251420 - RNA, 19 nt, Human
uaaagugcuaagguucuaa

SEQ ID NO: 1251421 - RNA, 15 nt, Human
uaaagucagauggaa

SEQ ID NO: 1251422 - RNA, 17 nt, Human
uaaagucagauggaaaa

SEQ ID NO: 1251423 - RNA, 21 nt, Human
uaaagucuguugauuaaagau

SEQ ID NO: 1251424 - RNA, 12 nt, Human
aauaaaaauaau

SEQ ID NO: 1251425 - RNA, 15 nt, Human
aauaaaaagaaaggc

SEQ ID NO: 1251426 - RNA, 14 nt, Human
aauaaaaauguuua

SEQ ID NO: 1251427 - RNA, 15 nt, Human
aauaaaaauguuuaa

SEQ ID NO: 1251428 - RNA, 20 nt, Human
aauaaaaggaagccaaagag

SEQ ID NO: 1251429 - RNA, 21 nt, Human
aauaaaaggaagccaaagagu

SEQ ID NO: 1251430 - RNA, 16 nt, Human
aauaaaagugaccuuu

SEQ ID NO: 1251431 - RNA, 22 nt, Human
aauaaaauccauacauuugugu

SEQ ID NO: 1251432 - RNA, 16 nt, Human
aauaaaaucuugaaaa

SEQ ID NO: 1251433 - RNA, 16 nt, Human
aauaaaguacaagagc

SEQ ID NO: 1251434 - RNA, 15 nt, Human
aauaaaggcaguuuu

SEQ ID NO: 1251435 - RNA, 16 nt, Human
aauaaaggcaguuuuc

SEQ ID NO: 1251436 - RNA, 18 nt, Human
aauaaaggcaguuuucua

SEQ ID NO: 1251437 - RNA, 19 nt, Human
aauaaaggcaguuuucuaa

SEQ ID NO: 1251438 - RNA, 19 nt, Human
uaaauacaauuuuuuuuau

SEQ ID NO: 1251439 - RNA, 12 nt, Human
uaaauagcuuuu

SEQ ID NO: 1251440 - RNA, 19 nt, Human
uaaauaguaaaaauaaaau

SEQ ID NO: 1251441 - RNA, 20 nt, Human
uaaauaguaaaaauaaaauu

SEQ ID NO: 1251442 - RNA, 12 nt, Human
uaaauauaaaga

SEQ ID NO: 1251443 - RNA, 13 nt, Human
uaaauauaaagac

SEQ ID NO: 1251444 - RNA, 14 nt, Human
uaaauauaaagacg

SEQ ID NO: 1251445 - RNA, 17 nt, Human
uaaauauaaagacguuu

SEQ ID NO: 1251446 - RNA, 23 nt, Human
uaaauauaaagacguuuuauaag

SEQ ID NO: 1251447 - RNA, 13 nt, Human
uaaauaguauuuc

SEQ ID NO: 1251448 - RNA, 21 nt, Human
uaaauaggcggggcuugccuu

SEQ ID NO: 1251449 - RNA, 22 nt, Human
uaaauaggcggggcuugccuuc

SEQ ID NO: 1251450 - RNA, 12 nt, Human
uaaauaguauuu

SEQ ID NO: 1251451 - RNA, 15 nt, Human
uaaaucuacacacgg

SEQ ID NO: 1251452 - RNA, 13 nt, Human
uaaaucuacacac

SEQ ID NO: 1251453 - RNA, 17 nt, Human
uaaauccuuuacuguua

SEQ ID NO: 1251454 - RNA, 17 nt, Human
aauacaaguuucaucca

SEQ ID NO: 1251455 - RNA, 20 nt, Human
aauacaauuuuuuuuauuag

SEQ ID NO: 1251456 - RNA, 13 nt, Human
uaaauaaauuuga

SEQ ID NO: 1251457 - RNA, 14 nt, Human
uaaauaaauuugac

SEQ ID NO: 1251458 - RNA, 16 nt, Human
uaaauaaauuugacuu

SEQ ID NO: 1251459 - RNA, 14 nt, Human
uaaauaacuggaaa

SEQ ID NO: 1251460 - RNA, 15 nt, Human
uaaauaacuggaaaa

SEQ ID NO: 1251461 - RNA, 23 nt, Human
uaaauguuuuuuuuuaaagacuu

SEQ ID NO: 1251462 - RNA, 20 nt, Human
uaaauguuuuuuuuuaaaga

SEQ ID NO: 1251463 - RNA, 16 nt, Human
uaaauuacagaaauuu

SEQ ID NO: 1251464 - RNA, 13 nt, Human
uaaauuuguacua

SEQ ID NO: 1251465 - RNA, 14 nt, Human
uaaauuuguacuau

SEQ ID NO: 1251466 - RNA, 19 nt, Human
uaaauuuguacuauuuaac

SEQ ID NO: 1251467 - RNA, 20 nt, Human
uaaauuuguacuauuuaacu

SEQ ID NO: 1251468 - RNA, 22 nt, Human
uaaauuuguacuauuuaacuga

SEQ ID NO: 1251469 - RNA, 13 nt, Human
uaaaugaauguuu

SEQ ID NO: 1251470 - RNA, 13 nt, Human
uaaaugacacuca

SEQ ID NO: 1251471 - RNA, 17 nt, Human
uaaaugauuucauucaa

SEQ ID NO: 1251472 - RNA, 17 nt, Human
uaaaugauucuuaguga

SEQ ID NO: 1251473 - RNA, 19 nt, Human
uaaaugcaaccauuugaaa

SEQ ID NO: 1251474 - RNA, 15 nt, Human
uaaaugcaaauaaca

SEQ ID NO: 1251475 - RNA, 16 nt, Human
uaaaugcaaauaacaa

SEQ ID NO: 1251476 - RNA, 17 nt, Human
uaaaugcaaauaacaaa

SEQ ID NO: 1251477 - RNA, 14 nt, Human
uaacaacauguuuc

SEQ ID NO: 1251478 - RNA, 19 nt, Human
uaacaacauguuuccagca

SEQ ID NO: 1251479 - RNA, 20 nt, Human
uaacaacauguuuccagcau

SEQ ID NO: 1251480 - RNA, 21 nt, Human
uaacaacauguuuccagcauu

SEQ ID NO: 1251481 - RNA, 13 nt, Human
uaacaaaaauaaa

SEQ ID NO: 1251482 - RNA, 20 nt, Human
uaacaaaugccaaauuaaaa

SEQ ID NO: 1251483 - RNA, 20 nt, Human
uaacaaaaauaaaaacucuu

SEQ ID NO: 1251484 - RNA, 21 nt, Human
uaaauuuguacuauuuaacug

SEQ ID NO: 1251485 - RNA, 16 nt, Human
uaaauuuuccuguccu

SEQ ID NO: 1251486 - RNA, 18 nt, Human
uaaauuuuccuguccucu

SEQ ID NO: 1251487 - RNA, 23 nt, Human
uaaauuuuccuguccucuuucag

SEQ ID NO: 1251488 - RNA, 24 nt, Human
uaaauuuuccuguccucuuucagc

SEQ ID NO: 1251489 - RNA, 15 nt, Human
uaacaaugcuguauu

SEQ ID NO: 1251490 - RNA, 17 nt, Human
uaacaaugcuguauuuu

SEQ ID NO: 1251491 - RNA, 15 nt, Human
uaacaagccagauuu

SEQ ID NO: 1251492 - RNA, 16 nt, Human
uaacaacuaugauuug

SEQ ID NO: 1251493 - RNA, 21 nt, Human
uaacaacuaugauuuggaaaa

SEQ ID NO: 1251494 - RNA, 22 nt, Human
uaacaacuaugauuuggaaaau

SEQ ID NO: 1251495 - RNA, 15 nt, Human
uaacaaccaaagacu

SEQ ID NO: 1251496 - RNA, 19 nt, Human
uaacaagaacuuuaaauug

SEQ ID NO: 1251497 - RNA, 13 nt, Human
uaaacgucuuaaa

SEQ ID NO: 1251498 - RNA, 17 nt, Human
uaaacgucuuaaauauu

SEQ ID NO: 1251499 - RNA, 14 nt, Human
uaaacguggauguu

SEQ ID NO: 1251500 - RNA, 18 nt, Human
uaaacguggauguuacuc

SEQ ID NO: 1251501 - RNA, 13 nt, Human
uaaacuaaacacg

SEQ ID NO: 1251502 - RNA, 13 nt, Human
uaaacuaaaugug

SEQ ID NO: 1251503 - RNA, 14 nt, Human
uaaacuaaaugugc

SEQ ID NO: 1251504 - RNA, 16 nt, Human
uaaacuaauaauugca

SEQ ID NO: 1251505 - RNA, 17 nt, Human
uaaacuaauaauugcag

SEQ ID NO: 1251506 - RNA, 13 nt, Human
uaaaccuuuuuug

SEQ ID NO: 1251507 - RNA, 15 nt, Human
uaaacgaaacaaaga

SEQ ID NO: 1251508 - RNA, 22 nt, Human
uaaacgaaacaaagacaauuua

SEQ ID NO: 1251509 - RNA, 16 nt, Human
uaaacgauuuuuaaaa

SEQ ID NO: 1251510 - RNA, 17 nt, Human
uaaacgauuuuuaaaau

SEQ ID NO: 1251511 - RNA, 18 nt, Human
uaaacgauuuuuaaaaug

SEQ ID NO: 1251512 - RNA, 19 nt, Human
uaaacgauuuuuaaaaugu

SEQ ID NO: 1251513 - RNA, 20 nt, Human
uaaacgauuuuuaaaaugua

SEQ ID NO: 1251514 - RNA, 21 nt, Human
uaaacgauuuuuaaaauguac

SEQ ID NO: 1251515 - RNA, 15 nt, Human
uaaacggauuccaaa

SEQ ID NO: 1251516 - RNA, 22 nt, Human
uaaaccccaccccaaaauuagc

SEQ ID NO: 1251517 - RNA, 20 nt, Human
uaaaccccaccuuuauuccu

SEQ ID NO: 1251518 - RNA, 23 nt, Human
uaaacccauauuguaaaacaggu

SEQ ID NO: 1251519 - RNA, 22 nt, Human
uaaaccaucucccuggugcuua

SEQ ID NO: 1251520 - RNA, 14 nt, Human
uaaaccauugugca

SEQ ID NO: 1251521 - RNA, 16 nt, Human
uaaaccaucucccugg

SEQ ID NO: 1251522 - RNA, 19 nt, Human
uaaaccaucucccuggugc

SEQ ID NO: 1251523 - RNA, 16 nt, Human
uaaaccggaccaucuc

SEQ ID NO: 1251524 - RNA, 17 nt, Human
uaaaccgcuaaaagaaa

SEQ ID NO: 1251525 - RNA, 11 nt, Human
uaaagaaagug

SEQ ID NO: 1251526 - RNA, 13 nt, Human
uaaagaaagugua

SEQ ID NO: 1251527 - RNA, 14 nt, Human
uaaagaaaguguau

SEQ ID NO: 1251528 - RNA, 15 nt, Human
uaaagaaaguguauu

SEQ ID NO: 1251529 - RNA, 16 nt, Human
uaaagaaaguguauuu

SEQ ID NO: 1251530 - RNA, 17 nt, Human
uaaagaaaguguauuug

SEQ ID NO: 1251531 - RNA, 12 nt, Human
uaaacugccccc

SEQ ID NO: 1251532 - RNA, 15 nt, Human
uaaacucuguugcaa

SEQ ID NO: 1251533 - RNA, 17 nt, Human
uaaacuauaagcaagaa

SEQ ID NO: 1251534 - RNA, 15 nt, Human
uaaacuauaagcaag

SEQ ID NO: 1251535 - RNA, 20 nt, Human
uaaacuaucuuggugaauuu

SEQ ID NO: 1251536 - RNA, 21 nt, Human
uaaacuaucuuggugaauuuu

SEQ ID NO: 1251537 - RNA, 22 nt, Human
uaaacuaucuuggugaauuuuu

SEQ ID NO: 1251538 - RNA, 14 nt, Human
uaaacucaaaauau

SEQ ID NO: 1251539 - RNA, 16 nt, Human
uaaacucaaaauauuu

SEQ ID NO: 1251540 - RNA, 19 nt, Human
uaaacucaaaauauuugua

SEQ ID NO: 1251541 - RNA, 21 nt, Human
uaaacucaaaauauuuguaca

SEQ ID NO: 1251542 - RNA, 22 nt, Human
uaaacucaaaauauuuguacau

SEQ ID NO: 1251543 - RNA, 23 nt, Human
uaaacucaaaauauuuguacaua

SEQ ID NO: 1251544 - RNA, 16 nt, Human
uaaagacuuuuaugau

SEQ ID NO: 1251545 - RNA, 16 nt, Human
uaaagacguuuuauaa

SEQ ID NO: 1251546 - RNA, 21 nt, Human
uaaagacguuuuauaagcauc

SEQ ID NO: 1251547 - RNA, 23 nt, Human
uaaagacguuuuauaagcaucau

SEQ ID NO: 1251548 - RNA, 14 nt, Human
uaaagacuggcuuu

SEQ ID NO: 1251549 - RNA, 20 nt, Human
uaaagacuggcuuuuauuaa

SEQ ID NO: 1251550 - RNA, 15 nt, Human
uaaagacuggcuuuu

SEQ ID NO: 1251551 - RNA, 22 nt, Human
uaaagagacagugauauuggaa

SEQ ID NO: 1251552 - RNA, 15 nt, Human
uaaagacaccuacug

SEQ ID NO: 1251553 - RNA, 13 nt, Human
uaaagacaugaag

SEQ ID NO: 1251554 - RNA, 16 nt, Human
uaaagacaugaagcca

SEQ ID NO: 1251555 - RNA, 11 nt, Human
uaaagacauuc

SEQ ID NO: 1251556 - RNA, 14 nt, Human
uaaagaagguuuca

SEQ ID NO: 1251557 - RNA, 15 nt, Human
uaaagaauucaaauu

SEQ ID NO: 1251558 - RNA, 14 nt, Human
uaaagaauucaaau

SEQ ID NO: 1251559 - RNA, 15 nt, Human
uaaagaauuauuuug

SEQ ID NO: 1251560 - RNA, 16 nt, Human
uaaagaauuauuuugu

SEQ ID NO: 1251561 - RNA, 17 nt, Human
uaaagaauaugaaacau

SEQ ID NO: 1251562 - RNA, 13 nt, Human
uaaagaauuauuu

SEQ ID NO: 1251563 - RNA, 20 nt, Human
uaaagaauugugguuuauau

SEQ ID NO: 1251564 - RNA, 18 nt, Human
uaaagaauugugguuuau

SEQ ID NO: 1251565 - RNA, 14 nt, Human
uaaagacaaaaaac

SEQ ID NO: 1251566 - RNA, 20 nt, Human
uaaagaaaguguauuuggaa

SEQ ID NO: 1251567 - RNA, 23 nt, Human
uaaagaaaguguauuuggaaaua

SEQ ID NO: 1251568 - RNA, 24 nt, Human
uaaagaaaguguauuuggaaauaa

SEQ ID NO: 1251569 - RNA, 17 nt, Human
uaaagaaauagaacaag

SEQ ID NO: 1251570 - RNA, 16 nt, Human
uaaagaaauagaacaa

SEQ ID NO: 1251571 - RNA, 15 nt, Human
uaaagaacauaaaua

SEQ ID NO: 1251572 - RNA, 13 nt, Human
uaaagaacaaagu

SEQ ID NO: 1251573 - RNA, 19 nt, Human
uaaagaacacccuauauuu

SEQ ID NO: 1251574 - RNA, 13 nt, Human
uaaagaagaaaaa

SEQ ID NO: 1251575 - RNA, 23 nt, Human
uaaagaagaaaaaaaaaaauuca

SEQ ID NO: 1251576 - RNA, 11 nt, Human
uaaagaagacc

SEQ ID NO: 1251577 - RNA, 12 nt, Human
uaaagaagaccu

SEQ ID NO: 1251578 - RNA, 16 nt, Human
uaaagaagaccugaga

SEQ ID NO: 1251579 - RNA, 20 nt, Human
uaaagaagaccugagaaugu

SEQ ID NO: 1251580 - RNA, 21 nt, Human
uaaagaagaccugagaaugua

SEQ ID NO: 1251581 - RNA, 10 nt, Human
uaaagcaaaa

SEQ ID NO: 1251582 - RNA, 10 nt, Human
uaaagcaaau

SEQ ID NO: 1251583 - RNA, 22 nt, Human
uaaagauuuuuuaauaauuuag

SEQ ID NO: 1251584 - RNA, 19 nt, Human
uaaagauggaguuucuaag

SEQ ID NO: 1251585 - RNA, 21 nt, Human
uaaagauggaguuucuaaggu

SEQ ID NO: 1251586 - RNA, 22 nt, Human
uaaagauggaguuucuaagguc

SEQ ID NO: 1251587 - RNA, 19 nt, Human
uaaagauucuauaguucua

SEQ ID NO: 1251588 - RNA, 20 nt, Human
uaaagauucuauaguucuag

SEQ ID NO: 1251589 - RNA, 21 nt, Human
uaaagauucuauaguucuaga

SEQ ID NO: 1251590 - RNA, 24 nt, Human
uaaagauucuauaguucuagacau

SEQ ID NO: 1251591 - RNA, 13 nt, Human
uaaagauuugggu

SEQ ID NO: 1251592 - RNA, 15 nt, Human
uaaagauuuuuguuu

SEQ ID NO: 1251593 - RNA, 12 nt, Human
uaaagauuuuuu

SEQ ID NO: 1251594 - RNA, 16 nt, Human
uaaagauuuuuuaaua

SEQ ID NO: 1251595 - RNA, 17 nt, Human
uaaagauuuuuuaauaa

SEQ ID NO: 1251596 - RNA, 20 nt, Human
uaaagauuuuuuaauaauuu

SEQ ID NO: 1251597 - RNA, 21 nt, Human
uaaagauuuuuuaauaauuua

SEQ ID NO: 1251598 - RNA, 19 nt, Human
uaaagagucuagauucaaa

SEQ ID NO: 1251599 - RNA, 21 nt, Human
uaaagagucuagauucaaagg

SEQ ID NO: 1251600 - RNA, 13 nt, Human
uaaagagucuaga

SEQ ID NO: 1251601 - RNA, 15 nt, Human
uaaagagucuagauu

SEQ ID NO: 1251602 - RNA, 18 nt, Human
uaaagagucuagauucaa

SEQ ID NO: 1251603 - RNA, 18 nt, Human
uaaagaguuaguuugagu

SEQ ID NO: 1251604 - RNA, 13 nt, Human
uaaagagacgaau

SEQ ID NO: 1251605 - RNA, 23 nt, Human
uaaagauacagaacucuuucaaa

SEQ ID NO: 1251606 - RNA, 23 nt, Human
uaaagagucuagauucaaagguu

SEQ ID NO: 1251607 - RNA, 18 nt, Human
uaaagauauuuuuaucuu

SEQ ID NO: 1251608 - RNA, 21 nt, Human
uaaagauauuuuuaucuuuau

SEQ ID NO: 1251609 - RNA, 22 nt, Human
uaaagauauuuuuaucuuuaua

SEQ ID NO: 1251610 - RNA, 19 nt, Human
uaaagaugagcuuugucua

SEQ ID NO: 1251611 - RNA, 17 nt, Human
uaaagauggaguuucua

SEQ ID NO: 1251612 - RNA, 18 nt, Human
uaaagauggaguuucuaa

SEQ ID NO: 1251613 - RNA, 22 nt, Human
aaguuuaguuugaggaauucuu

SEQ ID NO: 1251614 - RNA, 23 nt, Human
aaguuuagccccugaaagccaug

SEQ ID NO: 1251615 - RNA, 13 nt, Human
aaguuuagcucug

SEQ ID NO: 1251616 - RNA, 14 nt, Human
aaguuuagcucuga

SEQ ID NO: 1251617 - RNA, 15 nt, Human
aaguuuagcucugag

SEQ ID NO: 1251618 - RNA, 16 nt, Human
aaguuuagcucugaga

SEQ ID NO: 1251619 - RNA, 18 nt, Human
aaguuuaucaguaaauaa

SEQ ID NO: 1251620 - RNA, 20 nt, Human
aaguuuaucaguaaauaacu

SEQ ID NO: 1251621 - RNA, 15 nt, Human
aaguuucaucauuuu

SEQ ID NO: 1251622 - RNA, 23 nt, Human
aaguuucauucucccuuucacua

SEQ ID NO: 1251623 - RNA, 19 nt, Human
aaguuugcacuaucuuuca

SEQ ID NO: 1251624 - RNA, 21 nt, Human
aaguuugcacuaucuuucagc

SEQ ID NO: 1251625 - RNA, 20 nt, Human
aaguuugcacuaucuuucag

SEQ ID NO: 1251626 - RNA, 16 nt, Human
aaguuuguuuuugcgu

SEQ ID NO: 1251627 - RNA, 17 nt, Human
aaguuuuaaaaagccag

SEQ ID NO: 1251628 - RNA, 19 nt, Human
aaguuuuaaaaagccaguu

SEQ ID NO: 1251629 - RNA, 13 nt, Human
aaguuuuauauau

SEQ ID NO: 1251630 - RNA, 14 nt, Human
aaguuuuauauauu

SEQ ID NO: 1251631 - RNA, 15 nt, Human
aaguuuuauauauua

SEQ ID NO: 1251632 - RNA, 16 nt, Human
aaguuuuauauauuau

SEQ ID NO: 1251633 - RNA, 17 nt, Human
aaguuuuauauauuaua

SEQ ID NO: 1251634 - RNA, 21 nt, Human
aaguuuuauauauuauaugga

SEQ ID NO: 1251635 - RNA, 23 nt, Human
aaguuuuauauauuauauggaaa

SEQ ID NO: 1251636 - RNA, 17 nt, Human
uaaaauguucacuuuug

SEQ ID NO: 1251637 - RNA, 22 nt, Human
uaaaauguucacuuuugacaaa

SEQ ID NO: 1251638 - RNA, 19 nt, Human
uaaaauuuuuaaucuuuaa

SEQ ID NO: 1251639 - RNA, 13 nt, Human
uaaaccacugaaa

SEQ ID NO: 1251640 - RNA, 20 nt, Human
uaaaccacugaaaaaauaua

SEQ ID NO: 1251641 - RNA, 13 nt, Human
uaaaccaucuccc

SEQ ID NO: 1251642 - RNA, 18 nt, Human
uaaacaaacuguguaacu

SEQ ID NO: 1251643 - RNA, 19 nt, Human
uaaacaaacuguguaacug

SEQ ID NO: 1251644 - RNA, 22 nt, Human
uaaacaaacuguguaacugccc

SEQ ID NO: 1251645 - RNA, 13 nt, Human
uaaacaaagguug

SEQ ID NO: 1251646 - RNA, 17 nt, Human
uaaaauuuuuaaucuuu

SEQ ID NO: 1251647 - RNA, 20 nt, Human
uaaaauuauagcucuaaugu

SEQ ID NO: 1251648 - RNA, 21 nt, Human
uaaaauuauagcucuaauguu

SEQ ID NO: 1251649 - RNA, 13 nt, Human
uaaaauuauuuca

SEQ ID NO: 1251650 - RNA, 14 nt, Human
uaaaauuuguugca

SEQ ID NO: 1251651 - RNA, 15 nt, Human
uaaaauuuguugcau

SEQ ID NO: 1251652 - RNA, 15 nt, Human
uaaaauuauuucaug

SEQ ID NO: 1251653 - RNA, 20 nt, Human
uaaaauuuguucuuguauuu

SEQ ID NO: 1251654 - RNA, 19 nt, Human
uaaaauuacaacuaaguga

SEQ ID NO: 1251655 - RNA, 17 nt, Human
uaaaauuacaacuaagu

SEQ ID NO: 1251656 - RNA, 15 nt, Human
uaaaauuacaacuaa

SEQ ID NO: 1251657 - RNA, 13 nt, Human
uaaaauuacaacu

SEQ ID NO: 1251658 - RNA, 18 nt, Human
uaaaauuauagcucuaau

SEQ ID NO: 1251659 - RNA, 16 nt, Human
uaaaauuauagcucua

SEQ ID NO: 1251660 - RNA, 15 nt, Human
uaaaauuauagcucu

SEQ ID NO: 1251661 - RNA, 16 nt, Human
uaaaauuaaagcugaa

SEQ ID NO: 1251662 - RNA, 18 nt, Human
uaaaauuaaagcugaaaa

SEQ ID NO: 1251663 - RNA, 19 nt, Human
uaaaauuaaagcugaaaac

SEQ ID NO: 1251664 - RNA, 17 nt, Human
aaguucugcagauaaac

SEQ ID NO: 1251665 - RNA, 20 nt, Human
aaguuuaauggugccuucau

SEQ ID NO: 1251666 - RNA, 16 nt, Human
aaguuuaccagaaagc

SEQ ID NO: 1251667 - RNA, 17 nt, Human
aaguuuagauuuuaauc

SEQ ID NO: 1251668 - RNA, 21 nt, Human
aaguuuagccccugaaagcca

SEQ ID NO: 1251669 - RNA, 15 nt, Human
aaguuccaagagucu

SEQ ID NO: 1251670 - RNA, 16 nt, Human
aaguuccaagagucua

SEQ ID NO: 1251671 - RNA, 17 nt, Human
aaguuccaagagucuaa

SEQ ID NO: 1251672 - RNA, 20 nt, Human
aaguuccaagagucuaaaga

SEQ ID NO: 1251673 - RNA, 21 nt, Human
aaguuccaagagucuaaagau

SEQ ID NO: 1251674 - RNA, 19 nt, Human
aaguuccaaguugcuaaua

SEQ ID NO: 1251675 - RNA, 12 nt, Human
aaguucuaagau

SEQ ID NO: 1251676 - RNA, 14 nt, Human
aaguucuaagauuc

SEQ ID NO: 1251677 - RNA, 15 nt, Human
aaguucuaagauucu

SEQ ID NO: 1251678 - RNA, 16 nt, Human
aaguucuaagauucua

SEQ ID NO: 1251679 - RNA, 18 nt, Human
aaguucuaagauucuaau

SEQ ID NO: 1251680 - RNA, 19 nt, Human
aaguucuaagauucuaaug

SEQ ID NO: 1251681 - RNA, 20 nt, Human
aaguucuaagauucuaauga

SEQ ID NO: 1251682 - RNA, 21 nt, Human
aaguucuaagauucuaaugau

SEQ ID NO: 1251683 - RNA, 16 nt, Human
aaguucuaagauucug

SEQ ID NO: 1251684 - RNA, 17 nt, Human
aaguucuaagauucuga

SEQ ID NO: 1251685 - RNA, 17 nt, Human
aaguucuaauaauuucu

SEQ ID NO: 1251686 - RNA, 18 nt, Human
aaguucuaauaauuucua

SEQ ID NO: 1251687 - RNA, 19 nt, Human
aaguucuaauaauuucuaa

SEQ ID NO: 1251688 - RNA, 21 nt, Human
aaguucuaauaauuucuaaug

SEQ ID NO: 1251689 - RNA, 14 nt, Human
aaguuauugcaguu

SEQ ID NO: 1251690 - RNA, 15 nt, Human
aaguuauugcaguuu

SEQ ID NO: 1251691 - RNA, 17 nt, Human
aaguuauugcaguuuau

SEQ ID NO: 1251692 - RNA, 23 nt, Human
aaguuauugcaguuuaucauuca

SEQ ID NO: 1251693 - RNA, 17 nt, Human
guuuuuuuuuaaagacu

SEQ ID NO: 1251694 - RNA, 17 nt, Human
guuuuuuuuuucuuguc

SEQ ID NO: 1251695 - RNA, 17 nt, Human
guuuuuuuuuuguuugu

SEQ ID NO: 1251696 - RNA, 18 nt, Human
guuuuuuuuuucuugucu

SEQ ID NO: 1251697 - RNA, 21 nt, Human
guuuuuuuuuucuugucuaua

SEQ ID NO: 1251698 - RNA, 16 nt, Human
guuuuuuuuuuguuug

SEQ ID NO: 1251699 - RNA, 23 nt, Human
aaguguuagccuuuuuuccccag

SEQ ID NO: 1251700 - RNA, 22 nt, Human
aaguguuagccuuuuuucccca

SEQ ID NO: 1251701 - RNA, 14 nt, Human
aaguguucauuguu

SEQ ID NO: 1251702 - RNA, 23 nt, Human
aaguguuucauaaauuugagagu

SEQ ID NO: 1251703 - RNA, 13 nt, Human
aaguguuuucucu

SEQ ID NO: 1251704 - RNA, 22 nt, Human
aaguguuuucucugaacacauu

SEQ ID NO: 1251705 - RNA, 14 nt, Human
aaguguuuucucug

SEQ ID NO: 1251706 - RNA, 13 nt, Human
aaguuaaauguag

SEQ ID NO: 1251707 - RNA, 17 nt, Human
aaguuaaauguagaguu

SEQ ID NO: 1251708 - RNA, 16 nt, Human
aaguuacauguuugca

SEQ ID NO: 1251709 - RNA, 19 nt, Human
aaguuacauguuugcaccu

SEQ ID NO: 1251710 - RNA, 20 nt, Human
aaguuacauguuugcaccuu

SEQ ID NO: 1251711 - RNA, 22 nt, Human
aaguuagaacuagccaaaccag

SEQ ID NO: 1251712 - RNA, 17 nt, Human
aaguuauuaauuucuuc

SEQ ID NO: 1251713 - RNA, 18 nt, Human
aaguuauuaauuucuuca

SEQ ID NO: 1251714 - RNA, 17 nt, Human
guguugaaaauguucag

SEQ ID NO: 1251715 - RNA, 19 nt, Human
guguugagccuuuucccuc

SEQ ID NO: 1251716 - RNA, 22 nt, Human
guguugagcaucugucccccuu

SEQ ID NO: 1251717 - RNA, 13 nt, Human
guguugauacugu

SEQ ID NO: 1251718 - RNA, 13 nt, Human
guguuuaagacau

SEQ ID NO: 1251719 - RNA, 14 nt, Human
guguuuaagacauu

SEQ ID NO: 1251720 - RNA, 14 nt, Human
guguugauacuguu

SEQ ID NO: 1251721 - RNA, 12 nt, Human
guguuuaaaacu

SEQ ID NO: 1251722 - RNA, 21 nt, Human
guguuuaaaguucaacauguu

SEQ ID NO: 1251723 - RNA, 16 nt, Human
guguguuaagcucugc

SEQ ID NO: 1251724 - RNA, 17 nt, Human
guguguuaagcucugcu

SEQ ID NO: 1251725 - RNA, 16 nt, Human
guguguugauacuguu

SEQ ID NO: 1251726 - RNA, 14 nt, Human
guguguugauacug

SEQ ID NO: 1251727 - RNA, 15 nt, Human
guguucuguuuuguu

SEQ ID NO: 1251728 - RNA, 13 nt, Human
guguucuguuuug

SEQ ID NO: 1251729 - RNA, 16 nt, Human
guguugaaaauguuca

SEQ ID NO: 1251730 - RNA, 15 nt, Human
guguguguguguaug

SEQ ID NO: 1251731 - RNA, 19 nt, Human
guguguguaugcgugugug

SEQ ID NO: 1251732 - RNA, 15 nt, Human
guguguguauauaua

SEQ ID NO: 1251733 - RNA, 13 nt, Human
gugugugugaaug

SEQ ID NO: 1251734 - RNA, 19 nt, Human
aagcaaguaaaaaggcuaa

SEQ ID NO: 1251735 - RNA, 21 nt, Human
aagcaagcauucagaagaaaa

SEQ ID NO: 1251736 - RNA, 13 nt, Human
aagcaagcuuaau

SEQ ID NO: 1251737 - RNA, 20 nt, Human
aagcaaaugucaugcugccu

SEQ ID NO: 1251738 - RNA, 21 nt, Human
aagcaaaugucaugcugccuu

SEQ ID NO: 1251739 - RNA, 22 nt, Human
aagcaaaugucaugcugccuua

SEQ ID NO: 1251740 - RNA, 14 nt, Human
aagcaagcaagagg

SEQ ID NO: 1251741 - RNA, 15 nt, Human
aagcaagcaagaggc

SEQ ID NO: 1251742 - RNA, 15 nt, Human
aagcaagcauucaga

SEQ ID NO: 1251743 - RNA, 19 nt, Human
aagcaagcauucagaagaa

SEQ ID NO: 1251744 - RNA, 20 nt, Human
aagcaaguaaaaaggcuaaa

SEQ ID NO: 1251745 - RNA, 18 nt, Human
guguccacgacugucucc

SEQ ID NO: 1251746 - RNA, 19 nt, Human
aagcaagcugauuaaauga

SEQ ID NO: 1251747 - RNA, 16 nt, Human
aagcaaguauuagaau

SEQ ID NO: 1251748 - RNA, 18 nt, Human
guguccaugcgcucaggg

SEQ ID NO: 1251749 - RNA, 19 nt, Human
guguccaugcgcucagggc

SEQ ID NO: 1251750 - RNA, 20 nt, Human
guguccaugcgcucagggcc

SEQ ID NO: 1251751 - RNA, 21 nt, Human
guguccaugcgcucagggcca

SEQ ID NO: 1251752 - RNA, 16 nt, Human
gugucuugggcagagc

SEQ ID NO: 1251753 - RNA, 17 nt, Human
gugucuugggcagagcu

SEQ ID NO: 1251754 - RNA, 20 nt, Human
gugucuugggcagagcuggc

SEQ ID NO: 1251755 - RNA, 23 nt, Human
gugucuugggcagagcuggcucu

SEQ ID NO: 1251756 - RNA, 14 nt, Human
gugugaggccaggg

SEQ ID NO: 1251757 - RNA, 15 nt, Human
gugugaggccagggc

SEQ ID NO: 1251758 - RNA, 17 nt, Human
gugugaggccagggcag

SEQ ID NO: 1251759 - RNA, 20 nt, Human
aagcaaaugugaaucauuuu

SEQ ID NO: 1251760 - RNA, 14 nt, Human
aagcaaaugugaau

SEQ ID NO: 1251761 - RNA, 13 nt, Human
aagcaaaugugaa

SEQ ID NO: 1251762 - RNA, 12 nt, Human
aagcaaaugucu

SEQ ID NO: 1251763 - RNA, 17 nt, Human
aagcaaaucgaaugaaa

SEQ ID NO: 1251764 - RNA, 18 nt, Human
aagcaaaucgaaugaaau

SEQ ID NO: 1251765 - RNA, 16 nt, Human
aagcaaaugucaugcu

SEQ ID NO: 1251766 - RNA, 19 nt, Human
aagcaaaugucaugcugcc

SEQ ID NO: 1251767 - RNA, 19 nt, Human
aagcaaaauuuuuucucua

SEQ ID NO: 1251768 - RNA, 22 nt, Human
aagcaaaauuauagaaguuuag

SEQ ID NO: 1251769 - RNA, 21 nt, Human
aagcaaacucuaaaauuauaa

SEQ ID NO: 1251770 - RNA, 14 nt, Human
aagcaaaucauuug

SEQ ID NO: 1251771 - RNA, 16 nt, Human
aagcaaaucauuuguu

SEQ ID NO: 1251772 - RNA, 19 nt, Human
aagcaaaucauuuguuuaa

SEQ ID NO: 1251773 - RNA, 13 nt, Human
aagaugaucauuu

SEQ ID NO: 1251774 - RNA, 13 nt, Human
aagaugacugagg

SEQ ID NO: 1251775 - RNA, 14 nt, Human
aagaugacugaggg

SEQ ID NO: 1251776 - RNA, 15 nt, Human
aagaugacugagggu

SEQ ID NO: 1251777 - RNA, 18 nt, Human
aagaugcacuuugcuuua

SEQ ID NO: 1251778 - RNA, 16 nt, Human
aagaugcacuuugcuu

SEQ ID NO: 1251779 - RNA, 22 nt, Human
aagauguagaggagaaacugga

SEQ ID NO: 1251780 - RNA, 14 nt, Human
aagaucccauuuga

SEQ ID NO: 1251781 - RNA, 22 nt, Human
aagauccuagauccuaaggguc

SEQ ID NO: 1251782 - RNA, 12 nt, Human
aagaucaauaaa

SEQ ID NO: 1251783 - RNA, 15 nt, Human
aagaucacuuucuca

SEQ ID NO: 1251784 - RNA, 17 nt, Human
aagaucacuuucucagu

SEQ ID NO: 1251785 - RNA, 23 nt, Human
aagaucacuuucucaguuuucau

SEQ ID NO: 1251786 - RNA, 18 nt, Human
guggggggggugcugggc

SEQ ID NO: 1251787 - RNA, 24 nt, Human
gugggauguucagcacugucccuu

SEQ ID NO: 1251788 - RNA, 22 nt, Human
gugggauuaugggucacaggaa

SEQ ID NO: 1251789 - RNA, 19 nt, Human
guggggggucccaaagagu

SEQ ID NO: 1251790 - RNA, 19 nt, Human
guggggguagggggcugga

SEQ ID NO: 1251791 - RNA, 22 nt, Human
guggggguagggggcuggagga

SEQ ID NO: 1251792 - RNA, 18 nt, Human
guggguccaugggcagag

SEQ ID NO: 1251793 - RNA, 20 nt, Human
guggguccaugggcagagcc

SEQ ID NO: 1251794 - RNA, 22 nt, Human
guggguccaugggcagagccca

SEQ ID NO: 1251795 - RNA, 15 nt, Human
guggugucagacccu

SEQ ID NO: 1251796 - RNA, 23 nt, Human
guggugugucccccucuguccag

SEQ ID NO: 1251797 - RNA, 22 nt, Human
gugguggaaacuuuucuuaaaa

SEQ ID NO: 1251798 - RNA, 16 nt, Human
gugguggcacaggccc

SEQ ID NO: 1251799 - RNA, 18 nt, Human
gugguggccuggucccug

SEQ ID NO: 1251800 - RNA, 13 nt, Human
gugguggccuggu

SEQ ID NO: 1251801 - RNA, 17 nt, Human
guggcccgacagccugg

SEQ ID NO: 1251802 - RNA, 23 nt, Human
guggccccguuucugguggucug

SEQ ID NO: 1251803 - RNA, 23 nt, Human
guggccucagcucccacaagccu

SEQ ID NO: 1251804 - RNA, 21 nt, Human
guggcuucccgcucagcccuc

SEQ ID NO: 1251805 - RNA, 22 nt, Human
guggcuugagaaauauggacac

SEQ ID NO: 1251806 - RNA, 17 nt, Human
guggcuuucagagccuc

SEQ ID NO: 1251807 - RNA, 19 nt, Human
guggcuuuaggagcagugg

SEQ ID NO: 1251808 - RNA, 16 nt, Human
gugggaaaugguacug

SEQ ID NO: 1251809 - RNA, 23 nt, Human
gugggagcaaacugcaugcccag

SEQ ID NO: 1251810 - RNA, 20 nt, Human
gugggagcaaacugcaugcc

SEQ ID NO: 1251811 - RNA, 22 nt, Human
gugggagaccggccugccagga

SEQ ID NO: 1251812 - RNA, 23 nt, Human
gugggagaccggccugccaggag

SEQ ID NO: 1251813 - RNA, 19 nt, Human
gugggagcaaacugcaugc

SEQ ID NO: 1251814 - RNA, 13 nt, Human
gugggagccucgc

SEQ ID NO: 1251815 - RNA, 11 nt, Human
gugggagccuc

SEQ ID NO: 1251816 - RNA, 12 nt, Human
gugggagccucg

SEQ ID NO: 1251817 - RNA, 14 nt, Human
gugggagccucgca

SEQ ID NO: 1251818 - RNA, 23 nt, Human
gugggauguucagcacugucccu

SEQ ID NO: 1251819 - RNA, 12 nt, Human
aagaccagucca

SEQ ID NO: 1251820 - RNA, 13 nt, Human
aagaccauuuuuc

SEQ ID NO: 1251821 - RNA, 23 nt, Human
aagaccccuuaccacugcucuga

SEQ ID NO: 1251822 - RNA, 13 nt, Human
aagacccccagca

SEQ ID NO: 1251823 - RNA, 15 nt, Human
aagacccccagcacu

SEQ ID NO: 1251824 - RNA, 15 nt, Human
aagaccccuaacccu

SEQ ID NO: 1251825 - RNA, 14 nt, Human
aagacucaaauguu

SEQ ID NO: 1251826 - RNA, 16 nt, Human
aagacucaaauguucu

SEQ ID NO: 1251827 - RNA, 17 nt, Human
aagacucaaauguucua

SEQ ID NO: 1251828 - RNA, 18 nt, Human
aagacucaaauguucuaa

SEQ ID NO: 1251829 - RNA, 19 nt, Human
aagacucaaauguucuaag

SEQ ID NO: 1251830 - RNA, 10 nt, Human
aagacucauc

SEQ ID NO: 1251831 - RNA, 11 nt, Human
aagacucaucc

SEQ ID NO: 1251832 - RNA, 12 nt, Human
aagacucauccg

SEQ ID NO: 1251833 - RNA, 14 nt, Human
aagacuccuagcug

SEQ ID NO: 1251834 - RNA, 18 nt, Human
aagacugcuguggccagg

SEQ ID NO: 1251835 - RNA, 19 nt, Human
aagacugcuguggccagga

SEQ ID NO: 1251836 - RNA, 20 nt, Human
aagacugcuguggccaggag

SEQ ID NO: 1251837 - RNA, 21 nt, Human
aagacugcuguggccaggagg

SEQ ID NO: 1251838 - RNA, 20 nt, Human
aagacuggaagcuaauuugc

SEQ ID NO: 1251839 - RNA, 22 nt, Human
aagacuggaagcuaauuugcau

SEQ ID NO: 1251840 - RNA, 23 nt, Human
aagacuggaagcuaauuugcauu

SEQ ID NO: 1251841 - RNA, 22 nt, Human
aagacugcuguggccaggaggu

SEQ ID NO: 1251842 - RNA, 11 nt, Human
aagacuggcuu

SEQ ID NO: 1251843 - RNA, 23 nt, Human
aagacuggcuuuuauuaaugcac

SEQ ID NO: 1251844 - RNA, 15 nt, Human
aagagauuccugagc

SEQ ID NO: 1251845 - RNA, 22 nt, Human
aagacuggcuuuuauuaaugca

SEQ ID NO: 1251846 - RNA, 16 nt, Human
guggcccgacagccug

SEQ ID NO: 1251847 - RNA, 16 nt, Human
guggccccguuucugg

SEQ ID NO: 1251848 - RNA, 17 nt, Human
guggccccguuucuggu

SEQ ID NO: 1251849 - RNA, 21 nt, Human
guggccccacccugggcccug

SEQ ID NO: 1251850 - RNA, 23 nt, Human
guggccccacccugggcccuggg

SEQ ID NO: 1251851 - RNA, 20 nt, Human
aagagcuacguauuuaauag

SEQ ID NO: 1251852 - RNA, 12 nt, Human
aagagcucagga

SEQ ID NO: 1251853 - RNA, 13 nt, Human
aagagcucaggau

SEQ ID NO: 1251854 - RNA, 24 nt, Human
aagaauuucuaggacugaauuaug

SEQ ID NO: 1251855 - RNA, 21 nt, Human
aagaauucaaauuuuaucugc

SEQ ID NO: 1251856 - RNA, 18 nt, Human
aagaauucaaauuuuauc

SEQ ID NO: 1251857 - RNA, 17 nt, Human
aagaauucaaauuuuau

SEQ ID NO: 1251858 - RNA, 13 nt, Human
aagaauucaaauu

SEQ ID NO: 1251859 - RNA, 12 nt, Human
aagaauucaaau

SEQ ID NO: 1251860 - RNA, 18 nt, Human
aagaauguuaagacuuga

SEQ ID NO: 1251861 - RNA, 11 nt, Human
aagaauuauuu

SEQ ID NO: 1251862 - RNA, 16 nt, Human
aagaauuauuuugaug

SEQ ID NO: 1251863 - RNA, 14 nt, Human
aagaauuauuuugu

SEQ ID NO: 1251864 - RNA, 16 nt, Human
aagacaaaaagcuacu

SEQ ID NO: 1251865 - RNA, 13 nt, Human
aagacccaaaagg

SEQ ID NO: 1251866 - RNA, 13 nt, Human
guggcagcaacaa

SEQ ID NO: 1251867 - RNA, 14 nt, Human
guggcagcccagcc

SEQ ID NO: 1251868 - RNA, 19 nt, Human
guggcagcaacggcacagc

SEQ ID NO: 1251869 - RNA, 16 nt, Human
aagaauaucuggcaaa

SEQ ID NO: 1251870 - RNA, 20 nt, Human
aagaauaucuguaaugguac

SEQ ID NO: 1251871 - RNA, 17 nt, Human
aagaauaucuguaaugg

SEQ ID NO: 1251872 - RNA, 19 nt, Human
aagaauaucuguaauggua

SEQ ID NO: 1251873 - RNA, 21 nt, Human
aagaaucacaauaauuuucua

SEQ ID NO: 1251874 - RNA, 23 nt, Human
aagaaucagagaaggaacauacc

SEQ ID NO: 1251875 - RNA, 19 nt, Human
aagaauguuaagacuugac

SEQ ID NO: 1251876 - RNA, 12 nt, Human
aagaaucagaga

SEQ ID NO: 1251877 - RNA, 12 nt, Human
aagaauguuaag

SEQ ID NO: 1251878 - RNA, 17 nt, Human
guggacugagugggaag

SEQ ID NO: 1251879 - RNA, 18 nt, Human
guggacugagugggaagc

SEQ ID NO: 1251880 - RNA, 20 nt, Human
guggacugagugggaagccc

SEQ ID NO: 1251881 - RNA, 14 nt, Human
guggacucagggca

SEQ ID NO: 1251882 - RNA, 15 nt, Human
guggacucagggcag

SEQ ID NO: 1251883 - RNA, 16 nt, Human
guggacucagggcagc

SEQ ID NO: 1251884 - RNA, 21 nt, Human
guggacucagggcagcgccag

SEQ ID NO: 1251885 - RNA, 21 nt, Human
guggacuagaccuccagcugu

SEQ ID NO: 1251886 - RNA, 12 nt, Human
guggacucuggu

SEQ ID NO: 1251887 - RNA, 21 nt, Human
guggcaaagcagcaacuauuc

SEQ ID NO: 1251888 - RNA, 19 nt, Human
guggcaagugaauuugccu

SEQ ID NO: 1251889 - RNA, 12 nt, Human
guggcacaggcc

SEQ ID NO: 1251890 - RNA, 15 nt, Human
guggcagaguuacag

SEQ ID NO: 1251891 - RNA, 17 nt, Human
guggcacuggggcaggg

SEQ ID NO: 1251892 - RNA, 18 nt, Human
guggcacuggggcagggg

SEQ ID NO: 1251893 - RNA, 16 nt, Human
guggcacaggcccccu

SEQ ID NO: 1251894 - RNA, 19 nt, Human
guggacaccugcccugccc

SEQ ID NO: 1251895 - RNA, 18 nt, Human
guggacaccugcccugcc

SEQ ID NO: 1251896 - RNA, 17 nt, Human
guggacaccugcccugc

SEQ ID NO: 1251897 - RNA, 16 nt, Human
guggacaccugcccug

SEQ ID NO: 1251898 - RNA, 14 nt, Human
guggacaccugccc

SEQ ID NO: 1251899 - RNA, 13 nt, Human
guggacaccugcc

SEQ ID NO: 1251900 - RNA, 12 nt, Human
guggacaccugc

SEQ ID NO: 1251901 - RNA, 11 nt, Human
guggacaccug

SEQ ID NO: 1251902 - RNA, 16 nt, Human
guggaagcuuggggaa

SEQ ID NO: 1251903 - RNA, 16 nt, Human
guggacacacacagac

SEQ ID NO: 1251904 - RNA, 19 nt, Human
guggaagcuuggggaagac

SEQ ID NO: 1251905 - RNA, 14 nt, Human
guggaagcuugggg

SEQ ID NO: 1251906 - RNA, 16 nt, Human
guggaacugcugccac

SEQ ID NO: 1251907 - RNA, 15 nt, Human
gugcuggggccuggu

SEQ ID NO: 1251908 - RNA, 20 nt, Human
gugcuggucccggggccagc

SEQ ID NO: 1251909 - RNA, 19 nt, Human
gugcuggggccugguuccc

SEQ ID NO: 1251910 - RNA, 19 nt, Human
gugcugggccccugccucu

SEQ ID NO: 1251911 - RNA, 16 nt, Human
gugcugggccccugcc

SEQ ID NO: 1251912 - RNA, 18 nt, Human
gugcuggagguuggaucu

SEQ ID NO: 1251913 - RNA, 15 nt, Human
gugcugcugugugcu

SEQ ID NO: 1251914 - RNA, 16 nt, Human
gugcugcugugugcuu

SEQ ID NO: 1251915 - RNA, 18 nt, Human
gugcuggaauucuaacaa

SEQ ID NO: 1251916 - RNA, 23 nt, Human
aagaagguuucagaaagaagugg

SEQ ID NO: 1251917 - RNA, 16 nt, Human
aagaagggcugguauu

SEQ ID NO: 1251918 - RNA, 17 nt, Human
aagaagggacugagaga

SEQ ID NO: 1251919 - RNA, 14 nt, Human
aagaaggugaauag

SEQ ID NO: 1251920 - RNA, 22 nt, Human
aagaaguaaaagcaaaaaagaa

SEQ ID NO: 1251921 - RNA, 14 nt, Human
aagaaguaaaagca

SEQ ID NO: 1251922 - RNA, 20 nt, Human
gugcacuaauguguaagaca

SEQ ID NO: 1251923 - RNA, 22 nt, Human
gugcacuaauguguaagacaaa

SEQ ID NO: 1251924 - RNA, 19 nt, Human
gugcauuuggagggaguga

SEQ ID NO: 1251925 - RNA, 18 nt, Human
gugccaaguccagguccu

SEQ ID NO: 1251926 - RNA, 19 nt, Human
gugccaaguccagguccug

SEQ ID NO: 1251927 - RNA, 20 nt, Human
gugccaaguccagguccugg

SEQ ID NO: 1251928 - RNA, 21 nt, Human
gugccaaguccagguccuggu

SEQ ID NO: 1251929 - RNA, 23 nt, Human
aacugcaggcccuggccuccccu

SEQ ID NO: 1251930 - RNA, 14 nt, Human
aacugcagggaaaa

SEQ ID NO: 1251931 - RNA, 23 nt, Human
aacugcagggaaaauuauuugca

SEQ ID NO: 1251932 - RNA, 16 nt, Human
aacugcauacacuuuu

SEQ ID NO: 1251933 - RNA, 17 nt, Human
aacugcaugcccagaga

SEQ ID NO: 1251934 - RNA, 18 nt, Human
aacugcaugcccagagac

SEQ ID NO: 1251935 - RNA, 22 nt, Human
aacugcaugcccagagacccag

SEQ ID NO: 1251936 - RNA, 23 nt, Human
gugcacguaaaguacuuguaguu

SEQ ID NO: 1251937 - RNA, 15 nt, Human
aacuuguauuaugug

SEQ ID NO: 1251938 - RNA, 20 nt, Human
aacuuguaauuuuuuuaauu

SEQ ID NO: 1251939 - RNA, 15 nt, Human
aacuuguaaaugugg

SEQ ID NO: 1251940 - RNA, 21 nt, Human
aacuugguuuugcuacauaau

SEQ ID NO: 1251941 - RNA, 16 nt, Human
aacuugguuuugcuac

SEQ ID NO: 1251942 - RNA, 22 nt, Human
aacuugguuuugcuacauaauu

SEQ ID NO: 1251943 - RNA, 17 nt, Human
aacuuggauacuuggau

SEQ ID NO: 1251944 - RNA, 18 nt, Human
aacuugcuuaucaacuuc

SEQ ID NO: 1251945 - RNA, 22 nt, Human
gugccaaguccagguccuggug

SEQ ID NO: 1251946 - RNA, 14 nt, Human
gugccaauuucaag

SEQ ID NO: 1251947 - RNA, 21 nt, Human
gugccugacacacuaaccaag

SEQ ID NO: 1251948 - RNA, 16 nt, Human
gugccuggccacgccc

SEQ ID NO: 1251949 - RNA, 22 nt, Human
aagaaaauuuuuguaguagcgu

SEQ ID NO: 1251950 - RNA, 19 nt, Human
aagaaaauuuuuguaguag

SEQ ID NO: 1251951 - RNA, 15 nt, Human
aagaaaggcugcugu

SEQ ID NO: 1251952 - RNA, 23 nt, Human
aagaaaggaagcauuguaaaaua

SEQ ID NO: 1251953 - RNA, 20 nt, Human
aagaaaggcuguuaaauaca

SEQ ID NO: 1251954 - RNA, 16 nt, Human
aagaaagucagccaua

SEQ ID NO: 1251955 - RNA, 13 nt, Human
aagaaaguccacc

SEQ ID NO: 1251956 - RNA, 20 nt, Human
aagaaaggcugcuguacuga

SEQ ID NO: 1251957 - RNA, 22 nt, Human
aagaaagugagcaguguuagcu

SEQ ID NO: 1251958 - RNA, 12 nt, Human
aagaaaguguau

SEQ ID NO: 1251959 - RNA, 15 nt, Human
aagaaaguguauuug

SEQ ID NO: 1251960 - RNA, 18 nt, Human
aagaaaguguauuuggaa

SEQ ID NO: 1251961 - RNA, 21 nt, Human
aagaaauaaaaggaagccaaa

SEQ ID NO: 1251962 - RNA, 23 nt, Human
aagaaauaaaaggaagccaaaga

SEQ ID NO: 1251963 - RNA, 15 nt, Human
aagaaauaaguuuuu

SEQ ID NO: 1251964 - RNA, 13 nt, Human
aagaaaauaucac

SEQ ID NO: 1251965 - RNA, 13 nt, Human
aagaaaaucacuu

SEQ ID NO: 1251966 - RNA, 22 nt, Human
aagaaaaucuauuuuguaacuu

SEQ ID NO: 1251967 - RNA, 15 nt, Human
aagaaaaucuuuaua

SEQ ID NO: 1251968 - RNA, 16 nt, Human
aagaaaauuacaaaaa

SEQ ID NO: 1251969 - RNA, 22 nt, Human
aagaagcaguggccuuauugca

SEQ ID NO: 1251970 - RNA, 22 nt, Human
aagaagcauuuuguaaguugaa

SEQ ID NO: 1251971 - RNA, 19 nt, Human
aagaagccacagaccuagg

SEQ ID NO: 1251972 - RNA, 15 nt, Human
aagaagcccccagcu

SEQ ID NO: 1251973 - RNA, 16 nt, Human
aagaagcccccagcua

SEQ ID NO: 1251974 - RNA, 19 nt, Human
aagaagcccccagcuaaga

SEQ ID NO: 1251975 - RNA, 17 nt, Human
aagaagcccggcuccug

SEQ ID NO: 1251976 - RNA, 19 nt, Human
aagaagcccggcuccuggu

SEQ ID NO: 1251977 - RNA, 24 nt, Human
aagaagcccggcuccuggucaccu

SEQ ID NO: 1251978 - RNA, 23 nt, Human
aagaaggcaucgucaugcacagu

SEQ ID NO: 1251979 - RNA, 16 nt, Human
aagaagggacugagag

SEQ ID NO: 1251980 - RNA, 17 nt, Human
aagaaaacaucuuuaag

SEQ ID NO: 1251981 - RNA, 13 nt, Human
aagaaaacaucuu

SEQ ID NO: 1251982 - RNA, 11 nt, Human
aagaaaagaug

SEQ ID NO: 1251983 - RNA, 23 nt, Human
aagaaaagaugcacuuugcuuua

SEQ ID NO: 1251984 - RNA, 22 nt, Human
aagaaaagguucuuacugcuug

SEQ ID NO: 1251985 - RNA, 20 nt, Human
aagaaaauaagagcucagga

SEQ ID NO: 1251986 - RNA, 13 nt, Human
aacuuguuuucug

SEQ ID NO: 1251987 - RNA, 16 nt, Human
aacuugugcccucccu

SEQ ID NO: 1251988 - RNA, 19 nt, Human
aacuugugucccuaaugug

SEQ ID NO: 1251989 - RNA, 14 nt, Human
aagaaaaauaaaga

SEQ ID NO: 1251990 - RNA, 15 nt, Human
aagaaaaauaaagaa

SEQ ID NO: 1251991 - RNA, 16 nt, Human
aagaaaaauaaagaaa

SEQ ID NO: 1251992 - RNA, 18 nt, Human
gucgcccuggacugugug

SEQ ID NO: 1251993 - RNA, 20 nt, Human
gucgcccaugcuggagugca

SEQ ID NO: 1251994 - RNA, 14 nt, Human
gucgcccuggacug

SEQ ID NO: 1251995 - RNA, 15 nt, Human
gucuacuugcucagg

SEQ ID NO: 1251996 - RNA, 15 nt, Human
gucuauaaagcauuu

SEQ ID NO: 1251997 - RNA, 20 nt, Human
gucuauaaagcauuuaaccc

SEQ ID NO: 1251998 - RNA, 21 nt, Human
gucuaucaaccccagacacug

SEQ ID NO: 1251999 - RNA, 23 nt, Human
gucuaucaaccccagacacuggu

SEQ ID NO: 1252000 - RNA, 22 nt, Human
gucuaucaaccccagacacugg

SEQ ID NO: 1252001 - RNA, 14 nt, Human
gucgcccaggcugg

SEQ ID NO: 1252002 - RNA, 15 nt, Human
gucgcccaggcugga

SEQ ID NO: 1252003 - RNA, 20 nt, Human
gucgcccaggcuggagugca

SEQ ID NO: 1252004 - RNA, 22 nt, Human
gucgagaaagaggcaccaggaa

SEQ ID NO: 1252005 - RNA, 16 nt, Human
guccuuuuuccucucc

SEQ ID NO: 1252006 - RNA, 16 nt, Human
guccuuuuuuuccauc

SEQ ID NO: 1252007 - RNA, 19 nt, Human
guccuuuuuuuccaucuuu

SEQ ID NO: 1252008 - RNA, 20 nt, Human
guccuuuuuccucuccacac

SEQ ID NO: 1252009 - RNA, 16 nt, Human
gucgaaagcucuagaa

SEQ ID NO: 1252010 - RNA, 22 nt, Human
guccugccuguggcgccgucuc

SEQ ID NO: 1252011 - RNA, 20 nt, Human
guccuuggcaggcugauuuc

SEQ ID NO: 1252012 - RNA, 14 nt, Human
guccuuggccugcu

SEQ ID NO: 1252013 - RNA, 21 nt, Human
guccuugugaugugcacguaa

SEQ ID NO: 1252014 - RNA, 15 nt, Human
guccugcaccggggc

SEQ ID NO: 1252015 - RNA, 19 nt, Human
guccugcaccggggccugg

SEQ ID NO: 1252016 - RNA, 20 nt, Human
guccugcaccggggccuggg

SEQ ID NO: 1252017 - RNA, 21 nt, Human
aacauuacucugaaauuguaa

SEQ ID NO: 1252018 - RNA, 17 nt, Human
guccugaucagagccgu

SEQ ID NO: 1252019 - RNA, 18 nt, Human
aacauguuuccagcauuc

SEQ ID NO: 1252020 - RNA, 19 nt, Human
aacauguuuccagcauucc

SEQ ID NO: 1252021 - RNA, 21 nt, Human
aacauguuuccagcauuccca

SEQ ID NO: 1252022 - RNA, 22 nt, Human
aacauguuuccagcauucccag

SEQ ID NO: 1252023 - RNA, 13 nt, Human
aacauuaaaauau

SEQ ID NO: 1252024 - RNA, 20 nt, Human
aacauuaauagcagccuuuc

SEQ ID NO: 1252025 - RNA, 19 nt, Human
aacauuaauagcagccuuu

SEQ ID NO: 1252026 - RNA, 22 nt, Human
aaccaaaucacugaacuuugcu

SEQ ID NO: 1252027 - RNA, 15 nt, Human
aaccaaaucuggaag

SEQ ID NO: 1252028 - RNA, 23 nt, Human
aacauuuugaaagucuguccuug

SEQ ID NO: 1252029 - RNA, 16 nt, Human
aaccaagccguggcuu

SEQ ID NO: 1252030 - RNA, 16 nt, Human
aaccaacuuuucuauu

SEQ ID NO: 1252031 - RNA, 22 nt, Human
gucuccaggggcugcuuccucc

SEQ ID NO: 1252032 - RNA, 23 nt, Human
gucuccaggggcugcuuccuccu

SEQ ID NO: 1252033 - RNA, 21 nt, Human
gucuccaguauccacuuugca

SEQ ID NO: 1252034 - RNA, 20 nt, Human
gucuccagaaagccccaccc

SEQ ID NO: 1252035 - RNA, 15 nt, Human
gucuccaggggcugc

SEQ ID NO: 1252036 - RNA, 16 nt, Human
gucuccaggggcugcu

SEQ ID NO: 1252037 - RNA, 19 nt, Human
gucuccaggggcugcuucc

SEQ ID NO: 1252038 - RNA, 20 nt, Human
gucuccaggggcugcuuccu

SEQ ID NO: 1252039 - RNA, 21 nt, Human
gucuccaggggcugcuuccuc

SEQ ID NO: 1252040 - RNA, 12 nt, Human
aacauuuucugg

SEQ ID NO: 1252041 - RNA, 16 nt, Human
aacauuuucuggccag

SEQ ID NO: 1252042 - RNA, 14 nt, Human
gucuccauggcccu

SEQ ID NO: 1252043 - RNA, 15 nt, Human
gucucaaacuccuga

SEQ ID NO: 1252044 - RNA, 15 nt, Human
gucucaagagggcac

SEQ ID NO: 1252045 - RNA, 17 nt, Human
gucucaagagggcacug

SEQ ID NO: 1252046 - RNA, 22 nt, Human
gucucaaacuccugaccucagg

SEQ ID NO: 1252047 - RNA, 20 nt, Human
gucucaagagggcacuggug

SEQ ID NO: 1252048 - RNA, 22 nt, Human
gucucaagagggcacugguggc

SEQ ID NO: 1252049 - RNA, 23 nt, Human
gucucaguccaugaagauguaga

SEQ ID NO: 1252050 - RNA, 16 nt, Human
gucucaggucccugca

SEQ ID NO: 1252051 - RNA, 15 nt, Human
gucucaggucccugc

SEQ ID NO: 1252052 - RNA, 18 nt, Human
gucucaggcugccugagu

SEQ ID NO: 1252053 - RNA, 23 nt, Human
gucucacaugauuccagccauca

SEQ ID NO: 1252054 - RNA, 16 nt, Human
gucucaggcugccuga

SEQ ID NO: 1252055 - RNA, 13 nt, Human
gucuccagaaagc

SEQ ID NO: 1252056 - RNA, 15 nt, Human
gucuccagaaagccc

SEQ ID NO: 1252057 - RNA, 23 nt, Human
gucuccagaaagccccacccagg

SEQ ID NO: 1252058 - RNA, 22 nt, Human
guagcguuuuuuaaauguauac

SEQ ID NO: 1252059 - RNA, 18 nt, Human
guagcgucuuucuuuuuu

SEQ ID NO: 1252060 - RNA, 13 nt, Human
guagcuacagaga

SEQ ID NO: 1252061 - RNA, 14 nt, Human
guagcuacagagaa

SEQ ID NO: 1252062 - RNA, 15 nt, Human
guagcuacagagaaa

SEQ ID NO: 1252063 - RNA, 16 nt, Human
guagcuacagagaaac

SEQ ID NO: 1252064 - RNA, 18 nt, Human
guagcguuuuuuaaaugu

SEQ ID NO: 1252065 - RNA, 17 nt, Human
guagcguuuuuuaaaug

SEQ ID NO: 1252066 - RNA, 13 nt, Human
guagcguuuuuua

SEQ ID NO: 1252067 - RNA, 23 nt, Human
guagcgggggaggguaggcagga

SEQ ID NO: 1252068 - RNA, 17 nt, Human
guagcgucuuucuuuuu

SEQ ID NO: 1252069 - RNA, 22 nt, Human
guagccucaaucgagugagaca

SEQ ID NO: 1252070 - RNA, 11 nt, Human
guagccuuuuu

SEQ ID NO: 1252071 - RNA, 18 nt, Human
guagccuuuuuguauaaa

SEQ ID NO: 1252072 - RNA, 23 nt, Human
guagcuacagagaaaccagcuuc

SEQ ID NO: 1252073 - RNA, 18 nt, Human
guagcuacagagaaacca

SEQ ID NO: 1252074 - RNA, 10 nt, Human
guagcuccuc

SEQ ID NO: 1252075 - RNA, 12 nt, Human
guagcuccuccc

SEQ ID NO: 1252076 - RNA, 13 nt, Human
guagcuccucccc

SEQ ID NO: 1252077 - RNA, 19 nt, Human
guagcuccuccccuggagg

SEQ ID NO: 1252078 - RNA, 12 nt, Human
gucccccucugg

SEQ ID NO: 1252079 - RNA, 14 nt, Human
gucccccucuggcu

SEQ ID NO: 1252080 - RNA, 12 nt, Human
guccccccacuc

SEQ ID NO: 1252081 - RNA, 14 nt, Human
guccccccacuccc

SEQ ID NO: 1252082 - RNA, 13 nt, Human
guccaugggcaga

SEQ ID NO: 1252083 - RNA, 14 nt, Human
guccaugggcagag

SEQ ID NO: 1252084 - RNA, 16 nt, Human
guccaugggcagagcc

SEQ ID NO: 1252085 - RNA, 18 nt, Human
guccaugggcagagccca

SEQ ID NO: 1252086 - RNA, 23 nt, Human
guccaugggcagagcccaaggga

SEQ ID NO: 1252087 - RNA, 13 nt, Human
gucccccucuguc

SEQ ID NO: 1252088 - RNA, 19 nt, Human
gucccccucuguccaggca

SEQ ID NO: 1252089 - RNA, 21 nt, Human
gucccccucuguccaggcacu

SEQ ID NO: 1252090 - RNA, 17 nt, Human
guccccuagagucccag

SEQ ID NO: 1252091 - RNA, 12 nt, Human
guccccucaccu

SEQ ID NO: 1252092 - RNA, 16 nt, Human
gucccgauuguaacuc

SEQ ID NO: 1252093 - RNA, 18 nt, Human
gucccggaggcggugggc

SEQ ID NO: 1252094 - RNA, 19 nt, Human
guccguucacauguguggu

SEQ ID NO: 1252095 - RNA, 22 nt, Human
guccuaaccucgggccugcugc

SEQ ID NO: 1252096 - RNA, 20 nt, Human
guccuaauaauaucccacug

SEQ ID NO: 1252097 - RNA, 14 nt, Human
aacauauuguugaa

SEQ ID NO: 1252098 - RNA, 20 nt, Human
aacauguuauuuguaauaga

SEQ ID NO: 1252099 - RNA, 11 nt, Human
aacauguuucc

SEQ ID NO: 1252100 - RNA, 15 nt, Human
aacauguuuccagca

SEQ ID NO: 1252101 - RNA, 16 nt, Human
aacauguuuccagcau

SEQ ID NO: 1252102 - RNA, 17 nt, Human
aacauguuuccagcauu

SEQ ID NO: 1252103 - RNA, 19 nt, Human
aacauagacagaagaaaca

SEQ ID NO: 1252104 - RNA, 16 nt, Human
aacauauauaacaaug

SEQ ID NO: 1252105 - RNA, 22 nt, Human
aacauagaaauugccugacgaa

SEQ ID NO: 1252106 - RNA, 15 nt, Human
aacauagacagaaga

SEQ ID NO: 1252107 - RNA, 16 nt, Human
aacauagacagaagaa

SEQ ID NO: 1252108 - RNA, 15 nt, Human
aacauauauauacua

SEQ ID NO: 1252109 - RNA, 13 nt, Human
aacauaagcuauu

SEQ ID NO: 1252110 - RNA, 15 nt, Human
aacauaagcuauuuu

SEQ ID NO: 1252111 - RNA, 18 nt, Human
aacauaagcuauuuuucu

SEQ ID NO: 1252112 - RNA, 20 nt, Human
aacauaagcuauuuuucuaa

SEQ ID NO: 1252113 - RNA, 22 nt, Human
aacauaagcuauuuuucuaacu

SEQ ID NO: 1252114 - RNA, 20 nt, Human
aacauaaucuucugccuucu

SEQ ID NO: 1252115 - RNA, 15 nt, Human
aacagugauuaccag

SEQ ID NO: 1252116 - RNA, 21 nt, Human
aacagugagccugaauuuugu

SEQ ID NO: 1252117 - RNA, 17 nt, Human
aacagugaagacagaag

SEQ ID NO: 1252118 - RNA, 13 nt, Human
aacagugagccug

SEQ ID NO: 1252119 - RNA, 22 nt, Human
aacauaaucuucugccuucuca

SEQ ID NO: 1252120 - RNA, 19 nt, Human
aacagguuauaacaguguu

SEQ ID NO: 1252121 - RNA, 16 nt, Human
aacagugaagacagaa

SEQ ID NO: 1252122 - RNA, 19 nt, Human
aacagauguccaucagaug

SEQ ID NO: 1252123 - RNA, 20 nt, Human
aacagauguccaucagauga

SEQ ID NO: 1252124 - RNA, 18 nt, Human
aacagguauauacuuuga

SEQ ID NO: 1252125 - RNA, 14 nt, Human
guccuacagaaaaa

SEQ ID NO: 1252126 - RNA, 15 nt, Human
guccuacagaaaaac

SEQ ID NO: 1252127 - RNA, 16 nt, Human
guccuacagaaaaacc

SEQ ID NO: 1252128 - RNA, 19 nt, Human
aacagagacugaauagaua

SEQ ID NO: 1252129 - RNA, 16 nt, Human
aacagauaaauaguuu

SEQ ID NO: 1252130 - RNA, 12 nt, Human
aacagaggauau

SEQ ID NO: 1252131 - RNA, 20 nt, Human
aacugaaaucauacuucuua

SEQ ID NO: 1252132 - RNA, 18 nt, Human
aacucugguggcacagga

SEQ ID NO: 1252133 - RNA, 12 nt, Human
aacucugguggc

SEQ ID NO: 1252134 - RNA, 13 nt, Human
aacucugguggca

SEQ ID NO: 1252135 - RNA, 14 nt, Human
aacugaacucugac

SEQ ID NO: 1252136 - RNA, 16 nt, Human
aacucuguuacacuuu

SEQ ID NO: 1252137 - RNA, 21 nt, Human
aacugaacaccauugaaggcu

SEQ ID NO: 1252138 - RNA, 22 nt, Human
aacugaacaccauugaaggcuu

SEQ ID NO: 1252139 - RNA, 23 nt, Human
aacugaacaccauugaaggcuua

SEQ ID NO: 1252140 - RNA, 14 nt, Human
aacugcaggcccug

SEQ ID NO: 1252141 - RNA, 16 nt, Human
aacugcaggcccuggc

SEQ ID NO: 1252142 - RNA, 17 nt, Human
aacugcaggcccuggcc

SEQ ID NO: 1252143 - RNA, 18 nt, Human
aacugcaggcccuggccu

SEQ ID NO: 1252144 - RNA, 19 nt, Human
aacugcaggcccuggccuc

SEQ ID NO: 1252145 - RNA, 20 nt, Human
aacugcaggcccuggccucc

SEQ ID NO: 1252146 - RNA, 21 nt, Human
aacugcaggcccuggccuccc

SEQ ID NO: 1252147 - RNA, 14 nt, Human
gugagucaccacuu

SEQ ID NO: 1252148 - RNA, 18 nt, Human
gugaguaauuuuggauuu

SEQ ID NO: 1252149 - RNA, 16 nt, Human
aacucugcauucuagu

SEQ ID NO: 1252150 - RNA, 16 nt, Human
aacucugcuugauuuu

SEQ ID NO: 1252151 - RNA, 15 nt, Human
gugagcaggcuguga

SEQ ID NO: 1252152 - RNA, 12 nt, Human
gugagacagacu

SEQ ID NO: 1252153 - RNA, 14 nt, Human
gugagcacagccua

SEQ ID NO: 1252154 - RNA, 14 nt, Human
gugacccacaugcc

SEQ ID NO: 1252155 - RNA, 13 nt, Human
gugaccccagggc

SEQ ID NO: 1252156 - RNA, 14 nt, Human
gugaccccagggca

SEQ ID NO: 1252157 - RNA, 15 nt, Human
gugaccccagggcac

SEQ ID NO: 1252158 - RNA, 19 nt, Human
gugaccccagggcacagga

SEQ ID NO: 1252159 - RNA, 21 nt, Human
gugaccccagggcacaggagc

SEQ ID NO: 1252160 - RNA, 22 nt, Human
gugaccccagggcacaggagcu

SEQ ID NO: 1252161 - RNA, 23 nt, Human
gugaccccagggcacaggagcua

SEQ ID NO: 1252162 - RNA, 15 nt, Human
gugacccccagcucc

SEQ ID NO: 1252163 - RNA, 17 nt, Human
gugacccccagcuccgg

SEQ ID NO: 1252164 - RNA, 16 nt, Human
gugacccccagcuccg

SEQ ID NO: 1252165 - RNA, 21 nt, Human
gugagaagugaaugcugggac

SEQ ID NO: 1252166 - RNA, 22 nt, Human
gugagaagugaaugcugggacu

SEQ ID NO: 1252167 - RNA, 20 nt, Human
gugagaaccuggguugcaga

SEQ ID NO: 1252168 - RNA, 15 nt, Human
gugagaaauuuaaac

SEQ ID NO: 1252169 - RNA, 22 nt, Human
gugagaaccuggguugcagaca

SEQ ID NO: 1252170 - RNA, 20 nt, Human
gugagaagugaaugcuggga

SEQ ID NO: 1252171 - RNA, 21 nt, Human
gugacauuuuacauuaaauuu

SEQ ID NO: 1252172 - RNA, 20 nt, Human
gugacauuuuacauuaaauu

SEQ ID NO: 1252173 - RNA, 17 nt, Human
gugaccaaaaguuacau

SEQ ID NO: 1252174 - RNA, 19 nt, Human
gugacauuuuacauuaaau

SEQ ID NO: 1252175 - RNA, 17 nt, Human
gugacauuuuacauuaa

SEQ ID NO: 1252176 - RNA, 15 nt, Human
gugaccaaugucuug

SEQ ID NO: 1252177 - RNA, 16 nt, Human
gugaccaaugucuuga

SEQ ID NO: 1252178 - RNA, 17 nt, Human
gugaccacucugucuug

SEQ ID NO: 1252179 - RNA, 17 nt, Human
gugaccaggcauccucc

SEQ ID NO: 1252180 - RNA, 16 nt, Human
gugacccacaugccau

SEQ ID NO: 1252181 - RNA, 14 nt, Human
gugacauccaggag

SEQ ID NO: 1252182 - RNA, 16 nt, Human
gugacaucggaaaaau

SEQ ID NO: 1252183 - RNA, 18 nt, Human
gugacaucggaaaaauaa

SEQ ID NO: 1252184 - RNA, 19 nt, Human
gugacaucggaaaaauaau

SEQ ID NO: 1252185 - RNA, 13 nt, Human
aacuauauuguuu

SEQ ID NO: 1252186 - RNA, 15 nt, Human
aacuagaauuugauu

SEQ ID NO: 1252187 - RNA, 16 nt, Human
aacuagaauuugauua

SEQ ID NO: 1252188 - RNA, 17 nt, Human
aacuagacaccaaaguu

SEQ ID NO: 1252189 - RNA, 20 nt, Human
aacuagacaccaaaguucua

SEQ ID NO: 1252190 - RNA, 20 nt, Human
aacuaucucauuuccaagca

SEQ ID NO: 1252191 - RNA, 23 nt, Human
aacuaucucauuuccaagcaagu

SEQ ID NO: 1252192 - RNA, 14 nt, Human
gugaagaauacuuc

SEQ ID NO: 1252193 - RNA, 21 nt, Human
gugaagaaugcacaagaaugg

SEQ ID NO: 1252194 - RNA, 14 nt, Human
gugaagacagaagu

SEQ ID NO: 1252195 - RNA, 23 nt, Human
gugaagaaugcacaagaauggau

SEQ ID NO: 1252196 - RNA, 14 nt, Human
gugaaggcuucucu

SEQ ID NO: 1252197 - RNA, 17 nt, Human
gugaaggcuucucucug

SEQ ID NO: 1252198 - RNA, 22 nt, Human
gugaaggcuucucucuguggga

SEQ ID NO: 1252199 - RNA, 18 nt, Human
gugaagggaagagacagc

SEQ ID NO: 1252200 - RNA, 10 nt, Human
gugaagccaa

SEQ ID NO: 1252201 - RNA, 20 nt, Human
gugaagccaauucagacagg

SEQ ID NO: 1252202 - RNA, 22 nt, Human
gugaagccaauucagacaggca

SEQ ID NO: 1252203 - RNA, 10 nt, Human
gugaagccuu

SEQ ID NO: 1252204 - RNA, 11 nt, Human
gugaagccuuc

SEQ ID NO: 1252205 - RNA, 12 nt, Human
gugaagccuucc

SEQ ID NO: 1252206 - RNA, 12 nt, Human
gugaaggacccu

SEQ ID NO: 1252207 - RNA, 13 nt, Human
gugaaggacccuu

SEQ ID NO: 1252208 - RNA, 22 nt, Human
aacuacuucucuuguuagguaa

SEQ ID NO: 1252209 - RNA, 13 nt, Human
aacuacuuuauaa

SEQ ID NO: 1252210 - RNA, 15 nt, Human
aacuacuuuauaacu

SEQ ID NO: 1252211 - RNA, 17 nt, Human
aacuacuuuauaacuaa

SEQ ID NO: 1252212 - RNA, 19 nt, Human
aacuacuuugcugcuaaua

SEQ ID NO: 1252213 - RNA, 16 nt, Human
aacuacuuugcugcua

SEQ ID NO: 1252214 - RNA, 19 nt, Human
aacuaagaaacuuaaauuu

SEQ ID NO: 1252215 - RNA, 23 nt, Human
aacuaagaaauaugcacaauagc

SEQ ID NO: 1252216 - RNA, 15 nt, Human
aacuaagaaacuuaa

SEQ ID NO: 1252217 - RNA, 13 nt, Human
aacuaacuaaaac

SEQ ID NO: 1252218 - RNA, 14 nt, Human
aacuaacauguccu

SEQ ID NO: 1252219 - RNA, 15 nt, Human
aacuaacauguccug

SEQ ID NO: 1252220 - RNA, 18 nt, Human
aacguuuagcugacaaaa

SEQ ID NO: 1252221 - RNA, 20 nt, Human
aacguuuaagccaaaacaau

SEQ ID NO: 1252222 - RNA, 16 nt, Human
aacguguucaauauuu

SEQ ID NO: 1252223 - RNA, 11 nt, Human
aacuaacaugu

SEQ ID NO: 1252224 - RNA, 16 nt, Human
aaccuuucuucaccaa

SEQ ID NO: 1252225 - RNA, 18 nt, Human
aaccuuucuucaccaaau

SEQ ID NO: 1252226 - RNA, 17 nt, Human
aacguguucaauauuuu

SEQ ID NO: 1252227 - RNA, 18 nt, Human
aacguuaagaauuguuaa

SEQ ID NO: 1252228 - RNA, 23 nt, Human
aaccuuagauguucuaagucuuu

SEQ ID NO: 1252229 - RNA, 17 nt, Human
aaccuuaauuuauuauu

SEQ ID NO: 1252230 - RNA, 13 nt, Human
aaccuuguuuugg

SEQ ID NO: 1252231 - RNA, 23 nt, Human
aaccuuguuuuggacaguuuacc

SEQ ID NO: 1252232 - RNA, 19 nt, Human
aaccuuuacaugaggacuc

SEQ ID NO: 1252233 - RNA, 15 nt, Human
aaccuuguuuuggac

SEQ ID NO: 1252234 - RNA, 13 nt, Human
aaccuguucugcu

SEQ ID NO: 1252235 - RNA, 21 nt, Human
aaccuguuaccuacuuugacu

SEQ ID NO: 1252236 - RNA, 17 nt, Human
aaccuguucugcuuucc

SEQ ID NO: 1252237 - RNA, 24 nt, Human
aaccuguuaccuacuuugacuuuu

SEQ ID NO: 1252238 - RNA, 13 nt, Human
aaccuuaagaccu

SEQ ID NO: 1252239 - RNA, 13 nt, Human
aaccuuaagauac

SEQ ID NO: 1252240 - RNA, 18 nt, Human
aaccuuaauuuauuauua

SEQ ID NO: 1252241 - RNA, 15 nt, Human
gucuuccauuugcaa

SEQ ID NO: 1252242 - RNA, 19 nt, Human
gucuuuguuaagacugcug

SEQ ID NO: 1252243 - RNA, 22 nt, Human
gucucuuuaaaaggaaagaaaa

SEQ ID NO: 1252244 - RNA, 16 nt, Human
gucugaagucacugca

SEQ ID NO: 1252245 - RNA, 24 nt, Human
aaccaugaagagauuuuucaugau

SEQ ID NO: 1252246 - RNA, 15 nt, Human
aaccaugacgcaaag

SEQ ID NO: 1252247 - RNA, 22 nt, Human
aaccaugagaccacuguuauca

SEQ ID NO: 1252248 - RNA, 19 nt, Human
aaccaugcaaaugcuauga

SEQ ID NO: 1252249 - RNA, 12 nt, Human
aaccaucucccu

SEQ ID NO: 1252250 - RNA, 13 nt, Human
aaccaucucccug

SEQ ID NO: 1252251 - RNA, 14 nt, Human
aaccaucucccugg

SEQ ID NO: 1252252 - RNA, 18 nt, Human
aaccaucucccuggugcu

SEQ ID NO: 1252253 - RNA, 19 nt, Human
aaccaucucccuggugcuu

SEQ ID NO: 1252254 - RNA, 21 nt, Human
aaccaugaagagauuuuucau

SEQ ID NO: 1252255 - RNA, 23 nt, Human
aaccaugaagagauuuuucauga

SEQ ID NO: 1252256 - RNA, 13 nt, Human
gucucuuguaauc

SEQ ID NO: 1252257 - RNA, 17 nt, Human
gucugaagucacugcac

SEQ ID NO: 1252258 - RNA, 19 nt, Human
gucugaagucacugcacag

SEQ ID NO: 1252259 - RNA, 10 nt, Human
gucuggagac

SEQ ID NO: 1252260 - RNA, 21 nt, Human
gucuggagaccaccagggcau

SEQ ID NO: 1252261 - RNA, 17 nt, Human
gucuggagaccaccagg

SEQ ID NO: 1252262 - RNA, 21 nt, Human
gucuggaguugaucuggaacc

SEQ ID NO: 1252263 - RNA, 16 nt, Human
gucuggauaacuucca

SEQ ID NO: 1252264 - RNA, 18 nt, Human
gucuggauaacuuccaca

SEQ ID NO: 1252265 - RNA, 20 nt, Human
gucuggauaacuuccacagg

SEQ ID NO: 1252266 - RNA, 21 nt, Human
gucuggauaacuuccacaggg

SEQ ID NO: 1252267 - RNA, 15 nt, Human
gucuggcaaugccac

SEQ ID NO: 1252268 - RNA, 16 nt, Human
gucuggcaaugccaca

SEQ ID NO: 1252269 - RNA, 18 nt, Human
gucuggcaaugccacagc

SEQ ID NO: 1252270 - RNA, 22 nt, Human
gucuggggagcgggucugcucc

SEQ ID NO: 1252271 - RNA, 23 nt, Human
gucuggggagcgggucugcuccc

SEQ ID NO: 1252272 - RNA, 14 nt, Human
gucugggggcacaa

SEQ ID NO: 1252273 - RNA, 19 nt, Human
gucugggggcacaagacug

SEQ ID NO: 1252274 - RNA, 20 nt, Human
gucugggggcacaagacuga

SEQ ID NO: 1252275 - RNA, 14 nt, Human
gucugggugcuacu

SEQ ID NO: 1252276 - RNA, 15 nt, Human
gucugggugcuacug

SEQ ID NO: 1252277 - RNA, 20 nt, Human
gucugggugcuacuggggaa

SEQ ID NO: 1252278 - RNA, 14 nt, Human
gucuggguggcuca

SEQ ID NO: 1252279 - RNA, 17 nt, Human
gucuggguggcucacuc

SEQ ID NO: 1252280 - RNA, 15 nt, Human
gucuggguggcucac

SEQ ID NO: 1252281 - RNA, 15 nt, Human
gucuggugaagcuca

SEQ ID NO: 1252282 - RNA, 13 nt, Human
gucugguggcccc

SEQ ID NO: 1252283 - RNA, 20 nt, Human
gucugguggccccguuucug

SEQ ID NO: 1252284 - RNA, 14 nt, Human
gucugguucucaau

SEQ ID NO: 1252285 - RNA, 18 nt, Human
gucugguugggcagccag

SEQ ID NO: 1252286 - RNA, 18 nt, Human
gucugguucucaauucca

SEQ ID NO: 1252287 - RNA, 23 nt, Human
caccccuaaaagaaacccugcac

SEQ ID NO: 1252288 - RNA, 14 nt, Human
caccccuaaagaga

SEQ ID NO: 1252289 - RNA, 19 nt, Human
caccccauucccgcagugg

SEQ ID NO: 1252290 - RNA, 12 nt, Human
cacccccaaggu

SEQ ID NO: 1252291 - RNA, 11 nt, Human
cacccccaccc

SEQ ID NO: 1252292 - RNA, 14 nt, Human
cacccccaccccca

SEQ ID NO: 1252293 - RNA, 17 nt, Human
cacccccacccccagcu

SEQ ID NO: 1252294 - RNA, 12 nt, Human
cacccccagccu

SEQ ID NO: 1252295 - RNA, 13 nt, Human
cacccccagccug

SEQ ID NO: 1252296 - RNA, 14 nt, Human
cacccccagccugg

SEQ ID NO: 1252297 - RNA, 15 nt, Human
cacccccagccuggg

SEQ ID NO: 1252298 - RNA, 16 nt, Human
cacccccagccugggc

SEQ ID NO: 1252299 - RNA, 17 nt, Human
cacccccagccugggcc

SEQ ID NO: 1252300 - RNA, 18 nt, Human
cacccccagccugggccu

SEQ ID NO: 1252301 - RNA, 19 nt, Human
cacccccagccugggccua

SEQ ID NO: 1252302 - RNA, 12 nt, Human
cacccccagcuc

SEQ ID NO: 1252303 - RNA, 13 nt, Human
cacccccagcuca

SEQ ID NO: 1252304 - RNA, 14 nt, Human
cacccccagcucaa

SEQ ID NO: 1252305 - RNA, 12 nt, Human
cacccccagcuu

SEQ ID NO: 1252306 - RNA, 14 nt, Human
caccccccaagcug

SEQ ID NO: 1252307 - RNA, 15 nt, Human
caccccccaagcugu

SEQ ID NO: 1252308 - RNA, 16 nt, Human
caccccgacuuuuguu

SEQ ID NO: 1252309 - RNA, 12 nt, Human
cacccccuuucc

SEQ ID NO: 1252310 - RNA, 14 nt, Human
cacccccuuuccug

SEQ ID NO: 1252311 - RNA, 16 nt, Human
caccccgccugcccuc

SEQ ID NO: 1252312 - RNA, 18 nt, Human
cacccccuucuccaucca

SEQ ID NO: 1252313 - RNA, 18 nt, Human
cacccccggcagcagccc

SEQ ID NO: 1252314 - RNA, 21 nt, Human
cacccccggcagcagccccca

SEQ ID NO: 1252315 - RNA, 11 nt, Human
cacccccguca

SEQ ID NO: 1252316 - RNA, 18 nt, Human
cacccccucaccccucca

SEQ ID NO: 1252317 - RNA, 12 nt, Human
cacccccugcag

SEQ ID NO: 1252318 - RNA, 13 nt, Human
cacccccugcagc

SEQ ID NO: 1252319 - RNA, 14 nt, Human
cacccccugcagcu

SEQ ID NO: 1252320 - RNA, 17 nt, Human
cacccccugcagcuugu

SEQ ID NO: 1252321 - RNA, 22 nt, Human
cacccaccaguugaauuucauc

SEQ ID NO: 1252322 - RNA, 14 nt, Human
cacccaccccugca

SEQ ID NO: 1252323 - RNA, 16 nt, Human
cacccaccccugcaca

SEQ ID NO: 1252324 - RNA, 13 nt, Human
caccccagggcag

SEQ ID NO: 1252325 - RNA, 16 nt, Human
caccccagggcagcca

SEQ ID NO: 1252326 - RNA, 18 nt, Human
caccccagggcagccagg

SEQ ID NO: 1252327 - RNA, 22 nt, Human
caccccagggcagccagggaga

SEQ ID NO: 1252328 - RNA, 19 nt, Human
caccccagggcagccaggg

SEQ ID NO: 1252329 - RNA, 13 nt, Human
caccccauucccg

SEQ ID NO: 1252330 - RNA, 15 nt, Human
caccccauucccgca

SEQ ID NO: 1252331 - RNA, 17 nt, Human
caccccauucccgcagu

SEQ ID NO: 1252332 - RNA, 14 nt, Human
caccagacacccag

SEQ ID NO: 1252333 - RNA, 16 nt, Human
cacccaauucaaaaca

SEQ ID NO: 1252334 - RNA, 17 nt, Human
cacccaauucaaaacau

SEQ ID NO: 1252335 - RNA, 16 nt, Human
cacccaccaacccuca

SEQ ID NO: 1252336 - RNA, 17 nt, Human
cacccaccaacccucag

SEQ ID NO: 1252337 - RNA, 18 nt, Human
cacccaccaacccucagg

SEQ ID NO: 1252338 - RNA, 20 nt, Human
cacccaccaacccucagggc

SEQ ID NO: 1252339 - RNA, 12 nt, Human
caccacucuggc

SEQ ID NO: 1252340 - RNA, 13 nt, Human
caccacucuggca

SEQ ID NO: 1252341 - RNA, 14 nt, Human
caccacucuggcag

SEQ ID NO: 1252342 - RNA, 15 nt, Human
caccacucuggcagc

SEQ ID NO: 1252343 - RNA, 17 nt, Human
caccacucuggcagcca

SEQ ID NO: 1252344 - RNA, 18 nt, Human
caccacucuggcagccac

SEQ ID NO: 1252345 - RNA, 19 nt, Human
caccacucuggcagccaca

SEQ ID NO: 1252346 - RNA, 21 nt, Human
caccacucuggcagccacacu

SEQ ID NO: 1252347 - RNA, 23 nt, Human
caccacugcccccugcugccaug

SEQ ID NO: 1252348 - RNA, 15 nt, Human
caccccuaaagagau

SEQ ID NO: 1252349 - RNA, 15 nt, Human
caaaaaacuacuucu

SEQ ID NO: 1252350 - RNA, 11 nt, Human
caaaaaacuac

SEQ ID NO: 1252351 - RNA, 18 nt, Human
caaaaaaaucuuccaauu

SEQ ID NO: 1252352 - RNA, 12 nt, Human
caaaaaagaaaa

SEQ ID NO: 1252353 - RNA, 14 nt, Human
caaaaaagaaaacc

SEQ ID NO: 1252354 - RNA, 18 nt, Human
auuuuuuuaauuuacaaa

SEQ ID NO: 1252355 - RNA, 18 nt, Human
caaacuuggauacuugga

SEQ ID NO: 1252356 - RNA, 18 nt, Human
caaacuuuuauacucuuu

SEQ ID NO: 1252357 - RNA, 12 nt, Human
caaacuuugcau

SEQ ID NO: 1252358 - RNA, 13 nt, Human
caaacuuugcauc

SEQ ID NO: 1252359 - RNA, 20 nt, Human
caaacuuugcaucucaguau

SEQ ID NO: 1252360 - RNA, 16 nt, Human
caaagaaacaaagaug

SEQ ID NO: 1252361 - RNA, 17 nt, Human
caaagaaacaaagaugu

SEQ ID NO: 1252362 - RNA, 13 nt, Human
caaagaaagugua

SEQ ID NO: 1252363 - RNA, 14 nt, Human
caaagaaaguguau

SEQ ID NO: 1252364 - RNA, 20 nt, Human
caaagaggcugaggcuggca

SEQ ID NO: 1252365 - RNA, 22 nt, Human
caaagaggcugaggcuggcaca

SEQ ID NO: 1252366 - RNA, 12 nt, Human
caaagaggcugc

SEQ ID NO: 1252367 - RNA, 13 nt, Human
caaagaggcugcc

SEQ ID NO: 1252368 - RNA, 15 nt, Human
caaagaggcugcccc

SEQ ID NO: 1252369 - RNA, 16 nt, Human
caaagaggcugccccu

SEQ ID NO: 1252370 - RNA, 21 nt, Human
caaagaggcugccccucucac

SEQ ID NO: 1252371 - RNA, 22 nt, Human
caaagaggcugccccucucacc

SEQ ID NO: 1252372 - RNA, 23 nt, Human
caaagaggcugccccucucacca

SEQ ID NO: 1252373 - RNA, 13 nt, Human
caaagagguauuu

SEQ ID NO: 1252374 - RNA, 16 nt, Human
caaagagguauuuauc

SEQ ID NO: 1252375 - RNA, 19 nt, Human
caaagcaugggauuauuag

SEQ ID NO: 1252376 - RNA, 13 nt, Human
caaagcuuuccug

SEQ ID NO: 1252377 - RNA, 14 nt, Human
caaagcuuuccugc

SEQ ID NO: 1252378 - RNA, 16 nt, Human
caaagcuuuccugccc

SEQ ID NO: 1252379 - RNA, 18 nt, Human
caaagcuuuccugcccca

SEQ ID NO: 1252380 - RNA, 22 nt, Human
caaagcuuuccugccccaggcc

SEQ ID NO: 1252381 - RNA, 23 nt, Human
caaagcuuuccugccccaggccu

SEQ ID NO: 1252382 - RNA, 16 nt, Human
caaagcuuuuuccaga

SEQ ID NO: 1252383 - RNA, 12 nt, Human
caaauauauuca

SEQ ID NO: 1252384 - RNA, 16 nt, Human
caaauagaaaaugguc

SEQ ID NO: 1252385 - RNA, 15 nt, Human
caaauagcauaaguu

SEQ ID NO: 1252386 - RNA, 18 nt, Human
caaauaggaugcuuggga

SEQ ID NO: 1252387 - RNA, 20 nt, Human
caaauaauuuuucacuucaa

SEQ ID NO: 1252388 - RNA, 19 nt, Human
caaauacauuuaaaacauu

SEQ ID NO: 1252389 - RNA, 15 nt, Human
caaaguuguuguaac

SEQ ID NO: 1252390 - RNA, 22 nt, Human
caaaguuguuguaaccugcugu

SEQ ID NO: 1252391 - RNA, 13 nt, Human
caaaguuuaauaa

SEQ ID NO: 1252392 - RNA, 14 nt, Human
caaaggaugugaua

SEQ ID NO: 1252393 - RNA, 17 nt, Human
caaaggaugugauauau

SEQ ID NO: 1252394 - RNA, 21 nt, Human
caaaggaugugauauauaagu

SEQ ID NO: 1252395 - RNA, 15 nt, Human
caaaggcaagcacuu

SEQ ID NO: 1252396 - RNA, 13 nt, Human
caaaggaugugau

SEQ ID NO: 1252397 - RNA, 20 nt, Human
caaaguuuaauaaauuuauu

SEQ ID NO: 1252398 - RNA, 19 nt, Human
caaaguuuaccagaaagca

SEQ ID NO: 1252399 - RNA, 12 nt, Human
caaaguuucaau

SEQ ID NO: 1252400 - RNA, 16 nt, Human
caaaguuucaauuugu

SEQ ID NO: 1252401 - RNA, 17 nt, Human
caaauaaaaagugcuuu

SEQ ID NO: 1252402 - RNA, 18 nt, Human
caaauaaaaagugcuuuu

SEQ ID NO: 1252403 - RNA, 14 nt, Human
caaaucacugaacu

SEQ ID NO: 1252404 - RNA, 19 nt, Human
caaaucaccacaaacugua

SEQ ID NO: 1252405 - RNA, 20 nt, Human
caaaucaccacaaacuguaa

SEQ ID NO: 1252406 - RNA, 15 nt, Human
caaaucaccacaaac

SEQ ID NO: 1252407 - RNA, 15 nt, Human
caaaucacugaacuu

SEQ ID NO: 1252408 - RNA, 14 nt, Human
caaaucagaaguca

SEQ ID NO: 1252409 - RNA, 15 nt, Human
caaaucagaagucau

SEQ ID NO: 1252410 - RNA, 22 nt, Human
caaaucagaagucaucuugcua

SEQ ID NO: 1252411 - RNA, 15 nt, Human
caaaugucuuccugg

SEQ ID NO: 1252412 - RNA, 18 nt, Human
caaaugucuuccuggauu

SEQ ID NO: 1252413 - RNA, 17 nt, Human
caaauucaguuucauaa

SEQ ID NO: 1252414 - RNA, 15 nt, Human
caaauguuuaaucau

SEQ ID NO: 1252415 - RNA, 20 nt, Human
caaauucaguuucauaaaag

SEQ ID NO: 1252416 - RNA, 18 nt, Human
caaauucaguuucauaaa

SEQ ID NO: 1252417 - RNA, 13 nt, Human
caaauguuuaauc

SEQ ID NO: 1252418 - RNA, 22 nt, Human
caaauguucuaaguuucuaaga

SEQ ID NO: 1252419 - RNA, 23 nt, Human
caaauguucuaaguuucuaagau

SEQ ID NO: 1252420 - RNA, 14 nt, Human
caaauguucuaagu

SEQ ID NO: 1252421 - RNA, 15 nt, Human
caaauguucuaaguu

SEQ ID NO: 1252422 - RNA, 19 nt, Human
caaauguucuaaguuucua

SEQ ID NO: 1252423 - RNA, 21 nt, Human
caaauguucuaaguuucuaag

SEQ ID NO: 1252424 - RNA, 15 nt, Human
caaauguuaaaaugu

SEQ ID NO: 1252425 - RNA, 16 nt, Human
caaauguuaaaaugug

SEQ ID NO: 1252426 - RNA, 12 nt, Human
caaauguucuaa

SEQ ID NO: 1252427 - RNA, 21 nt, Human
caaauguucaucaaugaauga

SEQ ID NO: 1252428 - RNA, 18 nt, Human
caaauguuaaaauguguu

SEQ ID NO: 1252429 - RNA, 14 nt, Human
caaauguggcuccu

SEQ ID NO: 1252430 - RNA, 14 nt, Human
caaaugugcuuuga

SEQ ID NO: 1252431 - RNA, 18 nt, Human
caaaugugcuuugagaag

SEQ ID NO: 1252432 - RNA, 17 nt, Human
caacagguaaaacaggg

SEQ ID NO: 1252433 - RNA, 16 nt, Human
caacuucuaauugcca

SEQ ID NO: 1252434 - RNA, 12 nt, Human
caacuuuguaua

SEQ ID NO: 1252435 - RNA, 15 nt, Human
caagaaaacaggcac

SEQ ID NO: 1252436 - RNA, 16 nt, Human
caagaaaacaggcacu

SEQ ID NO: 1252437 - RNA, 17 nt, Human
caagaaaacaggcacug

SEQ ID NO: 1252438 - RNA, 11 nt, Human
caacuuuguau

SEQ ID NO: 1252439 - RNA, 14 nt, Human
caacuucaguccaa

SEQ ID NO: 1252440 - RNA, 14 nt, Human
caacuuacuacuga

SEQ ID NO: 1252441 - RNA, 11 nt, Human
caacuuauuaa

SEQ ID NO: 1252442 - RNA, 14 nt, Human
caacuucguuuccu

SEQ ID NO: 1252443 - RNA, 14 nt, Human
caacuucuaauugc

SEQ ID NO: 1252444 - RNA, 15 nt, Human
caacugcuaaucuac

SEQ ID NO: 1252445 - RNA, 11 nt, Human
caacugcuccc

SEQ ID NO: 1252446 - RNA, 14 nt, Human
caacugcucccacc

SEQ ID NO: 1252447 - RNA, 15 nt, Human
caacugcucccaccu

SEQ ID NO: 1252448 - RNA, 17 nt, Human
caacugcucccaccucc

SEQ ID NO: 1252449 - RNA, 18 nt, Human
caacugcucccaccuccu

SEQ ID NO: 1252450 - RNA, 18 nt, Human
caacugccuacuccaaaa

SEQ ID NO: 1252451 - RNA, 22 nt, Human
caacugccuacuccaaaauguu

SEQ ID NO: 1252452 - RNA, 21 nt, Human
caacugccucgaaacacagaa

SEQ ID NO: 1252453 - RNA, 23 nt, Human
caacugccucgaaacacagaaac

SEQ ID NO: 1252454 - RNA, 19 nt, Human
caacugcucccaccuccug

SEQ ID NO: 1252455 - RNA, 22 nt, Human
caacugcucccaccuccugaca

SEQ ID NO: 1252456 - RNA, 22 nt, Human
caacuuaauacucaaaugagua

SEQ ID NO: 1252457 - RNA, 21 nt, Human
caacucugaaggguaauuaua

SEQ ID NO: 1252458 - RNA, 13 nt, Human
caacucucuuauu

SEQ ID NO: 1252459 - RNA, 16 nt, Human
caacucucuuauugcc

SEQ ID NO: 1252460 - RNA, 21 nt, Human
caacucucuuauugccucacu

SEQ ID NO: 1252461 - RNA, 22 nt, Human
caacucucuuauugccucacuu

SEQ ID NO: 1252462 - RNA, 21 nt, Human
caacucuucccccucucccag

SEQ ID NO: 1252463 - RNA, 14 nt, Human
caacugccuacucc

SEQ ID NO: 1252464 - RNA, 15 nt, Human
caacugccuacucca

SEQ ID NO: 1252465 - RNA, 18 nt, Human
caacgcagcccugcuuug

SEQ ID NO: 1252466 - RNA, 14 nt, Human
caacgcuauuccag

SEQ ID NO: 1252467 - RNA, 12 nt, Human
caacgcagcccu

SEQ ID NO: 1252468 - RNA, 13 nt, Human
caacgcagcccug

SEQ ID NO: 1252469 - RNA, 15 nt, Human
caacgcagcccugcu

SEQ ID NO: 1252470 - RNA, 21 nt, Human
caaccugaauacccuuuucug

SEQ ID NO: 1252471 - RNA, 13 nt, Human
caaccucuuggcc

SEQ ID NO: 1252472 - RNA, 15 nt, Human
caaccucuuggccug

SEQ ID NO: 1252473 - RNA, 24 nt, Human
caaccugaauacccuuuucugacc

SEQ ID NO: 1252474 - RNA, 11 nt, Human
caacccucagg

SEQ ID NO: 1252475 - RNA, 12 nt, Human
caacccucaggg

SEQ ID NO: 1252476 - RNA, 13 nt, Human
caacccucagggc

SEQ ID NO: 1252477 - RNA, 21 nt, Human
caacccucagggcaaagccag

SEQ ID NO: 1252478 - RNA, 22 nt, Human
caacccucagggcaaagccagg

SEQ ID NO: 1252479 - RNA, 17 nt, Human
caacccuucccucaccu

SEQ ID NO: 1252480 - RNA, 18 nt, Human
caacccuucccucaccuu

SEQ ID NO: 1252481 - RNA, 19 nt, Human
caacccuuccugaaacuuc

SEQ ID NO: 1252482 - RNA, 18 nt, Human
caaauucugucucuggau

SEQ ID NO: 1252483 - RNA, 15 nt, Human
caaauucugucucug

SEQ ID NO: 1252484 - RNA, 14 nt, Human
caaauuuacagaga

SEQ ID NO: 1252485 - RNA, 15 nt, Human
caaauuuacagagac

SEQ ID NO: 1252486 - RNA, 16 nt, Human
caaauuuacagagaca

SEQ ID NO: 1252487 - RNA, 19 nt, Human
caaauuuaaaacuguugga

SEQ ID NO: 1252488 - RNA, 23 nt, Human
caacagguaaaacagggccacau

SEQ ID NO: 1252489 - RNA, 15 nt, Human
caacaguaaaccacu

SEQ ID NO: 1252490 - RNA, 20 nt, Human
caacaucacagcccagcccg

SEQ ID NO: 1252491 - RNA, 17 nt, Human
caacaucacagcccagc

SEQ ID NO: 1252492 - RNA, 22 nt, Human
caacaguaaaccacugaaaaaa

SEQ ID NO: 1252493 - RNA, 17 nt, Human
caacaguaaaccacuga

SEQ ID NO: 1252494 - RNA, 16 nt, Human
caacagugaagacaga

SEQ ID NO: 1252495 - RNA, 14 nt, Human
caacaucacagccc

SEQ ID NO: 1252496 - RNA, 16 nt, Human
caacaucacagcccag

SEQ ID NO: 1252497 - RNA, 21 nt, Human
caacccucagagccaccccua

SEQ ID NO: 1252498 - RNA, 16 nt, Human
caacauuguagccuca

SEQ ID NO: 1252499 - RNA, 16 nt, Human
caacauuucaaaauga

SEQ ID NO: 1252500 - RNA, 22 nt, Human
caacauuucuauagccaaaaau

SEQ ID NO: 1252501 - RNA, 14 nt, Human
caacauuucucaau

SEQ ID NO: 1252502 - RNA, 16 nt, Human
caacauuucucaauaa

SEQ ID NO: 1252503 - RNA, 17 nt, Human
caacauuucucaauaau

SEQ ID NO: 1252504 - RNA, 22 nt, Human
caaccaagaauguuaugugcaa

SEQ ID NO: 1252505 - RNA, 14 nt, Human
caaccaauggaaug

SEQ ID NO: 1252506 - RNA, 14 nt, Human
caaccacacccaca

SEQ ID NO: 1252507 - RNA, 19 nt, Human
caacaugaggccacuggag

SEQ ID NO: 1252508 - RNA, 15 nt, Human
caacaugaugaggua

SEQ ID NO: 1252509 - RNA, 15 nt, Human
caacaugcacugaug

SEQ ID NO: 1252510 - RNA, 22 nt, Human
caacaugaugagguaguaccuu

SEQ ID NO: 1252511 - RNA, 12 nt, Human
caacauggcuuu

SEQ ID NO: 1252512 - RNA, 13 nt, Human
caacauggcuuug

SEQ ID NO: 1252513 - RNA, 15 nt, Human
caacauguuauuugu

SEQ ID NO: 1252514 - RNA, 22 nt, Human
caacauguuauuuguaauagau

SEQ ID NO: 1252515 - RNA, 19 nt, Human
caacauguugggaaacuug

SEQ ID NO: 1252516 - RNA, 22 nt, Human
caacauguugggaaacuuggcu

SEQ ID NO: 1252517 - RNA, 23 nt, Human
caacauguugggaaacuuggcuc

SEQ ID NO: 1252518 - RNA, 20 nt, Human
caacauguuuccagcauucc

SEQ ID NO: 1252519 - RNA, 23 nt, Human
caacauguuauuuguaauagaug

SEQ ID NO: 1252520 - RNA, 22 nt, Human
caagugcagggccuguaauccc

SEQ ID NO: 1252521 - RNA, 23 nt, Human
caagucuuucucuuucccugguc

SEQ ID NO: 1252522 - RNA, 19 nt, Human
caaguggguacccccagga

SEQ ID NO: 1252523 - RNA, 17 nt, Human
caaguggguacccccag

SEQ ID NO: 1252524 - RNA, 22 nt, Human
caagugauucucaugccucagc

SEQ ID NO: 1252525 - RNA, 17 nt, Human
caagucuuucucuuucc

SEQ ID NO: 1252526 - RNA, 19 nt, Human
caagucuuucucuuucccu

SEQ ID NO: 1252527 - RNA, 20 nt, Human
caagucuuucucuuucccug

SEQ ID NO: 1252528 - RNA, 21 nt, Human
caagucuuucucuuucccugg

SEQ ID NO: 1252529 - RNA, 14 nt, Human
caagucuaccaauu

SEQ ID NO: 1252530 - RNA, 14 nt, Human
caagucuguuuacu

SEQ ID NO: 1252531 - RNA, 20 nt, Human
caagucuguuuacugcaagg

SEQ ID NO: 1252532 - RNA, 20 nt, Human
caagggcuuuguuuugcaca

SEQ ID NO: 1252533 - RNA, 14 nt, Human
caaggucugcuuuu

SEQ ID NO: 1252534 - RNA, 14 nt, Human
caaggucuuugguu

SEQ ID NO: 1252535 - RNA, 13 nt, Human
caaggucuuuaaa

SEQ ID NO: 1252536 - RNA, 13 nt, Human
caagguguccuac

SEQ ID NO: 1252537 - RNA, 18 nt, Human
caaguccugccucuuaaa

SEQ ID NO: 1252538 - RNA, 17 nt, Human
caagcacuaaacaaaga

SEQ ID NO: 1252539 - RNA, 14 nt, Human
caagcacuucuuuu

SEQ ID NO: 1252540 - RNA, 18 nt, Human
caagccaagggaaccugu

SEQ ID NO: 1252541 - RNA, 19 nt, Human
caagaaacugaggaauuuu

SEQ ID NO: 1252542 - RNA, 19 nt, Human
caagaaaacaggcacugcc

SEQ ID NO: 1252543 - RNA, 20 nt, Human
caagaaaacaggcacugccc

SEQ ID NO: 1252544 - RNA, 21 nt, Human
caagaaaacaggcacugcccu

SEQ ID NO: 1252545 - RNA, 22 nt, Human
caagaaaacaggcacugcccug

SEQ ID NO: 1252546 - RNA, 23 nt, Human
caagaaaacaggcacugcccugg

SEQ ID NO: 1252547 - RNA, 20 nt, Human
caagaaaauaagagcucagg

SEQ ID NO: 1252548 - RNA, 18 nt, Human
caagaaaauaagagcuca

SEQ ID NO: 1252549 - RNA, 18 nt, Human
caagaaacugaggaauuu

SEQ ID NO: 1252550 - RNA, 17 nt, Human
caagccguggcuucccg

SEQ ID NO: 1252551 - RNA, 14 nt, Human
caagccguggcuuc

SEQ ID NO: 1252552 - RNA, 15 nt, Human
caagccguggcuucc

SEQ ID NO: 1252553 - RNA, 16 nt, Human
caagccguggcuuccc

SEQ ID NO: 1252554 - RNA, 21 nt, Human
caagccaagggaaccuguguc

SEQ ID NO: 1252555 - RNA, 22 nt, Human
caagccaagggaaccugugucc

SEQ ID NO: 1252556 - RNA, 23 nt, Human
caagccaagggaaccuguguccg

SEQ ID NO: 1252557 - RNA, 19 nt, Human
caaggaugccccguccccc

SEQ ID NO: 1252558 - RNA, 20 nt, Human
caaggauagaugcuggccca

SEQ ID NO: 1252559 - RNA, 21 nt, Human
caaggauagaugcuggcccag

SEQ ID NO: 1252560 - RNA, 22 nt, Human
caaggauagaugcuggcccagg

SEQ ID NO: 1252561 - RNA, 23 nt, Human
caaggauagaugcuggcccaggg

SEQ ID NO: 1252562 - RNA, 14 nt, Human
caaggacuaggguc

SEQ ID NO: 1252563 - RNA, 17 nt, Human
caaggagucacugagac

SEQ ID NO: 1252564 - RNA, 18 nt, Human
caaggagucacugagacc

SEQ ID NO: 1252565 - RNA, 16 nt, Human
caaggagucagacauu

SEQ ID NO: 1252566 - RNA, 17 nt, Human
caaggauagaaguauac

SEQ ID NO: 1252567 - RNA, 15 nt, Human
caaggauagaugcug

SEQ ID NO: 1252568 - RNA, 16 nt, Human
caaggauagaugcugg

SEQ ID NO: 1252569 - RNA, 17 nt, Human
caaggauagaugcuggc

SEQ ID NO: 1252570 - RNA, 15 nt, Human
caaggaaaaacaggu

SEQ ID NO: 1252571 - RNA, 13 nt, Human
caagcggugucuc

SEQ ID NO: 1252572 - RNA, 15 nt, Human
caagcggugucucuc

SEQ ID NO: 1252573 - RNA, 16 nt, Human
caagcggugucucucc

SEQ ID NO: 1252574 - RNA, 13 nt, Human
caaggaaaggcac

SEQ ID NO: 1252575 - RNA, 16 nt, Human
cacauuccugaacagg

SEQ ID NO: 1252576 - RNA, 22 nt, Human
cacauucaaaauaggguauauu

SEQ ID NO: 1252577 - RNA, 23 nt, Human
cacauucagggcuauuuuuuccc

SEQ ID NO: 1252578 - RNA, 15 nt, Human
cacauguuuucucug

SEQ ID NO: 1252579 - RNA, 12 nt, Human
cacauuaaagaa

SEQ ID NO: 1252580 - RNA, 16 nt, Human
cacauuaaagaagacc

SEQ ID NO: 1252581 - RNA, 20 nt, Human
cacauuaaagaagaccugag

SEQ ID NO: 1252582 - RNA, 21 nt, Human
cacauuagaagacaauugaca

SEQ ID NO: 1252583 - RNA, 21 nt, Human
cacauuaggaaaaguugcuau

SEQ ID NO: 1252584 - RNA, 13 nt, Human
cacauguggacuu

SEQ ID NO: 1252585 - RNA, 22 nt, Human
cacaugugagcaugucacuucc

SEQ ID NO: 1252586 - RNA, 14 nt, Human
cacaugugcugccc

SEQ ID NO: 1252587 - RNA, 12 nt, Human
cacauguguggu

SEQ ID NO: 1252588 - RNA, 12 nt, Human
cacauguuuccu

SEQ ID NO: 1252589 - RNA, 14 nt, Human
cacauguuuccucu

SEQ ID NO: 1252590 - RNA, 15 nt, Human
cacauguuuccucua

SEQ ID NO: 1252591 - RNA, 12 nt, Human
cacauguccagu

SEQ ID NO: 1252592 - RNA, 18 nt, Human
cacaugggugaacacuca

SEQ ID NO: 1252593 - RNA, 17 nt, Human
cacauguaucuaugcau

SEQ ID NO: 1252594 - RNA, 17 nt, Human
cacauauuuuaaaauuu

SEQ ID NO: 1252595 - RNA, 13 nt, Human
cacaucaaagagg

SEQ ID NO: 1252596 - RNA, 20 nt, Human
cacaucacaagacuaugcca

SEQ ID NO: 1252597 - RNA, 14 nt, Human
cacaucacagauga

SEQ ID NO: 1252598 - RNA, 23 nt, Human
cacauggccccucccccugccag

SEQ ID NO: 1252599 - RNA, 17 nt, Human
cacauauuucagugagg

SEQ ID NO: 1252600 - RNA, 18 nt, Human
cacauauccaggcaccag

SEQ ID NO: 1252601 - RNA, 12 nt, Human
cacauauuuuaa

SEQ ID NO: 1252602 - RNA, 14 nt, Human
cacauauuuuaaaa

SEQ ID NO: 1252603 - RNA, 15 nt, Human
cacauauuuuaaaau

SEQ ID NO: 1252604 - RNA, 18 nt, Human
cacauuggagauguuuag

SEQ ID NO: 1252605 - RNA, 17 nt, Human
cacauuggaaacaaguc

SEQ ID NO: 1252606 - RNA, 20 nt, Human
cacauugcugugaacaggaa

SEQ ID NO: 1252607 - RNA, 21 nt, Human
cacauuggaagagcagcaccu

SEQ ID NO: 1252608 - RNA, 13 nt, Human
caccacagccagc

SEQ ID NO: 1252609 - RNA, 17 nt, Human
caccacagccagcaccu

SEQ ID NO: 1252610 - RNA, 19 nt, Human
caccacagccagcaccugg

SEQ ID NO: 1252611 - RNA, 13 nt, Human
caccaagccuuga

SEQ ID NO: 1252612 - RNA, 16 nt, Human
caccaagcuaggugcu

SEQ ID NO: 1252613 - RNA, 13 nt, Human
caccaagcugcug

SEQ ID NO: 1252614 - RNA, 13 nt, Human
caccaccaagcca

SEQ ID NO: 1252615 - RNA, 20 nt, Human
caccacccugcucauccacu

SEQ ID NO: 1252616 - RNA, 15 nt, Human
caccacuagccucag

SEQ ID NO: 1252617 - RNA, 18 nt, Human
caccacuagccucagggg

SEQ ID NO: 1252618 - RNA, 20 nt, Human
cacaggaaccacaagacugc

SEQ ID NO: 1252619 - RNA, 15 nt, Human
cacaggaaguagagg

SEQ ID NO: 1252620 - RNA, 20 nt, Human
cacagccuccccugccaggg

SEQ ID NO: 1252621 - RNA, 21 nt, Human
cacagccuccccugccagggc

SEQ ID NO: 1252622 - RNA, 23 nt, Human
cacagccuccccugccagggcag

SEQ ID NO: 1252623 - RNA, 22 nt, Human
cacaggaagccugcaguccugg

SEQ ID NO: 1252624 - RNA, 20 nt, Human
cacaggaguguccucuuccc

SEQ ID NO: 1252625 - RNA, 10 nt, Human
cacaggcagc

SEQ ID NO: 1252626 - RNA, 22 nt, Human
cacaggaguguccucuucccuc

SEQ ID NO: 1252627 - RNA, 11 nt, Human
cacaggcagcc

SEQ ID NO: 1252628 - RNA, 15 nt, Human
cacaggcagccagug

SEQ ID NO: 1252629 - RNA, 16 nt, Human
cacaggcagccagugc

SEQ ID NO: 1252630 - RNA, 17 nt, Human
cacaggcagccagugcc

SEQ ID NO: 1252631 - RNA, 19 nt, Human
cacaggcagccagugcccu

SEQ ID NO: 1252632 - RNA, 20 nt, Human
cacaggcagccagugcccug

SEQ ID NO: 1252633 - RNA, 23 nt, Human
cacaggcagccagugcccugagc

SEQ ID NO: 1252634 - RNA, 15 nt, Human
cacaggcccuuccuc

SEQ ID NO: 1252635 - RNA, 13 nt, Human
cacaggcccuccc

SEQ ID NO: 1252636 - RNA, 23 nt, Human
cacaguugaagggaggggcugug

SEQ ID NO: 1252637 - RNA, 23 nt, Human
cacaguucuuugggccagacaug

SEQ ID NO: 1252638 - RNA, 18 nt, Human
cacaguugaagggagggg

SEQ ID NO: 1252639 - RNA, 15 nt, Human
cacauauccaggcac

SEQ ID NO: 1252640 - RNA, 19 nt, Human
cacauauccaggcaccagg

SEQ ID NO: 1252641 - RNA, 22 nt, Human
cacauaauucaggaagcagcuu

SEQ ID NO: 1252642 - RNA, 15 nt, Human
cacaguuugaaauaa

SEQ ID NO: 1252643 - RNA, 12 nt, Human
cacauaaaacuu

SEQ ID NO: 1252644 - RNA, 13 nt, Human
cacaguuugaaau

SEQ ID NO: 1252645 - RNA, 13 nt, Human
cacagauggccag

SEQ ID NO: 1252646 - RNA, 14 nt, Human
cacagauggccagc

SEQ ID NO: 1252647 - RNA, 20 nt, Human
cacagcacgggggccaagga

SEQ ID NO: 1252648 - RNA, 19 nt, Human
cacagcaccagaauguaua

SEQ ID NO: 1252649 - RNA, 16 nt, Human
cacagcaccagaaugu

SEQ ID NO: 1252650 - RNA, 16 nt, Human
cacagcagccccugca

SEQ ID NO: 1252651 - RNA, 12 nt, Human
cacagcagccug

SEQ ID NO: 1252652 - RNA, 22 nt, Human
cacagccaacacgcaccugccu

SEQ ID NO: 1252653 - RNA, 14 nt, Human
cacagccuccccug

SEQ ID NO: 1252654 - RNA, 17 nt, Human
cacagccuccccugcca

SEQ ID NO: 1252655 - RNA, 19 nt, Human
cacagccuccccugccagg

SEQ ID NO: 1252656 - RNA, 19 nt, Human
cacagcaucucagcucauc

SEQ ID NO: 1252657 - RNA, 16 nt, Human
cacagcaucucagcuc

SEQ ID NO: 1252658 - RNA, 15 nt, Human
cacagcaucucagcu

SEQ ID NO: 1252659 - RNA, 16 nt, Human
cacagcauuguauaug

SEQ ID NO: 1252660 - RNA, 16 nt, Human
cacagccaaauuuaaa

SEQ ID NO: 1252661 - RNA, 14 nt, Human
cacagcaucucagc

SEQ ID NO: 1252662 - RNA, 13 nt, Human
cacagcaucucag

SEQ ID NO: 1252663 - RNA, 12 nt, Human
cacagcaucuca

SEQ ID NO: 1252664 - RNA, 14 nt, Human
cacagcagccuggg

SEQ ID NO: 1252665 - RNA, 19 nt, Human
cacacugggacuugcaaaa

SEQ ID NO: 1252666 - RNA, 22 nt, Human
cacacugggugguggccugguc

SEQ ID NO: 1252667 - RNA, 14 nt, Human
cacacuucaggcuc

SEQ ID NO: 1252668 - RNA, 17 nt, Human
cacacuucaggcucuuc

SEQ ID NO: 1252669 - RNA, 16 nt, Human
cacacuuacuuuuucu

SEQ ID NO: 1252670 - RNA, 14 nt, Human
cacacuuacuuuuu

SEQ ID NO: 1252671 - RNA, 18 nt, Human
cacacuucaggcucuucu

SEQ ID NO: 1252672 - RNA, 20 nt, Human
cacacuucaggcucuucucc

SEQ ID NO: 1252673 - RNA, 21 nt, Human
cacacuucaggcucuucuccu

SEQ ID NO: 1252674 - RNA, 22 nt, Human
cacacuucaggcucuucuccuu

SEQ ID NO: 1252675 - RNA, 16 nt, Human
cacacuaccgaaugug

SEQ ID NO: 1252676 - RNA, 18 nt, Human
cacacuaccgaauguguc

SEQ ID NO: 1252677 - RNA, 22 nt, Human
cacacuaccgaaugugucuuua

SEQ ID NO: 1252678 - RNA, 21 nt, Human
cacacuaccgaaugugucuuu

SEQ ID NO: 1252679 - RNA, 19 nt, Human
cacacucaugcauuguccu

SEQ ID NO: 1252680 - RNA, 19 nt, Human
cacacucagauccuccuca

SEQ ID NO: 1252681 - RNA, 20 nt, Human
cacacucagauccuccucau

SEQ ID NO: 1252682 - RNA, 14 nt, Human
cacacugaugcuua

SEQ ID NO: 1252683 - RNA, 18 nt, Human
cacacugaugcuuagaug

SEQ ID NO: 1252684 - RNA, 12 nt, Human
cacacugcacaa

SEQ ID NO: 1252685 - RNA, 23 nt, Human
cacacuucucaggacacaggccu

SEQ ID NO: 1252686 - RNA, 17 nt, Human
cacacuucucaggacac

SEQ ID NO: 1252687 - RNA, 13 nt, Human
cacacuucaaacu

SEQ ID NO: 1252688 - RNA, 18 nt, Human
cacacuucaaacuacuuu

SEQ ID NO: 1252689 - RNA, 14 nt, Human
cacacuucucagga

SEQ ID NO: 1252690 - RNA, 10 nt, Human
cacacuuguc

SEQ ID NO: 1252691 - RNA, 23 nt, Human
cacagacggaaggguaaacaaua

SEQ ID NO: 1252692 - RNA, 13 nt, Human
cacagacuauuuu

SEQ ID NO: 1252693 - RNA, 14 nt, Human
cacagacuauuuuu

SEQ ID NO: 1252694 - RNA, 10 nt, Human
cacagagagu

SEQ ID NO: 1252695 - RNA, 17 nt, Human
cacagagauucugaacu

SEQ ID NO: 1252696 - RNA, 13 nt, Human
cacaacuauauug

SEQ ID NO: 1252697 - RNA, 11 nt, Human
cacaacuagga

SEQ ID NO: 1252698 - RNA, 19 nt, Human
cacaacucacuccuuuuaa

SEQ ID NO: 1252699 - RNA, 22 nt, Human
cacaacucacuccuuuuaaaga

SEQ ID NO: 1252700 - RNA, 18 nt, Human
cacacacaugcuucccuu

SEQ ID NO: 1252701 - RNA, 22 nt, Human
cacacacauugcugugaacagg

SEQ ID NO: 1252702 - RNA, 15 nt, Human
cacacagacuauuuu

SEQ ID NO: 1252703 - RNA, 14 nt, Human
cacacccuguuuua

SEQ ID NO: 1252704 - RNA, 21 nt, Human
cacacccuguacuguucugug

SEQ ID NO: 1252705 - RNA, 12 nt, Human
cacaccccacuc

SEQ ID NO: 1252706 - RNA, 17 nt, Human
cacaccccacucccaca

SEQ ID NO: 1252707 - RNA, 17 nt, Human
cacacgagaaccugaag

SEQ ID NO: 1252708 - RNA, 23 nt, Human
cacaccuuuuauugacacagaaa

SEQ ID NO: 1252709 - RNA, 16 nt, Human
cacaccuguagcacuu

SEQ ID NO: 1252710 - RNA, 22 nt, Human
cacaccuuuuauugacacagaa

SEQ ID NO: 1252711 - RNA, 19 nt, Human
cacaccuccuucccucucu

SEQ ID NO: 1252712 - RNA, 22 nt, Human
cacaccuccuucccucucugga

SEQ ID NO: 1252713 - RNA, 18 nt, Human
cacacagcuacucucccc

SEQ ID NO: 1252714 - RNA, 14 nt, Human
cacaccacuagccu

SEQ ID NO: 1252715 - RNA, 19 nt, Human
cacaccacuagccucaggg

SEQ ID NO: 1252716 - RNA, 13 nt, Human
cacaccagagaac

SEQ ID NO: 1252717 - RNA, 21 nt, Human
cacaccaggcuugccugcagg

SEQ ID NO: 1252718 - RNA, 22 nt, Human
cacaccaggcuugccugcaggc

SEQ ID NO: 1252719 - RNA, 15 nt, Human
cacaccagggccagc

SEQ ID NO: 1252720 - RNA, 18 nt, Human
cacaccagggccagccuc

SEQ ID NO: 1252721 - RNA, 19 nt, Human
cacaccagggccagccucu

SEQ ID NO: 1252722 - RNA, 20 nt, Human
cacaccagggccagccucua

SEQ ID NO: 1252723 - RNA, 23 nt, Human
cacaacucacuccuuuuaaagaa

SEQ ID NO: 1252724 - RNA, 20 nt, Human
caaugaucaccgacugaaaa

SEQ ID NO: 1252725 - RNA, 20 nt, Human
caaugacaugaauuuuagcu

SEQ ID NO: 1252726 - RNA, 19 nt, Human
caaugauccuguauucaga

SEQ ID NO: 1252727 - RNA, 14 nt, Human
caaugaugaaugag

SEQ ID NO: 1252728 - RNA, 14 nt, Human
caaugacaugaauu

SEQ ID NO: 1252729 - RNA, 15 nt, Human
caaugacaugaauuu

SEQ ID NO: 1252730 - RNA, 20 nt, Human
caaugagguguccaacuggc

SEQ ID NO: 1252731 - RNA, 12 nt, Human
caaugacaugaa

SEQ ID NO: 1252732 - RNA, 13 nt, Human
caaugacaugaau

SEQ ID NO: 1252733 - RNA, 22 nt, Human
caaugaaugaaugaauggcuaa

SEQ ID NO: 1252734 - RNA, 20 nt, Human
caaugaauaaaaacucaagg

SEQ ID NO: 1252735 - RNA, 21 nt, Human
caaugaauaaaaacucaagga

SEQ ID NO: 1252736 - RNA, 22 nt, Human
caaugaauaaaaacucaaggag

SEQ ID NO: 1252737 - RNA, 23 nt, Human
caaugaauuuuauaaucugcagc

SEQ ID NO: 1252738 - RNA, 14 nt, Human
caaugacaaagcag

SEQ ID NO: 1252739 - RNA, 15 nt, Human
caaugacaaagcaga

SEQ ID NO: 1252740 - RNA, 16 nt, Human
caaugacaaagcagau

SEQ ID NO: 1252741 - RNA, 21 nt, Human
caaugaugaaugagaaucuac

SEQ ID NO: 1252742 - RNA, 13 nt, Human
caaugauggcaau

SEQ ID NO: 1252743 - RNA, 16 nt, Human
caaugauggcaauuuu

SEQ ID NO: 1252744 - RNA, 21 nt, Human
caaugauggcaauuuuguaac

SEQ ID NO: 1252745 - RNA, 16 nt, Human
caaugcagugccuuuc

SEQ ID NO: 1252746 - RNA, 16 nt, Human
caaugcaguugucucu

SEQ ID NO: 1252747 - RNA, 22 nt, Human
caauccucccacuucagccucc

SEQ ID NO: 1252748 - RNA, 18 nt, Human
caauccucccacuucagc

SEQ ID NO: 1252749 - RNA, 23 nt, Human
caauccuaugcaugguuucagca

SEQ ID NO: 1252750 - RNA, 15 nt, Human
caauccucccagaaa

SEQ ID NO: 1252751 - RNA, 11 nt, Human
caauccuggac

SEQ ID NO: 1252752 - RNA, 21 nt, Human
caaugaaaugaauuaaagugg

SEQ ID NO: 1252753 - RNA, 23 nt, Human
caaugaaaugaauuaaaguggac

SEQ ID NO: 1252754 - RNA, 17 nt, Human
caaugaacaucccuuuu

SEQ ID NO: 1252755 - RNA, 12 nt, Human
caauccuaugca

SEQ ID NO: 1252756 - RNA, 14 nt, Human
caauccuaugcaug

SEQ ID NO: 1252757 - RNA, 16 nt, Human
caauccuaugcauggu

SEQ ID NO: 1252758 - RNA, 18 nt, Human
caauccuaugcaugguuu

SEQ ID NO: 1252759 - RNA, 20 nt, Human
caauccuaugcaugguuuca

SEQ ID NO: 1252760 - RNA, 22 nt, Human
caauccuaugcaugguuucagc

SEQ ID NO: 1252761 - RNA, 14 nt, Human
caauccuauguuuu

SEQ ID NO: 1252762 - RNA, 20 nt, Human
caauccuauguuuuuguuca

SEQ ID NO: 1252763 - RNA, 17 nt, Human
caauagucaaauugugu

SEQ ID NO: 1252764 - RNA, 18 nt, Human
caauaugggggccuuuug

SEQ ID NO: 1252765 - RNA, 15 nt, Human
caaguguaaaauauu

SEQ ID NO: 1252766 - RNA, 16 nt, Human
caaguguaaaauauuu

SEQ ID NO: 1252767 - RNA, 21 nt, Human
caaguguaaaauauuuugaau

SEQ ID NO: 1252768 - RNA, 21 nt, Human
cacaaauucugucucuggauu

SEQ ID NO: 1252769 - RNA, 15 nt, Human
cacaaauuaucuuaa

SEQ ID NO: 1252770 - RNA, 17 nt, Human
cacaaauuauuaaugaa

SEQ ID NO: 1252771 - RNA, 20 nt, Human
cacaaauuauuaaugaaaau

SEQ ID NO: 1252772 - RNA, 22 nt, Human
cacaacacacagauuugagcuc

SEQ ID NO: 1252773 - RNA, 23 nt, Human
cacaacagccugacaacauuucu

SEQ ID NO: 1252774 - RNA, 17 nt, Human
cacaaccuucuguggcu

SEQ ID NO: 1252775 - RNA, 18 nt, Human
cacaaccuucuguggcuc

SEQ ID NO: 1252776 - RNA, 19 nt, Human
cacaaccuucuguggcuca

SEQ ID NO: 1252777 - RNA, 23 nt, Human
cacaaccuucuguggcucacaga

SEQ ID NO: 1252778 - RNA, 19 nt, Human
caauuuucuggaauacaug

SEQ ID NO: 1252779 - RNA, 20 nt, Human
caauuuucuggaauacauga

SEQ ID NO: 1252780 - RNA, 13 nt, Human
cacaaaacaaagc

SEQ ID NO: 1252781 - RNA, 16 nt, Human
cacaaaacccagaccu

SEQ ID NO: 1252782 - RNA, 15 nt, Human
cacaaacuguaaaua

SEQ ID NO: 1252783 - RNA, 23 nt, Human
cacaaacuguaaauaaaaagaaa

SEQ ID NO: 1252784 - RNA, 19 nt, Human
cacaaacuuuuauacucuu

SEQ ID NO: 1252785 - RNA, 17 nt, Human
cacaaacuguaauacaa

SEQ ID NO: 1252786 - RNA, 15 nt, Human
cacaaagacccuggc

SEQ ID NO: 1252787 - RNA, 16 nt, Human
cacaaagacccuggcu

SEQ ID NO: 1252788 - RNA, 17 nt, Human
cacaaagacccuggcuu

SEQ ID NO: 1252789 - RNA, 20 nt, Human
cacaaagacccuggcuuuca

SEQ ID NO: 1252790 - RNA, 15 nt, Human
caauuuucacugugu

SEQ ID NO: 1252791 - RNA, 20 nt, Human
caauuuucacuguguccagg

SEQ ID NO: 1252792 - RNA, 14 nt, Human
caauuuucacugug

SEQ ID NO: 1252793 - RNA, 15 nt, Human
caauuccaacaguuu

SEQ ID NO: 1252794 - RNA, 18 nt, Human
caauuccaacaguuuaau

SEQ ID NO: 1252795 - RNA, 19 nt, Human
caauuccaacaguuuaaug

SEQ ID NO: 1252796 - RNA, 21 nt, Human
caauuccaacaguuuaaugaa

SEQ ID NO: 1252797 - RNA, 22 nt, Human
caauuccaacaguuuaaugaag

SEQ ID NO: 1252798 - RNA, 13 nt, Human
caauuccaccugc

SEQ ID NO: 1252799 - RNA, 13 nt, Human
caauuuuaaagac

SEQ ID NO: 1252800 - RNA, 15 nt, Human
caauuuuaaagacau

SEQ ID NO: 1252801 - RNA, 21 nt, Human
caauuuuaucccucaccugua

SEQ ID NO: 1252802 - RNA, 17 nt, Human
caauucaaaaguuccaa

SEQ ID NO: 1252803 - RNA, 13 nt, Human
caauucaaagcug

SEQ ID NO: 1252804 - RNA, 20 nt, Human
caauucacaucuaaccucau

SEQ ID NO: 1252805 - RNA, 13 nt, Human
caauucagacagg

SEQ ID NO: 1252806 - RNA, 14 nt, Human
caauucagacaggc

SEQ ID NO: 1252807 - RNA, 15 nt, Human
caauucagacaggca

SEQ ID NO: 1252808 - RNA, 23 nt, Human
caauucagacaggcaaauaaaag

SEQ ID NO: 1252809 - RNA, 18 nt, Human
caauucauccucacucag

SEQ ID NO: 1252810 - RNA, 17 nt, Human
caaugcaguugucucug

SEQ ID NO: 1252811 - RNA, 18 nt, Human
caaugcaguugucucugu

SEQ ID NO: 1252812 - RNA, 20 nt, Human
caaugcaguugucucuguuu

SEQ ID NO: 1252813 - RNA, 19 nt, Human
caaugcaguugucucuguu

SEQ ID NO: 1252814 - RNA, 15 nt, Human
caaugccacagcccu

SEQ ID NO: 1252815 - RNA, 16 nt, Human
caaugccacagcccug

SEQ ID NO: 1252816 - RNA, 17 nt, Human
caaugccacagcccugu

SEQ ID NO: 1252817 - RNA, 19 nt, Human
caaugccacagcccuguca

SEQ ID NO: 1252818 - RNA, 22 nt, Human
caaugccacagcccugucagca

SEQ ID NO: 1252819 - RNA, 13 nt, Human
caaugucuggaga

SEQ ID NO: 1252820 - RNA, 14 nt, Human
caaugucuggagac

SEQ ID NO: 1252821 - RNA, 15 nt, Human
caaugucuggagacc

SEQ ID NO: 1252822 - RNA, 16 nt, Human
caaugucuggagacca

SEQ ID NO: 1252823 - RNA, 21 nt, Human
caaugucuggagaccaccagg

SEQ ID NO: 1252824 - RNA, 20 nt, Human
caaugucuggagaccaccag

SEQ ID NO: 1252825 - RNA, 11 nt, Human
caaugucuuga

SEQ ID NO: 1252826 - RNA, 21 nt, Human
caaugucuugaugcaugcacu

SEQ ID NO: 1252827 - RNA, 23 nt, Human
caaugucuugaugcaugcacugu

SEQ ID NO: 1252828 - RNA, 14 nt, Human
caauuaaaggcaaa

SEQ ID NO: 1252829 - RNA, 18 nt, Human
uuggacaaaauggaauac

SEQ ID NO: 1252830 - RNA, 17 nt, Human
uuggaauucgcuuucua

SEQ ID NO: 1252831 - RNA, 13 nt, Human
uuggaauacuuuu

SEQ ID NO: 1252832 - RNA, 15 nt, Human
uuggaauauaauugu

SEQ ID NO: 1252833 - RNA, 23 nt, Human
uuggaauauuguccauuguccaa

SEQ ID NO: 1252834 - RNA, 17 nt, Human
uuggaauguucucagau

SEQ ID NO: 1252835 - RNA, 15 nt, Human
uuggacaguuuacca

SEQ ID NO: 1252836 - RNA, 14 nt, Human
uuggacauccuccu

SEQ ID NO: 1252837 - RNA, 13 nt, Human
uuggacaaaauga

SEQ ID NO: 1252838 - RNA, 14 nt, Human
uuggacaaaucaca

SEQ ID NO: 1252839 - RNA, 20 nt, Human
uuggacaaaucacauauuuu

SEQ ID NO: 1252840 - RNA, 19 nt, Human
uuggacaaaucacauauuu

SEQ ID NO: 1252841 - RNA, 15 nt, Human
uuggacaagcuucug

SEQ ID NO: 1252842 - RNA, 17 nt, Human
uuggacaagcuucugag

SEQ ID NO: 1252843 - RNA, 19 nt, Human
uuggacaagcuucugagac

SEQ ID NO: 1252844 - RNA, 19 nt, Human
uuggacaccuuuagguucu

SEQ ID NO: 1252845 - RNA, 14 nt, Human
uuggacacgcucag

SEQ ID NO: 1252846 - RNA, 24 nt, Human
uuggaagacuaucuuacuauuuca

SEQ ID NO: 1252847 - RNA, 15 nt, Human
uuggaagagcagcac

SEQ ID NO: 1252848 - RNA, 16 nt, Human
uuggaagagcagcacc

SEQ ID NO: 1252849 - RNA, 17 nt, Human
uuggaagagcagcaccu

SEQ ID NO: 1252850 - RNA, 20 nt, Human
uuggaagagcagcaccuccu

SEQ ID NO: 1252851 - RNA, 22 nt, Human
uuggaagagcagcaccuccuca

SEQ ID NO: 1252852 - RNA, 22 nt, Human
uuggaagauggcauaaccuguc

SEQ ID NO: 1252853 - RNA, 21 nt, Human
uuggaagagcagcaccuccuc

SEQ ID NO: 1252854 - RNA, 20 nt, Human
uugcugugaggcuguccugu

SEQ ID NO: 1252855 - RNA, 18 nt, Human
uugcuguuuuaaacauua

SEQ ID NO: 1252856 - RNA, 19 nt, Human
uuggauuuaaaagccugcu

SEQ ID NO: 1252857 - RNA, 21 nt, Human
uuggauuuaaaagccugcuca

SEQ ID NO: 1252858 - RNA, 16 nt, Human
uuggauuuaguuucag

SEQ ID NO: 1252859 - RNA, 12 nt, Human
uuggauuuccua

SEQ ID NO: 1252860 - RNA, 14 nt, Human
uuggauuuccuaau

SEQ ID NO: 1252861 - RNA, 21 nt, Human
uuggauuuccuaauacuguca

SEQ ID NO: 1252862 - RNA, 14 nt, Human
uuggauuugacauu

SEQ ID NO: 1252863 - RNA, 22 nt, Human
uuggauuugacauugcguuuga

SEQ ID NO: 1252864 - RNA, 14 nt, Human
uuggcagccuugug

SEQ ID NO: 1252865 - RNA, 16 nt, Human
uuggcagccuugugau

SEQ ID NO: 1252866 - RNA, 12 nt, Human
uuggcaggcugg

SEQ ID NO: 1252867 - RNA, 12 nt, Human
uuggcagccuug

SEQ ID NO: 1252868 - RNA, 13 nt, Human
uuggcagccuugu

SEQ ID NO: 1252869 - RNA, 21 nt, Human
uuggcaccuaauccaggcaga

SEQ ID NO: 1252870 - RNA, 20 nt, Human
uuggauuuugcaaggugcau

SEQ ID NO: 1252871 - RNA, 17 nt, Human
uuggcaaugccaucauc

SEQ ID NO: 1252872 - RNA, 12 nt, Human
uuggcaauuuug

SEQ ID NO: 1252873 - RNA, 14 nt, Human
uuggcaauuuugug

SEQ ID NO: 1252874 - RNA, 13 nt, Human
uuggcaauuuugu

SEQ ID NO: 1252875 - RNA, 13 nt, Human
uuggcaccagaca

SEQ ID NO: 1252876 - RNA, 17 nt, Human
uuggcaccagacaccca

SEQ ID NO: 1252877 - RNA, 20 nt, Human
uuggcaccagacacccagga

SEQ ID NO: 1252878 - RNA, 21 nt, Human
uuggcaccagacacccaggac

SEQ ID NO: 1252879 - RNA, 23 nt, Human
uuggcaccagacacccaggacuu

SEQ ID NO: 1252880 - RNA, 17 nt, Human
uuggcaccgaagcccag

SEQ ID NO: 1252881 - RNA, 18 nt, Human
uuggcaccgaagcccaga

SEQ ID NO: 1252882 - RNA, 19 nt, Human
uuggcaccuaauccaggca

SEQ ID NO: 1252883 - RNA, 16 nt, Human
uugcuaagcauuccaa

SEQ ID NO: 1252884 - RNA, 19 nt, Human
uugcgcuccuggcccagcc

SEQ ID NO: 1252885 - RNA, 20 nt, Human
uugcgcuccuggcccagccu

SEQ ID NO: 1252886 - RNA, 21 nt, Human
uugcgcuccuggcccagccuu

SEQ ID NO: 1252887 - RNA, 18 nt, Human
uugcuaagcauuccaacu

SEQ ID NO: 1252888 - RNA, 16 nt, Human
uugcugcuaauauuuu

SEQ ID NO: 1252889 - RNA, 20 nt, Human
uugcugcuaauauuuuccuc

SEQ ID NO: 1252890 - RNA, 13 nt, Human
uugcugcuucucc

SEQ ID NO: 1252891 - RNA, 15 nt, Human
uugcuggaguacuua

SEQ ID NO: 1252892 - RNA, 15 nt, Human
uugcugcuucuccca

SEQ ID NO: 1252893 - RNA, 16 nt, Human
uugcugcuucucccag

SEQ ID NO: 1252894 - RNA, 17 nt, Human
uugcugcuucucccagg

SEQ ID NO: 1252895 - RNA, 21 nt, Human
uugcugcuucucccaggcaag

SEQ ID NO: 1252896 - RNA, 21 nt, Human
uugcuggaagacgcaagggcc

SEQ ID NO: 1252897 - RNA, 21 nt, Human
uugcuggaauaaguucaaauu

SEQ ID NO: 1252898 - RNA, 23 nt, Human
uugcuggacugucauagaaauua

SEQ ID NO: 1252899 - RNA, 17 nt, Human
uugcugucaagccauuu

SEQ ID NO: 1252900 - RNA, 14 nt, Human
uugcugugaggcug

SEQ ID NO: 1252901 - RNA, 15 nt, Human
uugcugugaggcugu

SEQ ID NO: 1252902 - RNA, 17 nt, Human
uugcugugaggcugucc

SEQ ID NO: 1252903 - RNA, 18 nt, Human
uugcugugaggcuguccu

SEQ ID NO: 1252904 - RNA, 19 nt, Human
uugcugugaggcuguccug

SEQ ID NO: 1252905 - RNA, 12 nt, Human
uugcgagagaug

SEQ ID NO: 1252906 - RNA, 14 nt, Human
uugcgagagaugug

SEQ ID NO: 1252907 - RNA, 15 nt, Human
uugcgagagaugugu

SEQ ID NO: 1252908 - RNA, 16 nt, Human
uugcgagagaugugug

SEQ ID NO: 1252909 - RNA, 17 nt, Human
uugcgagagaugugugu

SEQ ID NO: 1252910 - RNA, 19 nt, Human
uugcgagagauguguguug

SEQ ID NO: 1252911 - RNA, 19 nt, Human
uugcgauagagucucacug

SEQ ID NO: 1252912 - RNA, 15 nt, Human
uugcgcuccuggccc

SEQ ID NO: 1252913 - RNA, 19 nt, Human
uugccuuuugcaaccagga

SEQ ID NO: 1252914 - RNA, 13 nt, Human
uugccuuaaaaua

SEQ ID NO: 1252915 - RNA, 14 nt, Human
uugccuguaacaag

SEQ ID NO: 1252916 - RNA, 19 nt, Human
uugccuguaacaagccaga

SEQ ID NO: 1252917 - RNA, 22 nt, Human
uugccuuccagaaaacaaaacu

SEQ ID NO: 1252918 - RNA, 17 nt, Human
uugccuucuacuuuuaa

SEQ ID NO: 1252919 - RNA, 20 nt, Human
uugccaugacaacuucuaau

SEQ ID NO: 1252920 - RNA, 18 nt, Human
uuguacuuuagggaagua

SEQ ID NO: 1252921 - RNA, 17 nt, Human
uuguagaagucacauuc

SEQ ID NO: 1252922 - RNA, 22 nt, Human
uuguagaagucacauuccugaa

SEQ ID NO: 1252923 - RNA, 15 nt, Human
uuguagcauccugga

SEQ ID NO: 1252924 - RNA, 16 nt, Human
uuguaccgcaauguga

SEQ ID NO: 1252925 - RNA, 20 nt, Human
uuguacauuugggaguuuuu

SEQ ID NO: 1252926 - RNA, 15 nt, Human
uuguaccaacuuuua

SEQ ID NO: 1252927 - RNA, 20 nt, Human
uuguaaaauggugugaccac

SEQ ID NO: 1252928 - RNA, 19 nt, Human
uuguaaaaugacaaucaug

SEQ ID NO: 1252929 - RNA, 20 nt, Human
uuguaaaaugacaaucaugu

SEQ ID NO: 1252930 - RNA, 22 nt, Human
uuguaaaaugacaaucaugugu

SEQ ID NO: 1252931 - RNA, 17 nt, Human
uuguaaaauuauuucau

SEQ ID NO: 1252932 - RNA, 22 nt, Human
uuguaaacaaacuguguaacug

SEQ ID NO: 1252933 - RNA, 23 nt, Human
uuguaaacaaacuguguaacugc

SEQ ID NO: 1252934 - RNA, 16 nt, Human
uuguaaacucaaaaua

SEQ ID NO: 1252935 - RNA, 22 nt, Human
uuguaaacucaaaauauuugua

SEQ ID NO: 1252936 - RNA, 22 nt, Human
uuguaugaaagauggcugugcc

SEQ ID NO: 1252937 - RNA, 20 nt, Human
uuguaugauccuaaugaaug

SEQ ID NO: 1252938 - RNA, 16 nt, Human
uuguaugaaacuaaag

SEQ ID NO: 1252939 - RNA, 22 nt, Human
uugucaagaauagcauuguaaa

SEQ ID NO: 1252940 - RNA, 15 nt, Human
uugucuauaaagcau

SEQ ID NO: 1252941 - RNA, 16 nt, Human
uugucuauaaagcauu

SEQ ID NO: 1252942 - RNA, 18 nt, Human
uugucuauuaccuguuag

SEQ ID NO: 1252943 - RNA, 18 nt, Human
uugucuauaaagcauuua

SEQ ID NO: 1252944 - RNA, 13 nt, Human
uugucucugaugc

SEQ ID NO: 1252945 - RNA, 14 nt, Human
uugucucugaugca

SEQ ID NO: 1252946 - RNA, 17 nt, Human
uugucugaagucacugc

SEQ ID NO: 1252947 - RNA, 22 nt, Human
uugucugaaaagugaagacaga

SEQ ID NO: 1252948 - RNA, 12 nt, Human
uugucucuguuu

SEQ ID NO: 1252949 - RNA, 15 nt, Human
uugucugaacuugca

SEQ ID NO: 1252950 - RNA, 15 nt, Human
uugucucugaugcag

SEQ ID NO: 1252951 - RNA, 17 nt, Human
uugucucugaugcagcu

SEQ ID NO: 1252952 - RNA, 21 nt, Human
uugucucugaugcagcuuaua

SEQ ID NO: 1252953 - RNA, 20 nt, Human
uugucucugcaaacugccuu

SEQ ID NO: 1252954 - RNA, 22 nt, Human
uugucucugcaaacugccuucu

SEQ ID NO: 1252955 - RNA, 23 nt, Human
uugucucuguuuuacaaguugga

SEQ ID NO: 1252956 - RNA, 20 nt, Human
uugucugaagucacugcaca

SEQ ID NO: 1252957 - RNA, 18 nt, Human
uugucugaagucacugca

SEQ ID NO: 1252958 - RNA, 12 nt, Human
uugucuuaauau

SEQ ID NO: 1252959 - RNA, 17 nt, Human
uugucuuaauauugugg

SEQ ID NO: 1252960 - RNA, 13 nt, Human
uuggcaggcuggc

SEQ ID NO: 1252961 - RNA, 14 nt, Human
uuggcaggcuggcc

SEQ ID NO: 1252962 - RNA, 14 nt, Human
uuggcagucugaau

SEQ ID NO: 1252963 - RNA, 16 nt, Human
uuggcauagcucuggg

SEQ ID NO: 1252964 - RNA, 14 nt, Human
uuggcuuauaauuc

SEQ ID NO: 1252965 - RNA, 17 nt, Human
uuggcuuauaauucuuu

SEQ ID NO: 1252966 - RNA, 18 nt, Human
uuggcuuauaauucuuuc

SEQ ID NO: 1252967 - RNA, 19 nt, Human
uuggcuuauaauucuuuca

SEQ ID NO: 1252968 - RNA, 22 nt, Human
uugggacugcuaaauaaaauuu

SEQ ID NO: 1252969 - RNA, 14 nt, Human
uugggagacaugug

SEQ ID NO: 1252970 - RNA, 17 nt, Human
uugggagacaugugaca

SEQ ID NO: 1252971 - RNA, 13 nt, Human
uugggagagacuu

SEQ ID NO: 1252972 - RNA, 23 nt, Human
uugggagagacuuguuuuggaug

SEQ ID NO: 1252973 - RNA, 16 nt, Human
uugggagagggcgcag

SEQ ID NO: 1252974 - RNA, 18 nt, Human
uugggaauggauccugga

SEQ ID NO: 1252975 - RNA, 14 nt, Human
uugggaauuuuauu

SEQ ID NO: 1252976 - RNA, 20 nt, Human
uugguaaggggaauugagga

SEQ ID NO: 1252977 - RNA, 12 nt, Human
uugguaacuuuu

SEQ ID NO: 1252978 - RNA, 14 nt, Human
uugguaacuuuugu

SEQ ID NO: 1252979 - RNA, 15 nt, Human
uugguaacuuuugug

SEQ ID NO: 1252980 - RNA, 13 nt, Human
uugggauuugcug

SEQ ID NO: 1252981 - RNA, 14 nt, Human
uugggauuugcugu

SEQ ID NO: 1252982 - RNA, 17 nt, Human
uugggcacccccagccu

SEQ ID NO: 1252983 - RNA, 15 nt, Human
uugggagagggcgca

SEQ ID NO: 1252984 - RNA, 17 nt, Human
uugggagcuugggaaug

SEQ ID NO: 1252985 - RNA, 19 nt, Human
uugggagcuugggaaugga

SEQ ID NO: 1252986 - RNA, 13 nt, Human
uugggaguuuuua

SEQ ID NO: 1252987 - RNA, 15 nt, Human
uugggauaucuccug

SEQ ID NO: 1252988 - RNA, 16 nt, Human
uuggucuguacugauu

SEQ ID NO: 1252989 - RNA, 14 nt, Human
uuggucuguacuga

SEQ ID NO: 1252990 - RNA, 13 nt, Human
uuggucguuuuuu

SEQ ID NO: 1252991 - RNA, 22 nt, Human
uuggucucccuucucuacacuc

SEQ ID NO: 1252992 - RNA, 12 nt, Human
uugguaccagau

SEQ ID NO: 1252993 - RNA, 14 nt, Human
uugguaccagauaa

SEQ ID NO: 1252994 - RNA, 19 nt, Human
uugguaccagauaacuuuu

SEQ ID NO: 1252995 - RNA, 13 nt, Human
uuguaaaauggug

SEQ ID NO: 1252996 - RNA, 12 nt, Human
uuguaaaauggu

SEQ ID NO: 1252997 - RNA, 15 nt, Human
uuggucugugagaug

SEQ ID NO: 1252998 - RNA, 20 nt, Human
uuggucuguacugauucaau

SEQ ID NO: 1252999 - RNA, 13 nt, Human
uuguaaaaugaca

SEQ ID NO: 1253000 - RNA, 15 nt, Human
uuguaaaaugacaau

SEQ ID NO: 1253001 - RNA, 17 nt, Human
uuguaaaaugacaauca

SEQ ID NO: 1253002 - RNA, 21 nt, Human
uugaagagguuuuaaagcuuc

SEQ ID NO: 1253003 - RNA, 20 nt, Human
uugaagcacagugaucaagu

SEQ ID NO: 1253004 - RNA, 20 nt, Human
uugaagcaaaucgaaugaaa

SEQ ID NO: 1253005 - RNA, 14 nt, Human
uugaagcacguaca

SEQ ID NO: 1253006 - RNA, 18 nt, Human
uugaagcacguacauuuu

SEQ ID NO: 1253007 - RNA, 16 nt, Human
uugaagagguuuuaaa

SEQ ID NO: 1253008 - RNA, 20 nt, Human
uugaaugauuuuucuuuaca

SEQ ID NO: 1253009 - RNA, 21 nt, Human
uugaaugauuuuucuuuacaa

SEQ ID NO: 1253010 - RNA, 19 nt, Human
uugaauguggcuugagaaa

SEQ ID NO: 1253011 - RNA, 21 nt, Human
uugaauguggcuugagaaaua

SEQ ID NO: 1253012 - RNA, 22 nt, Human
uugaauguggcuugagaaauau

SEQ ID NO: 1253013 - RNA, 15 nt, Human
uugaaugcaaaccau

SEQ ID NO: 1253014 - RNA, 20 nt, Human
uugaauguguuucacaguuu

SEQ ID NO: 1253015 - RNA, 18 nt, Human
uugaaaauuaacaugaau

SEQ ID NO: 1253016 - RNA, 12 nt, Human
uucuuucuagaa

SEQ ID NO: 1253017 - RNA, 13 nt, Human
uucuuucuagaaa

SEQ ID NO: 1253018 - RNA, 16 nt, Human
uugaaaauguccagga

SEQ ID NO: 1253019 - RNA, 15 nt, Human
uugaaacagaaaaau

SEQ ID NO: 1253020 - RNA, 19 nt, Human
uucuuuaacugccguaauu

SEQ ID NO: 1253021 - RNA, 20 nt, Human
uucuuuacaaaacaaacuca

SEQ ID NO: 1253022 - RNA, 22 nt, Human
uucuuuacaaaacaaacucauu

SEQ ID NO: 1253023 - RNA, 11 nt, Human
uucuuuagaac

SEQ ID NO: 1253024 - RNA, 21 nt, Human
uugaaaaucuuauaauuuaaa

SEQ ID NO: 1253025 - RNA, 15 nt, Human
uucuuuccauuugca

SEQ ID NO: 1253026 - RNA, 16 nt, Human
uucuuucccagucugu

SEQ ID NO: 1253027 - RNA, 15 nt, Human
uucuguauauacuuu

SEQ ID NO: 1253028 - RNA, 16 nt, Human
uucuguauauacuuuu

SEQ ID NO: 1253029 - RNA, 17 nt, Human
uucuguauauacuuuuu

SEQ ID NO: 1253030 - RNA, 17 nt, Human
uucuggccuuguaagac

SEQ ID NO: 1253031 - RNA, 13 nt, Human
uucugugccugaa

SEQ ID NO: 1253032 - RNA, 15 nt, Human
uucugugccugaaua

SEQ ID NO: 1253033 - RNA, 16 nt, Human
uucugugccugaauau

SEQ ID NO: 1253034 - RNA, 17 nt, Human
uucugugccugaauauu

SEQ ID NO: 1253035 - RNA, 15 nt, Human
uucuuagcucaauga

SEQ ID NO: 1253036 - RNA, 20 nt, Human
uucuaaguuucuaagauucu

SEQ ID NO: 1253037 - RNA, 17 nt, Human
uucuaaguuucuaagau

SEQ ID NO: 1253038 - RNA, 18 nt, Human
uucuaaguuucuaagauu

SEQ ID NO: 1253039 - RNA, 14 nt, Human
uucuggccaggaag

SEQ ID NO: 1253040 - RNA, 21 nt, Human
uucuggccaguguuuaaaacu

SEQ ID NO: 1253041 - RNA, 15 nt, Human
uucuggccaggaagc

SEQ ID NO: 1253042 - RNA, 16 nt, Human
uucuggccaguguuua

SEQ ID NO: 1253043 - RNA, 17 nt, Human
uucuggccaguguuuaa

SEQ ID NO: 1253044 - RNA, 18 nt, Human
uucuggccaguguuuaaa

SEQ ID NO: 1253045 - RNA, 22 nt, Human
uucuggccaguguuuaaaacuu

SEQ ID NO: 1253046 - RNA, 15 nt, Human
uucuaaagcucugac

SEQ ID NO: 1253047 - RNA, 16 nt, Human
uucuaaagcucugaca

SEQ ID NO: 1253048 - RNA, 17 nt, Human
uucuaaagcucugacau

SEQ ID NO: 1253049 - RNA, 15 nt, Human
uucuaaguaaauaca

SEQ ID NO: 1253050 - RNA, 16 nt, Human
uucuaaguaaauacaa

SEQ ID NO: 1253051 - RNA, 17 nt, Human
uucuaaguaaauacaau

SEQ ID NO: 1253052 - RNA, 18 nt, Human
uucuaaguaaauacaauu

SEQ ID NO: 1253053 - RNA, 21 nt, Human
uucuaaguaaauacaauuuuu

SEQ ID NO: 1253054 - RNA, 12 nt, Human
uucuaagucuuu

SEQ ID NO: 1253055 - RNA, 15 nt, Human
uucuaagucuuucca

SEQ ID NO: 1253056 - RNA, 17 nt, Human
uucuaagucuuuccauu

SEQ ID NO: 1253057 - RNA, 20 nt, Human
uucuaaguaaauacaauuuu

SEQ ID NO: 1253058 - RNA, 12 nt, Human
uucuaaguuucu

SEQ ID NO: 1253059 - RNA, 13 nt, Human
uucuaaguuucua

SEQ ID NO: 1253060 - RNA, 14 nt, Human
uucuaaguuucuaa

SEQ ID NO: 1253061 - RNA, 16 nt, Human
uucuaaguuucuaaga

SEQ ID NO: 1253062 - RNA, 19 nt, Human
uucuuaggguuaugauuaa

SEQ ID NO: 1253063 - RNA, 23 nt, Human
uucuuagcucaaugagcauguuu

SEQ ID NO: 1253064 - RNA, 16 nt, Human
uucuuagcucaaugag

SEQ ID NO: 1253065 - RNA, 13 nt, Human
uucuuagugacuu

SEQ ID NO: 1253066 - RNA, 18 nt, Human
uucuuaugccauauaauu

SEQ ID NO: 1253067 - RNA, 15 nt, Human
uucuuauggaauuga

SEQ ID NO: 1253068 - RNA, 17 nt, Human
uucuuauggaauugauu

SEQ ID NO: 1253069 - RNA, 18 nt, Human
uucuuauggaauugauuu

SEQ ID NO: 1253070 - RNA, 22 nt, Human
uucuuauggaauugauuugcau

SEQ ID NO: 1253071 - RNA, 17 nt, Human
uucuuauguugcccagu

SEQ ID NO: 1253072 - RNA, 18 nt, Human
uucuuguguguaugcaca

SEQ ID NO: 1253073 - RNA, 22 nt, Human
uucuuguguguaugcacaugaa

SEQ ID NO: 1253074 - RNA, 20 nt, Human
uucuuuaaaguucuucuaag

SEQ ID NO: 1253075 - RNA, 12 nt, Human
uucuuuaacugc

SEQ ID NO: 1253076 - RNA, 14 nt, Human
uucuuuaacuuaau

SEQ ID NO: 1253077 - RNA, 11 nt, Human
uucuugucuau

SEQ ID NO: 1253078 - RNA, 13 nt, Human
uucuugucuauaa

SEQ ID NO: 1253079 - RNA, 14 nt, Human
uucuugucuauaaa

SEQ ID NO: 1253080 - RNA, 16 nt, Human
uucuugucuauaaagc

SEQ ID NO: 1253081 - RNA, 17 nt, Human
uucuugucuauaaagca

SEQ ID NO: 1253082 - RNA, 18 nt, Human
uucuugucuauaaagcau

SEQ ID NO: 1253083 - RNA, 22 nt, Human
uucuugucuauaaagcauuuaa

SEQ ID NO: 1253084 - RNA, 21 nt, Human
uucuugucuauaaagcauuua

SEQ ID NO: 1253085 - RNA, 14 nt, Human
uucuugucuuuauu

SEQ ID NO: 1253086 - RNA, 18 nt, Human
uucuucauaacaauuuua

SEQ ID NO: 1253087 - RNA, 21 nt, Human
uucuucauaacaauuuuagga

SEQ ID NO: 1253088 - RNA, 12 nt, Human
uucuuguauuua

SEQ ID NO: 1253089 - RNA, 20 nt, Human
uugauaugccuuuucccaac

SEQ ID NO: 1253090 - RNA, 22 nt, Human
uugaggcuugguuccuucccaa

SEQ ID NO: 1253091 - RNA, 16 nt, Human
uugauaugugaacagu

SEQ ID NO: 1253092 - RNA, 15 nt, Human
uugauaugacuguuu

SEQ ID NO: 1253093 - RNA, 22 nt, Human
uugauauuuucaacgcagcccu

SEQ ID NO: 1253094 - RNA, 15 nt, Human
uugauauuucuagcu

SEQ ID NO: 1253095 - RNA, 20 nt, Human
uugaucagccccacccuggc

SEQ ID NO: 1253096 - RNA, 21 nt, Human
uugaucagccccacccuggcc

SEQ ID NO: 1253097 - RNA, 12 nt, Human
uugaucaguuaa

SEQ ID NO: 1253098 - RNA, 18 nt, Human
uugaucaguuaagaaauu

SEQ ID NO: 1253099 - RNA, 17 nt, Human
uugauccagaaagaaaa

SEQ ID NO: 1253100 - RNA, 15 nt, Human
uugauccauuucuaa

SEQ ID NO: 1253101 - RNA, 16 nt, Human
uugauccauuucuaau

SEQ ID NO: 1253102 - RNA, 17 nt, Human
uugauccauuucuaauu

SEQ ID NO: 1253103 - RNA, 18 nt, Human
uugauccauuucuaauua

SEQ ID NO: 1253104 - RNA, 19 nt, Human
uugaucgccuuucccaggu

SEQ ID NO: 1253105 - RNA, 16 nt, Human
uugaucuccguggcuu

SEQ ID NO: 1253106 - RNA, 18 nt, Human
uugaauuguaacuguucu

SEQ ID NO: 1253107 - RNA, 13 nt, Human
uugagcucagccc

SEQ ID NO: 1253108 - RNA, 15 nt, Human
uugagcuauugcugu

SEQ ID NO: 1253109 - RNA, 18 nt, Human
uugagcucucucauuguc

SEQ ID NO: 1253110 - RNA, 15 nt, Human
uugagcucucugccc

SEQ ID NO: 1253111 - RNA, 15 nt, Human
uugaggacuucuugc

SEQ ID NO: 1253112 - RNA, 12 nt, Human
uugaggagcccc

SEQ ID NO: 1253113 - RNA, 16 nt, Human
uugaggagccccagcu

SEQ ID NO: 1253114 - RNA, 13 nt, Human
uugaggacuucuu

SEQ ID NO: 1253115 - RNA, 16 nt, Human
uugaggcaaaagaagg

SEQ ID NO: 1253116 - RNA, 23 nt, Human
uugaauuaauaucccuacaugua

SEQ ID NO: 1253117 - RNA, 13 nt, Human
uugaauuaucuug

SEQ ID NO: 1253118 - RNA, 18 nt, Human
uugaauuaucuugguuga

SEQ ID NO: 1253119 - RNA, 20 nt, Human
uugaauuaucuugguugaaa

SEQ ID NO: 1253120 - RNA, 22 nt, Human
uugaauuaucuugguugaaaau

SEQ ID NO: 1253121 - RNA, 12 nt, Human
uugaauucauuu

SEQ ID NO: 1253122 - RNA, 16 nt, Human
uugaauucauuucacu

SEQ ID NO: 1253123 - RNA, 19 nt, Human
uugaauucauuucacugua

SEQ ID NO: 1253124 - RNA, 21 nt, Human
uugaauucuugguugaggaaa

SEQ ID NO: 1253125 - RNA, 15 nt, Human
uugaauuguaacugu

SEQ ID NO: 1253126 - RNA, 16 nt, Human
uugcauaacguauaaa

SEQ ID NO: 1253127 - RNA, 19 nt, Human
uugcaguuuaucauucaag

SEQ ID NO: 1253128 - RNA, 20 nt, Human
uugcaguuuaucauucaagu

SEQ ID NO: 1253129 - RNA, 23 nt, Human
uugcaguuuaucauucaagugua

SEQ ID NO: 1253130 - RNA, 19 nt, Human
uugcauaacaauuccucua

SEQ ID NO: 1253131 - RNA, 13 nt, Human
uugcauaagagcu

SEQ ID NO: 1253132 - RNA, 19 nt, Human
uugccagagauccaaaaga

SEQ ID NO: 1253133 - RNA, 23 nt, Human
uugccaggcuggagugcaguggc

SEQ ID NO: 1253134 - RNA, 19 nt, Human
uugccaggcuggagugcag

SEQ ID NO: 1253135 - RNA, 20 nt, Human
uugccaggugacugucuggg

SEQ ID NO: 1253136 - RNA, 19 nt, Human
uugccauauuuucaccauu

SEQ ID NO: 1253137 - RNA, 23 nt, Human
uugccaucugcgugacaauaaaa

SEQ ID NO: 1253138 - RNA, 23 nt, Human
uugccaugacaacuucuaauugc

SEQ ID NO: 1253139 - RNA, 22 nt, Human
uugcagcccugcugcugccugc

SEQ ID NO: 1253140 - RNA, 17 nt, Human
uugcagcacagcugaga

SEQ ID NO: 1253141 - RNA, 16 nt, Human
uugcagaaaauucugu

SEQ ID NO: 1253142 - RNA, 17 nt, Human
uugcagaaaauucugug

SEQ ID NO: 1253143 - RNA, 18 nt, Human
uugcagccggcacagggu

SEQ ID NO: 1253144 - RNA, 20 nt, Human
uugcagccggcacagggucu

SEQ ID NO: 1253145 - RNA, 15 nt, Human
uugcagcgacuggca

SEQ ID NO: 1253146 - RNA, 9 nt, Human
uugcagcug

SEQ ID NO: 1253147 - RNA, 12 nt, Human
uugcagcuguuu

SEQ ID NO: 1253148 - RNA, 13 nt, Human
uugcagcuguuuu

SEQ ID NO: 1253149 - RNA, 17 nt, Human
uugcagcuguuuuguug

SEQ ID NO: 1253150 - RNA, 21 nt, Human
uugcaguucccacauuaaaga

SEQ ID NO: 1253151 - RNA, 13 nt, Human
uugcaguuuauca

SEQ ID NO: 1253152 - RNA, 18 nt, Human
uugcaguuuaucauucaa

SEQ ID NO: 1253153 - RNA, 14 nt, Human
uugaucuggaaccc

SEQ ID NO: 1253154 - RNA, 19 nt, Human
uugauucauaguaacuucu

SEQ ID NO: 1253155 - RNA, 23 nt, Human
uugauucgguauccccccaucuu

SEQ ID NO: 1253156 - RNA, 22 nt, Human
uugcacuucuaagacuuuacuu

SEQ ID NO: 1253157 - RNA, 19 nt, Human
uugcagaaaauucugugcc

SEQ ID NO: 1253158 - RNA, 15 nt, Human
uuguuauuaaacaaa

SEQ ID NO: 1253159 - RNA, 20 nt, Human
uugucuuuguucuucuacca

SEQ ID NO: 1253160 - RNA, 12 nt, Human
uugucuuuauuu

SEQ ID NO: 1253161 - RNA, 14 nt, Human
uugucuuauucccu

SEQ ID NO: 1253162 - RNA, 15 nt, Human
uuguuuacaugcuua

SEQ ID NO: 1253163 - RNA, 16 nt, Human
uuguuuacaugcuuau

SEQ ID NO: 1253164 - RNA, 17 nt, Human
uuguuuacaugcuuauu

SEQ ID NO: 1253165 - RNA, 23 nt, Human
uuguuuacaugcuuauuccauga

SEQ ID NO: 1253166 - RNA, 22 nt, Human
uuguuuacaugcuuauuccaug

SEQ ID NO: 1253167 - RNA, 22 nt, Human
uuguuuaauuuuuauuucuucc

SEQ ID NO: 1253168 - RNA, 23 nt, Human
uuguuauuugaaaacauguuuau

SEQ ID NO: 1253169 - RNA, 15 nt, Human
uuguuauuuugcaac

SEQ ID NO: 1253170 - RNA, 22 nt, Human
uuguuauuuugcaaccucgcug

SEQ ID NO: 1253171 - RNA, 13 nt, Human
uuguuuuacaaua

SEQ ID NO: 1253172 - RNA, 12 nt, Human
uuguuuuacaau

SEQ ID NO: 1253173 - RNA, 15 nt, Human
uuuaaaacagacacu

SEQ ID NO: 1253174 - RNA, 14 nt, Human
uuguuucugaucua

SEQ ID NO: 1253175 - RNA, 15 nt, Human
uuguuucuguuccaa

SEQ ID NO: 1253176 - RNA, 16 nt, Human
uuguuucuguuccaaa

SEQ ID NO: 1253177 - RNA, 23 nt, Human
uuguuuauugaauucauuucacu

SEQ ID NO: 1253178 - RNA, 21 nt, Human
uuguuuagaaagaauauucau

SEQ ID NO: 1253179 - RNA, 15 nt, Human
uuguuuauguaauuu

SEQ ID NO: 1253180 - RNA, 20 nt, Human
uuguuucuuucucugaggac

SEQ ID NO: 1253181 - RNA, 17 nt, Human
uuguuuggggcaggagu

SEQ ID NO: 1253182 - RNA, 17 nt, Human
uuguuucuguuccaaau

SEQ ID NO: 1253183 - RNA, 12 nt, Human
uuguuucuuaaa

SEQ ID NO: 1253184 - RNA, 14 nt, Human
uuguuucuuaaaua

SEQ ID NO: 1253185 - RNA, 23 nt, Human
uuguuucuuaaauaagaaacuuu

SEQ ID NO: 1253186 - RNA, 15 nt, Human
uuguuucuuaaauaa

SEQ ID NO: 1253187 - RNA, 16 nt, Human
uuguuucuuucucuga

SEQ ID NO: 1253188 - RNA, 19 nt, Human
uuguuucuuucucugagga

SEQ ID NO: 1253189 - RNA, 16 nt, Human
uuuaaaaugagaaauc

SEQ ID NO: 1253190 - RNA, 11 nt, Human
uuuaaaaugua

SEQ ID NO: 1253191 - RNA, 17 nt, Human
uuuaaaauguaaagcca

SEQ ID NO: 1253192 - RNA, 18 nt, Human
uuuaaaauguaaagccau

SEQ ID NO: 1253193 - RNA, 20 nt, Human
uuuaaaauguaaagccaugc

SEQ ID NO: 1253194 - RNA, 12 nt, Human
uuuaaaaugucu

SEQ ID NO: 1253195 - RNA, 16 nt, Human
uuuaaaauuacaacua

SEQ ID NO: 1253196 - RNA, 12 nt, Human
uuuaaaauguac

SEQ ID NO: 1253197 - RNA, 17 nt, Human
uuuaaaauuuauauugu

SEQ ID NO: 1253198 - RNA, 20 nt, Human
uuuaaaauuuauauuguaaa

SEQ ID NO: 1253199 - RNA, 12 nt, Human
uuuaaaauuugu

SEQ ID NO: 1253200 - RNA, 16 nt, Human
uuuaaaauuuguucuu

SEQ ID NO: 1253201 - RNA, 14 nt, Human
uuuaaacuguguac

SEQ ID NO: 1253202 - RNA, 15 nt, Human
uuuaaacuguguaca

SEQ ID NO: 1253203 - RNA, 16 nt, Human
uuuaaacuguacagug

SEQ ID NO: 1253204 - RNA, 18 nt, Human
uuuaaaccuauacucacu

SEQ ID NO: 1253205 - RNA, 11 nt, Human
uuuaaaccuuu

SEQ ID NO: 1253206 - RNA, 15 nt, Human
uuuaaacuauaagca

SEQ ID NO: 1253207 - RNA, 13 nt, Human
uuuaaacuguaca

SEQ ID NO: 1253208 - RNA, 15 nt, Human
uuuaaacuguacagu

SEQ ID NO: 1253209 - RNA, 18 nt, Human
uuuaaacuguacaguguc

SEQ ID NO: 1253210 - RNA, 14 nt, Human
uuuaaacagauguc

SEQ ID NO: 1253211 - RNA, 23 nt, Human
uuuaaacagauguccaucagaug

SEQ ID NO: 1253212 - RNA, 14 nt, Human
uuuaaacaccuccu

SEQ ID NO: 1253213 - RNA, 15 nt, Human
uuuaaacaaguauuu

SEQ ID NO: 1253214 - RNA, 15 nt, Human
uuuaaacauuaauag

SEQ ID NO: 1253215 - RNA, 19 nt, Human
uuuaaaccaauugcugcua

SEQ ID NO: 1253216 - RNA, 19 nt, Human
uuuaaacauuaauagcagc

SEQ ID NO: 1253217 - RNA, 17 nt, Human
uuuaaaccgcuaaaaga

SEQ ID NO: 1253218 - RNA, 20 nt, Human
uuuaaaccgcuaaaagaaac

SEQ ID NO: 1253219 - RNA, 21 nt, Human
uuuaaaccgcuaaaagaaacu

SEQ ID NO: 1253220 - RNA, 22 nt, Human
uuuaaaccgcuaaaagaaacuu

SEQ ID NO: 1253221 - RNA, 23 nt, Human
uuuaaaccgcuaaaagaaacuuu

SEQ ID NO: 1253222 - RNA, 17 nt, Human
uuuaaaaggaaagaaaa

SEQ ID NO: 1253223 - RNA, 13 nt, Human
uuuaaaagccugc

SEQ ID NO: 1253224 - RNA, 14 nt, Human
uuuaaaagccugcu

SEQ ID NO: 1253225 - RNA, 18 nt, Human
uuuaaaagugucaagcug

SEQ ID NO: 1253226 - RNA, 23 nt, Human
uuuaaaagugccauuaacaaaug

SEQ ID NO: 1253227 - RNA, 12 nt, Human
uuuaaaauagca

SEQ ID NO: 1253228 - RNA, 17 nt, Human
uuuaaaauagcguucuu

SEQ ID NO: 1253229 - RNA, 20 nt, Human
uuuaaaauagcguucuugua

SEQ ID NO: 1253230 - RNA, 23 nt, Human
uuuaaaauagcguucuuguaauu

SEQ ID NO: 1253231 - RNA, 11 nt, Human
uuuaaaauaua

SEQ ID NO: 1253232 - RNA, 21 nt, Human
uuuaaaauauauugaauauuu

SEQ ID NO: 1253233 - RNA, 16 nt, Human
uuuaaaauaucuacau

SEQ ID NO: 1253234 - RNA, 18 nt, Human
uuuaaaaucagcuauuuu

SEQ ID NO: 1253235 - RNA, 22 nt, Human
uuuaaaaucagcuauuuuguga

SEQ ID NO: 1253236 - RNA, 19 nt, Human
uuuaaaaucaucagaaagg

SEQ ID NO: 1253237 - RNA, 15 nt, Human
uuuaaaaucugucac

SEQ ID NO: 1253238 - RNA, 14 nt, Human
uuuaaaagaaugau

SEQ ID NO: 1253239 - RNA, 14 nt, Human
uuuaaaacccauuu

SEQ ID NO: 1253240 - RNA, 21 nt, Human
uuuaaaacccauuuaaauuuu

SEQ ID NO: 1253241 - RNA, 15 nt, Human
uuuaaaacuguugga

SEQ ID NO: 1253242 - RNA, 22 nt, Human
uuuaaaacuguuggaauggauu

SEQ ID NO: 1253243 - RNA, 17 nt, Human
uuuaaaagaaugauuau

SEQ ID NO: 1253244 - RNA, 11 nt, Human
uuuaaaacuug

SEQ ID NO: 1253245 - RNA, 19 nt, Human
uuuaaaagacacacuuguc

SEQ ID NO: 1253246 - RNA, 12 nt, Human
uuuaaaagacac

SEQ ID NO: 1253247 - RNA, 17 nt, Human
uuuaaaagaugcuuuua

SEQ ID NO: 1253248 - RNA, 13 nt, Human
uuuaaaagaugcu

SEQ ID NO: 1253249 - RNA, 12 nt, Human
uuuaaaagauuu

SEQ ID NO: 1253250 - RNA, 13 nt, Human
uuuaaaagcacga

SEQ ID NO: 1253251 - RNA, 19 nt, Human
uuuaaaagcacgacagugg

SEQ ID NO: 1253252 - RNA, 16 nt, Human
uuuacauggcuggagc

SEQ ID NO: 1253253 - RNA, 23 nt, Human
uuuaccagcauacccacacaaau

SEQ ID NO: 1253254 - RNA, 16 nt, Human
uuuacaugaggacucu

SEQ ID NO: 1253255 - RNA, 16 nt, Human
uuuacaugaaguauuu

SEQ ID NO: 1253256 - RNA, 12 nt, Human
uuuacaugcuua

SEQ ID NO: 1253257 - RNA, 13 nt, Human
uuuacaugcuuau

SEQ ID NO: 1253258 - RNA, 14 nt, Human
uuuacaugcuuauu

SEQ ID NO: 1253259 - RNA, 16 nt, Human
uuuacaugcuuauucc

SEQ ID NO: 1253260 - RNA, 17 nt, Human
uuuacaugcuuauucca

SEQ ID NO: 1253261 - RNA, 18 nt, Human
uuuacaugcuuauuccau

SEQ ID NO: 1253262 - RNA, 20 nt, Human
uuuacaugcuuauuccauga

SEQ ID NO: 1253263 - RNA, 17 nt, Human
uuuaccaguugccuuuu

SEQ ID NO: 1253264 - RNA, 13 nt, Human
uuuacagcugccu

SEQ ID NO: 1253265 - RNA, 23 nt, Human
uuuacagauuuauuccuuuguua

SEQ ID NO: 1253266 - RNA, 19 nt, Human
uuuacauccuucacugcuc

SEQ ID NO: 1253267 - RNA, 13 nt, Human
uuuacaugaagua

SEQ ID NO: 1253268 - RNA, 14 nt, Human
uuuacaugaaguau

SEQ ID NO: 1253269 - RNA, 15 nt, Human
uuuacaugaaguauu

SEQ ID NO: 1253270 - RNA, 21 nt, Human
uuuacaugaaguauuuuuuca

SEQ ID NO: 1253271 - RNA, 15 nt, Human
uuuaauauaaaugca

SEQ ID NO: 1253272 - RNA, 18 nt, Human
uuuaauauaaaugcaaau

SEQ ID NO: 1253273 - RNA, 20 nt, Human
uuuaauauaaaugcaaauaa

SEQ ID NO: 1253274 - RNA, 13 nt, Human
uuuaaucauauaa

SEQ ID NO: 1253275 - RNA, 12 nt, Human
uuuaaucauaua

SEQ ID NO: 1253276 - RNA, 13 nt, Human
uuuacagagacag

SEQ ID NO: 1253277 - RNA, 16 nt, Human
uuuaauauuacagaua

SEQ ID NO: 1253278 - RNA, 16 nt, Human
uuuaauauuuacucua

SEQ ID NO: 1253279 - RNA, 13 nt, Human
uuuaaucaaauuu

SEQ ID NO: 1253280 - RNA, 17 nt, Human
uuuaaucaaauuuguag

SEQ ID NO: 1253281 - RNA, 22 nt, Human
uuuaauaaacacucuugaaaaa

SEQ ID NO: 1253282 - RNA, 13 nt, Human
uuuaauaaaccau

SEQ ID NO: 1253283 - RNA, 15 nt, Human
uuuaauaauguuuca

SEQ ID NO: 1253284 - RNA, 16 nt, Human
uuuaaccuaugauauu

SEQ ID NO: 1253285 - RNA, 19 nt, Human
uuuaauaauguuucaaaca

SEQ ID NO: 1253286 - RNA, 23 nt, Human
uuuaauauaaaguaguccuguga

SEQ ID NO: 1253287 - RNA, 13 nt, Human
uuuaauauaaagu

SEQ ID NO: 1253288 - RNA, 16 nt, Human
uuuaauauaaaguuuu

SEQ ID NO: 1253289 - RNA, 18 nt, Human
uuuaauauaaaguuuuau

SEQ ID NO: 1253290 - RNA, 22 nt, Human
uuuaauauaaaguuuuauauau

SEQ ID NO: 1253291 - RNA, 23 nt, Human
uuuaauauaaaguuuuauauauu

SEQ ID NO: 1253292 - RNA, 13 nt, Human
uuuaauauaaaug

SEQ ID NO: 1253293 - RNA, 15 nt, Human
uuuaauaaacacucu

SEQ ID NO: 1253294 - RNA, 14 nt, Human
uuuaauaaacacuc

SEQ ID NO: 1253295 - RNA, 14 nt, Human
uuuaaccucuaaau

SEQ ID NO: 1253296 - RNA, 19 nt, Human
uuuaaccccccuguacaca

SEQ ID NO: 1253297 - RNA, 17 nt, Human
uuuaaccccccuguaca

SEQ ID NO: 1253298 - RNA, 18 nt, Human
uuuaaccccccuguacac

SEQ ID NO: 1253299 - RNA, 13 nt, Human
uuuaacauuccuc

SEQ ID NO: 1253300 - RNA, 12 nt, Human
uuuaacagaaau

SEQ ID NO: 1253301 - RNA, 23 nt, Human
uuuaacauuccucaugaauguaa

SEQ ID NO: 1253302 - RNA, 22 nt, Human
uuuaacauuccucaugaaugua

SEQ ID NO: 1253303 - RNA, 18 nt, Human
uuuaguugcaacuuugua

SEQ ID NO: 1253304 - RNA, 17 nt, Human
uuuaguugcaacuuugu

SEQ ID NO: 1253305 - RNA, 12 nt, Human
uuuaguuccugu

SEQ ID NO: 1253306 - RNA, 16 nt, Human
uuuagacagucucacu

SEQ ID NO: 1253307 - RNA, 20 nt, Human
uuuagacagucucacuuugu

SEQ ID NO: 1253308 - RNA, 14 nt, Human
uuuacccuggcccc

SEQ ID NO: 1253309 - RNA, 17 nt, Human
uuuacccuggccccucu

SEQ ID NO: 1253310 - RNA, 19 nt, Human
uuuacccuggccccucucc

SEQ ID NO: 1253311 - RNA, 20 nt, Human
uuuacccuggccccucuccc

SEQ ID NO: 1253312 - RNA, 13 nt, Human
uuuaguuccugug

SEQ ID NO: 1253313 - RNA, 19 nt, Human
uuuaguuccugugcacagc

SEQ ID NO: 1253314 - RNA, 11 nt, Human
uuuaguugaau

SEQ ID NO: 1253315 - RNA, 14 nt, Human
uuuaguugaauuuu

SEQ ID NO: 1253316 - RNA, 23 nt, Human
uuuaguugaauuuuuuuuaacau

SEQ ID NO: 1253317 - RNA, 17 nt, Human
uuuauaaauacugcaaa

SEQ ID NO: 1253318 - RNA, 20 nt, Human
uuuauaaauacugcaaauca

SEQ ID NO: 1253319 - RNA, 13 nt, Human
uuuauaaauccaa

SEQ ID NO: 1253320 - RNA, 14 nt, Human
uuuauaacuaacau

SEQ ID NO: 1253321 - RNA, 12 nt, Human
uuuauacagcug

SEQ ID NO: 1253322 - RNA, 13 nt, Human
uuuauacagcugu

SEQ ID NO: 1253323 - RNA, 14 nt, Human
uuuauacagcugua

SEQ ID NO: 1253324 - RNA, 18 nt, Human
uuuauacagcuguauugu

SEQ ID NO: 1253325 - RNA, 21 nt, Human
uuuauacagcuguauugucug

SEQ ID NO: 1253326 - RNA, 22 nt, Human
uuuauacagcuguauugucuga

SEQ ID NO: 1253327 - RNA, 19 nt, Human
uuuauccugaaauuucaga

SEQ ID NO: 1253328 - RNA, 16 nt, Human
uuuaucgcagaccuuu

SEQ ID NO: 1253329 - RNA, 16 nt, Human
uuuauccuaucucucc

SEQ ID NO: 1253330 - RNA, 18 nt, Human
uuuauccugaaauuucag

SEQ ID NO: 1253331 - RNA, 21 nt, Human
uuuaucugccucucuuguaau

SEQ ID NO: 1253332 - RNA, 19 nt, Human
uuuaucugccucucuugua

SEQ ID NO: 1253333 - RNA, 14 nt, Human
uuuaucugccucuc

SEQ ID NO: 1253334 - RNA, 15 nt, Human
uuuaucgcugggaaa

SEQ ID NO: 1253335 - RNA, 19 nt, Human
uuuaucgcugggaaaugag

SEQ ID NO: 1253336 - RNA, 20 nt, Human
uuuaucgcugggaaaugaga

SEQ ID NO: 1253337 - RNA, 16 nt, Human
uuuaucugaauuuuua

SEQ ID NO: 1253338 - RNA, 19 nt, Human
uuuaugacaguaauugugu

SEQ ID NO: 1253339 - RNA, 14 nt, Human
uuuaugagaaacuu

SEQ ID NO: 1253340 - RNA, 16 nt, Human
uuuaugacaguaauug

SEQ ID NO: 1253341 - RNA, 15 nt, Human
uuuaugacaguaauu

SEQ ID NO: 1253342 - RNA, 14 nt, Human
uuuaugacaguaau

SEQ ID NO: 1253343 - RNA, 14 nt, Human
uuuaugaaugggug

SEQ ID NO: 1253344 - RNA, 12 nt, Human
uuuaucuuuaua

SEQ ID NO: 1253345 - RNA, 20 nt, Human
uuuaucugccucucuuguaa

SEQ ID NO: 1253346 - RNA, 22 nt, Human
uuuauaccucaauuuucacugu

SEQ ID NO: 1253347 - RNA, 16 nt, Human
uuuauacucuuucugu

SEQ ID NO: 1253348 - RNA, 18 nt, Human
uuuauacucuuucuguau

SEQ ID NO: 1253349 - RNA, 20 nt, Human
uuuauacucuuucuguauau

SEQ ID NO: 1253350 - RNA, 20 nt, Human
uuuauacuuucccuacccuc

SEQ ID NO: 1253351 - RNA, 16 nt, Human
uuuaucccaaaguugu

SEQ ID NO: 1253352 - RNA, 18 nt, Human
uuuaucccaaaguuguug

SEQ ID NO: 1253353 - RNA, 16 nt, Human
uuuaucccucaccugu

SEQ ID NO: 1253354 - RNA, 21 nt, Human
uuuaucccaaaguuguuguaa

SEQ ID NO: 1253355 - RNA, 17 nt, Human
uuuauggcacuaguauu

SEQ ID NO: 1253356 - RNA, 23 nt, Human
uuucaauguguugauacauuccc

SEQ ID NO: 1253357 - RNA, 22 nt, Human
uuuaugauacuugaaaauuaac

SEQ ID NO: 1253358 - RNA, 17 nt, Human
uuuaugauaauagauuc

SEQ ID NO: 1253359 - RNA, 18 nt, Human
uuuaugauaauagauucu

SEQ ID NO: 1253360 - RNA, 19 nt, Human
uuuaugauaauagauucuc

SEQ ID NO: 1253361 - RNA, 17 nt, Human
uuuaugagaaagccuuc

SEQ ID NO: 1253362 - RNA, 14 nt, Human
uuuaugccaccuga

SEQ ID NO: 1253363 - RNA, 13 nt, Human
uuuaugcuugcaa

SEQ ID NO: 1253364 - RNA, 18 nt, Human
uuucagcgacuccguugg

SEQ ID NO: 1253365 - RNA, 23 nt, Human
uuucagcgacuccguuggccacu

SEQ ID NO: 1253366 - RNA, 22 nt, Human
uuucacauagcccacuuacauu

SEQ ID NO: 1253367 - RNA, 21 nt, Human
uuucacauagcccacuuacau

SEQ ID NO: 1253368 - RNA, 22 nt, Human
uuucaauuccaccugcaaucaa

SEQ ID NO: 1253369 - RNA, 18 nt, Human
uuucaauugcaucuccca

SEQ ID NO: 1253370 - RNA, 20 nt, Human
uuucaauugcaucucccaga

SEQ ID NO: 1253371 - RNA, 14 nt, Human
uuucacagaaaaua

SEQ ID NO: 1253372 - RNA, 13 nt, Human
uuucacagcuccu

SEQ ID NO: 1253373 - RNA, 17 nt, Human
uuucacagaaaauaagg

SEQ ID NO: 1253374 - RNA, 16 nt, Human
uuucacaguuugaaau

SEQ ID NO: 1253375 - RNA, 18 nt, Human
uuucacaguuugaaauaa

SEQ ID NO: 1253376 - RNA, 17 nt, Human
uuucacaguuugaaaua

SEQ ID NO: 1253377 - RNA, 15 nt, Human
uuuccacuucuucau

SEQ ID NO: 1253378 - RNA, 16 nt, Human
uuuccacuucuucauu

SEQ ID NO: 1253379 - RNA, 18 nt, Human
uuucauuuucucucaggu

SEQ ID NO: 1253380 - RNA, 17 nt, Human
uuucauuuucucucagg

SEQ ID NO: 1253381 - RNA, 23 nt, Human
uuuccaccacagccagcaccugg

SEQ ID NO: 1253382 - RNA, 23 nt, Human
uuuccacggagccacuccucuga

SEQ ID NO: 1253383 - RNA, 12 nt, Human
uuucagcuccug

SEQ ID NO: 1253384 - RNA, 16 nt, Human
uuucagcuccugacca

SEQ ID NO: 1253385 - RNA, 21 nt, Human
uuucagcuccugaccaguugc

SEQ ID NO: 1253386 - RNA, 20 nt, Human
uuucagcuccugaccaguug

SEQ ID NO: 1253387 - RNA, 15 nt, Human
uuucagcugucuuuu

SEQ ID NO: 1253388 - RNA, 16 nt, Human
uuucagcugucuuuug

SEQ ID NO: 1253389 - RNA, 16 nt, Human
uuucaguauuauaugu

SEQ ID NO: 1253390 - RNA, 14 nt, Human
uuucaguauuauau

SEQ ID NO: 1253391 - RNA, 18 nt, Human
uuucaguccccacagaua

SEQ ID NO: 1253392 - RNA, 20 nt, Human
uuucauuuaucuauaauuua

SEQ ID NO: 1253393 - RNA, 14 nt, Human
uuucauuucaacug

SEQ ID NO: 1253394 - RNA, 16 nt, Human
uuucauuucuucuaca

SEQ ID NO: 1253395 - RNA, 23 nt, Human
uuucauuucuucuacaacucaua

SEQ ID NO: 1253396 - RNA, 19 nt, Human
uuucauuugguucauuaau

SEQ ID NO: 1253397 - RNA, 16 nt, Human
uuucauuuucucucag

SEQ ID NO: 1253398 - RNA, 17 nt, Human
uuucugaguuuuaccaa

SEQ ID NO: 1253399 - RNA, 18 nt, Human
uuucugaguuuuaccaaa

SEQ ID NO: 1253400 - RNA, 12 nt, Human
uuucugaaauuu

SEQ ID NO: 1253401 - RNA, 19 nt, Human
uuucugaaauuuccuggga

SEQ ID NO: 1253402 - RNA, 16 nt, Human
uuucugaaaauauaac

SEQ ID NO: 1253403 - RNA, 20 nt, Human
uuucucucuuuauacagcug

SEQ ID NO: 1253404 - RNA, 21 nt, Human
uuucucucuuuauacagcugu

SEQ ID NO: 1253405 - RNA, 15 nt, Human
uuucucugaacacau

SEQ ID NO: 1253406 - RNA, 12 nt, Human
uuucucuaggaa

SEQ ID NO: 1253407 - RNA, 14 nt, Human
uuucucucaacacc

SEQ ID NO: 1253408 - RNA, 16 nt, Human
uuucucucaacaccau

SEQ ID NO: 1253409 - RNA, 22 nt, Human
uuucucgcuguccuuucuagag

SEQ ID NO: 1253410 - RNA, 16 nt, Human
uuucuaccauuucaga

SEQ ID NO: 1253411 - RNA, 17 nt, Human
uuucuaaaguaaaaaca

SEQ ID NO: 1253412 - RNA, 14 nt, Human
uuuccuggugccaa

SEQ ID NO: 1253413 - RNA, 16 nt, Human
uuuccuggugccaauu

SEQ ID NO: 1253414 - RNA, 19 nt, Human
uuuccuggugccaauuuca

SEQ ID NO: 1253415 - RNA, 22 nt, Human
uuuccuggugccaauuucaagu

SEQ ID NO: 1253416 - RNA, 22 nt, Human
uuucuaaaguaaaaacaaagaa

SEQ ID NO: 1253417 - RNA, 22 nt, Human
uuuccuggguggcuacucugug

SEQ ID NO: 1253418 - RNA, 23 nt, Human
uuuccuguauuuguucccaagag

SEQ ID NO: 1253419 - RNA, 12 nt, Human
uuuccuguccuc

SEQ ID NO: 1253420 - RNA, 14 nt, Human
uuucuaauuaugua

SEQ ID NO: 1253421 - RNA, 17 nt, Human
uuucuaauuauguagcu

SEQ ID NO: 1253422 - RNA, 18 nt, Human
uuucuaauuauguagcuc

SEQ ID NO: 1253423 - RNA, 19 nt, Human
uuucuaauuauguagcucu

SEQ ID NO: 1253424 - RNA, 13 nt, Human
uuucuaauugcuu

SEQ ID NO: 1253425 - RNA, 14 nt, Human
uuucuaauugcuua

SEQ ID NO: 1253426 - RNA, 23 nt, Human
uuucuaauugcuuauuuauugua

SEQ ID NO: 1253427 - RNA, 16 nt, Human
uuucuaauugcuuauu

SEQ ID NO: 1253428 - RNA, 22 nt, Human
uuuccucuuagucgagccaagu

SEQ ID NO: 1253429 - RNA, 23 nt, Human
uuuccucuguucaaagcugccug

SEQ ID NO: 1253430 - RNA, 14 nt, Human
uuuccucuccacac

SEQ ID NO: 1253431 - RNA, 12 nt, Human
uuuccucuccac

SEQ ID NO: 1253432 - RNA, 19 nt, Human
uuuccuaagugauuguaug

SEQ ID NO: 1253433 - RNA, 21 nt, Human
uuuccuaauaaaguucuguac

SEQ ID NO: 1253434 - RNA, 23 nt, Human
uuuccuaauaaaguucuguacuc

SEQ ID NO: 1253435 - RNA, 24 nt, Human
uuuccuaauaaaguucuguacuca

SEQ ID NO: 1253436 - RNA, 12 nt, Human
uuuccuaauacu

SEQ ID NO: 1253437 - RNA, 22 nt, Human
uuuccuccgucaccucagagac

SEQ ID NO: 1253438 - RNA, 18 nt, Human
uuuccuccucaggcacac

SEQ ID NO: 1253439 - RNA, 21 nt, Human
uuuccuccugaggcuuuggau

SEQ ID NO: 1253440 - RNA, 22 nt, Human
uuuccuccugaggcuuuggauu

SEQ ID NO: 1253441 - RNA, 18 nt, Human
uuugccacccucaugcug

SEQ ID NO: 1253442 - RNA, 19 nt, Human
uuugccacccucaugcugu

SEQ ID NO: 1253443 - RNA, 13 nt, Human
uuugccacagcuu

SEQ ID NO: 1253444 - RNA, 15 nt, Human
uuugccacagcuuuu

SEQ ID NO: 1253445 - RNA, 16 nt, Human
uuugccacagcuuuug

SEQ ID NO: 1253446 - RNA, 18 nt, Human
uuugccacagcuuuugca

SEQ ID NO: 1253447 - RNA, 12 nt, Human
uuugcauuuguu

SEQ ID NO: 1253448 - RNA, 20 nt, Human
uuugcauuuguuuauguaau

SEQ ID NO: 1253449 - RNA, 23 nt, Human
uuugcauuuguuuauguaauuuc

SEQ ID NO: 1253450 - RNA, 21 nt, Human
uuugcauuuguuuauguaauu

SEQ ID NO: 1253451 - RNA, 23 nt, Human
uuugccaagggcauaaauuauug

SEQ ID NO: 1253452 - RNA, 22 nt, Human
uuugccaagggcauaaauuauu

SEQ ID NO: 1253453 - RNA, 14 nt, Human
uuugauaugugaac

SEQ ID NO: 1253454 - RNA, 20 nt, Human
uuugauaugcauauuuguuu

SEQ ID NO: 1253455 - RNA, 15 nt, Human
uuugauaugugaaca

SEQ ID NO: 1253456 - RNA, 17 nt, Human
uuugauaugugaacagu

SEQ ID NO: 1253457 - RNA, 19 nt, Human
uuugcuucaugugucccag

SEQ ID NO: 1253458 - RNA, 20 nt, Human
uuugcuucaugugucccaga

SEQ ID NO: 1253459 - RNA, 23 nt, Human
uuugcuugcuuugaaguagcucu

SEQ ID NO: 1253460 - RNA, 18 nt, Human
uuugcuuuaauauaaaug

SEQ ID NO: 1253461 - RNA, 23 nt, Human
uuugcuuuaauauaaaugcaaau

SEQ ID NO: 1253462 - RNA, 19 nt, Human
uuugcuuucgguuccaguu

SEQ ID NO: 1253463 - RNA, 19 nt, Human
uuuggaccuaaauggccuc

SEQ ID NO: 1253464 - RNA, 16 nt, Human
uuuggaccuaauccaa

SEQ ID NO: 1253465 - RNA, 16 nt, Human
uuuggacuucuggggu

SEQ ID NO: 1253466 - RNA, 18 nt, Human
uuugguaaggggaauuga

SEQ ID NO: 1253467 - RNA, 20 nt, Human
uuugguaaaauacuucuuga

SEQ ID NO: 1253468 - RNA, 18 nt, Human
uuuggguuuuuuuccuuu

SEQ ID NO: 1253469 - RNA, 14 nt, Human
uuuggguucugccu

SEQ ID NO: 1253470 - RNA, 15 nt, Human
uuuggguucugccug

SEQ ID NO: 1253471 - RNA, 16 nt, Human
uuuggguucugccugc

SEQ ID NO: 1253472 - RNA, 11 nt, Human
uuuggguuucu

SEQ ID NO: 1253473 - RNA, 16 nt, Human
uuuggguuucugcccu

SEQ ID NO: 1253474 - RNA, 16 nt, Human
uuuggguuuuuuuccu

SEQ ID NO: 1253475 - RNA, 20 nt, Human
uuugguucauuaauucuaua

SEQ ID NO: 1253476 - RNA, 16 nt, Human
uuugguaccagauaac

SEQ ID NO: 1253477 - RNA, 11 nt, Human
uuugguucuaa

SEQ ID NO: 1253478 - RNA, 13 nt, Human
uuugguucuaagg

SEQ ID NO: 1253479 - RNA, 19 nt, Human
uuugguuucccaagagcua

SEQ ID NO: 1253480 - RNA, 23 nt, Human
uuuguaaaaugacaaucaugugu

SEQ ID NO: 1253481 - RNA, 13 nt, Human
uuuguauucaaaa

SEQ ID NO: 1253482 - RNA, 16 nt, Human
uuuguauuaagaaagg

SEQ ID NO: 1253483 - RNA, 16 nt, Human
uuuguaugcacuuugu

SEQ ID NO: 1253484 - RNA, 14 nt, Human
uuuguaaaaugaca

SEQ ID NO: 1253485 - RNA, 16 nt, Human
uuuguaaacucaaaau

SEQ ID NO: 1253486 - RNA, 17 nt, Human
uuuguaaacucaaaaua

SEQ ID NO: 1253487 - RNA, 22 nt, Human
uuuguaaacucaaaauauuugu

SEQ ID NO: 1253488 - RNA, 15 nt, Human
uuuguaaaucugcca

SEQ ID NO: 1253489 - RNA, 17 nt, Human
uuuguaaaucugccaca

SEQ ID NO: 1253490 - RNA, 13 nt, Human
uuugaaccaauaa

SEQ ID NO: 1253491 - RNA, 18 nt, Human
uuugaaccugaugaaaau

SEQ ID NO: 1253492 - RNA, 20 nt, Human
uuugaaccugaugaaaauaa

SEQ ID NO: 1253493 - RNA, 16 nt, Human
uuugaagcuacugugu

SEQ ID NO: 1253494 - RNA, 18 nt, Human
uuugaagcuacugugugu

SEQ ID NO: 1253495 - RNA, 12 nt, Human
uuugaaggcaaa

SEQ ID NO: 1253496 - RNA, 13 nt, Human
uuugaaggcaaaa

SEQ ID NO: 1253497 - RNA, 21 nt, Human
uuugaaauuguauuacaaauc

SEQ ID NO: 1253498 - RNA, 13 nt, Human
uuucuugucuaua

SEQ ID NO: 1253499 - RNA, 18 nt, Human
uuucuugucuauaaagca

SEQ ID NO: 1253500 - RNA, 20 nt, Human
uuucuugucuauaaagcauu

SEQ ID NO: 1253501 - RNA, 19 nt, Human
uuucuugugcacuggcacc

SEQ ID NO: 1253502 - RNA, 20 nt, Human
uuucuugugcacuggcacca

SEQ ID NO: 1253503 - RNA, 21 nt, Human
uuugaaauugaaccuuugugc

SEQ ID NO: 1253504 - RNA, 18 nt, Human
uuucuuaaccagaucauu

SEQ ID NO: 1253505 - RNA, 21 nt, Human
uuucuuaaauaagaaacuuuu

SEQ ID NO: 1253506 - RNA, 18 nt, Human
uuucuuaaauaagaaacu

SEQ ID NO: 1253507 - RNA, 19 nt, Human
uuucuuaaauaagaaacuu

SEQ ID NO: 1253508 - RNA, 23 nt, Human
uuucugaucugaugcaagcaaga

SEQ ID NO: 1253509 - RNA, 15 nt, Human
uuucugaucaaggcc

SEQ ID NO: 1253510 - RNA, 17 nt, Human
uuucugaucaaggccuu

SEQ ID NO: 1253511 - RNA, 12 nt, Human
uuucuuaaauaa

SEQ ID NO: 1253512 - RNA, 13 nt, Human
uuucuuaaagugc

SEQ ID NO: 1253513 - RNA, 17 nt, Human
uuucuuaaagugccagu

SEQ ID NO: 1253514 - RNA, 21 nt, Human
uuucuuaaagugccaguauuu

SEQ ID NO: 1253515 - RNA, 13 nt, Human
uuucuuaaauaag

SEQ ID NO: 1253516 - RNA, 20 nt, Human
uuucuuaaauaagaaacuuu

SEQ ID NO: 1253517 - RNA, 13 nt, Human
uuucuuaacuucu

SEQ ID NO: 1253518 - RNA, 14 nt, Human
uuucuuaacuucuu

SEQ ID NO: 1253519 - RNA, 17 nt, Human
uuugaaguuagcuuuaa

SEQ ID NO: 1253520 - RNA, 15 nt, Human
uuugaauaaauguca

SEQ ID NO: 1253521 - RNA, 20 nt, Human
uuugaauaaaugucacuuuu

SEQ ID NO: 1253522 - RNA, 13 nt, Human
uuugaaguauuua

SEQ ID NO: 1253523 - RNA, 22 nt, Human
uuugaagucauaccaaugaaaa

SEQ ID NO: 1253524 - RNA, 15 nt, Human
uuugaagugcuguuu

SEQ ID NO: 1253525 - RNA, 16 nt, Human
uuugaagugcuguuua

SEQ ID NO: 1253526 - RNA, 20 nt, Human
uuugaagugcuguuuauuaa

SEQ ID NO: 1253527 - RNA, 13 nt, Human
uuugaaguguaau

SEQ ID NO: 1253528 - RNA, 23 nt, Human
uuugaaguuagcuuuaacuuaaa

SEQ ID NO: 1253529 - RNA, 16 nt, Human
uuugaaguuagcuuua

SEQ ID NO: 1253530 - RNA, 22 nt, Human
uuugagauauuaaugcccagac

SEQ ID NO: 1253531 - RNA, 14 nt, Human
uuugaggcaaaaga

SEQ ID NO: 1253532 - RNA, 15 nt, Human
uuugaggcaaaagaa

SEQ ID NO: 1253533 - RNA, 20 nt, Human
uggugccccaggaccagcuc

SEQ ID NO: 1253534 - RNA, 21 nt, Human
uggugccccaggaccagcuca

SEQ ID NO: 1253535 - RNA, 16 nt, Human
uggugccccaggacca

SEQ ID NO: 1253536 - RNA, 17 nt, Human
uggugccccaggaccag

SEQ ID NO: 1253537 - RNA, 18 nt, Human
uggugccccaggaccagc

SEQ ID NO: 1253538 - RNA, 19 nt, Human
uggugccccaggaccagcu

SEQ ID NO: 1253539 - RNA, 10 nt, Human
uggugccacc

SEQ ID NO: 1253540 - RNA, 13 nt, Human
uggugccccagga

SEQ ID NO: 1253541 - RNA, 14 nt, Human
uggugccccaggac

SEQ ID NO: 1253542 - RNA, 23 nt, Human
uggugccccaggaccagcucagg

SEQ ID NO: 1253543 - RNA, 13 nt, Human
uguuuagacuuua

SEQ ID NO: 1253544 - RNA, 18 nt, Human
uguuuagacuuuaacaua

SEQ ID NO: 1253545 - RNA, 23 nt, Human
uguuuagacuuuaacauaagcua

SEQ ID NO: 1253546 - RNA, 21 nt, Human
uguuucaaacauauauaacaa

SEQ ID NO: 1253547 - RNA, 22 nt, Human
uguuucaaacauauauaacaau

SEQ ID NO: 1253548 - RNA, 19 nt, Human
uguuuagacuuuaacauaa

SEQ ID NO: 1253549 - RNA, 13 nt, Human
uguuucaaaguuc

SEQ ID NO: 1253550 - RNA, 14 nt, Human
uguuucaaacaugc

SEQ ID NO: 1253551 - RNA, 17 nt, Human
uguuucaaacaugccca

SEQ ID NO: 1253552 - RNA, 12 nt, Human
uguuucaagagg

SEQ ID NO: 1253553 - RNA, 17 nt, Human
uguuucacuacucagca

SEQ ID NO: 1253554 - RNA, 17 nt, Human
uguuucacaguuugaaa

SEQ ID NO: 1253555 - RNA, 19 nt, Human
uguuucacaguuugaaaua

SEQ ID NO: 1253556 - RNA, 20 nt, Human
uguuucacaguuugaaauaa

SEQ ID NO: 1253557 - RNA, 21 nt, Human
uguuucagaggcucagauugu

SEQ ID NO: 1253558 - RNA, 19 nt, Human
uguuucaagaggagccccc

SEQ ID NO: 1253559 - RNA, 22 nt, Human
uguuucaagaggagcccccacc

SEQ ID NO: 1253560 - RNA, 15 nt, Human
uguuucaaggcacuc

SEQ ID NO: 1253561 - RNA, 19 nt, Human
uguuucaaggcacucuaga

SEQ ID NO: 1253562 - RNA, 20 nt, Human
uguuucaaggcacucuagau

SEQ ID NO: 1253563 - RNA, 21 nt, Human
uguuucaaggcacucuagauu

SEQ ID NO: 1253564 - RNA, 16 nt, Human
uguuucaauugcaucu

SEQ ID NO: 1253565 - RNA, 16 nt, Human
uguuucacaaggucuu

SEQ ID NO: 1253566 - RNA, 13 nt, Human
uguuucacaaggu

SEQ ID NO: 1253567 - RNA, 12 nt, Human
uguuucacaguu

SEQ ID NO: 1253568 - RNA, 13 nt, Human
uguuugugcugug

SEQ ID NO: 1253569 - RNA, 14 nt, Human
uguuugugcugugg

SEQ ID NO: 1253570 - RNA, 20 nt, Human
uguuuguacacaacaauccu

SEQ ID NO: 1253571 - RNA, 13 nt, Human
uguuuccagcauu

SEQ ID NO: 1253572 - RNA, 15 nt, Human
uguuuccagcauucc

SEQ ID NO: 1253573 - RNA, 14 nt, Human
uguuuccagcauuc

SEQ ID NO: 1253574 - RNA, 18 nt, Human
uguuuccuuuuucagaua

SEQ ID NO: 1253575 - RNA, 14 nt, Human
uguuucgcucuuug

SEQ ID NO: 1253576 - RNA, 16 nt, Human
uguuuccuuuuucaga

SEQ ID NO: 1253577 - RNA, 15 nt, Human
uguuucguggggagg

SEQ ID NO: 1253578 - RNA, 17 nt, Human
uguuucuacuuugauau

SEQ ID NO: 1253579 - RNA, 15 nt, Human
uguuuggggcaggag

SEQ ID NO: 1253580 - RNA, 23 nt, Human
uguuuggggcaggaguagcugag

SEQ ID NO: 1253581 - RNA, 18 nt, Human
uguuuggguuuuuuuccu

SEQ ID NO: 1253582 - RNA, 13 nt, Human
uuaaaagaaugau

SEQ ID NO: 1253583 - RNA, 12 nt, Human
uuaaaagaauau

SEQ ID NO: 1253584 - RNA, 20 nt, Human
uuaaaagaugcuuuuaacag

SEQ ID NO: 1253585 - RNA, 22 nt, Human
uuaaaagaugcuuuuaacagag

SEQ ID NO: 1253586 - RNA, 13 nt, Human
uuaaaagauuuuu

SEQ ID NO: 1253587 - RNA, 14 nt, Human
uuaaaagcaaauca

SEQ ID NO: 1253588 - RNA, 21 nt, Human
uuaaaagcaaaucauuuguuu

SEQ ID NO: 1253589 - RNA, 18 nt, Human
uuaaaagcaaaucauuug

SEQ ID NO: 1253590 - RNA, 13 nt, Human
uuaaaagccugcu

SEQ ID NO: 1253591 - RNA, 18 nt, Human
uuaaaaguguauuuguua

SEQ ID NO: 1253592 - RNA, 16 nt, Human
uuaaaagugucaagcu

SEQ ID NO: 1253593 - RNA, 19 nt, Human
uuaaaauagcaaaagaaga

SEQ ID NO: 1253594 - RNA, 21 nt, Human
uuaaaauagcaaaagaagaag

SEQ ID NO: 1253595 - RNA, 23 nt, Human
uuaaaauagcaaaagaagaaguu

SEQ ID NO: 1253596 - RNA, 22 nt, Human
uuaaaauagcaaaagaagaagu

SEQ ID NO: 1253597 - RNA, 20 nt, Human
uuaaaauagcguucuuguaa

SEQ ID NO: 1253598 - RNA, 22 nt, Human
uuaaaauagcguucuuguaauu

SEQ ID NO: 1253599 - RNA, 21 nt, Human
uuaaaauagcguucuuguaau

SEQ ID NO: 1253600 - RNA, 22 nt, Human
uuaaacucuguugcaagugcaa

SEQ ID NO: 1253601 - RNA, 12 nt, Human
uuaaacuguaca

SEQ ID NO: 1253602 - RNA, 13 nt, Human
uuaaacuguacag

SEQ ID NO: 1253603 - RNA, 14 nt, Human
uuaaacuguacagu

SEQ ID NO: 1253604 - RNA, 15 nt, Human
uuaaacuguacagug

SEQ ID NO: 1253605 - RNA, 16 nt, Human
uuaaacuguacagugu

SEQ ID NO: 1253606 - RNA, 17 nt, Human
uuaaacuguacaguguc

SEQ ID NO: 1253607 - RNA, 18 nt, Human
uuaaacuguacagugucu

SEQ ID NO: 1253608 - RNA, 20 nt, Human
uuaaacuguacagugucuuu

SEQ ID NO: 1253609 - RNA, 21 nt, Human
uuaaacuguacagugucuuuu

SEQ ID NO: 1253610 - RNA, 12 nt, Human
uuaaacugugua

SEQ ID NO: 1253611 - RNA, 19 nt, Human
uuaaacuguguacauaacu

SEQ ID NO: 1253612 - RNA, 12 nt, Human
uuaaagaaagug

SEQ ID NO: 1253613 - RNA, 17 nt, Human
uuaaagaaaguguauuu

SEQ ID NO: 1253614 - RNA, 12 nt, Human
uuaaagaagacc

SEQ ID NO: 1253615 - RNA, 18 nt, Human
uguuuuuuuuuaaagacu

SEQ ID NO: 1253616 - RNA, 18 nt, Human
uguuuuuuuguuauuaaa

SEQ ID NO: 1253617 - RNA, 15 nt, Human
uguuuuuuuguuugu

SEQ ID NO: 1253618 - RNA, 16 nt, Human
uguuuuuuuguuauua

SEQ ID NO: 1253619 - RNA, 15 nt, Human
uguuuuuuucuaaua

SEQ ID NO: 1253620 - RNA, 18 nt, Human
uguuuuuuuuuuccacuu

SEQ ID NO: 1253621 - RNA, 19 nt, Human
uguuuuuuuuuuccacuua

SEQ ID NO: 1253622 - RNA, 23 nt, Human
uuaaaagaauaucuggcaaauua

SEQ ID NO: 1253623 - RNA, 22 nt, Human
uguuuuguucaccauuauaaug

SEQ ID NO: 1253624 - RNA, 17 nt, Human
uguuuuguuuggagaca

SEQ ID NO: 1253625 - RNA, 21 nt, Human
uguuuuguugacauucugaau

SEQ ID NO: 1253626 - RNA, 12 nt, Human
uguuuuguugac

SEQ ID NO: 1253627 - RNA, 13 nt, Human
uguuuuguugaca

SEQ ID NO: 1253628 - RNA, 14 nt, Human
uguuuuguugacau

SEQ ID NO: 1253629 - RNA, 15 nt, Human
uguuuuguugacauu

SEQ ID NO: 1253630 - RNA, 19 nt, Human
uguuuuguugacauucuga

SEQ ID NO: 1253631 - RNA, 20 nt, Human
uguuuuguugacauucugaa

SEQ ID NO: 1253632 - RNA, 20 nt, Human
uguuuuguugguuuuuaaag

SEQ ID NO: 1253633 - RNA, 15 nt, Human
uguuuuguuuuuaca

SEQ ID NO: 1253634 - RNA, 16 nt, Human
uguuuuguuuuuacaa

SEQ ID NO: 1253635 - RNA, 15 nt, Human
uguuuuuugccacag

SEQ ID NO: 1253636 - RNA, 18 nt, Human
uguuuuuugccacagcuu

SEQ ID NO: 1253637 - RNA, 19 nt, Human
uguuuuuugccacagcuuu

SEQ ID NO: 1253638 - RNA, 23 nt, Human
uguuuuuugccacagcuuuugca

SEQ ID NO: 1253639 - RNA, 22 nt, Human
uuaacuauugcauuuauaugua

SEQ ID NO: 1253640 - RNA, 21 nt, Human
uuaacuauugcauuuauaugu

SEQ ID NO: 1253641 - RNA, 14 nt, Human
uuaacuauugcauu

SEQ ID NO: 1253642 - RNA, 15 nt, Human
uuaacucauuagacu

SEQ ID NO: 1253643 - RNA, 16 nt, Human
uuaacucauuagacug

SEQ ID NO: 1253644 - RNA, 17 nt, Human
uuaacucauuagacugg

SEQ ID NO: 1253645 - RNA, 20 nt, Human
uuaacugacaagcuccauuu

SEQ ID NO: 1253646 - RNA, 21 nt, Human
uuaacugacaagccaucuuga

SEQ ID NO: 1253647 - RNA, 21 nt, Human
uuaacugaauaccacucugua

SEQ ID NO: 1253648 - RNA, 22 nt, Human
uuaacugaauaccacucuguaa

SEQ ID NO: 1253649 - RNA, 16 nt, Human
uuaacugaauaccacu

SEQ ID NO: 1253650 - RNA, 20 nt, Human
uuaacugaauaccacucugu

SEQ ID NO: 1253651 - RNA, 23 nt, Human
uuaacucccauuaccauguaaug

SEQ ID NO: 1253652 - RNA, 22 nt, Human
uuaacucccauuaccauguaau

SEQ ID NO: 1253653 - RNA, 15 nt, Human
uuaacucucuuuaug

SEQ ID NO: 1253654 - RNA, 19 nt, Human
uuaacucucuuuaugucug

SEQ ID NO: 1253655 - RNA, 17 nt, Human
uuaacucucuuuauguc

SEQ ID NO: 1253656 - RNA, 19 nt, Human
uuaacugccguaauuuaac

SEQ ID NO: 1253657 - RNA, 21 nt, Human
uuaacuggguaaugaaacaaa

SEQ ID NO: 1253658 - RNA, 17 nt, Human
uuaacuggguaaugaaa

SEQ ID NO: 1253659 - RNA, 12 nt, Human
uuaacuguggau

SEQ ID NO: 1253660 - RNA, 13 nt, Human
uuaacuguggaua

SEQ ID NO: 1253661 - RNA, 15 nt, Human
uuaacuguggauauu

SEQ ID NO: 1253662 - RNA, 15 nt, Human
uuaacuuaaauagua

SEQ ID NO: 1253663 - RNA, 13 nt, Human
uuaacuuaaauag

SEQ ID NO: 1253664 - RNA, 15 nt, Human
uuaacuucuguuuua

SEQ ID NO: 1253665 - RNA, 17 nt, Human
uuaacuucuguuuuacc

SEQ ID NO: 1253666 - RNA, 14 nt, Human
uuaacuucuugcuu

SEQ ID NO: 1253667 - RNA, 17 nt, Human
uuaacuucuugcuucuu

SEQ ID NO: 1253668 - RNA, 21 nt, Human
uuaacuucuugcuucuuucua

SEQ ID NO: 1253669 - RNA, 23 nt, Human
uuaaauguuuuuuuuuaaagacu

SEQ ID NO: 1253670 - RNA, 21 nt, Human
uuaaauguuuuuuuuuaaaga

SEQ ID NO: 1253671 - RNA, 13 nt, Human
uuaaauuacagaa

SEQ ID NO: 1253672 - RNA, 14 nt, Human
uuaaagacuuuuau

SEQ ID NO: 1253673 - RNA, 19 nt, Human
uuaaagaauucaaauuuua

SEQ ID NO: 1253674 - RNA, 17 nt, Human
uuaaagaauucaaauuu

SEQ ID NO: 1253675 - RNA, 15 nt, Human
uuaaagaauucaaau

SEQ ID NO: 1253676 - RNA, 20 nt, Human
uuaaagaauucaaauuuuau

SEQ ID NO: 1253677 - RNA, 14 nt, Human
uuaaagaauucaaa

SEQ ID NO: 1253678 - RNA, 16 nt, Human
uuaaagaauaugaaac

SEQ ID NO: 1253679 - RNA, 18 nt, Human
uuaaagaauaugaaacau

SEQ ID NO: 1253680 - RNA, 13 nt, Human
uuaaccagaucua

SEQ ID NO: 1253681 - RNA, 22 nt, Human
uuaaccagaucuagucaaucaa

SEQ ID NO: 1253682 - RNA, 14 nt, Human
uuaaccccccugua

SEQ ID NO: 1253683 - RNA, 17 nt, Human
uuaaccccccuguacac

SEQ ID NO: 1253684 - RNA, 20 nt, Human
uuaaccccccuguacacaac

SEQ ID NO: 1253685 - RNA, 18 nt, Human
uuaaccccccuguacaca

SEQ ID NO: 1253686 - RNA, 20 nt, Human
uuaaccuaugauauuuucug

SEQ ID NO: 1253687 - RNA, 21 nt, Human
uuaaccuaugauauuuucugu

SEQ ID NO: 1253688 - RNA, 12 nt, Human
uuaaccucugca

SEQ ID NO: 1253689 - RNA, 15 nt, Human
uuaaccucugcacua

SEQ ID NO: 1253690 - RNA, 14 nt, Human
uuaacgauguccaa

SEQ ID NO: 1253691 - RNA, 12 nt, Human
uuaaccuuugau

SEQ ID NO: 1253692 - RNA, 22 nt, Human
uuaaugucaauucuugccaaau

SEQ ID NO: 1253693 - RNA, 18 nt, Human
uuaauguacauagugcua

SEQ ID NO: 1253694 - RNA, 19 nt, Human
uuaauguauaguaaaucac

SEQ ID NO: 1253695 - RNA, 17 nt, Human
uuaauguaucaaacugu

SEQ ID NO: 1253696 - RNA, 13 nt, Human
uuaauguauguua

SEQ ID NO: 1253697 - RNA, 15 nt, Human
uuaauguauguuacc

SEQ ID NO: 1253698 - RNA, 17 nt, Human
uuaauguauguuaccaa

SEQ ID NO: 1253699 - RNA, 18 nt, Human
uuaauguauguuaccaaa

SEQ ID NO: 1253700 - RNA, 13 nt, Human
uuaauguguauua

SEQ ID NO: 1253701 - RNA, 17 nt, Human
uuaauguacauagugcu

SEQ ID NO: 1253702 - RNA, 20 nt, Human
uuaauggugccuucauuugg

SEQ ID NO: 1253703 - RNA, 17 nt, Human
uuaauggugccuucauu

SEQ ID NO: 1253704 - RNA, 19 nt, Human
uuaauggugccuucauuug

SEQ ID NO: 1253705 - RNA, 23 nt, Human
uuaaugccgauauacucuagaug

SEQ ID NO: 1253706 - RNA, 13 nt, Human
uuaaugcccagac

SEQ ID NO: 1253707 - RNA, 11 nt, Human
uuaaugcacuu

SEQ ID NO: 1253708 - RNA, 12 nt, Human
uuaaugcacuuu

SEQ ID NO: 1253709 - RNA, 13 nt, Human
uuaaugcacuuuc

SEQ ID NO: 1253710 - RNA, 14 nt, Human
uuaaugcacuuucu

SEQ ID NO: 1253711 - RNA, 15 nt, Human
uuaaugcacuuucua

SEQ ID NO: 1253712 - RNA, 18 nt, Human
uuaauguuuuuugccaca

SEQ ID NO: 1253713 - RNA, 15 nt, Human
uuaauguuuaaaaca

SEQ ID NO: 1253714 - RNA, 17 nt, Human
uuacaaguaacaaaaau

SEQ ID NO: 1253715 - RNA, 20 nt, Human
uuacaaguaacaaaaauaaa

SEQ ID NO: 1253716 - RNA, 19 nt, Human
uuacaaguaacaaaaauaa

SEQ ID NO: 1253717 - RNA, 15 nt, Human
uuaauauaaaugcaa

SEQ ID NO: 1253718 - RNA, 20 nt, Human
uuaauauauauuaucuuuuc

SEQ ID NO: 1253719 - RNA, 14 nt, Human
uuaauauuacagau

SEQ ID NO: 1253720 - RNA, 21 nt, Human
uuaaugauaugcuuguaacua

SEQ ID NO: 1253721 - RNA, 16 nt, Human
uuaaugcaauauacug

SEQ ID NO: 1253722 - RNA, 15 nt, Human
uuaagccuuuggaaa

SEQ ID NO: 1253723 - RNA, 16 nt, Human
uuaagccuuuggaaac

SEQ ID NO: 1253724 - RNA, 14 nt, Human
uuaagcucugagcu

SEQ ID NO: 1253725 - RNA, 15 nt, Human
uuaagcucugagcug

SEQ ID NO: 1253726 - RNA, 16 nt, Human
uuaagcucugagcugu

SEQ ID NO: 1253727 - RNA, 17 nt, Human
uuaagcucugagcuguc

SEQ ID NO: 1253728 - RNA, 18 nt, Human
uuaagcucugagcuguca

SEQ ID NO: 1253729 - RNA, 21 nt, Human
uuaauauaaaguuuuauauau

SEQ ID NO: 1253730 - RNA, 22 nt, Human
uuaauauaaaguuuuauauauu

SEQ ID NO: 1253731 - RNA, 23 nt, Human
uuaauauaaaguuuuauauauua

SEQ ID NO: 1253732 - RNA, 14 nt, Human
uuaauauaaaugca

SEQ ID NO: 1253733 - RNA, 17 nt, Human
uuaauauaaaugcaaau

SEQ ID NO: 1253734 - RNA, 19 nt, Human
uuacugucuuuuuucuaaa

SEQ ID NO: 1253735 - RNA, 13 nt, Human
uuacuguguaauu

SEQ ID NO: 1253736 - RNA, 16 nt, Human
uuacuguguaauuagu

SEQ ID NO: 1253737 - RNA, 20 nt, Human
uuacuguguaauuagugcca

SEQ ID NO: 1253738 - RNA, 18 nt, Human
uuacuguuagucauuugc

SEQ ID NO: 1253739 - RNA, 19 nt, Human
uuacuuaguauugcaaagu

SEQ ID NO: 1253740 - RNA, 15 nt, Human
uuacuuaguauugca

SEQ ID NO: 1253741 - RNA, 13 nt, Human
uuacuuaguauug

SEQ ID NO: 1253742 - RNA, 18 nt, Human
uuacuuauuaucuucagg

SEQ ID NO: 1253743 - RNA, 16 nt, Human
uuacuuaaucaaaacu

SEQ ID NO: 1253744 - RNA, 11 nt, Human
uuacuucauau

SEQ ID NO: 1253745 - RNA, 22 nt, Human
uuacuucguguccgacucuucu

SEQ ID NO: 1253746 - RNA, 15 nt, Human
uuacaauuuuuuauc

SEQ ID NO: 1253747 - RNA, 17 nt, Human
uuacaauuuuuuaucau

SEQ ID NO: 1253748 - RNA, 18 nt, Human
uuacaauuuuuuaucaug

SEQ ID NO: 1253749 - RNA, 20 nt, Human
uuacaauuuuuuaucaugca

SEQ ID NO: 1253750 - RNA, 17 nt, Human
uuacuaguuucccuugc

SEQ ID NO: 1253751 - RNA, 19 nt, Human
uuacuaucaugucaaacgu

SEQ ID NO: 1253752 - RNA, 15 nt, Human
uuacuauaagaacuu

SEQ ID NO: 1253753 - RNA, 20 nt, Human
uuacuauaagaacuuugagc

SEQ ID NO: 1253754 - RNA, 23 nt, Human
uuacuauaagaacuuugagcuac

SEQ ID NO: 1253755 - RNA, 21 nt, Human
uuacuaucaugucaaacguga

SEQ ID NO: 1253756 - RNA, 20 nt, Human
uuacuaaggaagauuacuca

SEQ ID NO: 1253757 - RNA, 13 nt, Human
uuacuacaugcac

SEQ ID NO: 1253758 - RNA, 14 nt, Human
uuacuacaugcacu

SEQ ID NO: 1253759 - RNA, 16 nt, Human
uuacuagggaucccuc

SEQ ID NO: 1253760 - RNA, 20 nt, Human
uuacuagggaucccucaucu

SEQ ID NO: 1253761 - RNA, 23 nt, Human
uuacuagggaucccucaucuguc

SEQ ID NO: 1253762 - RNA, 15 nt, Human
uuagacuuuaacaua

SEQ ID NO: 1253763 - RNA, 16 nt, Human
uuagacuuuaacauaa

SEQ ID NO: 1253764 - RNA, 21 nt, Human
uuagacuuuaacauaagcuau

SEQ ID NO: 1253765 - RNA, 22 nt, Human
uuagacuuuaacauaagcuauu

SEQ ID NO: 1253766 - RNA, 13 nt, Human
uuagagaaaacua

SEQ ID NO: 1253767 - RNA, 21 nt, Human
uuagagaaguauacauaaguu

SEQ ID NO: 1253768 - RNA, 12 nt, Human
uuagagaauaaa

SEQ ID NO: 1253769 - RNA, 16 nt, Human
uuagaccuguguuacu

SEQ ID NO: 1253770 - RNA, 17 nt, Human
uuagacucuuuuccuuc

SEQ ID NO: 1253771 - RNA, 15 nt, Human
uuagacuggaacuug

SEQ ID NO: 1253772 - RNA, 16 nt, Human
uuagacuggaacuuga

SEQ ID NO: 1253773 - RNA, 17 nt, Human
uuagacuggaacuugaa

SEQ ID NO: 1253774 - RNA, 21 nt, Human
uuagacuggaacuugaacuga

SEQ ID NO: 1253775 - RNA, 22 nt, Human
uuagacuggaacuugaacugau

SEQ ID NO: 1253776 - RNA, 15 nt, Human
uuagacuggacagcu

SEQ ID NO: 1253777 - RNA, 16 nt, Human
uuagacuggacagcuu

SEQ ID NO: 1253778 - RNA, 17 nt, Human
uuagacuggacagcuug

SEQ ID NO: 1253779 - RNA, 19 nt, Human
uuagacuggacagcuugug

SEQ ID NO: 1253780 - RNA, 18 nt, Human
uuagacugugauucagaa

SEQ ID NO: 1253781 - RNA, 16 nt, Human
uuagaccaccaagccu

SEQ ID NO: 1253782 - RNA, 17 nt, Human
uuagaccaccaagccuu

SEQ ID NO: 1253783 - RNA, 19 nt, Human
uuagaccaccaagccuuga

SEQ ID NO: 1253784 - RNA, 13 nt, Human
uuagaccuacagg

SEQ ID NO: 1253785 - RNA, 23 nt, Human
uuagaccuacagggggucuggcu

SEQ ID NO: 1253786 - RNA, 18 nt, Human
uuagacuaaggccauuau

SEQ ID NO: 1253787 - RNA, 19 nt, Human
uuagaaacacaacuauauu

SEQ ID NO: 1253788 - RNA, 21 nt, Human
uuagaaaacauaaucuucugc

SEQ ID NO: 1253789 - RNA, 23 nt, Human
uuagaaaaccagcucagcacugc

SEQ ID NO: 1253790 - RNA, 16 nt, Human
uuagaaaacuuuaaag

SEQ ID NO: 1253791 - RNA, 14 nt, Human
uuagaaaacuuuaa

SEQ ID NO: 1253792 - RNA, 13 nt, Human
uuacuuugugaau

SEQ ID NO: 1253793 - RNA, 17 nt, Human
uuacuuuuaaacaguga

SEQ ID NO: 1253794 - RNA, 14 nt, Human
uuacuuuuaaacug

SEQ ID NO: 1253795 - RNA, 15 nt, Human
uuacuuuuaaacugu

SEQ ID NO: 1253796 - RNA, 16 nt, Human
uuacuuuuaaacugug

SEQ ID NO: 1253797 - RNA, 19 nt, Human
uuacuuuuaaacuguguac

SEQ ID NO: 1253798 - RNA, 14 nt, Human
uuacuuuugcugua

SEQ ID NO: 1253799 - RNA, 13 nt, Human
uuacuuguaaaua

SEQ ID NO: 1253800 - RNA, 16 nt, Human
uuacuuguaaauauaa

SEQ ID NO: 1253801 - RNA, 17 nt, Human
uuacuuguaaauauaaa

SEQ ID NO: 1253802 - RNA, 19 nt, Human
uuacuuguaaauauaaaga

SEQ ID NO: 1253803 - RNA, 21 nt, Human
uuacuuguaaauauaaagacg

SEQ ID NO: 1253804 - RNA, 22 nt, Human
uuacuuguaaauauaaagacgu

SEQ ID NO: 1253805 - RNA, 23 nt, Human
uuacuuguaaauauaaagacguu

SEQ ID NO: 1253806 - RNA, 18 nt, Human
uuacuuuagaagccugca

SEQ ID NO: 1253807 - RNA, 16 nt, Human
uuacuuuauguuacua

SEQ ID NO: 1253808 - RNA, 21 nt, Human
uuacuuuggggcuaauuuaac

SEQ ID NO: 1253809 - RNA, 14 nt, Human
uuagggaaaacauu

SEQ ID NO: 1253810 - RNA, 17 nt, Human
uuaggcuguaacuacuu

SEQ ID NO: 1253811 - RNA, 20 nt, Human
uuaggcuguaacuacuuuau

SEQ ID NO: 1253812 - RNA, 23 nt, Human
uuaggcuauuuguaaaucugcca

SEQ ID NO: 1253813 - RNA, 14 nt, Human
uuaggcuguaacua

SEQ ID NO: 1253814 - RNA, 19 nt, Human
uuaggcccccaucauccuc

SEQ ID NO: 1253815 - RNA, 14 nt, Human
uuaggccucugaga

SEQ ID NO: 1253816 - RNA, 16 nt, Human
uuaggcuauuuguaaa

SEQ ID NO: 1253817 - RNA, 19 nt, Human
uuaggcuauuuguaaaucu

SEQ ID NO: 1253818 - RNA, 20 nt, Human
uuaggcuauuuguaaaucug

SEQ ID NO: 1253819 - RNA, 22 nt, Human
uuaggcuauuuguaaaucugcc

SEQ ID NO: 1253820 - RNA, 23 nt, Human
uuaggaaguugacuuauaguaca

SEQ ID NO: 1253821 - RNA, 22 nt, Human
uuaggaaguugacuuauaguac

SEQ ID NO: 1253822 - RNA, 11 nt, Human
uuaggaagagc

SEQ ID NO: 1253823 - RNA, 22 nt, Human
uuaggaagagccuuccacccag

SEQ ID NO: 1253824 - RNA, 18 nt, Human
uuaggaagcaagcuuaau

SEQ ID NO: 1253825 - RNA, 12 nt, Human
uuaggagaagcc

SEQ ID NO: 1253826 - RNA, 13 nt, Human
uuaggagaagcca

SEQ ID NO: 1253827 - RNA, 16 nt, Human
uuaggagaagccagga

SEQ ID NO: 1253828 - RNA, 17 nt, Human
uuaggagaagccaggaa

SEQ ID NO: 1253829 - RNA, 21 nt, Human
uuaggagagaagguagggguu

SEQ ID NO: 1253830 - RNA, 18 nt, Human
uuaggauguugaaaaagu

SEQ ID NO: 1253831 - RNA, 15 nt, Human
uuaggacuugcccuc

SEQ ID NO: 1253832 - RNA, 15 nt, Human
uuaggagcuaaggcu

SEQ ID NO: 1253833 - RNA, 17 nt, Human
uuaggagcuaaggcucu

SEQ ID NO: 1253834 - RNA, 16 nt, Human
uuaggagcuaaggcuc

SEQ ID NO: 1253835 - RNA, 16 nt, Human
uuaggcagacucuuua

SEQ ID NO: 1253836 - RNA, 15 nt, Human
uuaggcagacucuuu

SEQ ID NO: 1253837 - RNA, 14 nt, Human
uuaguguucauaaa

SEQ ID NO: 1253838 - RNA, 12 nt, Human
uuagucucaguu

SEQ ID NO: 1253839 - RNA, 21 nt, Human
uuagucucaguuugugugucu

SEQ ID NO: 1253840 - RNA, 22 nt, Human
uuagucucaguuugugugucuu

SEQ ID NO: 1253841 - RNA, 23 nt, Human
uuagucucaguuugugugucuua

SEQ ID NO: 1253842 - RNA, 13 nt, Human
uuaguuaccuuau

SEQ ID NO: 1253843 - RNA, 16 nt, Human
uuaguuaccuuauagu

SEQ ID NO: 1253844 - RNA, 18 nt, Human
uuaguuaccuuauaguua

SEQ ID NO: 1253845 - RNA, 19 nt, Human
uuaguuaccuuauaguuac

SEQ ID NO: 1253846 - RNA, 20 nt, Human
uuaguuaccuuauaguuacu

SEQ ID NO: 1253847 - RNA, 21 nt, Human
uuaguuaccuuauaguuacug

SEQ ID NO: 1253848 - RNA, 22 nt, Human
uuaguuaccuuauaguuacugu

SEQ ID NO: 1253849 - RNA, 15 nt, Human
uuaguuccacugaga

SEQ ID NO: 1253850 - RNA, 16 nt, Human
uuaguuccacugagac

SEQ ID NO: 1253851 - RNA, 17 nt, Human
uuaguauugcaaaguca

SEQ ID NO: 1253852 - RNA, 12 nt, Human
uuaguauuguug

SEQ ID NO: 1253853 - RNA, 16 nt, Human
uuaguauuguuguccu

SEQ ID NO: 1253854 - RNA, 17 nt, Human
uuaguauuguuguccuu

SEQ ID NO: 1253855 - RNA, 13 nt, Human
uuaguauugcaaa

SEQ ID NO: 1253856 - RNA, 11 nt, Human
uuaguauugca

SEQ ID NO: 1253857 - RNA, 13 nt, Human
uuaguaucuuuug

SEQ ID NO: 1253858 - RNA, 18 nt, Human
uuaguauuguuguccuuu

SEQ ID NO: 1253859 - RNA, 20 nt, Human
uuaguauuguuguccuuuuc

SEQ ID NO: 1253860 - RNA, 23 nt, Human
uuaguauuguuguccuuuucaua

SEQ ID NO: 1253861 - RNA, 22 nt, Human
uuaguauuguuguccuuuucau

SEQ ID NO: 1253862 - RNA, 13 nt, Human
uuagucaugugac

SEQ ID NO: 1253863 - RNA, 14 nt, Human
uuagucaugugacc

SEQ ID NO: 1253864 - RNA, 19 nt, Human
uuagucauguuuaucugcu

SEQ ID NO: 1253865 - RNA, 17 nt, Human
uuagucccucaugcaaa

SEQ ID NO: 1253866 - RNA, 22 nt, Human
uuaguccuguuauagacgagaa

SEQ ID NO: 1253867 - RNA, 12 nt, Human
uuagcuggaaaa

SEQ ID NO: 1253868 - RNA, 13 nt, Human
uuagcuggaaaag

SEQ ID NO: 1253869 - RNA, 12 nt, Human
uuagcugggaga

SEQ ID NO: 1253870 - RNA, 16 nt, Human
uuagcuggcauuacag

SEQ ID NO: 1253871 - RNA, 15 nt, Human
uuagcugucugcuca

SEQ ID NO: 1253872 - RNA, 17 nt, Human
uuagcugucugcucaga

SEQ ID NO: 1253873 - RNA, 15 nt, Human
uuagcugacaaaaua

SEQ ID NO: 1253874 - RNA, 18 nt, Human
uuagcugacaaaauacuu

SEQ ID NO: 1253875 - RNA, 12 nt, Human
uuagcugacaaa

SEQ ID NO: 1253876 - RNA, 14 nt, Human
uuagcuccuguggc

SEQ ID NO: 1253877 - RNA, 11 nt, Human
uuagcucugag

SEQ ID NO: 1253878 - RNA, 12 nt, Human
uuagcucugaga

SEQ ID NO: 1253879 - RNA, 13 nt, Human
uuagcucugagaa

SEQ ID NO: 1253880 - RNA, 23 nt, Human
uuagcuaauaaaaagcuuuuguc

SEQ ID NO: 1253881 - RNA, 13 nt, Human
uuagcucaaugag

SEQ ID NO: 1253882 - RNA, 14 nt, Human
uuagcucaaugagc

SEQ ID NO: 1253883 - RNA, 18 nt, Human
uuagcucaaugagcaugu

SEQ ID NO: 1253884 - RNA, 17 nt, Human
uuagcucaaugagcaug

SEQ ID NO: 1253885 - RNA, 13 nt, Human
uuagcuccugugg

SEQ ID NO: 1253886 - RNA, 12 nt, Human
uuagcuuuguca

SEQ ID NO: 1253887 - RNA, 16 nt, Human
uuagcuuugucacugu

SEQ ID NO: 1253888 - RNA, 23 nt, Human
uuaggaaauguuuuuaauaaaag

SEQ ID NO: 1253889 - RNA, 17 nt, Human
uuagcuuauguuaacug

SEQ ID NO: 1253890 - RNA, 13 nt, Human
uuagcuuuaacuu

SEQ ID NO: 1253891 - RNA, 20 nt, Human
uuagaugcaguucugaagaa

SEQ ID NO: 1253892 - RNA, 21 nt, Human
uuagaugcaguucugaagaag

SEQ ID NO: 1253893 - RNA, 22 nt, Human
uuagaugcaguucugaagaaga

SEQ ID NO: 1253894 - RNA, 15 nt, Human
uuagaucuggcaugu

SEQ ID NO: 1253895 - RNA, 21 nt, Human
uuagcuaaacggauuccaaag

SEQ ID NO: 1253896 - RNA, 15 nt, Human
uuagcuaauaaaaag

SEQ ID NO: 1253897 - RNA, 22 nt, Human
uuagcuaauaaaaagcuuuugu

SEQ ID NO: 1253898 - RNA, 15 nt, Human
uuagauaaauauuga

SEQ ID NO: 1253899 - RNA, 16 nt, Human
uuagauagcccugucc

SEQ ID NO: 1253900 - RNA, 17 nt, Human
uuagauagcccuguccu

SEQ ID NO: 1253901 - RNA, 18 nt, Human
uuagauagcccuguccug

SEQ ID NO: 1253902 - RNA, 20 nt, Human
uuagauagcccuguccuggu

SEQ ID NO: 1253903 - RNA, 15 nt, Human
uuagagauaagaguu

SEQ ID NO: 1253904 - RNA, 18 nt, Human
uuagagggaggagaauga

SEQ ID NO: 1253905 - RNA, 16 nt, Human
uuagagugucuuucca

SEQ ID NO: 1253906 - RNA, 17 nt, Human
uuagagugucuuuccac

SEQ ID NO: 1253907 - RNA, 16 nt, Human
uuaugcuuaaauucaa

SEQ ID NO: 1253908 - RNA, 17 nt, Human
uuaugcugugacacaug

SEQ ID NO: 1253909 - RNA, 15 nt, Human
uuaugcugauuuauu

SEQ ID NO: 1253910 - RNA, 21 nt, Human
uuauggcacuaguauuucuau

SEQ ID NO: 1253911 - RNA, 16 nt, Human
uuaugccaccugaaua

SEQ ID NO: 1253912 - RNA, 17 nt, Human
uuaugccuuuuuugauc

SEQ ID NO: 1253913 - RNA, 16 nt, Human
uuaugcgguuaauuuu

SEQ ID NO: 1253914 - RNA, 19 nt, Human
uuaugcgguuaauuuugaa

SEQ ID NO: 1253915 - RNA, 17 nt, Human
uuaugcucuuaauugcc

SEQ ID NO: 1253916 - RNA, 21 nt, Human
uuaugcucuuaauugccaccu

SEQ ID NO: 1253917 - RNA, 18 nt, Human
uuaugcucuuaauugcca

SEQ ID NO: 1253918 - RNA, 14 nt, Human
uuaugaaaaagaag

SEQ ID NO: 1253919 - RNA, 13 nt, Human
uuaugccaccuga

SEQ ID NO: 1253920 - RNA, 17 nt, Human
uuaucuugguugaaaau

SEQ ID NO: 1253921 - RNA, 16 nt, Human
uuaucuuuacuuuuaa

SEQ ID NO: 1253922 - RNA, 12 nt, Human
uuaucuuuauau

SEQ ID NO: 1253923 - RNA, 15 nt, Human
uuaucuuuuuaccuu

SEQ ID NO: 1253924 - RNA, 17 nt, Human
uuaugaaaaagaagaau

SEQ ID NO: 1253925 - RNA, 20 nt, Human
uuaguugcaacuuuguauaa

SEQ ID NO: 1253926 - RNA, 13 nt, Human
uuaguugcaacuu

SEQ ID NO: 1253927 - RNA, 18 nt, Human
uuaguuccugugcacagc

SEQ ID NO: 1253928 - RNA, 15 nt, Human
uuaguuccugugcac

SEQ ID NO: 1253929 - RNA, 12 nt, Human
uuaguuccugug

SEQ ID NO: 1253930 - RNA, 12 nt, Human
uuaucucugugu

SEQ ID NO: 1253931 - RNA, 15 nt, Human
uuaucuauaauuuac

SEQ ID NO: 1253932 - RNA, 17 nt, Human
uuaucuauaauuuaccu

SEQ ID NO: 1253933 - RNA, 22 nt, Human
uuaucuauaauuuaccuaagau

SEQ ID NO: 1253934 - RNA, 14 nt, Human
uuaucuauaauuua

SEQ ID NO: 1253935 - RNA, 18 nt, Human
uuaucugccucucuugua

SEQ ID NO: 1253936 - RNA, 18 nt, Human
uuaucugcaagugaggug

SEQ ID NO: 1253937 - RNA, 12 nt, Human
uuaucugggcuu

SEQ ID NO: 1253938 - RNA, 21 nt, Human
uuaucugccucucuuguaauu

SEQ ID NO: 1253939 - RNA, 17 nt, Human
uuaucugaauuuuuaaa

SEQ ID NO: 1253940 - RNA, 18 nt, Human
uuaucugaauuuuuaaac

SEQ ID NO: 1253941 - RNA, 21 nt, Human
uuaucugaauuuuuaaacaag

SEQ ID NO: 1253942 - RNA, 18 nt, Human
uuaucugagucaacuccu

SEQ ID NO: 1253943 - RNA, 20 nt, Human
uuaucugaauuuuuaaacaa

SEQ ID NO: 1253944 - RNA, 14 nt, Human
uuaucugaucagaa

SEQ ID NO: 1253945 - RNA, 16 nt, Human
uuaucugucagcugca

SEQ ID NO: 1253946 - RNA, 20 nt, Human
uuaucuugaauaauguaaga

SEQ ID NO: 1253947 - RNA, 16 nt, Human
uuauuaaacaaauaau

SEQ ID NO: 1253948 - RNA, 14 nt, Human
uuauuaaaccccuu

SEQ ID NO: 1253949 - RNA, 12 nt, Human
uuauuaaagaaa

SEQ ID NO: 1253950 - RNA, 13 nt, Human
uuauuaaagaaaa

SEQ ID NO: 1253951 - RNA, 14 nt, Human
uuauuaaagaaaaa

SEQ ID NO: 1253952 - RNA, 20 nt, Human
uuauuaaagaaaaaaaugua

SEQ ID NO: 1253953 - RNA, 21 nt, Human
uuauuaaagaaaaaaauguau

SEQ ID NO: 1253954 - RNA, 22 nt, Human
uuauuaaagaaaaaaauguauu

SEQ ID NO: 1253955 - RNA, 23 nt, Human
uuauuaaagaaaaaaauguauuu

SEQ ID NO: 1253956 - RNA, 17 nt, Human
uuauuaaucuuagugua

SEQ ID NO: 1253957 - RNA, 11 nt, Human
uuauuaaugca

SEQ ID NO: 1253958 - RNA, 12 nt, Human
uuauuaauuuga

SEQ ID NO: 1253959 - RNA, 20 nt, Human
uuauuaauuuuaguuuuuca

SEQ ID NO: 1253960 - RNA, 13 nt, Human
uuauuaaugcacu

SEQ ID NO: 1253961 - RNA, 17 nt, Human
uuauuaaugcacuuucu

SEQ ID NO: 1253962 - RNA, 18 nt, Human
uuauuaaugcacuuucua

SEQ ID NO: 1253963 - RNA, 17 nt, Human
uuauuacuguaagaaaa

SEQ ID NO: 1253964 - RNA, 18 nt, Human
uuauuacuguaagaaaau

SEQ ID NO: 1253965 - RNA, 19 nt, Human
uuauucguagauauuggac

SEQ ID NO: 1253966 - RNA, 13 nt, Human
uuauucuucuaga

SEQ ID NO: 1253967 - RNA, 14 nt, Human
uuauucuucuagag

SEQ ID NO: 1253968 - RNA, 12 nt, Human
uuauucuugguu

SEQ ID NO: 1253969 - RNA, 14 nt, Human
uuauugacacagaa

SEQ ID NO: 1253970 - RNA, 19 nt, Human
uuauugacacagaaaaugu

SEQ ID NO: 1253971 - RNA, 23 nt, Human
uuauugacacagaaaauguugag

SEQ ID NO: 1253972 - RNA, 18 nt, Human
uuauugcaguuuaucauu

SEQ ID NO: 1253973 - RNA, 21 nt, Human
uuauugcaguuuaucauucaa

SEQ ID NO: 1253974 - RNA, 22 nt, Human
uuauugcaguuuaucauucaag

SEQ ID NO: 1253975 - RNA, 14 nt, Human
uuauugcaguuuau

SEQ ID NO: 1253976 - RNA, 16 nt, Human
uuauugcaguuuauca

SEQ ID NO: 1253977 - RNA, 20 nt, Human
uucagacaucugagguuuua

SEQ ID NO: 1253978 - RNA, 13 nt, Human
uucagagagcagu

SEQ ID NO: 1253979 - RNA, 18 nt, Human
uucagagagcagugcuuu

SEQ ID NO: 1253980 - RNA, 19 nt, Human
uucagagagcagugcuuuu

SEQ ID NO: 1253981 - RNA, 22 nt, Human
uucagagagcagugcuuuuggc

SEQ ID NO: 1253982 - RNA, 21 nt, Human
uucagagagcagugcuuuugg

SEQ ID NO: 1253983 - RNA, 15 nt, Human
uucagagaggccuuu

SEQ ID NO: 1253984 - RNA, 22 nt, Human
uucagagccuccuuucuggcuu

SEQ ID NO: 1253985 - RNA, 22 nt, Human
uucagaguucuuuuugaaguau

SEQ ID NO: 1253986 - RNA, 23 nt, Human
uucagaguucuuuuugaaguauu

SEQ ID NO: 1253987 - RNA, 22 nt, Human
uucagaguugaugguuguacau

SEQ ID NO: 1253988 - RNA, 21 nt, Human
uucagaguugaugguuguaca

SEQ ID NO: 1253989 - RNA, 20 nt, Human
uucagauaaucacaauacau

SEQ ID NO: 1253990 - RNA, 15 nt, Human
uucacuacucagcau

SEQ ID NO: 1253991 - RNA, 20 nt, Human
uucagacauagaauuaacac

SEQ ID NO: 1253992 - RNA, 16 nt, Human
uucagacauagaauua

SEQ ID NO: 1253993 - RNA, 14 nt, Human
uucacuacucagca

SEQ ID NO: 1253994 - RNA, 15 nt, Human
uucacaaacuuuuau

SEQ ID NO: 1253995 - RNA, 18 nt, Human
uucaccugccccaacucu

SEQ ID NO: 1253996 - RNA, 21 nt, Human
uucaccuggaagcauuuguuu

SEQ ID NO: 1253997 - RNA, 13 nt, Human
uucaccuguaaac

SEQ ID NO: 1253998 - RNA, 16 nt, Human
uucaccuguaaaccug

SEQ ID NO: 1253999 - RNA, 17 nt, Human
uucaccuguaaaccuga

SEQ ID NO: 1254000 - RNA, 18 nt, Human
uucaccuguaaaccugag

SEQ ID NO: 1254001 - RNA, 16 nt, Human
uucaauuugauguggu

SEQ ID NO: 1254002 - RNA, 22 nt, Human
uucaauuugauguggugaaaag

SEQ ID NO: 1254003 - RNA, 15 nt, Human
uucaauuugaugugg

SEQ ID NO: 1254004 - RNA, 15 nt, Human
uucaauuuauaccuc

SEQ ID NO: 1254005 - RNA, 16 nt, Human
uucaauuuauaccuca

SEQ ID NO: 1254006 - RNA, 19 nt, Human
uucaauugcaucucccaga

SEQ ID NO: 1254007 - RNA, 15 nt, Human
uucaauugcaucucc

SEQ ID NO: 1254008 - RNA, 17 nt, Human
uucaauugcaucuccca

SEQ ID NO: 1254009 - RNA, 23 nt, Human
uucaaaucaaucuguaaaacuaa

SEQ ID NO: 1254010 - RNA, 22 nt, Human
uucaaaucaaucuguaaaacua

SEQ ID NO: 1254011 - RNA, 18 nt, Human
uucaaauagggucuaacu

SEQ ID NO: 1254012 - RNA, 19 nt, Human
uucaaauagggucuaacuc

SEQ ID NO: 1254013 - RNA, 13 nt, Human
uucaaaguguuau

SEQ ID NO: 1254014 - RNA, 14 nt, Human
uucaaaguuuaaua

SEQ ID NO: 1254015 - RNA, 19 nt, Human
uucaaaguuuaauaaauuu

SEQ ID NO: 1254016 - RNA, 17 nt, Human
uucaaauccuugaagau

SEQ ID NO: 1254017 - RNA, 16 nt, Human
uucaacgcagcccugc

SEQ ID NO: 1254018 - RNA, 19 nt, Human
uucaacgcagcccugcuuu

SEQ ID NO: 1254019 - RNA, 20 nt, Human
uucaacgcagcccugcuuug

SEQ ID NO: 1254020 - RNA, 16 nt, Human
uucaacggaaagugcu

SEQ ID NO: 1254021 - RNA, 17 nt, Human
uucaacugaccagccuc

SEQ ID NO: 1254022 - RNA, 23 nt, Human
uucaaagccagcguccuccucug

SEQ ID NO: 1254023 - RNA, 20 nt, Human
uucaaagcuguguguuugga

SEQ ID NO: 1254024 - RNA, 23 nt, Human
uucaaagcuguguguuuggaaga

SEQ ID NO: 1254025 - RNA, 22 nt, Human
uucaaagcuuuuuccagaggcu

SEQ ID NO: 1254026 - RNA, 12 nt, Human
uucaaagguucu

SEQ ID NO: 1254027 - RNA, 16 nt, Human
uucaaagguucuaggu

SEQ ID NO: 1254028 - RNA, 21 nt, Human
uucaaagguucuagguuucaa

SEQ ID NO: 1254029 - RNA, 20 nt, Human
uuauuuuauguugcauagaa

SEQ ID NO: 1254030 - RNA, 17 nt, Human
uuauuuuaauaauguuu

SEQ ID NO: 1254031 - RNA, 22 nt, Human
uuauuggcugagauaugaacau

SEQ ID NO: 1254032 - RNA, 15 nt, Human
uuauugguuuugcag

SEQ ID NO: 1254033 - RNA, 18 nt, Human
uuauugguuuugcagaag

SEQ ID NO: 1254034 - RNA, 15 nt, Human
uuauuggcugagaua

SEQ ID NO: 1254035 - RNA, 16 nt, Human
uuauuggcugagauau

SEQ ID NO: 1254036 - RNA, 14 nt, Human
uuauuggcugagau

SEQ ID NO: 1254037 - RNA, 15 nt, Human
uuauuuuaauaaugu

SEQ ID NO: 1254038 - RNA, 16 nt, Human
uuauuuuaauaauguu

SEQ ID NO: 1254039 - RNA, 13 nt, Human
uuauuguauucug

SEQ ID NO: 1254040 - RNA, 14 nt, Human
uuauuguauucugg

SEQ ID NO: 1254041 - RNA, 12 nt, Human
uuauugucccaa

SEQ ID NO: 1254042 - RNA, 15 nt, Human
uuauugucuagugaa

SEQ ID NO: 1254043 - RNA, 12 nt, Human
uuauuguacuug

SEQ ID NO: 1254044 - RNA, 18 nt, Human
uuccagagcacugcucca

SEQ ID NO: 1254045 - RNA, 21 nt, Human
uuccagagaguggcuccuccc

SEQ ID NO: 1254046 - RNA, 17 nt, Human
uuccagagaguggcucc

SEQ ID NO: 1254047 - RNA, 18 nt, Human
uuccagagaguggcuccu

SEQ ID NO: 1254048 - RNA, 19 nt, Human
uuccagagaguggcuccuc

SEQ ID NO: 1254049 - RNA, 20 nt, Human
uuccagagaguggcuccucc

SEQ ID NO: 1254050 - RNA, 19 nt, Human
uuccacucguguguuucua

SEQ ID NO: 1254051 - RNA, 13 nt, Human
uuccacugagacc

SEQ ID NO: 1254052 - RNA, 21 nt, Human
uuccaaauguaauaaacuuua

SEQ ID NO: 1254053 - RNA, 14 nt, Human
uuccaaauucaguu

SEQ ID NO: 1254054 - RNA, 15 nt, Human
uuccaaauucaguuu

SEQ ID NO: 1254055 - RNA, 18 nt, Human
uuccaaauucaguuucau

SEQ ID NO: 1254056 - RNA, 19 nt, Human
uuccaaauucaguuucaua

SEQ ID NO: 1254057 - RNA, 20 nt, Human
uuccaaauucaguuucauaa

SEQ ID NO: 1254058 - RNA, 16 nt, Human
uucauuugcuuuggaa

SEQ ID NO: 1254059 - RNA, 16 nt, Human
uuccaaaaucucccau

SEQ ID NO: 1254060 - RNA, 19 nt, Human
uuccaaaaucucccauuuu

SEQ ID NO: 1254061 - RNA, 18 nt, Human
uuccaaaaucucccauuu

SEQ ID NO: 1254062 - RNA, 20 nt, Human
uuccaaacucuucccucucu

SEQ ID NO: 1254063 - RNA, 21 nt, Human
uuccaaagaguagaauugcau

SEQ ID NO: 1254064 - RNA, 14 nt, Human
uuccaaacuaauuu

SEQ ID NO: 1254065 - RNA, 15 nt, Human
uuccaaauacuaaug

SEQ ID NO: 1254066 - RNA, 15 nt, Human
uucaugaaagauuca

SEQ ID NO: 1254067 - RNA, 17 nt, Human
uucaugaaagauucaau

SEQ ID NO: 1254068 - RNA, 18 nt, Human
uucaugaaagauucaaug

SEQ ID NO: 1254069 - RNA, 15 nt, Human
uucaugauuuugaaa

SEQ ID NO: 1254070 - RNA, 13 nt, Human
uucaggaaaauug

SEQ ID NO: 1254071 - RNA, 16 nt, Human
uucaggaaaaggccug

SEQ ID NO: 1254072 - RNA, 17 nt, Human
uucaggaaaaggccugg

SEQ ID NO: 1254073 - RNA, 18 nt, Human
uucaggaaaaggccuggg

SEQ ID NO: 1254074 - RNA, 19 nt, Human
uucaggaaaaggccugggg

SEQ ID NO: 1254075 - RNA, 18 nt, Human
uucaggaaaauugaaugc

SEQ ID NO: 1254076 - RNA, 13 nt, Human
uucaugcauggaa

SEQ ID NO: 1254077 - RNA, 13 nt, Human
uucaugcagcugu

SEQ ID NO: 1254078 - RNA, 14 nt, Human
uucaugcagcugug

SEQ ID NO: 1254079 - RNA, 15 nt, Human
uucaugcagcugugg

SEQ ID NO: 1254080 - RNA, 17 nt, Human
uucaugcaaacuuuauu

SEQ ID NO: 1254081 - RNA, 17 nt, Human
uucaugauuuugaaauc

SEQ ID NO: 1254082 - RNA, 15 nt, Human
uucaugcaaacucuu

SEQ ID NO: 1254083 - RNA, 16 nt, Human
uucaugcaaacucuuu

SEQ ID NO: 1254084 - RNA, 20 nt, Human
uucaugcaaacucuuugguc

SEQ ID NO: 1254085 - RNA, 18 nt, Human
uucauuugagaaguaaac

SEQ ID NO: 1254086 - RNA, 12 nt, Human
uucauuugcuuu

SEQ ID NO: 1254087 - RNA, 15 nt, Human
uuccauucuggaagu

SEQ ID NO: 1254088 - RNA, 13 nt, Human
uuccauucuggaa

SEQ ID NO: 1254089 - RNA, 16 nt, Human
uuccauuggaucucau

SEQ ID NO: 1254090 - RNA, 17 nt, Human
uuccauuggaucucauu

SEQ ID NO: 1254091 - RNA, 16 nt, Human
uuccauugguccaaga

SEQ ID NO: 1254092 - RNA, 17 nt, Human
uuccauugguccaagau

SEQ ID NO: 1254093 - RNA, 19 nt, Human
uuccauugguccaagauuc

SEQ ID NO: 1254094 - RNA, 13 nt, Human
uucccauccccag

SEQ ID NO: 1254095 - RNA, 14 nt, Human
uucccauccccagc

SEQ ID NO: 1254096 - RNA, 17 nt, Human
uucccauccccagcgau

SEQ ID NO: 1254097 - RNA, 15 nt, Human
uucccauccccagcg

SEQ ID NO: 1254098 - RNA, 14 nt, Human
uucccaucgcuguc

SEQ ID NO: 1254099 - RNA, 20 nt, Human
uuccagcaauucuccugccu

SEQ ID NO: 1254100 - RNA, 21 nt, Human
uuccagcaauucuccugccuc

SEQ ID NO: 1254101 - RNA, 22 nt, Human
uuccagcaauucuccugccuca

SEQ ID NO: 1254102 - RNA, 23 nt, Human
uuccagcaauucuccugccucag

SEQ ID NO: 1254103 - RNA, 15 nt, Human
uuccaugugcccagu

SEQ ID NO: 1254104 - RNA, 17 nt, Human
uuccaugugcccaguua

SEQ ID NO: 1254105 - RNA, 16 nt, Human
uuccaugugcccaguu

SEQ ID NO: 1254106 - RNA, 13 nt, Human
uuccauuaaacga

SEQ ID NO: 1254107 - RNA, 23 nt, Human
uuccauuaaacgauuuuuaaaau

SEQ ID NO: 1254108 - RNA, 23 nt, Human
uuccauuacaaguauuuuuaauu

SEQ ID NO: 1254109 - RNA, 13 nt, Human
uuccauuacaagu

SEQ ID NO: 1254110 - RNA, 14 nt, Human
uucccauuucagcu

SEQ ID NO: 1254111 - RNA, 15 nt, Human
uucccauuucagcug

SEQ ID NO: 1254112 - RNA, 14 nt, Human
uucccauucuugca

SEQ ID NO: 1254113 - RNA, 14 nt, Human
uucccauggggagg

SEQ ID NO: 1254114 - RNA, 15 nt, Human
uucccauggggaggg

SEQ ID NO: 1254115 - RNA, 23 nt, Human
uucccauggggagggauucuggu

SEQ ID NO: 1254116 - RNA, 22 nt, Human
uucccaugauuucauguacugc

SEQ ID NO: 1254117 - RNA, 21 nt, Human
uucccaugauuucauguacug

SEQ ID NO: 1254118 - RNA, 20 nt, Human
uucccaugauuucauguacu

SEQ ID NO: 1254119 - RNA, 18 nt, Human
uucccaugauuucaugua

SEQ ID NO: 1254120 - RNA, 13 nt, Human
uucccaugauuuc

SEQ ID NO: 1254121 - RNA, 15 nt, Human
uucccaucgcuguca

SEQ ID NO: 1254122 - RNA, 15 nt, Human
uucccauuuaucuaa

SEQ ID NO: 1254123 - RNA, 20 nt, Human
uuccccaucguugcccccau

SEQ ID NO: 1254124 - RNA, 19 nt, Human
uuccccaucucaggccaga

SEQ ID NO: 1254125 - RNA, 11 nt, Human
uuccccauggg

SEQ ID NO: 1254126 - RNA, 17 nt, Human
uuccccaucuucuaaac

SEQ ID NO: 1254127 - RNA, 18 nt, Human
uuccccaucuucuaaacc

SEQ ID NO: 1254128 - RNA, 19 nt, Human
uuccccaugucucgacuca

SEQ ID NO: 1254129 - RNA, 19 nt, Human
uuccccauggcccugagcg

SEQ ID NO: 1254130 - RNA, 23 nt, Human
uuccccaugguuuuaaucuguau

SEQ ID NO: 1254131 - RNA, 23 nt, Human
uucccccaccaccaaaacugcuc

SEQ ID NO: 1254132 - RNA, 12 nt, Human
uucccccaccac

SEQ ID NO: 1254133 - RNA, 15 nt, Human
uucccccacugauca

SEQ ID NO: 1254134 - RNA, 13 nt, Human
uuccccccaaggg

SEQ ID NO: 1254135 - RNA, 22 nt, Human
uucccuggaaaccuuccaccca

SEQ ID NO: 1254136 - RNA, 23 nt, Human
uucccuggaaaccuuccacccag

SEQ ID NO: 1254137 - RNA, 20 nt, Human
uucccuggaaaccuuccacc

SEQ ID NO: 1254138 - RNA, 22 nt, Human
uucccugcugugaaagaaguaa

SEQ ID NO: 1254139 - RNA, 14 nt, Human
uucccugccucuca

SEQ ID NO: 1254140 - RNA, 23 nt, Human
uucccugccucucaucaacugaa

SEQ ID NO: 1254141 - RNA, 17 nt, Human
uucccuugaugaagaag

SEQ ID NO: 1254142 - RNA, 15 nt, Human
uucccuuccugccag

SEQ ID NO: 1254143 - RNA, 14 nt, Human
uucccuuccugcca

SEQ ID NO: 1254144 - RNA, 21 nt, Human
uucccucucucauacccuccc

SEQ ID NO: 1254145 - RNA, 13 nt, Human
uucccucucugga

SEQ ID NO: 1254146 - RNA, 17 nt, Human
uucccucucccaggccc

SEQ ID NO: 1254147 - RNA, 16 nt, Human
uucccucucccaggcc

SEQ ID NO: 1254148 - RNA, 14 nt, Human
uucccucucucacu

SEQ ID NO: 1254149 - RNA, 15 nt, Human
uucccucucuggaga

SEQ ID NO: 1254150 - RNA, 19 nt, Human
uucccccuccaaucccacc

SEQ ID NO: 1254151 - RNA, 13 nt, Human
uucccuccuuggu

SEQ ID NO: 1254152 - RNA, 12 nt, Human
uucccuccuugg

SEQ ID NO: 1254153 - RNA, 14 nt, Human
uucccucucccagg

SEQ ID NO: 1254154 - RNA, 15 nt, Human
uucccucucccaggc

SEQ ID NO: 1254155 - RNA, 13 nt, Human
uucccugacucau

SEQ ID NO: 1254156 - RNA, 16 nt, Human
uucccugacucauucu

SEQ ID NO: 1254157 - RNA, 13 nt, Human
uucccugaagcuc

SEQ ID NO: 1254158 - RNA, 14 nt, Human
uucccucuuuggcu

SEQ ID NO: 1254159 - RNA, 16 nt, Human
uucccucuuuggcucc

SEQ ID NO: 1254160 - RNA, 20 nt, Human
uucccucuuuggcuccccug

SEQ ID NO: 1254161 - RNA, 18 nt, Human
uucccuugaugaagaagu

SEQ ID NO: 1254162 - RNA, 18 nt, Human
uuccuaugauguauacug

SEQ ID NO: 1254163 - RNA, 14 nt, Human
uuccuaugcuuuga

SEQ ID NO: 1254164 - RNA, 21 nt, Human
uuccuaugauguauacugcca

SEQ ID NO: 1254165 - RNA, 14 nt, Human
uuccuaugauguau

SEQ ID NO: 1254166 - RNA, 22 nt, Human
uucccuuugugagucaauacau

SEQ ID NO: 1254167 - RNA, 12 nt, Human
uucccuuuguga

SEQ ID NO: 1254168 - RNA, 13 nt, Human
uuccuauacgcag

SEQ ID NO: 1254169 - RNA, 19 nt, Human
uuccuauacgcagcgugcu

SEQ ID NO: 1254170 - RNA, 21 nt, Human
uuccucacaccaggcuugccu

SEQ ID NO: 1254171 - RNA, 14 nt, Human
uuccucagacucua

SEQ ID NO: 1254172 - RNA, 18 nt, Human
uuccucagacucuaagaa

SEQ ID NO: 1254173 - RNA, 14 nt, Human
uuccucagccagcc

SEQ ID NO: 1254174 - RNA, 11 nt, Human
uuccucagcca

SEQ ID NO: 1254175 - RNA, 16 nt, Human
uuccuaugcuuugaaa

SEQ ID NO: 1254176 - RNA, 16 nt, Human
uuccugcauuugugaa

SEQ ID NO: 1254177 - RNA, 18 nt, Human
uuccugcauuugugaaau

SEQ ID NO: 1254178 - RNA, 15 nt, Human
uuccugccagccccu

SEQ ID NO: 1254179 - RNA, 18 nt, Human
uuccucccauucaagauu

SEQ ID NO: 1254180 - RNA, 22 nt, Human
uuccuggagcagaagcagcaac

SEQ ID NO: 1254181 - RNA, 20 nt, Human
uuccugccagccccugccau

SEQ ID NO: 1254182 - RNA, 23 nt, Human
uuccugccccaacuccuuccagc

SEQ ID NO: 1254183 - RNA, 13 nt, Human
uuccugccccagg

SEQ ID NO: 1254184 - RNA, 16 nt, Human
uuccugccccaggccu

SEQ ID NO: 1254185 - RNA, 15 nt, Human
uuccuggacagcugu

SEQ ID NO: 1254186 - RNA, 17 nt, Human
uuccuggacagcugugc

SEQ ID NO: 1254187 - RNA, 19 nt, Human
uuccuggacagcugugccu

SEQ ID NO: 1254188 - RNA, 20 nt, Human
uuccuggacagcugugccuc

SEQ ID NO: 1254189 - RNA, 21 nt, Human
uuccuggacagcugugccucg

SEQ ID NO: 1254190 - RNA, 24 nt, Human
uuccuggacagcugugccucgcuc

SEQ ID NO: 1254191 - RNA, 12 nt, Human
uucuaaagauuc

SEQ ID NO: 1254192 - RNA, 13 nt, Human
uucuaaagauucu

SEQ ID NO: 1254193 - RNA, 14 nt, Human
uucuaaagauucua

SEQ ID NO: 1254194 - RNA, 16 nt, Human
uucuaaagauucuaua

SEQ ID NO: 1254195 - RNA, 22 nt, Human
uucuaaagauucuauaguucua

SEQ ID NO: 1254196 - RNA, 23 nt, Human
uucuaaagauucuauaguucuag

SEQ ID NO: 1254197 - RNA, 16 nt, Human
uucguuuaaugaaugc

SEQ ID NO: 1254198 - RNA, 15 nt, Human
uucguuuauuuucaa

SEQ ID NO: 1254199 - RNA, 14 nt, Human
uucgggcugugccc

SEQ ID NO: 1254200 - RNA, 12 nt, Human
uucguucugugg

SEQ ID NO: 1254201 - RNA, 18 nt, Human
uucuaaaaauugugauca

SEQ ID NO: 1254202 - RNA, 18 nt, Human
uucgggccaaggaccuga

SEQ ID NO: 1254203 - RNA, 20 nt, Human
uucgggccaaggaccugaga

SEQ ID NO: 1254204 - RNA, 12 nt, Human
uucgggcugugc

SEQ ID NO: 1254205 - RNA, 13 nt, Human
uucgggcugugcc

SEQ ID NO: 1254206 - RNA, 17 nt, Human
uuugugggggacuguaa

SEQ ID NO: 1254207 - RNA, 18 nt, Human
uuugugggggacuguaag

SEQ ID NO: 1254208 - RNA, 20 nt, Human
uuuguggguuuuuauuuccu

SEQ ID NO: 1254209 - RNA, 20 nt, Human
uuugugggggacuguaaguu

SEQ ID NO: 1254210 - RNA, 22 nt, Human
uggggccaggcugggucgcccu

SEQ ID NO: 1254211 - RNA, 21 nt, Human
uggggccaggcugggucgccc

SEQ ID NO: 1254212 - RNA, 22 nt, Human
uggggaugguaguuuuuucauc

SEQ ID NO: 1254213 - RNA, 15 nt, Human
uggggccaggucacc

SEQ ID NO: 1254214 - RNA, 18 nt, Human
uggggauaggccagccgc

SEQ ID NO: 1254215 - RNA, 17 nt, Human
uggggauaggccagccg

SEQ ID NO: 1254216 - RNA, 20 nt, Human
uggggaucccucccccccau

SEQ ID NO: 1254217 - RNA, 20 nt, Human
uggggaguuuaggguggggg

SEQ ID NO: 1254218 - RNA, 21 nt, Human
ugggcuugcuauucugucccu

SEQ ID NO: 1254219 - RNA, 13 nt, Human
ugggcuugauucu

SEQ ID NO: 1254220 - RNA, 14 nt, Human
ugggcuugauucug

SEQ ID NO: 1254221 - RNA, 14 nt, Human
ugggcuugcuauuc

SEQ ID NO: 1254222 - RNA, 17 nt, Human
ugggcuugcuauucugu

SEQ ID NO: 1254223 - RNA, 15 nt, Human
ugggccuucagggag

SEQ ID NO: 1254224 - RNA, 12 nt, Human
ugggccuucagg

SEQ ID NO: 1254225 - RNA, 15 nt, Human
ugggccuuaggaaga

SEQ ID NO: 1254226 - RNA, 13 nt, Human
ugggcuucaucug

SEQ ID NO: 1254227 - RNA, 14 nt, Human
ugggcuucccaagg

SEQ ID NO: 1254228 - RNA, 13 nt, Human
ugggcuucccaag

SEQ ID NO: 1254229 - RNA, 13 nt, Human
ugggcuuccugga

SEQ ID NO: 1254230 - RNA, 14 nt, Human
ugggcuuccuggag

SEQ ID NO: 1254231 - RNA, 15 nt, Human
ugggcuuccuggagc

SEQ ID NO: 1254232 - RNA, 16 nt, Human
ugggcuuccuggagca

SEQ ID NO: 1254233 - RNA, 17 nt, Human
ugggcuuccuggagcag

SEQ ID NO: 1254234 - RNA, 20 nt, Human
ugggcuuccuggagcagaag

SEQ ID NO: 1254235 - RNA, 16 nt, Human
uggguacuucuugaag

SEQ ID NO: 1254236 - RNA, 19 nt, Human
uggguacuucuugaaggug

SEQ ID NO: 1254237 - RNA, 20 nt, Human
uggguauaguucaugucugc

SEQ ID NO: 1254238 - RNA, 15 nt, Human
uggggguucuuucuu

SEQ ID NO: 1254239 - RNA, 19 nt, Human
uggggguucuuucuuccuc

SEQ ID NO: 1254240 - RNA, 10 nt, Human
uggggguggg

SEQ ID NO: 1254241 - RNA, 16 nt, Human
uggggguggggguagg

SEQ ID NO: 1254242 - RNA, 20 nt, Human
uggggguucuuucuuccucu

SEQ ID NO: 1254243 - RNA, 22 nt, Human
uggggguucuuucuuccucugc

SEQ ID NO: 1254244 - RNA, 16 nt, Human
uggggguucaggcccg

SEQ ID NO: 1254245 - RNA, 18 nt, Human
uggguaaugaaacaaaga

SEQ ID NO: 1254246 - RNA, 15 nt, Human
uggguacccccagga

SEQ ID NO: 1254247 - RNA, 21 nt, Human
ugggggaguagaucuuucuag

SEQ ID NO: 1254248 - RNA, 16 nt, Human
ugggggacuguaaguu

SEQ ID NO: 1254249 - RNA, 14 nt, Human
ugggggacuuacau

SEQ ID NO: 1254250 - RNA, 21 nt, Human
ugggggacuuacaugauucau

SEQ ID NO: 1254251 - RNA, 19 nt, Human
uggggguagggggcuggag

SEQ ID NO: 1254252 - RNA, 21 nt, Human
uggggguccuccuccagggac

SEQ ID NO: 1254253 - RNA, 21 nt, Human
uggggguagggggcuggagga

SEQ ID NO: 1254254 - RNA, 13 nt, Human
uggggggguggcc

SEQ ID NO: 1254255 - RNA, 14 nt, Human
uggggggguggccg

SEQ ID NO: 1254256 - RNA, 23 nt, Human
uggggggguggccgcugaguggc

SEQ ID NO: 1254257 - RNA, 18 nt, Human
uggggggugaugagggca

SEQ ID NO: 1254258 - RNA, 19 nt, Human
uggggggugaugagggcag

SEQ ID NO: 1254259 - RNA, 20 nt, Human
uggggggugaugagggcagc

SEQ ID NO: 1254260 - RNA, 16 nt, Human
ugggggguggccaggc

SEQ ID NO: 1254261 - RNA, 24 nt, Human
uggggggugaugagggcagcagcc

SEQ ID NO: 1254262 - RNA, 23 nt, Human
ugggccccugccucucugcaggu

SEQ ID NO: 1254263 - RNA, 21 nt, Human
ugggccccugccucucugcag

SEQ ID NO: 1254264 - RNA, 13 nt, Human
ugggcccucucug

SEQ ID NO: 1254265 - RNA, 16 nt, Human
ugggcccucucugcuc

SEQ ID NO: 1254266 - RNA, 18 nt, Human
ugggcccucucugcucug

SEQ ID NO: 1254267 - RNA, 11 nt, Human
ugggccuucag

SEQ ID NO: 1254268 - RNA, 20 nt, Human
ugggccugggcuccuggacc

SEQ ID NO: 1254269 - RNA, 21 nt, Human
ugggccuggucucacccugga

SEQ ID NO: 1254270 - RNA, 22 nt, Human
ugggccuggucucacccuggag

SEQ ID NO: 1254271 - RNA, 23 nt, Human
ugggccugguuaaauaaggcagg

SEQ ID NO: 1254272 - RNA, 13 nt, Human
ugggccugggcuc

SEQ ID NO: 1254273 - RNA, 15 nt, Human
ugggccugggcuccu

SEQ ID NO: 1254274 - RNA, 16 nt, Human
ugggccugggcuccug

SEQ ID NO: 1254275 - RNA, 17 nt, Human
ugggccugggcuccugg

SEQ ID NO: 1254276 - RNA, 18 nt, Human
ugggccugggcuccugga

SEQ ID NO: 1254277 - RNA, 19 nt, Human
ugggccugggcuccuggac

SEQ ID NO: 1254278 - RNA, 13 nt, Human
ugggcagagccca

SEQ ID NO: 1254279 - RNA, 14 nt, Human
ugggcagagcccaa

SEQ ID NO: 1254280 - RNA, 12 nt, Human
ugggcagagcug

SEQ ID NO: 1254281 - RNA, 16 nt, Human
ugggcagagcuggcuc

SEQ ID NO: 1254282 - RNA, 13 nt, Human
ugggcaggaggga

SEQ ID NO: 1254283 - RNA, 14 nt, Human
ugggcagagcuggc

SEQ ID NO: 1254284 - RNA, 15 nt, Human
ugggcaggagggagg

SEQ ID NO: 1254285 - RNA, 16 nt, Human
ugggcaggagggaggu

SEQ ID NO: 1254286 - RNA, 18 nt, Human
ugggcaggagggaggugc

SEQ ID NO: 1254287 - RNA, 13 nt, Human
ugggcagggagcg

SEQ ID NO: 1254288 - RNA, 17 nt, Human
ugggauuacaggcguga

SEQ ID NO: 1254289 - RNA, 18 nt, Human
ugggauuacaggcuccug

SEQ ID NO: 1254290 - RNA, 16 nt, Human
ugggauguucagcacu

SEQ ID NO: 1254291 - RNA, 20 nt, Human
ugggauguucagcacugucc

SEQ ID NO: 1254292 - RNA, 21 nt, Human
ugggauguucagcacuguccc

SEQ ID NO: 1254293 - RNA, 22 nt, Human
ugggauguucagcacugucccu

SEQ ID NO: 1254294 - RNA, 20 nt, Human
ugggaucagggguaggaaug

SEQ ID NO: 1254295 - RNA, 14 nt, Human
uggcugcuguggga

SEQ ID NO: 1254296 - RNA, 16 nt, Human
uggcugcugugggaaa

SEQ ID NO: 1254297 - RNA, 19 nt, Human
ugggaucagggguaggaau

SEQ ID NO: 1254298 - RNA, 18 nt, Human
ugguccccuccuucccaa

SEQ ID NO: 1254299 - RNA, 22 nt, Human
ugguccccuccuucccaaguga

SEQ ID NO: 1254300 - RNA, 12 nt, Human
uggucccugggu

SEQ ID NO: 1254301 - RNA, 22 nt, Human
uggucccuguuuucccacgagg

SEQ ID NO: 1254302 - RNA, 23 nt, Human
uggucccuuguauccccugcagg

SEQ ID NO: 1254303 - RNA, 22 nt, Human
uggucccuuguauccccugcag

SEQ ID NO: 1254304 - RNA, 16 nt, Human
ugguccuauggccuca

SEQ ID NO: 1254305 - RNA, 19 nt, Human
ugguccuauggccucaugu

SEQ ID NO: 1254306 - RNA, 20 nt, Human
ugguccgugggacggugccc

SEQ ID NO: 1254307 - RNA, 13 nt, Human
ugguauguuuuca

SEQ ID NO: 1254308 - RNA, 21 nt, Human
ugguauguuuucaggcuagau

SEQ ID NO: 1254309 - RNA, 13 nt, Human
ugguauuuucaau

SEQ ID NO: 1254310 - RNA, 17 nt, Human
ugguauuuucaauagcc

SEQ ID NO: 1254311 - RNA, 20 nt, Human
ugguauuuucaauagccacu

SEQ ID NO: 1254312 - RNA, 22 nt, Human
ugguauuuucaauagccacuaa

SEQ ID NO: 1254313 - RNA, 22 nt, Human
uggguaucaccacuggagauca

SEQ ID NO: 1254314 - RNA, 13 nt, Human
ugggucacaggaa

SEQ ID NO: 1254315 - RNA, 21 nt, Human
uggguaucaccacuggagauc

SEQ ID NO: 1254316 - RNA, 12 nt, Human
ugggucacagga

SEQ ID NO: 1254317 - RNA, 18 nt, Human
uggucaacuugagcaugu

SEQ ID NO: 1254318 - RNA, 20 nt, Human
uggucacaggacucugccuc

SEQ ID NO: 1254319 - RNA, 19 nt, Human
uggucacaggacucugccu

SEQ ID NO: 1254320 - RNA, 22 nt, Human
uggucacaggaaguagaggagg

SEQ ID NO: 1254321 - RNA, 18 nt, Human
uggucacaggacucugcc

SEQ ID NO: 1254322 - RNA, 22 nt, Human
uggugacaucagguuuuucccg

SEQ ID NO: 1254323 - RNA, 17 nt, Human
uggugagggaagacgcc

SEQ ID NO: 1254324 - RNA, 22 nt, Human
uggugcaauguguguauaugga

SEQ ID NO: 1254325 - RNA, 23 nt, Human
uggugcacagcacaaauuaguua

SEQ ID NO: 1254326 - RNA, 15 nt, Human
uggugccaauuucaa

SEQ ID NO: 1254327 - RNA, 17 nt, Human
uggucgaggaguaacaa

SEQ ID NO: 1254328 - RNA, 13 nt, Human
uggucgcuccugc

SEQ ID NO: 1254329 - RNA, 15 nt, Human
uggucgcuccugccc

SEQ ID NO: 1254330 - RNA, 13 nt, Human
uggucguuuuuuu

SEQ ID NO: 1254331 - RNA, 12 nt, Human
uggucuaaaacu

SEQ ID NO: 1254332 - RNA, 22 nt, Human
uggucguuuuuuuuuuguuugu

SEQ ID NO: 1254333 - RNA, 18 nt, Human
uggucuaagguucagccu

SEQ ID NO: 1254334 - RNA, 18 nt, Human
uggucuaaguccagucca

SEQ ID NO: 1254335 - RNA, 12 nt, Human
ugguccuuuggg

SEQ ID NO: 1254336 - RNA, 15 nt, Human
ugguccuuucuuccg

SEQ ID NO: 1254337 - RNA, 23 nt, Human
uggucgagaaagaggcaccagga

SEQ ID NO: 1254338 - RNA, 16 nt, Human
uggucgaggaguaaca

SEQ ID NO: 1254339 - RNA, 20 nt, Human
uggucgaggaguaacaauac

SEQ ID NO: 1254340 - RNA, 18 nt, Human
uggugacaucagguuuuu

SEQ ID NO: 1254341 - RNA, 18 nt, Human
uggacauccuccucccac

SEQ ID NO: 1254342 - RNA, 20 nt, Human
uggaccaauagggcugagcu

SEQ ID NO: 1254343 - RNA, 21 nt, Human
uggaccaauagggcugagcuc

SEQ ID NO: 1254344 - RNA, 23 nt, Human
uggacaguuuaccaguugccuuu

SEQ ID NO: 1254345 - RNA, 14 nt, Human
uggacauccuccuc

SEQ ID NO: 1254346 - RNA, 16 nt, Human
uggacacucagaccug

SEQ ID NO: 1254347 - RNA, 23 nt, Human
uggacacuuaauacuaccuugaa

SEQ ID NO: 1254348 - RNA, 14 nt, Human
uggacaggcuggcu

SEQ ID NO: 1254349 - RNA, 20 nt, Human
uggacacuacacccagcaau

SEQ ID NO: 1254350 - RNA, 15 nt, Human
uggacacucagaccu

SEQ ID NO: 1254351 - RNA, 19 nt, Human
uggacacuacacccagcaa

SEQ ID NO: 1254352 - RNA, 18 nt, Human
uggacacuacacccagca

SEQ ID NO: 1254353 - RNA, 17 nt, Human
uggacacuacacccagc

SEQ ID NO: 1254354 - RNA, 16 nt, Human
uggacacuacacccag

SEQ ID NO: 1254355 - RNA, 18 nt, Human
uggacaccuuuagguucu

SEQ ID NO: 1254356 - RNA, 15 nt, Human
uggacacgcucagug

SEQ ID NO: 1254357 - RNA, 22 nt, Human
uggacacgcucaguggggcaga

SEQ ID NO: 1254358 - RNA, 14 nt, Human
ugcuguuuauuaau

SEQ ID NO: 1254359 - RNA, 17 nt, Human
ugcuguuuauuaaucuu

SEQ ID NO: 1254360 - RNA, 23 nt, Human
ugcuguuuauuaaucuuagugua

SEQ ID NO: 1254361 - RNA, 16 nt, Human
ugcuguuucaaaguuc

SEQ ID NO: 1254362 - RNA, 17 nt, Human
ugcuguuugacaccucu

SEQ ID NO: 1254363 - RNA, 23 nt, Human
ugcuguuguuaugaugugcuuaa

SEQ ID NO: 1254364 - RNA, 22 nt, Human
ugcuguuguuaugaugugcuua

SEQ ID NO: 1254365 - RNA, 20 nt, Human
ugcuguuguuaugaugugcu

SEQ ID NO: 1254366 - RNA, 19 nt, Human
ugcuguuguuaugaugugc

SEQ ID NO: 1254367 - RNA, 18 nt, Human
ugcuguuguuaugaugug

SEQ ID NO: 1254368 - RNA, 17 nt, Human
ugcuguuguuaugaugu

SEQ ID NO: 1254369 - RNA, 16 nt, Human
ugcuguuguuaugaug

SEQ ID NO: 1254370 - RNA, 15 nt, Human
ugcuguuguuaugau

SEQ ID NO: 1254371 - RNA, 14 nt, Human
ugcuguuccagugg

SEQ ID NO: 1254372 - RNA, 14 nt, Human
uggagaaggaaggc

SEQ ID NO: 1254373 - RNA, 15 nt, Human
uggagaagucucagc

SEQ ID NO: 1254374 - RNA, 16 nt, Human
uggagaagucucagcu

SEQ ID NO: 1254375 - RNA, 17 nt, Human
uggagaagucucagcua

SEQ ID NO: 1254376 - RNA, 23 nt, Human
uggagaagucucagcuaagcuca

SEQ ID NO: 1254377 - RNA, 13 nt, Human
uggagaaggaagg

SEQ ID NO: 1254378 - RNA, 12 nt, Human
uggagaaggaag

SEQ ID NO: 1254379 - RNA, 11 nt, Human
uggagaaggaa

SEQ ID NO: 1254380 - RNA, 21 nt, Human
uggagaagcucccugaaguaa

SEQ ID NO: 1254381 - RNA, 14 nt, Human
uggacuggaagggg

SEQ ID NO: 1254382 - RNA, 17 nt, Human
uggacugagugggaagc

SEQ ID NO: 1254383 - RNA, 19 nt, Human
uggacugagugggaagccc

SEQ ID NO: 1254384 - RNA, 15 nt, Human
uggaccagccucucc

SEQ ID NO: 1254385 - RNA, 15 nt, Human
uggaccacugggcaa

SEQ ID NO: 1254386 - RNA, 19 nt, Human
uggaccacugggcaaugau

SEQ ID NO: 1254387 - RNA, 14 nt, Human
uggacucagggcag

SEQ ID NO: 1254388 - RNA, 15 nt, Human
uggacucagggcagc

SEQ ID NO: 1254389 - RNA, 18 nt, Human
uggacucagggcagcgcc

SEQ ID NO: 1254390 - RNA, 20 nt, Human
uggacucagggcagcgccag

SEQ ID NO: 1254391 - RNA, 13 nt, Human
uggacuccucugu

SEQ ID NO: 1254392 - RNA, 14 nt, Human
uggacuccucuguc

SEQ ID NO: 1254393 - RNA, 15 nt, Human
uggauaacuuccaca

SEQ ID NO: 1254394 - RNA, 16 nt, Human
uggauaacuuccacag

SEQ ID NO: 1254395 - RNA, 21 nt, Human
uggaucucuucuuaauguaca

SEQ ID NO: 1254396 - RNA, 20 nt, Human
uggaucucuucuuaauguac

SEQ ID NO: 1254397 - RNA, 19 nt, Human
uggaucucuucuuaaugua

SEQ ID NO: 1254398 - RNA, 22 nt, Human
uggaucucccugagaugggcuu

SEQ ID NO: 1254399 - RNA, 21 nt, Human
uggauaacuuccacagggucc

SEQ ID NO: 1254400 - RNA, 22 nt, Human
uggaucucuucuuaauguacau

SEQ ID NO: 1254401 - RNA, 23 nt, Human
uggaucucuucuuaauguacaua

SEQ ID NO: 1254402 - RNA, 16 nt, Human
uggaguugguggugcu

SEQ ID NO: 1254403 - RNA, 17 nt, Human
uggaguugguggugcug

SEQ ID NO: 1254404 - RNA, 21 nt, Human
uggaguuucauguacaagaug

SEQ ID NO: 1254405 - RNA, 13 nt, Human
uggaguuucuaag

SEQ ID NO: 1254406 - RNA, 14 nt, Human
uggaguuucuaagg

SEQ ID NO: 1254407 - RNA, 16 nt, Human
uggaguuucuaagguc

SEQ ID NO: 1254408 - RNA, 17 nt, Human
uggaguuucuaaggucc

SEQ ID NO: 1254409 - RNA, 20 nt, Human
uggaguuuuguuuccucugu

SEQ ID NO: 1254410 - RNA, 16 nt, Human
uggaguuuuguuuccu

SEQ ID NO: 1254411 - RNA, 17 nt, Human
uggaguuuuuuguacca

SEQ ID NO: 1254412 - RNA, 18 nt, Human
uggaguuuuuuguaccaa

SEQ ID NO: 1254413 - RNA, 14 nt, Human
uggagacugucuca

SEQ ID NO: 1254414 - RNA, 17 nt, Human
uggagacugucucaaga

SEQ ID NO: 1254415 - RNA, 13 nt, Human
uggaggaccugag

SEQ ID NO: 1254416 - RNA, 15 nt, Human
uggaggaccugagcc

SEQ ID NO: 1254417 - RNA, 14 nt, Human
uggaggaccugagc

SEQ ID NO: 1254418 - RNA, 20 nt, Human
uggcaauagucaaauugugu

SEQ ID NO: 1254419 - RNA, 17 nt, Human
uggcaaggguucaccug

SEQ ID NO: 1254420 - RNA, 14 nt, Human
uggcaagugaauuu

SEQ ID NO: 1254421 - RNA, 15 nt, Human
uggcacuaguauuuc

SEQ ID NO: 1254422 - RNA, 22 nt, Human
uggcacuaacguugagccccug

SEQ ID NO: 1254423 - RNA, 23 nt, Human
uggauuuuuuccuucaaaguuua

SEQ ID NO: 1254424 - RNA, 20 nt, Human
uggcaaaacucuacuuaauc

SEQ ID NO: 1254425 - RNA, 23 nt, Human
uggcaaagcagcaacuauucaca

SEQ ID NO: 1254426 - RNA, 17 nt, Human
uggcaaaggaaggugga

SEQ ID NO: 1254427 - RNA, 15 nt, Human
uggcgggguggggug

SEQ ID NO: 1254428 - RNA, 17 nt, Human
uggcggggaggaggaaa

SEQ ID NO: 1254429 - RNA, 19 nt, Human
uggcggggaggaggaaauc

SEQ ID NO: 1254430 - RNA, 18 nt, Human
uggcggggggcccauugg

SEQ ID NO: 1254431 - RNA, 15 nt, Human
uggcguaaguacaga

SEQ ID NO: 1254432 - RNA, 16 nt, Human
uggcguaaguacagag

SEQ ID NO: 1254433 - RNA, 21 nt, Human
uggcggcuggggucccagcag

SEQ ID NO: 1254434 - RNA, 20 nt, Human
uggcggcuggggucccagca

SEQ ID NO: 1254435 - RNA, 14 nt, Human
uggcucccacaggc

SEQ ID NO: 1254436 - RNA, 17 nt, Human
uggcucccacaggcccu

SEQ ID NO: 1254437 - RNA, 20 nt, Human
uggcucccacaggcccuucc

SEQ ID NO: 1254438 - RNA, 17 nt, Human
uggcguaaguacagaga

SEQ ID NO: 1254439 - RNA, 18 nt, Human
uggcguaaguacagagaa

SEQ ID NO: 1254440 - RNA, 19 nt, Human
uggcguaaguacagagaag

SEQ ID NO: 1254441 - RNA, 20 nt, Human
uggcguaaguacagagaagc

SEQ ID NO: 1254442 - RNA, 21 nt, Human
uggcguaaguacagagaagcc

SEQ ID NO: 1254443 - RNA, 22 nt, Human
uggcguaaguacagagaagcca

SEQ ID NO: 1254444 - RNA, 23 nt, Human
uggcguaaguacagagaagccau

SEQ ID NO: 1254445 - RNA, 16 nt, Human
uggcguaggcuacaga

SEQ ID NO: 1254446 - RNA, 17 nt, Human
uggcguaggcuacagag

SEQ ID NO: 1254447 - RNA, 18 nt, Human
uggcguaggcuacagaga

SEQ ID NO: 1254448 - RNA, 20 nt, Human
uggcugcugaucgccuuccc

SEQ ID NO: 1254449 - RNA, 14 nt, Human
uggcuccucccggu

SEQ ID NO: 1254450 - RNA, 16 nt, Human
uggcuccucccggugc

SEQ ID NO: 1254451 - RNA, 14 nt, Human
uggcucccaggggc

SEQ ID NO: 1254452 - RNA, 19 nt, Human
uggcucccaggggcucccu

SEQ ID NO: 1254453 - RNA, 21 nt, Human
uggcucccaggggcucccucc

SEQ ID NO: 1254454 - RNA, 18 nt, Human
uggcuccucccggugccc

SEQ ID NO: 1254455 - RNA, 19 nt, Human
uggcuccucccggugccca

SEQ ID NO: 1254456 - RNA, 19 nt, Human
uggccuccccugccaccag

SEQ ID NO: 1254457 - RNA, 20 nt, Human
uggccuccccugccaccagg

SEQ ID NO: 1254458 - RNA, 21 nt, Human
uggccuccccugccaccaggc

SEQ ID NO: 1254459 - RNA, 23 nt, Human
uggccuccccugccaccaggcca

SEQ ID NO: 1254460 - RNA, 13 nt, Human
uggcgaugccagc

SEQ ID NO: 1254461 - RNA, 14 nt, Human
uggcgaugccagcc

SEQ ID NO: 1254462 - RNA, 19 nt, Human
uggcgaugccagccaagcu

SEQ ID NO: 1254463 - RNA, 16 nt, Human
uggcgaugccagccaa

SEQ ID NO: 1254464 - RNA, 19 nt, Human
uggccucagcucccacaag

SEQ ID NO: 1254465 - RNA, 13 nt, Human
uggccucaugugg

SEQ ID NO: 1254466 - RNA, 15 nt, Human
uggccucauguggcu

SEQ ID NO: 1254467 - RNA, 17 nt, Human
uggccucauguggcugg

SEQ ID NO: 1254468 - RNA, 18 nt, Human
uggccucauguggcugga

SEQ ID NO: 1254469 - RNA, 19 nt, Human
uggccucauguggcuggaa

SEQ ID NO: 1254470 - RNA, 20 nt, Human
uggccucauguggcuggaag

SEQ ID NO: 1254471 - RNA, 21 nt, Human
uggccucauguggcuggaaga

SEQ ID NO: 1254472 - RNA, 15 nt, Human
uggccucccccacuu

SEQ ID NO: 1254473 - RNA, 14 nt, Human
uggccuccccugcc

SEQ ID NO: 1254474 - RNA, 15 nt, Human
uggccuccccugcca

SEQ ID NO: 1254475 - RNA, 17 nt, Human
uggccuccccugccacc

SEQ ID NO: 1254476 - RNA, 12 nt, Human
uggcagaggagg

SEQ ID NO: 1254477 - RNA, 12 nt, Human
uggcagaguuac

SEQ ID NO: 1254478 - RNA, 17 nt, Human
uggcagaguuacaguuc

SEQ ID NO: 1254479 - RNA, 13 nt, Human
uggcagagaugcc

SEQ ID NO: 1254480 - RNA, 17 nt, Human
uggcagagaugccuccc

SEQ ID NO: 1254481 - RNA, 19 nt, Human
uggcagagaugccucccug

SEQ ID NO: 1254482 - RNA, 18 nt, Human
uggcagagaugccucccu

SEQ ID NO: 1254483 - RNA, 19 nt, Human
uggcagaguuacaguucug

SEQ ID NO: 1254484 - RNA, 20 nt, Human
uggcagaguuacaguucugu

SEQ ID NO: 1254485 - RNA, 12 nt, Human
uggccagccccu

SEQ ID NO: 1254486 - RNA, 16 nt, Human
uggccagccccuuaga

SEQ ID NO: 1254487 - RNA, 20 nt, Human
uggccagccccuuagacaga

SEQ ID NO: 1254488 - RNA, 21 nt, Human
uggccagccccuuagacagag

SEQ ID NO: 1254489 - RNA, 22 nt, Human
uggccagccccuuagacagagg

SEQ ID NO: 1254490 - RNA, 16 nt, Human
uggccaggcugcucuu

SEQ ID NO: 1254491 - RNA, 17 nt, Human
uggccaggcugcucuug

SEQ ID NO: 1254492 - RNA, 23 nt, Human
uggccagcgagcgcccagcuccu

SEQ ID NO: 1254493 - RNA, 21 nt, Human
uggccagcuggaggcaggggc

SEQ ID NO: 1254494 - RNA, 21 nt, Human
uggccaggaagcuuuggugag

SEQ ID NO: 1254495 - RNA, 13 nt, Human
uggccaggaagcu

SEQ ID NO: 1254496 - RNA, 17 nt, Human
uggcccagggcccagag

SEQ ID NO: 1254497 - RNA, 20 nt, Human
uggccaggcugcucuugaac

SEQ ID NO: 1254498 - RNA, 18 nt, Human
uggcccagggcccagagc

SEQ ID NO: 1254499 - RNA, 20 nt, Human
uggcccagggcccagagccc

SEQ ID NO: 1254500 - RNA, 21 nt, Human
uggcccagggcccagagccca

SEQ ID NO: 1254501 - RNA, 22 nt, Human
uggcccagggcccagagcccag

SEQ ID NO: 1254502 - RNA, 23 nt, Human
uggcccagggcccagagcccagc

SEQ ID NO: 1254503 - RNA, 12 nt, Human
uggcccaucagg

SEQ ID NO: 1254504 - RNA, 22 nt, Human
uggcccaucaggguaggcugga

SEQ ID NO: 1254505 - RNA, 21 nt, Human
uggccccccugguccccuccu

SEQ ID NO: 1254506 - RNA, 15 nt, Human
uggccccccuggucc

SEQ ID NO: 1254507 - RNA, 11 nt, Human
uggcccccucc

SEQ ID NO: 1254508 - RNA, 15 nt, Human
uggccccguuucugg

SEQ ID NO: 1254509 - RNA, 16 nt, Human
uggccccguuucuggu

SEQ ID NO: 1254510 - RNA, 21 nt, Human
uggccccucaaaucguccagc

SEQ ID NO: 1254511 - RNA, 19 nt, Human
uggccuauguggucuaagg

SEQ ID NO: 1254512 - RNA, 16 nt, Human
uggccuauguggucua

SEQ ID NO: 1254513 - RNA, 15 nt, Human
uggccucaaagcaag

SEQ ID NO: 1254514 - RNA, 13 nt, Human
ugcgcucagggcc

SEQ ID NO: 1254515 - RNA, 14 nt, Human
ugcgcucagggcca

SEQ ID NO: 1254516 - RNA, 15 nt, Human
ugcgcucagggccau

SEQ ID NO: 1254517 - RNA, 19 nt, Human
ugcgcucagggccaugcug

SEQ ID NO: 1254518 - RNA, 21 nt, Human
ugcgcucagggccaugcugag

SEQ ID NO: 1254519 - RNA, 22 nt, Human
ugcgcucagggccaugcugagg

SEQ ID NO: 1254520 - RNA, 23 nt, Human
ugcgcucagggccaugcugaggc

SEQ ID NO: 1254521 - RNA, 13 nt, Human
ugcgcuccuggcc

SEQ ID NO: 1254522 - RNA, 14 nt, Human
ugcgcuccuggccc

SEQ ID NO: 1254523 - RNA, 17 nt, Human
ugcgcuccuggcccagc

SEQ ID NO: 1254524 - RNA, 20 nt, Human
ugcgcuccuggcccagccuu

SEQ ID NO: 1254525 - RNA, 18 nt, Human
ugcgcuccuggcccagcc

SEQ ID NO: 1254526 - RNA, 17 nt, Human
ugcgccaccgcccagag

SEQ ID NO: 1254527 - RNA, 20 nt, Human
ugccuugcauaauggucaga

SEQ ID NO: 1254528 - RNA, 23 nt, Human
ugccucuaccugacacucccuug

SEQ ID NO: 1254529 - RNA, 16 nt, Human
ugccucuacugggaag

SEQ ID NO: 1254530 - RNA, 23 nt, Human
ugccucuacugggaaggcuacuu

SEQ ID NO: 1254531 - RNA, 19 nt, Human
ugccucuacugggaaggcu

SEQ ID NO: 1254532 - RNA, 15 nt, Human
ugccucuaccugaca

SEQ ID NO: 1254533 - RNA, 17 nt, Human
ugccucuaccugacacu

SEQ ID NO: 1254534 - RNA, 21 nt, Human
ugcgcaggcuggcccugcccu

SEQ ID NO: 1254535 - RNA, 22 nt, Human
ugcgcaggcuggcccugcccug

SEQ ID NO: 1254536 - RNA, 23 nt, Human
ugcgcaggcuggcccugcccugg

SEQ ID NO: 1254537 - RNA, 17 nt, Human
ugccuuggccucccaag

SEQ ID NO: 1254538 - RNA, 22 nt, Human
ugcguguuuggguuuuuuuccu

SEQ ID NO: 1254539 - RNA, 19 nt, Human
ugcuaacaugaagaccuuu

SEQ ID NO: 1254540 - RNA, 17 nt, Human
ugcuaacaugaagaccu

SEQ ID NO: 1254541 - RNA, 18 nt, Human
ugcuaacggugcucaggg

SEQ ID NO: 1254542 - RNA, 19 nt, Human
ugcuaacggugcucagggg

SEQ ID NO: 1254543 - RNA, 13 nt, Human
ugcuaaaaccuga

SEQ ID NO: 1254544 - RNA, 17 nt, Human
ugcuaaaaccugaaauu

SEQ ID NO: 1254545 - RNA, 14 nt, Human
ugcuaaaauaacag

SEQ ID NO: 1254546 - RNA, 22 nt, Human
ugcuacuggggaaacuggccau

SEQ ID NO: 1254547 - RNA, 19 nt, Human
ugcuacuggggaaacuggc

SEQ ID NO: 1254548 - RNA, 16 nt, Human
ugcuacuuauauaauu

SEQ ID NO: 1254549 - RNA, 15 nt, Human
ugcuagaacaugguu

SEQ ID NO: 1254550 - RNA, 22 nt, Human
ugcuaagacucaguggggaggg

SEQ ID NO: 1254551 - RNA, 13 nt, Human
ugcuacuggggaa

SEQ ID NO: 1254552 - RNA, 18 nt, Human
ugcuacuggggaaacugg

SEQ ID NO: 1254553 - RNA, 20 nt, Human
ugcucaggagcccugggagg

SEQ ID NO: 1254554 - RNA, 19 nt, Human
ugcucaggagcccugggag

SEQ ID NO: 1254555 - RNA, 18 nt, Human
ugcucaggagcccuggga

SEQ ID NO: 1254556 - RNA, 14 nt, Human
ugcucacccagugc

SEQ ID NO: 1254557 - RNA, 19 nt, Human
ugcucacccagugcccucu

SEQ ID NO: 1254558 - RNA, 17 nt, Human
ugcucacgucaaaugca

SEQ ID NO: 1254559 - RNA, 13 nt, Human
ugcucagacagaa

SEQ ID NO: 1254560 - RNA, 18 nt, Human
ugcuagaacucccuuuca

SEQ ID NO: 1254561 - RNA, 12 nt, Human
ugcuaggaagag

SEQ ID NO: 1254562 - RNA, 18 nt, Human
ugcuaggaagaggagugg

SEQ ID NO: 1254563 - RNA, 14 nt, Human
ugcuaggccagagc

SEQ ID NO: 1254564 - RNA, 17 nt, Human
ugcuaggccagagccca

SEQ ID NO: 1254565 - RNA, 19 nt, Human
ugcuaggccagagcccacu

SEQ ID NO: 1254566 - RNA, 18 nt, Human
ugcuaggccagagcccac

SEQ ID NO: 1254567 - RNA, 17 nt, Human
ugcuagaacucccuuuc

SEQ ID NO: 1254568 - RNA, 15 nt, Human
ugcuagaacucccuu

SEQ ID NO: 1254569 - RNA, 14 nt, Human
ugcuagaacucccu

SEQ ID NO: 1254570 - RNA, 13 nt, Human
ugcuagaacuccc

SEQ ID NO: 1254571 - RNA, 13 nt, Human
ugcucuccuccac

SEQ ID NO: 1254572 - RNA, 10 nt, Human
ugcucuccuc

SEQ ID NO: 1254573 - RNA, 12 nt, Human
ugcucuccucuu

SEQ ID NO: 1254574 - RNA, 11 nt, Human
ugcucuccucu

SEQ ID NO: 1254575 - RNA, 13 nt, Human
ugcucuccucuuc

SEQ ID NO: 1254576 - RNA, 14 nt, Human
ugcucuccucuucu

SEQ ID NO: 1254577 - RNA, 15 nt, Human
ugcucuccucuucua

SEQ ID NO: 1254578 - RNA, 14 nt, Human
ugcucuccucuugc

SEQ ID NO: 1254579 - RNA, 14 nt, Human
ugcucuuggcugga

SEQ ID NO: 1254580 - RNA, 15 nt, Human
ugcucuuggcuggac

SEQ ID NO: 1254581 - RNA, 19 nt, Human
ugcucuuggcuggacccag

SEQ ID NO: 1254582 - RNA, 20 nt, Human
ugcucuuggcuggacccagc

SEQ ID NO: 1254583 - RNA, 21 nt, Human
ugcucuuggcuggacccagcc

SEQ ID NO: 1254584 - RNA, 24 nt, Human
ugcucauauuucccaugauuucau

SEQ ID NO: 1254585 - RNA, 15 nt, Human
ugcucggggugcaca

SEQ ID NO: 1254586 - RNA, 16 nt, Human
ugcucggggugcacag

SEQ ID NO: 1254587 - RNA, 17 nt, Human
ugcucggggugcacagg

SEQ ID NO: 1254588 - RNA, 18 nt, Human
ugcucggggugcacagga

SEQ ID NO: 1254589 - RNA, 19 nt, Human
ugcucggggugcacaggag

SEQ ID NO: 1254590 - RNA, 20 nt, Human
ugcucggggugcacaggagg

SEQ ID NO: 1254591 - RNA, 22 nt, Human
ugcucggggugcacaggagggg

SEQ ID NO: 1254592 - RNA, 21 nt, Human
ugcucggggugcacaggaggg

SEQ ID NO: 1254593 - RNA, 15 nt, Human
ugcucuaacagcccu

SEQ ID NO: 1254594 - RNA, 16 nt, Human
ugcucuaacagcccuc

SEQ ID NO: 1254595 - RNA, 22 nt, Human
ugcucauauuucccaugauuuc

SEQ ID NO: 1254596 - RNA, 15 nt, Human
ugcucauauuuccca

SEQ ID NO: 1254597 - RNA, 14 nt, Human
ugcucauauuuccc

SEQ ID NO: 1254598 - RNA, 22 nt, Human
ugcucauauugugauucugccu

SEQ ID NO: 1254599 - RNA, 23 nt, Human
ugcucauauugugauucugccuu

SEQ ID NO: 1254600 - RNA, 21 nt, Human
ugcucauauugugauucugcc

SEQ ID NO: 1254601 - RNA, 16 nt, Human
ugcuguucaugaaaga

SEQ ID NO: 1254602 - RNA, 17 nt, Human
ugcuguucaugaaagau

SEQ ID NO: 1254603 - RNA, 22 nt, Human
ugcuguucucuugggaacugaa

SEQ ID NO: 1254604 - RNA, 15 nt, Human
ugcuguuauauuuca

SEQ ID NO: 1254605 - RNA, 18 nt, Human
ugcuguuauauuucauca

SEQ ID NO: 1254606 - RNA, 15 nt, Human
ugcugugugcuuuuu

SEQ ID NO: 1254607 - RNA, 17 nt, Human
ugcuguggugugucccc

SEQ ID NO: 1254608 - RNA, 23 nt, Human
ugcuguggugugucccccucugu

SEQ ID NO: 1254609 - RNA, 12 nt, Human
ugcuguguaaaa

SEQ ID NO: 1254610 - RNA, 21 nt, Human
ugcugugugcuuuuuuugugu

SEQ ID NO: 1254611 - RNA, 13 nt, Human
ugcugguuuuagu

SEQ ID NO: 1254612 - RNA, 13 nt, Human
ugcugguuuguag

SEQ ID NO: 1254613 - RNA, 22 nt, Human
ugcugguuuguaguugaauauu

SEQ ID NO: 1254614 - RNA, 15 nt, Human
ugcuguggugugucc

SEQ ID NO: 1254615 - RNA, 16 nt, Human
ugcugugguguguccc

SEQ ID NO: 1254616 - RNA, 20 nt, Human
ugcuguaaagaguugcuuuu

SEQ ID NO: 1254617 - RNA, 18 nt, Human
ugcuggugagccaagcag

SEQ ID NO: 1254618 - RNA, 19 nt, Human
ugcuggucccggggccagc

SEQ ID NO: 1254619 - RNA, 13 nt, Human
ugcugguccgugg

SEQ ID NO: 1254620 - RNA, 16 nt, Human
ugcugguccgugggac

SEQ ID NO: 1254621 - RNA, 22 nt, Human
ugcuggguccauaucacacaca

SEQ ID NO: 1254622 - RNA, 16 nt, Human
ugcugggauuuccaac

SEQ ID NO: 1254623 - RNA, 12 nt, Human
ugcugggcucag

SEQ ID NO: 1254624 - RNA, 13 nt, Human
ugcugggcucagu

SEQ ID NO: 1254625 - RNA, 14 nt, Human
ugcugggcucagug

SEQ ID NO: 1254626 - RNA, 15 nt, Human
ugcugggcucaguga

SEQ ID NO: 1254627 - RNA, 17 nt, Human
ugcugggcucagugaag

SEQ ID NO: 1254628 - RNA, 20 nt, Human
ugcugggggggauuguaaaa

SEQ ID NO: 1254629 - RNA, 18 nt, Human
ugcuggggccugguuccc

SEQ ID NO: 1254630 - RNA, 23 nt, Human
ugcuggggccugggacaacugcu

SEQ ID NO: 1254631 - RNA, 16 nt, Human
ugcuggggaagacagu

SEQ ID NO: 1254632 - RNA, 17 nt, Human
ugcuggggaagacagug

SEQ ID NO: 1254633 - RNA, 22 nt, Human
ugcuggggaagacaguggcccc

SEQ ID NO: 1254634 - RNA, 14 nt, Human
ugcuggggccuggg

SEQ ID NO: 1254635 - RNA, 17 nt, Human
ugcuggggccugggaca

SEQ ID NO: 1254636 - RNA, 17 nt, Human
ugcugccugcuuuuuau

SEQ ID NO: 1254637 - RNA, 15 nt, Human
ugcugccugcuuuuu

SEQ ID NO: 1254638 - RNA, 15 nt, Human
ugcucuuucucugcc

SEQ ID NO: 1254639 - RNA, 16 nt, Human
ugcugccucccucugc

SEQ ID NO: 1254640 - RNA, 18 nt, Human
ugcugccuuauucaggga

SEQ ID NO: 1254641 - RNA, 19 nt, Human
ugcugccuuauucagggaa

SEQ ID NO: 1254642 - RNA, 20 nt, Human
ugcugccuuauucagggaag

SEQ ID NO: 1254643 - RNA, 13 nt, Human
ugcugcucccuca

SEQ ID NO: 1254644 - RNA, 14 nt, Human
ugcugcucccucag

SEQ ID NO: 1254645 - RNA, 15 nt, Human
ugcugcucccucaga

SEQ ID NO: 1254646 - RNA, 17 nt, Human
ugcugcucccucagacu

SEQ ID NO: 1254647 - RNA, 16 nt, Human
ugcugcucccucagac

SEQ ID NO: 1254648 - RNA, 17 nt, Human
ugcugcucuuggcugga

SEQ ID NO: 1254649 - RNA, 18 nt, Human
ugcugcucuuggcuggac

SEQ ID NO: 1254650 - RNA, 19 nt, Human
ugcugcucuuggcuggacc

SEQ ID NO: 1254651 - RNA, 21 nt, Human
ugcugcucuuggcuggaccca

SEQ ID NO: 1254652 - RNA, 23 nt, Human
ugcugcucuuggcuggacccagc

SEQ ID NO: 1254653 - RNA, 11 nt, Human
ugcugcugaga

SEQ ID NO: 1254654 - RNA, 13 nt, Human
ugcugcugagaac

SEQ ID NO: 1254655 - RNA, 15 nt, Human
ugcugcugagaaccu

SEQ ID NO: 1254656 - RNA, 16 nt, Human
ugcugcugagaaccug

SEQ ID NO: 1254657 - RNA, 17 nt, Human
ugcugcugagaaccugg

SEQ ID NO: 1254658 - RNA, 18 nt, Human
ugcugcugagaaccuggc

SEQ ID NO: 1254659 - RNA, 12 nt, Human
ugcucuuucucu

SEQ ID NO: 1254660 - RNA, 13 nt, Human
ugcucuuucucug

SEQ ID NO: 1254661 - RNA, 14 nt, Human
ugcucuuucucugc

SEQ ID NO: 1254662 - RNA, 24 nt, Human
ugcugggccccugccucucugcag

SEQ ID NO: 1254663 - RNA, 23 nt, Human
ugcugggccccugccucucugca

SEQ ID NO: 1254664 - RNA, 22 nt, Human
ugcugggccccugccucucugc

SEQ ID NO: 1254665 - RNA, 21 nt, Human
ugcugggccccugccucucug

SEQ ID NO: 1254666 - RNA, 19 nt, Human
ugcugggccccugccucuc

SEQ ID NO: 1254667 - RNA, 18 nt, Human
ugcugggccccugccucu

SEQ ID NO: 1254668 - RNA, 17 nt, Human
ugcugggccccugccuc

SEQ ID NO: 1254669 - RNA, 16 nt, Human
ugcugggccccugccu

SEQ ID NO: 1254670 - RNA, 14 nt, Human
ugcugggccccugc

SEQ ID NO: 1254671 - RNA, 15 nt, Human
ugcugcuucucccag

SEQ ID NO: 1254672 - RNA, 18 nt, Human
ugcugcuucucccaggca

SEQ ID NO: 1254673 - RNA, 19 nt, Human
ugcugcuucucccaggcaa

SEQ ID NO: 1254674 - RNA, 20 nt, Human
ugcugcuucucccaggcaag

SEQ ID NO: 1254675 - RNA, 23 nt, Human
ugcugcuucucccaggcaaggcu

SEQ ID NO: 1254676 - RNA, 14 nt, Human
ugcugggauuucca

SEQ ID NO: 1254677 - RNA, 20 nt, Human
ugcugggauuacagguguga

SEQ ID NO: 1254678 - RNA, 14 nt, Human
ugcugcugccugcc

SEQ ID NO: 1254679 - RNA, 13 nt, Human
ugcugcugccugc

SEQ ID NO: 1254680 - RNA, 21 nt, Human
ugcugcugagaaccuggccuu

SEQ ID NO: 1254681 - RNA, 19 nt, Human
ugcugcugagaaccuggcc

SEQ ID NO: 1254682 - RNA, 20 nt, Human
ugcugcugagaaccuggccu

SEQ ID NO: 1254683 - RNA, 22 nt, Human
ugcugcugagaaccuggccuuc

SEQ ID NO: 1254684 - RNA, 14 nt, Human
ugcugcuucaauuu

SEQ ID NO: 1254685 - RNA, 13 nt, Human
ugcugcuucaauu

SEQ ID NO: 1254686 - RNA, 23 nt, Human
ugcccugguuuccugcccuggga

SEQ ID NO: 1254687 - RNA, 19 nt, Human
ugcccugguuuccugcccu

SEQ ID NO: 1254688 - RNA, 20 nt, Human
ugcccugguuuccugcccug

SEQ ID NO: 1254689 - RNA, 12 nt, Human
ugcccuggugcu

SEQ ID NO: 1254690 - RNA, 14 nt, Human
ugcccuggugcugc

SEQ ID NO: 1254691 - RNA, 16 nt, Human
ugcccuggugcugcca

SEQ ID NO: 1254692 - RNA, 17 nt, Human
ugcccuggugcugccac

SEQ ID NO: 1254693 - RNA, 17 nt, Human
ugcccugguuuccugcc

SEQ ID NO: 1254694 - RNA, 18 nt, Human
ugcccugguuuccugccc

SEQ ID NO: 1254695 - RNA, 13 nt, Human
ugcccugggaggc

SEQ ID NO: 1254696 - RNA, 15 nt, Human
ugcccugggaggcag

SEQ ID NO: 1254697 - RNA, 17 nt, Human
ugcccugggaggcagug

SEQ ID NO: 1254698 - RNA, 18 nt, Human
ugcccugggaggcaguga

SEQ ID NO: 1254699 - RNA, 20 nt, Human
ugcccggcuaauuuuuguaa

SEQ ID NO: 1254700 - RNA, 11 nt, Human
ugccuccuccc

SEQ ID NO: 1254701 - RNA, 12 nt, Human
ugccuccucccu

SEQ ID NO: 1254702 - RNA, 13 nt, Human
ugccuccucccuc

SEQ ID NO: 1254703 - RNA, 19 nt, Human
ugccuccucccucccucuc

SEQ ID NO: 1254704 - RNA, 13 nt, Human
ugccucaaugcca

SEQ ID NO: 1254705 - RNA, 15 nt, Human
ugccucaaugccagu

SEQ ID NO: 1254706 - RNA, 16 nt, Human
ugccucaaugccagua

SEQ ID NO: 1254707 - RNA, 14 nt, Human
ugccuccucuucaa

SEQ ID NO: 1254708 - RNA, 16 nt, Human
ugccuccucuucaacu

SEQ ID NO: 1254709 - RNA, 15 nt, Human
ugccuccucccuccc

SEQ ID NO: 1254710 - RNA, 14 nt, Human
ugccuccugccggc

SEQ ID NO: 1254711 - RNA, 21 nt, Human
ugccuccugccggcuccuugg

SEQ ID NO: 1254712 - RNA, 20 nt, Human
ugccuccugccggcuccuug

SEQ ID NO: 1254713 - RNA, 21 nt, Human
ugccucgcuccccacucugcu

SEQ ID NO: 1254714 - RNA, 20 nt, Human
ugccucggccucccaaagug

SEQ ID NO: 1254715 - RNA, 21 nt, Human
ugccuaguauugacaaaaugu

SEQ ID NO: 1254716 - RNA, 22 nt, Human
ugccuaguauugacaaaauguu

SEQ ID NO: 1254717 - RNA, 18 nt, Human
ugccuaguauugacaaaa

SEQ ID NO: 1254718 - RNA, 17 nt, Human
ugccuaguauugacaaa

SEQ ID NO: 1254719 - RNA, 16 nt, Human
ugccuaguauugacaa

SEQ ID NO: 1254720 - RNA, 21 nt, Human
ugccuauuaucugucagcugc

SEQ ID NO: 1254721 - RNA, 17 nt, Human
ugccuauugcuagagcu

SEQ ID NO: 1254722 - RNA, 18 nt, Human
ugccuauugcuagagcuc

SEQ ID NO: 1254723 - RNA, 20 nt, Human
ugccuauugcuagagcuccu

SEQ ID NO: 1254724 - RNA, 12 nt, Human
ugccucaaauaa

SEQ ID NO: 1254725 - RNA, 21 nt, Human
ugccucaaauaaaaagugcuu

SEQ ID NO: 1254726 - RNA, 22 nt, Human
ugccucaaauaaaaagugcuuu

SEQ ID NO: 1254727 - RNA, 14 nt, Human
ugccucaaccuccc

SEQ ID NO: 1254728 - RNA, 19 nt, Human
ugccaggcuggagugcagu

SEQ ID NO: 1254729 - RNA, 10 nt, Human
ugcccagaca

SEQ ID NO: 1254730 - RNA, 14 nt, Human
ugccaggcucucuu

SEQ ID NO: 1254731 - RNA, 15 nt, Human
ugcccagagacccag

SEQ ID NO: 1254732 - RNA, 16 nt, Human
ugcccagagacccagc

SEQ ID NO: 1254733 - RNA, 17 nt, Human
ugcccagagacccagcg

SEQ ID NO: 1254734 - RNA, 18 nt, Human
ugcccagagacccagcgg

SEQ ID NO: 1254735 - RNA, 17 nt, Human
ugccaggcuggagugca

SEQ ID NO: 1254736 - RNA, 16 nt, Human
ugccaggcuaauuuuu

SEQ ID NO: 1254737 - RNA, 12 nt, Human
ugccaggcucuc

SEQ ID NO: 1254738 - RNA, 17 nt, Human
ugccaggcuaauuuuuu

SEQ ID NO: 1254739 - RNA, 23 nt, Human
ugcccagagacccagcggacaca

SEQ ID NO: 1254740 - RNA, 20 nt, Human
ugcccagagacccagcggac

SEQ ID NO: 1254741 - RNA, 13 nt, Human
ugcccauguuuca

SEQ ID NO: 1254742 - RNA, 15 nt, Human
ugcccauguuucaaa

SEQ ID NO: 1254743 - RNA, 14 nt, Human
ugcccauuuugaau

SEQ ID NO: 1254744 - RNA, 16 nt, Human
ugccccaacuccuucc

SEQ ID NO: 1254745 - RNA, 18 nt, Human
ugccccaacuccuuccag

SEQ ID NO: 1254746 - RNA, 19 nt, Human
ugccccaacuccuuccagc

SEQ ID NO: 1254747 - RNA, 22 nt, Human
ugccccaacuccuuccagcuag

SEQ ID NO: 1254748 - RNA, 20 nt, Human
ugccccaacuccuuccagcu

SEQ ID NO: 1254749 - RNA, 14 nt, Human
ugccccacuugucc

SEQ ID NO: 1254750 - RNA, 18 nt, Human
ugccccacuuguccuuag

SEQ ID NO: 1254751 - RNA, 19 nt, Human
ugccccacuuguccuuagc

SEQ ID NO: 1254752 - RNA, 15 nt, Human
ugccccucuccuucu

SEQ ID NO: 1254753 - RNA, 20 nt, Human
ugccccucuccuucuuagcu

SEQ ID NO: 1254754 - RNA, 19 nt, Human
ugccccuccucucugcccu

SEQ ID NO: 1254755 - RNA, 20 nt, Human
ugccccuccucucugcccua

SEQ ID NO: 1254756 - RNA, 12 nt, Human
ugccccucucac

SEQ ID NO: 1254757 - RNA, 14 nt, Human
ugccccucucacca

SEQ ID NO: 1254758 - RNA, 15 nt, Human
ugccccucucaccaa

SEQ ID NO: 1254759 - RNA, 15 nt, Human
ugccccucccuucaa

SEQ ID NO: 1254760 - RNA, 16 nt, Human
ugccccucccuucaac

SEQ ID NO: 1254761 - RNA, 17 nt, Human
ugccccuccucucugcc

SEQ ID NO: 1254762 - RNA, 18 nt, Human
ugccccuccucucugccc

SEQ ID NO: 1254763 - RNA, 21 nt, Human
ugccccuugacaacuggcagg

SEQ ID NO: 1254764 - RNA, 20 nt, Human
ugccccuuggacacgcucag

SEQ ID NO: 1254765 - RNA, 19 nt, Human
ugccccuuuauaaauccaa

SEQ ID NO: 1254766 - RNA, 14 nt, Human
ugccccuuucugga

SEQ ID NO: 1254767 - RNA, 11 nt, Human
ugccccuuucu

SEQ ID NO: 1254768 - RNA, 20 nt, Human
ugcccgccugggucuccuaa

SEQ ID NO: 1254769 - RNA, 13 nt, Human
ugccaccugucug

SEQ ID NO: 1254770 - RNA, 12 nt, Human
ugccaccugucu

SEQ ID NO: 1254771 - RNA, 11 nt, Human
ugccaccuguc

SEQ ID NO: 1254772 - RNA, 10 nt, Human
ugccaccugu

SEQ ID NO: 1254773 - RNA, 14 nt, Human
ugccaccuggaccc

SEQ ID NO: 1254774 - RNA, 15 nt, Human
ugccaccuggacccc

SEQ ID NO: 1254775 - RNA, 18 nt, Human
ugccaccuggaccccugc

SEQ ID NO: 1254776 - RNA, 19 nt, Human
ugccaccuggaccccugca

SEQ ID NO: 1254777 - RNA, 20 nt, Human
ugccaccuggaccccugcau

SEQ ID NO: 1254778 - RNA, 14 nt, Human
ugccaccuccugcc

SEQ ID NO: 1254779 - RNA, 18 nt, Human
ugccaccucuaacagcac

SEQ ID NO: 1254780 - RNA, 20 nt, Human
ugccaccucuaacagcacca

SEQ ID NO: 1254781 - RNA, 19 nt, Human
ugccaccucuaacagcacc

SEQ ID NO: 1254782 - RNA, 13 nt, Human
ugccaccuggacc

SEQ ID NO: 1254783 - RNA, 22 nt, Human
ugccaaauuauucuccuauguu

SEQ ID NO: 1254784 - RNA, 22 nt, Human
ugccaaauuaaaaaagauaaac

SEQ ID NO: 1254785 - RNA, 12 nt, Human
ugccaaccuaaa

SEQ ID NO: 1254786 - RNA, 16 nt, Human
ugccaaccuaaaacuc

SEQ ID NO: 1254787 - RNA, 18 nt, Human
ugccaaccuaaaacucuu

SEQ ID NO: 1254788 - RNA, 15 nt, Human
ugccaccucccccca

SEQ ID NO: 1254789 - RNA, 17 nt, Human
ugccaccuccccccaca

SEQ ID NO: 1254790 - RNA, 16 nt, Human
ugccaccugucugucu

SEQ ID NO: 1254791 - RNA, 15 nt, Human
ugccaccugucuguc

SEQ ID NO: 1254792 - RNA, 14 nt, Human
ugccaccugucugu

SEQ ID NO: 1254793 - RNA, 16 nt, Human
ugccacuaaauugaca

SEQ ID NO: 1254794 - RNA, 19 nt, Human
ugccaggagcacggcucug

SEQ ID NO: 1254795 - RNA, 20 nt, Human
ugccaggagcacggcucugu

SEQ ID NO: 1254796 - RNA, 13 nt, Human
ugccaggaggacc

SEQ ID NO: 1254797 - RNA, 17 nt, Human
ugccaggaggacccagg

SEQ ID NO: 1254798 - RNA, 20 nt, Human
ugccaggaggacccagggcu

SEQ ID NO: 1254799 - RNA, 20 nt, Human
ugccacuaaauugacacuua

SEQ ID NO: 1254800 - RNA, 22 nt, Human
ugccacguuggagaagcccgug

SEQ ID NO: 1254801 - RNA, 20 nt, Human
ugccaggaccagucaaccug

SEQ ID NO: 1254802 - RNA, 15 nt, Human
ugccaggagcacggc

SEQ ID NO: 1254803 - RNA, 16 nt, Human
ugcauuugauacauuu

SEQ ID NO: 1254804 - RNA, 20 nt, Human
ugcauuuggagggagugagu

SEQ ID NO: 1254805 - RNA, 17 nt, Human
ugcaugguuuagaaagc

SEQ ID NO: 1254806 - RNA, 21 nt, Human
ugcauggugccccaggaccag

SEQ ID NO: 1254807 - RNA, 22 nt, Human
ugcauggugccccaggaccagc

SEQ ID NO: 1254808 - RNA, 17 nt, Human
ugcauggugccccagga

SEQ ID NO: 1254809 - RNA, 18 nt, Human
ugcauggugccccaggac

SEQ ID NO: 1254810 - RNA, 19 nt, Human
ugcauggugccccaggacc

SEQ ID NO: 1254811 - RNA, 20 nt, Human
ugcauggugccccaggacca

SEQ ID NO: 1254812 - RNA, 17 nt, Human
ugcaucagaaagggagg

SEQ ID NO: 1254813 - RNA, 18 nt, Human
ugcaucagaaagggaggg

SEQ ID NO: 1254814 - RNA, 20 nt, Human
ugcaucagaaagggagggcu

SEQ ID NO: 1254815 - RNA, 21 nt, Human
ugcaucagaaagggagggcuc

SEQ ID NO: 1254816 - RNA, 22 nt, Human
ugcaucagaaagggagggcucu

SEQ ID NO: 1254817 - RNA, 23 nt, Human
ugcaucagaaagggagggcucug

SEQ ID NO: 1254818 - RNA, 14 nt, Human
ugcauuugggucca

SEQ ID NO: 1254819 - RNA, 16 nt, Human
ugcauuuggguccagg

SEQ ID NO: 1254820 - RNA, 17 nt, Human
ugcauuuggguccagga

SEQ ID NO: 1254821 - RNA, 18 nt, Human
ugcauuuggguccaggag

SEQ ID NO: 1254822 - RNA, 20 nt, Human
ugcauuuggguccaggagga

SEQ ID NO: 1254823 - RNA, 19 nt, Human
ugcauuuggguccaggagg

SEQ ID NO: 1254824 - RNA, 17 nt, Human
ugccaaacaaaaagguu

SEQ ID NO: 1254825 - RNA, 23 nt, Human
ugccaaacaaaaagguucucagg

SEQ ID NO: 1254826 - RNA, 15 nt, Human
ugccaaaggauguga

SEQ ID NO: 1254827 - RNA, 16 nt, Human
ugccaaaggaugugau

SEQ ID NO: 1254828 - RNA, 17 nt, Human
ugccaaaggaugugaua

SEQ ID NO: 1254829 - RNA, 19 nt, Human
ugccaaaggaugugauaua

SEQ ID NO: 1254830 - RNA, 17 nt, Human
ugccaaauauguccugg

SEQ ID NO: 1254831 - RNA, 18 nt, Human
ugccaaauauguccuggg

SEQ ID NO: 1254832 - RNA, 13 nt, Human
ugccaaauuaaaa

SEQ ID NO: 1254833 - RNA, 17 nt, Human
ugccaaauuaaaaaaga

SEQ ID NO: 1254834 - RNA, 18 nt, Human
ugccaaauuaaaaaagau

SEQ ID NO: 1254835 - RNA, 19 nt, Human
ugccaaauuaaaaaagaua

SEQ ID NO: 1254836 - RNA, 18 nt, Human
ugcauauuauuuuauguu

SEQ ID NO: 1254837 - RNA, 19 nt, Human
ugcauauguugaauacuuu

SEQ ID NO: 1254838 - RNA, 22 nt, Human
ugcauaguaccaaucauuuuaa

SEQ ID NO: 1254839 - RNA, 12 nt, Human
ugcaguucugaa

SEQ ID NO: 1254840 - RNA, 14 nt, Human
ugcaguucugaaga

SEQ ID NO: 1254841 - RNA, 13 nt, Human
ugcaguugucucu

SEQ ID NO: 1254842 - RNA, 14 nt, Human
ugcaguugucucug

SEQ ID NO: 1254843 - RNA, 15 nt, Human
ugcaguugucucugu

SEQ ID NO: 1254844 - RNA, 17 nt, Human
ugcaguugucucuguuu

SEQ ID NO: 1254845 - RNA, 10 nt, Human
ugcaguuuau

SEQ ID NO: 1254846 - RNA, 12 nt, Human
ugcaguuuauca

SEQ ID NO: 1254847 - RNA, 16 nt, Human
ugcaguuuaucauuca

SEQ ID NO: 1254848 - RNA, 17 nt, Human
ugcaguuuaucauucaa

SEQ ID NO: 1254849 - RNA, 20 nt, Human
ugcauaggaguuuggaggaa

SEQ ID NO: 1254850 - RNA, 19 nt, Human
ugcaguuuaucauucaagu

SEQ ID NO: 1254851 - RNA, 20 nt, Human
ugcauaguaccaaucauuuu

SEQ ID NO: 1254852 - RNA, 21 nt, Human
ugcauaguaccaaucauuuua

SEQ ID NO: 1254853 - RNA, 14 nt, Human
ugcaguuauuugcu

SEQ ID NO: 1254854 - RNA, 21 nt, Human
ugcaguucccacauuaaagaa

SEQ ID NO: 1254855 - RNA, 21 nt, Human
ugcagggcagucauuggcugu

SEQ ID NO: 1254856 - RNA, 23 nt, Human
ugcagggagcugggcuuccagaa

SEQ ID NO: 1254857 - RNA, 14 nt, Human
ugcagggauguggg

SEQ ID NO: 1254858 - RNA, 15 nt, Human
ugcagggaugugggu

SEQ ID NO: 1254859 - RNA, 16 nt, Human
ugcagggauguggguu

SEQ ID NO: 1254860 - RNA, 18 nt, Human
ugcagggauguggguucc

SEQ ID NO: 1254861 - RNA, 22 nt, Human
ugcagggauguggguuccacag

SEQ ID NO: 1254862 - RNA, 23 nt, Human
ugcagggauguggguuccacaga

SEQ ID NO: 1254863 - RNA, 13 nt, Human
ugcagggcaguca

SEQ ID NO: 1254864 - RNA, 14 nt, Human
ugcagggcagucau

SEQ ID NO: 1254865 - RNA, 15 nt, Human
ugcagggaaaauuau

SEQ ID NO: 1254866 - RNA, 20 nt, Human
ugcagggaaaauuauuugca

SEQ ID NO: 1254867 - RNA, 21 nt, Human
ugcagggaaaauuauuugcau

SEQ ID NO: 1254868 - RNA, 22 nt, Human
ugcagggaaaauuauuugcaua

SEQ ID NO: 1254869 - RNA, 13 nt, Human
ugauuuaauguuu

SEQ ID NO: 1254870 - RNA, 16 nt, Human
ugauuuaauguuuuca

SEQ ID NO: 1254871 - RNA, 15 nt, Human
ugauuuaauuugaaa

SEQ ID NO: 1254872 - RNA, 23 nt, Human
ugacauaaguauuuaauucaugu

SEQ ID NO: 1254873 - RNA, 19 nt, Human
ugacagacaggcucuuagc

SEQ ID NO: 1254874 - RNA, 16 nt, Human
ugacagacagcccucc

SEQ ID NO: 1254875 - RNA, 14 nt, Human
ugacagacaggcuc

SEQ ID NO: 1254876 - RNA, 15 nt, Human
ugacagacaggcucu

SEQ ID NO: 1254877 - RNA, 12 nt, Human
ugacaagcucac

SEQ ID NO: 1254878 - RNA, 23 nt, Human
ugacaagaaaggcugcuguacug

SEQ ID NO: 1254879 - RNA, 22 nt, Human
ugacaagauuauaauauuuuaa

SEQ ID NO: 1254880 - RNA, 22 nt, Human
ugacaagaaaggcugcuguacu

SEQ ID NO: 1254881 - RNA, 19 nt, Human
ugacaacuucuaauugcca

SEQ ID NO: 1254882 - RNA, 22 nt, Human
ugacaacuucuaauugccaugu

SEQ ID NO: 1254883 - RNA, 18 nt, Human
ugaauuguaacuguucuu

SEQ ID NO: 1254884 - RNA, 14 nt, Human
ugacaacuucuaau

SEQ ID NO: 1254885 - RNA, 15 nt, Human
ugacaacuucuaauu

SEQ ID NO: 1254886 - RNA, 15 nt, Human
ugacaagcucacaga

SEQ ID NO: 1254887 - RNA, 20 nt, Human
ugacaagcucacagaccuuu

SEQ ID NO: 1254888 - RNA, 18 nt, Human
ugacaagcuccauuuaaa

SEQ ID NO: 1254889 - RNA, 21 nt, Human
ugacaagcuccauuuaaacag

SEQ ID NO: 1254890 - RNA, 17 nt, Human
ugacaauaaaacauuaa

SEQ ID NO: 1254891 - RNA, 13 nt, Human
ugacaaucaugug

SEQ ID NO: 1254892 - RNA, 15 nt, Human
ugacaaucaugugug

SEQ ID NO: 1254893 - RNA, 16 nt, Human
ugacaaucaugugugu

SEQ ID NO: 1254894 - RNA, 18 nt, Human
ugacaaucauguguguua

SEQ ID NO: 1254895 - RNA, 17 nt, Human
ugacaaucauguguguu

SEQ ID NO: 1254896 - RNA, 14 nt, Human
ugacaauugggagc

SEQ ID NO: 1254897 - RNA, 12 nt, Human
ugacacaaacac

SEQ ID NO: 1254898 - RNA, 17 nt, Human
ugacacaaacacacaca

SEQ ID NO: 1254899 - RNA, 13 nt, Human
ugacacaaacaca

SEQ ID NO: 1254900 - RNA, 22 nt, Human
ugacacuuuaauuaccaaccug

SEQ ID NO: 1254901 - RNA, 15 nt, Human
ugacauacccccucc

SEQ ID NO: 1254902 - RNA, 16 nt, Human
ugacauacccccuccc

SEQ ID NO: 1254903 - RNA, 20 nt, Human
ugacauacccccucccccac

SEQ ID NO: 1254904 - RNA, 17 nt, Human
ugacaugggacauuugc

SEQ ID NO: 1254905 - RNA, 18 nt, Human
ugacaugggacauuugcu

SEQ ID NO: 1254906 - RNA, 14 nt, Human
ugacauguccuucu

SEQ ID NO: 1254907 - RNA, 17 nt, Human
ugacauguccuucugag

SEQ ID NO: 1254908 - RNA, 15 nt, Human
ugaccacagcacagc

SEQ ID NO: 1254909 - RNA, 16 nt, Human
ugaccacagcacagcc

SEQ ID NO: 1254910 - RNA, 17 nt, Human
ugaccacagcacagcca

SEQ ID NO: 1254911 - RNA, 19 nt, Human
ugaccacagcacagccaac

SEQ ID NO: 1254912 - RNA, 20 nt, Human
ugaccacugcagaagacagu

SEQ ID NO: 1254913 - RNA, 14 nt, Human
ugaccacucagaga

SEQ ID NO: 1254914 - RNA, 16 nt, Human
ugaccacucagagaca

SEQ ID NO: 1254915 - RNA, 18 nt, Human
ugaccacucagagacaug

SEQ ID NO: 1254916 - RNA, 20 nt, Human
ugaccacucagagacaugca

SEQ ID NO: 1254917 - RNA, 15 nt, Human
ugaccacucugucuu

SEQ ID NO: 1254918 - RNA, 16 nt, Human
ugaccacucugucuug

SEQ ID NO: 1254919 - RNA, 23 nt, Human
ugaccacuuuuuagaaagauaau

SEQ ID NO: 1254920 - RNA, 12 nt, Human
ugaccagcuccc

SEQ ID NO: 1254921 - RNA, 13 nt, Human
ugaccagcucccc

SEQ ID NO: 1254922 - RNA, 16 nt, Human
ugaccagcucccccuc

SEQ ID NO: 1254923 - RNA, 17 nt, Human
ugaccagcucccccucc

SEQ ID NO: 1254924 - RNA, 18 nt, Human
ugaccagcucccccuccc

SEQ ID NO: 1254925 - RNA, 19 nt, Human
ugaccagcucccccucccu

SEQ ID NO: 1254926 - RNA, 20 nt, Human
ugaccagcucccccucccuc

SEQ ID NO: 1254927 - RNA, 22 nt, Human
ugaccagcucccccucccuccc

SEQ ID NO: 1254928 - RNA, 16 nt, Human
ugaccaggcauccucc

SEQ ID NO: 1254929 - RNA, 16 nt, Human
ugaccaggcugccucc

SEQ ID NO: 1254930 - RNA, 17 nt, Human
ugaccaguugcagucac

SEQ ID NO: 1254931 - RNA, 18 nt, Human
ugaccaguugcagucacu

SEQ ID NO: 1254932 - RNA, 13 nt, Human
ugacccuggcucc

SEQ ID NO: 1254933 - RNA, 13 nt, Human
ugacccuuuucau

SEQ ID NO: 1254934 - RNA, 15 nt, Human
ugacccuugcuguga

SEQ ID NO: 1254935 - RNA, 15 nt, Human
ugaagauacugaaau

SEQ ID NO: 1254936 - RNA, 16 nt, Human
ugaagauacugaaaua

SEQ ID NO: 1254937 - RNA, 18 nt, Human
ugaagauacugaaauaaa

SEQ ID NO: 1254938 - RNA, 20 nt, Human
ugaaggaauaaauugcuccu

SEQ ID NO: 1254939 - RNA, 14 nt, Human
ugaagauacugaaa

SEQ ID NO: 1254940 - RNA, 15 nt, Human
ugaacucuuaaucaa

SEQ ID NO: 1254941 - RNA, 21 nt, Human
ugaacucuuaaucaaauagca

SEQ ID NO: 1254942 - RNA, 14 nt, Human
ugaacucuuaauca

SEQ ID NO: 1254943 - RNA, 16 nt, Human
ugaacucugacaacag

SEQ ID NO: 1254944 - RNA, 16 nt, Human
ugaaggagagcccuuc

SEQ ID NO: 1254945 - RNA, 22 nt, Human
ugaaggacuaauagaaaaguau

SEQ ID NO: 1254946 - RNA, 20 nt, Human
ugaaggagagcccuucauuu

SEQ ID NO: 1254947 - RNA, 12 nt, Human
ugaaggacccuu

SEQ ID NO: 1254948 - RNA, 17 nt, Human
ugaaggacuaauagaaa

SEQ ID NO: 1254949 - RNA, 20 nt, Human
ugaaggacuaauagaaaagu

SEQ ID NO: 1254950 - RNA, 13 nt, Human
ugaaguccaagca

SEQ ID NO: 1254951 - RNA, 17 nt, Human
ugaagugagcacagccu

SEQ ID NO: 1254952 - RNA, 18 nt, Human
ugaagugagcacagccua

SEQ ID NO: 1254953 - RNA, 23 nt, Human
ugaagugagcugagauugcacca

SEQ ID NO: 1254954 - RNA, 18 nt, Human
ugaagugcuguuuauuaa

SEQ ID NO: 1254955 - RNA, 22 nt, Human
ugaagugcuguuuauuaaucuu

SEQ ID NO: 1254956 - RNA, 11 nt, Human
ugaaguccaag

SEQ ID NO: 1254957 - RNA, 23 nt, Human
ugaaguuagcuuuaacuuaaaua

SEQ ID NO: 1254958 - RNA, 18 nt, Human
ugaaguuagcuuuaacuu

SEQ ID NO: 1254959 - RNA, 13 nt, Human
ugaaguugcugcu

SEQ ID NO: 1254960 - RNA, 14 nt, Human
ugaaguugcugcuu

SEQ ID NO: 1254961 - RNA, 22 nt, Human
ugaaguugcugcuucucccagg

SEQ ID NO: 1254962 - RNA, 15 nt, Human
ugaaguugcugcuuc

SEQ ID NO: 1254963 - RNA, 18 nt, Human
ugaauaaaaacucaagga

SEQ ID NO: 1254964 - RNA, 16 nt, Human
ugaauaaaaacucaag

SEQ ID NO: 1254965 - RNA, 15 nt, Human
ugaauuauauguuca

SEQ ID NO: 1254966 - RNA, 17 nt, Human
ugaauuaggcuguaacu

SEQ ID NO: 1254967 - RNA, 20 nt, Human
ugaauuaggcuguaacuacu

SEQ ID NO: 1254968 - RNA, 21 nt, Human
ugaauuaggcuguaacuacuu

SEQ ID NO: 1254969 - RNA, 22 nt, Human
ugaauuaggcuguaacuacuuu

SEQ ID NO: 1254970 - RNA, 15 nt, Human
ugaauuacauuugua

SEQ ID NO: 1254971 - RNA, 16 nt, Human
ugaauuacauuuguau

SEQ ID NO: 1254972 - RNA, 18 nt, Human
ugaauuacauuuguauaa

SEQ ID NO: 1254973 - RNA, 16 nt, Human
ugaauuauuuucucuc

SEQ ID NO: 1254974 - RNA, 14 nt, Human
ugaauuauuacagu

SEQ ID NO: 1254975 - RNA, 16 nt, Human
ugaauuauuacagugu

SEQ ID NO: 1254976 - RNA, 17 nt, Human
ugaauuauuacaguguu

SEQ ID NO: 1254977 - RNA, 18 nt, Human
ugaauuauuacaguguuu

SEQ ID NO: 1254978 - RNA, 15 nt, Human
ugaauuauucaauuu

SEQ ID NO: 1254979 - RNA, 13 nt, Human
ugaauuaugaaac

SEQ ID NO: 1254980 - RNA, 15 nt, Human
ugaauuaguuuuaaa

SEQ ID NO: 1254981 - RNA, 21 nt, Human
ugaauuaucuugguugaaaau

SEQ ID NO: 1254982 - RNA, 15 nt, Human
ugaauuaugaaacuu

SEQ ID NO: 1254983 - RNA, 17 nt, Human
ugaauuaugaaacuuuu

SEQ ID NO: 1254984 - RNA, 13 nt, Human
ugaauuauucaau

SEQ ID NO: 1254985 - RNA, 15 nt, Human
ugaauucauuucacu

SEQ ID NO: 1254986 - RNA, 16 nt, Human
ugaauucauuucacug

SEQ ID NO: 1254987 - RNA, 12 nt, Human
ugaauucccuca

SEQ ID NO: 1254988 - RNA, 13 nt, Human
ugaauucccucac

SEQ ID NO: 1254989 - RNA, 14 nt, Human
ugaauucccucacu

SEQ ID NO: 1254990 - RNA, 22 nt, Human
ugaauucccucacucgucuccc

SEQ ID NO: 1254991 - RNA, 20 nt, Human
ugaauucuugguugaggaaa

SEQ ID NO: 1254992 - RNA, 22 nt, Human
ugaauucuugguugaggaaaca

SEQ ID NO: 1254993 - RNA, 21 nt, Human
ugaauucuugguugaggaaac

SEQ ID NO: 1254994 - RNA, 23 nt, Human
ugaaucauuuuaccuuugacaaa

SEQ ID NO: 1254995 - RNA, 22 nt, Human
ugaaucauuuuaccuuugacaa

SEQ ID NO: 1254996 - RNA, 14 nt, Human
ugaauaaagacacc

SEQ ID NO: 1254997 - RNA, 15 nt, Human
ugaauaaagacaccu

SEQ ID NO: 1254998 - RNA, 18 nt, Human
ugaaucauuguauguggu

SEQ ID NO: 1254999 - RNA, 21 nt, Human
ugaaucauuguauguggucau

SEQ ID NO: 1255000 - RNA, 15 nt, Human
ugaauccaaacuaau

SEQ ID NO: 1255001 - RNA, 16 nt, Human
ugaauccaaacuaauc

SEQ ID NO: 1255002 - RNA, 21 nt, Human
ugaauguguuucacaguuuga

SEQ ID NO: 1255003 - RNA, 22 nt, Human
ugaauguguuucacaguuugaa

SEQ ID NO: 1255004 - RNA, 23 nt, Human
ugaauguguuucacaguuugaaa

SEQ ID NO: 1255005 - RNA, 17 nt, Human
ugaaugaaaauguccau

SEQ ID NO: 1255006 - RNA, 11 nt, Human
ugaaugaacac

SEQ ID NO: 1255007 - RNA, 14 nt, Human
ugaaugagaaucua

SEQ ID NO: 1255008 - RNA, 22 nt, Human
ugaaugaggucagcaugucuau

SEQ ID NO: 1255009 - RNA, 16 nt, Human
ucuuucuuucaauaaa

SEQ ID NO: 1255010 - RNA, 13 nt, Human
ucuuucuuuauuu

SEQ ID NO: 1255011 - RNA, 16 nt, Human
ucuuucauuucuucua

SEQ ID NO: 1255012 - RNA, 20 nt, Human
ucuuuccauuggaucucauu

SEQ ID NO: 1255013 - RNA, 21 nt, Human
ucuuucauuugcuuuggaagu

SEQ ID NO: 1255014 - RNA, 19 nt, Human
ucuuuccacggagccacuc

SEQ ID NO: 1255015 - RNA, 22 nt, Human
ucuuuccacggagccacuccuc

SEQ ID NO: 1255016 - RNA, 23 nt, Human
ucuuuccacggagccacuccucu

SEQ ID NO: 1255017 - RNA, 15 nt, Human
ucuuucagcaagaua

SEQ ID NO: 1255018 - RNA, 21 nt, Human
ucuuucagcaagauaaacauu

SEQ ID NO: 1255019 - RNA, 11 nt, Human
ucuuucagcuc

SEQ ID NO: 1255020 - RNA, 13 nt, Human
ucuuucagcuccu

SEQ ID NO: 1255021 - RNA, 14 nt, Human
ucuuucagcuccug

SEQ ID NO: 1255022 - RNA, 15 nt, Human
ucuuucagcuccuga

SEQ ID NO: 1255023 - RNA, 12 nt, Human
ucuuugccaagu

SEQ ID NO: 1255024 - RNA, 12 nt, Human
ucuuugaaauua

SEQ ID NO: 1255025 - RNA, 15 nt, Human
ucuuugaaauuaugu

SEQ ID NO: 1255026 - RNA, 16 nt, Human
ucuuugaaauuaugua

SEQ ID NO: 1255027 - RNA, 12 nt, Human
ucuuugaauaaa

SEQ ID NO: 1255028 - RNA, 13 nt, Human
ucuuugaauaaau

SEQ ID NO: 1255029 - RNA, 20 nt, Human
ucuuugccacccucaugcug

SEQ ID NO: 1255030 - RNA, 18 nt, Human
ucuuugccacccucaugc

SEQ ID NO: 1255031 - RNA, 17 nt, Human
ucuuugccacccucaug

SEQ ID NO: 1255032 - RNA, 16 nt, Human
ucuuugccacccucau

SEQ ID NO: 1255033 - RNA, 14 nt, Human
ucuuugccacccuc

SEQ ID NO: 1255034 - RNA, 19 nt, Human
ucuuuggaaaguacacucu

SEQ ID NO: 1255035 - RNA, 16 nt, Human
ucuuuggaaaguacac

SEQ ID NO: 1255036 - RNA, 13 nt, Human
ucuuuuauaauuc

SEQ ID NO: 1255037 - RNA, 14 nt, Human
ucuuuuauaggauu

SEQ ID NO: 1255038 - RNA, 13 nt, Human
ucuugcuaccagu

SEQ ID NO: 1255039 - RNA, 21 nt, Human
ucuugcaguaucggcacugua

SEQ ID NO: 1255040 - RNA, 14 nt, Human
ucuugcuaccagua

SEQ ID NO: 1255041 - RNA, 20 nt, Human
ucuugcuaccaguauuuaga

SEQ ID NO: 1255042 - RNA, 22 nt, Human
ucuugcuggucuagucacgcau

SEQ ID NO: 1255043 - RNA, 18 nt, Human
ucuugcuucccuaaucua

SEQ ID NO: 1255044 - RNA, 22 nt, Human
ucuugcuucccuaaucuauggu

SEQ ID NO: 1255045 - RNA, 23 nt, Human
ucuugcuucccuaaucuaugguc

SEQ ID NO: 1255046 - RNA, 11 nt, Human
ucuugcuucuu

SEQ ID NO: 1255047 - RNA, 13 nt, Human
ucuccucuugcca

SEQ ID NO: 1255048 - RNA, 16 nt, Human
ucuccucuugccacug

SEQ ID NO: 1255049 - RNA, 13 nt, Human
ucucccuggugcu

SEQ ID NO: 1255050 - RNA, 16 nt, Human
ucucccuggugcuuau

SEQ ID NO: 1255051 - RNA, 14 nt, Human
ucucccuguacagu

SEQ ID NO: 1255052 - RNA, 18 nt, Human
ucucccuguacaguguua

SEQ ID NO: 1255053 - RNA, 22 nt, Human
ucuccucuugccacugccucuu

SEQ ID NO: 1255054 - RNA, 17 nt, Human
ucuccucuugccacugc

SEQ ID NO: 1255055 - RNA, 20 nt, Human
ucuugcacagucacugcucu

SEQ ID NO: 1255056 - RNA, 20 nt, Human
ucuugcaguaucggcacugu

SEQ ID NO: 1255057 - RNA, 23 nt, Human
ucuugcaggaaggacuaugaaaa

SEQ ID NO: 1255058 - RNA, 22 nt, Human
ucuugcaccccaaagcuuuccu

SEQ ID NO: 1255059 - RNA, 23 nt, Human
ucuugcaccccaaagcuuuccug

SEQ ID NO: 1255060 - RNA, 19 nt, Human
ucuugcacagucacugcuc

SEQ ID NO: 1255061 - RNA, 16 nt, Human
ucuugcuucuuucuag

SEQ ID NO: 1255062 - RNA, 17 nt, Human
ucuugcuucuuucuaga

SEQ ID NO: 1255063 - RNA, 18 nt, Human
ucuugcuucuuucuagaa

SEQ ID NO: 1255064 - RNA, 20 nt, Human
ucuugcuuggggaacuugug

SEQ ID NO: 1255065 - RNA, 13 nt, Human
ucuuguguuggcu

SEQ ID NO: 1255066 - RNA, 22 nt, Human
ucuuguguuuccacagccugca

SEQ ID NO: 1255067 - RNA, 13 nt, Human
ucuuguugagccg

SEQ ID NO: 1255068 - RNA, 17 nt, Human
ucuuguuggugcacagc

SEQ ID NO: 1255069 - RNA, 14 nt, Human
ucuuguuucaauuc

SEQ ID NO: 1255070 - RNA, 16 nt, Human
ucuuguuggugcacag

SEQ ID NO: 1255071 - RNA, 20 nt, Human
ucuuucaagcagucgugccu

SEQ ID NO: 1255072 - RNA, 21 nt, Human
ucuuucaagcagucgugccug

SEQ ID NO: 1255073 - RNA, 11 nt, Human
ucuuucaaaac

SEQ ID NO: 1255074 - RNA, 20 nt, Human
ucuuucaaaaccuuuugaaa

SEQ ID NO: 1255075 - RNA, 21 nt, Human
ucuuucaaaaccuuuugaaau

SEQ ID NO: 1255076 - RNA, 23 nt, Human
ucuuucaaaaccuuuugaaauua

SEQ ID NO: 1255077 - RNA, 22 nt, Human
ugaaauuaugugacauuuuaca

SEQ ID NO: 1255078 - RNA, 20 nt, Human
ugaaauuaugugacauuuua

SEQ ID NO: 1255079 - RNA, 12 nt, Human
ugaaauuauuca

SEQ ID NO: 1255080 - RNA, 16 nt, Human
ugaaauuccauuugua

SEQ ID NO: 1255081 - RNA, 14 nt, Human
ugaaauucuccugg

SEQ ID NO: 1255082 - RNA, 15 nt, Human
ugaaauucuccugga

SEQ ID NO: 1255083 - RNA, 16 nt, Human
ugaaauucuccuggag

SEQ ID NO: 1255084 - RNA, 15 nt, Human
ugaaauuccauuugu

SEQ ID NO: 1255085 - RNA, 19 nt, Human
ugaaauuccaaagucucua

SEQ ID NO: 1255086 - RNA, 16 nt, Human
ugaaauuccaaagucu

SEQ ID NO: 1255087 - RNA, 17 nt, Human
ugaaauuccaaagucuc

SEQ ID NO: 1255088 - RNA, 12 nt, Human
ugaaauuccaaa

SEQ ID NO: 1255089 - RNA, 14 nt, Human
ugaaauuccaaagu

SEQ ID NO: 1255090 - RNA, 15 nt, Human
ugaaauuccaaaguc

SEQ ID NO: 1255091 - RNA, 14 nt, Human
ugaaauuaaccucu

SEQ ID NO: 1255092 - RNA, 17 nt, Human
ugaaauuaaccucucac

SEQ ID NO: 1255093 - RNA, 22 nt, Human
ugaaauuaacuggguaaugaaa

SEQ ID NO: 1255094 - RNA, 19 nt, Human
ugaaauuaagaaggcaaaa

SEQ ID NO: 1255095 - RNA, 21 nt, Human
ugaaauuaagaaggcaaaaau

SEQ ID NO: 1255096 - RNA, 23 nt, Human
ugaaauuaagaaggcaaaaaugu

SEQ ID NO: 1255097 - RNA, 15 nt, Human
ugaaauuauguaaau

SEQ ID NO: 1255098 - RNA, 13 nt, Human
ugaaauuauguaa

SEQ ID NO: 1255099 - RNA, 15 nt, Human
ugaaaucauucauuu

SEQ ID NO: 1255100 - RNA, 16 nt, Human
ugaaaucaguuacucu

SEQ ID NO: 1255101 - RNA, 17 nt, Human
ugaaaucaguuacucuu

SEQ ID NO: 1255102 - RNA, 16 nt, Human
ugaaauauugacuuuu

SEQ ID NO: 1255103 - RNA, 19 nt, Human
ugaaagguuagagaauaaa

SEQ ID NO: 1255104 - RNA, 17 nt, Human
ugaaauggauacuuaua

SEQ ID NO: 1255105 - RNA, 12 nt, Human
ugaaauguaagg

SEQ ID NO: 1255106 - RNA, 20 nt, Human
ugaaauguaaggcuguguaa

SEQ ID NO: 1255107 - RNA, 15 nt, Human
ugaaauguaaggcug

SEQ ID NO: 1255108 - RNA, 19 nt, Human
ugaaauguaaggcugugua

SEQ ID NO: 1255109 - RNA, 19 nt, Human
ugaacaguuguguuugaag

SEQ ID NO: 1255110 - RNA, 17 nt, Human
ugaacaggaaacuccug

SEQ ID NO: 1255111 - RNA, 13 nt, Human
ugaacagcuggug

SEQ ID NO: 1255112 - RNA, 14 nt, Human
ugaacagcuggugu

SEQ ID NO: 1255113 - RNA, 15 nt, Human
ugaacagcuggugua

SEQ ID NO: 1255114 - RNA, 18 nt, Human
ugaacagcugguguagcu

SEQ ID NO: 1255115 - RNA, 19 nt, Human
ugaacagcugguguagcua

SEQ ID NO: 1255116 - RNA, 23 nt, Human
ugaacagcugguguagcuacaga

SEQ ID NO: 1255117 - RNA, 22 nt, Human
ugaacaggaaacuccugugacc

SEQ ID NO: 1255118 - RNA, 11 nt, Human
ugaacaagaau

SEQ ID NO: 1255119 - RNA, 12 nt, Human
ugaacaagaauu

SEQ ID NO: 1255120 - RNA, 14 nt, Human
ugaacaagaauugg

SEQ ID NO: 1255121 - RNA, 18 nt, Human
ugaacaagaauuggaagc

SEQ ID NO: 1255122 - RNA, 14 nt, Human
ugaacaagagaagc

SEQ ID NO: 1255123 - RNA, 16 nt, Human
ugaacaagagaagcau

SEQ ID NO: 1255124 - RNA, 17 nt, Human
ugaacaagagaagcauu

SEQ ID NO: 1255125 - RNA, 18 nt, Human
ugaacaagagaagcauuc

SEQ ID NO: 1255126 - RNA, 23 nt, Human
ugaacaagagaagcauucucauu

SEQ ID NO: 1255127 - RNA, 18 nt, Human
ugaacacaaacuguaaau

SEQ ID NO: 1255128 - RNA, 12 nt, Human
ugaacaguggag

SEQ ID NO: 1255129 - RNA, 20 nt, Human
ugaacauugguucuuucauu

SEQ ID NO: 1255130 - RNA, 16 nt, Human
ugaaaagcagacauuu

SEQ ID NO: 1255131 - RNA, 22 nt, Human
ugaaaagcagguugauaaauca

SEQ ID NO: 1255132 - RNA, 19 nt, Human
ugaaaagcagguugauaaa

SEQ ID NO: 1255133 - RNA, 18 nt, Human
ugaaaagcagguugauaa

SEQ ID NO: 1255134 - RNA, 17 nt, Human
ugaaaagcuagaauuga

SEQ ID NO: 1255135 - RNA, 22 nt, Human
ucuuuuauaauucucauuaaaa

SEQ ID NO: 1255136 - RNA, 18 nt, Human
ucuuuuauacucagcuuu

SEQ ID NO: 1255137 - RNA, 20 nt, Human
ugaaaagcuccauuuuuagu

SEQ ID NO: 1255138 - RNA, 16 nt, Human
ugaaacauuuucuccc

SEQ ID NO: 1255139 - RNA, 18 nt, Human
ugaaacauuuucucccug

SEQ ID NO: 1255140 - RNA, 19 nt, Human
ugaaacauuuucucccugg

SEQ ID NO: 1255141 - RNA, 20 nt, Human
ugaaaccaguguuagggaag

SEQ ID NO: 1255142 - RNA, 23 nt, Human
ugaaacaaagaguucaagaaaua

SEQ ID NO: 1255143 - RNA, 14 nt, Human
ugaaacaaagaguu

SEQ ID NO: 1255144 - RNA, 15 nt, Human
ugaaacaacuuggaa

SEQ ID NO: 1255145 - RNA, 16 nt, Human
ugaaacaacuuggaaa

SEQ ID NO: 1255146 - RNA, 17 nt, Human
ugaaacaagaagccaca

SEQ ID NO: 1255147 - RNA, 16 nt, Human
ugaaagguacuucaaa

SEQ ID NO: 1255148 - RNA, 16 nt, Human
ugaaagguaauuugag

SEQ ID NO: 1255149 - RNA, 15 nt, Human
ugaaagguacuucaa

SEQ ID NO: 1255150 - RNA, 15 nt, Human
ugaaagcuacucaua

SEQ ID NO: 1255151 - RNA, 16 nt, Human
ugaaagcugauuuuuu

SEQ ID NO: 1255152 - RNA, 16 nt, Human
ugaaagaugaucauuu

SEQ ID NO: 1255153 - RNA, 19 nt, Human
ugaaagaggcugaggccug

SEQ ID NO: 1255154 - RNA, 21 nt, Human
ugaaagaggcugaggccugga

SEQ ID NO: 1255155 - RNA, 18 nt, Human
ugaaacccugucucuacu

SEQ ID NO: 1255156 - RNA, 20 nt, Human
ugaaaccccuguaggccuca

SEQ ID NO: 1255157 - RNA, 16 nt, Human
ugaaagccauggagau

SEQ ID NO: 1255158 - RNA, 13 nt, Human
ugaaagccaugga

SEQ ID NO: 1255159 - RNA, 19 nt, Human
ugaaagauggcugugccuc

SEQ ID NO: 1255160 - RNA, 18 nt, Human
ugaaagauggcugugccu

SEQ ID NO: 1255161 - RNA, 23 nt, Human
ugaaagccaaggagucacugaga

SEQ ID NO: 1255162 - RNA, 16 nt, Human
ugaggagcuugaaacc

SEQ ID NO: 1255163 - RNA, 22 nt, Human
ugagcuggggaccugguacccu

SEQ ID NO: 1255164 - RNA, 16 nt, Human
ugagcugucaacgaga

SEQ ID NO: 1255165 - RNA, 12 nt, Human
ugaggagcuggg

SEQ ID NO: 1255166 - RNA, 13 nt, Human
ugaggagcugggg

SEQ ID NO: 1255167 - RNA, 20 nt, Human
ugaggagcuggggaucccuc

SEQ ID NO: 1255168 - RNA, 23 nt, Human
ugaggcaucgcaauguaagacuc

SEQ ID NO: 1255169 - RNA, 17 nt, Human
ugagggagaacaagacc

SEQ ID NO: 1255170 - RNA, 14 nt, Human
ugagggagccuggc

SEQ ID NO: 1255171 - RNA, 20 nt, Human
ugaggcuccacuuggucugu

SEQ ID NO: 1255172 - RNA, 18 nt, Human
ugaggcuccacuuggucu

SEQ ID NO: 1255173 - RNA, 16 nt, Human
ugaggucucagccccu

SEQ ID NO: 1255174 - RNA, 13 nt, Human
ugagguccugagc

SEQ ID NO: 1255175 - RNA, 14 nt, Human
ugagguccugagca

SEQ ID NO: 1255176 - RNA, 15 nt, Human
ugagguccugagcac

SEQ ID NO: 1255177 - RNA, 16 nt, Human
ugagguccugagcacu

SEQ ID NO: 1255178 - RNA, 17 nt, Human
ugagguccugagcacug

SEQ ID NO: 1255179 - RNA, 18 nt, Human
ugagguccugagcacugc

SEQ ID NO: 1255180 - RNA, 19 nt, Human
ugagguccugagcacugcc

SEQ ID NO: 1255181 - RNA, 23 nt, Human
ugagguccugagcacugccagga

SEQ ID NO: 1255182 - RNA, 20 nt, Human
ugagguccugagcacugcca

SEQ ID NO: 1255183 - RNA, 21 nt, Human
ugagguccugagcacugccag

SEQ ID NO: 1255184 - RNA, 22 nt, Human
ugagguccugagcacugccagg

SEQ ID NO: 1255185 - RNA, 13 nt, Human
ugaggucucagcc

SEQ ID NO: 1255186 - RNA, 14 nt, Human
ugaggucucagccc

SEQ ID NO: 1255187 - RNA, 15 nt, Human
ugaggucucagcccc

SEQ ID NO: 1255188 - RNA, 17 nt, Human
ugaggucucagccccuu

SEQ ID NO: 1255189 - RNA, 16 nt, Human
ugauaacuggaaacuu

SEQ ID NO: 1255190 - RNA, 19 nt, Human
ugaguuugucgcucaugug

SEQ ID NO: 1255191 - RNA, 20 nt, Human
ugaguuugucgcucaugugu

SEQ ID NO: 1255192 - RNA, 13 nt, Human
ugaguuuuaccaa

SEQ ID NO: 1255193 - RNA, 12 nt, Human
ugaguuuuacca

SEQ ID NO: 1255194 - RNA, 19 nt, Human
ugaguuuuccauggcagga

SEQ ID NO: 1255195 - RNA, 13 nt, Human
ugaguuuuccaug

SEQ ID NO: 1255196 - RNA, 17 nt, Human
ugaguuuuguguuuguu

SEQ ID NO: 1255197 - RNA, 21 nt, Human
ugaguuuuguguuuguuguag

SEQ ID NO: 1255198 - RNA, 18 nt, Human
ugaguuuuguguuuguug

SEQ ID NO: 1255199 - RNA, 15 nt, Human
ugaguucucccugua

SEQ ID NO: 1255200 - RNA, 22 nt, Human
ugaguuugggccccagaggcug

SEQ ID NO: 1255201 - RNA, 23 nt, Human
ugaguuugggccccagaggcugg

SEQ ID NO: 1255202 - RNA, 15 nt, Human
ugagucccaggcuga

SEQ ID NO: 1255203 - RNA, 19 nt, Human
ugagucccaggcugagccu

SEQ ID NO: 1255204 - RNA, 17 nt, Human
ugagucguacagaaagc

SEQ ID NO: 1255205 - RNA, 19 nt, Human
ugagucguacagaaagcug

SEQ ID NO: 1255206 - RNA, 17 nt, Human
ugagucgugaccugcua

SEQ ID NO: 1255207 - RNA, 15 nt, Human
ugagucuagauguuu

SEQ ID NO: 1255208 - RNA, 15 nt, Human
ugagucucucugggc

SEQ ID NO: 1255209 - RNA, 16 nt, Human
ugagucuuugguucua

SEQ ID NO: 1255210 - RNA, 17 nt, Human
ugagucuuugguucuaa

SEQ ID NO: 1255211 - RNA, 18 nt, Human
ugagucuuugguucuaag

SEQ ID NO: 1255212 - RNA, 20 nt, Human
ugagucuuugguucuaagga

SEQ ID NO: 1255213 - RNA, 21 nt, Human
ugagucuuugguucuaaggac

SEQ ID NO: 1255214 - RNA, 15 nt, Human
ugagugaauaaaugu

SEQ ID NO: 1255215 - RNA, 19 nt, Human
ugagaccaccucucaauau

SEQ ID NO: 1255216 - RNA, 18 nt, Human
ugagacccagcccucauc

SEQ ID NO: 1255217 - RNA, 20 nt, Human
ugagacccagcccucauccc

SEQ ID NO: 1255218 - RNA, 15 nt, Human
ugagaccaccucuca

SEQ ID NO: 1255219 - RNA, 12 nt, Human
ugagaccaccuc

SEQ ID NO: 1255220 - RNA, 14 nt, Human
ugagaccacuguua

SEQ ID NO: 1255221 - RNA, 12 nt, Human
ugagaaccuggg

SEQ ID NO: 1255222 - RNA, 21 nt, Human
ugagaaccuggguugcagaca

SEQ ID NO: 1255223 - RNA, 23 nt, Human
ugagaaccuggguugcagacagg

SEQ ID NO: 1255224 - RNA, 22 nt, Human
ugagaaccuggguugcagacag

SEQ ID NO: 1255225 - RNA, 17 nt, Human
ugagacuccagaccuga

SEQ ID NO: 1255226 - RNA, 22 nt, Human
ugagacuaaucuuauucauuuu

SEQ ID NO: 1255227 - RNA, 17 nt, Human
ugagaaauuuauaaacu

SEQ ID NO: 1255228 - RNA, 20 nt, Human
ugaccucaggcaaucugccc

SEQ ID NO: 1255229 - RNA, 20 nt, Human
ugagaaccguagaugauuuc

SEQ ID NO: 1255230 - RNA, 12 nt, Human
ugagaaccuggc

SEQ ID NO: 1255231 - RNA, 14 nt, Human
ugagaaccuggccu

SEQ ID NO: 1255232 - RNA, 15 nt, Human
ugagaaccuggccuu

SEQ ID NO: 1255233 - RNA, 16 nt, Human
ugagaaccuggccuuc

SEQ ID NO: 1255234 - RNA, 22 nt, Human
ugaccucagcuuugauauuuca

SEQ ID NO: 1255235 - RNA, 21 nt, Human
ugaccucaggcaaucugcccg

SEQ ID NO: 1255236 - RNA, 19 nt, Human
ugaccgcgacuaauuucaa

SEQ ID NO: 1255237 - RNA, 16 nt, Human
ugaccggacuuuucug

SEQ ID NO: 1255238 - RNA, 19 nt, Human
ugaccggacuuuucugcaa

SEQ ID NO: 1255239 - RNA, 16 nt, Human
ugagagugaacaaauu

SEQ ID NO: 1255240 - RNA, 21 nt, Human
ugagacuaaucuuauucauuu

SEQ ID NO: 1255241 - RNA, 13 nt, Human
ugagagucuagau

SEQ ID NO: 1255242 - RNA, 14 nt, Human
ugagagucuagauu

SEQ ID NO: 1255243 - RNA, 15 nt, Human
ugagagucuagauuc

SEQ ID NO: 1255244 - RNA, 17 nt, Human
ugagagucuagauucuc

SEQ ID NO: 1255245 - RNA, 16 nt, Human
ugagagucuagauucu

SEQ ID NO: 1255246 - RNA, 12 nt, Human
ugagagugugac

SEQ ID NO: 1255247 - RNA, 14 nt, Human
ugagagugugacca

SEQ ID NO: 1255248 - RNA, 13 nt, Human
ugagagugugacc

SEQ ID NO: 1255249 - RNA, 17 nt, Human
ugagauaguuuucaucc

SEQ ID NO: 1255250 - RNA, 18 nt, Human
ugagauaguuuucaucca

SEQ ID NO: 1255251 - RNA, 21 nt, Human
ugagauaguuuucauccauaa

SEQ ID NO: 1255252 - RNA, 12 nt, Human
ugagauauuaau

SEQ ID NO: 1255253 - RNA, 13 nt, Human
ugagauauuaaug

SEQ ID NO: 1255254 - RNA, 20 nt, Human
ugagauauuaaugcccagac

SEQ ID NO: 1255255 - RNA, 19 nt, Human
ugagauauuaaugcccaga

SEQ ID NO: 1255256 - RNA, 20 nt, Human
ugagcaguccuuggccugcu

SEQ ID NO: 1255257 - RNA, 16 nt, Human
ugagcaguguuagcuu

SEQ ID NO: 1255258 - RNA, 18 nt, Human
ugagcaguggcuggucca

SEQ ID NO: 1255259 - RNA, 22 nt, Human
ugagcaguggcugguccagggc

SEQ ID NO: 1255260 - RNA, 12 nt, Human
ugagcaguggcu

SEQ ID NO: 1255261 - RNA, 13 nt, Human
ugagcaguggcug

SEQ ID NO: 1255262 - RNA, 14 nt, Human
ugagcaguggcugg

SEQ ID NO: 1255263 - RNA, 15 nt, Human
ugagcaguggcuggu

SEQ ID NO: 1255264 - RNA, 13 nt, Human
ugagcauagguga

SEQ ID NO: 1255265 - RNA, 21 nt, Human
ugagcauaggugauccaugua

SEQ ID NO: 1255266 - RNA, 23 nt, Human
ugagcauaggugauccauguaac

SEQ ID NO: 1255267 - RNA, 12 nt, Human
ugagcaucacag

SEQ ID NO: 1255268 - RNA, 18 nt, Human
ugagcaucacagaaugug

SEQ ID NO: 1255269 - RNA, 13 nt, Human
ugagcaucacaga

SEQ ID NO: 1255270 - RNA, 14 nt, Human
ugagcaucacagaa

SEQ ID NO: 1255271 - RNA, 15 nt, Human
ugagcaucacagaau

SEQ ID NO: 1255272 - RNA, 14 nt, Human
ugagccccagggag

SEQ ID NO: 1255273 - RNA, 18 nt, Human
ugagcccuguccugccua

SEQ ID NO: 1255274 - RNA, 15 nt, Human
ugagccccuggaggc

SEQ ID NO: 1255275 - RNA, 14 nt, Human
ugagccucagucuc

SEQ ID NO: 1255276 - RNA, 13 nt, Human
ugagccugccgag

SEQ ID NO: 1255277 - RNA, 18 nt, Human
ugagcuccuguccccugc

SEQ ID NO: 1255278 - RNA, 20 nt, Human
ugagcuccuguccccugcua

SEQ ID NO: 1255279 - RNA, 19 nt, Human
ugagcuccuuaaggcucuu

SEQ ID NO: 1255280 - RNA, 21 nt, Human
ugagcuccuuaaggcucuuuu

SEQ ID NO: 1255281 - RNA, 21 nt, Human
ugagcuccuguccccugcuac

SEQ ID NO: 1255282 - RNA, 22 nt, Human
ugagcuccuguccccugcuaca

SEQ ID NO: 1255283 - RNA, 20 nt, Human
ugagcucuauuaugaaugug

SEQ ID NO: 1255284 - RNA, 18 nt, Human
ugagcuggaccucaccaa

SEQ ID NO: 1255285 - RNA, 19 nt, Human
ugauucugauguacucuaa

SEQ ID NO: 1255286 - RNA, 16 nt, Human
ugauucugcaguaaau

SEQ ID NO: 1255287 - RNA, 22 nt, Human
ugauucugcaguaaaucuuuua

SEQ ID NO: 1255288 - RNA, 12 nt, Human
ugauucugccuu

SEQ ID NO: 1255289 - RNA, 13 nt, Human
ugauucugccuuu

SEQ ID NO: 1255290 - RNA, 21 nt, Human
ugauugaccguguuggucugu

SEQ ID NO: 1255291 - RNA, 12 nt, Human
ugauugauuuga

SEQ ID NO: 1255292 - RNA, 14 nt, Human
ugauugauuugaag

SEQ ID NO: 1255293 - RNA, 15 nt, Human
ugauugaugacccuu

SEQ ID NO: 1255294 - RNA, 20 nt, Human
ugauuggcaggaguuggaag

SEQ ID NO: 1255295 - RNA, 21 nt, Human
ugauuggccuguagaguugcu

SEQ ID NO: 1255296 - RNA, 21 nt, Human
ugauuguggaauggagauuca

SEQ ID NO: 1255297 - RNA, 18 nt, Human
ugauugucuuaauauugu

SEQ ID NO: 1255298 - RNA, 20 nt, Human
ugauuguaguaaucugcauu

SEQ ID NO: 1255299 - RNA, 16 nt, Human
ugauuguauuguugaa

SEQ ID NO: 1255300 - RNA, 13 nt, Human
ugauugucuuaau

SEQ ID NO: 1255301 - RNA, 14 nt, Human
ugauugucuuaaua

SEQ ID NO: 1255302 - RNA, 14 nt, Human
ugauuguggaaugg

SEQ ID NO: 1255303 - RNA, 18 nt, Human
ugauuguggaauggagau

SEQ ID NO: 1255304 - RNA, 13 nt, Human
ugauuauauguca

SEQ ID NO: 1255305 - RNA, 17 nt, Human
ugauuaugaauuacauu

SEQ ID NO: 1255306 - RNA, 19 nt, Human
ugauuaugaauuacauuug

SEQ ID NO: 1255307 - RNA, 22 nt, Human
ugauuagugaaaggaagauaaa

SEQ ID NO: 1255308 - RNA, 19 nt, Human
ugauuagcuuugucacugu

SEQ ID NO: 1255309 - RNA, 17 nt, Human
ugauuagacagaacacc

SEQ ID NO: 1255310 - RNA, 20 nt, Human
ugauuacuggccuuuuucau

SEQ ID NO: 1255311 - RNA, 21 nt, Human
ugauuacuggccuuuuucauu

SEQ ID NO: 1255312 - RNA, 23 nt, Human
ugauuacuggccuuuuucauuua

SEQ ID NO: 1255313 - RNA, 23 nt, Human
ugauuagaaauuaccuguggaua

SEQ ID NO: 1255314 - RNA, 13 nt, Human
ugauuagacagaa

SEQ ID NO: 1255315 - RNA, 15 nt, Human
ugauuagacagaaca

SEQ ID NO: 1255316 - RNA, 16 nt, Human
ugauuagacagaacac

SEQ ID NO: 1255317 - RNA, 22 nt, Human
ugauguuuagaaacacaacuau

SEQ ID NO: 1255318 - RNA, 18 nt, Human
ugauguucuaaggcucug

SEQ ID NO: 1255319 - RNA, 19 nt, Human
ugauguucuaaggcucuga

SEQ ID NO: 1255320 - RNA, 20 nt, Human
ugauguucuaaggcucugag

SEQ ID NO: 1255321 - RNA, 21 nt, Human
ugauguucuaaggcucugaga

SEQ ID NO: 1255322 - RNA, 22 nt, Human
ugauguucuaaggcucugagag

SEQ ID NO: 1255323 - RNA, 13 nt, Human
ugauguuccuucc

SEQ ID NO: 1255324 - RNA, 12 nt, Human
ugauguucuaag

SEQ ID NO: 1255325 - RNA, 14 nt, Human
ugauguucuaaggc

SEQ ID NO: 1255326 - RNA, 15 nt, Human
ugauguucuaaggcu

SEQ ID NO: 1255327 - RNA, 17 nt, Human
ugauguucuaaggcucu

SEQ ID NO: 1255328 - RNA, 21 nt, Human
ugauuaugaauuacauuugua

SEQ ID NO: 1255329 - RNA, 22 nt, Human
ugauuaugaauuacauuuguau

SEQ ID NO: 1255330 - RNA, 20 nt, Human
ugauuauuaacgauguccaa

SEQ ID NO: 1255331 - RNA, 14 nt, Human
ugauuauucagugu

SEQ ID NO: 1255332 - RNA, 16 nt, Human
ugauuauucaguguca

SEQ ID NO: 1255333 - RNA, 20 nt, Human
ugauuauuuuuuucuguaaa

SEQ ID NO: 1255334 - RNA, 16 nt, Human
ugauucaaucuguaaa

SEQ ID NO: 1255335 - RNA, 17 nt, Human
ugauucaaucuguaaac

SEQ ID NO: 1255336 - RNA, 21 nt, Human
ugauucaaucuguaaacugug

SEQ ID NO: 1255337 - RNA, 22 nt, Human
ugauucaaucuguaaacugugu

SEQ ID NO: 1255338 - RNA, 23 nt, Human
ugauucaaucuguaaacugugua

SEQ ID NO: 1255339 - RNA, 12 nt, Human
ugauucacagug

SEQ ID NO: 1255340 - RNA, 19 nt, Human
ugauucaauuugauguggu

SEQ ID NO: 1255341 - RNA, 16 nt, Human
ugauucaauuugaugu

SEQ ID NO: 1255342 - RNA, 14 nt, Human
ugauucaauuugau

SEQ ID NO: 1255343 - RNA, 16 nt, Human
ugauucacaucucauu

SEQ ID NO: 1255344 - RNA, 16 nt, Human
ugauucaccucuucuu

SEQ ID NO: 1255345 - RNA, 18 nt, Human
ugauucagaaaauguucu

SEQ ID NO: 1255346 - RNA, 19 nt, Human
ugauucagaaaauguucug

SEQ ID NO: 1255347 - RNA, 20 nt, Human
ugauucagaaaauguucugu

SEQ ID NO: 1255348 - RNA, 21 nt, Human
ugauucagaaaauguucuguu

SEQ ID NO: 1255349 - RNA, 22 nt, Human
ugauucagaaaauguucuguuu

SEQ ID NO: 1255350 - RNA, 21 nt, Human
ugaugguuguacauauaagug

SEQ ID NO: 1255351 - RNA, 17 nt, Human
ugaugucaauuucugug

SEQ ID NO: 1255352 - RNA, 14 nt, Human
ugaugguuguacau

SEQ ID NO: 1255353 - RNA, 13 nt, Human
ugaugguuguaca

SEQ ID NO: 1255354 - RNA, 14 nt, Human
ugaugguuccccug

SEQ ID NO: 1255355 - RNA, 16 nt, Human
ugauguggugaaaagc

SEQ ID NO: 1255356 - RNA, 12 nt, Human
ugauguuaaaaa

SEQ ID NO: 1255357 - RNA, 13 nt, Human
ugauguuaaaaaa

SEQ ID NO: 1255358 - RNA, 14 nt, Human
ugauguuaaaaaaa

SEQ ID NO: 1255359 - RNA, 23 nt, Human
ugauguuaaaaaaauaagaagaa

SEQ ID NO: 1255360 - RNA, 19 nt, Human
ugaugucccaacuuguaaa

SEQ ID NO: 1255361 - RNA, 22 nt, Human
ugaugucauacagagaagucac

SEQ ID NO: 1255362 - RNA, 20 nt, Human
ugaugucauacagagaaguc

SEQ ID NO: 1255363 - RNA, 21 nt, Human
ugaugucauacagagaaguca

SEQ ID NO: 1255364 - RNA, 18 nt, Human
ugaugucaauuucugugu

SEQ ID NO: 1255365 - RNA, 19 nt, Human
ugaugucaauuucuguguu

SEQ ID NO: 1255366 - RNA, 23 nt, Human
ugaugucaauuucuguguugcca

SEQ ID NO: 1255367 - RNA, 14 nt, Human
ugaugucauacaga

SEQ ID NO: 1255368 - RNA, 15 nt, Human
ugaugucauacagag

SEQ ID NO: 1255369 - RNA, 16 nt, Human
ugaugucauacagaga

SEQ ID NO: 1255370 - RNA, 17 nt, Human
ugaugucauacagagaa

SEQ ID NO: 1255371 - RNA, 18 nt, Human
ugaugucauacagagaag

SEQ ID NO: 1255372 - RNA, 19 nt, Human
ugaugucauacagagaagu

SEQ ID NO: 1255373 - RNA, 11 nt, Human
ugaugccuggc

SEQ ID NO: 1255374 - RNA, 15 nt, Human
ugaugccugugaacu

SEQ ID NO: 1255375 - RNA, 20 nt, Human
ugaugccugugaacugaacu

SEQ ID NO: 1255376 - RNA, 20 nt, Human
ugaugcuacaggauuugaaa

SEQ ID NO: 1255377 - RNA, 23 nt, Human
ugaugcuacaggauuugaaauug

SEQ ID NO: 1255378 - RNA, 21 nt, Human
ugaugccucugucuucuggac

SEQ ID NO: 1255379 - RNA, 21 nt, Human
ugaugccugugaacugaacuc

SEQ ID NO: 1255380 - RNA, 20 nt, Human
ugaugcuaaaaccugaaauu

SEQ ID NO: 1255381 - RNA, 20 nt, Human
ugaugauuuagagugcuguc

SEQ ID NO: 1255382 - RNA, 21 nt, Human
ugaugcagcuuauacgaaaua

SEQ ID NO: 1255383 - RNA, 21 nt, Human
ugaugcaucagaaagggaggg

SEQ ID NO: 1255384 - RNA, 22 nt, Human
ugaugcaucagaaagggagggc

SEQ ID NO: 1255385 - RNA, 17 nt, Human
ugaugcaugcacuguuc

SEQ ID NO: 1255386 - RNA, 18 nt, Human
ugaugcaugcacuguucc

SEQ ID NO: 1255387 - RNA, 23 nt, Human
ugaugcaugcacuguucccccug

SEQ ID NO: 1255388 - RNA, 14 nt, Human
ugaugccucugucu

SEQ ID NO: 1255389 - RNA, 17 nt, Human
ugaucagcuuauugucu

SEQ ID NO: 1255390 - RNA, 18 nt, Human
ugauagcaaauggccuca

SEQ ID NO: 1255391 - RNA, 24 nt, Human
ugaucagcuuauugucuagugaaa

SEQ ID NO: 1255392 - RNA, 14 nt, Human
ugauagauuuucug

SEQ ID NO: 1255393 - RNA, 22 nt, Human
ugaucauguguggaaguuauua

SEQ ID NO: 1255394 - RNA, 13 nt, Human
ugauccaacuaau

SEQ ID NO: 1255395 - RNA, 14 nt, Human
ugauccaacuaaug

SEQ ID NO: 1255396 - RNA, 15 nt, Human
ugaucugugggcaca

SEQ ID NO: 1255397 - RNA, 19 nt, Human
ugaucugucuguggcaaaa

SEQ ID NO: 1255398 - RNA, 14 nt, Human
ugaucugucugugg

SEQ ID NO: 1255399 - RNA, 17 nt, Human
ugaucugucuguggcaa

SEQ ID NO: 1255400 - RNA, 15 nt, Human
ugaucuggaacccag

SEQ ID NO: 1255401 - RNA, 17 nt, Human
ugaucuggaacccagac

SEQ ID NO: 1255402 - RNA, 18 nt, Human
ugaucuggaacccagacu

SEQ ID NO: 1255403 - RNA, 19 nt, Human
ugaucuggaacccagacuc

SEQ ID NO: 1255404 - RNA, 17 nt, Human
ugaucugggucucuaau

SEQ ID NO: 1255405 - RNA, 18 nt, Human
ugaucuccguggcuuugg

SEQ ID NO: 1255406 - RNA, 15 nt, Human
ugaucuccguggcuu

SEQ ID NO: 1255407 - RNA, 18 nt, Human
ucuccagccucagcucuc

SEQ ID NO: 1255408 - RNA, 19 nt, Human
ucuccagccucagccuccc

SEQ ID NO: 1255409 - RNA, 16 nt, Human
ucuccagcggcccugu

SEQ ID NO: 1255410 - RNA, 18 nt, Human
ucuccagcggcccuguca

SEQ ID NO: 1255411 - RNA, 20 nt, Human
ucuccagcggcccugucauc

SEQ ID NO: 1255412 - RNA, 12 nt, Human
ucuccagcugac

SEQ ID NO: 1255413 - RNA, 14 nt, Human
ucuccagcugacua

SEQ ID NO: 1255414 - RNA, 15 nt, Human
ucuccagcugacuaa

SEQ ID NO: 1255415 - RNA, 11 nt, Human
ucuccagcugg

SEQ ID NO: 1255416 - RNA, 17 nt, Human
ucuccagcugggcucug

SEQ ID NO: 1255417 - RNA, 19 nt, Human
ucuccagcugggcucugca

SEQ ID NO: 1255418 - RNA, 16 nt, Human
ucuccagccucagccu

SEQ ID NO: 1255419 - RNA, 14 nt, Human
ucuccacugccuuc

SEQ ID NO: 1255420 - RNA, 14 nt, Human
ucuccacuuucagc

SEQ ID NO: 1255421 - RNA, 15 nt, Human
ucuccacuuucagcu

SEQ ID NO: 1255422 - RNA, 16 nt, Human
ucuccacuuucagcug

SEQ ID NO: 1255423 - RNA, 17 nt, Human
ucuccacuuucagcugu

SEQ ID NO: 1255424 - RNA, 18 nt, Human
ucuccacuuucagcuguc

SEQ ID NO: 1255425 - RNA, 19 nt, Human
ucuccacuuucagcugucu

SEQ ID NO: 1255426 - RNA, 18 nt, Human
ucuccagaaagccccacc

SEQ ID NO: 1255427 - RNA, 17 nt, Human
ucuccagaggccaagga

SEQ ID NO: 1255428 - RNA, 21 nt, Human
ucuccagcugggcucugcaau

SEQ ID NO: 1255429 - RNA, 15 nt, Human
ucuccaggcaggucu

SEQ ID NO: 1255430 - RNA, 19 nt, Human
ucuccccagguccagcucu

SEQ ID NO: 1255431 - RNA, 20 nt, Human
ucuccccagguccagcucug

SEQ ID NO: 1255432 - RNA, 22 nt, Human
ucuccccagguccagcucugga

SEQ ID NO: 1255433 - RNA, 12 nt, Human
ucucccccaaca

SEQ ID NO: 1255434 - RNA, 17 nt, Human
ucucccccaacagcugg

SEQ ID NO: 1255435 - RNA, 21 nt, Human
ucucccccaacagcuggaccc

SEQ ID NO: 1255436 - RNA, 12 nt, Human
ucuccccugcac

SEQ ID NO: 1255437 - RNA, 13 nt, Human
ucuccccugcacu

SEQ ID NO: 1255438 - RNA, 14 nt, Human
ucuccccugcacug

SEQ ID NO: 1255439 - RNA, 15 nt, Human
ucuccccugcacugu

SEQ ID NO: 1255440 - RNA, 16 nt, Human
ucuccccugcacugua

SEQ ID NO: 1255441 - RNA, 17 nt, Human
ucuccccugcacuguaa

SEQ ID NO: 1255442 - RNA, 21 nt, Human
ucuccccugcacuguaaaaug

SEQ ID NO: 1255443 - RNA, 12 nt, Human
ucuccccugccc

SEQ ID NO: 1255444 - RNA, 14 nt, Human
ucuccccugccccc

SEQ ID NO: 1255445 - RNA, 18 nt, Human
ucucccuccucugcccgg

SEQ ID NO: 1255446 - RNA, 21 nt, Human
ucucccuccuccaggaagccu

SEQ ID NO: 1255447 - RNA, 15 nt, Human
ucucccugcauggca

SEQ ID NO: 1255448 - RNA, 14 nt, Human
ucucccucccuugg

SEQ ID NO: 1255449 - RNA, 19 nt, Human
ucucccugcauggcauccu

SEQ ID NO: 1255450 - RNA, 15 nt, Human
ucucccugccuccug

SEQ ID NO: 1255451 - RNA, 20 nt, Human
ucucccuggaaugaguugag

SEQ ID NO: 1255452 - RNA, 16 nt, Human
ucucauacccucccuc

SEQ ID NO: 1255453 - RNA, 16 nt, Human
ucucagugaagaauac

SEQ ID NO: 1255454 - RNA, 15 nt, Human
ucucagucugucacc

SEQ ID NO: 1255455 - RNA, 18 nt, Human
ucucagucucugagcagu

SEQ ID NO: 1255456 - RNA, 15 nt, Human
ucucagucucugagc

SEQ ID NO: 1255457 - RNA, 17 nt, Human
ucucagucucugagcag

SEQ ID NO: 1255458 - RNA, 23 nt, Human
ucucaguccaugaagauguagag

SEQ ID NO: 1255459 - RNA, 11 nt, Human
ucucagucucu

SEQ ID NO: 1255460 - RNA, 13 nt, Human
ucucagucucuga

SEQ ID NO: 1255461 - RNA, 14 nt, Human
ucuaugagucuaga

SEQ ID NO: 1255462 - RNA, 15 nt, Human
ucuaugagucuagau

SEQ ID NO: 1255463 - RNA, 16 nt, Human
ucuaugagucuagaug

SEQ ID NO: 1255464 - RNA, 15 nt, Human
ucucauccugcaggc

SEQ ID NO: 1255465 - RNA, 19 nt, Human
ucucaucucagugaagaau

SEQ ID NO: 1255466 - RNA, 20 nt, Human
ucucaucucagugaagaaua

SEQ ID NO: 1255467 - RNA, 18 nt, Human
ucucaucucuucuuuuaa

SEQ ID NO: 1255468 - RNA, 22 nt, Human
ucucaucuggggagcaggcagc

SEQ ID NO: 1255469 - RNA, 11 nt, Human
ucucaucuggg

SEQ ID NO: 1255470 - RNA, 13 nt, Human
ucucaugaaccuc

SEQ ID NO: 1255471 - RNA, 14 nt, Human
ucucaugaaccuca

SEQ ID NO: 1255472 - RNA, 16 nt, Human
ucucaugccucagccu

SEQ ID NO: 1255473 - RNA, 19 nt, Human
ucucaugccucagccuccu

SEQ ID NO: 1255474 - RNA, 13 nt, Human
ucucaugccucag

SEQ ID NO: 1255475 - RNA, 18 nt, Human
ucucaugccccuggcugg

SEQ ID NO: 1255476 - RNA, 21 nt, Human
ucucaugccccuggcugggac

SEQ ID NO: 1255477 - RNA, 22 nt, Human
ucucaugaaccucaagcugcau

SEQ ID NO: 1255478 - RNA, 12 nt, Human
ucucaugccagu

SEQ ID NO: 1255479 - RNA, 20 nt, Human
ucucaugccaguaacaggcu

SEQ ID NO: 1255480 - RNA, 20 nt, Human
ucucaugccucagccuccug

SEQ ID NO: 1255481 - RNA, 13 nt, Human
ucuccacuccaga

SEQ ID NO: 1255482 - RNA, 17 nt, Human
ucuacacuaagagagaa

SEQ ID NO: 1255483 - RNA, 13 nt, Human
ucuacaaaacauu

SEQ ID NO: 1255484 - RNA, 18 nt, Human
ucuacaaaacauuaaacu

SEQ ID NO: 1255485 - RNA, 18 nt, Human
ucuacaaaauccugauga

SEQ ID NO: 1255486 - RNA, 17 nt, Human
ucuacaacucauacacu

SEQ ID NO: 1255487 - RNA, 21 nt, Human
ucuacaacucauacacucgua

SEQ ID NO: 1255488 - RNA, 16 nt, Human
ucuacagagcuucccu

SEQ ID NO: 1255489 - RNA, 17 nt, Human
ucuacagagcuucccug

SEQ ID NO: 1255490 - RNA, 18 nt, Human
ucuacagagcuucccuga

SEQ ID NO: 1255491 - RNA, 19 nt, Human
ucuacagagcuucccugac

SEQ ID NO: 1255492 - RNA, 15 nt, Human
ucuaccuggucuggu

SEQ ID NO: 1255493 - RNA, 15 nt, Human
ucuaccuucucccca

SEQ ID NO: 1255494 - RNA, 16 nt, Human
ucuaccuucuccccag

SEQ ID NO: 1255495 - RNA, 18 nt, Human
ucuaccuucuccccagcu

SEQ ID NO: 1255496 - RNA, 23 nt, Human
ucuaccuucuccccagcucccag

SEQ ID NO: 1255497 - RNA, 20 nt, Human
ucuaccuucuccccagcucc

SEQ ID NO: 1255498 - RNA, 12 nt, Human
ucuacuaaaaau

SEQ ID NO: 1255499 - RNA, 20 nt, Human
ucuacugggaaggcuacuuc

SEQ ID NO: 1255500 - RNA, 16 nt, Human
ucuacuggucuugugg

SEQ ID NO: 1255501 - RNA, 20 nt, Human
ucuacuggucuuguggaauu

SEQ ID NO: 1255502 - RNA, 23 nt, Human
ucuacuggucuuguggaauuggg

SEQ ID NO: 1255503 - RNA, 21 nt, Human
ucuacuuaauccaauggguuu

SEQ ID NO: 1255504 - RNA, 22 nt, Human
ucuacuuccaaacuaauuuuua

SEQ ID NO: 1255505 - RNA, 14 nt, Human
ucuacuuccccaug

SEQ ID NO: 1255506 - RNA, 19 nt, Human
ucuacuuccaaacuaauuu

SEQ ID NO: 1255507 - RNA, 23 nt, Human
ucuaugaacucuguuuucuuucu

SEQ ID NO: 1255508 - RNA, 14 nt, Human
ucuaucaccaagga

SEQ ID NO: 1255509 - RNA, 20 nt, Human
ucguggacaccugcccugcc

SEQ ID NO: 1255510 - RNA, 19 nt, Human
ucguggacaccugcccugc

SEQ ID NO: 1255511 - RNA, 18 nt, Human
ucguggacaccugcccug

SEQ ID NO: 1255512 - RNA, 17 nt, Human
ucguggacaccugcccu

SEQ ID NO: 1255513 - RNA, 22 nt, Human
ucguggacacacacagacuauu

SEQ ID NO: 1255514 - RNA, 20 nt, Human
ucguggacugagugggaagc

SEQ ID NO: 1255515 - RNA, 22 nt, Human
ucguggacugagugggaagccc

SEQ ID NO: 1255516 - RNA, 10 nt, Human
ucguggagag

SEQ ID NO: 1255517 - RNA, 12 nt, Human
ucguggagagcu

SEQ ID NO: 1255518 - RNA, 16 nt, Human
ucguggagagcuagga

SEQ ID NO: 1255519 - RNA, 18 nt, Human
ucguggagagcuaggagc

SEQ ID NO: 1255520 - RNA, 16 nt, Human
ucguggacaccugccc

SEQ ID NO: 1255521 - RNA, 15 nt, Human
ucguggacaccugcc

SEQ ID NO: 1255522 - RNA, 14 nt, Human
ucguggacaccugc

SEQ ID NO: 1255523 - RNA, 13 nt, Human
ucguggacaccug

SEQ ID NO: 1255524 - RNA, 12 nt, Human
ucguggacaccu

SEQ ID NO: 1255525 - RNA, 18 nt, Human
ucguggacacacacagac

SEQ ID NO: 1255526 - RNA, 21 nt, Human
ucgugaccugcuaggccagag

SEQ ID NO: 1255527 - RNA, 17 nt, Human
ucgugaccugcuaggcc

SEQ ID NO: 1255528 - RNA, 24 nt, Human
ucguggagagcuaggagcaaagcc

SEQ ID NO: 1255529 - RNA, 16 nt, Human
ucguguccccuauccu

SEQ ID NO: 1255530 - RNA, 14 nt, Human
ucuaaagguccaca

SEQ ID NO: 1255531 - RNA, 15 nt, Human
ucuaaagguccacag

SEQ ID NO: 1255532 - RNA, 17 nt, Human
ucuaaagguccacaggu

SEQ ID NO: 1255533 - RNA, 22 nt, Human
ucuaaagguccacaggucuaga

SEQ ID NO: 1255534 - RNA, 23 nt, Human
ucuaaagguccacaggucuagac

SEQ ID NO: 1255535 - RNA, 11 nt, Human
ucuaaaguucu

SEQ ID NO: 1255536 - RNA, 12 nt, Human
ucuaaaguucua

SEQ ID NO: 1255537 - RNA, 13 nt, Human
ucuaaaguucuaa

SEQ ID NO: 1255538 - RNA, 14 nt, Human
ucuaaaguucuaag

SEQ ID NO: 1255539 - RNA, 15 nt, Human
ucuaaaguucuaaga

SEQ ID NO: 1255540 - RNA, 16 nt, Human
ucuaaaguucuaagau

SEQ ID NO: 1255541 - RNA, 17 nt, Human
ucuaaaguucuaagauu

SEQ ID NO: 1255542 - RNA, 18 nt, Human
ucuaaaguucuaagauuc

SEQ ID NO: 1255543 - RNA, 19 nt, Human
ucuaaaguucuaagauucu

SEQ ID NO: 1255544 - RNA, 20 nt, Human
ucuaaaguucuaagauucug

SEQ ID NO: 1255545 - RNA, 21 nt, Human
ucuaaaguucuaagauucuga

SEQ ID NO: 1255546 - RNA, 15 nt, Human
ucgucuuucccaugg

SEQ ID NO: 1255547 - RNA, 18 nt, Human
ucgucuuucccaugggga

SEQ ID NO: 1255548 - RNA, 20 nt, Human
ucgucuuucccauggggagg

SEQ ID NO: 1255549 - RNA, 16 nt, Human
ucgugaaaacacauuu

SEQ ID NO: 1255550 - RNA, 15 nt, Human
ucggcacuguacaaa

SEQ ID NO: 1255551 - RNA, 16 nt, Human
ucggauuuuuuccaaa

SEQ ID NO: 1255552 - RNA, 17 nt, Human
ucggauuuuuuccaaaa

SEQ ID NO: 1255553 - RNA, 10 nt, Human
ucggauuaga

SEQ ID NO: 1255554 - RNA, 13 nt, Human
ucggauuuuuucc

SEQ ID NO: 1255555 - RNA, 14 nt, Human
ucggauuuuuucca

SEQ ID NO: 1255556 - RNA, 18 nt, Human
ucggauccagggaggcug

SEQ ID NO: 1255557 - RNA, 19 nt, Human
uccuuagaaaaaaaauuau

SEQ ID NO: 1255558 - RNA, 18 nt, Human
uccuuagacucuuuuccu

SEQ ID NO: 1255559 - RNA, 18 nt, Human
uccuuagaucuggcaugu

SEQ ID NO: 1255560 - RNA, 17 nt, Human
uccuuagaucuggcaug

SEQ ID NO: 1255561 - RNA, 13 nt, Human
uccuuagccugga

SEQ ID NO: 1255562 - RNA, 14 nt, Human
uccuuagccuggac

SEQ ID NO: 1255563 - RNA, 15 nt, Human
uccuuagccuggacc

SEQ ID NO: 1255564 - RNA, 21 nt, Human
uccuuagccuggaccucugac

SEQ ID NO: 1255565 - RNA, 22 nt, Human
uccuuagccuggaccucugaca

SEQ ID NO: 1255566 - RNA, 23 nt, Human
uccuuagccuggaccucugacag

SEQ ID NO: 1255567 - RNA, 17 nt, Human
uccuggcaauagucaaa

SEQ ID NO: 1255568 - RNA, 17 nt, Human
uccuggcccagccuuug

SEQ ID NO: 1255569 - RNA, 19 nt, Human
uccuggaggggcuggggac

SEQ ID NO: 1255570 - RNA, 22 nt, Human
uccuggaugauacuaauaaacu

SEQ ID NO: 1255571 - RNA, 14 nt, Human
uccuggccgccugg

SEQ ID NO: 1255572 - RNA, 12 nt, Human
uccuggcgccug

SEQ ID NO: 1255573 - RNA, 15 nt, Human
uccugucucccuccu

SEQ ID NO: 1255574 - RNA, 23 nt, Human
uccugucucccuccucugcccgg

SEQ ID NO: 1255575 - RNA, 21 nt, Human
uccugcccugggaggcaguga

SEQ ID NO: 1255576 - RNA, 11 nt, Human
uccugcccugg

SEQ ID NO: 1255577 - RNA, 12 nt, Human
uccugcccuggg

SEQ ID NO: 1255578 - RNA, 14 nt, Human
uccugcccugggag

SEQ ID NO: 1255579 - RNA, 15 nt, Human
uccugcccugggagg

SEQ ID NO: 1255580 - RNA, 14 nt, Human
uccugccggcuccu

SEQ ID NO: 1255581 - RNA, 17 nt, Human
uccugccggcuccuugg

SEQ ID NO: 1255582 - RNA, 15 nt, Human
uccuggaggcccagu

SEQ ID NO: 1255583 - RNA, 18 nt, Human
uccuggaggcccaguuca

SEQ ID NO: 1255584 - RNA, 20 nt, Human
uccuggagcagaagcagcaa

SEQ ID NO: 1255585 - RNA, 11 nt, Human
uccuggagggg

SEQ ID NO: 1255586 - RNA, 18 nt, Human
uccuggagcagaccaccc

SEQ ID NO: 1255587 - RNA, 19 nt, Human
uccuggagcagaccacccc

SEQ ID NO: 1255588 - RNA, 13 nt, Human
uccuggaggccca

SEQ ID NO: 1255589 - RNA, 14 nt, Human
uccuggaggcccag

SEQ ID NO: 1255590 - RNA, 18 nt, Human
uccuggacagcugugccu

SEQ ID NO: 1255591 - RNA, 19 nt, Human
uccuggacagcugugccuc

SEQ ID NO: 1255592 - RNA, 22 nt, Human
uccuggacagcugugccucgcu

SEQ ID NO: 1255593 - RNA, 21 nt, Human
uccuggacaugaagauucuuu

SEQ ID NO: 1255594 - RNA, 16 nt, Human
uccugccuaaggcuga

SEQ ID NO: 1255595 - RNA, 19 nt, Human
uccugccuaaggcugaacu

SEQ ID NO: 1255596 - RNA, 22 nt, Human
uccuggacaugaagauucuuuc

SEQ ID NO: 1255597 - RNA, 13 nt, Human
uccuggagcagaa

SEQ ID NO: 1255598 - RNA, 14 nt, Human
uccuggagcagaag

SEQ ID NO: 1255599 - RNA, 16 nt, Human
uccuggagcagaagca

SEQ ID NO: 1255600 - RNA, 18 nt, Human
uccuggagcagaagcagc

SEQ ID NO: 1255601 - RNA, 19 nt, Human
uccuggagcagaagcagca

SEQ ID NO: 1255602 - RNA, 11 nt, Human
uccugccacca

SEQ ID NO: 1255603 - RNA, 16 nt, Human
uccugccaccacgccc

SEQ ID NO: 1255604 - RNA, 16 nt, Human
uccugccacccagccc

SEQ ID NO: 1255605 - RNA, 20 nt, Human
uccugccacccagccccagc

SEQ ID NO: 1255606 - RNA, 22 nt, Human
uccugccacccagccccagcca

SEQ ID NO: 1255607 - RNA, 20 nt, Human
uccugaggcuccacuugguc

SEQ ID NO: 1255608 - RNA, 19 nt, Human
uccugaggcuccacuuggu

SEQ ID NO: 1255609 - RNA, 21 nt, Human
uccugaggcuccacuuggucu

SEQ ID NO: 1255610 - RNA, 16 nt, Human
uccugcauuugugaaa

SEQ ID NO: 1255611 - RNA, 17 nt, Human
uccugccccugagccca

SEQ ID NO: 1255612 - RNA, 21 nt, Human
uccugccccaacuccuuccag

SEQ ID NO: 1255613 - RNA, 18 nt, Human
uccugccccugagcccau

SEQ ID NO: 1255614 - RNA, 10 nt, Human
uccugcccug

SEQ ID NO: 1255615 - RNA, 13 nt, Human
uccugccagcccc

SEQ ID NO: 1255616 - RNA, 14 nt, Human
uccugccagccccu

SEQ ID NO: 1255617 - RNA, 14 nt, Human
uccugccccaggcc

SEQ ID NO: 1255618 - RNA, 15 nt, Human
uccugccccaggccu

SEQ ID NO: 1255619 - RNA, 20 nt, Human
uccucccacccggcugcaga

SEQ ID NO: 1255620 - RNA, 21 nt, Human
uccucccacccggcugcagag

SEQ ID NO: 1255621 - RNA, 12 nt, Human
uccuccuccagg

SEQ ID NO: 1255622 - RNA, 13 nt, Human
uccuccuccaggg

SEQ ID NO: 1255623 - RNA, 14 nt, Human
uccuccuccaggga

SEQ ID NO: 1255624 - RNA, 15 nt, Human
uccuccuccagggac

SEQ ID NO: 1255625 - RNA, 16 nt, Human
uccuccuccagggaca

SEQ ID NO: 1255626 - RNA, 17 nt, Human
uccuccuccagggacag

SEQ ID NO: 1255627 - RNA, 14 nt, Human
uccuccucccaccc

SEQ ID NO: 1255628 - RNA, 20 nt, Human
uccuccucccacccggcugc

SEQ ID NO: 1255629 - RNA, 11 nt, Human
uccuccucugu

SEQ ID NO: 1255630 - RNA, 13 nt, Human
uccuccucuguga

SEQ ID NO: 1255631 - RNA, 12 nt, Human
uccuccucugug

SEQ ID NO: 1255632 - RNA, 23 nt, Human
uccucugucucgagcgcccugca

SEQ ID NO: 1255633 - RNA, 15 nt, Human
uccucugucucgagc

SEQ ID NO: 1255634 - RNA, 19 nt, Human
uccucugugaccaaugucu

SEQ ID NO: 1255635 - RNA, 21 nt, Human
uccucugugaccaaugucuug

SEQ ID NO: 1255636 - RNA, 20 nt, Human
uccucugugaccaaugucuu

SEQ ID NO: 1255637 - RNA, 19 nt, Human
uccucuguucaaagcugcc

SEQ ID NO: 1255638 - RNA, 23 nt, Human
uccucuguucaaagcugccuguc

SEQ ID NO: 1255639 - RNA, 15 nt, Human
uccucuuccaugcug

SEQ ID NO: 1255640 - RNA, 19 nt, Human
uccugagaaaaaagguucc

SEQ ID NO: 1255641 - RNA, 24 nt, Human
uccugagaaaaaagguuccgcuug

SEQ ID NO: 1255642 - RNA, 15 nt, Human
uccugagaaagcuca

SEQ ID NO: 1255643 - RNA, 16 nt, Human
uccugagaaagcucaa

SEQ ID NO: 1255644 - RNA, 18 nt, Human
uccugagaaagcucaaag

SEQ ID NO: 1255645 - RNA, 23 nt, Human
uccugagccagugucaggaggaa

SEQ ID NO: 1255646 - RNA, 14 nt, Human
uccugagccccagg

SEQ ID NO: 1255647 - RNA, 16 nt, Human
uccugagccccaggga

SEQ ID NO: 1255648 - RNA, 17 nt, Human
uccugagccccagggag

SEQ ID NO: 1255649 - RNA, 12 nt, Human
uccugagcucag

SEQ ID NO: 1255650 - RNA, 13 nt, Human
uccugagcucagc

SEQ ID NO: 1255651 - RNA, 14 nt, Human
uccugagcucagcg

SEQ ID NO: 1255652 - RNA, 18 nt, Human
uccugagcucagcgugga

SEQ ID NO: 1255653 - RNA, 19 nt, Human
uccugagcucagcguggag

SEQ ID NO: 1255654 - RNA, 22 nt, Human
uccuaagcuggagugcaguggc

SEQ ID NO: 1255655 - RNA, 22 nt, Human
uccgcuuggagcuauuuuccag

SEQ ID NO: 1255656 - RNA, 16 nt, Human
uccuaagggucgaaag

SEQ ID NO: 1255657 - RNA, 18 nt, Human
uccuaagggucgaaagcu

SEQ ID NO: 1255658 - RNA, 20 nt, Human
uccuaagggucgaaagcucu

SEQ ID NO: 1255659 - RNA, 21 nt, Human
uccuaagggucgaaagcucua

SEQ ID NO: 1255660 - RNA, 23 nt, Human
uccuaagggucgaaagcucuaga

SEQ ID NO: 1255661 - RNA, 13 nt, Human
uccuacccccugu

SEQ ID NO: 1255662 - RNA, 15 nt, Human
uccuacccccugugc

SEQ ID NO: 1255663 - RNA, 16 nt, Human
uccuacccccugugcc

SEQ ID NO: 1255664 - RNA, 17 nt, Human
uccuacccccugugccu

SEQ ID NO: 1255665 - RNA, 13 nt, Human
uccuacagaaaaa

SEQ ID NO: 1255666 - RNA, 14 nt, Human
uccuacagaaaaac

SEQ ID NO: 1255667 - RNA, 15 nt, Human
uccuacagaaaaacc

SEQ ID NO: 1255668 - RNA, 20 nt, Human
uccuacagaaaaaccuuggg

SEQ ID NO: 1255669 - RNA, 17 nt, Human
uccuacagaaaaaccuu

SEQ ID NO: 1255670 - RNA, 19 nt, Human
uccuacagaaaaaccuugg

SEQ ID NO: 1255671 - RNA, 19 nt, Human
uccuaucaccuauuuccau

SEQ ID NO: 1255672 - RNA, 20 nt, Human
uccuacauuaauuaucuagu

SEQ ID NO: 1255673 - RNA, 21 nt, Human
uccuccaggguggcagcaaca

SEQ ID NO: 1255674 - RNA, 12 nt, Human
uccuccauggga

SEQ ID NO: 1255675 - RNA, 20 nt, Human
uccucccaauuucagacucc

SEQ ID NO: 1255676 - RNA, 21 nt, Human
uccucccaauuucagacuccc

SEQ ID NO: 1255677 - RNA, 20 nt, Human
uccuccaggguggcagcaac

SEQ ID NO: 1255678 - RNA, 12 nt, Human
uccuccacgccu

SEQ ID NO: 1255679 - RNA, 12 nt, Human
uccuccagcccc

SEQ ID NO: 1255680 - RNA, 13 nt, Human
uccuccagccccu

SEQ ID NO: 1255681 - RNA, 17 nt, Human
uccuccagccccuguag

SEQ ID NO: 1255682 - RNA, 15 nt, Human
uccuccaggaagccu

SEQ ID NO: 1255683 - RNA, 14 nt, Human
uccuccagggacag

SEQ ID NO: 1255684 - RNA, 16 nt, Human
uccuccagggacagca

SEQ ID NO: 1255685 - RNA, 17 nt, Human
uccuccaccucaacucc

SEQ ID NO: 1255686 - RNA, 19 nt, Human
uccuccacguucugcucau

SEQ ID NO: 1255687 - RNA, 17 nt, Human
uccuccaacaccaagca

SEQ ID NO: 1255688 - RNA, 22 nt, Human
uccuccaacaccaagcacagca

SEQ ID NO: 1255689 - RNA, 17 nt, Human
uccuaucagaaguuucu

SEQ ID NO: 1255690 - RNA, 19 nt, Human
uccucauuguaaacaaacu

SEQ ID NO: 1255691 - RNA, 15 nt, Human
uccgcuauccaccaa

SEQ ID NO: 1255692 - RNA, 16 nt, Human
uccgccuggccuggcc

SEQ ID NO: 1255693 - RNA, 20 nt, Human
uccgcuuggagcuauuuucc

SEQ ID NO: 1255694 - RNA, 16 nt, Human
uccgcaggugcugguc

SEQ ID NO: 1255695 - RNA, 18 nt, Human
uccgcaggugcugguccc

SEQ ID NO: 1255696 - RNA, 14 nt, Human
uccgcagugagaga

SEQ ID NO: 1255697 - RNA, 14 nt, Human
uccgccacuggggc

SEQ ID NO: 1255698 - RNA, 15 nt, Human
uccgccacuggggcu

SEQ ID NO: 1255699 - RNA, 21 nt, Human
uccgccacuggggcucagagc

SEQ ID NO: 1255700 - RNA, 19 nt, Human
uccgccacuggggcucaga

SEQ ID NO: 1255701 - RNA, 20 nt, Human
ucccuugccucaaugccagu

SEQ ID NO: 1255702 - RNA, 23 nt, Human
uccgcagcccccacccccaaggu

SEQ ID NO: 1255703 - RNA, 15 nt, Human
uccgcaggugcuggu

SEQ ID NO: 1255704 - RNA, 16 nt, Human
ucccuucauacuugaa

SEQ ID NO: 1255705 - RNA, 14 nt, Human
ucccuucauacuug

SEQ ID NO: 1255706 - RNA, 16 nt, Human
ucccuucaguacccuc

SEQ ID NO: 1255707 - RNA, 18 nt, Human
ucccuucaguacccucuc

SEQ ID NO: 1255708 - RNA, 19 nt, Human
ucccuucaguacccucuca

SEQ ID NO: 1255709 - RNA, 20 nt, Human
ucccuucaguacccucucag

SEQ ID NO: 1255710 - RNA, 21 nt, Human
ucccuucaguacccucucagc

SEQ ID NO: 1255711 - RNA, 23 nt, Human
ucccuucaguacccucucagcuc

SEQ ID NO: 1255712 - RNA, 10 nt, Human
ucccuucaua

SEQ ID NO: 1255713 - RNA, 15 nt, Human
ucccuuccugccagc

SEQ ID NO: 1255714 - RNA, 14 nt, Human
ucccuugccccccu

SEQ ID NO: 1255715 - RNA, 18 nt, Human
ucccuugccccccuggcc

SEQ ID NO: 1255716 - RNA, 12 nt, Human
ucccuugccuca

SEQ ID NO: 1255717 - RNA, 21 nt, Human
ucccccuguuucagaggcuca

SEQ ID NO: 1255718 - RNA, 12 nt, Human
uccccccaucuu

SEQ ID NO: 1255719 - RNA, 15 nt, Human
uccccccaucuugcu

SEQ ID NO: 1255720 - RNA, 22 nt, Human
uccccccaucuugcuucccuaa

SEQ ID NO: 1255721 - RNA, 13 nt, Human
ucccccccaugca

SEQ ID NO: 1255722 - RNA, 17 nt, Human
ucccccccaugcacugu

SEQ ID NO: 1255723 - RNA, 18 nt, Human
ucccccccaugcacugug

SEQ ID NO: 1255724 - RNA, 23 nt, Human
uccagaaagaaaacuuguauuau

SEQ ID NO: 1255725 - RNA, 13 nt, Human
uccagaaaacaaa

SEQ ID NO: 1255726 - RNA, 14 nt, Human
uccagaaaacaaaa

SEQ ID NO: 1255727 - RNA, 15 nt, Human
uccacuuuguuucgu

SEQ ID NO: 1255728 - RNA, 18 nt, Human
uccacuuuguuucguggg

SEQ ID NO: 1255729 - RNA, 19 nt, Human
uccacuuuguuucgugggg

SEQ ID NO: 1255730 - RNA, 22 nt, Human
uccacuuuguuucguggggagg

SEQ ID NO: 1255731 - RNA, 23 nt, Human
uccacuuuguuucguggggaggu

SEQ ID NO: 1255732 - RNA, 14 nt, Human
uccagaaagcccca

SEQ ID NO: 1255733 - RNA, 16 nt, Human
uccagaaagccccacc

SEQ ID NO: 1255734 - RNA, 18 nt, Human
uccagagucccugccugg

SEQ ID NO: 1255735 - RNA, 23 nt, Human
uccagaaagccccacccaggcca

SEQ ID NO: 1255736 - RNA, 19 nt, Human
uccagagucccugccugga

SEQ ID NO: 1255737 - RNA, 20 nt, Human
uccagagucccugccuggac

SEQ ID NO: 1255738 - RNA, 21 nt, Human
uccagagucccugccuggacc

SEQ ID NO: 1255739 - RNA, 20 nt, Human
uccagaaagccccacccagg

SEQ ID NO: 1255740 - RNA, 15 nt, Human
uccagauaguguagc

SEQ ID NO: 1255741 - RNA, 22 nt, Human
uccagauaguguagcugaggag

SEQ ID NO: 1255742 - RNA, 21 nt, Human
uccacuuggucugugagaugc

SEQ ID NO: 1255743 - RNA, 18 nt, Human
uccaaagucauaauugca

SEQ ID NO: 1255744 - RNA, 23 nt, Human
uccacuuggucugugagaugcua

SEQ ID NO: 1255745 - RNA, 15 nt, Human
uccaaagucauaauu

SEQ ID NO: 1255746 - RNA, 17 nt, Human
uccaaagucauaauugc

SEQ ID NO: 1255747 - RNA, 13 nt, Human
uccagcuccugua

SEQ ID NO: 1255748 - RNA, 14 nt, Human
uccagcuccuuugg

SEQ ID NO: 1255749 - RNA, 15 nt, Human
uccagcuccuuuggg

SEQ ID NO: 1255750 - RNA, 19 nt, Human
uccagcuccuuugggcuuc

SEQ ID NO: 1255751 - RNA, 12 nt, Human
uccagcucugga

SEQ ID NO: 1255752 - RNA, 13 nt, Human
uccagcucuggag

SEQ ID NO: 1255753 - RNA, 15 nt, Human
uccagcucuggaggg

SEQ ID NO: 1255754 - RNA, 20 nt, Human
uccagcucuggaggggaggg

SEQ ID NO: 1255755 - RNA, 16 nt, Human
uccagcuccuuugggc

SEQ ID NO: 1255756 - RNA, 14 nt, Human
uccagcugacuaaa

SEQ ID NO: 1255757 - RNA, 21 nt, Human
uccagcugacuaaacuuuuuu

SEQ ID NO: 1255758 - RNA, 16 nt, Human
uccagcugagcgccag

SEQ ID NO: 1255759 - RNA, 22 nt, Human
uccagcaauucuccugccucag

SEQ ID NO: 1255760 - RNA, 22 nt, Human
uccagcugccccggccccuccc

SEQ ID NO: 1255761 - RNA, 12 nt, Human
uccagcugcccc

SEQ ID NO: 1255762 - RNA, 13 nt, Human
uccagcugccccg

SEQ ID NO: 1255763 - RNA, 21 nt, Human
uccaggggcugcuuccuccug

SEQ ID NO: 1255764 - RNA, 22 nt, Human
uccaggggcugcuuccuccugg

SEQ ID NO: 1255765 - RNA, 23 nt, Human
uccaggggcugcuuccuccugga

SEQ ID NO: 1255766 - RNA, 20 nt, Human
uccaugggccauaugaaaag

SEQ ID NO: 1255767 - RNA, 18 nt, Human
uccaugggagaaaauaga

SEQ ID NO: 1255768 - RNA, 15 nt, Human
uccaugggcagagcc

SEQ ID NO: 1255769 - RNA, 16 nt, Human
uccaugggcagagccc

SEQ ID NO: 1255770 - RNA, 17 nt, Human
uccaugggcagagccca

SEQ ID NO: 1255771 - RNA, 18 nt, Human
uccaugggcagagcccaa

SEQ ID NO: 1255772 - RNA, 22 nt, Human
uccaugggcagagcccaaggga

SEQ ID NO: 1255773 - RNA, 20 nt, Human
uccaugcugugcgcccaggg

SEQ ID NO: 1255774 - RNA, 21 nt, Human
uccaugcugugcgcccagggc

SEQ ID NO: 1255775 - RNA, 22 nt, Human
uccaugcugugcgcccagggcu

SEQ ID NO: 1255776 - RNA, 14 nt, Human
uccaugcugccucc

SEQ ID NO: 1255777 - RNA, 15 nt, Human
uccaugcugccucca

SEQ ID NO: 1255778 - RNA, 22 nt, Human
uccaugcguguuucugacucug

SEQ ID NO: 1255779 - RNA, 15 nt, Human
uccauacauuugugu

SEQ ID NO: 1255780 - RNA, 21 nt, Human
uccauaaucuggacuccucug

SEQ ID NO: 1255781 - RNA, 17 nt, Human
uccauagaccuuuucau

SEQ ID NO: 1255782 - RNA, 14 nt, Human
uccaucaggccacu

SEQ ID NO: 1255783 - RNA, 16 nt, Human
uccaucagaugacaag

SEQ ID NO: 1255784 - RNA, 13 nt, Human
uccaucaucaugu

SEQ ID NO: 1255785 - RNA, 19 nt, Human
uccaucacguuagcugucc

SEQ ID NO: 1255786 - RNA, 21 nt, Human
uccaguucuucgacuguuguu

SEQ ID NO: 1255787 - RNA, 23 nt, Human
uccaguuggaguuuuuuguacca

SEQ ID NO: 1255788 - RNA, 23 nt, Human
uccaguucuucgacuguuguuau

SEQ ID NO: 1255789 - RNA, 19 nt, Human
uccaguucuucgacuguug

SEQ ID NO: 1255790 - RNA, 22 nt, Human
uccaguuaaaaaaaauuuuaau

SEQ ID NO: 1255791 - RNA, 16 nt, Human
uccaguucaugagaau

SEQ ID NO: 1255792 - RNA, 19 nt, Human
uccaguucaugagaaucua

SEQ ID NO: 1255793 - RNA, 22 nt, Human
uccauaaucuggacuccucugu

SEQ ID NO: 1255794 - RNA, 17 nt, Human
uccauaaauccuugaug

SEQ ID NO: 1255795 - RNA, 13 nt, Human
uccauaaagaccc

SEQ ID NO: 1255796 - RNA, 14 nt, Human
uccauaacugaaca

SEQ ID NO: 1255797 - RNA, 14 nt, Human
uccaguaaaauaau

SEQ ID NO: 1255798 - RNA, 15 nt, Human
uccagguccuggugg

SEQ ID NO: 1255799 - RNA, 21 nt, Human
uccagguccugguggggcagc

SEQ ID NO: 1255800 - RNA, 21 nt, Human
uccagguauucguuaucuaau

SEQ ID NO: 1255801 - RNA, 22 nt, Human
uccagguccugguggggcagcu

SEQ ID NO: 1255802 - RNA, 19 nt, Human
uccagguagagggugugua

SEQ ID NO: 1255803 - RNA, 23 nt, Human
uccccagagaaaggggagcccac

SEQ ID NO: 1255804 - RNA, 14 nt, Human
ucccauguucaagc

SEQ ID NO: 1255805 - RNA, 10 nt, Human
ucccaugugg

SEQ ID NO: 1255806 - RNA, 20 nt, Human
uccccagcauuccagccccu

SEQ ID NO: 1255807 - RNA, 12 nt, Human
uccccagcccag

SEQ ID NO: 1255808 - RNA, 13 nt, Human
uccccagcccaga

SEQ ID NO: 1255809 - RNA, 14 nt, Human
uccccagcccagag

SEQ ID NO: 1255810 - RNA, 15 nt, Human
uccccagcccagaga

SEQ ID NO: 1255811 - RNA, 16 nt, Human
uccccagcccagagac

SEQ ID NO: 1255812 - RNA, 17 nt, Human
uccccagcccagagaca

SEQ ID NO: 1255813 - RNA, 22 nt, Human
uccccccaagggaggcugcugc

SEQ ID NO: 1255814 - RNA, 17 nt, Human
uccccccacaagugccc

SEQ ID NO: 1255815 - RNA, 22 nt, Human
uccccccacaagugcccuccag

SEQ ID NO: 1255816 - RNA, 18 nt, Human
uccccccacucccucaca

SEQ ID NO: 1255817 - RNA, 16 nt, Human
ucccaggcgccccuuc

SEQ ID NO: 1255818 - RNA, 23 nt, Human
ucccaggccccaugaccuccagc

SEQ ID NO: 1255819 - RNA, 12 nt, Human
ucccaggcccac

SEQ ID NO: 1255820 - RNA, 19 nt, Human
ucccaggcccacugugccu

SEQ ID NO: 1255821 - RNA, 20 nt, Human
ucccaggcccacugugccuc

SEQ ID NO: 1255822 - RNA, 11 nt, Human
ucccaggcccc

SEQ ID NO: 1255823 - RNA, 18 nt, Human
ucccaggccccaugaccu

SEQ ID NO: 1255824 - RNA, 21 nt, Human
ucccaggccccaugaccucca

SEQ ID NO: 1255825 - RNA, 22 nt, Human
ucccaggccccaugaccuccag

SEQ ID NO: 1255826 - RNA, 11 nt, Human
ucccaggaacu

SEQ ID NO: 1255827 - RNA, 16 nt, Human
ucccaggaacugggcc

SEQ ID NO: 1255828 - RNA, 12 nt, Human
ucccaggacccu

SEQ ID NO: 1255829 - RNA, 17 nt, Human
ucccaggaccacaggcu

SEQ ID NO: 1255830 - RNA, 18 nt, Human
ucccaggaccacaggcuc

SEQ ID NO: 1255831 - RNA, 19 nt, Human
ucccaggaccacaggcuca

SEQ ID NO: 1255832 - RNA, 23 nt, Human
ucccaggaccacaggcucaggca

SEQ ID NO: 1255833 - RNA, 24 nt, Human
ucccaggaccacaggcucaggcag

SEQ ID NO: 1255834 - RNA, 11 nt, Human
ucccaggaccc

SEQ ID NO: 1255835 - RNA, 23 nt, Human
uccaugggcagagcccaagggaa

SEQ ID NO: 1255836 - RNA, 19 nt, Human
uccauuaaacgauuuuuaa

SEQ ID NO: 1255837 - RNA, 23 nt, Human
ucccaccugacacaccaggcgcu

SEQ ID NO: 1255838 - RNA, 22 nt, Human
uccauucacaguucuuugggcc

SEQ ID NO: 1255839 - RNA, 13 nt, Human
ucccaccugacac

SEQ ID NO: 1255840 - RNA, 19 nt, Human
ucccaccugacacaccagg

SEQ ID NO: 1255841 - RNA, 19 nt, Human
ucaugggccacugcuuuuc

SEQ ID NO: 1255842 - RNA, 17 nt, Human
ucaugcuguucaugaaa

SEQ ID NO: 1255843 - RNA, 17 nt, Human
ucaucuuucccuccuug

SEQ ID NO: 1255844 - RNA, 18 nt, Human
ucaucuuucccuccuugg

SEQ ID NO: 1255845 - RNA, 19 nt, Human
ucaucuuucccuccuuggu

SEQ ID NO: 1255846 - RNA, 12 nt, Human
ucaucuuucuuc

SEQ ID NO: 1255847 - RNA, 14 nt, Human
ucaucuuucccucc

SEQ ID NO: 1255848 - RNA, 15 nt, Human
ucaucuuucccuccu

SEQ ID NO: 1255849 - RNA, 16 nt, Human
ucaucuuucccuccuu

SEQ ID NO: 1255850 - RNA, 11 nt, Human
ucaucuugcua

SEQ ID NO: 1255851 - RNA, 17 nt, Human
ucaucuugcuaccagua

SEQ ID NO: 1255852 - RNA, 18 nt, Human
ucaucuugcuaccaguau

SEQ ID NO: 1255853 - RNA, 21 nt, Human
ucaucuugcuaccaguauuua

SEQ ID NO: 1255854 - RNA, 22 nt, Human
ucaucuugcuaccaguauuuag

SEQ ID NO: 1255855 - RNA, 16 nt, Human
ucaucuccccaucauu

SEQ ID NO: 1255856 - RNA, 20 nt, Human
ucaucucauuuaauccuccc

SEQ ID NO: 1255857 - RNA, 21 nt, Human
ucaucucauuuaauccucccu

SEQ ID NO: 1255858 - RNA, 12 nt, Human
ucaucucccacc

SEQ ID NO: 1255859 - RNA, 22 nt, Human
ucaucucccaccuagcagcacc

SEQ ID NO: 1255860 - RNA, 15 nt, Human
ucaucuccugccuuc

SEQ ID NO: 1255861 - RNA, 18 nt, Human
ucaucuccugccuuccuc

SEQ ID NO: 1255862 - RNA, 19 nt, Human
ucaucucagcucacugcaa

SEQ ID NO: 1255863 - RNA, 22 nt, Human
ucaucucagugaagaauacuuc

SEQ ID NO: 1255864 - RNA, 18 nt, Human
ucaguguaccauuugccu

SEQ ID NO: 1255865 - RNA, 19 nt, Human
ucaguguaccauuugccuc

SEQ ID NO: 1255866 - RNA, 22 nt, Human
ucaguguagaaccuaauucaau

SEQ ID NO: 1255867 - RNA, 21 nt, Human
ucaguguauggaaauaaaugu

SEQ ID NO: 1255868 - RNA, 22 nt, Human
ucaguguauggaaauaaaugua

SEQ ID NO: 1255869 - RNA, 12 nt, Human
ucauagcagcuu

SEQ ID NO: 1255870 - RNA, 13 nt, Human
ucauagagacuug

SEQ ID NO: 1255871 - RNA, 11 nt, Human
ucauagcagcu

SEQ ID NO: 1255872 - RNA, 22 nt, Human
ucaguguaccgcgucuacccug

SEQ ID NO: 1255873 - RNA, 17 nt, Human
ucaucaaugaaugaaug

SEQ ID NO: 1255874 - RNA, 13 nt, Human
ucaucaauuaaag

SEQ ID NO: 1255875 - RNA, 19 nt, Human
ucaucaauggggccaguca

SEQ ID NO: 1255876 - RNA, 23 nt, Human
ucaucauucacuucacugugcug

SEQ ID NO: 1255877 - RNA, 22 nt, Human
ucaucauucacuucacugugcu

SEQ ID NO: 1255878 - RNA, 21 nt, Human
ucaucauucacuucacugugc

SEQ ID NO: 1255879 - RNA, 19 nt, Human
ucaucauucacuucacugu

SEQ ID NO: 1255880 - RNA, 17 nt, Human
ucaucauucacuucacu

SEQ ID NO: 1255881 - RNA, 16 nt, Human
ucaucaugauaauuca

SEQ ID NO: 1255882 - RNA, 14 nt, Human
ucaucauggccagc

SEQ ID NO: 1255883 - RNA, 17 nt, Human
ucaucauggccagcugg

SEQ ID NO: 1255884 - RNA, 18 nt, Human
ucaucauggccagcugga

SEQ ID NO: 1255885 - RNA, 22 nt, Human
ucaucauggccagcuggaggca

SEQ ID NO: 1255886 - RNA, 22 nt, Human
ucaucauguaucgcuucaugua

SEQ ID NO: 1255887 - RNA, 13 nt, Human
ucaucauucucug

SEQ ID NO: 1255888 - RNA, 14 nt, Human
ucaucauucucugu

SEQ ID NO: 1255889 - RNA, 18 nt, Human
ucaucauucucugucuca

SEQ ID NO: 1255890 - RNA, 19 nt, Human
ucaucauucucugucucau

SEQ ID NO: 1255891 - RNA, 20 nt, Human
ucauccaccccaucccuccc

SEQ ID NO: 1255892 - RNA, 14 nt, Human
ucauggugcucaga

SEQ ID NO: 1255893 - RNA, 15 nt, Human
ucauuagaaauauuu

SEQ ID NO: 1255894 - RNA, 20 nt, Human
ucauuagacuggaacuugaa

SEQ ID NO: 1255895 - RNA, 16 nt, Human
ucauuaggauggcuag

SEQ ID NO: 1255896 - RNA, 14 nt, Human
ucauuguagaaaag

SEQ ID NO: 1255897 - RNA, 14 nt, Human
ucauuguauguggu

SEQ ID NO: 1255898 - RNA, 23 nt, Human
ucauugucugugaagugagaccu

SEQ ID NO: 1255899 - RNA, 18 nt, Human
ucauugucuguguagagu

SEQ ID NO: 1255900 - RNA, 22 nt, Human
ucauuuaauccucccuuccucc

SEQ ID NO: 1255901 - RNA, 17 nt, Human
ucauuuagcauguuguu

SEQ ID NO: 1255902 - RNA, 23 nt, Human
ucauuuagcauguuguugaaagg

SEQ ID NO: 1255903 - RNA, 15 nt, Human
ucauuuagccugucc

SEQ ID NO: 1255904 - RNA, 16 nt, Human
ucauuuagccuguccu

SEQ ID NO: 1255905 - RNA, 17 nt, Human
ucauuuagccuguccug

SEQ ID NO: 1255906 - RNA, 18 nt, Human
ucauuuagucaugugacc

SEQ ID NO: 1255907 - RNA, 19 nt, Human
ucauuuaguuugauuauuc

SEQ ID NO: 1255908 - RNA, 12 nt, Human
uccaaaccacuu

SEQ ID NO: 1255909 - RNA, 22 nt, Human
uccaaaccacuuuuugcagcuu

SEQ ID NO: 1255910 - RNA, 19 nt, Human
uccaaagaggcugccccuc

SEQ ID NO: 1255911 - RNA, 20 nt, Human
uccaaagaguagaauugcau

SEQ ID NO: 1255912 - RNA, 19 nt, Human
uccaaacuaccuuccaguu

SEQ ID NO: 1255913 - RNA, 12 nt, Human
uccaaacuaauu

SEQ ID NO: 1255914 - RNA, 16 nt, Human
uccaaacuaauuuuua

SEQ ID NO: 1255915 - RNA, 13 nt, Human
uccaaagaggcug

SEQ ID NO: 1255916 - RNA, 14 nt, Human
uccaaagaggcugc

SEQ ID NO: 1255917 - RNA, 15 nt, Human
uccaaagaggcugcc

SEQ ID NO: 1255918 - RNA, 16 nt, Human
uccaaagaggcugccc

SEQ ID NO: 1255919 - RNA, 18 nt, Human
uccaaagaggcugccccu

SEQ ID NO: 1255920 - RNA, 14 nt, Human
uccaaacaggcuca

SEQ ID NO: 1255921 - RNA, 21 nt, Human
uccaaaagaagcccccagcua

SEQ ID NO: 1255922 - RNA, 16 nt, Human
uccaaaagauugcuga

SEQ ID NO: 1255923 - RNA, 14 nt, Human
uccaaacauccucu

SEQ ID NO: 1255924 - RNA, 12 nt, Human
uccaaaacugcc

SEQ ID NO: 1255925 - RNA, 13 nt, Human
uccaaaacugccu

SEQ ID NO: 1255926 - RNA, 21 nt, Human
uccaaaaccgccagcucuguu

SEQ ID NO: 1255927 - RNA, 14 nt, Human
uccaaaagaagccc

SEQ ID NO: 1255928 - RNA, 15 nt, Human
uccaaaagaagcccc

SEQ ID NO: 1255929 - RNA, 18 nt, Human
uccaaaagaagcccccag

SEQ ID NO: 1255930 - RNA, 12 nt, Human
ucauuuaucuau

SEQ ID NO: 1255931 - RNA, 16 nt, Human
ucauuuaucuauaauu

SEQ ID NO: 1255932 - RNA, 18 nt, Human
ucauuuaucuauaauuua

SEQ ID NO: 1255933 - RNA, 21 nt, Human
ucauuuaucuauaauuuaccu

SEQ ID NO: 1255934 - RNA, 21 nt, Human
uccaaaaauguguaagaacaa

SEQ ID NO: 1255935 - RNA, 17 nt, Human
uccaaaaauguguaaga

SEQ ID NO: 1255936 - RNA, 18 nt, Human
uccaaaaccgccagcucu

SEQ ID NO: 1255937 - RNA, 19 nt, Human
uccaaaaccgccagcucug

SEQ ID NO: 1255938 - RNA, 20 nt, Human
uccaaaaccgccagcucugu

SEQ ID NO: 1255939 - RNA, 22 nt, Human
uccaaaaccgccagcucuguuc

SEQ ID NO: 1255940 - RNA, 20 nt, Human
ucagucucuauaccaauaaa

SEQ ID NO: 1255941 - RNA, 13 nt, Human
ucagugaagacua

SEQ ID NO: 1255942 - RNA, 14 nt, Human
ucagugaaguugcu

SEQ ID NO: 1255943 - RNA, 16 nt, Human
ucagugaaguugcugc

SEQ ID NO: 1255944 - RNA, 17 nt, Human
ucagugaaguugcugcu

SEQ ID NO: 1255945 - RNA, 18 nt, Human
ucagugaaguugcugcuu

SEQ ID NO: 1255946 - RNA, 20 nt, Human
ucagugaaguugcugcuucu

SEQ ID NO: 1255947 - RNA, 18 nt, Human
ucagugacccuggcuccu

SEQ ID NO: 1255948 - RNA, 21 nt, Human
ucagucucuauaccaauaaag

SEQ ID NO: 1255949 - RNA, 18 nt, Human
ucagucucuauaccaaua

SEQ ID NO: 1255950 - RNA, 15 nt, Human
ucagucucuauacca

SEQ ID NO: 1255951 - RNA, 13 nt, Human
ucaguauuuaacu

SEQ ID NO: 1255952 - RNA, 14 nt, Human
ucaguauuuaacua

SEQ ID NO: 1255953 - RNA, 20 nt, Human
ucaguauuuaacuaauuaua

SEQ ID NO: 1255954 - RNA, 15 nt, Human
ucaguauuuaacuaa

SEQ ID NO: 1255955 - RNA, 16 nt, Human
ucagucucccucccuu

SEQ ID NO: 1255956 - RNA, 18 nt, Human
ucagucucagaaugucau

SEQ ID NO: 1255957 - RNA, 19 nt, Human
ucagucucagaaugucauu

SEQ ID NO: 1255958 - RNA, 16 nt, Human
ucagucaauauuuuua

SEQ ID NO: 1255959 - RNA, 13 nt, Human
ucagucacagcca

SEQ ID NO: 1255960 - RNA, 14 nt, Human
ucagucacagccac

SEQ ID NO: 1255961 - RNA, 15 nt, Human
ucagucacagccacc

SEQ ID NO: 1255962 - RNA, 13 nt, Human
ucaggcuagaugu

SEQ ID NO: 1255963 - RNA, 12 nt, Human
ucaggcugccug

SEQ ID NO: 1255964 - RNA, 13 nt, Human
ucaggcugccuga

SEQ ID NO: 1255965 - RNA, 16 nt, Human
ucaggcucuucuccuu

SEQ ID NO: 1255966 - RNA, 21 nt, Human
ucaggcucuucuccuuucaca

SEQ ID NO: 1255967 - RNA, 15 nt, Human
ucaggcugccugagu

SEQ ID NO: 1255968 - RNA, 17 nt, Human
ucagggaaggaggagcc

SEQ ID NO: 1255969 - RNA, 19 nt, Human
ucagggaaggaggagccug

SEQ ID NO: 1255970 - RNA, 20 nt, Human
ucagggaaggaggagccugu

SEQ ID NO: 1255971 - RNA, 21 nt, Human
ucagggaaggaggagccuguc

SEQ ID NO: 1255972 - RNA, 23 nt, Human
ucagggaaggaggagccuguccu

SEQ ID NO: 1255973 - RNA, 22 nt, Human
ucagggaaggaggagccugucc

SEQ ID NO: 1255974 - RNA, 15 nt, Human
ucagguauuaagaaa

SEQ ID NO: 1255975 - RNA, 17 nt, Human
ucagguauuaagaaaau

SEQ ID NO: 1255976 - RNA, 18 nt, Human
ucaggucacauaaaacuu

SEQ ID NO: 1255977 - RNA, 12 nt, Human
ucaggucccugc

SEQ ID NO: 1255978 - RNA, 23 nt, Human
ucaggucacauaaaacuuuguau

SEQ ID NO: 1255979 - RNA, 16 nt, Human
ucagguccucagagaa

SEQ ID NO: 1255980 - RNA, 21 nt, Human
ucaggugaaacuccagaugcc

SEQ ID NO: 1255981 - RNA, 16 nt, Human
ucaggugaaaggaaau

SEQ ID NO: 1255982 - RNA, 15 nt, Human
ucaggagcccuggga

SEQ ID NO: 1255983 - RNA, 14 nt, Human
ucaggagcccuggg

SEQ ID NO: 1255984 - RNA, 12 nt, Human
ucaggagcccug

SEQ ID NO: 1255985 - RNA, 11 nt, Human
ucaggagcccu

SEQ ID NO: 1255986 - RNA, 22 nt, Human
ucaggaaucaucaggaacguuu

SEQ ID NO: 1255987 - RNA, 16 nt, Human
ucaggaauucuuggag

SEQ ID NO: 1255988 - RNA, 19 nt, Human
ucaggaaucggaauccugu

SEQ ID NO: 1255989 - RNA, 17 nt, Human
ucaggaauauuuuccaa

SEQ ID NO: 1255990 - RNA, 18 nt, Human
ucaggaauauuuuccaaa

SEQ ID NO: 1255991 - RNA, 18 nt, Human
ucaggaauucuuggagaa

SEQ ID NO: 1255992 - RNA, 15 nt, Human
ucaggacacaggccu

SEQ ID NO: 1255993 - RNA, 16 nt, Human
ucaggacacaggccug

SEQ ID NO: 1255994 - RNA, 23 nt, Human
ucaggacacaggccuguguagcu

SEQ ID NO: 1255995 - RNA, 17 nt, Human
ucaggacacaggccugu

SEQ ID NO: 1255996 - RNA, 18 nt, Human
ucaggacacaggccugug

SEQ ID NO: 1255997 - RNA, 19 nt, Human
ucaggacacaggccugugu

SEQ ID NO: 1255998 - RNA, 18 nt, Human
ucaggagcccugggaggc

SEQ ID NO: 1255999 - RNA, 16 nt, Human
ucaggaguguguguga

SEQ ID NO: 1256000 - RNA, 20 nt, Human
ucaggaucaaaccccgacca

SEQ ID NO: 1256001 - RNA, 20 nt, Human
ucaggauccaagcuaagcac

SEQ ID NO: 1256002 - RNA, 22 nt, Human
ucaggauccaagcuaagcacug

SEQ ID NO: 1256003 - RNA, 14 nt, Human
ucaggaucuauuuu

SEQ ID NO: 1256004 - RNA, 18 nt, Human
ucaggaugagggaaaaga

SEQ ID NO: 1256005 - RNA, 19 nt, Human
ucaggaugagggaaaagaa

SEQ ID NO: 1256006 - RNA, 17 nt, Human
ucaggccuagaggccug

SEQ ID NO: 1256007 - RNA, 18 nt, Human
ucaggccuuugagcucag

SEQ ID NO: 1256008 - RNA, 20 nt, Human
ucaggcuacugcuucaaucu

SEQ ID NO: 1256009 - RNA, 15 nt, Human
ucaggcucuucuccu

SEQ ID NO: 1256010 - RNA, 14 nt, Human
ucagcuccaggugg

SEQ ID NO: 1256011 - RNA, 19 nt, Human
ucagcuccagguggcucug

SEQ ID NO: 1256012 - RNA, 13 nt, Human
ucagcucccacaa

SEQ ID NO: 1256013 - RNA, 16 nt, Human
ucagcucccacaagcc

SEQ ID NO: 1256014 - RNA, 15 nt, Human
ucaccggcucucacc

SEQ ID NO: 1256015 - RNA, 18 nt, Human
ucaccggggugguuuagu

SEQ ID NO: 1256016 - RNA, 22 nt, Human
ucaccggcucucaccuggcccu

SEQ ID NO: 1256017 - RNA, 13 nt, Human
ucaccgugggcuc

SEQ ID NO: 1256018 - RNA, 15 nt, Human
ucaccgugggcuccc

SEQ ID NO: 1256019 - RNA, 16 nt, Human
ucaccgugggcucccu

SEQ ID NO: 1256020 - RNA, 17 nt, Human
ucaccgugggcucccug

SEQ ID NO: 1256021 - RNA, 18 nt, Human
ucaccgugggcucccuga

SEQ ID NO: 1256022 - RNA, 19 nt, Human
ucaccgugggcucccugac

SEQ ID NO: 1256023 - RNA, 13 nt, Human
ucagcugucuuuu

SEQ ID NO: 1256024 - RNA, 14 nt, Human
ucagcugucuuuug

SEQ ID NO: 1256025 - RNA, 15 nt, Human
ucagcugucuuuugg

SEQ ID NO: 1256026 - RNA, 19 nt, Human
ucagcugucuuuuggagga

SEQ ID NO: 1256027 - RNA, 20 nt, Human
ucagcucccacaagccucug

SEQ ID NO: 1256028 - RNA, 18 nt, Human
ucagcucccacaagccuc

SEQ ID NO: 1256029 - RNA, 14 nt, Human
ucagcucugaaaga

SEQ ID NO: 1256030 - RNA, 16 nt, Human
ucagcucugaaagaga

SEQ ID NO: 1256031 - RNA, 18 nt, Human
ucagcucugaaagagaaa

SEQ ID NO: 1256032 - RNA, 21 nt, Human
ucagcucugaaagagaaacac

SEQ ID NO: 1256033 - RNA, 16 nt, Human
ucagcucugacauucu

SEQ ID NO: 1256034 - RNA, 22 nt, Human
ucagcucugacauucugauucg

SEQ ID NO: 1256035 - RNA, 19 nt, Human
ucagcucugggccauucuc

SEQ ID NO: 1256036 - RNA, 22 nt, Human
ucagcucuucuccauccuacca

SEQ ID NO: 1256037 - RNA, 16 nt, Human
uaugauucccagccag

SEQ ID NO: 1256038 - RNA, 16 nt, Human
uaugauucaaaugucu

SEQ ID NO: 1256039 - RNA, 21 nt, Human
uaugauucaaaugucuauaaa

SEQ ID NO: 1256040 - RNA, 21 nt, Human
uaugauuagcuuugucacugu

SEQ ID NO: 1256041 - RNA, 22 nt, Human
uaugauuacuggccuuuuucau

SEQ ID NO: 1256042 - RNA, 12 nt, Human
uaugauuauuaa

SEQ ID NO: 1256043 - RNA, 21 nt, Human
uaugauuauuaacgaugucca

SEQ ID NO: 1256044 - RNA, 15 nt, Human
uaugauuacuggccu

SEQ ID NO: 1256045 - RNA, 14 nt, Human
uaugagcucuucau

SEQ ID NO: 1256046 - RNA, 15 nt, Human
uaugagcucuucaug

SEQ ID NO: 1256047 - RNA, 16 nt, Human
uaugagcucuucaugu

SEQ ID NO: 1256048 - RNA, 18 nt, Human
uaugacuauguaaacuac

SEQ ID NO: 1256049 - RNA, 21 nt, Human
uaugacuugggcacccccagc

SEQ ID NO: 1256050 - RNA, 22 nt, Human
uaugacuugggcacccccagcc

SEQ ID NO: 1256051 - RNA, 23 nt, Human
uaugacuugggcacccccagccu

SEQ ID NO: 1256052 - RNA, 17 nt, Human
uaugacuauguaaacua

SEQ ID NO: 1256053 - RNA, 16 nt, Human
uaugacuauguaaacu

SEQ ID NO: 1256054 - RNA, 14 nt, Human
uaugcacaguaaaa

SEQ ID NO: 1256055 - RNA, 16 nt, Human
uaugcaauuuccuuuu

SEQ ID NO: 1256056 - RNA, 16 nt, Human
uaugcaaacaggguaa

SEQ ID NO: 1256057 - RNA, 14 nt, Human
uaugcaaaagcaag

SEQ ID NO: 1256058 - RNA, 19 nt, Human
uaugauuuuuuuuucauac

SEQ ID NO: 1256059 - RNA, 15 nt, Human
uaugauuuggaaaau

SEQ ID NO: 1256060 - RNA, 17 nt, Human
uaugauuuggaaaauaa

SEQ ID NO: 1256061 - RNA, 18 nt, Human
uaugauuuggaaaauaaa

SEQ ID NO: 1256062 - RNA, 17 nt, Human
uaugauuuaauuugaaa

SEQ ID NO: 1256063 - RNA, 18 nt, Human
uaugauuuaauuugaaau

SEQ ID NO: 1256064 - RNA, 13 nt, Human
uaugauuuacauu

SEQ ID NO: 1256065 - RNA, 17 nt, Human
uaugauuuuuuuuucau

SEQ ID NO: 1256066 - RNA, 20 nt, Human
uaugcauauuauuuuauguu

SEQ ID NO: 1256067 - RNA, 15 nt, Human
uaugcauauuuguuu

SEQ ID NO: 1256068 - RNA, 18 nt, Human
uaugcagagguccacaac

SEQ ID NO: 1256069 - RNA, 15 nt, Human
uaugcacaugaacuu

SEQ ID NO: 1256070 - RNA, 19 nt, Human
uaugcacaugaacuuagau

SEQ ID NO: 1256071 - RNA, 16 nt, Human
uaugcacaugaacuua

SEQ ID NO: 1256072 - RNA, 19 nt, Human
uaugcacuuauaauuuucc

SEQ ID NO: 1256073 - RNA, 22 nt, Human
uaugcacuuauaauuuuccuaa

SEQ ID NO: 1256074 - RNA, 20 nt, Human
uaugcacuuauaauuuuccu

SEQ ID NO: 1256075 - RNA, 18 nt, Human
uaugcagaacacauuuca

SEQ ID NO: 1256076 - RNA, 20 nt, Human
uaugcagaacacauuucaaa

SEQ ID NO: 1256077 - RNA, 15 nt, Human
uaugcuucuguuuua

SEQ ID NO: 1256078 - RNA, 16 nt, Human
uaugcuucuguuuuau

SEQ ID NO: 1256079 - RNA, 20 nt, Human
uaugcuuauauuguucacuu

SEQ ID NO: 1256080 - RNA, 14 nt, Human
uaugcauauuuguu

SEQ ID NO: 1256081 - RNA, 17 nt, Human
uauggaaauaaauguau

SEQ ID NO: 1256082 - RNA, 13 nt, Human
uauggaaauauau

SEQ ID NO: 1256083 - RNA, 15 nt, Human
uauggaaauauauau

SEQ ID NO: 1256084 - RNA, 14 nt, Human
uauggaaauauaua

SEQ ID NO: 1256085 - RNA, 18 nt, Human
uauggaauugauuugcau

SEQ ID NO: 1256086 - RNA, 15 nt, Human
uauggaauuuugcaa

SEQ ID NO: 1256087 - RNA, 16 nt, Human
uauggacaaaacaaga

SEQ ID NO: 1256088 - RNA, 11 nt, Human
uauggaauuga

SEQ ID NO: 1256089 - RNA, 19 nt, Human
uauggaauugauuugcauu

SEQ ID NO: 1256090 - RNA, 16 nt, Human
uaugcuugcaaaaacu

SEQ ID NO: 1256091 - RNA, 18 nt, Human
uaugcuuguaacuaaaau

SEQ ID NO: 1256092 - RNA, 20 nt, Human
uaugcuuguaacuaaaauaa

SEQ ID NO: 1256093 - RNA, 15 nt, Human
uaugcuuugaaacag

SEQ ID NO: 1256094 - RNA, 16 nt, Human
uauggaaauaaaugua

SEQ ID NO: 1256095 - RNA, 20 nt, Human
uaugaaguuuuuuuuauaca

SEQ ID NO: 1256096 - RNA, 18 nt, Human
uaugaauaaagacaccua

SEQ ID NO: 1256097 - RNA, 14 nt, Human
uaucuucacuuguc

SEQ ID NO: 1256098 - RNA, 15 nt, Human
uaucuucucaaguuc

SEQ ID NO: 1256099 - RNA, 17 nt, Human
uaucuucucaaguucua

SEQ ID NO: 1256100 - RNA, 18 nt, Human
uaucuucucaaguucuaa

SEQ ID NO: 1256101 - RNA, 20 nt, Human
uaucuucucaaguucuaaga

SEQ ID NO: 1256102 - RNA, 21 nt, Human
uaucuucucaaguucuaagau

SEQ ID NO: 1256103 - RNA, 16 nt, Human
uaucuguuugagaaag

SEQ ID NO: 1256104 - RNA, 15 nt, Human
uaucuguuugagaaa

SEQ ID NO: 1256105 - RNA, 19 nt, Human
uaucuguuugagaaaguca

SEQ ID NO: 1256106 - RNA, 18 nt, Human
uaucuuacuauuucacaa

SEQ ID NO: 1256107 - RNA, 17 nt, Human
uaucuuacuauuucaca

SEQ ID NO: 1256108 - RNA, 21 nt, Human
uaucuguagacggcucaguau

SEQ ID NO: 1256109 - RNA, 22 nt, Human
uaucuguaaugguacugacuuu

SEQ ID NO: 1256110 - RNA, 18 nt, Human
uaucugggcugugggcaa

SEQ ID NO: 1256111 - RNA, 11 nt, Human
uaucugggcuu

SEQ ID NO: 1256112 - RNA, 14 nt, Human
uaucugggcuuccu

SEQ ID NO: 1256113 - RNA, 15 nt, Human
uaucugggcuuccug

SEQ ID NO: 1256114 - RNA, 16 nt, Human
uaucugggcuuccugg

SEQ ID NO: 1256115 - RNA, 18 nt, Human
uaucugggcuuccuggag

SEQ ID NO: 1256116 - RNA, 20 nt, Human
uaucugggcuuccuggagca

SEQ ID NO: 1256117 - RNA, 13 nt, Human
uaucuguaauggu

SEQ ID NO: 1256118 - RNA, 15 nt, Human
uaucugucagcugca

SEQ ID NO: 1256119 - RNA, 17 nt, Human
uaugaauuacauuugua

SEQ ID NO: 1256120 - RNA, 15 nt, Human
uaugaaugugaagcc

SEQ ID NO: 1256121 - RNA, 16 nt, Human
uaugaaugugaagccu

SEQ ID NO: 1256122 - RNA, 17 nt, Human
uaugaaugugaagccuu

SEQ ID NO: 1256123 - RNA, 18 nt, Human
uaugaaugugaagccuuc

SEQ ID NO: 1256124 - RNA, 23 nt, Human
uaugaauuacauuuguauaaaau

SEQ ID NO: 1256125 - RNA, 19 nt, Human
uaugaaugugaagccuucc

SEQ ID NO: 1256126 - RNA, 14 nt, Human
uaugaauuauucaa

SEQ ID NO: 1256127 - RNA, 18 nt, Human
uaugaauuauucaauuua

SEQ ID NO: 1256128 - RNA, 19 nt, Human
uaugaauuauucaauuuau

SEQ ID NO: 1256129 - RNA, 18 nt, Human
uaugaauugaauuaucuu

SEQ ID NO: 1256130 - RNA, 22 nt, Human
uaucuucucaaguucuaagauu

SEQ ID NO: 1256131 - RNA, 13 nt, Human
uaugaauacuuug

SEQ ID NO: 1256132 - RNA, 15 nt, Human
uaugaauacuuugca

SEQ ID NO: 1256133 - RNA, 22 nt, Human
uaugacaguaauuguguuuaca

SEQ ID NO: 1256134 - RNA, 18 nt, Human
uaugacaguaauuguguu

SEQ ID NO: 1256135 - RNA, 17 nt, Human
uaugacaguaauugugu

SEQ ID NO: 1256136 - RNA, 15 nt, Human
uaugacaguaauugu

SEQ ID NO: 1256137 - RNA, 14 nt, Human
uaugaccacacucc

SEQ ID NO: 1256138 - RNA, 19 nt, Human
uaugaccacacuccagcug

SEQ ID NO: 1256139 - RNA, 20 nt, Human
uaugacaucacuuguacaaa

SEQ ID NO: 1256140 - RNA, 23 nt, Human
uaugacaucacuuguacaaaaua

SEQ ID NO: 1256141 - RNA, 24 nt, Human
uaugacaucacuuguacaaaauaa

SEQ ID NO: 1256142 - RNA, 23 nt, Human
uaugacaguaauuguguuuacau

SEQ ID NO: 1256143 - RNA, 19 nt, Human
uaugacaucacuuguacaa

SEQ ID NO: 1256144 - RNA, 18 nt, Human
uaucguaaaauuaagaaa

SEQ ID NO: 1256145 - RNA, 15 nt, Human
uaucguaaaauuaag

SEQ ID NO: 1256146 - RNA, 15 nt, Human
uauccuucagccuga

SEQ ID NO: 1256147 - RNA, 18 nt, Human
uauccuuucauauaguua

SEQ ID NO: 1256148 - RNA, 11 nt, Human
uauccucccug

SEQ ID NO: 1256149 - RNA, 12 nt, Human
uauccucccugu

SEQ ID NO: 1256150 - RNA, 14 nt, Human
uauccucccuguaa

SEQ ID NO: 1256151 - RNA, 15 nt, Human
uauccucccuguaac

SEQ ID NO: 1256152 - RNA, 16 nt, Human
uauccucccuguaacu

SEQ ID NO: 1256153 - RNA, 17 nt, Human
uauccucccuguaacuu

SEQ ID NO: 1256154 - RNA, 14 nt, Human
uauccucucuuccu

SEQ ID NO: 1256155 - RNA, 15 nt, Human
uauccucucuuccuc

SEQ ID NO: 1256156 - RNA, 18 nt, Human
uauccucucuuccucuuc

SEQ ID NO: 1256157 - RNA, 12 nt, Human
uauccucuguaa

SEQ ID NO: 1256158 - RNA, 14 nt, Human
uauccugaaauuuc

SEQ ID NO: 1256159 - RNA, 16 nt, Human
uauccugaaauuucag

SEQ ID NO: 1256160 - RNA, 17 nt, Human
uauccugaaauuucaga

SEQ ID NO: 1256161 - RNA, 21 nt, Human
uaucugaggcacaugucagca

SEQ ID NO: 1256162 - RNA, 23 nt, Human
uaucugaguuacagaaaugauua

SEQ ID NO: 1256163 - RNA, 13 nt, Human
uaucugaucagaa

SEQ ID NO: 1256164 - RNA, 22 nt, Human
uaucugcaagugagguguguca

SEQ ID NO: 1256165 - RNA, 21 nt, Human
uaucugccucucuuguaauuu

SEQ ID NO: 1256166 - RNA, 20 nt, Human
uaucugccucucuuguaauu

SEQ ID NO: 1256167 - RNA, 16 nt, Human
uaucugccucucuugu

SEQ ID NO: 1256168 - RNA, 15 nt, Human
uaucuggccucugcu

SEQ ID NO: 1256169 - RNA, 23 nt, Human
uaucugggaagcuauuuuuuuca

SEQ ID NO: 1256170 - RNA, 22 nt, Human
uaucuaccccagacuagaugua

SEQ ID NO: 1256171 - RNA, 22 nt, Human
uaucuaaguuaauuuaaaguug

SEQ ID NO: 1256172 - RNA, 13 nt, Human
uaucuaaucauga

SEQ ID NO: 1256173 - RNA, 13 nt, Human
uaucuaauuuaua

SEQ ID NO: 1256174 - RNA, 23 nt, Human
uaucuaaguuaauuuaaaguugu

SEQ ID NO: 1256175 - RNA, 19 nt, Human
uaucuaaguuaauuuaaag

SEQ ID NO: 1256176 - RNA, 20 nt, Human
uaucuaaguuaauuuaaagu

SEQ ID NO: 1256177 - RNA, 15 nt, Human
uaggucucaauaccu

SEQ ID NO: 1256178 - RNA, 16 nt, Human
uaggucagugcaaaua

SEQ ID NO: 1256179 - RNA, 20 nt, Human
uagguauaaguggugugugu

SEQ ID NO: 1256180 - RNA, 14 nt, Human
uagguaggaaaugu

SEQ ID NO: 1256181 - RNA, 16 nt, Human
uagguaguaccaaaau

SEQ ID NO: 1256182 - RNA, 14 nt, Human
uagguacacagcuc

SEQ ID NO: 1256183 - RNA, 16 nt, Human
uaggcuagggugggga

SEQ ID NO: 1256184 - RNA, 20 nt, Human
uaggccuugcggcuccucag

SEQ ID NO: 1256185 - RNA, 21 nt, Human
uaggccuugcggcuccucagg

SEQ ID NO: 1256186 - RNA, 16 nt, Human
uaggcuauuuguaaau

SEQ ID NO: 1256187 - RNA, 18 nt, Human
uaggcuauuuguaaaucu

SEQ ID NO: 1256188 - RNA, 20 nt, Human
uaggcuauuuguaaaucugc

SEQ ID NO: 1256189 - RNA, 17 nt, Human
uaggccguuccuucaaa

SEQ ID NO: 1256190 - RNA, 14 nt, Human
uaggcccccacuug

SEQ ID NO: 1256191 - RNA, 19 nt, Human
uaggcccccacuugccucu

SEQ ID NO: 1256192 - RNA, 21 nt, Human
uaggcccccacuugccucuuc

SEQ ID NO: 1256193 - RNA, 18 nt, Human
uaggccaugggacaggga

SEQ ID NO: 1256194 - RNA, 22 nt, Human
uaggaccaagcaucuugggggg

SEQ ID NO: 1256195 - RNA, 18 nt, Human
uaggaccaagcaucuugg

SEQ ID NO: 1256196 - RNA, 19 nt, Human
uaggaccaugguuaagagu

SEQ ID NO: 1256197 - RNA, 23 nt, Human
uaggaccaugguuaagaguccaa

SEQ ID NO: 1256198 - RNA, 19 nt, Human
uaggaccuuuccaccacag

SEQ ID NO: 1256199 - RNA, 20 nt, Human
uaggaauugacccacaagaa

SEQ ID NO: 1256200 - RNA, 19 nt, Human
uaggacacaguuccuggga

SEQ ID NO: 1256201 - RNA, 17 nt, Human
uaggaccaagcaucuug

SEQ ID NO: 1256202 - RNA, 12 nt, Human
uaggaauugacc

SEQ ID NO: 1256203 - RNA, 16 nt, Human
uaggaauggaaaggau

SEQ ID NO: 1256204 - RNA, 21 nt, Human
guggcucugaggugccugucc

SEQ ID NO: 1256205 - RNA, 17 nt, Human
guggcugaggccaccca

SEQ ID NO: 1256206 - RNA, 13 nt, Human
guggcugcagccu

SEQ ID NO: 1256207 - RNA, 14 nt, Human
guggcugcagccuc

SEQ ID NO: 1256208 - RNA, 17 nt, Human
guggcugcagccucagg

SEQ ID NO: 1256209 - RNA, 15 nt, Human
guggcugcagccuca

SEQ ID NO: 1256210 - RNA, 23 nt, Human
uaggaauagcaugucacuaaagc

SEQ ID NO: 1256211 - RNA, 20 nt, Human
uaguugcaacuuuguauaaa

SEQ ID NO: 1256212 - RNA, 13 nt, Human
uaguguucauaaa

SEQ ID NO: 1256213 - RNA, 15 nt, Human
uagugcuaacaugaa

SEQ ID NO: 1256214 - RNA, 16 nt, Human
uagugcaguuauuugc

SEQ ID NO: 1256215 - RNA, 22 nt, Human
uagugccacuuaauguauguua

SEQ ID NO: 1256216 - RNA, 13 nt, Human
uagucaaauugug

SEQ ID NO: 1256217 - RNA, 14 nt, Human
uagucaaauugugu

SEQ ID NO: 1256218 - RNA, 14 nt, Human
uagugcaaauuguc

SEQ ID NO: 1256219 - RNA, 15 nt, Human
uagugcaaauuguca

SEQ ID NO: 1256220 - RNA, 19 nt, Human
uaguauuuuuuguauaauu

SEQ ID NO: 1256221 - RNA, 18 nt, Human
uaguauuucuaugaaaua

SEQ ID NO: 1256222 - RNA, 19 nt, Human
uaguauuucuaugaaauau

SEQ ID NO: 1256223 - RNA, 13 nt, Human
uaguauuuucuaa

SEQ ID NO: 1256224 - RNA, 14 nt, Human
uaguauuuucuaaa

SEQ ID NO: 1256225 - RNA, 18 nt, Human
uaguauuuuuuguauaau

SEQ ID NO: 1256226 - RNA, 21 nt, Human
uaggugauccacucgccuuca

SEQ ID NO: 1256227 - RNA, 15 nt, Human
uaggugauccaugua

SEQ ID NO: 1256228 - RNA, 16 nt, Human
uaggugauccauguaa

SEQ ID NO: 1256229 - RNA, 19 nt, Human
uaggugauccauguaacug

SEQ ID NO: 1256230 - RNA, 22 nt, Human
uaggugauccauguaacugccu

SEQ ID NO: 1256231 - RNA, 21 nt, Human
uaggugauccauguaacugcc

SEQ ID NO: 1256232 - RNA, 22 nt, Human
uaggugcaauuucaagguucua

SEQ ID NO: 1256233 - RNA, 13 nt, Human
uaguaucaaaaga

SEQ ID NO: 1256234 - RNA, 18 nt, Human
uaguaucaucagauagca

SEQ ID NO: 1256235 - RNA, 20 nt, Human
uauaauucacauuguauuca

SEQ ID NO: 1256236 - RNA, 17 nt, Human
uauaauuauauguugua

SEQ ID NO: 1256237 - RNA, 15 nt, Human
uauaauucacauugu

SEQ ID NO: 1256238 - RNA, 13 nt, Human
uauaauuauaugu

SEQ ID NO: 1256239 - RNA, 19 nt, Human
uauaauuauauguuguaag

SEQ ID NO: 1256240 - RNA, 13 nt, Human
uauaauucuuuca

SEQ ID NO: 1256241 - RNA, 16 nt, Human
uauaauucuuucaaua

SEQ ID NO: 1256242 - RNA, 17 nt, Human
uauaauugccaaaaagu

SEQ ID NO: 1256243 - RNA, 17 nt, Human
uauaauuggauuuccua

SEQ ID NO: 1256244 - RNA, 18 nt, Human
uauaauuggauuuccuaa

SEQ ID NO: 1256245 - RNA, 19 nt, Human
uauaauuggauuuccuaau

SEQ ID NO: 1256246 - RNA, 20 nt, Human
uauaauuggauuuccuaaua

SEQ ID NO: 1256247 - RNA, 22 nt, Human
uauaauuggauuuccuaauacu

SEQ ID NO: 1256248 - RNA, 21 nt, Human
uauaauuguucucagaauccc

SEQ ID NO: 1256249 - RNA, 12 nt, Human
uauaccuguguu

SEQ ID NO: 1256250 - RNA, 23 nt, Human
uauaccuguguuucuugccucau

SEQ ID NO: 1256251 - RNA, 18 nt, Human
uauaauguuguuauuuaa

SEQ ID NO: 1256252 - RNA, 16 nt, Human
uauaaucaucaaguaa

SEQ ID NO: 1256253 - RNA, 17 nt, Human
uauaaucaucaaguaau

SEQ ID NO: 1256254 - RNA, 22 nt, Human
uauaaucaucaaguaauacaaa

SEQ ID NO: 1256255 - RNA, 23 nt, Human
uauaaucauuauuacuuuugcug

SEQ ID NO: 1256256 - RNA, 17 nt, Human
uauaaucauuauuacuu

SEQ ID NO: 1256257 - RNA, 16 nt, Human
uauaaucuuauaauug

SEQ ID NO: 1256258 - RNA, 17 nt, Human
uauaaucuuauaauugu

SEQ ID NO: 1256259 - RNA, 17 nt, Human
uauaauguuguuauuua

SEQ ID NO: 1256260 - RNA, 19 nt, Human
uauaauguuguuauuuaaa

SEQ ID NO: 1256261 - RNA, 22 nt, Human
uauaauaaaggacuguaaucuu

SEQ ID NO: 1256262 - RNA, 19 nt, Human
uauaauaaaggacuguaau

SEQ ID NO: 1256263 - RNA, 14 nt, Human
uauaauaaaggacu

SEQ ID NO: 1256264 - RNA, 11 nt, Human
uauaaaugucu

SEQ ID NO: 1256265 - RNA, 17 nt, Human
uauaaaugucuuuaaug

SEQ ID NO: 1256266 - RNA, 23 nt, Human
uauaaaugucuuuaaugcaauau

SEQ ID NO: 1256267 - RNA, 19 nt, Human
uauaaaugucuuuaaugca

SEQ ID NO: 1256268 - RNA, 16 nt, Human
uauaauaaauguacau

SEQ ID NO: 1256269 - RNA, 17 nt, Human
uauaauauacuauauuu

SEQ ID NO: 1256270 - RNA, 20 nt, Human
uauaauauacuauauuuaug

SEQ ID NO: 1256271 - RNA, 13 nt, Human
uauaauauuuuaa

SEQ ID NO: 1256272 - RNA, 17 nt, Human
uaguugccuuaaaauaa

SEQ ID NO: 1256273 - RNA, 21 nt, Human
uauaaagacguuuuauaagca

SEQ ID NO: 1256274 - RNA, 14 nt, Human
uauaaagaauugug

SEQ ID NO: 1256275 - RNA, 17 nt, Human
uauaaagacguuuuaua

SEQ ID NO: 1256276 - RNA, 12 nt, Human
uauaaagcauuu

SEQ ID NO: 1256277 - RNA, 12 nt, Human
uauaaagcagua

SEQ ID NO: 1256278 - RNA, 15 nt, Human
uauaaaugcaaauaa

SEQ ID NO: 1256279 - RNA, 16 nt, Human
uauaaaugcaaauaac

SEQ ID NO: 1256280 - RNA, 17 nt, Human
uauaaaugcaaauaaca

SEQ ID NO: 1256281 - RNA, 18 nt, Human
uauaaaugcaaauaacaa

SEQ ID NO: 1256282 - RNA, 17 nt, Human
uauacuauaguaccagu

SEQ ID NO: 1256283 - RNA, 22 nt, Human
uauacuagggagccauuugaga

SEQ ID NO: 1256284 - RNA, 20 nt, Human
uauacuagggagccauuuga

SEQ ID NO: 1256285 - RNA, 20 nt, Human
uauacgcagcgugcuuuaaa

SEQ ID NO: 1256286 - RNA, 22 nt, Human
uauaccuguguuucuugccuca

SEQ ID NO: 1256287 - RNA, 16 nt, Human
uauacgaaauaauugu

SEQ ID NO: 1256288 - RNA, 17 nt, Human
uauacgaaauaauuguu

SEQ ID NO: 1256289 - RNA, 17 nt, Human
uauacugcauacuuuuu

SEQ ID NO: 1256290 - RNA, 23 nt, Human
uauacugcuuggagcugagcaaa

SEQ ID NO: 1256291 - RNA, 12 nt, Human
uauacugcauac

SEQ ID NO: 1256292 - RNA, 16 nt, Human
uauacugcauacuuuu

SEQ ID NO: 1256293 - RNA, 13 nt, Human
uauaguuaacaca

SEQ ID NO: 1256294 - RNA, 15 nt, Human
uauaguuaacacacu

SEQ ID NO: 1256295 - RNA, 16 nt, Human
uauaguuaacacacua

SEQ ID NO: 1256296 - RNA, 18 nt, Human
uauaguuaacacacuacc

SEQ ID NO: 1256297 - RNA, 13 nt, Human
uauaguuacugug

SEQ ID NO: 1256298 - RNA, 15 nt, Human
uauaguuacugugua

SEQ ID NO: 1256299 - RNA, 16 nt, Human
uauaguuacuguguaa

SEQ ID NO: 1256300 - RNA, 18 nt, Human
uauaguuacuguguaauu

SEQ ID NO: 1256301 - RNA, 20 nt, Human
uauaguuacuguguaauuag

SEQ ID NO: 1256302 - RNA, 22 nt, Human
uauaguuacuguguaauuagug

SEQ ID NO: 1256303 - RNA, 17 nt, Human
uauaguuaacacacuac

SEQ ID NO: 1256304 - RNA, 22 nt, Human
uauaguuauuaaguucuuuaaa

SEQ ID NO: 1256305 - RNA, 21 nt, Human
uauaguucaugucugcuauca

SEQ ID NO: 1256306 - RNA, 12 nt, Human
uauaguucuaga

SEQ ID NO: 1256307 - RNA, 13 nt, Human
uauaguucuagac

SEQ ID NO: 1256308 - RNA, 15 nt, Human
uauaguucuagacau

SEQ ID NO: 1256309 - RNA, 12 nt, Human
uauaguucuagg

SEQ ID NO: 1256310 - RNA, 13 nt, Human
uauaguucuaggc

SEQ ID NO: 1256311 - RNA, 14 nt, Human
uauaguuucugagg

SEQ ID NO: 1256312 - RNA, 22 nt, Human
uauaguuucugaggcuuuauga

SEQ ID NO: 1256313 - RNA, 15 nt, Human
uauaguuuuacuuuu

SEQ ID NO: 1256314 - RNA, 13 nt, Human
uauauaacaaugc

SEQ ID NO: 1256315 - RNA, 22 nt, Human
uauauaaauauauuauuacuug

SEQ ID NO: 1256316 - RNA, 16 nt, Human
uauaguuuuacuuuua

SEQ ID NO: 1256317 - RNA, 17 nt, Human
uauaguuuuacuuuuaa

SEQ ID NO: 1256318 - RNA, 19 nt, Human
uauauaaauauauuauuac

SEQ ID NO: 1256319 - RNA, 14 nt, Human
uauauguguaugca

SEQ ID NO: 1256320 - RNA, 13 nt, Human
uauaugcuucugu

SEQ ID NO: 1256321 - RNA, 21 nt, Human
uauaugcuuacugauauauuu

SEQ ID NO: 1256322 - RNA, 16 nt, Human
uauaugcuuacugaua

SEQ ID NO: 1256323 - RNA, 17 nt, Human
uauaugcuuacugauau

SEQ ID NO: 1256324 - RNA, 14 nt, Human
uauaugcuuacuga

SEQ ID NO: 1256325 - RNA, 14 nt, Human
uauuucuaugaaau

SEQ ID NO: 1256326 - RNA, 15 nt, Human
uauuucuaugaaaua

SEQ ID NO: 1256327 - RNA, 22 nt, Human
uauuucuuccuaccaagucaaa

SEQ ID NO: 1256328 - RNA, 16 nt, Human
uauuugaaccaauaaa

SEQ ID NO: 1256329 - RNA, 14 nt, Human
uauuugaacuuuuu

SEQ ID NO: 1256330 - RNA, 20 nt, Human
uauuugaaaacauguuuauu

SEQ ID NO: 1256331 - RNA, 13 nt, Human
uauuucuaugaaa

SEQ ID NO: 1256332 - RNA, 14 nt, Human
uauuuauuacugua

SEQ ID NO: 1256333 - RNA, 13 nt, Human
uauuuauguaugg

SEQ ID NO: 1256334 - RNA, 12 nt, Human
uauuuauguauu

SEQ ID NO: 1256335 - RNA, 13 nt, Human
uauuuauguauug

SEQ ID NO: 1256336 - RNA, 20 nt, Human
uauuuauguauugugcaaug

SEQ ID NO: 1256337 - RNA, 13 nt, Human
uauuuaugaaagu

SEQ ID NO: 1256338 - RNA, 12 nt, Human
uauuuaucuuua

SEQ ID NO: 1256339 - RNA, 16 nt, Human
uauuuaacagaaauug

SEQ ID NO: 1256340 - RNA, 15 nt, Human
uauuuauauguacau

SEQ ID NO: 1256341 - RNA, 17 nt, Human
uauuuauauguacauga

SEQ ID NO: 1256342 - RNA, 13 nt, Human
uauuguuguccuu

SEQ ID NO: 1256343 - RNA, 14 nt, Human
uauuguuguccuuu

SEQ ID NO: 1256344 - RNA, 16 nt, Human
uauuguuguccuuuuc

SEQ ID NO: 1256345 - RNA, 18 nt, Human
uauuguuguccuuuucau

SEQ ID NO: 1256346 - RNA, 22 nt, Human
uauuguuguccuuuucauaggu

SEQ ID NO: 1256347 - RNA, 12 nt, Human
uauuguuucaau

SEQ ID NO: 1256348 - RNA, 18 nt, Human
uauuguuucaauugcauc

SEQ ID NO: 1256349 - RNA, 18 nt, Human
uauuuaaauguaaagaca

SEQ ID NO: 1256350 - RNA, 15 nt, Human
uauuuaacaagaucu

SEQ ID NO: 1256351 - RNA, 12 nt, Human
uauuuaacagaa

SEQ ID NO: 1256352 - RNA, 13 nt, Human
uauuuaacagaaa

SEQ ID NO: 1256353 - RNA, 14 nt, Human
uauuuaacagaaau

SEQ ID NO: 1256354 - RNA, 23 nt, Human
uauugugcaauguguauaaacaa

SEQ ID NO: 1256355 - RNA, 15 nt, Human
uauuguucucacacu

SEQ ID NO: 1256356 - RNA, 14 nt, Human
uauuguugaaaaag

SEQ ID NO: 1256357 - RNA, 17 nt, Human
uauuguugaaaaaguuu

SEQ ID NO: 1256358 - RNA, 17 nt, Human
uauuguugcauugcuuu

SEQ ID NO: 1256359 - RNA, 19 nt, Human
uauugugcaauguaaauau

SEQ ID NO: 1256360 - RNA, 14 nt, Human
uauugugcaaugug

SEQ ID NO: 1256361 - RNA, 16 nt, Human
uauugugcaaugugua

SEQ ID NO: 1256362 - RNA, 18 nt, Human
uauugugcaauguguaua

SEQ ID NO: 1256363 - RNA, 17 nt, Human
uauugcauuuauaugua

SEQ ID NO: 1256364 - RNA, 13 nt, Human
uauugcauuuaua

SEQ ID NO: 1256365 - RNA, 15 nt, Human
uauugcauuaauuuu

SEQ ID NO: 1256366 - RNA, 20 nt, Human
uauugcaguuuaucauucaa

SEQ ID NO: 1256367 - RNA, 19 nt, Human
uauugcaguuuaucauuca

SEQ ID NO: 1256368 - RNA, 14 nt, Human
uauugcaaagucag

SEQ ID NO: 1256369 - RNA, 20 nt, Human
uauugcaaagucaggaauca

SEQ ID NO: 1256370 - RNA, 13 nt, Human
uauugcacauugu

SEQ ID NO: 1256371 - RNA, 17 nt, Human
uauugcacauuguaaaa

SEQ ID NO: 1256372 - RNA, 11 nt, Human
uauugcaguuu

SEQ ID NO: 1256373 - RNA, 13 nt, Human
uauugcaguuuau

SEQ ID NO: 1256374 - RNA, 15 nt, Human
uauugcaguuuauca

SEQ ID NO: 1256375 - RNA, 17 nt, Human
uauuccaagacaugucu

SEQ ID NO: 1256376 - RNA, 15 nt, Human
uauucauuuucucua

SEQ ID NO: 1256377 - RNA, 17 nt, Human
uauugauaagaucuuuu

SEQ ID NO: 1256378 - RNA, 18 nt, Human
uauugauaagaucuuuua

SEQ ID NO: 1256379 - RNA, 19 nt, Human
uauugauaagaucuuuuau

SEQ ID NO: 1256380 - RNA, 23 nt, Human
uauugauaagaucuuuuauuuug

SEQ ID NO: 1256381 - RNA, 23 nt, Human
uauucauccaaguuaaauguaga

SEQ ID NO: 1256382 - RNA, 18 nt, Human
uauucauuguggucauag

SEQ ID NO: 1256383 - RNA, 14 nt, Human
uauucauuuucucu

SEQ ID NO: 1256384 - RNA, 16 nt, Human
uauucauuuucucuaa

SEQ ID NO: 1256385 - RNA, 14 nt, Human
uauuaucugucagc

SEQ ID NO: 1256386 - RNA, 12 nt, Human
uauuaucuuuuc

SEQ ID NO: 1256387 - RNA, 16 nt, Human
uauuauccccauuucu

SEQ ID NO: 1256388 - RNA, 15 nt, Human
uauuaucccagcugc

SEQ ID NO: 1256389 - RNA, 14 nt, Human
uauuaucugggcuu

SEQ ID NO: 1256390 - RNA, 13 nt, Human
uauuaucugucag

SEQ ID NO: 1256391 - RNA, 15 nt, Human
uauuaucaacaauag

SEQ ID NO: 1256392 - RNA, 14 nt, Human
uauuaucuuuucau

SEQ ID NO: 1256393 - RNA, 19 nt, Human
uauuaucuuuucauacauu

SEQ ID NO: 1256394 - RNA, 13 nt, Human
uauuaugaaugug

SEQ ID NO: 1256395 - RNA, 14 nt, Human
uauuaugaauguga

SEQ ID NO: 1256396 - RNA, 14 nt, Human
uauuaugauuagcu

SEQ ID NO: 1256397 - RNA, 20 nt, Human
uauuaugaaugugaagccuu

SEQ ID NO: 1256398 - RNA, 21 nt, Human
uauuaugaaugugaagccuuc

SEQ ID NO: 1256399 - RNA, 22 nt, Human
uauuaugaaugugaagccuucc

SEQ ID NO: 1256400 - RNA, 14 nt, Human
uauuaugagaugcu

SEQ ID NO: 1256401 - RNA, 15 nt, Human
uauuaugagaugcug

SEQ ID NO: 1256402 - RNA, 17 nt, Human
uauuaugagaugcuggc

SEQ ID NO: 1256403 - RNA, 19 nt, Human
uauuaugcauuauaucaaa

SEQ ID NO: 1256404 - RNA, 20 nt, Human
uauuauggaggcaggaguuu

SEQ ID NO: 1256405 - RNA, 17 nt, Human
uauuaugucucuucuga

SEQ ID NO: 1256406 - RNA, 16 nt, Human
uauuauguuaaaacug

SEQ ID NO: 1256407 - RNA, 21 nt, Human
uauuaugucucuucugagcua

SEQ ID NO: 1256408 - RNA, 13 nt, Human
uauuauuuauaua

SEQ ID NO: 1256409 - RNA, 14 nt, Human
uauuauuuguguuu

SEQ ID NO: 1256410 - RNA, 15 nt, Human
uauuaagcaucagaa

SEQ ID NO: 1256411 - RNA, 18 nt, Human
uauuaacuuuaauguuuu

SEQ ID NO: 1256412 - RNA, 16 nt, Human
uauuaagguguggcuu

SEQ ID NO: 1256413 - RNA, 19 nt, Human
uauuaauaaacauucuauc

SEQ ID NO: 1256414 - RNA, 16 nt, Human
uauuaaguaacuuauu

SEQ ID NO: 1256415 - RNA, 14 nt, Human
uauuauaaucuuau

SEQ ID NO: 1256416 - RNA, 19 nt, Human
uauuauaaucuuauaauug

SEQ ID NO: 1256417 - RNA, 17 nt, Human
uauuauauuuacaaaug

SEQ ID NO: 1256418 - RNA, 21 nt, Human
uauuauauguacccucugaaa

SEQ ID NO: 1256419 - RNA, 17 nt, Human
uauuauauguacccucu

SEQ ID NO: 1256420 - RNA, 18 nt, Human
uauuauacuuguaauuau

SEQ ID NO: 1256421 - RNA, 17 nt, Human
uauuauacuuguaauua

SEQ ID NO: 1256422 - RNA, 12 nt, Human
uauuauauggaa

SEQ ID NO: 1256423 - RNA, 13 nt, Human
uauuauauggaaa

SEQ ID NO: 1256424 - RNA, 13 nt, Human
uauguguguuuua

SEQ ID NO: 1256425 - RNA, 16 nt, Human
uauggagucauuuuua

SEQ ID NO: 1256426 - RNA, 22 nt, Human
uauggagucauuuuuacaaugu

SEQ ID NO: 1256427 - RNA, 14 nt, Human
uauggaggcaggag

SEQ ID NO: 1256428 - RNA, 14 nt, Human
uauggagagcccug

SEQ ID NO: 1256429 - RNA, 15 nt, Human
uauggagagcccugg

SEQ ID NO: 1256430 - RNA, 16 nt, Human
uauggagagcccuggg

SEQ ID NO: 1256431 - RNA, 13 nt, Human
uauggacuaucug

SEQ ID NO: 1256432 - RNA, 17 nt, Human
uauggacuaucugucug

SEQ ID NO: 1256433 - RNA, 18 nt, Human
uauggacuaucugucugg

SEQ ID NO: 1256434 - RNA, 21 nt, Human
uauggacuaucugucuggugg

SEQ ID NO: 1256435 - RNA, 12 nt, Human
uauguuaaaacu

SEQ ID NO: 1256436 - RNA, 19 nt, Human
uauguuagugcaaauuguc

SEQ ID NO: 1256437 - RNA, 15 nt, Human
uauguuauauauaaa

SEQ ID NO: 1256438 - RNA, 19 nt, Human
uauguuauauauaaauaua

SEQ ID NO: 1256439 - RNA, 21 nt, Human
uauguuauauauaaauauauu

SEQ ID NO: 1256440 - RNA, 19 nt, Human
uauguuaagggaagaauuc

SEQ ID NO: 1256441 - RNA, 18 nt, Human
uauguuacuacaugcacu

SEQ ID NO: 1256442 - RNA, 16 nt, Human
uauguucagauuauug

SEQ ID NO: 1256443 - RNA, 20 nt, Human
uauguuauauauaaauauau

SEQ ID NO: 1256444 - RNA, 16 nt, Human
uauguucaaagucaaa

SEQ ID NO: 1256445 - RNA, 21 nt, Human
uauguucaacuaggaucagaa

SEQ ID NO: 1256446 - RNA, 17 nt, Human
uauguucuaagaaguga

SEQ ID NO: 1256447 - RNA, 14 nt, Human
uauguuccauuaaa

SEQ ID NO: 1256448 - RNA, 15 nt, Human
uauguuccauuaaac

SEQ ID NO: 1256449 - RNA, 16 nt, Human
uauguuccauuaaacg

SEQ ID NO: 1256450 - RNA, 20 nt, Human
uauguuccauuaaacgauuu

SEQ ID NO: 1256451 - RNA, 18 nt, Human
uauguucuaaccuuuaca

SEQ ID NO: 1256452 - RNA, 17 nt, Human
uauguugaagccuuugu

SEQ ID NO: 1256453 - RNA, 12 nt, Human
uauguugaauac

SEQ ID NO: 1256454 - RNA, 15 nt, Human
uauguugaauacuuu

SEQ ID NO: 1256455 - RNA, 18 nt, Human
uauguugaauacuuuuua

SEQ ID NO: 1256456 - RNA, 22 nt, Human
uauguuguaauauuucuucaaa

SEQ ID NO: 1256457 - RNA, 13 nt, Human
uauuaacauaccu

SEQ ID NO: 1256458 - RNA, 17 nt, Human
uauuaacuuuaauguuu

SEQ ID NO: 1256459 - RNA, 15 nt, Human
uauuaacgaugucca

SEQ ID NO: 1256460 - RNA, 20 nt, Human
ucaaaccaaaucacugaacu

SEQ ID NO: 1256461 - RNA, 15 nt, Human
ucaaacauuuugaaa

SEQ ID NO: 1256462 - RNA, 17 nt, Human
ucaaacauuuugaaagu

SEQ ID NO: 1256463 - RNA, 18 nt, Human
ucaaacauuuugaaaguc

SEQ ID NO: 1256464 - RNA, 19 nt, Human
ucaaaccccgaccaccugc

SEQ ID NO: 1256465 - RNA, 20 nt, Human
ucaaaccccgaccaccugcc

SEQ ID NO: 1256466 - RNA, 13 nt, Human
ucaaacauuuucu

SEQ ID NO: 1256467 - RNA, 15 nt, Human
ucaaacauuuucugg

SEQ ID NO: 1256468 - RNA, 12 nt, Human
ucaaacauuuug

SEQ ID NO: 1256469 - RNA, 23 nt, Human
ucaaaccccgaccaccugcccaa

SEQ ID NO: 1256470 - RNA, 15 nt, Human
ucaaacccuagccuu

SEQ ID NO: 1256471 - RNA, 16 nt, Human
ucaaacccuagccuug

SEQ ID NO: 1256472 - RNA, 17 nt, Human
ucaaacccuagccuugc

SEQ ID NO: 1256473 - RNA, 18 nt, Human
ucaaacccuagccuugcu

SEQ ID NO: 1256474 - RNA, 19 nt, Human
ucaaacccuagccuugcuu

SEQ ID NO: 1256475 - RNA, 20 nt, Human
ucaaacccuagccuugcuug

SEQ ID NO: 1256476 - RNA, 21 nt, Human
ucaaacccuagccuugcuugu

SEQ ID NO: 1256477 - RNA, 19 nt, Human
ucaaacugaggaauuucac

SEQ ID NO: 1256478 - RNA, 17 nt, Human
ucaaacauauauaacaa

SEQ ID NO: 1256479 - RNA, 21 nt, Human
uauuugcauaacaauuccucu

SEQ ID NO: 1256480 - RNA, 22 nt, Human
uauuugcauaacaauuccucua

SEQ ID NO: 1256481 - RNA, 21 nt, Human
uauuugaaugauuuuucuuua

SEQ ID NO: 1256482 - RNA, 19 nt, Human
uauuugagaagcugcucaa

SEQ ID NO: 1256483 - RNA, 21 nt, Human
uauuugacaacguuucagcga

SEQ ID NO: 1256484 - RNA, 16 nt, Human
ucaaauccuugaagau

SEQ ID NO: 1256485 - RNA, 20 nt, Human
ucaaaucuaccacuguauga

SEQ ID NO: 1256486 - RNA, 15 nt, Human
ucaaaucuaccacug

SEQ ID NO: 1256487 - RNA, 23 nt, Human
ucaaaugaauggaggaacuuucc

SEQ ID NO: 1256488 - RNA, 20 nt, Human
ucaaauggggccagauccag

SEQ ID NO: 1256489 - RNA, 20 nt, Human
ucaaaugguaggcauuuccu

SEQ ID NO: 1256490 - RNA, 21 nt, Human
ucaaaugguaggcauuuccua

SEQ ID NO: 1256491 - RNA, 16 nt, Human
ucaaaugguaucuuuu

SEQ ID NO: 1256492 - RNA, 22 nt, Human
ucaaacuuggauacuuggauuu

SEQ ID NO: 1256493 - RNA, 21 nt, Human
ucaaagaggcugaggcuggca

SEQ ID NO: 1256494 - RNA, 12 nt, Human
ucaaacuuggau

SEQ ID NO: 1256495 - RNA, 16 nt, Human
ucaaggaauuucuuaa

SEQ ID NO: 1256496 - RNA, 19 nt, Human
ucaaggaauuucuuaacuu

SEQ ID NO: 1256497 - RNA, 21 nt, Human
ucaaggaauuucuuaacuucu

SEQ ID NO: 1256498 - RNA, 23 nt, Human
ucaaggaauuucuuaacuucuug

SEQ ID NO: 1256499 - RNA, 21 nt, Human
ucaaggacacgggccugucca

SEQ ID NO: 1256500 - RNA, 20 nt, Human
ucaaggaaguagaaacaaaa

SEQ ID NO: 1256501 - RNA, 22 nt, Human
ucaacuccaaacugacucuuaa

SEQ ID NO: 1256502 - RNA, 13 nt, Human
ucaaccugccuga

SEQ ID NO: 1256503 - RNA, 17 nt, Human
ucaaccugggcaaagcc

SEQ ID NO: 1256504 - RNA, 14 nt, Human
ucaacucccugccc

SEQ ID NO: 1256505 - RNA, 15 nt, Human
ucaacucccugcccc

SEQ ID NO: 1256506 - RNA, 21 nt, Human
ucaacucccugccccccagcc

SEQ ID NO: 1256507 - RNA, 22 nt, Human
ucaacucccugccccccagccc

SEQ ID NO: 1256508 - RNA, 20 nt, Human
ucaacucucuuauugccuca

SEQ ID NO: 1256509 - RNA, 21 nt, Human
ucaacucucuuauugccucac

SEQ ID NO: 1256510 - RNA, 23 nt, Human
ucaacucucuuauugccucacuu

SEQ ID NO: 1256511 - RNA, 24 nt, Human
ucaacucucuuauugccucacuuc

SEQ ID NO: 1256512 - RNA, 18 nt, Human
ucaacugaccagccucca

SEQ ID NO: 1256513 - RNA, 19 nt, Human
ucaacucuugaguuuuuca

SEQ ID NO: 1256514 - RNA, 14 nt, Human
ucaacucuuuguua

SEQ ID NO: 1256515 - RNA, 22 nt, Human
ucaacucuuuguuauuugaaaa

SEQ ID NO: 1256516 - RNA, 24 nt, Human
ucaacugaccagccuccaugcugc

SEQ ID NO: 1256517 - RNA, 16 nt, Human
ucaacucuuuguuauu

SEQ ID NO: 1256518 - RNA, 20 nt, Human
ucaaauguuuaaucauauaa

SEQ ID NO: 1256519 - RNA, 18 nt, Human
ucaaauguuuaaucauau

SEQ ID NO: 1256520 - RNA, 17 nt, Human
ucaaauguuuaaucaua

SEQ ID NO: 1256521 - RNA, 15 nt, Human
ucaaauguuuaauca

SEQ ID NO: 1256522 - RNA, 14 nt, Human
ucaaauguuuaauc

SEQ ID NO: 1256523 - RNA, 12 nt, Human
ucaaauguuuaa

SEQ ID NO: 1256524 - RNA, 23 nt, Human
ucaaauguucuaaguuucuaaga

SEQ ID NO: 1256525 - RNA, 13 nt, Human
ucaaauguucuaa

SEQ ID NO: 1256526 - RNA, 14 nt, Human
ucaaauguucuaag

SEQ ID NO: 1256527 - RNA, 15 nt, Human
ucaaauguucuaagu

SEQ ID NO: 1256528 - RNA, 19 nt, Human
ucaaauguucuaaguuucu

SEQ ID NO: 1256529 - RNA, 20 nt, Human
ucaaauguucuaaguuucua

SEQ ID NO: 1256530 - RNA, 21 nt, Human
ucaaauguucuaaguuucuaa

SEQ ID NO: 1256531 - RNA, 22 nt, Human
ucaaauguucuaaguuucuaag

SEQ ID NO: 1256532 - RNA, 19 nt, Human
ucaaccccuccccuccauc

SEQ ID NO: 1256533 - RNA, 21 nt, Human
ucaaccccuccccuccauccc

SEQ ID NO: 1256534 - RNA, 23 nt, Human
ucaaccccuccccuccaucccug

SEQ ID NO: 1256535 - RNA, 23 nt, Human
ucaauuaaaauagucucuuuaaa

SEQ ID NO: 1256536 - RNA, 15 nt, Human
ucaauguuuucaguu

SEQ ID NO: 1256537 - RNA, 14 nt, Human
ucaauuauaguuuc

SEQ ID NO: 1256538 - RNA, 15 nt, Human
ucaauuauaguuucu

SEQ ID NO: 1256539 - RNA, 16 nt, Human
ucaauuauaguuucug

SEQ ID NO: 1256540 - RNA, 17 nt, Human
ucaauuauaguuucuga

SEQ ID NO: 1256541 - RNA, 19 nt, Human
ucaauuauaguuucugagg

SEQ ID NO: 1256542 - RNA, 14 nt, Human
ucaauaaaauccau

SEQ ID NO: 1256543 - RNA, 18 nt, Human
ucaauguuucuucuaggu

SEQ ID NO: 1256544 - RNA, 22 nt, Human
ucacaagacccaaaaggcagaa

SEQ ID NO: 1256545 - RNA, 21 nt, Human
ucaauuccaacaguuuaauga

SEQ ID NO: 1256546 - RNA, 18 nt, Human
ucaauuauaguuucugag

SEQ ID NO: 1256547 - RNA, 15 nt, Human
ucaauucaaagcugu

SEQ ID NO: 1256548 - RNA, 17 nt, Human
ucaauucaaagcugugu

SEQ ID NO: 1256549 - RNA, 22 nt, Human
ucaauucaaagcuguguguuug

SEQ ID NO: 1256550 - RNA, 15 nt, Human
ucaauuccaacaguu

SEQ ID NO: 1256551 - RNA, 18 nt, Human
ucaauuccaacaguuuaa

SEQ ID NO: 1256552 - RNA, 19 nt, Human
ucaauuccaacaguuuaau

SEQ ID NO: 1256553 - RNA, 20 nt, Human
ucaauuccaacaguuuaaug

SEQ ID NO: 1256554 - RNA, 14 nt, Human
ucaauuccaccugc

SEQ ID NO: 1256555 - RNA, 23 nt, Human
ucacaagauggaauuuaucaaac

SEQ ID NO: 1256556 - RNA, 12 nt, Human
ucacaaggcagc

SEQ ID NO: 1256557 - RNA, 16 nt, Human
ucacaaggcagcaagg

SEQ ID NO: 1256558 - RNA, 18 nt, Human
ucacaaggcagcaaggcc

SEQ ID NO: 1256559 - RNA, 23 nt, Human
ucacaaggcagcaaggcccgagc

SEQ ID NO: 1256560 - RNA, 22 nt, Human
ucacaaggcagcaaggcccgag

SEQ ID NO: 1256561 - RNA, 22 nt, Human
ucacaaguggguacccccagga

SEQ ID NO: 1256562 - RNA, 20 nt, Human
ucacaaguggguacccccag

SEQ ID NO: 1256563 - RNA, 12 nt, Human
ucacacaccugu

SEQ ID NO: 1256564 - RNA, 14 nt, Human
ucacauuggaaaca

SEQ ID NO: 1256565 - RNA, 15 nt, Human
ucacaguauugcuca

SEQ ID NO: 1256566 - RNA, 16 nt, Human
ucacaggugacucuaa

SEQ ID NO: 1256567 - RNA, 15 nt, Human
ucacaggucccaaau

SEQ ID NO: 1256568 - RNA, 14 nt, Human
ucacaguauugcuc

SEQ ID NO: 1256569 - RNA, 19 nt, Human
ucacaggacucugccuccu

SEQ ID NO: 1256570 - RNA, 23 nt, Human
ucacaggacucugccuccucuuc

SEQ ID NO: 1256571 - RNA, 19 nt, Human
ucacaggagggagggggaa

SEQ ID NO: 1256572 - RNA, 12 nt, Human
ucacaggcagcc

SEQ ID NO: 1256573 - RNA, 23 nt, Human
ucacagguagacaguauauaacu

SEQ ID NO: 1256574 - RNA, 12 nt, Human
ucacacacugau

SEQ ID NO: 1256575 - RNA, 19 nt, Human
ucacacaggcauuuccugg

SEQ ID NO: 1256576 - RNA, 17 nt, Human
ucacaggacucugccuc

SEQ ID NO: 1256577 - RNA, 18 nt, Human
ucacaggacucugccucc

SEQ ID NO: 1256578 - RNA, 15 nt, Human
ucacaccacuagccu

SEQ ID NO: 1256579 - RNA, 23 nt, Human
ucacaccaggcuugccugcaggc

SEQ ID NO: 1256580 - RNA, 12 nt, Human
ucacacaggcau

SEQ ID NO: 1256581 - RNA, 20 nt, Human
ucacaccacuagccucaggg

SEQ ID NO: 1256582 - RNA, 21 nt, Human
ucacaccaggcuugccugcag

SEQ ID NO: 1256583 - RNA, 22 nt, Human
ucacaccaggcuugccugcagg

SEQ ID NO: 1256584 - RNA, 12 nt, Human
ucacauuuaaau

SEQ ID NO: 1256585 - RNA, 22 nt, Human
ucacauuguauucagaguugau

SEQ ID NO: 1256586 - RNA, 17 nt, Human
ucacauuggaaacaagu

SEQ ID NO: 1256587 - RNA, 19 nt, Human
ucaccagagacuuuagggg

SEQ ID NO: 1256588 - RNA, 15 nt, Human
ucaccagagacuuua

SEQ ID NO: 1256589 - RNA, 14 nt, Human
ucaccagagacuuu

SEQ ID NO: 1256590 - RNA, 15 nt, Human
ucaccccuguuucug

SEQ ID NO: 1256591 - RNA, 20 nt, Human
ucaccacgacuggccagggc

SEQ ID NO: 1256592 - RNA, 18 nt, Human
ucaccacgacuggccagg

SEQ ID NO: 1256593 - RNA, 16 nt, Human
ucaccacugcccccug

SEQ ID NO: 1256594 - RNA, 22 nt, Human
ucaccgacugaaaauauuguuu

SEQ ID NO: 1256595 - RNA, 16 nt, Human
ucaccgagugggggca

SEQ ID NO: 1256596 - RNA, 13 nt, Human
ucacccuuugcug

SEQ ID NO: 1256597 - RNA, 15 nt, Human
ucacccuuugcugug

SEQ ID NO: 1256598 - RNA, 22 nt, Human
ucacccuuugcugugaggcugu

SEQ ID NO: 1256599 - RNA, 20 nt, Human
ucacccuggggcuaggaaau

SEQ ID NO: 1256600 - RNA, 17 nt, Human
ucacccuggaggcaccu

SEQ ID NO: 1256601 - RNA, 18 nt, Human
ucacccuggaggcaccug

SEQ ID NO: 1256602 - RNA, 15 nt, Human
ucacccuaccugugc

SEQ ID NO: 1256603 - RNA, 17 nt, Human
ucacccuaccugugccu

SEQ ID NO: 1256604 - RNA, 23 nt, Human
ucacccugauuuaggagaagcca

SEQ ID NO: 1256605 - RNA, 13 nt, Human
ucacccugccuua

SEQ ID NO: 1256606 - RNA, 15 nt, Human
ucacccugccuuauc

SEQ ID NO: 1256607 - RNA, 19 nt, Human
guggcaucaucucagcuca

SEQ ID NO: 1256608 - RNA, 15 nt, Human
guggccaagaagcag

SEQ ID NO: 1256609 - RNA, 17 nt, Human
guggccaagaagcagug

SEQ ID NO: 1256610 - RNA, 22 nt, Human
guggccaagaagcaguggccuu

SEQ ID NO: 1256611 - RNA, 18 nt, Human
guggccaagagaaacuuc

SEQ ID NO: 1256612 - RNA, 23 nt, Human
guggccaagaagcaguggccuua

SEQ ID NO: 1256613 - RNA, 14 nt, Human
guggcauccagagu

SEQ ID NO: 1256614 - RNA, 18 nt, Human
guggcucgggaggcgaag

SEQ ID NO: 1256615 - RNA, 20 nt, Human
guggccccacccugggcccu

SEQ ID NO: 1256616 - RNA, 18 nt, Human
guggccccacccugggcc

SEQ ID NO: 1256617 - RNA, 19 nt, Human
guggccccacccugggccc

SEQ ID NO: 1256618 - RNA, 18 nt, Human
guggccaugacccugccu

SEQ ID NO: 1256619 - RNA, 20 nt, Human
guggccaugacccugccucu

SEQ ID NO: 1256620 - RNA, 21 nt, Human
guggccaugacccugccucuc

SEQ ID NO: 1256621 - RNA, 13 nt, Human
guggccaugcucc

SEQ ID NO: 1256622 - RNA, 18 nt, Human
guggccaugcuccucuuc

SEQ ID NO: 1256623 - RNA, 19 nt, Human
guggccaugcuccucuucc

SEQ ID NO: 1256624 - RNA, 15 nt, Human
guggccccacccugg

SEQ ID NO: 1256625 - RNA, 21 nt, Human
guggccacuccagaccccugg

SEQ ID NO: 1256626 - RNA, 13 nt, Human
guggccaccagua

SEQ ID NO: 1256627 - RNA, 21 nt, Human
guggccagcgagggcgugucu

SEQ ID NO: 1256628 - RNA, 12 nt, Human
guggccaggagg

SEQ ID NO: 1256629 - RNA, 13 nt, Human
guggccaggaggu

SEQ ID NO: 1256630 - RNA, 10 nt, Human
guggccaggc

SEQ ID NO: 1256631 - RNA, 23 nt, Human
guggccaggccgggaaaaagccc

SEQ ID NO: 1256632 - RNA, 11 nt, Human
guggcagucug

SEQ ID NO: 1256633 - RNA, 12 nt, Human
guggcaggcaga

SEQ ID NO: 1256634 - RNA, 13 nt, Human
guggcaggcagag

SEQ ID NO: 1256635 - RNA, 15 nt, Human
guggcaggcagaggc

SEQ ID NO: 1256636 - RNA, 22 nt, Human
guggcaggcagaggcccaggcu

SEQ ID NO: 1256637 - RNA, 24 nt, Human
guggcaggcagaggcccaggcugc

SEQ ID NO: 1256638 - RNA, 23 nt, Human
guggcaggcagaggcccaggcug

SEQ ID NO: 1256639 - RNA, 16 nt, Human
guggcaggggacagga

SEQ ID NO: 1256640 - RNA, 18 nt, Human
guggcaggggacaggagu

SEQ ID NO: 1256641 - RNA, 20 nt, Human
guggcaggggacaggagucc

SEQ ID NO: 1256642 - RNA, 21 nt, Human
guggaacauaaaaaggacauc

SEQ ID NO: 1256643 - RNA, 20 nt, Human
guggaacauaaaaaggacau

SEQ ID NO: 1256644 - RNA, 19 nt, Human
guggaacauaaaaaggaca

SEQ ID NO: 1256645 - RNA, 20 nt, Human
guggaaauuaagacuuuaug

SEQ ID NO: 1256646 - RNA, 23 nt, Human
guggaacuacauuaguacacagc

SEQ ID NO: 1256647 - RNA, 16 nt, Human
guggaacgaaaaugaa

SEQ ID NO: 1256648 - RNA, 14 nt, Human
guggaacugcugcc

SEQ ID NO: 1256649 - RNA, 15 nt, Human
guggaacugcugcca

SEQ ID NO: 1256650 - RNA, 13 nt, Human
guggacuuuuauu

SEQ ID NO: 1256651 - RNA, 18 nt, Human
guggagaggcccggccuc

SEQ ID NO: 1256652 - RNA, 12 nt, Human
guggagagggaa

SEQ ID NO: 1256653 - RNA, 14 nt, Human
guggagagggaaug

SEQ ID NO: 1256654 - RNA, 15 nt, Human
guggagagggaaugu

SEQ ID NO: 1256655 - RNA, 18 nt, Human
guggagagggaaugugaa

SEQ ID NO: 1256656 - RNA, 16 nt, Human
guggagucugccaccc

SEQ ID NO: 1256657 - RNA, 17 nt, Human
guggagucugccaccca

SEQ ID NO: 1256658 - RNA, 14 nt, Human
guggauauuguuac

SEQ ID NO: 1256659 - RNA, 16 nt, Human
guggauauuuguauaa

SEQ ID NO: 1256660 - RNA, 23 nt, Human
guggaucacaaaguggaacgaaa

SEQ ID NO: 1256661 - RNA, 21 nt, Human
guggaucagagaugcaccacc

SEQ ID NO: 1256662 - RNA, 19 nt, Human
guggauccaaacugaucca

SEQ ID NO: 1256663 - RNA, 19 nt, Human
guggaucuauuucauguuu

SEQ ID NO: 1256664 - RNA, 23 nt, Human
guggaugauccccacgccacagc

SEQ ID NO: 1256665 - RNA, 12 nt, Human
guggaggcugcu

SEQ ID NO: 1256666 - RNA, 13 nt, Human
guggaggcugcuc

SEQ ID NO: 1256667 - RNA, 14 nt, Human
guggaggcugcucg

SEQ ID NO: 1256668 - RNA, 23 nt, Human
guggagggacaaguggacucagg

SEQ ID NO: 1256669 - RNA, 12 nt, Human
guggagggccac

SEQ ID NO: 1256670 - RNA, 22 nt, Human
guggagggguaggggcugggaa

SEQ ID NO: 1256671 - RNA, 19 nt, Human
guggagggguaggggcugg

SEQ ID NO: 1256672 - RNA, 12 nt, Human
gugcugccacac

SEQ ID NO: 1256673 - RNA, 14 nt, Human
gugcugagauuaca

SEQ ID NO: 1256674 - RNA, 21 nt, Human
gugcugacggccagggagaag

SEQ ID NO: 1256675 - RNA, 23 nt, Human
gugcugacggccagggagaagcu

SEQ ID NO: 1256676 - RNA, 22 nt, Human
gugcugacgggacccacaugcu

SEQ ID NO: 1256677 - RNA, 15 nt, Human
gugcugacggccagg

SEQ ID NO: 1256678 - RNA, 16 nt, Human
gugcugacggccaggg

SEQ ID NO: 1256679 - RNA, 18 nt, Human
gugcugacggccagggag

SEQ ID NO: 1256680 - RNA, 15 nt, Human
gugcucuuuguuuug

SEQ ID NO: 1256681 - RNA, 16 nt, Human
gugcucuuuguuuugu

SEQ ID NO: 1256682 - RNA, 22 nt, Human
gugcucuuuguuuugugucucu

SEQ ID NO: 1256683 - RNA, 14 nt, Human
gugcucuuuucucc

SEQ ID NO: 1256684 - RNA, 16 nt, Human
gugcucuuuucuccuc

SEQ ID NO: 1256685 - RNA, 20 nt, Human
gugcucuuuucuccucacug

SEQ ID NO: 1256686 - RNA, 21 nt, Human
gugcugaacaguggaggaaga

SEQ ID NO: 1256687 - RNA, 23 nt, Human
gugcucuuuguuuugugucucuu

SEQ ID NO: 1256688 - RNA, 19 nt, Human
gugcugaauguugggacug

SEQ ID NO: 1256689 - RNA, 16 nt, Human
gugcccucugggcucu

SEQ ID NO: 1256690 - RNA, 17 nt, Human
gugcccucugggcucug

SEQ ID NO: 1256691 - RNA, 19 nt, Human
gugcccucugggcucugag

SEQ ID NO: 1256692 - RNA, 12 nt, Human
gugcccugagcc

SEQ ID NO: 1256693 - RNA, 15 nt, Human
gugcccugagccagg

SEQ ID NO: 1256694 - RNA, 17 nt, Human
gugcccugagccagggu

SEQ ID NO: 1256695 - RNA, 13 nt, Human
gugcccugauccc

SEQ ID NO: 1256696 - RNA, 19 nt, Human
gugccuugucacgccagac

SEQ ID NO: 1256697 - RNA, 13 nt, Human
gugccuuguuuuu

SEQ ID NO: 1256698 - RNA, 16 nt, Human
gugccuuuauuuccac

SEQ ID NO: 1256699 - RNA, 20 nt, Human
gugccuuuauuuccacugug

SEQ ID NO: 1256700 - RNA, 16 nt, Human
gugccuuucaggaucu

SEQ ID NO: 1256701 - RNA, 18 nt, Human
gugccuuuauuuccacug

SEQ ID NO: 1256702 - RNA, 23 nt, Human
gugcuuucuucucccaauucauc

SEQ ID NO: 1256703 - RNA, 15 nt, Human
gugcuuugagagaga

SEQ ID NO: 1256704 - RNA, 17 nt, Human
gugcuuugagagagaaa

SEQ ID NO: 1256705 - RNA, 15 nt, Human
gugcuuuuaaaugca

SEQ ID NO: 1256706 - RNA, 23 nt, Human
gugcuuuuggcggggaggaggaa

SEQ ID NO: 1256707 - RNA, 16 nt, Human
gugcuuuuuuugugug

SEQ ID NO: 1256708 - RNA, 16 nt, Human
guggaaaacuuaugcu

SEQ ID NO: 1256709 - RNA, 21 nt, Human
guggaaaacuuaugcugauuu

SEQ ID NO: 1256710 - RNA, 18 nt, Human
gugcuugauagaaaugcc

SEQ ID NO: 1256711 - RNA, 14 nt, Human
gugcuugagccagg

SEQ ID NO: 1256712 - RNA, 20 nt, Human
gugcuuuccauucgugaaaa

SEQ ID NO: 1256713 - RNA, 21 nt, Human
gugcugccacacuucaggcuc

SEQ ID NO: 1256714 - RNA, 22 nt, Human
gugcuguuguuaugaugugcuu

SEQ ID NO: 1256715 - RNA, 19 nt, Human
gugcuguuuuguuauauaa

SEQ ID NO: 1256716 - RNA, 21 nt, Human
gugcuguuuuguuauauaauu

SEQ ID NO: 1256717 - RNA, 21 nt, Human
gugcuuaucccauagccagga

SEQ ID NO: 1256718 - RNA, 20 nt, Human
gugcuguuguuaugaugugc

SEQ ID NO: 1256719 - RNA, 19 nt, Human
gugcuguuguuaugaugug

SEQ ID NO: 1256720 - RNA, 15 nt, Human
gugcuguuuauuaau

SEQ ID NO: 1256721 - RNA, 19 nt, Human
gugcuguuuauuaaucuua

SEQ ID NO: 1256722 - RNA, 14 nt, Human
gugcuguuucaaag

SEQ ID NO: 1256723 - RNA, 15 nt, Human
gugcuguuucaaagu

SEQ ID NO: 1256724 - RNA, 16 nt, Human
gugcuguuucaaaguu

SEQ ID NO: 1256725 - RNA, 16 nt, Human
gugcuguuuuguuaua

SEQ ID NO: 1256726 - RNA, 17 nt, Human
gugcuguuguuaugaug

SEQ ID NO: 1256727 - RNA, 15 nt, Human
gugcuguuguuauga

SEQ ID NO: 1256728 - RNA, 14 nt, Human
gugcuguuguuaug

SEQ ID NO: 1256729 - RNA, 11 nt, Human
gugcugugugu

SEQ ID NO: 1256730 - RNA, 17 nt, Human
gugcuucgggcccuucc

SEQ ID NO: 1256731 - RNA, 20 nt, Human
gugcuucuaguucugccagg

SEQ ID NO: 1256732 - RNA, 14 nt, Human
gugcuucgggcccu

SEQ ID NO: 1256733 - RNA, 21 nt, Human
gugcuucuaguucugccagga

SEQ ID NO: 1256734 - RNA, 22 nt, Human
gugcuucuaguucugccaggag

SEQ ID NO: 1256735 - RNA, 18 nt, Human
gugcuuauguaugaggua

SEQ ID NO: 1256736 - RNA, 21 nt, Human
gugcuuaugcucuuaauugcc

SEQ ID NO: 1256737 - RNA, 16 nt, Human
gugcuuaugguaccag

SEQ ID NO: 1256738 - RNA, 24 nt, Human
gugcaguggcgugaucucagcuca

SEQ ID NO: 1256739 - RNA, 18 nt, Human
gugcaugcagcaucuaag

SEQ ID NO: 1256740 - RNA, 18 nt, Human
gugcaucucagcccacau

SEQ ID NO: 1256741 - RNA, 24 nt, Human
gugcaguggcgcgaucucagcuca

SEQ ID NO: 1256742 - RNA, 15 nt, Human
gugcaucucagccca

SEQ ID NO: 1256743 - RNA, 18 nt, Human
gugcaaauugucacagga

SEQ ID NO: 1256744 - RNA, 22 nt, Human
gugcaaaguucccuacuuccug

SEQ ID NO: 1256745 - RNA, 22 nt, Human
gugcaacaagguccucugucag

SEQ ID NO: 1256746 - RNA, 13 nt, Human
gugcaacacuggu

SEQ ID NO: 1256747 - RNA, 14 nt, Human
gugcaacaggguau

SEQ ID NO: 1256748 - RNA, 24 nt, Human
gugcaacaggguauggacuaucug

SEQ ID NO: 1256749 - RNA, 23 nt, Human
gugcagggccuguaaucccagca

SEQ ID NO: 1256750 - RNA, 14 nt, Human
gugcagggaugugg

SEQ ID NO: 1256751 - RNA, 15 nt, Human
gugcagggauguggg

SEQ ID NO: 1256752 - RNA, 15 nt, Human
gugcagguggggaga

SEQ ID NO: 1256753 - RNA, 15 nt, Human
gugcaguacuuugug

SEQ ID NO: 1256754 - RNA, 22 nt, Human
gugcaguaucaugcccugugca

SEQ ID NO: 1256755 - RNA, 24 nt, Human
gugcaguggcaucaucucagcuca

SEQ ID NO: 1256756 - RNA, 16 nt, Human
gugcaguccugaucag

SEQ ID NO: 1256757 - RNA, 13 nt, Human
gugcccacaggcc

SEQ ID NO: 1256758 - RNA, 21 nt, Human
gugcccacaggccgcccugcg

SEQ ID NO: 1256759 - RNA, 22 nt, Human
gugcccacagugucaggcacug

SEQ ID NO: 1256760 - RNA, 16 nt, Human
gugcccagaauaaguu

SEQ ID NO: 1256761 - RNA, 16 nt, Human
gugccaguauuuuaaa

SEQ ID NO: 1256762 - RNA, 18 nt, Human
gugccaguauuuuaaaau

SEQ ID NO: 1256763 - RNA, 12 nt, Human
gugcccaagcca

SEQ ID NO: 1256764 - RNA, 19 nt, Human
gugcccaagccagaggcug

SEQ ID NO: 1256765 - RNA, 20 nt, Human
gugcccaagccagaggcugg

SEQ ID NO: 1256766 - RNA, 13 nt, Human
gugcccaggagaa

SEQ ID NO: 1256767 - RNA, 12 nt, Human
gugcccaggaga

SEQ ID NO: 1256768 - RNA, 16 nt, Human
gugcccaguuaaucuu

SEQ ID NO: 1256769 - RNA, 17 nt, Human
gugcccaguuaaucuug

SEQ ID NO: 1256770 - RNA, 12 nt, Human
gugccccaggac

SEQ ID NO: 1256771 - RNA, 14 nt, Human
gugccccaggacca

SEQ ID NO: 1256772 - RNA, 15 nt, Human
gugccccaggaccag

SEQ ID NO: 1256773 - RNA, 19 nt, Human
gugccccaggaccagcuca

SEQ ID NO: 1256774 - RNA, 21 nt, Human
gugccccaggaccagcucagg

SEQ ID NO: 1256775 - RNA, 13 nt, Human
gugcccccacuga

SEQ ID NO: 1256776 - RNA, 15 nt, Human
gugcccccacugacc

SEQ ID NO: 1256777 - RNA, 18 nt, Human
gugcccccacugaccaga

SEQ ID NO: 1256778 - RNA, 19 nt, Human
gugcccccacugaccagaa

SEQ ID NO: 1256779 - RNA, 22 nt, Human
gugcccccaaccauuuccucag

SEQ ID NO: 1256780 - RNA, 14 nt, Human
gugcccccaggguc

SEQ ID NO: 1256781 - RNA, 22 nt, Human
gugcccccaggguccugggagg

SEQ ID NO: 1256782 - RNA, 16 nt, Human
gugcccccaggguccu

SEQ ID NO: 1256783 - RNA, 13 nt, Human
gugcccucuccca

SEQ ID NO: 1256784 - RNA, 15 nt, Human
gugcccucucccacc

SEQ ID NO: 1256785 - RNA, 17 nt, Human
gugcccucucccacccu

SEQ ID NO: 1256786 - RNA, 18 nt, Human
gugcccucucccacccuc

SEQ ID NO: 1256787 - RNA, 19 nt, Human
gugcccucucccacccucu

SEQ ID NO: 1256788 - RNA, 20 nt, Human
gugcccucucccacccucuu

SEQ ID NO: 1256789 - RNA, 21 nt, Human
gugcccucucccacccucuuc

SEQ ID NO: 1256790 - RNA, 22 nt, Human
gugcccucucccacccucuucc

SEQ ID NO: 1256791 - RNA, 13 nt, Human
gugcccucugggc

SEQ ID NO: 1256792 - RNA, 14 nt, Human
gugcccucugggcu

SEQ ID NO: 1256793 - RNA, 15 nt, Human
gugcccucugggcuc

SEQ ID NO: 1256794 - RNA, 23 nt, Human
gugaggauuaaauaauguaaaua

SEQ ID NO: 1256795 - RNA, 23 nt, Human
gugaggcaaugggagcugaggcc

SEQ ID NO: 1256796 - RNA, 16 nt, Human
gugauccauguaacug

SEQ ID NO: 1256797 - RNA, 14 nt, Human
gugauccacucgcc

SEQ ID NO: 1256798 - RNA, 21 nt, Human
gugaucccuagcugugaccuc

SEQ ID NO: 1256799 - RNA, 22 nt, Human
gugaucccuagcugugaccucu

SEQ ID NO: 1256800 - RNA, 20 nt, Human
gugauucacagugugaaucu

SEQ ID NO: 1256801 - RNA, 21 nt, Human
gugauucagaaaauguucugu

SEQ ID NO: 1256802 - RNA, 20 nt, Human
gugauucucaugccucagcc

SEQ ID NO: 1256803 - RNA, 15 nt, Human
gugauuccgcaguga

SEQ ID NO: 1256804 - RNA, 13 nt, Human
gugauucugccuu

SEQ ID NO: 1256805 - RNA, 24 nt, Human
gugauuggccuguagaguugcuga

SEQ ID NO: 1256806 - RNA, 14 nt, Human
gugauuguggaaug

SEQ ID NO: 1256807 - RNA, 19 nt, Human
gugauuguggaauggagau

SEQ ID NO: 1256808 - RNA, 23 nt, Human
gugauuguggaauggagauucag

SEQ ID NO: 1256809 - RNA, 16 nt, Human
gugauuuuuaugccac

SEQ ID NO: 1256810 - RNA, 17 nt, Human
gugauuuaagggcccag

SEQ ID NO: 1256811 - RNA, 22 nt, Human
gugauuuaagggcccaggucag

SEQ ID NO: 1256812 - RNA, 17 nt, Human
gugauuuuuaugccacc

SEQ ID NO: 1256813 - RNA, 19 nt, Human
gugauuuuuaugccaccug

SEQ ID NO: 1256814 - RNA, 20 nt, Human
gugauuuuuaugccaccuga

SEQ ID NO: 1256815 - RNA, 16 nt, Human
gugacaagcucacaga

SEQ ID NO: 1256816 - RNA, 17 nt, Human
gugaauuuuuuuuuccu

SEQ ID NO: 1256817 - RNA, 13 nt, Human
gugacaaaaaauu

SEQ ID NO: 1256818 - RNA, 17 nt, Human
gugacccggcacccccu

SEQ ID NO: 1256819 - RNA, 18 nt, Human
gugacccggcacccccug

SEQ ID NO: 1256820 - RNA, 21 nt, Human
gugacccggcacccccugcag

SEQ ID NO: 1256821 - RNA, 22 nt, Human
gugacccggcacccccugcagc

SEQ ID NO: 1256822 - RNA, 23 nt, Human
gugacccggcacccccugcagcu

SEQ ID NO: 1256823 - RNA, 20 nt, Human
gugacaaaaaauuaaagcau

SEQ ID NO: 1256824 - RNA, 16 nt, Human
gugaccucagcuuuga

SEQ ID NO: 1256825 - RNA, 21 nt, Human
gugaccggacuuuucugcaaa

SEQ ID NO: 1256826 - RNA, 18 nt, Human
gugaccuauaccuguguu

SEQ ID NO: 1256827 - RNA, 16 nt, Human
gugacccuggcuccuu

SEQ ID NO: 1256828 - RNA, 15 nt, Human
gugaccggacuuuuc

SEQ ID NO: 1256829 - RNA, 19 nt, Human
gugaccggacuuuucugca

SEQ ID NO: 1256830 - RNA, 12 nt, Human
gugacucuuucc

SEQ ID NO: 1256831 - RNA, 13 nt, Human
gugaccugcuagg

SEQ ID NO: 1256832 - RNA, 18 nt, Human
gugaccugcuaggccaga

SEQ ID NO: 1256833 - RNA, 12 nt, Human
gugaccugcuga

SEQ ID NO: 1256834 - RNA, 13 nt, Human
gugaccugcugag

SEQ ID NO: 1256835 - RNA, 14 nt, Human
gugaccugcugagc

SEQ ID NO: 1256836 - RNA, 15 nt, Human
gugaccugcugagcu

SEQ ID NO: 1256837 - RNA, 16 nt, Human
gugaccugcugagcuc

SEQ ID NO: 1256838 - RNA, 18 nt, Human
gugaccugcugagcucug

SEQ ID NO: 1256839 - RNA, 19 nt, Human
gugaccugcugagcucuga

SEQ ID NO: 1256840 - RNA, 20 nt, Human
gugaccugcugagcucugag

SEQ ID NO: 1256841 - RNA, 21 nt, Human
gugaccugcugagcucugaga

SEQ ID NO: 1256842 - RNA, 16 nt, Human
gugagcagucaggaaa

SEQ ID NO: 1256843 - RNA, 17 nt, Human
gugagcaggcugugagu

SEQ ID NO: 1256844 - RNA, 17 nt, Human
gugagccaccgugccug

SEQ ID NO: 1256845 - RNA, 21 nt, Human
gugagccaccgugccuggcca

SEQ ID NO: 1256846 - RNA, 15 nt, Human
gugagccaccacgcc

SEQ ID NO: 1256847 - RNA, 20 nt, Human
gugagcauggaacacuucga

SEQ ID NO: 1256848 - RNA, 13 nt, Human
gugagcauguuug

SEQ ID NO: 1256849 - RNA, 16 nt, Human
gugagccaccacgccc

SEQ ID NO: 1256850 - RNA, 15 nt, Human
gugagccaccgugcc

SEQ ID NO: 1256851 - RNA, 22 nt, Human
gugagccaccgugccuggccac

SEQ ID NO: 1256852 - RNA, 19 nt, Human
gugagcauguuuggaaggg

SEQ ID NO: 1256853 - RNA, 13 nt, Human
gugagcugagcag

SEQ ID NO: 1256854 - RNA, 14 nt, Human
gugagcugagcagg

SEQ ID NO: 1256855 - RNA, 16 nt, Human
gugagcugagcaggcc

SEQ ID NO: 1256856 - RNA, 17 nt, Human
gugagcugagcaggcca

SEQ ID NO: 1256857 - RNA, 12 nt, Human
gugaaugggugc

SEQ ID NO: 1256858 - RNA, 18 nt, Human
gugaauuaggcuguaacu

SEQ ID NO: 1256859 - RNA, 21 nt, Human
gugaauuaggcuguaacuacu

SEQ ID NO: 1256860 - RNA, 22 nt, Human
gugaauuaggcuguaacuacuu

SEQ ID NO: 1256861 - RNA, 16 nt, Human
gugaauuaguuuuaaa

SEQ ID NO: 1256862 - RNA, 14 nt, Human
gugaaucagagcac

SEQ ID NO: 1256863 - RNA, 21 nt, Human
gugaauacugcuacagcaauu

SEQ ID NO: 1256864 - RNA, 18 nt, Human
gugaauagccauauuugu

SEQ ID NO: 1256865 - RNA, 19 nt, Human
gugaauagccauauuugua

SEQ ID NO: 1256866 - RNA, 23 nt, Human
gugaauagccauauuuguaaaau

SEQ ID NO: 1256867 - RNA, 13 nt, Human
gugaaucaagggu

SEQ ID NO: 1256868 - RNA, 15 nt, Human
gugaaucaaggguca

SEQ ID NO: 1256869 - RNA, 17 nt, Human
gugaaucaagggucagg

SEQ ID NO: 1256870 - RNA, 21 nt, Human
gugaaucaagggucaggccuu

SEQ ID NO: 1256871 - RNA, 20 nt, Human
gugaaauuauucauaauuau

SEQ ID NO: 1256872 - RNA, 18 nt, Human
gugaaauuauucauaauu

SEQ ID NO: 1256873 - RNA, 22 nt, Human
gugaaauuuacaucauuucuuu

SEQ ID NO: 1256874 - RNA, 20 nt, Human
gugaaauuuacaucauuucu

SEQ ID NO: 1256875 - RNA, 15 nt, Human
gugaauaccugcuca

SEQ ID NO: 1256876 - RNA, 19 nt, Human
gugaauacugcuacagcaa

SEQ ID NO: 1256877 - RNA, 13 nt, Human
gugaaaucauuca

SEQ ID NO: 1256878 - RNA, 22 nt, Human
gugaaauaccaaccugaagaca

SEQ ID NO: 1256879 - RNA, 13 nt, Human
gugaaagaaguaa

SEQ ID NO: 1256880 - RNA, 14 nt, Human
gugaaacuuucauu

SEQ ID NO: 1256881 - RNA, 19 nt, Human
gugaaagaaaauaacaaua

SEQ ID NO: 1256882 - RNA, 20 nt, Human
gugaaacucguuaauuugua

SEQ ID NO: 1256883 - RNA, 17 nt, Human
gucugccacccaggauc

SEQ ID NO: 1256884 - RNA, 12 nt, Human
gugaaaagaaua

SEQ ID NO: 1256885 - RNA, 16 nt, Human
gugaaaaugugugugu

SEQ ID NO: 1256886 - RNA, 15 nt, Human
gugaaaaugguccag

SEQ ID NO: 1256887 - RNA, 17 nt, Human
gugaaaaugguccagga

SEQ ID NO: 1256888 - RNA, 19 nt, Human
gugaaacauuuucucccug

SEQ ID NO: 1256889 - RNA, 15 nt, Human
gugaaacauuuucuc

SEQ ID NO: 1256890 - RNA, 18 nt, Human
gugaaacauuuucucccu

SEQ ID NO: 1256891 - RNA, 22 nt, Human
gucuacccugggauucaggaaa

SEQ ID NO: 1256892 - RNA, 22 nt, Human
gucucacuugugcaguguugac

SEQ ID NO: 1256893 - RNA, 14 nt, Human
gucucgagcgcccu

SEQ ID NO: 1256894 - RNA, 15 nt, Human
gucucgagcgcccug

SEQ ID NO: 1256895 - RNA, 17 nt, Human
gucucgagcgcccugca

SEQ ID NO: 1256896 - RNA, 18 nt, Human
gucucgagcgcccugcag

SEQ ID NO: 1256897 - RNA, 19 nt, Human
gucucgagcgcccugcaga

SEQ ID NO: 1256898 - RNA, 20 nt, Human
gucucgagcgcccugcagac

SEQ ID NO: 1256899 - RNA, 23 nt, Human
gucucgagcgcccugcagacccu

SEQ ID NO: 1256900 - RNA, 21 nt, Human
gucucgagcgcccugcagacc

SEQ ID NO: 1256901 - RNA, 17 nt, Human
gucuacacuaagagaga

SEQ ID NO: 1256902 - RNA, 21 nt, Human
gucuaaucuagauaucgacuu

SEQ ID NO: 1256903 - RNA, 17 nt, Human
gucuacacacccugcau

SEQ ID NO: 1256904 - RNA, 22 nt, Human
gucuaaagauggaguuucuaag

SEQ ID NO: 1256905 - RNA, 20 nt, Human
gucuaaagauggaguuucua

SEQ ID NO: 1256906 - RNA, 21 nt, Human
gucuaaagauggaguuucuaa

SEQ ID NO: 1256907 - RNA, 12 nt, Human
gucuaagauucu

SEQ ID NO: 1256908 - RNA, 13 nt, Human
gucuaagauucua

SEQ ID NO: 1256909 - RNA, 14 nt, Human
gucuaagauucuag

SEQ ID NO: 1256910 - RNA, 15 nt, Human
gucuaagauucuaga

SEQ ID NO: 1256911 - RNA, 16 nt, Human
gucuaagauucuagau

SEQ ID NO: 1256912 - RNA, 18 nt, Human
gucuaagauucuagauca

SEQ ID NO: 1256913 - RNA, 23 nt, Human
gucuacacuaagagagaaugaga

SEQ ID NO: 1256914 - RNA, 15 nt, Human
gucuaccaauuauaa

SEQ ID NO: 1256915 - RNA, 13 nt, Human
gucuacccuggga

SEQ ID NO: 1256916 - RNA, 14 nt, Human
gucuacccugggau

SEQ ID NO: 1256917 - RNA, 22 nt, Human
gucuacauaacuaauacagcug

SEQ ID NO: 1256918 - RNA, 19 nt, Human
gucguggggugugcuggga

SEQ ID NO: 1256919 - RNA, 21 nt, Human
gucguggggugugcugggagc

SEQ ID NO: 1256920 - RNA, 23 nt, Human
gucguuaaaaacagauuuggaaa

SEQ ID NO: 1256921 - RNA, 15 nt, Human
gucguucccagugug

SEQ ID NO: 1256922 - RNA, 21 nt, Human
gucguuuuuuuuuuguuuguu

SEQ ID NO: 1256923 - RNA, 16 nt, Human
gucguuuuuuuuuugu

SEQ ID NO: 1256924 - RNA, 11 nt, Human
gucuaaaacuc

SEQ ID NO: 1256925 - RNA, 13 nt, Human
gucugacuguuuc

SEQ ID NO: 1256926 - RNA, 14 nt, Human
gucugagguccuga

SEQ ID NO: 1256927 - RNA, 15 nt, Human
gucugagguccugag

SEQ ID NO: 1256928 - RNA, 16 nt, Human
gucugagguccugagc

SEQ ID NO: 1256929 - RNA, 17 nt, Human
gucugagguccugagca

SEQ ID NO: 1256930 - RNA, 18 nt, Human
gucugagguccugagcac

SEQ ID NO: 1256931 - RNA, 19 nt, Human
gucugagguccugagcacu

SEQ ID NO: 1256932 - RNA, 21 nt, Human
gucugagguccugagcacugc

SEQ ID NO: 1256933 - RNA, 19 nt, Human
gucugccaaccuaaaacuc

SEQ ID NO: 1256934 - RNA, 21 nt, Human
gucugccaaccuaaaacucuu

SEQ ID NO: 1256935 - RNA, 14 nt, Human
gucugccacccagg

SEQ ID NO: 1256936 - RNA, 21 nt, Human
gucucuauaccaauaaaguga

SEQ ID NO: 1256937 - RNA, 14 nt, Human
gucucgucucuuuu

SEQ ID NO: 1256938 - RNA, 15 nt, Human
gucucggccuucaca

SEQ ID NO: 1256939 - RNA, 16 nt, Human
gucucucaugaaccuc

SEQ ID NO: 1256940 - RNA, 17 nt, Human
gucucucagggccaggc

SEQ ID NO: 1256941 - RNA, 18 nt, Human
gucucucagggccaggcc

SEQ ID NO: 1256942 - RNA, 15 nt, Human
gucucucaugaaccu

SEQ ID NO: 1256943 - RNA, 22 nt, Human
gucucucguaguguuaaguuau

SEQ ID NO: 1256944 - RNA, 17 nt, Human
gucucucuaugccucuc

SEQ ID NO: 1256945 - RNA, 22 nt, Human
gucucucuaugccucucuacag

SEQ ID NO: 1256946 - RNA, 18 nt, Human
gucucucuaugccucucu

SEQ ID NO: 1256947 - RNA, 22 nt, Human
gucucuguuuuacaaguuggag

SEQ ID NO: 1256948 - RNA, 14 nt, Human
gucucuucuccacu

SEQ ID NO: 1256949 - RNA, 15 nt, Human
gucucuuauggaugu

SEQ ID NO: 1256950 - RNA, 22 nt, Human
gucucuuauggauguccccagc

SEQ ID NO: 1256951 - RNA, 23 nt, Human
gucucuuauggauguccccagca

SEQ ID NO: 1256952 - RNA, 15 nt, Human
gucucuucuccacug

SEQ ID NO: 1256953 - RNA, 16 nt, Human
gucucuucuccacugg

SEQ ID NO: 1256954 - RNA, 17 nt, Human
gucucuucuccacugga

SEQ ID NO: 1256955 - RNA, 21 nt, Human
gucucuuccaguuugcuuugc

SEQ ID NO: 1256956 - RNA, 15 nt, Human
guccugggaggagag

SEQ ID NO: 1256957 - RNA, 16 nt, Human
guccugggaggagaga

SEQ ID NO: 1256958 - RNA, 13 nt, Human
guccugggccugc

SEQ ID NO: 1256959 - RNA, 14 nt, Human
guccugggccugca

SEQ ID NO: 1256960 - RNA, 17 nt, Human
guccugggccugcagaa

SEQ ID NO: 1256961 - RNA, 19 nt, Human
guccuggggaaccugaccc

SEQ ID NO: 1256962 - RNA, 20 nt, Human
guccuggggaaccugacccc

SEQ ID NO: 1256963 - RNA, 16 nt, Human
guccugguggggcagc

SEQ ID NO: 1256964 - RNA, 17 nt, Human
guccugguggggcagcu

SEQ ID NO: 1256965 - RNA, 18 nt, Human
guccugguggggcagcuc

SEQ ID NO: 1256966 - RNA, 20 nt, Human
guccugguggggcagcuccu

SEQ ID NO: 1256967 - RNA, 22 nt, Human
guccugguggggcagcuccucu

SEQ ID NO: 1256968 - RNA, 23 nt, Human
guccuggugguauuuucaauagc

SEQ ID NO: 1256969 - RNA, 20 nt, Human
guccuggugguauuuucaau

SEQ ID NO: 1256970 - RNA, 15 nt, Human
guccuguacauugug

SEQ ID NO: 1256971 - RNA, 16 nt, Human
guccugucaucaucau

SEQ ID NO: 1256972 - RNA, 19 nt, Human
guccugucaucaucauggc

SEQ ID NO: 1256973 - RNA, 20 nt, Human
guccugucaucaucauggcc

SEQ ID NO: 1256974 - RNA, 21 nt, Human
guccugucaucaucauggcca

SEQ ID NO: 1256975 - RNA, 23 nt, Human
guccugucaucaucauggccagc

SEQ ID NO: 1256976 - RNA, 18 nt, Human
guccugugaaugccacug

SEQ ID NO: 1256977 - RNA, 19 nt, Human
guccugugaaugccacugc

SEQ ID NO: 1256978 - RNA, 21 nt, Human
guccucccaauuucagacucc

SEQ ID NO: 1256979 - RNA, 22 nt, Human
guccuggcgccuggcaguccgu

SEQ ID NO: 1256980 - RNA, 16 nt, Human
guccucccgagcuccu

SEQ ID NO: 1256981 - RNA, 21 nt, Human
guccucccgagcuccucuucc

SEQ ID NO: 1256982 - RNA, 22 nt, Human
guccucccgagcuccucuucca

SEQ ID NO: 1256983 - RNA, 22 nt, Human
gucccuggggcuagggggagcc

SEQ ID NO: 1256984 - RNA, 20 nt, Human
gucccuggguagcgggggag

SEQ ID NO: 1256985 - RNA, 19 nt, Human
gucccaggaaucaguuuaa

SEQ ID NO: 1256986 - RNA, 17 nt, Human
gucccagcagcugccag

SEQ ID NO: 1256987 - RNA, 16 nt, Human
gucccagguuggcucu

SEQ ID NO: 1256988 - RNA, 17 nt, Human
gucccagguuggcucug

SEQ ID NO: 1256989 - RNA, 18 nt, Human
gucccagguuggcucugc

SEQ ID NO: 1256990 - RNA, 19 nt, Human
gucccagguuggcucugcc

SEQ ID NO: 1256991 - RNA, 22 nt, Human
gucccagguuggcucugccagu

SEQ ID NO: 1256992 - RNA, 21 nt, Human
gucccagguuggcucugccag

SEQ ID NO: 1256993 - RNA, 20 nt, Human
gucccugccuggaccagccu

SEQ ID NO: 1256994 - RNA, 21 nt, Human
gucccugccuggaccagccuc

SEQ ID NO: 1256995 - RNA, 14 nt, Human
gucccugccuggac

SEQ ID NO: 1256996 - RNA, 22 nt, Human
gucccugccuggaccagccucu

SEQ ID NO: 1256997 - RNA, 23 nt, Human
gucccugccuggaccagccucuc

SEQ ID NO: 1256998 - RNA, 19 nt, Human
gucccugggagggacaugc

SEQ ID NO: 1256999 - RNA, 15 nt, Human
gucccuggggcuagg

SEQ ID NO: 1257000 - RNA, 12 nt, Human
guccucagcccc

SEQ ID NO: 1257001 - RNA, 12 nt, Human
guccucagccuu

SEQ ID NO: 1257002 - RNA, 14 nt, Human
guccucagccuugc

SEQ ID NO: 1257003 - RNA, 20 nt, Human
guccucagagaauuucuacc

SEQ ID NO: 1257004 - RNA, 16 nt, Human
guccucagccuugcca

SEQ ID NO: 1257005 - RNA, 20 nt, Human
guccucagccuugccagaga

SEQ ID NO: 1257006 - RNA, 21 nt, Human
guccucagccuugccagagau

SEQ ID NO: 1257007 - RNA, 21 nt, Human
guccuccaacaccaagcacag

SEQ ID NO: 1257008 - RNA, 22 nt, Human
guccuccaacaccaagcacagc

SEQ ID NO: 1257009 - RNA, 15 nt, Human
guccuauggccucau

SEQ ID NO: 1257010 - RNA, 16 nt, Human
guccuauggccucaug

SEQ ID NO: 1257011 - RNA, 15 nt, Human
guccuagcacagaug

SEQ ID NO: 1257012 - RNA, 21 nt, Human
guccuagcacagauggccagc

SEQ ID NO: 1257013 - RNA, 17 nt, Human
guccuagcacagauggc

SEQ ID NO: 1257014 - RNA, 16 nt, Human
guccuaguuguucagc

SEQ ID NO: 1257015 - RNA, 20 nt, Human
guccuaucuccagcggcccu

SEQ ID NO: 1257016 - RNA, 14 nt, Human
guccuaucugggcu

SEQ ID NO: 1257017 - RNA, 15 nt, Human
guccuaucugggcuu

SEQ ID NO: 1257018 - RNA, 17 nt, Human
guccuaucugggcuucc

SEQ ID NO: 1257019 - RNA, 18 nt, Human
guccuaucugggcuuccu

SEQ ID NO: 1257020 - RNA, 19 nt, Human
guccuaucugggcuuccug

SEQ ID NO: 1257021 - RNA, 24 nt, Human
guccuaucugggcuuccuggagca

SEQ ID NO: 1257022 - RNA, 20 nt, Human
guccuaucugggcuuccugg

SEQ ID NO: 1257023 - RNA, 21 nt, Human
guccuaucugggcuuccugga

SEQ ID NO: 1257024 - RNA, 22 nt, Human
guccuaucugggcuuccuggag

SEQ ID NO: 1257025 - RNA, 14 nt, Human
guccuauggccuca

SEQ ID NO: 1257026 - RNA, 19 nt, Human
gucacguuuggugcuucuc

SEQ ID NO: 1257027 - RNA, 21 nt, Human
gucagcaaguccuaagccugu

SEQ ID NO: 1257028 - RNA, 20 nt, Human
gucagcagccucccugaaga

SEQ ID NO: 1257029 - RNA, 14 nt, Human
gucacgccagacuu

SEQ ID NO: 1257030 - RNA, 20 nt, Human
gucacggcugcgcacugugu

SEQ ID NO: 1257031 - RNA, 18 nt, Human
gucacggauuugugucug

SEQ ID NO: 1257032 - RNA, 21 nt, Human
gucaccucagagacauacacc

SEQ ID NO: 1257033 - RNA, 13 nt, Human
gucaccugugcuu

SEQ ID NO: 1257034 - RNA, 13 nt, Human
gucagcccuaggg

SEQ ID NO: 1257035 - RNA, 22 nt, Human
gucagcccuaggguggagagcc

SEQ ID NO: 1257036 - RNA, 23 nt, Human
gucagcagccucccugaagacca

SEQ ID NO: 1257037 - RNA, 14 nt, Human
gucagcaugaauuu

SEQ ID NO: 1257038 - RNA, 20 nt, Human
gucagcaugaauuuguaaug

SEQ ID NO: 1257039 - RNA, 13 nt, Human
gucagccacuguu

SEQ ID NO: 1257040 - RNA, 15 nt, Human
gucagcaugaauuug

SEQ ID NO: 1257041 - RNA, 12 nt, Human
gucauaauugca

SEQ ID NO: 1257042 - RNA, 14 nt, Human
gucauaauugcauu

SEQ ID NO: 1257043 - RNA, 16 nt, Human
gucauaauugcauuga

SEQ ID NO: 1257044 - RNA, 18 nt, Human
gucauaauugcauugacu

SEQ ID NO: 1257045 - RNA, 12 nt, Human
gucauacagaga

SEQ ID NO: 1257046 - RNA, 13 nt, Human
gucauacagagaa

SEQ ID NO: 1257047 - RNA, 14 nt, Human
gucauacagagaag

SEQ ID NO: 1257048 - RNA, 15 nt, Human
gucauacagagaagu

SEQ ID NO: 1257049 - RNA, 16 nt, Human
gucauacagagaaguc

SEQ ID NO: 1257050 - RNA, 15 nt, Human
gucauaccaaugaaa

SEQ ID NO: 1257051 - RNA, 16 nt, Human
gucauaccaaugaaaa

SEQ ID NO: 1257052 - RNA, 13 nt, Human
gucauagaaauua

SEQ ID NO: 1257053 - RNA, 22 nt, Human
gucauagaaauuacacccaaag

SEQ ID NO: 1257054 - RNA, 15 nt, Human
gucauagguuaauau

SEQ ID NO: 1257055 - RNA, 23 nt, Human
gucaucaauuaaaggcaaaggca

SEQ ID NO: 1257056 - RNA, 23 nt, Human
gucaucacucuagguuuuacaga

SEQ ID NO: 1257057 - RNA, 16 nt, Human
gucaucucagcuggau

SEQ ID NO: 1257058 - RNA, 18 nt, Human
gucauccucacagugaac

SEQ ID NO: 1257059 - RNA, 17 nt, Human
gucaucaucauggccag

SEQ ID NO: 1257060 - RNA, 18 nt, Human
gucaucaucauggccagc

SEQ ID NO: 1257061 - RNA, 20 nt, Human
gucaucaucauggccagcug

SEQ ID NO: 1257062 - RNA, 21 nt, Human
gucaucaucauggccagcugg

SEQ ID NO: 1257063 - RNA, 19 nt, Human
gucauccucaaagaaagug

SEQ ID NO: 1257064 - RNA, 22 nt, Human
gucauccucaaagaaaguguau

SEQ ID NO: 1257065 - RNA, 12 nt, Human
gucaucuugcua

SEQ ID NO: 1257066 - RNA, 14 nt, Human
gucaucuugcuacc

SEQ ID NO: 1257067 - RNA, 15 nt, Human
gucaucuugcuacca

SEQ ID NO: 1257068 - RNA, 18 nt, Human
gucaucuugcuaccagua

SEQ ID NO: 1257069 - RNA, 22 nt, Human
gucaucuugcuaccaguauuua

SEQ ID NO: 1257070 - RNA, 20 nt, Human
gucaugaggagauucugccu

SEQ ID NO: 1257071 - RNA, 22 nt, Human
gucaugaggagauucugccuuu

SEQ ID NO: 1257072 - RNA, 21 nt, Human
gucaugaggagauucugccuu

SEQ ID NO: 1257073 - RNA, 19 nt, Human
gucaugcacaguauuugua

SEQ ID NO: 1257074 - RNA, 24 nt, Human
gucaugcacaguauuuguaauuaa

SEQ ID NO: 1257075 - RNA, 14 nt, Human
gucauguguauaaa

SEQ ID NO: 1257076 - RNA, 15 nt, Human
gucauguuuaagaaa

SEQ ID NO: 1257077 - RNA, 13 nt, Human
gucaugcugccuu

SEQ ID NO: 1257078 - RNA, 14 nt, Human
gucaugcugccuua

SEQ ID NO: 1257079 - RNA, 23 nt, Human
gucaugggccacugcuuuucccu

SEQ ID NO: 1257080 - RNA, 20 nt, Human
gucauguaagcugaaaauau

SEQ ID NO: 1257081 - RNA, 11 nt, Human
gucaugugacc

SEQ ID NO: 1257082 - RNA, 15 nt, Human
gucaugugacaggua

SEQ ID NO: 1257083 - RNA, 12 nt, Human
gucauguguaua

SEQ ID NO: 1257084 - RNA, 13 nt, Human
gucauguguauaa

SEQ ID NO: 1257085 - RNA, 16 nt, Human
guccacuucugacagc

SEQ ID NO: 1257086 - RNA, 17 nt, Human
guccacuucugacagcc

SEQ ID NO: 1257087 - RNA, 18 nt, Human
guccacuucugacagccu

SEQ ID NO: 1257088 - RNA, 19 nt, Human
guccacuucugacagccuc

SEQ ID NO: 1257089 - RNA, 21 nt, Human
guccagacacaaagagacaaa

SEQ ID NO: 1257090 - RNA, 12 nt, Human
guccagcucugg

SEQ ID NO: 1257091 - RNA, 13 nt, Human
guccagcucugga

SEQ ID NO: 1257092 - RNA, 14 nt, Human
guccagcucuggag

SEQ ID NO: 1257093 - RNA, 16 nt, Human
guccagcucuggaggg

SEQ ID NO: 1257094 - RNA, 21 nt, Human
guccagcucuggaggggaggg

SEQ ID NO: 1257095 - RNA, 17 nt, Human
guccagcugagcgccag

SEQ ID NO: 1257096 - RNA, 13 nt, Human
guccaggagccug

SEQ ID NO: 1257097 - RNA, 21 nt, Human
guccaggaugcuaacaucuaa

SEQ ID NO: 1257098 - RNA, 15 nt, Human
guccaggcacugaga

SEQ ID NO: 1257099 - RNA, 13 nt, Human
guccaggcugccg

SEQ ID NO: 1257100 - RNA, 14 nt, Human
guccaggcugccgu

SEQ ID NO: 1257101 - RNA, 16 nt, Human
guccaggcugccgugg

SEQ ID NO: 1257102 - RNA, 20 nt, Human
guccaggcugccguggggcc

SEQ ID NO: 1257103 - RNA, 21 nt, Human
gucccagaagaugacugaggg

SEQ ID NO: 1257104 - RNA, 12 nt, Human
gucccagagcag

SEQ ID NO: 1257105 - RNA, 22 nt, Human
gucccagaaaaagcaucauggc

SEQ ID NO: 1257106 - RNA, 11 nt, Human
gucccagcagc

SEQ ID NO: 1257107 - RNA, 12 nt, Human
gucccagcagcu

SEQ ID NO: 1257108 - RNA, 14 nt, Human
gucccagcagcugc

SEQ ID NO: 1257109 - RNA, 15 nt, Human
gucccagcagcugcc

SEQ ID NO: 1257110 - RNA, 22 nt, Human
gucccagcagcugccaggagca

SEQ ID NO: 1257111 - RNA, 16 nt, Human
guauucguuaucuaau

SEQ ID NO: 1257112 - RNA, 21 nt, Human
guauucauccaaguuaaaugu

SEQ ID NO: 1257113 - RNA, 22 nt, Human
guauucauccaaguuaaaugua

SEQ ID NO: 1257114 - RNA, 19 nt, Human
guauuccagaccugaagaa

SEQ ID NO: 1257115 - RNA, 21 nt, Human
guauucccaaaaauuacuuug

SEQ ID NO: 1257116 - RNA, 19 nt, Human
guauuuauuuaguauuuau

SEQ ID NO: 1257117 - RNA, 17 nt, Human
guauuucuaugaaauau

SEQ ID NO: 1257118 - RNA, 13 nt, Human
guauuucaaauug

SEQ ID NO: 1257119 - RNA, 19 nt, Human
guauuuauuuuuucuuuuc

SEQ ID NO: 1257120 - RNA, 22 nt, Human
guauuucuaugaaauauuaugu

SEQ ID NO: 1257121 - RNA, 15 nt, Human
guauuugaaucagcc

SEQ ID NO: 1257122 - RNA, 11 nt, Human
guauuugcuaa

SEQ ID NO: 1257123 - RNA, 12 nt, Human
guauuugcuaau

SEQ ID NO: 1257124 - RNA, 12 nt, Human
guauuugcuuuu

SEQ ID NO: 1257125 - RNA, 22 nt, Human
guauuugcuuuuuuguuuuggc

SEQ ID NO: 1257126 - RNA, 19 nt, Human
guauuuggaaauaaaguca

SEQ ID NO: 1257127 - RNA, 20 nt, Human
guauuuggaaauaaagucag

SEQ ID NO: 1257128 - RNA, 21 nt, Human
guauuuggaaauaaagucaga

SEQ ID NO: 1257129 - RNA, 20 nt, Human
guauuacaguggggaaugaa

SEQ ID NO: 1257130 - RNA, 22 nt, Human
guauuacaguggggaaugaaga

SEQ ID NO: 1257131 - RNA, 19 nt, Human
guauucaaaaauuaucuau

SEQ ID NO: 1257132 - RNA, 16 nt, Human
guauuauuuacauuua

SEQ ID NO: 1257133 - RNA, 16 nt, Human
guauuaugucucuucu

SEQ ID NO: 1257134 - RNA, 15 nt, Human
guauuauguguguuu

SEQ ID NO: 1257135 - RNA, 18 nt, Human
guauuauaccaaaauguu

SEQ ID NO: 1257136 - RNA, 13 nt, Human
guauuauauguac

SEQ ID NO: 1257137 - RNA, 14 nt, Human
gucaccucauggaa

SEQ ID NO: 1257138 - RNA, 19 nt, Human
gucaccuaggaagccucag

SEQ ID NO: 1257139 - RNA, 20 nt, Human
gucaccuaggaagccucaga

SEQ ID NO: 1257140 - RNA, 21 nt, Human
gucaccuaggaagccucagau

SEQ ID NO: 1257141 - RNA, 16 nt, Human
gucaccucagagacau

SEQ ID NO: 1257142 - RNA, 20 nt, Human
gucacccagguuggagugca

SEQ ID NO: 1257143 - RNA, 20 nt, Human
gucacccaggcuggagugca

SEQ ID NO: 1257144 - RNA, 20 nt, Human
gucacccaggcuggacugca

SEQ ID NO: 1257145 - RNA, 15 nt, Human
gucaauaaaauccau

SEQ ID NO: 1257146 - RNA, 11 nt, Human
gucaaguuauu

SEQ ID NO: 1257147 - RNA, 20 nt, Human
gucaaguuauuaauuucuuc

SEQ ID NO: 1257148 - RNA, 21 nt, Human
gucaauaaaauccauacauuu

SEQ ID NO: 1257149 - RNA, 14 nt, Human
gucaaugcaguugu

SEQ ID NO: 1257150 - RNA, 16 nt, Human
gucaaugcaguugucu

SEQ ID NO: 1257151 - RNA, 22 nt, Human
gucaaugcaguugucucuguuu

SEQ ID NO: 1257152 - RNA, 18 nt, Human
gucaaguuauuaauuucu

SEQ ID NO: 1257153 - RNA, 15 nt, Human
gucaauguuuucagu

SEQ ID NO: 1257154 - RNA, 16 nt, Human
guauuuuaaaagaaug

SEQ ID NO: 1257155 - RNA, 17 nt, Human
guauuuuaaaagaauga

SEQ ID NO: 1257156 - RNA, 20 nt, Human
guauuugggaagugaagacu

SEQ ID NO: 1257157 - RNA, 13 nt, Human
guauuuguaauua

SEQ ID NO: 1257158 - RNA, 17 nt, Human
guauuuguuaauuuaga

SEQ ID NO: 1257159 - RNA, 18 nt, Human
guauuuguuaauuuagaa

SEQ ID NO: 1257160 - RNA, 23 nt, Human
guauuuguuaauuuagaaaacuu

SEQ ID NO: 1257161 - RNA, 18 nt, Human
guauuuuaaaagaaugau

SEQ ID NO: 1257162 - RNA, 16 nt, Human
guauuuguucccaaga

SEQ ID NO: 1257163 - RNA, 22 nt, Human
guauuuguuaauuuagaaaacu

SEQ ID NO: 1257164 - RNA, 20 nt, Human
gucaacuugagcauguuacu

SEQ ID NO: 1257165 - RNA, 17 nt, Human
gucaagugcguccacga

SEQ ID NO: 1257166 - RNA, 19 nt, Human
gucaagauucagcuagugg

SEQ ID NO: 1257167 - RNA, 18 nt, Human
gucaagccauuuuuacau

SEQ ID NO: 1257168 - RNA, 16 nt, Human
gucaagauucagcuag

SEQ ID NO: 1257169 - RNA, 15 nt, Human
gucaagauucagcua

SEQ ID NO: 1257170 - RNA, 19 nt, Human
gucaagagugaauucccuc

SEQ ID NO: 1257171 - RNA, 20 nt, Human
gucaagagugaauucccuca

SEQ ID NO: 1257172 - RNA, 17 nt, Human
gucaacuugagcauguu

SEQ ID NO: 1257173 - RNA, 21 nt, Human
gucaagaauagcauuguaaaa

SEQ ID NO: 1257174 - RNA, 22 nt, Human
gucaagcugaguauuaaaaugu

SEQ ID NO: 1257175 - RNA, 16 nt, Human
ggggcagagccaggaa

SEQ ID NO: 1257176 - RNA, 15 nt, Human
ggggcagagccagga

SEQ ID NO: 1257177 - RNA, 17 nt, Human
ggggcagaggcaguacc

SEQ ID NO: 1257178 - RNA, 23 nt, Human
ggggcagaggcaguaccugggca

SEQ ID NO: 1257179 - RNA, 14 nt, Human
ggggcagagccagg

SEQ ID NO: 1257180 - RNA, 13 nt, Human
ggggcagagccag

SEQ ID NO: 1257181 - RNA, 13 nt, Human
ggggauguguccu

SEQ ID NO: 1257182 - RNA, 16 nt, Human
ggggcagcagcagugg

SEQ ID NO: 1257183 - RNA, 12 nt, Human
ggggcagccccc

SEQ ID NO: 1257184 - RNA, 18 nt, Human
ggggaguuuagggugggg

SEQ ID NO: 1257185 - RNA, 21 nt, Human
ggggaucccucccccccaugc

SEQ ID NO: 1257186 - RNA, 23 nt, Human
ggggaucccucccccccaugcac

SEQ ID NO: 1257187 - RNA, 20 nt, Human
gggcuugggccuaggcugca

SEQ ID NO: 1257188 - RNA, 17 nt, Human
ggggagacugggcugag

SEQ ID NO: 1257189 - RNA, 18 nt, Human
ggggagacugggcugagg

SEQ ID NO: 1257190 - RNA, 14 nt, Human
ggggagcaggcagc

SEQ ID NO: 1257191 - RNA, 11 nt, Human
ggggagcccac

SEQ ID NO: 1257192 - RNA, 19 nt, Human
ggggagcccacuguccugg

SEQ ID NO: 1257193 - RNA, 17 nt, Human
ggggaguuaagaccugg

SEQ ID NO: 1257194 - RNA, 21 nt, Human
ggggaguuaagaccuggcagc

SEQ ID NO: 1257195 - RNA, 22 nt, Human
ggggagccccuucugcucagcu

SEQ ID NO: 1257196 - RNA, 19 nt, Human
ggggagcgggucugcuccc

SEQ ID NO: 1257197 - RNA, 15 nt, Human
ggggagcugggccug

SEQ ID NO: 1257198 - RNA, 13 nt, Human
ggggaggaggagg

SEQ ID NO: 1257199 - RNA, 22 nt, Human
ggggaguaaagaauuauuuugu

SEQ ID NO: 1257200 - RNA, 21 nt, Human
gggcuugcuauucugucccua

SEQ ID NO: 1257201 - RNA, 14 nt, Human
gggcuugccuucug

SEQ ID NO: 1257202 - RNA, 11 nt, Human
gggcuugggcc

SEQ ID NO: 1257203 - RNA, 15 nt, Human
gggcuugggccuagg

SEQ ID NO: 1257204 - RNA, 13 nt, Human
gggcuugccuucu

SEQ ID NO: 1257205 - RNA, 17 nt, Human
gggcuucagguccaggc

SEQ ID NO: 1257206 - RNA, 16 nt, Human
gggcuucccaagggcu

SEQ ID NO: 1257207 - RNA, 13 nt, Human
gggcuucccaagg

SEQ ID NO: 1257208 - RNA, 12 nt, Human
gggcuuccugga

SEQ ID NO: 1257209 - RNA, 13 nt, Human
gggcuuccuggag

SEQ ID NO: 1257210 - RNA, 14 nt, Human
gggcuuccuggagc

SEQ ID NO: 1257211 - RNA, 15 nt, Human
gggcuuccuggagca

SEQ ID NO: 1257212 - RNA, 16 nt, Human
gggcuuccuggagcag

SEQ ID NO: 1257213 - RNA, 21 nt, Human
gggcuuccuggagcagaagca

SEQ ID NO: 1257214 - RNA, 15 nt, Human
gggcuuccuggugcu

SEQ ID NO: 1257215 - RNA, 17 nt, Human
gggcuucagcugccagu

SEQ ID NO: 1257216 - RNA, 20 nt, Human
ggggcuuauaauaaaggacu

SEQ ID NO: 1257217 - RNA, 23 nt, Human
ggggcuguccugccacccagccc

SEQ ID NO: 1257218 - RNA, 11 nt, Human
ggggcuuccug

SEQ ID NO: 1257219 - RNA, 13 nt, Human
ggggcuuccuggu

SEQ ID NO: 1257220 - RNA, 21 nt, Human
ggggcuuccuggugcuggagg

SEQ ID NO: 1257221 - RNA, 14 nt, Human
ggggcuugccuucu

SEQ ID NO: 1257222 - RNA, 17 nt, Human
gggggaacucagaucca

SEQ ID NO: 1257223 - RNA, 23 nt, Human
ggggcuggaggagcccaggccag

SEQ ID NO: 1257224 - RNA, 16 nt, Human
ggggcuggaggagccc

SEQ ID NO: 1257225 - RNA, 17 nt, Human
ggggcuggaggagccca

SEQ ID NO: 1257226 - RNA, 21 nt, Human
ggggcuggaggagcccaggcc

SEQ ID NO: 1257227 - RNA, 22 nt, Human
ggggcugcugcugggcucagug

SEQ ID NO: 1257228 - RNA, 16 nt, Human
ggggcugcuuccuccu

SEQ ID NO: 1257229 - RNA, 18 nt, Human
ggggcugcuuccuccugg

SEQ ID NO: 1257230 - RNA, 19 nt, Human
ggggcugcuuccuccugga

SEQ ID NO: 1257231 - RNA, 12 nt, Human
ggggcugcugcu

SEQ ID NO: 1257232 - RNA, 13 nt, Human
ggggcuggaggag

SEQ ID NO: 1257233 - RNA, 11 nt, Human
ggggcaggagu

SEQ ID NO: 1257234 - RNA, 17 nt, Human
ggggcaggaguagcuga

SEQ ID NO: 1257235 - RNA, 19 nt, Human
ggggcaggaguagcugagc

SEQ ID NO: 1257236 - RNA, 20 nt, Human
ggggcaggaguagcugagcu

SEQ ID NO: 1257237 - RNA, 21 nt, Human
ggggcaggaguagcugagcuc

SEQ ID NO: 1257238 - RNA, 13 nt, Human
ggggcaggcuggg

SEQ ID NO: 1257239 - RNA, 14 nt, Human
ggggcaggcugggc

SEQ ID NO: 1257240 - RNA, 15 nt, Human
ggggcaggcugggcc

SEQ ID NO: 1257241 - RNA, 16 nt, Human
ggggcaggcugggcca

SEQ ID NO: 1257242 - RNA, 20 nt, Human
gggguucuuucuuccucugc

SEQ ID NO: 1257243 - RNA, 22 nt, Human
gggguucuuucuuccucugcug

SEQ ID NO: 1257244 - RNA, 14 nt, Human
gggguucaggcccg

SEQ ID NO: 1257245 - RNA, 21 nt, Human
gggguuccguguccaccccca

SEQ ID NO: 1257246 - RNA, 23 nt, Human
ggggugacccggcacccccugca

SEQ ID NO: 1257247 - RNA, 14 nt, Human
ggggugaggagcug

SEQ ID NO: 1257248 - RNA, 15 nt, Human
ggggugaggagcugg

SEQ ID NO: 1257249 - RNA, 23 nt, Human
ggggugaugagggcagcagccag

SEQ ID NO: 1257250 - RNA, 17 nt, Human
ggggugaugagggcagc

SEQ ID NO: 1257251 - RNA, 13 nt, Human
ggggugcacagga

SEQ ID NO: 1257252 - RNA, 14 nt, Human
ggggugcacaggag

SEQ ID NO: 1257253 - RNA, 15 nt, Human
ggggugcacaggagg

SEQ ID NO: 1257254 - RNA, 16 nt, Human
ggggugcacaggaggg

SEQ ID NO: 1257255 - RNA, 13 nt, Human
ggggugcagggau

SEQ ID NO: 1257256 - RNA, 16 nt, Human
ggggugcccacaggcc

SEQ ID NO: 1257257 - RNA, 18 nt, Human
ggggugcagggauguggg

SEQ ID NO: 1257258 - RNA, 17 nt, Human
ggguacauggugcuggg

SEQ ID NO: 1257259 - RNA, 16 nt, Human
gggccuuuggcaggug

SEQ ID NO: 1257260 - RNA, 18 nt, Human
gggccuuggccuggagca

SEQ ID NO: 1257261 - RNA, 13 nt, Human
gggccuugggcuc

SEQ ID NO: 1257262 - RNA, 14 nt, Human
gggccuugggcucc

SEQ ID NO: 1257263 - RNA, 24 nt, Human
gggccuugggcuccgugugggaga

SEQ ID NO: 1257264 - RNA, 12 nt, Human
gggcgcaggccg

SEQ ID NO: 1257265 - RNA, 13 nt, Human
gggcgccuguggu

SEQ ID NO: 1257266 - RNA, 22 nt, Human
gggccugguuaaauaaggcagg

SEQ ID NO: 1257267 - RNA, 23 nt, Human
gggccugguuaaauaaggcaggg

SEQ ID NO: 1257268 - RNA, 15 nt, Human
gggccuguacugccu

SEQ ID NO: 1257269 - RNA, 16 nt, Human
gggccuguacugccug

SEQ ID NO: 1257270 - RNA, 17 nt, Human
gggccuguacugccugc

SEQ ID NO: 1257271 - RNA, 18 nt, Human
gggccuguacugccugcu

SEQ ID NO: 1257272 - RNA, 20 nt, Human
gggccuguacugccugcuug

SEQ ID NO: 1257273 - RNA, 16 nt, Human
gggccuguccacaggc

SEQ ID NO: 1257274 - RNA, 23 nt, Human
gggccuguccacaggcuucugag

SEQ ID NO: 1257275 - RNA, 20 nt, Human
gggccuuaggaagagccuuc

SEQ ID NO: 1257276 - RNA, 18 nt, Human
gggccuuaggaagagccu

SEQ ID NO: 1257277 - RNA, 14 nt, Human
gggccuuggccugg

SEQ ID NO: 1257278 - RNA, 15 nt, Human
gggccuuggccugga

SEQ ID NO: 1257279 - RNA, 16 nt, Human
gggccuuggccuggag

SEQ ID NO: 1257280 - RNA, 17 nt, Human
gggccuuggccuggagc

SEQ ID NO: 1257281 - RNA, 14 nt, Human
gggcucccugacug

SEQ ID NO: 1257282 - RNA, 18 nt, Human
gggcucccugacugggag

SEQ ID NO: 1257283 - RNA, 21 nt, Human
gggcucccuguaaccucuuca

SEQ ID NO: 1257284 - RNA, 14 nt, Human
gggcgcggcuggga

SEQ ID NO: 1257285 - RNA, 22 nt, Human
gggccuggcagccgugccuuca

SEQ ID NO: 1257286 - RNA, 10 nt, Human
gggccuggca

SEQ ID NO: 1257287 - RNA, 19 nt, Human
gggccuggucucacccugg

SEQ ID NO: 1257288 - RNA, 20 nt, Human
gggccuggucucacccugga

SEQ ID NO: 1257289 - RNA, 21 nt, Human
gggccuggucucacccuggag

SEQ ID NO: 1257290 - RNA, 23 nt, Human
gggccuggucucacccuggaggc

SEQ ID NO: 1257291 - RNA, 20 nt, Human
ggcucccacaggcccuuccu

SEQ ID NO: 1257292 - RNA, 21 nt, Human
ggcucccacaggcccuuccuc

SEQ ID NO: 1257293 - RNA, 11 nt, Human
gggcccggacg

SEQ ID NO: 1257294 - RNA, 12 nt, Human
gggcccggacgc

SEQ ID NO: 1257295 - RNA, 16 nt, Human
gggcccucucugcucu

SEQ ID NO: 1257296 - RNA, 23 nt, Human
gggccugcugcugagaaccuggc

SEQ ID NO: 1257297 - RNA, 13 nt, Human
gggcccuccuucc

SEQ ID NO: 1257298 - RNA, 12 nt, Human
gggccuggagau

SEQ ID NO: 1257299 - RNA, 21 nt, Human
gggccuggagauccuccugca

SEQ ID NO: 1257300 - RNA, 20 nt, Human
gggcuuauaauaaaggacug

SEQ ID NO: 1257301 - RNA, 14 nt, Human
gggcuuauaucugg

SEQ ID NO: 1257302 - RNA, 19 nt, Human
gggcuuauaucuggccucu

SEQ ID NO: 1257303 - RNA, 17 nt, Human
gggcugucaucugugca

SEQ ID NO: 1257304 - RNA, 22 nt, Human
gggcuguaacugccaggcucuc

SEQ ID NO: 1257305 - RNA, 22 nt, Human
gggcuguccugccacccagccc

SEQ ID NO: 1257306 - RNA, 23 nt, Human
gggcugguucuguaauugugugu

SEQ ID NO: 1257307 - RNA, 14 nt, Human
gggcugagggagcc

SEQ ID NO: 1257308 - RNA, 18 nt, Human
gggcugaggagcagcagg

SEQ ID NO: 1257309 - RNA, 16 nt, Human
gggcuguaacugccag

SEQ ID NO: 1257310 - RNA, 17 nt, Human
gggcuguaacugccagg

SEQ ID NO: 1257311 - RNA, 18 nt, Human
gggcuguaacugccaggc

SEQ ID NO: 1257312 - RNA, 19 nt, Human
gggcuguaacugccaggcu

SEQ ID NO: 1257313 - RNA, 16 nt, Human
gggcugucaucugugc

SEQ ID NO: 1257314 - RNA, 23 nt, Human
gggcugagcuggggaccugguac

SEQ ID NO: 1257315 - RNA, 12 nt, Human
gggcugagggag

SEQ ID NO: 1257316 - RNA, 13 nt, Human
gggcugagggagc

SEQ ID NO: 1257317 - RNA, 23 nt, Human
gggcuccuccaggguggcagcaa

SEQ ID NO: 1257318 - RNA, 22 nt, Human
gggcuccuccaggguggcagca

SEQ ID NO: 1257319 - RNA, 17 nt, Human
gggcuccgugugggaga

SEQ ID NO: 1257320 - RNA, 18 nt, Human
gggcuccgugugggagac

SEQ ID NO: 1257321 - RNA, 11 nt, Human
gggcuccugca

SEQ ID NO: 1257322 - RNA, 18 nt, Human
gggcuccugcacuuacuu

SEQ ID NO: 1257323 - RNA, 22 nt, Human
gggcuccugcacuuacuugcuu

SEQ ID NO: 1257324 - RNA, 13 nt, Human
gggcuccuggacc

SEQ ID NO: 1257325 - RNA, 18 nt, Human
gggcuccuugugggccug

SEQ ID NO: 1257326 - RNA, 19 nt, Human
gggcuccuugugggccugg

SEQ ID NO: 1257327 - RNA, 20 nt, Human
gggcuccuugugggccuggg

SEQ ID NO: 1257328 - RNA, 22 nt, Human
gggcuccuugugggccugggcu

SEQ ID NO: 1257329 - RNA, 23 nt, Human
gggcuccuugugggccugggcuc

SEQ ID NO: 1257330 - RNA, 12 nt, Human
gggcuccuuucc

SEQ ID NO: 1257331 - RNA, 18 nt, Human
gggcucgaggggugggcu

SEQ ID NO: 1257332 - RNA, 20 nt, Human
gggcucgaggggugggcugg

SEQ ID NO: 1257333 - RNA, 15 nt, Human
gggcucuaacgccug

SEQ ID NO: 1257334 - RNA, 16 nt, Human
gggcucuaacgccuga

SEQ ID NO: 1257335 - RNA, 17 nt, Human
gggcucuaacgccugag

SEQ ID NO: 1257336 - RNA, 18 nt, Human
gggcucuaacgccugagc

SEQ ID NO: 1257337 - RNA, 19 nt, Human
gggcucuaacgccugagcc

SEQ ID NO: 1257338 - RNA, 20 nt, Human
gggcucuaacgccugagccc

SEQ ID NO: 1257339 - RNA, 21 nt, Human
gggcucuaacgccugagccca

SEQ ID NO: 1257340 - RNA, 23 nt, Human
gggcucuaacgccugagcccagg

SEQ ID NO: 1257341 - RNA, 22 nt, Human
gggcucuaacgccugagcccag

SEQ ID NO: 1257342 - RNA, 12 nt, Human
gggcucuccugg

SEQ ID NO: 1257343 - RNA, 13 nt, Human
gggcucuccuggc

SEQ ID NO: 1257344 - RNA, 22 nt, Human
gggcucuccuggcuucccaucc

SEQ ID NO: 1257345 - RNA, 11 nt, Human
gggcucugagg

SEQ ID NO: 1257346 - RNA, 12 nt, Human
gggcucugaggc

SEQ ID NO: 1257347 - RNA, 15 nt, Human
gggcucugaggcgcc

SEQ ID NO: 1257348 - RNA, 11 nt, Human
gggcucugagu

SEQ ID NO: 1257349 - RNA, 16 nt, Human
gggcucugaguacccc

SEQ ID NO: 1257350 - RNA, 10 nt, Human
gggcucugau

SEQ ID NO: 1257351 - RNA, 20 nt, Human
gggcucugcaauuccccucu

SEQ ID NO: 1257352 - RNA, 21 nt, Human
gggcucugcaauuccccucug

SEQ ID NO: 1257353 - RNA, 23 nt, Human
gggcucugcaauuccccucugcu

SEQ ID NO: 1257354 - RNA, 19 nt, Human
gggugcugggccccugccu

SEQ ID NO: 1257355 - RNA, 16 nt, Human
ggguagcgggggaggg

SEQ ID NO: 1257356 - RNA, 14 nt, Human
ggguucauuugugu

SEQ ID NO: 1257357 - RNA, 22 nt, Human
ggguuccagcaauucuccugcc

SEQ ID NO: 1257358 - RNA, 12 nt, Human
ggguggaagcuu

SEQ ID NO: 1257359 - RNA, 14 nt, Human
ggguucuuucuucc

SEQ ID NO: 1257360 - RNA, 16 nt, Human
ggguucuuucuuccuc

SEQ ID NO: 1257361 - RNA, 20 nt, Human
ggguucugccugccagcugc

SEQ ID NO: 1257362 - RNA, 21 nt, Human
ggguucugccugccagcugca

SEQ ID NO: 1257363 - RNA, 21 nt, Human
ggguuccguguccacccccau

SEQ ID NO: 1257364 - RNA, 17 nt, Human
ggguuccuccccuccag

SEQ ID NO: 1257365 - RNA, 18 nt, Human
ggguuccuccccuccagc

SEQ ID NO: 1257366 - RNA, 19 nt, Human
ggguuccuccccuccagcu

SEQ ID NO: 1257367 - RNA, 22 nt, Human
gguacuucaaauccuugaagau

SEQ ID NO: 1257368 - RNA, 21 nt, Human
gguacuguaugaucaaauguu

SEQ ID NO: 1257369 - RNA, 20 nt, Human
gguacuguaugaucaaaugu

SEQ ID NO: 1257370 - RNA, 18 nt, Human
gguacuguaugaucaaau

SEQ ID NO: 1257371 - RNA, 17 nt, Human
gguacuguaugaucaaa

SEQ ID NO: 1257372 - RNA, 21 nt, Human
gguacuguacagcuggcucua

SEQ ID NO: 1257373 - RNA, 18 nt, Human
gguacuguacagcuggcu

SEQ ID NO: 1257374 - RNA, 20 nt, Human
gguacuguacagcuggcucu

SEQ ID NO: 1257375 - RNA, 18 nt, Human
gguacugacuuugcuugc

SEQ ID NO: 1257376 - RNA, 15 nt, Human
gguacuguacagcug

SEQ ID NO: 1257377 - RNA, 14 nt, Human
gguacccuccuggc

SEQ ID NO: 1257378 - RNA, 13 nt, Human
gguacccucugga

SEQ ID NO: 1257379 - RNA, 20 nt, Human
ggguuucaccauguuggcca

SEQ ID NO: 1257380 - RNA, 15 nt, Human
ggguuuauucacuga

SEQ ID NO: 1257381 - RNA, 20 nt, Human
ggguuucaccauguuagcca

SEQ ID NO: 1257382 - RNA, 23 nt, Human
ggguuguaaauuggcauggaaau

SEQ ID NO: 1257383 - RNA, 15 nt, Human
ggguugugugucugu

SEQ ID NO: 1257384 - RNA, 15 nt, Human
gguagacacacauga

SEQ ID NO: 1257385 - RNA, 20 nt, Human
gguagaaagagauacagagg

SEQ ID NO: 1257386 - RNA, 19 nt, Human
gguagaauguaaagcuugu

SEQ ID NO: 1257387 - RNA, 22 nt, Human
gguagacacacaugaaguccaa

SEQ ID NO: 1257388 - RNA, 15 nt, Human
gguagaauguaaagc

SEQ ID NO: 1257389 - RNA, 18 nt, Human
ggucaaguuauuaauuuc

SEQ ID NO: 1257390 - RNA, 14 nt, Human
ggucacacacugau

SEQ ID NO: 1257391 - RNA, 15 nt, Human
ggucacagcggaggu

SEQ ID NO: 1257392 - RNA, 22 nt, Human
ggucccccacucuaaagcaaau

SEQ ID NO: 1257393 - RNA, 14 nt, Human
ggucccagcagcug

SEQ ID NO: 1257394 - RNA, 12 nt, Human
ggucccagcagc

SEQ ID NO: 1257395 - RNA, 15 nt, Human
ggucccagcagcugc

SEQ ID NO: 1257396 - RNA, 18 nt, Human
ggucagcacaucucaaca

SEQ ID NO: 1257397 - RNA, 21 nt, Human
ggucagcaugucuauucagcu

SEQ ID NO: 1257398 - RNA, 23 nt, Human
ggugccccaggaccagcucagga

SEQ ID NO: 1257399 - RNA, 17 nt, Human
ggugccuaguauugaca

SEQ ID NO: 1257400 - RNA, 16 nt, Human
ggugccuaggccuggg

SEQ ID NO: 1257401 - RNA, 22 nt, Human
ggugauagguauaaguggugug

SEQ ID NO: 1257402 - RNA, 12 nt, Human
ggugcccaggag

SEQ ID NO: 1257403 - RNA, 13 nt, Human
ggugcccaggaga

SEQ ID NO: 1257404 - RNA, 14 nt, Human
ggugcccaggagaa

SEQ ID NO: 1257405 - RNA, 13 nt, Human
ggugccccaggac

SEQ ID NO: 1257406 - RNA, 14 nt, Human
ggugccccaggacc

SEQ ID NO: 1257407 - RNA, 15 nt, Human
ggugccccaggacca

SEQ ID NO: 1257408 - RNA, 16 nt, Human
ggugccccaggaccag

SEQ ID NO: 1257409 - RNA, 17 nt, Human
ggugccccaggaccagc

SEQ ID NO: 1257410 - RNA, 20 nt, Human
ggugccccaggaccagcuca

SEQ ID NO: 1257411 - RNA, 21 nt, Human
ggugccccaggaccagcucag

SEQ ID NO: 1257412 - RNA, 22 nt, Human
ggugccccaggaccagcucagg

SEQ ID NO: 1257413 - RNA, 20 nt, Human
ggugaccccagggcacagga

SEQ ID NO: 1257414 - RNA, 21 nt, Human
ggugaccccagggcacaggag

SEQ ID NO: 1257415 - RNA, 23 nt, Human
ggugaccccagggcacaggagcu

SEQ ID NO: 1257416 - RNA, 22 nt, Human
ggugaccccagggcacaggagc

SEQ ID NO: 1257417 - RNA, 20 nt, Human
ggugacccggcacccccugc

SEQ ID NO: 1257418 - RNA, 21 nt, Human
ggugacccggcacccccugca

SEQ ID NO: 1257419 - RNA, 22 nt, Human
ggugacccggcacccccugcag

SEQ ID NO: 1257420 - RNA, 23 nt, Human
ggugacccggcacccccugcagc

SEQ ID NO: 1257421 - RNA, 16 nt, Human
ggugaggucagcacau

SEQ ID NO: 1257422 - RNA, 23 nt, Human
ggugaggucuguuccuuuuauau

SEQ ID NO: 1257423 - RNA, 23 nt, Human
ggugaguuggcuuaccuggccca

SEQ ID NO: 1257424 - RNA, 20 nt, Human
ggugcuaaugucaaaccacu

SEQ ID NO: 1257425 - RNA, 19 nt, Human
ggugccuaguauugacaaa

SEQ ID NO: 1257426 - RNA, 17 nt, Human
ggugcggcuggccaugg

SEQ ID NO: 1257427 - RNA, 14 nt, Human
ggugcucagggggc

SEQ ID NO: 1257428 - RNA, 16 nt, Human
ggugcucucuuucugu

SEQ ID NO: 1257429 - RNA, 13 nt, Human
gguccgugggacg

SEQ ID NO: 1257430 - RNA, 21 nt, Human
gguccgguguucuaagaugug

SEQ ID NO: 1257431 - RNA, 18 nt, Human
gguccggcagcuucugcc

SEQ ID NO: 1257432 - RNA, 16 nt, Human
gguccgguguucuaag

SEQ ID NO: 1257433 - RNA, 17 nt, Human
gguccgguguucuaaga

SEQ ID NO: 1257434 - RNA, 19 nt, Human
ggucccuuguauccccugc

SEQ ID NO: 1257435 - RNA, 11 nt, Human
ggucccugggu

SEQ ID NO: 1257436 - RNA, 20 nt, Human
ggucccuggguagcggggga

SEQ ID NO: 1257437 - RNA, 17 nt, Human
ggucccuaauaaagcug

SEQ ID NO: 1257438 - RNA, 16 nt, Human
ggucccuaauaaagcu

SEQ ID NO: 1257439 - RNA, 13 nt, Human
ggucccuaauaaa

SEQ ID NO: 1257440 - RNA, 12 nt, Human
ggucccuaauaa

SEQ ID NO: 1257441 - RNA, 18 nt, Human
ggucccuaauaaagcugu

SEQ ID NO: 1257442 - RNA, 13 nt, Human
gguccccuccuuc

SEQ ID NO: 1257443 - RNA, 21 nt, Human
ggucccccacucuaaagcaaa

SEQ ID NO: 1257444 - RNA, 12 nt, Human
gguccccuccuu

SEQ ID NO: 1257445 - RNA, 14 nt, Human
ggucccucugugua

SEQ ID NO: 1257446 - RNA, 17 nt, Human
ggucccuccccuucucu

SEQ ID NO: 1257447 - RNA, 21 nt, Human
ggugaagcucacuucugggcu

SEQ ID NO: 1257448 - RNA, 15 nt, Human
ggucugagcuccagc

SEQ ID NO: 1257449 - RNA, 16 nt, Human
ggucugagcuccagcu

SEQ ID NO: 1257450 - RNA, 22 nt, Human
ggugaagaggaggggaagaggc

SEQ ID NO: 1257451 - RNA, 19 nt, Human
ggucucgaacuccugaccu

SEQ ID NO: 1257452 - RNA, 20 nt, Human
ggucucgaacuccugaccuu

SEQ ID NO: 1257453 - RNA, 20 nt, Human
ggucucccuucucuacacuc

SEQ ID NO: 1257454 - RNA, 21 nt, Human
ggucucccuucucuacacucu

SEQ ID NO: 1257455 - RNA, 21 nt, Human
guaaaucacgcuuuuugaaaa

SEQ ID NO: 1257456 - RNA, 14 nt, Human
guaaauauuuuaaa

SEQ ID NO: 1257457 - RNA, 14 nt, Human
guaaaucaguaaga

SEQ ID NO: 1257458 - RNA, 13 nt, Human
guaaauauuuuaa

SEQ ID NO: 1257459 - RNA, 23 nt, Human
guaaauauuuuaaagaauugugu

SEQ ID NO: 1257460 - RNA, 11 nt, Human
guaaauauaaa

SEQ ID NO: 1257461 - RNA, 12 nt, Human
guaaauauaaag

SEQ ID NO: 1257462 - RNA, 13 nt, Human
guaaauauaaaga

SEQ ID NO: 1257463 - RNA, 14 nt, Human
guaaauauaaagac

SEQ ID NO: 1257464 - RNA, 15 nt, Human
guaaauauaaagacg

SEQ ID NO: 1257465 - RNA, 19 nt, Human
guaaauauaaagacguuuu

SEQ ID NO: 1257466 - RNA, 23 nt, Human
guaaauauaaagacguuuuauaa

SEQ ID NO: 1257467 - RNA, 21 nt, Human
guaaauacaauuuuuuuuauu

SEQ ID NO: 1257468 - RNA, 19 nt, Human
guaaauacaauuuuuuuua

SEQ ID NO: 1257469 - RNA, 16 nt, Human
guaaauacccauaugu

SEQ ID NO: 1257470 - RNA, 14 nt, Human
guaaauaggaauug

SEQ ID NO: 1257471 - RNA, 16 nt, Human
guaaaauaaaaggucg

SEQ ID NO: 1257472 - RNA, 19 nt, Human
guaaaagcaaaaaagaaaa

SEQ ID NO: 1257473 - RNA, 16 nt, Human
guaaaagcauuuugua

SEQ ID NO: 1257474 - RNA, 17 nt, Human
guaaaagguauuaaauu

SEQ ID NO: 1257475 - RNA, 13 nt, Human
guaaauaaaaaga

SEQ ID NO: 1257476 - RNA, 13 nt, Human
guaaauacaauuu

SEQ ID NO: 1257477 - RNA, 21 nt, Human
guaaauaacuggaaaacagaa

SEQ ID NO: 1257478 - RNA, 20 nt, Human
guaaauaacuggaaaacaga

SEQ ID NO: 1257479 - RNA, 14 nt, Human
guaaauaauacauu

SEQ ID NO: 1257480 - RNA, 16 nt, Human
guaaauaauacauuau

SEQ ID NO: 1257481 - RNA, 12 nt, Human
guaaauaaugcu

SEQ ID NO: 1257482 - RNA, 16 nt, Human
guaaauaaugcuuuga

SEQ ID NO: 1257483 - RNA, 15 nt, Human
guaaauaaaaagaaa

SEQ ID NO: 1257484 - RNA, 14 nt, Human
guaaauaaaaagaa

SEQ ID NO: 1257485 - RNA, 17 nt, Human
guaaaucaguaagaggu

SEQ ID NO: 1257486 - RNA, 21 nt, Human
guaaaucaguaagagguguua

SEQ ID NO: 1257487 - RNA, 13 nt, Human
guaaaucuacaca

SEQ ID NO: 1257488 - RNA, 12 nt, Human
guaaaucugcca

SEQ ID NO: 1257489 - RNA, 13 nt, Human
guaaaucugccac

SEQ ID NO: 1257490 - RNA, 14 nt, Human
guaaaucugccaca

SEQ ID NO: 1257491 - RNA, 14 nt, Human
guaaaucuuuuaca

SEQ ID NO: 1257492 - RNA, 17 nt, Human
guaaaugucucacugag

SEQ ID NO: 1257493 - RNA, 19 nt, Human
guaaaugucucacugagca

SEQ ID NO: 1257494 - RNA, 15 nt, Human
guaaaucugccacaa

SEQ ID NO: 1257495 - RNA, 16 nt, Human
guaaaugguaugucau

SEQ ID NO: 1257496 - RNA, 23 nt, Human
guaagcauaagcuuaugcuuaaa

SEQ ID NO: 1257497 - RNA, 20 nt, Human
guaagcacugacugggacca

SEQ ID NO: 1257498 - RNA, 21 nt, Human
guaagauuuguuuuuaaacug

SEQ ID NO: 1257499 - RNA, 17 nt, Human
guaagauuuguuuuuaa

SEQ ID NO: 1257500 - RNA, 16 nt, Human
guaagcacugacuggg

SEQ ID NO: 1257501 - RNA, 19 nt, Human
guaaguacagagaagccau

SEQ ID NO: 1257502 - RNA, 17 nt, Human
guaagggugacaaaugg

SEQ ID NO: 1257503 - RNA, 13 nt, Human
guaaguacagaga

SEQ ID NO: 1257504 - RNA, 14 nt, Human
guaaguacagagaa

SEQ ID NO: 1257505 - RNA, 15 nt, Human
guaaguacagagaag

SEQ ID NO: 1257506 - RNA, 16 nt, Human
guaaguacagagaagc

SEQ ID NO: 1257507 - RNA, 17 nt, Human
guaaguacagagaagcc

SEQ ID NO: 1257508 - RNA, 18 nt, Human
guaaguacagagaagcca

SEQ ID NO: 1257509 - RNA, 18 nt, Human
guaaggauccggaaagaa

SEQ ID NO: 1257510 - RNA, 19 nt, Human
guaaggauccggaaagaag

SEQ ID NO: 1257511 - RNA, 13 nt, Human
guaaggcucuaga

SEQ ID NO: 1257512 - RNA, 14 nt, Human
guaaggcucuagau

SEQ ID NO: 1257513 - RNA, 16 nt, Human
guaaggcucuagauca

SEQ ID NO: 1257514 - RNA, 13 nt, Human
guaaggcugugua

SEQ ID NO: 1257515 - RNA, 14 nt, Human
guaaggcuguguaa

SEQ ID NO: 1257516 - RNA, 19 nt, Human
guaaggcuguguaagauuu

SEQ ID NO: 1257517 - RNA, 13 nt, Human
guaacuguucuug

SEQ ID NO: 1257518 - RNA, 16 nt, Human
guaacuguuuuuuaag

SEQ ID NO: 1257519 - RNA, 18 nt, Human
guaacuucuuauggaauu

SEQ ID NO: 1257520 - RNA, 20 nt, Human
guaacuucuuauggaauuga

SEQ ID NO: 1257521 - RNA, 21 nt, Human
guaacuucuuauggaauugau

SEQ ID NO: 1257522 - RNA, 21 nt, Human
guaacuugauccauuucuaau

SEQ ID NO: 1257523 - RNA, 23 nt, Human
guaacuugauccauuucuaauua

SEQ ID NO: 1257524 - RNA, 22 nt, Human
guaacuugauccauuucuaauu

SEQ ID NO: 1257525 - RNA, 14 nt, Human
guaacuuuuguaag

SEQ ID NO: 1257526 - RNA, 15 nt, Human
guaacuuuuguaaga

SEQ ID NO: 1257527 - RNA, 17 nt, Human
guaacuuuuguaagaca

SEQ ID NO: 1257528 - RNA, 14 nt, Human
guaacuuuugugaa

SEQ ID NO: 1257529 - RNA, 20 nt, Human
guaagaaaccuacugcccag

SEQ ID NO: 1257530 - RNA, 13 nt, Human
guaagaaauacag

SEQ ID NO: 1257531 - RNA, 16 nt, Human
guaagaaauacagacu

SEQ ID NO: 1257532 - RNA, 18 nt, Human
guaagaacaacuaccuga

SEQ ID NO: 1257533 - RNA, 23 nt, Human
guaagaacaacuaccugagcuaa

SEQ ID NO: 1257534 - RNA, 15 nt, Human
guaagacaaagguuu

SEQ ID NO: 1257535 - RNA, 15 nt, Human
guaagagcaaaagaa

SEQ ID NO: 1257536 - RNA, 18 nt, Human
guaagauuauagauucua

SEQ ID NO: 1257537 - RNA, 20 nt, Human
guaagauuauagauucuaaa

SEQ ID NO: 1257538 - RNA, 21 nt, Human
guaagauuauagauucuaaag

SEQ ID NO: 1257539 - RNA, 22 nt, Human
guaagauuauagauucuaaaga

SEQ ID NO: 1257540 - RNA, 23 nt, Human
guaagauuauagauucuaaagau

SEQ ID NO: 1257541 - RNA, 13 nt, Human
guaagauuuccuu

SEQ ID NO: 1257542 - RNA, 18 nt, Human
guaagauuuccuucuuuu

SEQ ID NO: 1257543 - RNA, 16 nt, Human
guaagauuuguuuuua

SEQ ID NO: 1257544 - RNA, 20 nt, Human
guaaaaacaaagaaauuaug

SEQ ID NO: 1257545 - RNA, 13 nt, Human
guaaaaaauuuau

SEQ ID NO: 1257546 - RNA, 18 nt, Human
guaaaaacaaagaaauua

SEQ ID NO: 1257547 - RNA, 22 nt, Human
gguuuuuuuucaguuguucuuu

SEQ ID NO: 1257548 - RNA, 17 nt, Human
guaaaaauggaaacuau

SEQ ID NO: 1257549 - RNA, 15 nt, Human
guaaaaaugauuuca

SEQ ID NO: 1257550 - RNA, 14 nt, Human
guaaaaauaaaauu

SEQ ID NO: 1257551 - RNA, 13 nt, Human
guaaaaauaaaau

SEQ ID NO: 1257552 - RNA, 19 nt, Human
guaaaacaaacaauaccug

SEQ ID NO: 1257553 - RNA, 17 nt, Human
guaaaacagggccacau

SEQ ID NO: 1257554 - RNA, 20 nt, Human
guaaaacagggccacauaga

SEQ ID NO: 1257555 - RNA, 11 nt, Human
guaaaacauuu

SEQ ID NO: 1257556 - RNA, 18 nt, Human
guaaaacauuuauuuuga

SEQ ID NO: 1257557 - RNA, 20 nt, Human
guaaaaccuggagauggugg

SEQ ID NO: 1257558 - RNA, 12 nt, Human
guaaaagcaaaa

SEQ ID NO: 1257559 - RNA, 18 nt, Human
guaaaagcaaaaaagaaa

SEQ ID NO: 1257560 - RNA, 20 nt, Human
guaaaacauuuauuuugaca

SEQ ID NO: 1257561 - RNA, 20 nt, Human
gguuuucacauuggaaacaa

SEQ ID NO: 1257562 - RNA, 13 nt, Human
gguuuucgagauu

SEQ ID NO: 1257563 - RNA, 19 nt, Human
gguuuaauguuuuggccaa

SEQ ID NO: 1257564 - RNA, 13 nt, Human
gguuuaauguuuu

SEQ ID NO: 1257565 - RNA, 18 nt, Human
gguuuacucacugcugca

SEQ ID NO: 1257566 - RNA, 17 nt, Human
gguuuuguauucucuga

SEQ ID NO: 1257567 - RNA, 18 nt, Human
gguuuuguauucucugag

SEQ ID NO: 1257568 - RNA, 19 nt, Human
gguuuuguauucucugagc

SEQ ID NO: 1257569 - RNA, 16 nt, Human
gguuuuuaaaacccag

SEQ ID NO: 1257570 - RNA, 14 nt, Human
gguuuuuauuuccu

SEQ ID NO: 1257571 - RNA, 20 nt, Human
gguuuuuacugcucugagaa

SEQ ID NO: 1257572 - RNA, 19 nt, Human
gguuuuuacugcucugaga

SEQ ID NO: 1257573 - RNA, 12 nt, Human
gguuuuucccug

SEQ ID NO: 1257574 - RNA, 23 nt, Human
gguuuuuguuuguuuccuuuguu

SEQ ID NO: 1257575 - RNA, 20 nt, Human
gguuuuuggacuucuggggu

SEQ ID NO: 1257576 - RNA, 14 nt, Human
gguuuuuuaguuga

SEQ ID NO: 1257577 - RNA, 13 nt, Human
gguuuuuuuccuu

SEQ ID NO: 1257578 - RNA, 22 nt, Human
guaaaaaaaaaaaaaagcaaca

SEQ ID NO: 1257579 - RNA, 23 nt, Human
guaaaaaaaaaaaaaauguucuu

SEQ ID NO: 1257580 - RNA, 20 nt, Human
gguggcccuuaugacugcca

SEQ ID NO: 1257581 - RNA, 23 nt, Human
gguggcccuuaugacugccaaga

SEQ ID NO: 1257582 - RNA, 20 nt, Human
gguggccgcugaguggcagg

SEQ ID NO: 1257583 - RNA, 21 nt, Human
gguggccgcugaguggcaggg

SEQ ID NO: 1257584 - RNA, 16 nt, Human
gguggcccgacagccu

SEQ ID NO: 1257585 - RNA, 17 nt, Human
gguggcccgacagccug

SEQ ID NO: 1257586 - RNA, 18 nt, Human
gguggcccgacagccugg

SEQ ID NO: 1257587 - RNA, 19 nt, Human
gguggcccgacagccuggc

SEQ ID NO: 1257588 - RNA, 20 nt, Human
gguggcccgacagccuggca

SEQ ID NO: 1257589 - RNA, 15 nt, Human
gguggcccucucccc

SEQ ID NO: 1257590 - RNA, 18 nt, Human
gguggcccucuccccugc

SEQ ID NO: 1257591 - RNA, 19 nt, Human
gguggcccucuccccugcc

SEQ ID NO: 1257592 - RNA, 20 nt, Human
gguggcccucuccccugccc

SEQ ID NO: 1257593 - RNA, 22 nt, Human
gguggcccucuccccugccccc

SEQ ID NO: 1257594 - RNA, 21 nt, Human
gguggcccucuccccugcccc

SEQ ID NO: 1257595 - RNA, 18 nt, Human
gguucuuucuuccucugc

SEQ ID NO: 1257596 - RNA, 19 nt, Human
gguucagaauuaaacuuuu

SEQ ID NO: 1257597 - RNA, 23 nt, Human
gguucaacaaagaaacaaagaug

SEQ ID NO: 1257598 - RNA, 14 nt, Human
gguucaacuuauua

SEQ ID NO: 1257599 - RNA, 18 nt, Human
gguucagaauuaaacuuu

SEQ ID NO: 1257600 - RNA, 21 nt, Human
gguugggcagccagaccagca

SEQ ID NO: 1257601 - RNA, 13 nt, Human
gguugguagggug

SEQ ID NO: 1257602 - RNA, 16 nt, Human
gguugguaggguggga

SEQ ID NO: 1257603 - RNA, 22 nt, Human
gguugaacucugguggcacagg

SEQ ID NO: 1257604 - RNA, 16 nt, Human
gguugaacucuggugg

SEQ ID NO: 1257605 - RNA, 15 nt, Human
gguugaccccagagg

SEQ ID NO: 1257606 - RNA, 16 nt, Human
gguugaccccagagga

SEQ ID NO: 1257607 - RNA, 15 nt, Human
gguugacuuuaccca

SEQ ID NO: 1257608 - RNA, 18 nt, Human
gguugcuccgccuggccu

SEQ ID NO: 1257609 - RNA, 16 nt, Human
gguugcuccgccuggc

SEQ ID NO: 1257610 - RNA, 17 nt, Human
gguuuaaaugaacaaga

SEQ ID NO: 1257611 - RNA, 17 nt, Human
gguuuaagaaauagaau

SEQ ID NO: 1257612 - RNA, 13 nt, Human
gguuguuauguga

SEQ ID NO: 1257613 - RNA, 12 nt, Human
gguuguuucugu

SEQ ID NO: 1257614 - RNA, 19 nt, Human
gguuguuucuguuccaaau

SEQ ID NO: 1257615 - RNA, 14 nt, Human
gguuguuucuguuc

SEQ ID NO: 1257616 - RNA, 18 nt, Human
gguuuaaagaaaguguau

SEQ ID NO: 1257617 - RNA, 15 nt, Human
gguuuaaagagucua

SEQ ID NO: 1257618 - RNA, 20 nt, Human
gguuuaaagagucuagauuc

SEQ ID NO: 1257619 - RNA, 22 nt, Human
gguuuaaagagucuagauucaa

SEQ ID NO: 1257620 - RNA, 12 nt, Human
gguuuaaaugaa

SEQ ID NO: 1257621 - RNA, 22 nt, Human
gguuuaaaugaacaagagaagc

SEQ ID NO: 1257622 - RNA, 19 nt, Human
guaaugauaacuggaaacu

SEQ ID NO: 1257623 - RNA, 18 nt, Human
guaaugaugucguuugaa

SEQ ID NO: 1257624 - RNA, 14 nt, Human
guaaugaauaccuu

SEQ ID NO: 1257625 - RNA, 22 nt, Human
guaaugacagaacaugcuguua

SEQ ID NO: 1257626 - RNA, 16 nt, Human
guaauggcaguuauau

SEQ ID NO: 1257627 - RNA, 23 nt, Human
guaauggcaguuauauuuugcag

SEQ ID NO: 1257628 - RNA, 19 nt, Human
guaaugguacugacuuugc

SEQ ID NO: 1257629 - RNA, 23 nt, Human
guaaugguacugacuuugcuugc

SEQ ID NO: 1257630 - RNA, 14 nt, Human
guaaugguguagaa

SEQ ID NO: 1257631 - RNA, 15 nt, Human
guaaugguguagaac

SEQ ID NO: 1257632 - RNA, 16 nt, Human
guaaugguguagaaca

SEQ ID NO: 1257633 - RNA, 17 nt, Human
guaaugguguagaacac

SEQ ID NO: 1257634 - RNA, 19 nt, Human
guaauguaucaaauacauu

SEQ ID NO: 1257635 - RNA, 19 nt, Human
guaaugucuugagcucuau

SEQ ID NO: 1257636 - RNA, 17 nt, Human
guaaugucuugagcucu

SEQ ID NO: 1257637 - RNA, 17 nt, Human
guaauguuaauauugau

SEQ ID NO: 1257638 - RNA, 22 nt, Human
guaauguuaauauugauuuauu

SEQ ID NO: 1257639 - RNA, 18 nt, Human
guaauguuaauauugauu

SEQ ID NO: 1257640 - RNA, 13 nt, Human
guaaugaaaacca

SEQ ID NO: 1257641 - RNA, 11 nt, Human
guaaugaaaac

SEQ ID NO: 1257642 - RNA, 15 nt, Human
guaaucguguccccu

SEQ ID NO: 1257643 - RNA, 22 nt, Human
guaaucuaugaauucuaaguga

SEQ ID NO: 1257644 - RNA, 22 nt, Human
guaaucugaauaaaguguaaca

SEQ ID NO: 1257645 - RNA, 23 nt, Human
guaauucuaccaaggucuucuua

SEQ ID NO: 1257646 - RNA, 18 nt, Human
guaauucuaaaugaaugu

SEQ ID NO: 1257647 - RNA, 22 nt, Human
guaauucuaaaugaauguuuac

SEQ ID NO: 1257648 - RNA, 17 nt, Human
guaauucagguuuuucc

SEQ ID NO: 1257649 - RNA, 12 nt, Human
guaauucuaaau

SEQ ID NO: 1257650 - RNA, 14 nt, Human
guaauucuaaauga

SEQ ID NO: 1257651 - RNA, 15 nt, Human
guaauucuaaaugaa

SEQ ID NO: 1257652 - RNA, 23 nt, Human
guaauuauuuauguauggugcaa

SEQ ID NO: 1257653 - RNA, 19 nt, Human
guaauuauuuauguauggu

SEQ ID NO: 1257654 - RNA, 15 nt, Human
guaauuggaaaggca

SEQ ID NO: 1257655 - RNA, 15 nt, Human
guaauugacaugugc

SEQ ID NO: 1257656 - RNA, 23 nt, Human
guaauuguacuaaagccaaacau

SEQ ID NO: 1257657 - RNA, 23 nt, Human
guaauuaguaacauguguuaagu

SEQ ID NO: 1257658 - RNA, 20 nt, Human
guaauuagugccacuuaaug

SEQ ID NO: 1257659 - RNA, 21 nt, Human
guaauuagugccacuuaaugu

SEQ ID NO: 1257660 - RNA, 13 nt, Human
guaauuauggagu

SEQ ID NO: 1257661 - RNA, 18 nt, Human
guaauuaaaagcaaauca

SEQ ID NO: 1257662 - RNA, 19 nt, Human
guaauuaaaagcaaaucau

SEQ ID NO: 1257663 - RNA, 20 nt, Human
guaauuaaaagcaaaucauu

SEQ ID NO: 1257664 - RNA, 21 nt, Human
guaauuaaaagcaaaucauuu

SEQ ID NO: 1257665 - RNA, 15 nt, Human
guaauuaguaacaug

SEQ ID NO: 1257666 - RNA, 15 nt, Human
guacagacagaaaaa

SEQ ID NO: 1257667 - RNA, 14 nt, Human
guacagaaagcugc

SEQ ID NO: 1257668 - RNA, 13 nt, Human
guacagaaagcug

SEQ ID NO: 1257669 - RNA, 18 nt, Human
guaauuguacuaaagcca

SEQ ID NO: 1257670 - RNA, 11 nt, Human
guacagagaag

SEQ ID NO: 1257671 - RNA, 12 nt, Human
guacagagaagc

SEQ ID NO: 1257672 - RNA, 13 nt, Human
guacagagaagcc

SEQ ID NO: 1257673 - RNA, 14 nt, Human
guacagagaagcca

SEQ ID NO: 1257674 - RNA, 15 nt, Human
guacagagaagccag

SEQ ID NO: 1257675 - RNA, 16 nt, Human
guacagagaagccagc

SEQ ID NO: 1257676 - RNA, 18 nt, Human
guacagagaagccagcuu

SEQ ID NO: 1257677 - RNA, 19 nt, Human
guacagagaagccagcuug

SEQ ID NO: 1257678 - RNA, 21 nt, Human
guacagagaagccagcuuguu

SEQ ID NO: 1257679 - RNA, 23 nt, Human
guacagagaagccagcuuguuua

SEQ ID NO: 1257680 - RNA, 15 nt, Human
guacagagaagccau

SEQ ID NO: 1257681 - RNA, 16 nt, Human
guacagagaagccauc

SEQ ID NO: 1257682 - RNA, 18 nt, Human
guacagagaagccaucac

SEQ ID NO: 1257683 - RNA, 17 nt, Human
guacagagaagccauca

SEQ ID NO: 1257684 - RNA, 21 nt, Human
guacagaguguggacucuggu

SEQ ID NO: 1257685 - RNA, 12 nt, Human
guacagcuggcu

SEQ ID NO: 1257686 - RNA, 14 nt, Human
guacagcuggcucu

SEQ ID NO: 1257687 - RNA, 15 nt, Human
guacagcuggcucua

SEQ ID NO: 1257688 - RNA, 22 nt, Human
guacauagugcuaacaugaaga

SEQ ID NO: 1257689 - RNA, 16 nt, Human
guacauaugugcugga

SEQ ID NO: 1257690 - RNA, 14 nt, Human
guacauaugugcug

SEQ ID NO: 1257691 - RNA, 17 nt, Human
guacauaguuauuuauu

SEQ ID NO: 1257692 - RNA, 18 nt, Human
guacauaguuauuuauuu

SEQ ID NO: 1257693 - RNA, 19 nt, Human
guacauacccuggccgccc

SEQ ID NO: 1257694 - RNA, 22 nt, Human
guacauacccuggccgcccccu

SEQ ID NO: 1257695 - RNA, 14 nt, Human
guacauaacugaaa

SEQ ID NO: 1257696 - RNA, 16 nt, Human
guacaggguuaucugc

SEQ ID NO: 1257697 - RNA, 21 nt, Human
guacaguauggggguuguaaa

SEQ ID NO: 1257698 - RNA, 22 nt, Human
guacaguauggggguuguaaau

SEQ ID NO: 1257699 - RNA, 23 nt, Human
guacaguauggggguuguaaauu

SEQ ID NO: 1257700 - RNA, 24 nt, Human
guacaguauggggguuguaaauug

SEQ ID NO: 1257701 - RNA, 13 nt, Human
guacagugucuuu

SEQ ID NO: 1257702 - RNA, 14 nt, Human
guacagugucuuuu

SEQ ID NO: 1257703 - RNA, 15 nt, Human
guacagugucuuuuu

SEQ ID NO: 1257704 - RNA, 20 nt, Human
guacagugucuuuuuuugua

SEQ ID NO: 1257705 - RNA, 21 nt, Human
guacagugucuuuuuuuguau

SEQ ID NO: 1257706 - RNA, 22 nt, Human
guacagugucuuuuuuuguaua

SEQ ID NO: 1257707 - RNA, 12 nt, Human
guacaguguuac

SEQ ID NO: 1257708 - RNA, 14 nt, Human
guacaguuaucuaa

SEQ ID NO: 1257709 - RNA, 20 nt, Human
guacaguuaucuaaguuaau

SEQ ID NO: 1257710 - RNA, 19 nt, Human
guacuugcucuugaugccu

SEQ ID NO: 1257711 - RNA, 18 nt, Human
guacuugcucuugaugcc

SEQ ID NO: 1257712 - RNA, 16 nt, Human
guacuugcucuugaug

SEQ ID NO: 1257713 - RNA, 15 nt, Human
guacuugcucuugau

SEQ ID NO: 1257714 - RNA, 22 nt, Human
guacuugcucuugaugccuggc

SEQ ID NO: 1257715 - RNA, 21 nt, Human
guacuuggaguauuggggucu

SEQ ID NO: 1257716 - RNA, 12 nt, Human
guacuuguaguu

SEQ ID NO: 1257717 - RNA, 14 nt, Human
guacuugcucuuga

SEQ ID NO: 1257718 - RNA, 22 nt, Human
guacuugccuuauuagaguguc

SEQ ID NO: 1257719 - RNA, 20 nt, Human
guagaaaaaaaaauucacau

SEQ ID NO: 1257720 - RNA, 13 nt, Human
guagaaaagcuau

SEQ ID NO: 1257721 - RNA, 15 nt, Human
guagaaacugcaggg

SEQ ID NO: 1257722 - RNA, 19 nt, Human
guagaaacugcagggaaaa

SEQ ID NO: 1257723 - RNA, 15 nt, Human
guagaggagaaacug

SEQ ID NO: 1257724 - RNA, 23 nt, Human
guacuuuauuuucuauaauuuaa

SEQ ID NO: 1257725 - RNA, 22 nt, Human
guacuuucauauuuuaaacaga

SEQ ID NO: 1257726 - RNA, 13 nt, Human
guacccccaggac

SEQ ID NO: 1257727 - RNA, 14 nt, Human
guacccccaggacc

SEQ ID NO: 1257728 - RNA, 16 nt, Human
guacccccaggaccag

SEQ ID NO: 1257729 - RNA, 15 nt, Human
guacccccaggacca

SEQ ID NO: 1257730 - RNA, 15 nt, Human
guaccgcaaugugac

SEQ ID NO: 1257731 - RNA, 16 nt, Human
guacccucugaaauac

SEQ ID NO: 1257732 - RNA, 15 nt, Human
guacccucuggaggg

SEQ ID NO: 1257733 - RNA, 18 nt, Human
guaccgcgucuacccugg

SEQ ID NO: 1257734 - RNA, 17 nt, Human
guaccuagcuggcucug

SEQ ID NO: 1257735 - RNA, 17 nt, Human
guacccuccuggcucuu

SEQ ID NO: 1257736 - RNA, 17 nt, Human
guacccucucagcucca

SEQ ID NO: 1257737 - RNA, 18 nt, Human
guacccucucagcuccag

SEQ ID NO: 1257738 - RNA, 19 nt, Human
guacccucucagcuccagg

SEQ ID NO: 1257739 - RNA, 20 nt, Human
guaccgcgucuacccuggga

SEQ ID NO: 1257740 - RNA, 12 nt, Human
guaccugagggu

SEQ ID NO: 1257741 - RNA, 14 nt, Human
guaccugagggucu

SEQ ID NO: 1257742 - RNA, 17 nt, Human
guaccugcccccaaucc

SEQ ID NO: 1257743 - RNA, 15 nt, Human
guaccugagggucug

SEQ ID NO: 1257744 - RNA, 15 nt, Human
guaccugggcaagcu

SEQ ID NO: 1257745 - RNA, 16 nt, Human
guaccugggcaagcug

SEQ ID NO: 1257746 - RNA, 15 nt, Human
guaccuggggccaaa

SEQ ID NO: 1257747 - RNA, 21 nt, Human
guaccuuuugaggagccccag

SEQ ID NO: 1257748 - RNA, 23 nt, Human
guaccuuuugaggagccccagcu

SEQ ID NO: 1257749 - RNA, 23 nt, Human
guacgaaccuacaguuuuaacug

SEQ ID NO: 1257750 - RNA, 15 nt, Human
guacgaugacagugu

SEQ ID NO: 1257751 - RNA, 17 nt, Human
guacggauuuucaguua

SEQ ID NO: 1257752 - RNA, 13 nt, Human
guacuaaagccaa

SEQ ID NO: 1257753 - RNA, 22 nt, Human
guacuaacuccuaggaaaauac

SEQ ID NO: 1257754 - RNA, 17 nt, Human
guacuaauauuucugua

SEQ ID NO: 1257755 - RNA, 20 nt, Human
ggccuguggaucaaauccag

SEQ ID NO: 1257756 - RNA, 20 nt, Human
ggcgccgucuccaggggcug

SEQ ID NO: 1257757 - RNA, 21 nt, Human
ggcgccgucuccaggggcugc

SEQ ID NO: 1257758 - RNA, 22 nt, Human
ggcgcgaucucggcucacugca

SEQ ID NO: 1257759 - RNA, 15 nt, Human
ggcgccugugguucu

SEQ ID NO: 1257760 - RNA, 16 nt, Human
ggcgccugugguucug

SEQ ID NO: 1257761 - RNA, 16 nt, Human
ggcgcggcugggagga

SEQ ID NO: 1257762 - RNA, 20 nt, Human
ggcggauguugaagugagcu

SEQ ID NO: 1257763 - RNA, 17 nt, Human
ggcggcaggggccugga

SEQ ID NO: 1257764 - RNA, 18 nt, Human
ggcggcaggggccuggag

SEQ ID NO: 1257765 - RNA, 22 nt, Human
ggcggccuaugacuugggcacc

SEQ ID NO: 1257766 - RNA, 11 nt, Human
ggccugugagc

SEQ ID NO: 1257767 - RNA, 22 nt, Human
ggccugucucaagcucuuccuu

SEQ ID NO: 1257768 - RNA, 17 nt, Human
ggccuguacugccugcu

SEQ ID NO: 1257769 - RNA, 17 nt, Human
ggccuguagaguugcug

SEQ ID NO: 1257770 - RNA, 18 nt, Human
ggccuguccaacacaucu

SEQ ID NO: 1257771 - RNA, 18 nt, Human
ggccuguacugccugcuu

SEQ ID NO: 1257772 - RNA, 15 nt, Human
ggccuguccacaggc

SEQ ID NO: 1257773 - RNA, 22 nt, Human
ggccuguccacaggcuucugag

SEQ ID NO: 1257774 - RNA, 14 nt, Human
ggccuguccuccaa

SEQ ID NO: 1257775 - RNA, 14 nt, Human
ggccugggcaggag

SEQ ID NO: 1257776 - RNA, 11 nt, Human
ggccugggagg

SEQ ID NO: 1257777 - RNA, 17 nt, Human
ggccugggcuccuggac

SEQ ID NO: 1257778 - RNA, 18 nt, Human
ggccugggcuccuggacc

SEQ ID NO: 1257779 - RNA, 13 nt, Human
ggccugggcagga

SEQ ID NO: 1257780 - RNA, 19 nt, Human
ggccuggcuggcugagggc

SEQ ID NO: 1257781 - RNA, 21 nt, Human
ggccugggacaacugcuccca

SEQ ID NO: 1257782 - RNA, 11 nt, Human
ggccuggcugg

SEQ ID NO: 1257783 - RNA, 12 nt, Human
ggccuggcuggc

SEQ ID NO: 1257784 - RNA, 14 nt, Human
ggccuggcuggcug

SEQ ID NO: 1257785 - RNA, 15 nt, Human
ggccuggcuggcuga

SEQ ID NO: 1257786 - RNA, 17 nt, Human
ggccuggcuggcugagg

SEQ ID NO: 1257787 - RNA, 13 nt, Human
ggccucuugagca

SEQ ID NO: 1257788 - RNA, 16 nt, Human
ggccucuugagcagug

SEQ ID NO: 1257789 - RNA, 18 nt, Human
ggccucuugagcaguggc

SEQ ID NO: 1257790 - RNA, 22 nt, Human
ggccucuugagcaguggcuggu

SEQ ID NO: 1257791 - RNA, 17 nt, Human
ggccugaaagaggcuga

SEQ ID NO: 1257792 - RNA, 23 nt, Human
ggccugaaagaggcugaggccug

SEQ ID NO: 1257793 - RNA, 12 nt, Human
ggcuccagcugg

SEQ ID NO: 1257794 - RNA, 15 nt, Human
ggcuccagccccucu

SEQ ID NO: 1257795 - RNA, 21 nt, Human
ggcuccagccccucuuggaga

SEQ ID NO: 1257796 - RNA, 18 nt, Human
ggcucacacaccuguagc

SEQ ID NO: 1257797 - RNA, 16 nt, Human
ggcuccagaugcaggg

SEQ ID NO: 1257798 - RNA, 17 nt, Human
ggcuccagaugcagggc

SEQ ID NO: 1257799 - RNA, 18 nt, Human
ggcuccagaugcagggca

SEQ ID NO: 1257800 - RNA, 19 nt, Human
ggcuccagaugcagggcag

SEQ ID NO: 1257801 - RNA, 17 nt, Human
ggcucccacaggcccuu

SEQ ID NO: 1257802 - RNA, 18 nt, Human
ggcucccacaggcccuuc

SEQ ID NO: 1257803 - RNA, 19 nt, Human
ggcucccacaggcccuucc

SEQ ID NO: 1257804 - RNA, 22 nt, Human
ggcuccagccccucuuggagaa

SEQ ID NO: 1257805 - RNA, 23 nt, Human
ggcuccagccccucuuggagaag

SEQ ID NO: 1257806 - RNA, 18 nt, Human
ggcggcucggaggaagcc

SEQ ID NO: 1257807 - RNA, 18 nt, Human
ggcggcuggggucccagc

SEQ ID NO: 1257808 - RNA, 20 nt, Human
ggcuagagugcgguggcgcg

SEQ ID NO: 1257809 - RNA, 16 nt, Human
ggcuaggguggggaga

SEQ ID NO: 1257810 - RNA, 14 nt, Human
ggcuagggggagcc

SEQ ID NO: 1257811 - RNA, 17 nt, Human
ggcuauagaugucuuuu

SEQ ID NO: 1257812 - RNA, 19 nt, Human
ggcuauagaugucuuuucc

SEQ ID NO: 1257813 - RNA, 19 nt, Human
ggcuaugggggcacugagg

SEQ ID NO: 1257814 - RNA, 18 nt, Human
ggcuauagaugucuuuuc

SEQ ID NO: 1257815 - RNA, 16 nt, Human
ggcuauuuguaaaucu

SEQ ID NO: 1257816 - RNA, 21 nt, Human
ggcuauuuuguuugcuucaug

SEQ ID NO: 1257817 - RNA, 19 nt, Human
ggcucaagcgauucuccug

SEQ ID NO: 1257818 - RNA, 13 nt, Human
ggcccugcccugg

SEQ ID NO: 1257819 - RNA, 20 nt, Human
ggcccugcccugguuuccug

SEQ ID NO: 1257820 - RNA, 11 nt, Human
ggcccugcccu

SEQ ID NO: 1257821 - RNA, 12 nt, Human
ggcccugcccug

SEQ ID NO: 1257822 - RNA, 23 nt, Human
ggcccugagcgaguggagucugc

SEQ ID NO: 1257823 - RNA, 11 nt, Human
ggcccugagcg

SEQ ID NO: 1257824 - RNA, 19 nt, Human
ggcccugcaaaaggacucu

SEQ ID NO: 1257825 - RNA, 22 nt, Human
ggcccugcaaaaggacucucag

SEQ ID NO: 1257826 - RNA, 22 nt, Human
ggcccugcccugguuuccugcc

SEQ ID NO: 1257827 - RNA, 14 nt, Human
ggcccugcuuccug

SEQ ID NO: 1257828 - RNA, 15 nt, Human
ggcccugcuuccugc

SEQ ID NO: 1257829 - RNA, 16 nt, Human
ggcccugcuuccugcu

SEQ ID NO: 1257830 - RNA, 13 nt, Human
ggcccuggcuccc

SEQ ID NO: 1257831 - RNA, 22 nt, Human
ggcccuggcucccacaggcccu

SEQ ID NO: 1257832 - RNA, 18 nt, Human
ggcccugcuuccugcuug

SEQ ID NO: 1257833 - RNA, 17 nt, Human
ggcccuggaucagcgug

SEQ ID NO: 1257834 - RNA, 18 nt, Human
ggcccuggaucagcgugg

SEQ ID NO: 1257835 - RNA, 20 nt, Human
ggcccuggaucagcguggcc

SEQ ID NO: 1257836 - RNA, 22 nt, Human
ggcccuggaucagcguggccuu

SEQ ID NO: 1257837 - RNA, 23 nt, Human
ggcccuggaucagcguggccuug

SEQ ID NO: 1257838 - RNA, 13 nt, Human
ggcccuggccucc

SEQ ID NO: 1257839 - RNA, 14 nt, Human
ggcccuggccuccc

SEQ ID NO: 1257840 - RNA, 17 nt, Human
ggcccuggccuccccug

SEQ ID NO: 1257841 - RNA, 13 nt, Human
ggcccacugugcc

SEQ ID NO: 1257842 - RNA, 17 nt, Human
ggcccacugugccucag

SEQ ID NO: 1257843 - RNA, 18 nt, Human
ggcccacugugccucaga

SEQ ID NO: 1257844 - RNA, 21 nt, Human
ggcccacugugccucagagac

SEQ ID NO: 1257845 - RNA, 23 nt, Human
ggcccacugugccucagagacca

SEQ ID NO: 1257846 - RNA, 12 nt, Human
ggcccucucccc

SEQ ID NO: 1257847 - RNA, 15 nt, Human
ggcccucuccccugc

SEQ ID NO: 1257848 - RNA, 16 nt, Human
ggcccucuccccugcc

SEQ ID NO: 1257849 - RNA, 23 nt, Human
ggcccucuccccugcccccugca

SEQ ID NO: 1257850 - RNA, 14 nt, Human
ggcccucucugcuc

SEQ ID NO: 1257851 - RNA, 15 nt, Human
ggcccucucugcucu

SEQ ID NO: 1257852 - RNA, 21 nt, Human
ggcccaauccaagguggggug

SEQ ID NO: 1257853 - RNA, 21 nt, Human
ggcccucucugcucugcgugu

SEQ ID NO: 1257854 - RNA, 19 nt, Human
ggccucuuccgugacguca

SEQ ID NO: 1257855 - RNA, 20 nt, Human
ggccucggacuuagcuggga

SEQ ID NO: 1257856 - RNA, 20 nt, Human
ggccucaaaggcccgcucua

SEQ ID NO: 1257857 - RNA, 19 nt, Human
ggccucaaaugcaccaugu

SEQ ID NO: 1257858 - RNA, 22 nt, Human
ggccucggacuuagcugggaga

SEQ ID NO: 1257859 - RNA, 12 nt, Human
ggccuaggcugc

SEQ ID NO: 1257860 - RNA, 14 nt, Human
ggccuaggcugcau

SEQ ID NO: 1257861 - RNA, 13 nt, Human
ggccuaggcugca

SEQ ID NO: 1257862 - RNA, 16 nt, Human
ggccuaucuaaacugg

SEQ ID NO: 1257863 - RNA, 18 nt, Human
ggccuaugacuugggcac

SEQ ID NO: 1257864 - RNA, 15 nt, Human
ggccuauggagagcc

SEQ ID NO: 1257865 - RNA, 16 nt, Human
ggccuauggagagccc

SEQ ID NO: 1257866 - RNA, 17 nt, Human
ggccuauggagagcccu

SEQ ID NO: 1257867 - RNA, 18 nt, Human
ggccuauggagagcccug

SEQ ID NO: 1257868 - RNA, 19 nt, Human
ggccuauggagagcccugg

SEQ ID NO: 1257869 - RNA, 21 nt, Human
ggccuauggagagcccuggga

SEQ ID NO: 1257870 - RNA, 14 nt, Human
ggccuauguggucu

SEQ ID NO: 1257871 - RNA, 22 nt, Human
ggccuauggagagcccugggac

SEQ ID NO: 1257872 - RNA, 23 nt, Human
ggccucaaagcaagcauucagaa

SEQ ID NO: 1257873 - RNA, 18 nt, Human
ggccucaaaggcccgcuc

SEQ ID NO: 1257874 - RNA, 19 nt, Human
ggccucaaaggcccgcucu

SEQ ID NO: 1257875 - RNA, 23 nt, Human
ggcccugggccugccucaccacg

SEQ ID NO: 1257876 - RNA, 18 nt, Human
ggcccugggccugccuca

SEQ ID NO: 1257877 - RNA, 12 nt, Human
ggcccugggcug

SEQ ID NO: 1257878 - RNA, 13 nt, Human
ggcccugggcugg

SEQ ID NO: 1257879 - RNA, 14 nt, Human
ggcccugggcugga

SEQ ID NO: 1257880 - RNA, 15 nt, Human
ggcccugggcuggaa

SEQ ID NO: 1257881 - RNA, 13 nt, Human
ggcccuggggccu

SEQ ID NO: 1257882 - RNA, 14 nt, Human
ggcccuggggccug

SEQ ID NO: 1257883 - RNA, 15 nt, Human
ggcccuggggccugu

SEQ ID NO: 1257884 - RNA, 16 nt, Human
ggcccuggggccugua

SEQ ID NO: 1257885 - RNA, 17 nt, Human
ggcccuggggccuguac

SEQ ID NO: 1257886 - RNA, 18 nt, Human
ggcccuggggccuguacu

SEQ ID NO: 1257887 - RNA, 23 nt, Human
ggcccuggggccuguacugccug

SEQ ID NO: 1257888 - RNA, 19 nt, Human
ggcccugucauccagcuca

SEQ ID NO: 1257889 - RNA, 22 nt, Human
ggccuaaccugccgagagucca

SEQ ID NO: 1257890 - RNA, 21 nt, Human
ggccgugacgucuggguggcc

SEQ ID NO: 1257891 - RNA, 21 nt, Human
ggccgugaaugggugcccaca

SEQ ID NO: 1257892 - RNA, 16 nt, Human
ggccgugacgucuggg

SEQ ID NO: 1257893 - RNA, 20 nt, Human
ggccgugacgucuggguggc

SEQ ID NO: 1257894 - RNA, 15 nt, Human
ggccuaagaggcugc

SEQ ID NO: 1257895 - RNA, 22 nt, Human
ggccuaagaggcugcccuccug

SEQ ID NO: 1257896 - RNA, 18 nt, Human
ggccuaagaggcugcccu

SEQ ID NO: 1257897 - RNA, 20 nt, Human
ggccuaagaggcugcccucc

SEQ ID NO: 1257898 - RNA, 16 nt, Human
ggccuaccccgcagac

SEQ ID NO: 1257899 - RNA, 20 nt, Human
ggccuaccccgcagacaccu

SEQ ID NO: 1257900 - RNA, 23 nt, Human
ggccuaccccgcagacaccuugg

SEQ ID NO: 1257901 - RNA, 24 nt, Human
ggccuacuagagucugaacagcug

SEQ ID NO: 1257902 - RNA, 17 nt, Human
ggccuaggaggguccuc

SEQ ID NO: 1257903 - RNA, 19 nt, Human
ggccuaggaggguccucug

SEQ ID NO: 1257904 - RNA, 21 nt, Human
ggccuaggaggguccucugag

SEQ ID NO: 1257905 - RNA, 23 nt, Human
ggccuaggaggguccucugagac

SEQ ID NO: 1257906 - RNA, 13 nt, Human
ggccuaggauucu

SEQ ID NO: 1257907 - RNA, 15 nt, Human
ggccuaggauucuaa

SEQ ID NO: 1257908 - RNA, 18 nt, Human
ggagaugaggccagacca

SEQ ID NO: 1257909 - RNA, 15 nt, Human
ggagaugcuccuugg

SEQ ID NO: 1257910 - RNA, 15 nt, Human
ggauacuggcacaga

SEQ ID NO: 1257911 - RNA, 17 nt, Human
ggauacuggcacagagg

SEQ ID NO: 1257912 - RNA, 18 nt, Human
ggauacuggcacagaggu

SEQ ID NO: 1257913 - RNA, 18 nt, Human
ggauacuuauauggaaau

SEQ ID NO: 1257914 - RNA, 12 nt, Human
ggauagaggggu

SEQ ID NO: 1257915 - RNA, 13 nt, Human
ggauagaugcugg

SEQ ID NO: 1257916 - RNA, 14 nt, Human
ggauagaugcuggc

SEQ ID NO: 1257917 - RNA, 18 nt, Human
ggauagaugcuggcccag

SEQ ID NO: 1257918 - RNA, 13 nt, Human
ggaucccucaucu

SEQ ID NO: 1257919 - RNA, 18 nt, Human
ggaucccucaucuguccc

SEQ ID NO: 1257920 - RNA, 22 nt, Human
ggaucccucaucugucccuccg

SEQ ID NO: 1257921 - RNA, 17 nt, Human
ggaucccucccccccau

SEQ ID NO: 1257922 - RNA, 22 nt, Human
ggaucaaaccccgaccaccugc

SEQ ID NO: 1257923 - RNA, 14 nt, Human
ggaucacaagaugg

SEQ ID NO: 1257924 - RNA, 18 nt, Human
ggaucacaagauggaauu

SEQ ID NO: 1257925 - RNA, 16 nt, Human
ggauauguaaaacauu

SEQ ID NO: 1257926 - RNA, 14 nt, Human
ggauaggccagccg

SEQ ID NO: 1257927 - RNA, 15 nt, Human
ggauaggccagccgc

SEQ ID NO: 1257928 - RNA, 21 nt, Human
ggauaggccuucauuaacaaa

SEQ ID NO: 1257929 - RNA, 16 nt, Human
ggauauaguuuuacuu

SEQ ID NO: 1257930 - RNA, 20 nt, Human
ggauauaguuuuacuuuuaa

SEQ ID NO: 1257931 - RNA, 17 nt, Human
ggauccgacugcuuugg

SEQ ID NO: 1257932 - RNA, 19 nt, Human
ggauccgacugcuuuggac

SEQ ID NO: 1257933 - RNA, 21 nt, Human
ggauccgacugcuuuggaccu

SEQ ID NO: 1257934 - RNA, 22 nt, Human
ggaugccaauauuaaaucugcu

SEQ ID NO: 1257935 - RNA, 16 nt, Human
ggaugcggauggccgg

SEQ ID NO: 1257936 - RNA, 16 nt, Human
ggaugcuaacaucuaa

SEQ ID NO: 1257937 - RNA, 14 nt, Human
ggauggacaucuug

SEQ ID NO: 1257938 - RNA, 16 nt, Human
ggauucuuccaucuga

SEQ ID NO: 1257939 - RNA, 15 nt, Human
ggauugcacguggcc

SEQ ID NO: 1257940 - RNA, 17 nt, Human
ggauugcacguggccuc

SEQ ID NO: 1257941 - RNA, 18 nt, Human
ggauugcacguggccucu

SEQ ID NO: 1257942 - RNA, 19 nt, Human
ggauugcaauaucugaagc

SEQ ID NO: 1257943 - RNA, 16 nt, Human
ggauugcgagagaugu

SEQ ID NO: 1257944 - RNA, 19 nt, Human
ggauuacaggcuccugcca

SEQ ID NO: 1257945 - RNA, 13 nt, Human
ggauggacaucuu

SEQ ID NO: 1257946 - RNA, 15 nt, Human
ggauuguaaaauggu

SEQ ID NO: 1257947 - RNA, 17 nt, Human
ggauugcgagagaugug

SEQ ID NO: 1257948 - RNA, 18 nt, Human
ggauugcgagagaugugu

SEQ ID NO: 1257949 - RNA, 19 nt, Human
ggauugcgagagaugugug

SEQ ID NO: 1257950 - RNA, 19 nt, Human
ggcaaucauggugcucaga

SEQ ID NO: 1257951 - RNA, 15 nt, Human
ggcaaugauggcaau

SEQ ID NO: 1257952 - RNA, 17 nt, Human
ggcaaugccacagcccu

SEQ ID NO: 1257953 - RNA, 17 nt, Human
ggcacccccagccuggg

SEQ ID NO: 1257954 - RNA, 18 nt, Human
ggcacccccagccugggc

SEQ ID NO: 1257955 - RNA, 19 nt, Human
ggcacccccagccugggcc

SEQ ID NO: 1257956 - RNA, 20 nt, Human
ggcacccccagccugggccu

SEQ ID NO: 1257957 - RNA, 21 nt, Human
ggcacccccagccugggccua

SEQ ID NO: 1257958 - RNA, 17 nt, Human
ggcacccccgucaagag

SEQ ID NO: 1257959 - RNA, 13 nt, Human
ggcacccccugca

SEQ ID NO: 1257960 - RNA, 14 nt, Human
ggcacccccugcag

SEQ ID NO: 1257961 - RNA, 18 nt, Human
ggcaccggggccucggac

SEQ ID NO: 1257962 - RNA, 15 nt, Human
ggcaccgaagcccag

SEQ ID NO: 1257963 - RNA, 16 nt, Human
ggcaccgaagcccaga

SEQ ID NO: 1257964 - RNA, 23 nt, Human
ggcaccgaagcccagagggucug

SEQ ID NO: 1257965 - RNA, 15 nt, Human
ggcacccccugcagc

SEQ ID NO: 1257966 - RNA, 20 nt, Human
ggcaaugggagcugaggcca

SEQ ID NO: 1257967 - RNA, 21 nt, Human
ggcaaugggagcugaggccac

SEQ ID NO: 1257968 - RNA, 18 nt, Human
ggcaaugccacagcccug

SEQ ID NO: 1257969 - RNA, 13 nt, Human
ggcacccccagcc

SEQ ID NO: 1257970 - RNA, 14 nt, Human
ggcacccccagccu

SEQ ID NO: 1257971 - RNA, 15 nt, Human
ggcacccccagccug

SEQ ID NO: 1257972 - RNA, 16 nt, Human
ggcacccccagccugg

SEQ ID NO: 1257973 - RNA, 11 nt, Human
ggcaucuuuug

SEQ ID NO: 1257974 - RNA, 14 nt, Human
ggcaucuuuuguau

SEQ ID NO: 1257975 - RNA, 16 nt, Human
ggcaucuuuuguauua

SEQ ID NO: 1257976 - RNA, 21 nt, Human
ggcaucuuuuguauuaagaaa

SEQ ID NO: 1257977 - RNA, 17 nt, Human
ggcaucuuuuguauuaa

SEQ ID NO: 1257978 - RNA, 17 nt, Human
ggcauggccagguggcc

SEQ ID NO: 1257979 - RNA, 18 nt, Human
ggcauggccagguggcca

SEQ ID NO: 1257980 - RNA, 12 nt, Human
ggcauggaaauu

SEQ ID NO: 1257981 - RNA, 17 nt, Human
ggcagcuucugcccccu

SEQ ID NO: 1257982 - RNA, 20 nt, Human
ggcagcuucugcccccugca

SEQ ID NO: 1257983 - RNA, 21 nt, Human
ggcagcuucugcccccugcag

SEQ ID NO: 1257984 - RNA, 22 nt, Human
ggcagcuucugcccccugcaga

SEQ ID NO: 1257985 - RNA, 23 nt, Human
ggcagcuucugcccccugcagaa

SEQ ID NO: 1257986 - RNA, 14 nt, Human
ggcagggugacccu

SEQ ID NO: 1257987 - RNA, 22 nt, Human
ggcagcgccaggcugaccacag

SEQ ID NO: 1257988 - RNA, 22 nt, Human
ggcaccgaagcccagagggucu

SEQ ID NO: 1257989 - RNA, 15 nt, Human
ggcaccuaauccagg

SEQ ID NO: 1257990 - RNA, 16 nt, Human
ggcaccuaauccaggc

SEQ ID NO: 1257991 - RNA, 17 nt, Human
ggcaccuaauccaggca

SEQ ID NO: 1257992 - RNA, 23 nt, Human
ggcaccugggcccuggggccugu

SEQ ID NO: 1257993 - RNA, 22 nt, Human
ggcaccugguggccaugcuccu

SEQ ID NO: 1257994 - RNA, 23 nt, Human
ggcacuaacguugagccccugga

SEQ ID NO: 1257995 - RNA, 16 nt, Human
ggcagcuucugccccc

SEQ ID NO: 1257996 - RNA, 20 nt, Human
ggcagcucuggacagcccca

SEQ ID NO: 1257997 - RNA, 13 nt, Human
ggcagcuccucug

SEQ ID NO: 1257998 - RNA, 16 nt, Human
ggcagcuccucugucu

SEQ ID NO: 1257999 - RNA, 21 nt, Human
ggcagcuccucugucucgagc

SEQ ID NO: 1258000 - RNA, 18 nt, Human
ggcagcuccucugucucg

SEQ ID NO: 1258001 - RNA, 15 nt, Human
ggcagcucuggacag

SEQ ID NO: 1258002 - RNA, 18 nt, Human
ggccacaugggaggcuca

SEQ ID NO: 1258003 - RNA, 19 nt, Human
ggccacaugggaggcucac

SEQ ID NO: 1258004 - RNA, 17 nt, Human
ggccacuccagaccccu

SEQ ID NO: 1258005 - RNA, 13 nt, Human
ggccacuccgaga

SEQ ID NO: 1258006 - RNA, 14 nt, Human
ggccacuccuuccu

SEQ ID NO: 1258007 - RNA, 15 nt, Human
ggccacuccuuccug

SEQ ID NO: 1258008 - RNA, 16 nt, Human
ggccacuccuuccugc

SEQ ID NO: 1258009 - RNA, 17 nt, Human
ggccacuccuuccugcc

SEQ ID NO: 1258010 - RNA, 19 nt, Human
ggccacuccuuccugcccc

SEQ ID NO: 1258011 - RNA, 20 nt, Human
ggccacuccuuccugcccca

SEQ ID NO: 1258012 - RNA, 11 nt, Human
ggccagccugg

SEQ ID NO: 1258013 - RNA, 11 nt, Human
ggccagccucu

SEQ ID NO: 1258014 - RNA, 12 nt, Human
ggccagccuggc

SEQ ID NO: 1258015 - RNA, 13 nt, Human
ggccagccuggcc

SEQ ID NO: 1258016 - RNA, 14 nt, Human
ggccagccuggccu

SEQ ID NO: 1258017 - RNA, 15 nt, Human
ggccagccuggccuc

SEQ ID NO: 1258018 - RNA, 16 nt, Human
ggccagccuggccucc

SEQ ID NO: 1258019 - RNA, 18 nt, Human
ggccacgcuccagcugcc

SEQ ID NO: 1258020 - RNA, 17 nt, Human
ggccagccuggccuccu

SEQ ID NO: 1258021 - RNA, 18 nt, Human
ggccagccuggccuccug

SEQ ID NO: 1258022 - RNA, 19 nt, Human
ggccagccuggccuccugc

SEQ ID NO: 1258023 - RNA, 20 nt, Human
ggccagccuggccuccugcc

SEQ ID NO: 1258024 - RNA, 22 nt, Human
ggccagccuggccuccugccuc

SEQ ID NO: 1258025 - RNA, 21 nt, Human
ggccagccuggccuccugccu

SEQ ID NO: 1258026 - RNA, 22 nt, Human
ggccagcgagcgcccagcuccu

SEQ ID NO: 1258027 - RNA, 12 nt, Human
ggccagcuccgc

SEQ ID NO: 1258028 - RNA, 13 nt, Human
ggccagcuggagg

SEQ ID NO: 1258029 - RNA, 15 nt, Human
ggccagcuggaggca

SEQ ID NO: 1258030 - RNA, 18 nt, Human
ggccagcuggaggcaggg

SEQ ID NO: 1258031 - RNA, 15 nt, Human
ggccagcuuuucaaa

SEQ ID NO: 1258032 - RNA, 20 nt, Human
ggccauucuuucccaacacc

SEQ ID NO: 1258033 - RNA, 20 nt, Human
ggccauucuccacagcaacc

SEQ ID NO: 1258034 - RNA, 13 nt, Human
ggccauguccaaa

SEQ ID NO: 1258035 - RNA, 15 nt, Human
ggccauguccaaaga

SEQ ID NO: 1258036 - RNA, 16 nt, Human
ggccauguccaaagag

SEQ ID NO: 1258037 - RNA, 22 nt, Human
ggccauguccaaagaggcugcc

SEQ ID NO: 1258038 - RNA, 23 nt, Human
ggccauguccaaagaggcugccc

SEQ ID NO: 1258039 - RNA, 11 nt, Human
ggccaggcugc

SEQ ID NO: 1258040 - RNA, 18 nt, Human
ggccagcugugguuuucu

SEQ ID NO: 1258041 - RNA, 14 nt, Human
ggccaggccucucc

SEQ ID NO: 1258042 - RNA, 14 nt, Human
ggccaggcugcucu

SEQ ID NO: 1258043 - RNA, 15 nt, Human
ggccaggcugcucuu

SEQ ID NO: 1258044 - RNA, 16 nt, Human
ggccaggcugcucuug

SEQ ID NO: 1258045 - RNA, 16 nt, Human
ggagaugaggccagac

SEQ ID NO: 1258046 - RNA, 15 nt, Human
ggagaugaggccaga

SEQ ID NO: 1258047 - RNA, 14 nt, Human
ggagaugaggccag

SEQ ID NO: 1258048 - RNA, 13 nt, Human
ggagauccuccug

SEQ ID NO: 1258049 - RNA, 15 nt, Human
ggagauccuccugca

SEQ ID NO: 1258050 - RNA, 17 nt, Human
ggagaggccccagccgc

SEQ ID NO: 1258051 - RNA, 16 nt, Human
ggagagguugucugug

SEQ ID NO: 1258052 - RNA, 13 nt, Human
ggagagugggggu

SEQ ID NO: 1258053 - RNA, 18 nt, Human
ggagaguuuccugaaaca

SEQ ID NO: 1258054 - RNA, 19 nt, Human
ggagaaucgcuccugcagc

SEQ ID NO: 1258055 - RNA, 18 nt, Human
ggagaagcccgugugaga

SEQ ID NO: 1258056 - RNA, 17 nt, Human
ggagacacuggccccuc

SEQ ID NO: 1258057 - RNA, 20 nt, Human
ggagacacuggccccucaaa

SEQ ID NO: 1258058 - RNA, 14 nt, Human
ggagacagcaucag

SEQ ID NO: 1258059 - RNA, 17 nt, Human
ggagacagcaucagggu

SEQ ID NO: 1258060 - RNA, 18 nt, Human
ggagacagcaucaggguu

SEQ ID NO: 1258061 - RNA, 21 nt, Human
ggacugggagcccccagccug

SEQ ID NO: 1258062 - RNA, 18 nt, Human
ggacugggagcccccagc

SEQ ID NO: 1258063 - RNA, 19 nt, Human
ggacugggagcccccagcc

SEQ ID NO: 1258064 - RNA, 20 nt, Human
ggacugggagcccccagccu

SEQ ID NO: 1258065 - RNA, 18 nt, Human
ggacuggccucugcugau

SEQ ID NO: 1258066 - RNA, 15 nt, Human
ggacgcucucuggcc

SEQ ID NO: 1258067 - RNA, 20 nt, Human
ggacgccugggggugccagg

SEQ ID NO: 1258068 - RNA, 16 nt, Human
ggacugcucaggaaac

SEQ ID NO: 1258069 - RNA, 14 nt, Human
ggacgcucucuggc

SEQ ID NO: 1258070 - RNA, 13 nt, Human
ggacgcucucugg

SEQ ID NO: 1258071 - RNA, 17 nt, Human
ggacugugugcucagga

SEQ ID NO: 1258072 - RNA, 12 nt, Human
ggagaagccagg

SEQ ID NO: 1258073 - RNA, 13 nt, Human
ggagaagccagga

SEQ ID NO: 1258074 - RNA, 15 nt, Human
ggagaagccaggaau

SEQ ID NO: 1258075 - RNA, 19 nt, Human
ggagaaucacuugaacccg

SEQ ID NO: 1258076 - RNA, 15 nt, Human
ggagaaucacuugaa

SEQ ID NO: 1258077 - RNA, 16 nt, Human
ggacauuugcucaugg

SEQ ID NO: 1258078 - RNA, 14 nt, Human
ggacauuucucuaa

SEQ ID NO: 1258079 - RNA, 12 nt, Human
ggaccaaagcaa

SEQ ID NO: 1258080 - RNA, 22 nt, Human
ggaccaaagggagucugccagg

SEQ ID NO: 1258081 - RNA, 16 nt, Human
ggaccaagcaucuugg

SEQ ID NO: 1258082 - RNA, 19 nt, Human
ggacagcaacuaucagacu

SEQ ID NO: 1258083 - RNA, 20 nt, Human
ggacagaugccuccuuccuc

SEQ ID NO: 1258084 - RNA, 22 nt, Human
ggacacuacacccagcaauaga

SEQ ID NO: 1258085 - RNA, 15 nt, Human
ggacagaugccuccu

SEQ ID NO: 1258086 - RNA, 21 nt, Human
ggacagaugccuccuuccucu

SEQ ID NO: 1258087 - RNA, 22 nt, Human
ggaccacccucacuggcucucc

SEQ ID NO: 1258088 - RNA, 15 nt, Human
ggaccacccugagcc

SEQ ID NO: 1258089 - RNA, 16 nt, Human
ggaccacccugagccg

SEQ ID NO: 1258090 - RNA, 18 nt, Human
ggaccacccugagccggc

SEQ ID NO: 1258091 - RNA, 20 nt, Human
ggaccacaacuauuuucaga

SEQ ID NO: 1258092 - RNA, 15 nt, Human
ggaccacaggcucag

SEQ ID NO: 1258093 - RNA, 14 nt, Human
ggaccacaggcuca

SEQ ID NO: 1258094 - RNA, 15 nt, Human
ggaccagaagcuccc

SEQ ID NO: 1258095 - RNA, 18 nt, Human
ggaccagaagcuccccca

SEQ ID NO: 1258096 - RNA, 21 nt, Human
ggaccagaagcucccccagca

SEQ ID NO: 1258097 - RNA, 18 nt, Human
ggaccuucgggcugugcc

SEQ ID NO: 1258098 - RNA, 19 nt, Human
ggaccuucgggcugugccc

SEQ ID NO: 1258099 - RNA, 20 nt, Human
ggaccuucgggcugugcccg

SEQ ID NO: 1258100 - RNA, 17 nt, Human
ggacgcccaggacccca

SEQ ID NO: 1258101 - RNA, 14 nt, Human
ggacgccugggggu

SEQ ID NO: 1258102 - RNA, 19 nt, Human
ggacgccugggggugccag

SEQ ID NO: 1258103 - RNA, 16 nt, Human
ggaaggauucugcugg

SEQ ID NO: 1258104 - RNA, 22 nt, Human
ggaaggaucccaugagcuccuu

SEQ ID NO: 1258105 - RNA, 19 nt, Human
ggaaggauucugcuggccu

SEQ ID NO: 1258106 - RNA, 20 nt, Human
ggaaggauucugcuggccuc

SEQ ID NO: 1258107 - RNA, 22 nt, Human
ggaaggauucugcuggccucug

SEQ ID NO: 1258108 - RNA, 14 nt, Human
ggaaggcagggagg

SEQ ID NO: 1258109 - RNA, 18 nt, Human
ggaaggcaggcagggcuc

SEQ ID NO: 1258110 - RNA, 19 nt, Human
ggaaggcaggcagggcucu

SEQ ID NO: 1258111 - RNA, 21 nt, Human
ggaaggcaggcagggcucucc

SEQ ID NO: 1258112 - RNA, 22 nt, Human
ggaaggcaggcagggcucuccu

SEQ ID NO: 1258113 - RNA, 11 nt, Human
ggaaggcaggc

SEQ ID NO: 1258114 - RNA, 12 nt, Human
ggaaggcaggca

SEQ ID NO: 1258115 - RNA, 14 nt, Human
ggaaggcaggcagg

SEQ ID NO: 1258116 - RNA, 15 nt, Human
ggaaggcaggcaggg

SEQ ID NO: 1258117 - RNA, 16 nt, Human
ggaaggcaggcagggc

SEQ ID NO: 1258118 - RNA, 17 nt, Human
ggaaggcaggcagggcu

SEQ ID NO: 1258119 - RNA, 13 nt, Human
ggaaccugacccc

SEQ ID NO: 1258120 - RNA, 21 nt, Human
ggaaggcagggaggaggcaga

SEQ ID NO: 1258121 - RNA, 17 nt, Human
ggaaggcagggaggagg

SEQ ID NO: 1258122 - RNA, 19 nt, Human
ggaaggcuacuucggggcu

SEQ ID NO: 1258123 - RNA, 20 nt, Human
ggaaggcuacuucggggcug

SEQ ID NO: 1258124 - RNA, 23 nt, Human
ggaaggcuacuucggggcuggga

SEQ ID NO: 1258125 - RNA, 22 nt, Human
ggaaggcuacuucggggcuggg

SEQ ID NO: 1258126 - RNA, 19 nt, Human
ggaaggcuuguugugcuuu

SEQ ID NO: 1258127 - RNA, 21 nt, Human
ggaaggcuuguugugcuuuua

SEQ ID NO: 1258128 - RNA, 17 nt, Human
ggaaggcugagaggaga

SEQ ID NO: 1258129 - RNA, 11 nt, Human
ggaagggagcc

SEQ ID NO: 1258130 - RNA, 13 nt, Human
ggaagggagccaa

SEQ ID NO: 1258131 - RNA, 15 nt, Human
ggaagggagccaagg

SEQ ID NO: 1258132 - RNA, 17 nt, Human
ggaagggagccaaggga

SEQ ID NO: 1258133 - RNA, 21 nt, Human
ggaagggagccaagggaugga

SEQ ID NO: 1258134 - RNA, 18 nt, Human
ggaagugcuaauuuugaa

SEQ ID NO: 1258135 - RNA, 22 nt, Human
ggaaguggcugagucaggacuu

SEQ ID NO: 1258136 - RNA, 18 nt, Human
ggaaguggggcgggcuuc

SEQ ID NO: 1258137 - RNA, 20 nt, Human
ggaagugacgguuuaauggg

SEQ ID NO: 1258138 - RNA, 19 nt, Human
ggaaguaguuaucauguua

SEQ ID NO: 1258139 - RNA, 13 nt, Human
ggaagucaaagca

SEQ ID NO: 1258140 - RNA, 16 nt, Human
ggaaguaguuaucaug

SEQ ID NO: 1258141 - RNA, 13 nt, Human
ggaaguaguuauc

SEQ ID NO: 1258142 - RNA, 15 nt, Human
ggaaguccaaugugg

SEQ ID NO: 1258143 - RNA, 16 nt, Human
ggaaguccaauguggc

SEQ ID NO: 1258144 - RNA, 17 nt, Human
ggaaguccaauguggca

SEQ ID NO: 1258145 - RNA, 16 nt, Human
ggaaguccggccccag

SEQ ID NO: 1258146 - RNA, 21 nt, Human
ggaagucguccuuacuccugu

SEQ ID NO: 1258147 - RNA, 22 nt, Human
ggaagucguccuuacuccugug

SEQ ID NO: 1258148 - RNA, 23 nt, Human
ggaagucguccuuacuccugugg

SEQ ID NO: 1258149 - RNA, 20 nt, Human
ggaagugaagacuggaagcu

SEQ ID NO: 1258150 - RNA, 14 nt, Human
ggaaguagaaacaa

SEQ ID NO: 1258151 - RNA, 16 nt, Human
ggaaguaggaaguaaa

SEQ ID NO: 1258152 - RNA, 19 nt, Human
ggaagguacuguaugauca

SEQ ID NO: 1258153 - RNA, 15 nt, Human
ggaaggguaaacaau

SEQ ID NO: 1258154 - RNA, 14 nt, Human
ggaaggguaaacaa

SEQ ID NO: 1258155 - RNA, 15 nt, Human
ggaaggggccagagg

SEQ ID NO: 1258156 - RNA, 17 nt, Human
ggaaggggccagaggcu

SEQ ID NO: 1258157 - RNA, 14 nt, Human
ggaaggggacccuc

SEQ ID NO: 1258158 - RNA, 16 nt, Human
ggaauuggagcucgug

SEQ ID NO: 1258159 - RNA, 22 nt, Human
ggaauuggagcucgugggacag

SEQ ID NO: 1258160 - RNA, 12 nt, Human
ggaauuguguuu

SEQ ID NO: 1258161 - RNA, 14 nt, Human
ggaauuucccagga

SEQ ID NO: 1258162 - RNA, 15 nt, Human
ggaauuucccaggac

SEQ ID NO: 1258163 - RNA, 16 nt, Human
ggaauuucccaggacc

SEQ ID NO: 1258164 - RNA, 17 nt, Human
ggaauuucccaggaccc

SEQ ID NO: 1258165 - RNA, 18 nt, Human
ggaauuucccaggacccu

SEQ ID NO: 1258166 - RNA, 19 nt, Human
ggaauuucccaggacccug

SEQ ID NO: 1258167 - RNA, 18 nt, Human
ggaauuucuuaacuucuu

SEQ ID NO: 1258168 - RNA, 22 nt, Human
ggaauuucuuaacuucuugcuu

SEQ ID NO: 1258169 - RNA, 16 nt, Human
ggaauuugccugcugg

SEQ ID NO: 1258170 - RNA, 21 nt, Human
ggacacuacacccagcaauag

SEQ ID NO: 1258171 - RNA, 20 nt, Human
ggacacuacacccagcaaua

SEQ ID NO: 1258172 - RNA, 19 nt, Human
ggacacuacacccagcaau

SEQ ID NO: 1258173 - RNA, 18 nt, Human
ggacacuacacccagcaa

SEQ ID NO: 1258174 - RNA, 17 nt, Human
ggacacuacacccagca

SEQ ID NO: 1258175 - RNA, 16 nt, Human
ggacacuacacccagc

SEQ ID NO: 1258176 - RNA, 15 nt, Human
ggacacuacacccag

SEQ ID NO: 1258177 - RNA, 14 nt, Human
ggacaaaggagccu

SEQ ID NO: 1258178 - RNA, 15 nt, Human
ggacaaaggagccug

SEQ ID NO: 1258179 - RNA, 16 nt, Human
ggacaaaggagccugu

SEQ ID NO: 1258180 - RNA, 17 nt, Human
ggacaaaggagccugug

SEQ ID NO: 1258181 - RNA, 18 nt, Human
ggacaaaggagccuguga

SEQ ID NO: 1258182 - RNA, 21 nt, Human
ggacaaaucacauauuuuaaa

SEQ ID NO: 1258183 - RNA, 18 nt, Human
ggacaaaucacauauuuu

SEQ ID NO: 1258184 - RNA, 19 nt, Human
ggaauuuucaucuaggauu

SEQ ID NO: 1258185 - RNA, 20 nt, Human
ggacaaaaccccccagauau

SEQ ID NO: 1258186 - RNA, 16 nt, Human
ggacaaaauggaauac

SEQ ID NO: 1258187 - RNA, 17 nt, Human
ggacaaaauggaauacu

SEQ ID NO: 1258188 - RNA, 11 nt, Human
ggacaaacugc

SEQ ID NO: 1258189 - RNA, 11 nt, Human
ggacaaaauga

SEQ ID NO: 1258190 - RNA, 14 nt, Human
ggacaaagaaccuu

SEQ ID NO: 1258191 - RNA, 13 nt, Human
ggacaaagaaccu

SEQ ID NO: 1258192 - RNA, 13 nt, Human
ggacaaaggagcc

SEQ ID NO: 1258193 - RNA, 15 nt, Human
ggaauugauuugcau

SEQ ID NO: 1258194 - RNA, 17 nt, Human
ggaauugauuugcauug

SEQ ID NO: 1258195 - RNA, 18 nt, Human
ggaauugauuugcauuga

SEQ ID NO: 1258196 - RNA, 19 nt, Human
ggaauugauuugcauugaa

SEQ ID NO: 1258197 - RNA, 19 nt, Human
ggaauuacgugcucugugg

SEQ ID NO: 1258198 - RNA, 21 nt, Human
ggaauggaggggcagagccag

SEQ ID NO: 1258199 - RNA, 19 nt, Human
ggaauggauuuuucuuuaa

SEQ ID NO: 1258200 - RNA, 17 nt, Human
ggaauggaggggcagag

SEQ ID NO: 1258201 - RNA, 16 nt, Human
ggaauggaggggcaga

SEQ ID NO: 1258202 - RNA, 14 nt, Human
ggaauggaggggca

SEQ ID NO: 1258203 - RNA, 20 nt, Human
ggaauggauuuuucuuuaac

SEQ ID NO: 1258204 - RNA, 22 nt, Human
ggaauggauuuuucuuuaacug

SEQ ID NO: 1258205 - RNA, 12 nt, Human
ggaauggcagca

SEQ ID NO: 1258206 - RNA, 14 nt, Human
ggaauggcagcagg

SEQ ID NO: 1258207 - RNA, 16 nt, Human
ggaauggcagcagggg

SEQ ID NO: 1258208 - RNA, 19 nt, Human
ggaaugcccuucacuguca

SEQ ID NO: 1258209 - RNA, 15 nt, Human
gcuuucagaauaugu

SEQ ID NO: 1258210 - RNA, 13 nt, Human
gcuuucagagccu

SEQ ID NO: 1258211 - RNA, 13 nt, Human
gcuuucagggagg

SEQ ID NO: 1258212 - RNA, 15 nt, Human
gcuuuguaugcacuu

SEQ ID NO: 1258213 - RNA, 14 nt, Human
gcuuuguggcacug

SEQ ID NO: 1258214 - RNA, 18 nt, Human
gcuuugucuacuucaaaa

SEQ ID NO: 1258215 - RNA, 22 nt, Human
gcuuuguggcacuggggcaggg

SEQ ID NO: 1258216 - RNA, 18 nt, Human
gcuucugcccccugcaga

SEQ ID NO: 1258217 - RNA, 12 nt, Human
gcuuuagaaaca

SEQ ID NO: 1258218 - RNA, 20 nt, Human
gcuuuagaaacagugcaaca

SEQ ID NO: 1258219 - RNA, 21 nt, Human
gcuuuagaaucccagcccccu

SEQ ID NO: 1258220 - RNA, 16 nt, Human
gcuuuagaaucccagc

SEQ ID NO: 1258221 - RNA, 15 nt, Human
ggaaaacauuccauc

SEQ ID NO: 1258222 - RNA, 15 nt, Human
ggaaaacagaacacu

SEQ ID NO: 1258223 - RNA, 21 nt, Human
ggaaaaccaagccguggcuuc

SEQ ID NO: 1258224 - RNA, 10 nt, Human
ggaaaagcuu

SEQ ID NO: 1258225 - RNA, 12 nt, Human
ggaaaaggccug

SEQ ID NO: 1258226 - RNA, 13 nt, Human
ggaaaaggccugg

SEQ ID NO: 1258227 - RNA, 14 nt, Human
ggaaaaggccuggg

SEQ ID NO: 1258228 - RNA, 16 nt, Human
ggaaaaggccuggggu

SEQ ID NO: 1258229 - RNA, 22 nt, Human
ggaaaaggccuggggugacccg

SEQ ID NO: 1258230 - RNA, 17 nt, Human
ggaaaaggccuggggug

SEQ ID NO: 1258231 - RNA, 16 nt, Human
gcuuuucccaaaagcc

SEQ ID NO: 1258232 - RNA, 18 nt, Human
gcuuuucaugcaaacucu

SEQ ID NO: 1258233 - RNA, 22 nt, Human
gcuuuucacugcuggcugccuu

SEQ ID NO: 1258234 - RNA, 23 nt, Human
gcuuuucacugcuggcugccuua

SEQ ID NO: 1258235 - RNA, 15 nt, Human
ggaaaaauguaggag

SEQ ID NO: 1258236 - RNA, 14 nt, Human
gcuuuguuuugcac

SEQ ID NO: 1258237 - RNA, 13 nt, Human
gcuuuucacugcu

SEQ ID NO: 1258238 - RNA, 23 nt, Human
gcuuuguuuugcacacuuugcca

SEQ ID NO: 1258239 - RNA, 14 nt, Human
gcuuuucacugcug

SEQ ID NO: 1258240 - RNA, 18 nt, Human
gcuuuucacugcuggcug

SEQ ID NO: 1258241 - RNA, 18 nt, Human
ggaacauaaaaaggacau

SEQ ID NO: 1258242 - RNA, 17 nt, Human
ggaacauggggaggagg

SEQ ID NO: 1258243 - RNA, 13 nt, Human
ggaacauaaaaag

SEQ ID NO: 1258244 - RNA, 18 nt, Human
ggaacagugugcaaggca

SEQ ID NO: 1258245 - RNA, 19 nt, Human
ggaacagugugcaaggcag

SEQ ID NO: 1258246 - RNA, 13 nt, Human
ggaacauggggag

SEQ ID NO: 1258247 - RNA, 14 nt, Human
ggaacauggggagg

SEQ ID NO: 1258248 - RNA, 11 nt, Human
ggaaccagacu

SEQ ID NO: 1258249 - RNA, 12 nt, Human
ggaaccagacuc

SEQ ID NO: 1258250 - RNA, 19 nt, Human
ggaaccagacucuugccug

SEQ ID NO: 1258251 - RNA, 13 nt, Human
ggaaccagacucu

SEQ ID NO: 1258252 - RNA, 11 nt, Human
ggaacccagac

SEQ ID NO: 1258253 - RNA, 13 nt, Human
ggaacccagacuc

SEQ ID NO: 1258254 - RNA, 14 nt, Human
ggaacccagacuca

SEQ ID NO: 1258255 - RNA, 15 nt, Human
ggaacccagacucag

SEQ ID NO: 1258256 - RNA, 21 nt, Human
ggaaccccggggugcccacag

SEQ ID NO: 1258257 - RNA, 16 nt, Human
ggaaaucaacuugcuu

SEQ ID NO: 1258258 - RNA, 19 nt, Human
ggaaauacaguucugcucu

SEQ ID NO: 1258259 - RNA, 18 nt, Human
ggaaauacaguucugcuc

SEQ ID NO: 1258260 - RNA, 18 nt, Human
ggaaauacuguaugguuu

SEQ ID NO: 1258261 - RNA, 16 nt, Human
ggaaauauauauuaua

SEQ ID NO: 1258262 - RNA, 23 nt, Human
ggaaauauauauuauacuuguaa

SEQ ID NO: 1258263 - RNA, 12 nt, Human
ggaaaauuauuu

SEQ ID NO: 1258264 - RNA, 14 nt, Human
ggaaaauucauuuu

SEQ ID NO: 1258265 - RNA, 15 nt, Human
ggaaaauucauuuuu

SEQ ID NO: 1258266 - RNA, 20 nt, Human
ggaaagggcccuccuuccua

SEQ ID NO: 1258267 - RNA, 21 nt, Human
ggaaagggcccuccuuccuaa

SEQ ID NO: 1258268 - RNA, 22 nt, Human
ggaaagggcccuccuuccuaaa

SEQ ID NO: 1258269 - RNA, 21 nt, Human
gcuguucaugaaagauucaau

SEQ ID NO: 1258270 - RNA, 12 nt, Human
gcuguucaugaa

SEQ ID NO: 1258271 - RNA, 20 nt, Human
gcugugggcgugagaccugc

SEQ ID NO: 1258272 - RNA, 21 nt, Human
gcugugggcgugagaccugcc

SEQ ID NO: 1258273 - RNA, 22 nt, Human
gcugugggcgugagaccugccc

SEQ ID NO: 1258274 - RNA, 23 nt, Human
gcuguggugugucccccucuguc

SEQ ID NO: 1258275 - RNA, 19 nt, Human
gcuguggugagggaagacg

SEQ ID NO: 1258276 - RNA, 20 nt, Human
gcugucuacacuaagagaga

SEQ ID NO: 1258277 - RNA, 14 nt, Human
gcuguccuuucuag

SEQ ID NO: 1258278 - RNA, 14 nt, Human
gcuguccuuuuucc

SEQ ID NO: 1258279 - RNA, 19 nt, Human
gcuguccuuuuuccucucc

SEQ ID NO: 1258280 - RNA, 15 nt, Human
gcuguccuggagggg

SEQ ID NO: 1258281 - RNA, 16 nt, Human
gcuguccuggaggggc

SEQ ID NO: 1258282 - RNA, 23 nt, Human
gcuguccuggaggggcuggggac

SEQ ID NO: 1258283 - RNA, 12 nt, Human
gcuuaguuugug

SEQ ID NO: 1258284 - RNA, 14 nt, Human
gcuuaguuugugug

SEQ ID NO: 1258285 - RNA, 16 nt, Human
gcuuaguuuguguguu

SEQ ID NO: 1258286 - RNA, 16 nt, Human
gcuuagaguuggccau

SEQ ID NO: 1258287 - RNA, 15 nt, Human
gcuuagauuucauag

SEQ ID NO: 1258288 - RNA, 13 nt, Human
gcuuagauuucau

SEQ ID NO: 1258289 - RNA, 19 nt, Human
gcuuagcaguccccuuccc

SEQ ID NO: 1258290 - RNA, 23 nt, Human
gcuuagcuuuagaaacagugcaa

SEQ ID NO: 1258291 - RNA, 20 nt, Human
gcuuagcucaauuagugugg

SEQ ID NO: 1258292 - RNA, 17 nt, Human
gcuuauaauaaaggacu

SEQ ID NO: 1258293 - RNA, 16 nt, Human
gcuuauaauucuuuca

SEQ ID NO: 1258294 - RNA, 15 nt, Human
gcuuaugaaaagaau

SEQ ID NO: 1258295 - RNA, 18 nt, Human
gcuuaugacaucacuugu

SEQ ID NO: 1258296 - RNA, 22 nt, Human
gcuuaugacaucacuuguacaa

SEQ ID NO: 1258297 - RNA, 23 nt, Human
gcuuaugacaucacuuguacaaa

SEQ ID NO: 1258298 - RNA, 18 nt, Human
gcuuaugcuuaaauucaa

SEQ ID NO: 1258299 - RNA, 23 nt, Human
gcuuaugauagcaaauggccuca

SEQ ID NO: 1258300 - RNA, 16 nt, Human
gcuuaugguaccagau

SEQ ID NO: 1258301 - RNA, 20 nt, Human
gcuuaguuuguguguugucu

SEQ ID NO: 1258302 - RNA, 21 nt, Human
gcuuaguuuguguguugucuc

SEQ ID NO: 1258303 - RNA, 14 nt, Human
gcuucauagagacu

SEQ ID NO: 1258304 - RNA, 17 nt, Human
gcuucauagagacuugg

SEQ ID NO: 1258305 - RNA, 15 nt, Human
gcuuaugcucuuaau

SEQ ID NO: 1258306 - RNA, 15 nt, Human
gcuuaugguaccaga

SEQ ID NO: 1258307 - RNA, 19 nt, Human
gcuucugcccccugcagaa

SEQ ID NO: 1258308 - RNA, 16 nt, Human
gcuucugcccccugca

SEQ ID NO: 1258309 - RNA, 17 nt, Human
gcuucugcccccugcag

SEQ ID NO: 1258310 - RNA, 22 nt, Human
gcuucugagcagcgagccugcu

SEQ ID NO: 1258311 - RNA, 15 nt, Human
gcuucucccaggcaa

SEQ ID NO: 1258312 - RNA, 16 nt, Human
gcuucucccaggcaag

SEQ ID NO: 1258313 - RNA, 17 nt, Human
gcuucucccaggcaagg

SEQ ID NO: 1258314 - RNA, 18 nt, Human
gcuucucccaggcaaggc

SEQ ID NO: 1258315 - RNA, 23 nt, Human
gcuucucccaggcaaggcugugg

SEQ ID NO: 1258316 - RNA, 20 nt, Human
gcuucucccaggcaaggcug

SEQ ID NO: 1258317 - RNA, 22 nt, Human
gcuucucccaggcaaggcugug

SEQ ID NO: 1258318 - RNA, 18 nt, Human
gcuucugagcagcgagcc

SEQ ID NO: 1258319 - RNA, 21 nt, Human
gcuucugagcagcgagccugc

SEQ ID NO: 1258320 - RNA, 23 nt, Human
gcuucugagcagcgagccugcua

SEQ ID NO: 1258321 - RNA, 22 nt, Human
gcuucucauccugcaggcagcu

SEQ ID NO: 1258322 - RNA, 11 nt, Human
gcuucucccag

SEQ ID NO: 1258323 - RNA, 13 nt, Human
gcuucucccaggc

SEQ ID NO: 1258324 - RNA, 14 nt, Human
gcuucucccaggca

SEQ ID NO: 1258325 - RNA, 14 nt, Human
gcuccaagaauuuc

SEQ ID NO: 1258326 - RNA, 15 nt, Human
gcuccaaccugcaaa

SEQ ID NO: 1258327 - RNA, 18 nt, Human
gcuccaaccugcaaagau

SEQ ID NO: 1258328 - RNA, 21 nt, Human
gcuccaaccugcaaagaucug

SEQ ID NO: 1258329 - RNA, 16 nt, Human
gcuccaaaugcagcuu

SEQ ID NO: 1258330 - RNA, 17 nt, Human
gcuccaaagucauaauu

SEQ ID NO: 1258331 - RNA, 19 nt, Human
gcuccaaagucauaauugc

SEQ ID NO: 1258332 - RNA, 20 nt, Human
gcuccaaagucauaauugca

SEQ ID NO: 1258333 - RNA, 14 nt, Human
gcuccaagauucua

SEQ ID NO: 1258334 - RNA, 15 nt, Human
gcuccaagauucuag

SEQ ID NO: 1258335 - RNA, 16 nt, Human
gcuccaagauucuaga

SEQ ID NO: 1258336 - RNA, 17 nt, Human
gcuccaagauucuagau

SEQ ID NO: 1258337 - RNA, 16 nt, Human
gcuccaagccccaucu

SEQ ID NO: 1258338 - RNA, 19 nt, Human
gcuccaagccccaucuucu

SEQ ID NO: 1258339 - RNA, 20 nt, Human
gcuccaaggggaaucagaac

SEQ ID NO: 1258340 - RNA, 21 nt, Human
gcuccaaggggaaucagaacu

SEQ ID NO: 1258341 - RNA, 23 nt, Human
gcuccaaggggaaucagaacuca

SEQ ID NO: 1258342 - RNA, 18 nt, Human
gcuccaagauucuagaug

SEQ ID NO: 1258343 - RNA, 17 nt, Human
gcuccagcuggccggga

SEQ ID NO: 1258344 - RNA, 23 nt, Human
gcuccagcuggccgggagccuga

SEQ ID NO: 1258345 - RNA, 12 nt, Human
gcuccagcugcc

SEQ ID NO: 1258346 - RNA, 13 nt, Human
gcuccagcugccc

SEQ ID NO: 1258347 - RNA, 21 nt, Human
gcuccagcugccccggccccu

SEQ ID NO: 1258348 - RNA, 20 nt, Human
gcuccauuuuuagugaaaua

SEQ ID NO: 1258349 - RNA, 19 nt, Human
gcuccauuuaaacagaugu

SEQ ID NO: 1258350 - RNA, 10 nt, Human
gcucccucag

SEQ ID NO: 1258351 - RNA, 11 nt, Human
gcucccucaga

SEQ ID NO: 1258352 - RNA, 22 nt, Human
gcucccucagacuggggcaaug

SEQ ID NO: 1258353 - RNA, 12 nt, Human
gcucccucagac

SEQ ID NO: 1258354 - RNA, 16 nt, Human
gcucccuccgccccca

SEQ ID NO: 1258355 - RNA, 18 nt, Human
gcucccuccgcccccagg

SEQ ID NO: 1258356 - RNA, 19 nt, Human
gcucccuccgcccccaggu

SEQ ID NO: 1258357 - RNA, 16 nt, Human
gcucccugacugggag

SEQ ID NO: 1258358 - RNA, 18 nt, Human
gcucccugacugggaguu

SEQ ID NO: 1258359 - RNA, 16 nt, Human
gcuccagcugccccgg

SEQ ID NO: 1258360 - RNA, 22 nt, Human
gcuccaguguccugagcucagc

SEQ ID NO: 1258361 - RNA, 23 nt, Human
gcuccaguguccugagcucagcg

SEQ ID NO: 1258362 - RNA, 23 nt, Human
gcuccauuuaaacagauguccau

SEQ ID NO: 1258363 - RNA, 16 nt, Human
gcuccauuuaaacaga

SEQ ID NO: 1258364 - RNA, 14 nt, Human
gcuccaucuccacu

SEQ ID NO: 1258365 - RNA, 21 nt, Human
gcuccauccgugccucuuuuu

SEQ ID NO: 1258366 - RNA, 16 nt, Human
gcucaguaauuugagg

SEQ ID NO: 1258367 - RNA, 21 nt, Human
gcucaguaauuugaggacaac

SEQ ID NO: 1258368 - RNA, 17 nt, Human
gcucagugaaguugcug

SEQ ID NO: 1258369 - RNA, 20 nt, Human
gcucagugaaguugcugcuu

SEQ ID NO: 1258370 - RNA, 19 nt, Human
gcucagugaaguugcugcu

SEQ ID NO: 1258371 - RNA, 17 nt, Human
gcucaguggggcagagg

SEQ ID NO: 1258372 - RNA, 19 nt, Human
gcucauauggggcugggag

SEQ ID NO: 1258373 - RNA, 19 nt, Human
gcucagauagaaugacagu

SEQ ID NO: 1258374 - RNA, 15 nt, Human
gcucagauagaauga

SEQ ID NO: 1258375 - RNA, 17 nt, Human
gcucagcacugccugcu

SEQ ID NO: 1258376 - RNA, 18 nt, Human
gcucagcacugccugcuc

SEQ ID NO: 1258377 - RNA, 19 nt, Human
gcucagcacugccugcucc

SEQ ID NO: 1258378 - RNA, 20 nt, Human
gcucagcacugccugcuccc

SEQ ID NO: 1258379 - RNA, 22 nt, Human
gcucagcacugccugcucccau

SEQ ID NO: 1258380 - RNA, 12 nt, Human
gcucagccagca

SEQ ID NO: 1258381 - RNA, 13 nt, Human
gcucagccagcac

SEQ ID NO: 1258382 - RNA, 14 nt, Human
gcucagccagcacu

SEQ ID NO: 1258383 - RNA, 15 nt, Human
gcucagccagcacuu

SEQ ID NO: 1258384 - RNA, 22 nt, Human
gcucacccccuucuccauccac

SEQ ID NO: 1258385 - RNA, 21 nt, Human
gcucagaggguguccugcacc

SEQ ID NO: 1258386 - RNA, 18 nt, Human
gcucacccccuucuccau

SEQ ID NO: 1258387 - RNA, 20 nt, Human
gcucacccccuucuccaucc

SEQ ID NO: 1258388 - RNA, 19 nt, Human
gcucacccagugcccucuc

SEQ ID NO: 1258389 - RNA, 13 nt, Human
gcucacccagugc

SEQ ID NO: 1258390 - RNA, 16 nt, Human
gcucacccccuucucc

SEQ ID NO: 1258391 - RNA, 20 nt, Human
gcuaagcucacguccugaga

SEQ ID NO: 1258392 - RNA, 22 nt, Human
gcuaagcucacguccugagaaa

SEQ ID NO: 1258393 - RNA, 15 nt, Human
gcuaagcuaggaaug

SEQ ID NO: 1258394 - RNA, 19 nt, Human
gcuaagcuaggaaugaaau

SEQ ID NO: 1258395 - RNA, 14 nt, Human
gcuaagcauuccaa

SEQ ID NO: 1258396 - RNA, 22 nt, Human
gcuaacaugaagaccuuuuucu

SEQ ID NO: 1258397 - RNA, 13 nt, Human
gcuaacaugaaga

SEQ ID NO: 1258398 - RNA, 22 nt, Human
gcuaacagggaaggcaggcagg

SEQ ID NO: 1258399 - RNA, 17 nt, Human
gcuaagcaaaaugugau

SEQ ID NO: 1258400 - RNA, 14 nt, Human
gcuacguauuuaau

SEQ ID NO: 1258401 - RNA, 20 nt, Human
gcuacuaugauuuaauuuga

SEQ ID NO: 1258402 - RNA, 22 nt, Human
gcuacuaugauuuaauuugaaa

SEQ ID NO: 1258403 - RNA, 14 nt, Human
gcuagcaguggcag

SEQ ID NO: 1258404 - RNA, 16 nt, Human
gcuagcaguggcaggc

SEQ ID NO: 1258405 - RNA, 18 nt, Human
gcuagcaguggcaggcag

SEQ ID NO: 1258406 - RNA, 20 nt, Human
gcuagcaguggcaggcagag

SEQ ID NO: 1258407 - RNA, 12 nt, Human
gcuaucucccug

SEQ ID NO: 1258408 - RNA, 13 nt, Human
gcuaucucugugu

SEQ ID NO: 1258409 - RNA, 16 nt, Human
gcuaucucugugugca

SEQ ID NO: 1258410 - RNA, 20 nt, Human
gcuaucucugugugcacaaa

SEQ ID NO: 1258411 - RNA, 23 nt, Human
gccugugagcuaggaauuguguu

SEQ ID NO: 1258412 - RNA, 17 nt, Human
gccugugaacugaacuc

SEQ ID NO: 1258413 - RNA, 15 nt, Human
gccugucagauccag

SEQ ID NO: 1258414 - RNA, 19 nt, Human
gccugugaacccaggacaa

SEQ ID NO: 1258415 - RNA, 21 nt, Human
gccugugaacccaggacaagc

SEQ ID NO: 1258416 - RNA, 23 nt, Human
gccugugacauacccccuccccc

SEQ ID NO: 1258417 - RNA, 21 nt, Human
gccugugacauacccccuccc

SEQ ID NO: 1258418 - RNA, 15 nt, Human
gccugugcaaugcau

SEQ ID NO: 1258419 - RNA, 10 nt, Human
gccugugcca

SEQ ID NO: 1258420 - RNA, 13 nt, Human
gccugugccaggu

SEQ ID NO: 1258421 - RNA, 14 nt, Human
gccugugccaggug

SEQ ID NO: 1258422 - RNA, 14 nt, Human
gcguaggcuacaga

SEQ ID NO: 1258423 - RNA, 16 nt, Human
gcguaggcuacagaga

SEQ ID NO: 1258424 - RNA, 17 nt, Human
gcguaggcuacagagaa

SEQ ID NO: 1258425 - RNA, 18 nt, Human
gcguaggcuacagagaag

SEQ ID NO: 1258426 - RNA, 19 nt, Human
gcguaggcuacagagaagc

SEQ ID NO: 1258427 - RNA, 20 nt, Human
gcguaggcuacagagaagcc

SEQ ID NO: 1258428 - RNA, 19 nt, Human
gcguauuauaccaaaaugu

SEQ ID NO: 1258429 - RNA, 12 nt, Human
gcgucuuccuga

SEQ ID NO: 1258430 - RNA, 15 nt, Human
gcgugagaccugccc

SEQ ID NO: 1258431 - RNA, 13 nt, Human
gcgucuuccugag

SEQ ID NO: 1258432 - RNA, 14 nt, Human
gcgucuuccugagu

SEQ ID NO: 1258433 - RNA, 21 nt, Human
gcgucuuccugaguggugcca

SEQ ID NO: 1258434 - RNA, 13 nt, Human
gcgugacaauaaa

SEQ ID NO: 1258435 - RNA, 14 nt, Human
gcgugagcugagca

SEQ ID NO: 1258436 - RNA, 23 nt, Human
gcgugagcuuaaaauacaagacu

SEQ ID NO: 1258437 - RNA, 12 nt, Human
gcgugagcuuaa

SEQ ID NO: 1258438 - RNA, 19 nt, Human
gcuaaauaaaauuuguugc

SEQ ID NO: 1258439 - RNA, 20 nt, Human
gcuaaauaaaauuuguugca

SEQ ID NO: 1258440 - RNA, 21 nt, Human
gcuaaauaaaauuuguugcau

SEQ ID NO: 1258441 - RNA, 19 nt, Human
gcuaaauccuuuacuguua

SEQ ID NO: 1258442 - RNA, 15 nt, Human
gcuaacagggaaggc

SEQ ID NO: 1258443 - RNA, 16 nt, Human
gcuaacagggaaggca

SEQ ID NO: 1258444 - RNA, 18 nt, Human
gcuaacagggaaggcagg

SEQ ID NO: 1258445 - RNA, 20 nt, Human
gcuaacagggaaggcaggca

SEQ ID NO: 1258446 - RNA, 17 nt, Human
gcugauggagaaggaag

SEQ ID NO: 1258447 - RNA, 16 nt, Human
gcugauggagaaggaa

SEQ ID NO: 1258448 - RNA, 13 nt, Human
gcugaguuuccua

SEQ ID NO: 1258449 - RNA, 15 nt, Human
gcugaguuuccuaug

SEQ ID NO: 1258450 - RNA, 17 nt, Human
gcugaguggcaggggac

SEQ ID NO: 1258451 - RNA, 19 nt, Human
gcugaguggcaggggacag

SEQ ID NO: 1258452 - RNA, 21 nt, Human
gcugaguggcaggggacagga

SEQ ID NO: 1258453 - RNA, 11 nt, Human
gcugaguuucc

SEQ ID NO: 1258454 - RNA, 12 nt, Human
gcugaguuuccu

SEQ ID NO: 1258455 - RNA, 14 nt, Human
gcugacuguagcuu

SEQ ID NO: 1258456 - RNA, 21 nt, Human
gcugacuguacuccucccagg

SEQ ID NO: 1258457 - RNA, 17 nt, Human
gcugagucccaggcuga

SEQ ID NO: 1258458 - RNA, 21 nt, Human
gcugagucccaggcugagccu

SEQ ID NO: 1258459 - RNA, 22 nt, Human
gcugagucccaggcugagccuc

SEQ ID NO: 1258460 - RNA, 17 nt, Human
gcugauggagccuuccc

SEQ ID NO: 1258461 - RNA, 20 nt, Human
gcugauguagcaugcuuguu

SEQ ID NO: 1258462 - RNA, 17 nt, Human
gcugaugucaauuucug

SEQ ID NO: 1258463 - RNA, 20 nt, Human
gcugaugucaauuucugugu

SEQ ID NO: 1258464 - RNA, 23 nt, Human
gcugaugucaauuucuguguugc

SEQ ID NO: 1258465 - RNA, 21 nt, Human
gcugcaguuuugcuaucuggg

SEQ ID NO: 1258466 - RNA, 17 nt, Human
gcugcaguuuugcuauc

SEQ ID NO: 1258467 - RNA, 17 nt, Human
gcugcauggcagggggc

SEQ ID NO: 1258468 - RNA, 22 nt, Human
gcugcauggcagggggcugcug

SEQ ID NO: 1258469 - RNA, 19 nt, Human
gcugcauugaaaagagcug

SEQ ID NO: 1258470 - RNA, 20 nt, Human
gcugcauugaaaagagcuga

SEQ ID NO: 1258471 - RNA, 17 nt, Human
gcucuugaugccuggcg

SEQ ID NO: 1258472 - RNA, 22 nt, Human
gcucuugauaccccccucuguc

SEQ ID NO: 1258473 - RNA, 23 nt, Human
gcucuugauaccccccucugucu

SEQ ID NO: 1258474 - RNA, 21 nt, Human
gcucuuguugagccgugggca

SEQ ID NO: 1258475 - RNA, 17 nt, Human
gcugacagacagcccuc

SEQ ID NO: 1258476 - RNA, 16 nt, Human
gcucuuucucugccag

SEQ ID NO: 1258477 - RNA, 14 nt, Human
gcucuuucucugcc

SEQ ID NO: 1258478 - RNA, 15 nt, Human
gcucuuucucugcca

SEQ ID NO: 1258479 - RNA, 17 nt, Human
gcucuuucucugccagu

SEQ ID NO: 1258480 - RNA, 18 nt, Human
gcugacuguacuccuccc

SEQ ID NO: 1258481 - RNA, 19 nt, Human
gcugacuguacuccuccca

SEQ ID NO: 1258482 - RNA, 17 nt, Human
gcugacucacaccugaa

SEQ ID NO: 1258483 - RNA, 21 nt, Human
gcugaccaugcucaucugcug

SEQ ID NO: 1258484 - RNA, 22 nt, Human
gcugaccaugcucaucugcugg

SEQ ID NO: 1258485 - RNA, 16 nt, Human
gcucuugaugccuggc

SEQ ID NO: 1258486 - RNA, 15 nt, Human
gcucuugaugccugg

SEQ ID NO: 1258487 - RNA, 14 nt, Human
gcucuugaugccug

SEQ ID NO: 1258488 - RNA, 23 nt, Human
gcucuucuccuuucacaaccuuc

SEQ ID NO: 1258489 - RNA, 13 nt, Human
gcucuucuccuuu

SEQ ID NO: 1258490 - RNA, 17 nt, Human
gcucuucuccuuucaca

SEQ ID NO: 1258491 - RNA, 21 nt, Human
gcucuucuccuuucacaaccu

SEQ ID NO: 1258492 - RNA, 20 nt, Human
gcucuggacagccccacccu

SEQ ID NO: 1258493 - RNA, 22 nt, Human
gcucuggacagccccacccugg

SEQ ID NO: 1258494 - RNA, 15 nt, Human
gcucuuccuuacucc

SEQ ID NO: 1258495 - RNA, 17 nt, Human
gcucuccuccaccucaa

SEQ ID NO: 1258496 - RNA, 13 nt, Human
gcucuccucuucu

SEQ ID NO: 1258497 - RNA, 15 nt, Human
gcucuccucuucuac

SEQ ID NO: 1258498 - RNA, 15 nt, Human
gcucuccucuugcca

SEQ ID NO: 1258499 - RNA, 19 nt, Human
gcucuccucuugccacugc

SEQ ID NO: 1258500 - RNA, 22 nt, Human
gcucuccucuugccacugccuc

SEQ ID NO: 1258501 - RNA, 20 nt, Human
gcucuccauucugcuccuuc

SEQ ID NO: 1258502 - RNA, 13 nt, Human
gcucucuggccuu

SEQ ID NO: 1258503 - RNA, 12 nt, Human
gcucucuggccu

SEQ ID NO: 1258504 - RNA, 11 nt, Human
gcucucuggcc

SEQ ID NO: 1258505 - RNA, 23 nt, Human
gcucuccucuucuacucacuuuu

SEQ ID NO: 1258506 - RNA, 14 nt, Human
gcucuccuggcccu

SEQ ID NO: 1258507 - RNA, 12 nt, Human
gcucuccuggcu

SEQ ID NO: 1258508 - RNA, 13 nt, Human
gcucuccuggcuu

SEQ ID NO: 1258509 - RNA, 14 nt, Human
gcucuccuggcuuc

SEQ ID NO: 1258510 - RNA, 15 nt, Human
gcucuccuggcuucc

SEQ ID NO: 1258511 - RNA, 17 nt, Human
gcucuccuggcuuccca

SEQ ID NO: 1258512 - RNA, 23 nt, Human
gcucuccuggcuucccaucccca

SEQ ID NO: 1258513 - RNA, 19 nt, Human
gcucucgcacaccucugca

SEQ ID NO: 1258514 - RNA, 19 nt, Human
gcucucggguugugugucu

SEQ ID NO: 1258515 - RNA, 19 nt, Human
gcucucucauugucugugu

SEQ ID NO: 1258516 - RNA, 20 nt, Human
gcucucuccaggcaggucug

SEQ ID NO: 1258517 - RNA, 21 nt, Human
gcucccuguaaccucuucaga

SEQ ID NO: 1258518 - RNA, 16 nt, Human
gcucccugugccccca

SEQ ID NO: 1258519 - RNA, 12 nt, Human
gcucccuggggg

SEQ ID NO: 1258520 - RNA, 15 nt, Human
gcucgaaucucugug

SEQ ID NO: 1258521 - RNA, 16 nt, Human
gcucgaaucucugugc

SEQ ID NO: 1258522 - RNA, 19 nt, Human
gcucgaaucucugugccuu

SEQ ID NO: 1258523 - RNA, 11 nt, Human
gcuccuugggc

SEQ ID NO: 1258524 - RNA, 12 nt, Human
gcucuccauucu

SEQ ID NO: 1258525 - RNA, 14 nt, Human
gcucuccauucugc

SEQ ID NO: 1258526 - RNA, 17 nt, Human
gcucuccauucugcucc

SEQ ID NO: 1258527 - RNA, 18 nt, Human
gcucuccauucugcuccu

SEQ ID NO: 1258528 - RNA, 19 nt, Human
gcucuccauucugcuccuu

SEQ ID NO: 1258529 - RNA, 21 nt, Human
gcucuccauucugcuccuucc

SEQ ID NO: 1258530 - RNA, 20 nt, Human
gcucucuggccuucggccuc

SEQ ID NO: 1258531 - RNA, 19 nt, Human
gcucucuggccuucggccu

SEQ ID NO: 1258532 - RNA, 15 nt, Human
gcucucuggccuucg

SEQ ID NO: 1258533 - RNA, 14 nt, Human
gcucucuggccuuc

SEQ ID NO: 1258534 - RNA, 17 nt, Human
gcucugcgugucaccug

SEQ ID NO: 1258535 - RNA, 16 nt, Human
gcucuggacagcccca

SEQ ID NO: 1258536 - RNA, 19 nt, Human
gcucuggacagccccaccc

SEQ ID NO: 1258537 - RNA, 22 nt, Human
gcucugcgugucaccugugcuu

SEQ ID NO: 1258538 - RNA, 22 nt, Human
gcucugcuccccuaaagccuca

SEQ ID NO: 1258539 - RNA, 22 nt, Human
gcucugcuauuaggccagcaag

SEQ ID NO: 1258540 - RNA, 20 nt, Human
gccugagugacagagcaaga

SEQ ID NO: 1258541 - RNA, 16 nt, Human
gccugaucagaccacg

SEQ ID NO: 1258542 - RNA, 20 nt, Human
gccugaucagaccacggcuc

SEQ ID NO: 1258543 - RNA, 17 nt, Human
gccugacccucaucuuu

SEQ ID NO: 1258544 - RNA, 23 nt, Human
gccugacccuacuucuuuugcuc

SEQ ID NO: 1258545 - RNA, 18 nt, Human
gccugagucgugaccugc

SEQ ID NO: 1258546 - RNA, 20 nt, Human
gccugagucgugaccugcua

SEQ ID NO: 1258547 - RNA, 23 nt, Human
gccugagucgugaccugcuaggc

SEQ ID NO: 1258548 - RNA, 22 nt, Human
gccugagucgugaccugcuagg

SEQ ID NO: 1258549 - RNA, 20 nt, Human
gccugacaaccacuggucug

SEQ ID NO: 1258550 - RNA, 21 nt, Human
gccugacaaccacuggucugu

SEQ ID NO: 1258551 - RNA, 22 nt, Human
gccugacacacuaaccaagcug

SEQ ID NO: 1258552 - RNA, 15 nt, Human
gccugacacacuaac

SEQ ID NO: 1258553 - RNA, 22 nt, Human
gccugacauuuggaguguuccc

SEQ ID NO: 1258554 - RNA, 15 nt, Human
gccugaccaaacagc

SEQ ID NO: 1258555 - RNA, 21 nt, Human
gccucucugcaggucccuaau

SEQ ID NO: 1258556 - RNA, 20 nt, Human
gccucucugcaggucccuaa

SEQ ID NO: 1258557 - RNA, 23 nt, Human
gccucucugcaggucccuaauaa

SEQ ID NO: 1258558 - RNA, 12 nt, Human
gccucugccugu

SEQ ID NO: 1258559 - RNA, 19 nt, Human
gccucugcugauccuccca

SEQ ID NO: 1258560 - RNA, 13 nt, Human
gccucugccuguc

SEQ ID NO: 1258561 - RNA, 22 nt, Human
gccucucgcuccucaaccccuc

SEQ ID NO: 1258562 - RNA, 18 nt, Human
gccucugcugauccuccc

SEQ ID NO: 1258563 - RNA, 19 nt, Human
gccucugcgagugguuucu

SEQ ID NO: 1258564 - RNA, 16 nt, Human
gccugcacaauaaaaa

SEQ ID NO: 1258565 - RNA, 16 nt, Human
gccugcagaauuuggg

SEQ ID NO: 1258566 - RNA, 16 nt, Human
gccugcagacucacug

SEQ ID NO: 1258567 - RNA, 22 nt, Human
gccugcuuuuuauggccuguga

SEQ ID NO: 1258568 - RNA, 14 nt, Human
gccuggaggaccug

SEQ ID NO: 1258569 - RNA, 15 nt, Human
gccuggaggaccuga

SEQ ID NO: 1258570 - RNA, 16 nt, Human
gccuggaggaccugag

SEQ ID NO: 1258571 - RNA, 17 nt, Human
gccuggaggaccugagc

SEQ ID NO: 1258572 - RNA, 19 nt, Human
gccugcuuuuuauggccug

SEQ ID NO: 1258573 - RNA, 18 nt, Human
gccugcuuuuuauggccu

SEQ ID NO: 1258574 - RNA, 22 nt, Human
gccuggggcugaggcugaggca

SEQ ID NO: 1258575 - RNA, 21 nt, Human
gccuggggcucuaacgccuga

SEQ ID NO: 1258576 - RNA, 22 nt, Human
gccuggggcucuaacgccugag

SEQ ID NO: 1258577 - RNA, 17 nt, Human
gccuggggcuggccucc

SEQ ID NO: 1258578 - RNA, 14 nt, Human
gccuggggcuggcc

SEQ ID NO: 1258579 - RNA, 23 nt, Human
gccuggggcucuaacgccugagc

SEQ ID NO: 1258580 - RNA, 13 nt, Human
gccugggggccug

SEQ ID NO: 1258581 - RNA, 14 nt, Human
gccugggggccugg

SEQ ID NO: 1258582 - RNA, 15 nt, Human
gccugggggccuggc

SEQ ID NO: 1258583 - RNA, 16 nt, Human
gccugggggccuggcu

SEQ ID NO: 1258584 - RNA, 17 nt, Human
gccugggggccuggcug

SEQ ID NO: 1258585 - RNA, 18 nt, Human
gccugggggccuggcugg

SEQ ID NO: 1258586 - RNA, 19 nt, Human
gccugggggccuggcuggc

SEQ ID NO: 1258587 - RNA, 20 nt, Human
gccugggggccuggcuggcu

SEQ ID NO: 1258588 - RNA, 18 nt, Human
gccuggccauacuguguc

SEQ ID NO: 1258589 - RNA, 17 nt, Human
gccuggccagugcccug

SEQ ID NO: 1258590 - RNA, 14 nt, Human
gccuggcccacccc

SEQ ID NO: 1258591 - RNA, 20 nt, Human
gccuggggcucuaacgccug

SEQ ID NO: 1258592 - RNA, 15 nt, Human
gccugggucuccuaa

SEQ ID NO: 1258593 - RNA, 17 nt, Human
gccuguacugccugcuu

SEQ ID NO: 1258594 - RNA, 18 nt, Human
gccuguacugccugcuug

SEQ ID NO: 1258595 - RNA, 20 nt, Human
gccuguacugccugcuuggg

SEQ ID NO: 1258596 - RNA, 19 nt, Human
gccuguacugccugcuugg

SEQ ID NO: 1258597 - RNA, 13 nt, Human
gccuguagaguug

SEQ ID NO: 1258598 - RNA, 15 nt, Human
gccuguagaguugcu

SEQ ID NO: 1258599 - RNA, 16 nt, Human
gccuguagaguugcug

SEQ ID NO: 1258600 - RNA, 19 nt, Human
gccuguagaguugcugaga

SEQ ID NO: 1258601 - RNA, 17 nt, Human
gccuguagaguugcuga

SEQ ID NO: 1258602 - RNA, 20 nt, Human
gccuguagccccagugacag

SEQ ID NO: 1258603 - RNA, 21 nt, Human
gccuguagccccagugacagc

SEQ ID NO: 1258604 - RNA, 18 nt, Human
gccuggaggaccugagcc

SEQ ID NO: 1258605 - RNA, 19 nt, Human
gccuggaggaccugagccu

SEQ ID NO: 1258606 - RNA, 20 nt, Human
gccuggaggaccugagccug

SEQ ID NO: 1258607 - RNA, 21 nt, Human
gccuggaggaccugagccugc

SEQ ID NO: 1258608 - RNA, 22 nt, Human
gccuggaggaccugagccugcc

SEQ ID NO: 1258609 - RNA, 24 nt, Human
gccuggaguguaugacugcacaug

SEQ ID NO: 1258610 - RNA, 20 nt, Human
gccuggaugcggauggccgg

SEQ ID NO: 1258611 - RNA, 20 nt, Human
gccuggcaguccgugggacg

SEQ ID NO: 1258612 - RNA, 13 nt, Human
gccuggccacgcc

SEQ ID NO: 1258613 - RNA, 13 nt, Human
gccuggccagaca

SEQ ID NO: 1258614 - RNA, 14 nt, Human
gccuggccagacac

SEQ ID NO: 1258615 - RNA, 16 nt, Human
gccuggccagacacag

SEQ ID NO: 1258616 - RNA, 17 nt, Human
gccuggccagacacagg

SEQ ID NO: 1258617 - RNA, 15 nt, Human
gccuggccagugccc

SEQ ID NO: 1258618 - RNA, 20 nt, Human
gccuggccagacacaggccc

SEQ ID NO: 1258619 - RNA, 21 nt, Human
gccuggccagacacaggcccu

SEQ ID NO: 1258620 - RNA, 19 nt, Human
gccucucugcaggucccua

SEQ ID NO: 1258621 - RNA, 19 nt, Human
gccucucgcuccucaaccc

SEQ ID NO: 1258622 - RNA, 23 nt, Human
gccucuaccugacacucccuugg

SEQ ID NO: 1258623 - RNA, 15 nt, Human
gccucuacugggaag

SEQ ID NO: 1258624 - RNA, 16 nt, Human
gccucuacugggaagg

SEQ ID NO: 1258625 - RNA, 17 nt, Human
gccucuacugggaaggc

SEQ ID NO: 1258626 - RNA, 18 nt, Human
gccucuacugggaaggcu

SEQ ID NO: 1258627 - RNA, 22 nt, Human
gccucuagagcagacuacagcu

SEQ ID NO: 1258628 - RNA, 14 nt, Human
gccucucccuccuc

SEQ ID NO: 1258629 - RNA, 23 nt, Human
gccucucccuccuccaggaagcc

SEQ ID NO: 1258630 - RNA, 22 nt, Human
gccucucccuccuccaggaagc

SEQ ID NO: 1258631 - RNA, 20 nt, Human
gccucggacuuagcugggag

SEQ ID NO: 1258632 - RNA, 21 nt, Human
gccucggacuuagcugggaga

SEQ ID NO: 1258633 - RNA, 19 nt, Human
gccuccccuuaaaggggag

SEQ ID NO: 1258634 - RNA, 17 nt, Human
gccucggccucccaaag

SEQ ID NO: 1258635 - RNA, 17 nt, Human
gccucagugacccuggc

SEQ ID NO: 1258636 - RNA, 20 nt, Human
gccucagugacccuggcucc

SEQ ID NO: 1258637 - RNA, 18 nt, Human
gccuccccucuccuuccu

SEQ ID NO: 1258638 - RNA, 19 nt, Human
gccuccccucuccuuccug

SEQ ID NO: 1258639 - RNA, 21 nt, Human
gccuccccucuccuuccugug

SEQ ID NO: 1258640 - RNA, 14 nt, Human
gccuccccugccac

SEQ ID NO: 1258641 - RNA, 15 nt, Human
gccuccccugccacc

SEQ ID NO: 1258642 - RNA, 16 nt, Human
gccuccccugccacca

SEQ ID NO: 1258643 - RNA, 19 nt, Human
gccuccccugccaccaggc

SEQ ID NO: 1258644 - RNA, 14 nt, Human
gccuccccugccag

SEQ ID NO: 1258645 - RNA, 15 nt, Human
gccuccccugccagg

SEQ ID NO: 1258646 - RNA, 17 nt, Human
gccuccccugccagggc

SEQ ID NO: 1258647 - RNA, 18 nt, Human
gccuccccugccagggca

SEQ ID NO: 1258648 - RNA, 20 nt, Human
gccuccccuuaaaggggaga

SEQ ID NO: 1258649 - RNA, 19 nt, Human
gccucaccagcccuggcaa

SEQ ID NO: 1258650 - RNA, 15 nt, Human
gccucacccaccccu

SEQ ID NO: 1258651 - RNA, 17 nt, Human
gccucacccaccccugc

SEQ ID NO: 1258652 - RNA, 18 nt, Human
gccucacccaccccugca

SEQ ID NO: 1258653 - RNA, 19 nt, Human
gccucacccaccccugcac

SEQ ID NO: 1258654 - RNA, 20 nt, Human
gccucacccaccccugcaca

SEQ ID NO: 1258655 - RNA, 15 nt, Human
gccucaaccucccaa

SEQ ID NO: 1258656 - RNA, 22 nt, Human
gccucacuuuuaaugaacaaau

SEQ ID NO: 1258657 - RNA, 19 nt, Human
gccucagaagugcaucugg

SEQ ID NO: 1258658 - RNA, 23 nt, Human
gccucacuuuuaaugaacaaaug

SEQ ID NO: 1258659 - RNA, 17 nt, Human
gccucagaaaccagacu

SEQ ID NO: 1258660 - RNA, 16 nt, Human
gccucagccucccaag

SEQ ID NO: 1258661 - RNA, 14 nt, Human
gccucagccucccg

SEQ ID NO: 1258662 - RNA, 13 nt, Human
gccucagaagugc

SEQ ID NO: 1258663 - RNA, 15 nt, Human
gccucagucucccuc

SEQ ID NO: 1258664 - RNA, 18 nt, Human
gccucagucucccucccu

SEQ ID NO: 1258665 - RNA, 15 nt, Human
gccucagcucccaca

SEQ ID NO: 1258666 - RNA, 16 nt, Human
gccucagcucccacaa

SEQ ID NO: 1258667 - RNA, 17 nt, Human
gccucagcucccacaag

SEQ ID NO: 1258668 - RNA, 21 nt, Human
gccucagcucccacaagccuc

SEQ ID NO: 1258669 - RNA, 15 nt, Human
gccucaggacuggga

SEQ ID NO: 1258670 - RNA, 16 nt, Human
gccucaggacugggag

SEQ ID NO: 1258671 - RNA, 17 nt, Human
gccucaggacugggagc

SEQ ID NO: 1258672 - RNA, 23 nt, Human
gccucaggacugggagcccccag

SEQ ID NO: 1258673 - RNA, 16 nt, Human
gccucaggggucugag

SEQ ID NO: 1258674 - RNA, 18 nt, Human
gccucaggacugggagcc

SEQ ID NO: 1258675 - RNA, 14 nt, Human
gccucagggcuccu

SEQ ID NO: 1258676 - RNA, 20 nt, Human
gccuaucagaguugcugcaa

SEQ ID NO: 1258677 - RNA, 16 nt, Human
gccuaugacuugggca

SEQ ID NO: 1258678 - RNA, 17 nt, Human
gccuaugacuugggcac

SEQ ID NO: 1258679 - RNA, 18 nt, Human
gccuaugacuugggcacc

SEQ ID NO: 1258680 - RNA, 22 nt, Human
gccuauauuuuuuguuaaauga

SEQ ID NO: 1258681 - RNA, 23 nt, Human
gccuaagggauccugccugcccc

SEQ ID NO: 1258682 - RNA, 17 nt, Human
gccuaagugcagccccg

SEQ ID NO: 1258683 - RNA, 16 nt, Human
gccuaaggcugaacuu

SEQ ID NO: 1258684 - RNA, 14 nt, Human
gccgagcaaccgug

SEQ ID NO: 1258685 - RNA, 19 nt, Human
gccgagcaaccguggcccu

SEQ ID NO: 1258686 - RNA, 20 nt, Human
gccgagcaaccguggcccuu

SEQ ID NO: 1258687 - RNA, 14 nt, Human
gccgagcaggaggc

SEQ ID NO: 1258688 - RNA, 15 nt, Human
gccgagcaggaggcc

SEQ ID NO: 1258689 - RNA, 21 nt, Human
gcccugggaggcucuggagcc

SEQ ID NO: 1258690 - RNA, 19 nt, Human
gcccugggaggcucuggag

SEQ ID NO: 1258691 - RNA, 18 nt, Human
gcccugggaggcucugga

SEQ ID NO: 1258692 - RNA, 17 nt, Human
gcccugggaggcucugg

SEQ ID NO: 1258693 - RNA, 23 nt, Human
gcccugggaggcucuggagccca

SEQ ID NO: 1258694 - RNA, 16 nt, Human
gcccugggaggcagug

SEQ ID NO: 1258695 - RNA, 22 nt, Human
gcccugggaccgcuacaccacu

SEQ ID NO: 1258696 - RNA, 23 nt, Human
gcccugggagaaucgcuccugca

SEQ ID NO: 1258697 - RNA, 13 nt, Human
gcccugggccugc

SEQ ID NO: 1258698 - RNA, 15 nt, Human
gcccugggccugccu

SEQ ID NO: 1258699 - RNA, 16 nt, Human
gcccugggccugccuc

SEQ ID NO: 1258700 - RNA, 20 nt, Human
gcccugggccugccucacca

SEQ ID NO: 1258701 - RNA, 22 nt, Human
gcccugggccugccucaccacg

SEQ ID NO: 1258702 - RNA, 15 nt, Human
gcccuggugcugcca

SEQ ID NO: 1258703 - RNA, 16 nt, Human
gcccuggugcugccac

SEQ ID NO: 1258704 - RNA, 17 nt, Human
gcccuggugcugccaca

SEQ ID NO: 1258705 - RNA, 21 nt, Human
gcccuggugcugccacacuuc

SEQ ID NO: 1258706 - RNA, 11 nt, Human
gcccugggcug

SEQ ID NO: 1258707 - RNA, 12 nt, Human
gcccugggcugg

SEQ ID NO: 1258708 - RNA, 13 nt, Human
gcccugggcugga

SEQ ID NO: 1258709 - RNA, 14 nt, Human
gcccugggcuggaa

SEQ ID NO: 1258710 - RNA, 16 nt, Human
gcccugggcuggaauc

SEQ ID NO: 1258711 - RNA, 18 nt, Human
gcccugggcuggaaucag

SEQ ID NO: 1258712 - RNA, 12 nt, Human
gcccuggggccu

SEQ ID NO: 1258713 - RNA, 13 nt, Human
gcccuggggccug

SEQ ID NO: 1258714 - RNA, 14 nt, Human
gcccuggggccugu

SEQ ID NO: 1258715 - RNA, 15 nt, Human
gcccuggggccugua

SEQ ID NO: 1258716 - RNA, 18 nt, Human
gcccuggggccuguacug

SEQ ID NO: 1258717 - RNA, 19 nt, Human
gcccuggggccuguacugc

SEQ ID NO: 1258718 - RNA, 23 nt, Human
gcccuggggccuguacugccugc

SEQ ID NO: 1258719 - RNA, 21 nt, Human
gcccuggggccuguacugccu

SEQ ID NO: 1258720 - RNA, 22 nt, Human
gcccuggggccuguacugccug

SEQ ID NO: 1258721 - RNA, 16 nt, Human
gcccugggaggcucug

SEQ ID NO: 1258722 - RNA, 15 nt, Human
gcccugggaggcucu

SEQ ID NO: 1258723 - RNA, 14 nt, Human
gcccugggaggcuc

SEQ ID NO: 1258724 - RNA, 13 nt, Human
gcccugggaggcu

SEQ ID NO: 1258725 - RNA, 11 nt, Human
gcccugggagg

SEQ ID NO: 1258726 - RNA, 14 nt, Human
gcccugggaggcag

SEQ ID NO: 1258727 - RNA, 14 nt, Human
gcccugggaccgcu

SEQ ID NO: 1258728 - RNA, 20 nt, Human
gcccugggaccgcuacacca

SEQ ID NO: 1258729 - RNA, 15 nt, Human
gcccuggcucccaca

SEQ ID NO: 1258730 - RNA, 19 nt, Human
gcccuggcucccacaggcc

SEQ ID NO: 1258731 - RNA, 20 nt, Human
gcccuggcucccacaggccc

SEQ ID NO: 1258732 - RNA, 19 nt, Human
gcccuggccuccccugcca

SEQ ID NO: 1258733 - RNA, 20 nt, Human
gcccuggccuccccugccac

SEQ ID NO: 1258734 - RNA, 21 nt, Human
gcccuggccuccccugccacc

SEQ ID NO: 1258735 - RNA, 24 nt, Human
gcccuggccuccccugccaccagg

SEQ ID NO: 1258736 - RNA, 22 nt, Human
gcccuggaucagcguggccuug

SEQ ID NO: 1258737 - RNA, 15 nt, Human
gcccuggcaugucaa

SEQ ID NO: 1258738 - RNA, 12 nt, Human
gcccuggccucc

SEQ ID NO: 1258739 - RNA, 14 nt, Human
gcccuggccucccc

SEQ ID NO: 1258740 - RNA, 16 nt, Human
gcccuggccuccccug

SEQ ID NO: 1258741 - RNA, 17 nt, Human
gcccuggccuccccugc

SEQ ID NO: 1258742 - RNA, 21 nt, Human
gcccuuccucuccacugccuu

SEQ ID NO: 1258743 - RNA, 17 nt, Human
gcccuuccucuccacug

SEQ ID NO: 1258744 - RNA, 16 nt, Human
gcccuuccucuccacu

SEQ ID NO: 1258745 - RNA, 18 nt, Human
gcccuuccucuccacugc

SEQ ID NO: 1258746 - RNA, 19 nt, Human
gcccuuccucuccacugcc

SEQ ID NO: 1258747 - RNA, 20 nt, Human
gcccuuccucuccacugccu

SEQ ID NO: 1258748 - RNA, 23 nt, Human
gcccuuguuuggggcaggaguag

SEQ ID NO: 1258749 - RNA, 14 nt, Human
gcccuuuugucucu

SEQ ID NO: 1258750 - RNA, 15 nt, Human
gcccuuuccuccuca

SEQ ID NO: 1258751 - RNA, 16 nt, Human
gcccuuuccuccucag

SEQ ID NO: 1258752 - RNA, 22 nt, Human
gcccuuucggauccagggaggc

SEQ ID NO: 1258753 - RNA, 19 nt, Human
gcccuuucggauccaggga

SEQ ID NO: 1258754 - RNA, 18 nt, Human
gcccuuugagugcagucc

SEQ ID NO: 1258755 - RNA, 23 nt, Human
gcccuggugguggcucgggaggc

SEQ ID NO: 1258756 - RNA, 18 nt, Human
gcccugguggcccucucc

SEQ ID NO: 1258757 - RNA, 19 nt, Human
gcccugguggcccucuccc

SEQ ID NO: 1258758 - RNA, 20 nt, Human
gcccugguggcccucucccc

SEQ ID NO: 1258759 - RNA, 13 nt, Human
gcccugguggccc

SEQ ID NO: 1258760 - RNA, 14 nt, Human
gcccugguggcccu

SEQ ID NO: 1258761 - RNA, 15 nt, Human
gcccugguggcccuc

SEQ ID NO: 1258762 - RNA, 14 nt, Human
gcccugguuuccug

SEQ ID NO: 1258763 - RNA, 15 nt, Human
gcccugguuuccugc

SEQ ID NO: 1258764 - RNA, 17 nt, Human
gcccugguuuccugccc

SEQ ID NO: 1258765 - RNA, 18 nt, Human
gcccugguuuccugcccu

SEQ ID NO: 1258766 - RNA, 19 nt, Human
gcccugguuuccugcccug

SEQ ID NO: 1258767 - RNA, 20 nt, Human
gcccugguuuccugcccugg

SEQ ID NO: 1258768 - RNA, 21 nt, Human
gcccugguuuccugcccuggg

SEQ ID NO: 1258769 - RNA, 23 nt, Human
gcccugguuuccugcccugggag

SEQ ID NO: 1258770 - RNA, 20 nt, Human
gcccugucagcaugaauuug

SEQ ID NO: 1258771 - RNA, 22 nt, Human
gcccugucagcaugaauuugua

SEQ ID NO: 1258772 - RNA, 22 nt, Human
gcccuggacugugugcucagga

SEQ ID NO: 1258773 - RNA, 16 nt, Human
gcccuggacugugugc

SEQ ID NO: 1258774 - RNA, 12 nt, Human
gcccuggacugu

SEQ ID NO: 1258775 - RNA, 22 nt, Human
gcccugcuuugggcugcccugg

SEQ ID NO: 1258776 - RNA, 23 nt, Human
gcccugcuuugggcugcccuggu

SEQ ID NO: 1258777 - RNA, 17 nt, Human
gcccuggaucagcgugg

SEQ ID NO: 1258778 - RNA, 18 nt, Human
gcccuggaucagcguggc

SEQ ID NO: 1258779 - RNA, 19 nt, Human
gcccuggaucagcguggcc

SEQ ID NO: 1258780 - RNA, 20 nt, Human
gcccuggaucagcguggccu

SEQ ID NO: 1258781 - RNA, 21 nt, Human
gcccuggaucagcguggccuu

SEQ ID NO: 1258782 - RNA, 23 nt, Human
gcccuggaucagcguggccuugu

SEQ ID NO: 1258783 - RNA, 15 nt, Human
gcccugaucccagag

SEQ ID NO: 1258784 - RNA, 13 nt, Human
gcccugaucccag

SEQ ID NO: 1258785 - RNA, 14 nt, Human
gcccugcaaaagga

SEQ ID NO: 1258786 - RNA, 18 nt, Human
gcccugcaaaaggacucu

SEQ ID NO: 1258787 - RNA, 20 nt, Human
gcccugaggccuagacucug

SEQ ID NO: 1258788 - RNA, 17 nt, Human
gcccugaggacagaugc

SEQ ID NO: 1258789 - RNA, 20 nt, Human
gcccugcuuugggcugcccu

SEQ ID NO: 1258790 - RNA, 21 nt, Human
gcccugcuuugggcugcccug

SEQ ID NO: 1258791 - RNA, 13 nt, Human
gcccugcagaccc

SEQ ID NO: 1258792 - RNA, 14 nt, Human
gcccugcagacccu

SEQ ID NO: 1258793 - RNA, 15 nt, Human
gcccugcagacccug

SEQ ID NO: 1258794 - RNA, 16 nt, Human
gcccugcagacccugc

SEQ ID NO: 1258795 - RNA, 21 nt, Human
gcccugcaaaaggacucucag

SEQ ID NO: 1258796 - RNA, 17 nt, Human
gcccugcaccaugcugc

SEQ ID NO: 1258797 - RNA, 21 nt, Human
gcccugcaccaugcugcuggg

SEQ ID NO: 1258798 - RNA, 22 nt, Human
gcccugcaccaugcugcugggg

SEQ ID NO: 1258799 - RNA, 14 nt, Human
gcccggcuccuggu

SEQ ID NO: 1258800 - RNA, 13 nt, Human
gcccggcuccugg

SEQ ID NO: 1258801 - RNA, 14 nt, Human
gcccucgcugccag

SEQ ID NO: 1258802 - RNA, 15 nt, Human
gcccucgcugccagc

SEQ ID NO: 1258803 - RNA, 17 nt, Human
gcccucgcugccagcuc

SEQ ID NO: 1258804 - RNA, 23 nt, Human
gcccucgugguggaaacuuuucu

SEQ ID NO: 1258805 - RNA, 17 nt, Human
gcccucgugguggaaac

SEQ ID NO: 1258806 - RNA, 13 nt, Human
gcccucucccacc

SEQ ID NO: 1258807 - RNA, 16 nt, Human
gcccucucccacccuc

SEQ ID NO: 1258808 - RNA, 19 nt, Human
gcccucucccacccucuuc

SEQ ID NO: 1258809 - RNA, 20 nt, Human
gcccucucccacccucuucc

SEQ ID NO: 1258810 - RNA, 17 nt, Human
gcccucuccccucagcc

SEQ ID NO: 1258811 - RNA, 20 nt, Human
gcccucuccccucagccucu

SEQ ID NO: 1258812 - RNA, 14 nt, Human
gcccucuccccugc

SEQ ID NO: 1258813 - RNA, 15 nt, Human
gcccucuccccugcc

SEQ ID NO: 1258814 - RNA, 16 nt, Human
gcccucuccccugccc

SEQ ID NO: 1258815 - RNA, 17 nt, Human
gcccucuccccugcccc

SEQ ID NO: 1258816 - RNA, 18 nt, Human
gcccucuccccugccccc

SEQ ID NO: 1258817 - RNA, 20 nt, Human
gcccucuccccugcccccug

SEQ ID NO: 1258818 - RNA, 16 nt, Human
gcccucucugcucugc

SEQ ID NO: 1258819 - RNA, 17 nt, Human
gcccucugcauccucug

SEQ ID NO: 1258820 - RNA, 18 nt, Human
gcccucugcauccucugg

SEQ ID NO: 1258821 - RNA, 19 nt, Human
gcccucugcauccucugga

SEQ ID NO: 1258822 - RNA, 20 nt, Human
gcccucugcauccucuggag

SEQ ID NO: 1258823 - RNA, 21 nt, Human
gcccucugcauccucuggagc

SEQ ID NO: 1258824 - RNA, 22 nt, Human
gcccucugcauccucuggagcc

SEQ ID NO: 1258825 - RNA, 21 nt, Human
gcccugaggacagaugccucc

SEQ ID NO: 1258826 - RNA, 23 nt, Human
gcccucuccccugcccccugcag

SEQ ID NO: 1258827 - RNA, 22 nt, Human
gcccucuccccugcccccugca

SEQ ID NO: 1258828 - RNA, 16 nt, Human
gcagacucagcucuga

SEQ ID NO: 1258829 - RNA, 13 nt, Human
gcagacucacugu

SEQ ID NO: 1258830 - RNA, 15 nt, Human
gcagacucagcucug

SEQ ID NO: 1258831 - RNA, 17 nt, Human
gcagaccuuuuuuagga

SEQ ID NO: 1258832 - RNA, 14 nt, Human
gcagacguccauca

SEQ ID NO: 1258833 - RNA, 12 nt, Human
gccccucccuuc

SEQ ID NO: 1258834 - RNA, 14 nt, Human
gccccucccuucaa

SEQ ID NO: 1258835 - RNA, 15 nt, Human
gccccucccuucaac

SEQ ID NO: 1258836 - RNA, 18 nt, Human
gccccuccucucugcccu

SEQ ID NO: 1258837 - RNA, 19 nt, Human
gccccuccucucugcccua

SEQ ID NO: 1258838 - RNA, 20 nt, Human
gccccucucccuugggcucu

SEQ ID NO: 1258839 - RNA, 21 nt, Human
gccccucucccuugggcucug

SEQ ID NO: 1258840 - RNA, 23 nt, Human
gccccucucccuugggcucugau

SEQ ID NO: 1258841 - RNA, 17 nt, Human
gccccucuccuucuuag

SEQ ID NO: 1258842 - RNA, 14 nt, Human
gccccucucaccaa

SEQ ID NO: 1258843 - RNA, 15 nt, Human
gccccucucaccaaa

SEQ ID NO: 1258844 - RNA, 13 nt, Human
gccccucucagcc

SEQ ID NO: 1258845 - RNA, 14 nt, Human
gccccucucagccc

SEQ ID NO: 1258846 - RNA, 15 nt, Human
gccccucucagcccu

SEQ ID NO: 1258847 - RNA, 16 nt, Human
gccccucucagcccuc

SEQ ID NO: 1258848 - RNA, 20 nt, Human
gccccucucagcccucacac

SEQ ID NO: 1258849 - RNA, 18 nt, Human
gccccucuccccagggaa

SEQ ID NO: 1258850 - RNA, 12 nt, Human
gccccucucccu

SEQ ID NO: 1258851 - RNA, 18 nt, Human
gcccggcuaauuuuugua

SEQ ID NO: 1258852 - RNA, 17 nt, Human
gcccggcagggcgggca

SEQ ID NO: 1258853 - RNA, 24 nt, Human
gcccgcgauguggaacugcugcca

SEQ ID NO: 1258854 - RNA, 21 nt, Human
gcccgcgauguggaacugcug

SEQ ID NO: 1258855 - RNA, 15 nt, Human
gcccggcagggcggg

SEQ ID NO: 1258856 - RNA, 12 nt, Human
gccccuuccccc

SEQ ID NO: 1258857 - RNA, 17 nt, Human
gccccuucccccuccaa

SEQ ID NO: 1258858 - RNA, 16 nt, Human
gcccgacagccuggca

SEQ ID NO: 1258859 - RNA, 17 nt, Human
gcccgacagccuggcac

SEQ ID NO: 1258860 - RNA, 19 nt, Human
gcccgacagccuggcacag

SEQ ID NO: 1258861 - RNA, 16 nt, Human
gccccuuagacagagg

SEQ ID NO: 1258862 - RNA, 22 nt, Human
gccccuuagacagaggcccuca

SEQ ID NO: 1258863 - RNA, 17 nt, Human
gccccuuagacagaggc

SEQ ID NO: 1258864 - RNA, 12 nt, Human
gcccgagcagcu

SEQ ID NO: 1258865 - RNA, 13 nt, Human
gcccgagcagcug

SEQ ID NO: 1258866 - RNA, 14 nt, Human
gcccgagcagcuga

SEQ ID NO: 1258867 - RNA, 16 nt, Human
gcccgagcagcugagc

SEQ ID NO: 1258868 - RNA, 17 nt, Human
gcccgagcagcugagca

SEQ ID NO: 1258869 - RNA, 18 nt, Human
gcccgagcagcugagcag

SEQ ID NO: 1258870 - RNA, 19 nt, Human
gcccgagcagcugagcagg

SEQ ID NO: 1258871 - RNA, 20 nt, Human
gcccgagcagcugagcaggg

SEQ ID NO: 1258872 - RNA, 22 nt, Human
gcccgagcagcugagcagggcc

SEQ ID NO: 1258873 - RNA, 23 nt, Human
gcccgagcagcugagcagggccg

SEQ ID NO: 1258874 - RNA, 17 nt, Human
gaugggguuucaccaug

SEQ ID NO: 1258875 - RNA, 19 nt, Human
gaugggaugguggagggcc

SEQ ID NO: 1258876 - RNA, 20 nt, Human
gaugggaugguggagggcca

SEQ ID NO: 1258877 - RNA, 13 nt, Human
gaugggauucugg

SEQ ID NO: 1258878 - RNA, 17 nt, Human
gaugggauucuggacag

SEQ ID NO: 1258879 - RNA, 12 nt, Human
gauggggcuccc

SEQ ID NO: 1258880 - RNA, 14 nt, Human
gauggccccagcac

SEQ ID NO: 1258881 - RNA, 15 nt, Human
gauggccccagcaca

SEQ ID NO: 1258882 - RNA, 13 nt, Human
gauggccagcccc

SEQ ID NO: 1258883 - RNA, 14 nt, Human
gauggccagccccu

SEQ ID NO: 1258884 - RNA, 19 nt, Human
gauggccagccccuuagac

SEQ ID NO: 1258885 - RNA, 14 nt, Human
gauggcccauccug

SEQ ID NO: 1258886 - RNA, 12 nt, Human
gauggccccagc

SEQ ID NO: 1258887 - RNA, 18 nt, Human
gauggccggagaggaccg

SEQ ID NO: 1258888 - RNA, 20 nt, Human
gaugggagggaggcucaggu

SEQ ID NO: 1258889 - RNA, 22 nt, Human
gaugccagccaagcucugcagu

SEQ ID NO: 1258890 - RNA, 13 nt, Human
gaucagaacaaau

SEQ ID NO: 1258891 - RNA, 16 nt, Human
gaucagaccauaaugu

SEQ ID NO: 1258892 - RNA, 16 nt, Human
gaucagagccgugguc

SEQ ID NO: 1258893 - RNA, 23 nt, Human
gaucagagccgugguccuuuggg

SEQ ID NO: 1258894 - RNA, 18 nt, Human
gaugccagccaagcucug

SEQ ID NO: 1258895 - RNA, 17 nt, Human
gaugcccaaauccuuag

SEQ ID NO: 1258896 - RNA, 11 nt, Human
gaugcccagag

SEQ ID NO: 1258897 - RNA, 22 nt, Human
gaugcuagaacucccuuucaac

SEQ ID NO: 1258898 - RNA, 20 nt, Human
gaugcuagaacucccuuuca

SEQ ID NO: 1258899 - RNA, 16 nt, Human
gaugccccgucccccu

SEQ ID NO: 1258900 - RNA, 18 nt, Human
gaugcuagaacucccuuu

SEQ ID NO: 1258901 - RNA, 21 nt, Human
gaugccccgucccccucuggc

SEQ ID NO: 1258902 - RNA, 23 nt, Human
gaugcccccuaauccccuucucc

SEQ ID NO: 1258903 - RNA, 13 nt, Human
gaugcuccuuggg

SEQ ID NO: 1258904 - RNA, 14 nt, Human
gaugcuccuugggc

SEQ ID NO: 1258905 - RNA, 16 nt, Human
gaugcuccuugggccc

SEQ ID NO: 1258906 - RNA, 21 nt, Human
gaugcuccuugggcccuuuga

SEQ ID NO: 1258907 - RNA, 17 nt, Human
gaugcugacuguacucc

SEQ ID NO: 1258908 - RNA, 20 nt, Human
gaugcugacuguacuccucc

SEQ ID NO: 1258909 - RNA, 17 nt, Human
gaugcugaaaauguccu

SEQ ID NO: 1258910 - RNA, 20 nt, Human
gaugcugacauucaccugcc

SEQ ID NO: 1258911 - RNA, 21 nt, Human
gaugcugacauucaccugccc

SEQ ID NO: 1258912 - RNA, 22 nt, Human
gaugguucccuugaugaagaag

SEQ ID NO: 1258913 - RNA, 13 nt, Human
gaugguuccccug

SEQ ID NO: 1258914 - RNA, 18 nt, Human
gaugguuccccuguucac

SEQ ID NO: 1258915 - RNA, 21 nt, Human
gaugguuccccuguucacucu

SEQ ID NO: 1258916 - RNA, 17 nt, Human
gauguuacuccaaaacu

SEQ ID NO: 1258917 - RNA, 14 nt, Human
gauguggugaaaag

SEQ ID NO: 1258918 - RNA, 16 nt, Human
gauguggguuccacag

SEQ ID NO: 1258919 - RNA, 18 nt, Human
gauguggguuccacagac

SEQ ID NO: 1258920 - RNA, 16 nt, Human
gauguggucacagcug

SEQ ID NO: 1258921 - RNA, 17 nt, Human
gauguggucacagcugu

SEQ ID NO: 1258922 - RNA, 18 nt, Human
gauguggucacagcugua

SEQ ID NO: 1258923 - RNA, 17 nt, Human
gaugguaguuuuuucau

SEQ ID NO: 1258924 - RNA, 16 nt, Human
gauggucuuacagcag

SEQ ID NO: 1258925 - RNA, 17 nt, Human
gauggucuuacagcagg

SEQ ID NO: 1258926 - RNA, 21 nt, Human
gauggucuuacagcaggcagu

SEQ ID NO: 1258927 - RNA, 16 nt, Human
gauguuuaguaaucau

SEQ ID NO: 1258928 - RNA, 14 nt, Human
gauguuuauucuuc

SEQ ID NO: 1258929 - RNA, 18 nt, Human
gauguuuauucuucuaga

SEQ ID NO: 1258930 - RNA, 17 nt, Human
gauguucagcacugucc

SEQ ID NO: 1258931 - RNA, 19 nt, Human
gauguucagcacugucccu

SEQ ID NO: 1258932 - RNA, 20 nt, Human
gauguucagcacugucccuu

SEQ ID NO: 1258933 - RNA, 22 nt, Human
gauguucagcacugucccuugc

SEQ ID NO: 1258934 - RNA, 12 nt, Human
gauguucuaagg

SEQ ID NO: 1258935 - RNA, 14 nt, Human
gauuacacacguga

SEQ ID NO: 1258936 - RNA, 16 nt, Human
gauuaaauaagauucu

SEQ ID NO: 1258937 - RNA, 17 nt, Human
gauuaaauaagauucua

SEQ ID NO: 1258938 - RNA, 20 nt, Human
gauuacaggcgugagccacc

SEQ ID NO: 1258939 - RNA, 17 nt, Human
gauuacaggcuccugcc

SEQ ID NO: 1258940 - RNA, 18 nt, Human
gauuaaauaagauucuaa

SEQ ID NO: 1258941 - RNA, 20 nt, Human
gauuacaggcaugagccacu

SEQ ID NO: 1258942 - RNA, 14 nt, Human
gauuacaggcguga

SEQ ID NO: 1258943 - RNA, 20 nt, Human
gauuaaagaugagcuuuguc

SEQ ID NO: 1258944 - RNA, 21 nt, Human
gauucaaugccccugaauuua

SEQ ID NO: 1258945 - RNA, 16 nt, Human
gauucaauuugaugug

SEQ ID NO: 1258946 - RNA, 15 nt, Human
gauucuauuuauaug

SEQ ID NO: 1258947 - RNA, 20 nt, Human
gauucuauuuauauguacau

SEQ ID NO: 1258948 - RNA, 21 nt, Human
gauucuauuuauauguacaug

SEQ ID NO: 1258949 - RNA, 18 nt, Human
gauucucaaaggagcgag

SEQ ID NO: 1258950 - RNA, 13 nt, Human
gauucucauaacu

SEQ ID NO: 1258951 - RNA, 19 nt, Human
gauucaaugccccugaauu

SEQ ID NO: 1258952 - RNA, 20 nt, Human
gauucaaugccccugaauuu

SEQ ID NO: 1258953 - RNA, 20 nt, Human
gauucaaucuguaaacugug

SEQ ID NO: 1258954 - RNA, 21 nt, Human
gauucaaucuguaaacugugu

SEQ ID NO: 1258955 - RNA, 22 nt, Human
gauucaaucuguaaacugugua

SEQ ID NO: 1258956 - RNA, 18 nt, Human
gauuacaggcuccugcca

SEQ ID NO: 1258957 - RNA, 21 nt, Human
gauuacaggcuccugccacca

SEQ ID NO: 1258958 - RNA, 16 nt, Human
gauucucaugccucag

SEQ ID NO: 1258959 - RNA, 17 nt, Human
gauugagcucucugccc

SEQ ID NO: 1258960 - RNA, 16 nt, Human
gauugagucugugcca

SEQ ID NO: 1258961 - RNA, 19 nt, Human
gauugauagaguguuauca

SEQ ID NO: 1258962 - RNA, 15 nt, Human
gauugauuugaagaa

SEQ ID NO: 1258963 - RNA, 17 nt, Human
gauugauuugaagaaca

SEQ ID NO: 1258964 - RNA, 13 nt, Human
gauugcgagagau

SEQ ID NO: 1258965 - RNA, 14 nt, Human
gauugcgagagaug

SEQ ID NO: 1258966 - RNA, 15 nt, Human
gauugcgagagaugu

SEQ ID NO: 1258967 - RNA, 16 nt, Human
gauugcgagagaugug

SEQ ID NO: 1258968 - RNA, 17 nt, Human
gauugcgagagaugugu

SEQ ID NO: 1258969 - RNA, 18 nt, Human
gauugcgagagaugugug

SEQ ID NO: 1258970 - RNA, 19 nt, Human
gauugcgagagaugugugu

SEQ ID NO: 1258971 - RNA, 20 nt, Human
gauugcgagagauguguguu

SEQ ID NO: 1258972 - RNA, 13 nt, Human
gauuuccuaauac

SEQ ID NO: 1258973 - RNA, 22 nt, Human
gauuuccugcuuugggaagccg

SEQ ID NO: 1258974 - RNA, 12 nt, Human
gauuuccuucuu

SEQ ID NO: 1258975 - RNA, 13 nt, Human
gauuuccuugaau

SEQ ID NO: 1258976 - RNA, 17 nt, Human
gauuuccuugaaugugg

SEQ ID NO: 1258977 - RNA, 22 nt, Human
gauuuccuugaauguggcuuga

SEQ ID NO: 1258978 - RNA, 16 nt, Human
gauuugagcucagccc

SEQ ID NO: 1258979 - RNA, 18 nt, Human
gauuucuagguaggaaau

SEQ ID NO: 1258980 - RNA, 19 nt, Human
gauuugaagaacaugugag

SEQ ID NO: 1258981 - RNA, 20 nt, Human
gauuugaagaacaugugaga

SEQ ID NO: 1258982 - RNA, 13 nt, Human
gauuugacauugc

SEQ ID NO: 1258983 - RNA, 22 nt, Human
gauuggggaagagagccugcag

SEQ ID NO: 1258984 - RNA, 22 nt, Human
gauugcgagagauguguguuga

SEQ ID NO: 1258985 - RNA, 21 nt, Human
gauugcgagagauguguguug

SEQ ID NO: 1258986 - RNA, 21 nt, Human
gauuggguuuuuggacuucug

SEQ ID NO: 1258987 - RNA, 20 nt, Human
gauugguguuuuuuucuaug

SEQ ID NO: 1258988 - RNA, 17 nt, Human
gauugguguuuuuuucu

SEQ ID NO: 1258989 - RNA, 13 nt, Human
gcaacaauaaaua

SEQ ID NO: 1258990 - RNA, 20 nt, Human
gcaacaagguccucugucag

SEQ ID NO: 1258991 - RNA, 14 nt, Human
gcaacaauuuauga

SEQ ID NO: 1258992 - RNA, 15 nt, Human
gcaaauuggagaaaa

SEQ ID NO: 1258993 - RNA, 19 nt, Human
gcaaauuugcauuaaauua

SEQ ID NO: 1258994 - RNA, 14 nt, Human
gcaaauuggagaaa

SEQ ID NO: 1258995 - RNA, 16 nt, Human
gcaaauugucacagga

SEQ ID NO: 1258996 - RNA, 15 nt, Human
gcaaauguggcuccu

SEQ ID NO: 1258997 - RNA, 16 nt, Human
gcaaagauaucucauc

SEQ ID NO: 1258998 - RNA, 19 nt, Human
gcaaagaucuguccucagc

SEQ ID NO: 1258999 - RNA, 20 nt, Human
gcaaagaucuguccucagcc

SEQ ID NO: 1259000 - RNA, 21 nt, Human
gcaaagaucuguccucagccu

SEQ ID NO: 1259001 - RNA, 22 nt, Human
gcaaagaucuguccucagccuu

SEQ ID NO: 1259002 - RNA, 16 nt, Human
gcaaagauuuaaucug

SEQ ID NO: 1259003 - RNA, 12 nt, Human
gcaaagcacaga

SEQ ID NO: 1259004 - RNA, 14 nt, Human
gcaaagcacagaga

SEQ ID NO: 1259005 - RNA, 13 nt, Human
gcaaagcacagag

SEQ ID NO: 1259006 - RNA, 21 nt, Human
gcaaagccuguucauggcaga

SEQ ID NO: 1259007 - RNA, 15 nt, Human
gcaaaggaaggugga

SEQ ID NO: 1259008 - RNA, 20 nt, Human
gcaaaggaagguggauggcc

SEQ ID NO: 1259009 - RNA, 21 nt, Human
gauuuuaggagcuaaggcucu

SEQ ID NO: 1259010 - RNA, 15 nt, Human
gauuuucuuuugccu

SEQ ID NO: 1259011 - RNA, 21 nt, Human
gauuuugaaaccaugaagaga

SEQ ID NO: 1259012 - RNA, 21 nt, Human
gauuuugaaaucaugaagaua

SEQ ID NO: 1259013 - RNA, 15 nt, Human
gauuugcauugaaca

SEQ ID NO: 1259014 - RNA, 17 nt, Human
gauuugcauugaacaca

SEQ ID NO: 1259015 - RNA, 21 nt, Human
gauuuuaaguuucucugcaga

SEQ ID NO: 1259016 - RNA, 20 nt, Human
gauuuuacaugaaguauuuu

SEQ ID NO: 1259017 - RNA, 12 nt, Human
gauuuuacauga

SEQ ID NO: 1259018 - RNA, 13 nt, Human
gauuuuacaugaa

SEQ ID NO: 1259019 - RNA, 16 nt, Human
gauuuuacaugaagua

SEQ ID NO: 1259020 - RNA, 19 nt, Human
gauuuuaggagcuaaggcu

SEQ ID NO: 1259021 - RNA, 13 nt, Human
gauuuuuaaaaug

SEQ ID NO: 1259022 - RNA, 16 nt, Human
gauuuuuaaaauguac

SEQ ID NO: 1259023 - RNA, 14 nt, Human
gauuuuuacacaug

SEQ ID NO: 1259024 - RNA, 23 nt, Human
gauuuugaaccugaugaaaauaa

SEQ ID NO: 1259025 - RNA, 17 nt, Human
gauuuucuuuugccuuu

SEQ ID NO: 1259026 - RNA, 20 nt, Human
gauuuugcaguucuuuggcu

SEQ ID NO: 1259027 - RNA, 22 nt, Human
gauuuugggagugacucaagaa

SEQ ID NO: 1259028 - RNA, 14 nt, Human
gcacuggccccacc

SEQ ID NO: 1259029 - RNA, 15 nt, Human
gcacuggggcagggg

SEQ ID NO: 1259030 - RNA, 18 nt, Human
gcacuggggcaggggccg

SEQ ID NO: 1259031 - RNA, 23 nt, Human
gcacuggggcaggggccgggggc

SEQ ID NO: 1259032 - RNA, 14 nt, Human
gcacugguggcccg

SEQ ID NO: 1259033 - RNA, 19 nt, Human
gcacugguggcccgacagc

SEQ ID NO: 1259034 - RNA, 16 nt, Human
gcacugcuugaggaaa

SEQ ID NO: 1259035 - RNA, 17 nt, Human
gcacugcuugaggaaaa

SEQ ID NO: 1259036 - RNA, 14 nt, Human
gcacugcugcccag

SEQ ID NO: 1259037 - RNA, 15 nt, Human
gcacugcugcccagc

SEQ ID NO: 1259038 - RNA, 18 nt, Human
gcacugcugcccagccuc

SEQ ID NO: 1259039 - RNA, 20 nt, Human
gcacugcugcccagccucca

SEQ ID NO: 1259040 - RNA, 21 nt, Human
gcacugagauaccagcgagga

SEQ ID NO: 1259041 - RNA, 16 nt, Human
gcagaaggaaggcagg

SEQ ID NO: 1259042 - RNA, 22 nt, Human
gcagaaggaaggcagggaggag

SEQ ID NO: 1259043 - RNA, 15 nt, Human
gcagaaggaaggcag

SEQ ID NO: 1259044 - RNA, 13 nt, Human
gcagaaggaaggc

SEQ ID NO: 1259045 - RNA, 12 nt, Human
gcagaaggaagg

SEQ ID NO: 1259046 - RNA, 23 nt, Human
gcagaagggggucucuucuucca

SEQ ID NO: 1259047 - RNA, 16 nt, Human
gcagaaguguuuuuua

SEQ ID NO: 1259048 - RNA, 19 nt, Human
gcacuguggguagacacac

SEQ ID NO: 1259049 - RNA, 19 nt, Human
gcacugugacccccagcuc

SEQ ID NO: 1259050 - RNA, 16 nt, Human
gcacugucuuaaggca

SEQ ID NO: 1259051 - RNA, 11 nt, Human
gcacugugaag

SEQ ID NO: 1259052 - RNA, 14 nt, Human
gcacugugaaggac

SEQ ID NO: 1259053 - RNA, 16 nt, Human
gcacugugaaggaccc

SEQ ID NO: 1259054 - RNA, 17 nt, Human
gcacugugaaggacccu

SEQ ID NO: 1259055 - RNA, 18 nt, Human
gcacugugaaggacccuu

SEQ ID NO: 1259056 - RNA, 15 nt, Human
gcagacaccuuggac

SEQ ID NO: 1259057 - RNA, 12 nt, Human
gcagacagagcc

SEQ ID NO: 1259058 - RNA, 13 nt, Human
gcagacagagcca

SEQ ID NO: 1259059 - RNA, 14 nt, Human
gcagacagagccag

SEQ ID NO: 1259060 - RNA, 15 nt, Human
gcagacagagccagg

SEQ ID NO: 1259061 - RNA, 16 nt, Human
gcagacagagccagga

SEQ ID NO: 1259062 - RNA, 17 nt, Human
gcagacagagccaggag

SEQ ID NO: 1259063 - RNA, 18 nt, Human
gcagacagagccaggaga

SEQ ID NO: 1259064 - RNA, 21 nt, Human
gcagacagagccaggagaagc

SEQ ID NO: 1259065 - RNA, 22 nt, Human
gcagacagagccaggagaagcu

SEQ ID NO: 1259066 - RNA, 23 nt, Human
gcagacagagccaggagaagcuc

SEQ ID NO: 1259067 - RNA, 22 nt, Human
gcaccccagcuggggccaggcu

SEQ ID NO: 1259068 - RNA, 12 nt, Human
gcacccccagcc

SEQ ID NO: 1259069 - RNA, 13 nt, Human
gcacccccagccu

SEQ ID NO: 1259070 - RNA, 14 nt, Human
gcacccccagccug

SEQ ID NO: 1259071 - RNA, 15 nt, Human
gcacccccagccugg

SEQ ID NO: 1259072 - RNA, 16 nt, Human
gcacccccagccuggg

SEQ ID NO: 1259073 - RNA, 17 nt, Human
gcacccccagccugggc

SEQ ID NO: 1259074 - RNA, 18 nt, Human
gcacccccagccugggcc

SEQ ID NO: 1259075 - RNA, 19 nt, Human
gcacccccagccugggccu

SEQ ID NO: 1259076 - RNA, 20 nt, Human
gcacccccagccugggccua

SEQ ID NO: 1259077 - RNA, 21 nt, Human
gcacccccagccugggccuau

SEQ ID NO: 1259078 - RNA, 14 nt, Human
gcaccccccaagcu

SEQ ID NO: 1259079 - RNA, 23 nt, Human
gcacccccagccugggccuaugg

SEQ ID NO: 1259080 - RNA, 16 nt, Human
gcacccccgucaagag

SEQ ID NO: 1259081 - RNA, 19 nt, Human
gcaccugggcccuggggcc

SEQ ID NO: 1259082 - RNA, 20 nt, Human
gcaccugggcccuggggccu

SEQ ID NO: 1259083 - RNA, 23 nt, Human
gcaccugggcccuggggccugua

SEQ ID NO: 1259084 - RNA, 22 nt, Human
gcaccugggcccuggggccugu

SEQ ID NO: 1259085 - RNA, 22 nt, Human
gcaccugguggccaugcuccuc

SEQ ID NO: 1259086 - RNA, 18 nt, Human
gcaccuguaaugugcgag

SEQ ID NO: 1259087 - RNA, 15 nt, Human
gcaccugucccagaa

SEQ ID NO: 1259088 - RNA, 19 nt, Human
gcaccugucccagaaaaag

SEQ ID NO: 1259089 - RNA, 22 nt, Human
gcaccugucccagaaaaagcau

SEQ ID NO: 1259090 - RNA, 15 nt, Human
gcacagauggauuug

SEQ ID NO: 1259091 - RNA, 15 nt, Human
gcacaguauuuguaa

SEQ ID NO: 1259092 - RNA, 16 nt, Human
gcacagucacugcucu

SEQ ID NO: 1259093 - RNA, 16 nt, Human
gcacagugacuucuga

SEQ ID NO: 1259094 - RNA, 13 nt, Human
gcacagugcaucu

SEQ ID NO: 1259095 - RNA, 17 nt, Human
gcacagugacuucugag

SEQ ID NO: 1259096 - RNA, 18 nt, Human
gcacagugacuucugaga

SEQ ID NO: 1259097 - RNA, 19 nt, Human
gcacagugacuucugagau

SEQ ID NO: 1259098 - RNA, 15 nt, Human
gcacagugcaucuca

SEQ ID NO: 1259099 - RNA, 18 nt, Human
gcacagugcaucucagcc

SEQ ID NO: 1259100 - RNA, 19 nt, Human
gcacagugcaucucagccc

SEQ ID NO: 1259101 - RNA, 12 nt, Human
gcacauguuucc

SEQ ID NO: 1259102 - RNA, 22 nt, Human
gcaccaguugcugcuucaauuu

SEQ ID NO: 1259103 - RNA, 19 nt, Human
gcaccagggguuucucgca

SEQ ID NO: 1259104 - RNA, 23 nt, Human
gcaccaggguugaccccagagga

SEQ ID NO: 1259105 - RNA, 18 nt, Human
gcaccaggaagccguccu

SEQ ID NO: 1259106 - RNA, 16 nt, Human
gcaccagggguuucuc

SEQ ID NO: 1259107 - RNA, 18 nt, Human
gcaccagggguuucucgc

SEQ ID NO: 1259108 - RNA, 14 nt, Human
gcaccaaaagaagu

SEQ ID NO: 1259109 - RNA, 15 nt, Human
gcaccaaaagaagua

SEQ ID NO: 1259110 - RNA, 16 nt, Human
gcaccaaaagaaguaa

SEQ ID NO: 1259111 - RNA, 18 nt, Human
gcaccaaaagaaguaaaa

SEQ ID NO: 1259112 - RNA, 13 nt, Human
gcaacucugaagg

SEQ ID NO: 1259113 - RNA, 19 nt, Human
gcaaugggagcugaggcca

SEQ ID NO: 1259114 - RNA, 20 nt, Human
gcaaugggagcugaggccac

SEQ ID NO: 1259115 - RNA, 13 nt, Human
gcaauguaaauau

SEQ ID NO: 1259116 - RNA, 15 nt, Human
gcaauguaaauauuu

SEQ ID NO: 1259117 - RNA, 18 nt, Human
gcaauguaaauauuuuaa

SEQ ID NO: 1259118 - RNA, 19 nt, Human
gcaauguaaauauuuuaaa

SEQ ID NO: 1259119 - RNA, 17 nt, Human
gcaacgcuauuccagcu

SEQ ID NO: 1259120 - RNA, 19 nt, Human
gcaacuaucagacuaagcc

SEQ ID NO: 1259121 - RNA, 22 nt, Human
gcaacuaucagacuaagccagc

SEQ ID NO: 1259122 - RNA, 23 nt, Human
gcaacuaucagacuaagccagca

SEQ ID NO: 1259123 - RNA, 13 nt, Human
gcaacuauucaca

SEQ ID NO: 1259124 - RNA, 22 nt, Human
gcaacucaaggacuuugcagcc

SEQ ID NO: 1259125 - RNA, 18 nt, Human
gcaacgcuauuccagcug

SEQ ID NO: 1259126 - RNA, 19 nt, Human
gcaauuaauuccuucagca

SEQ ID NO: 1259127 - RNA, 16 nt, Human
gcaauucaaaaguucc

SEQ ID NO: 1259128 - RNA, 22 nt, Human
gcaauucaaaaguuccaagagu

SEQ ID NO: 1259129 - RNA, 14 nt, Human
gcaauuccccucug

SEQ ID NO: 1259130 - RNA, 18 nt, Human
gcaauuccccucugcugc

SEQ ID NO: 1259131 - RNA, 21 nt, Human
gcaauuccccucugcugcugu

SEQ ID NO: 1259132 - RNA, 20 nt, Human
gcaauuacaacggagucaaa

SEQ ID NO: 1259133 - RNA, 16 nt, Human
gcaauuaauuccuuca

SEQ ID NO: 1259134 - RNA, 19 nt, Human
gcaauguguguauauggac

SEQ ID NO: 1259135 - RNA, 20 nt, Human
gcaauguguguauauggaca

SEQ ID NO: 1259136 - RNA, 20 nt, Human
gcaauguuaauuuaguggaa

SEQ ID NO: 1259137 - RNA, 23 nt, Human
gcaauguaaauauuuuaaagaau

SEQ ID NO: 1259138 - RNA, 16 nt, Human
gcaauguguauaaaca

SEQ ID NO: 1259139 - RNA, 17 nt, Human
gcaauguguauaaacaa

SEQ ID NO: 1259140 - RNA, 20 nt, Human
gcaauguguauaaacaagaa

SEQ ID NO: 1259141 - RNA, 23 nt, Human
gcaauguguauaaacaagaaaaa

SEQ ID NO: 1259142 - RNA, 14 nt, Human
gcaauguguguaua

SEQ ID NO: 1259143 - RNA, 16 nt, Human
gcaauguguguauaug

SEQ ID NO: 1259144 - RNA, 18 nt, Human
gcaauguguguauaugga

SEQ ID NO: 1259145 - RNA, 18 nt, Human
gcaauuuaaauguuauga

SEQ ID NO: 1259146 - RNA, 12 nt, Human
gcaauugucuga

SEQ ID NO: 1259147 - RNA, 13 nt, Human
gcaauuuaaaugu

SEQ ID NO: 1259148 - RNA, 23 nt, Human
gcaauuggcaccgaagcccagag

SEQ ID NO: 1259149 - RNA, 12 nt, Human
gcaauugccuuu

SEQ ID NO: 1259150 - RNA, 13 nt, Human
gcaauugccuuuu

SEQ ID NO: 1259151 - RNA, 13 nt, Human
gcaauuucaaggu

SEQ ID NO: 1259152 - RNA, 18 nt, Human
gcaauuucaagguucuaa

SEQ ID NO: 1259153 - RNA, 18 nt, Human
gcaauuuccuuuuuuguu

SEQ ID NO: 1259154 - RNA, 17 nt, Human
gcaauuucuaauuuuua

SEQ ID NO: 1259155 - RNA, 22 nt, Human
gcaauuucuaauuuuuaagaau

SEQ ID NO: 1259156 - RNA, 19 nt, Human
gcaauuucuaauuuuuaag

SEQ ID NO: 1259157 - RNA, 14 nt, Human
gcaauucuccugcc

SEQ ID NO: 1259158 - RNA, 15 nt, Human
gcaauucuccugccu

SEQ ID NO: 1259159 - RNA, 16 nt, Human
gcaauucuccugccuc

SEQ ID NO: 1259160 - RNA, 17 nt, Human
gcaauucuccugccuca

SEQ ID NO: 1259161 - RNA, 18 nt, Human
gcaauucuccugccucag

SEQ ID NO: 1259162 - RNA, 19 nt, Human
gcaauucuccugccucagc

SEQ ID NO: 1259163 - RNA, 20 nt, Human
gcaauucuccugccucagcc

SEQ ID NO: 1259164 - RNA, 16 nt, Human
gcaauuuuuauauuaa

SEQ ID NO: 1259165 - RNA, 14 nt, Human
gcaauuuugugguu

SEQ ID NO: 1259166 - RNA, 13 nt, Human
gcacaaaacccag

SEQ ID NO: 1259167 - RNA, 23 nt, Human
gcacaaaacccagaccuguuagc

SEQ ID NO: 1259168 - RNA, 14 nt, Human
gcaauuuuguaacg

SEQ ID NO: 1259169 - RNA, 12 nt, Human
gcaauuuugugg

SEQ ID NO: 1259170 - RNA, 17 nt, Human
gcacaaagacccuggcu

SEQ ID NO: 1259171 - RNA, 18 nt, Human
gcacaaagacccuggcuu

SEQ ID NO: 1259172 - RNA, 13 nt, Human
gcacaaauauuua

SEQ ID NO: 1259173 - RNA, 23 nt, Human
gcacaaauucugucucuggauua

SEQ ID NO: 1259174 - RNA, 14 nt, Human
gcacaaauauuuau

SEQ ID NO: 1259175 - RNA, 15 nt, Human
gcacaaauauuuauu

SEQ ID NO: 1259176 - RNA, 16 nt, Human
gcacaaauauuuauuu

SEQ ID NO: 1259177 - RNA, 19 nt, Human
gcacaaauuaguuauauau

SEQ ID NO: 1259178 - RNA, 14 nt, Human
gcacaagaauggau

SEQ ID NO: 1259179 - RNA, 15 nt, Human
gcacaagaauggauc

SEQ ID NO: 1259180 - RNA, 16 nt, Human
gcacaagaauggauca

SEQ ID NO: 1259181 - RNA, 20 nt, Human
gcacaagacugacgccaggg

SEQ ID NO: 1259182 - RNA, 12 nt, Human
gcacaagacuga

SEQ ID NO: 1259183 - RNA, 19 nt, Human
gcacaagacugacgccagg

SEQ ID NO: 1259184 - RNA, 22 nt, Human
gcacacuuugccauauuuucac

SEQ ID NO: 1259185 - RNA, 21 nt, Human
gcacacuuugguaccagauaa

SEQ ID NO: 1259186 - RNA, 20 nt, Human
gcacacuuugcacugauaua

SEQ ID NO: 1259187 - RNA, 13 nt, Human
gcacacuuugcca

SEQ ID NO: 1259188 - RNA, 14 nt, Human
gcacacuuugccau

SEQ ID NO: 1259189 - RNA, 16 nt, Human
gcacagagagucugga

SEQ ID NO: 1259190 - RNA, 12 nt, Human
gaguuaagaccu

SEQ ID NO: 1259191 - RNA, 13 nt, Human
gaguuaagaccug

SEQ ID NO: 1259192 - RNA, 14 nt, Human
gaguuaagaccugg

SEQ ID NO: 1259193 - RNA, 18 nt, Human
gagugugcggcugugugu

SEQ ID NO: 1259194 - RNA, 23 nt, Human
gagugugcgugguggucccuggg

SEQ ID NO: 1259195 - RNA, 15 nt, Human
gaguguggacucugg

SEQ ID NO: 1259196 - RNA, 15 nt, Human
gagugaauucccuca

SEQ ID NO: 1259197 - RNA, 16 nt, Human
gagugaauucccucac

SEQ ID NO: 1259198 - RNA, 18 nt, Human
gagugaauucccucacuc

SEQ ID NO: 1259199 - RNA, 21 nt, Human
gagugggguuaucucuguguu

SEQ ID NO: 1259200 - RNA, 13 nt, Human
gaguggggguggg

SEQ ID NO: 1259201 - RNA, 14 nt, Human
gaguggguggggag

SEQ ID NO: 1259202 - RNA, 15 nt, Human
gaguggguggggagu

SEQ ID NO: 1259203 - RNA, 21 nt, Human
gagugguuuaggcuauuugua

SEQ ID NO: 1259204 - RNA, 13 nt, Human
gaguguacaagua

SEQ ID NO: 1259205 - RNA, 18 nt, Human
gaguguagcaacuacagu

SEQ ID NO: 1259206 - RNA, 19 nt, Human
gaguguccucuucccucuc

SEQ ID NO: 1259207 - RNA, 15 nt, Human
gauaaaugauagaca

SEQ ID NO: 1259208 - RNA, 14 nt, Human
gauaaaucauuuua

SEQ ID NO: 1259209 - RNA, 13 nt, Human
gauaaaucauuuu

SEQ ID NO: 1259210 - RNA, 12 nt, Human
gaguugaggcca

SEQ ID NO: 1259211 - RNA, 20 nt, Human
gauaaaucauuuuaugucaa

SEQ ID NO: 1259212 - RNA, 22 nt, Human
gauaaauggcuuccuggcaaua

SEQ ID NO: 1259213 - RNA, 17 nt, Human
gaguuaagaccuggcag

SEQ ID NO: 1259214 - RNA, 21 nt, Human
gaguuaagaccuggcagcucu

SEQ ID NO: 1259215 - RNA, 13 nt, Human
gaguuacaguucu

SEQ ID NO: 1259216 - RNA, 14 nt, Human
gaguuacaguucug

SEQ ID NO: 1259217 - RNA, 15 nt, Human
gaguuacaguucugu

SEQ ID NO: 1259218 - RNA, 16 nt, Human
gaguuacaguucugug

SEQ ID NO: 1259219 - RNA, 17 nt, Human
gaguuacaguucugugg

SEQ ID NO: 1259220 - RNA, 17 nt, Human
gauauaaguguguguuu

SEQ ID NO: 1259221 - RNA, 20 nt, Human
gauaucuuggacaaaucaca

SEQ ID NO: 1259222 - RNA, 15 nt, Human
gauaugaaagcugau

SEQ ID NO: 1259223 - RNA, 15 nt, Human
gauauaagugugugu

SEQ ID NO: 1259224 - RNA, 14 nt, Human
gauaugauucaaau

SEQ ID NO: 1259225 - RNA, 22 nt, Human
gauaugauucaaaugucuauaa

SEQ ID NO: 1259226 - RNA, 24 nt, Human
gauaugauucaaaugucuauaaac

SEQ ID NO: 1259227 - RNA, 21 nt, Human
gaucaauuauaguuucugagg

SEQ ID NO: 1259228 - RNA, 13 nt, Human
gaucacaaaaaca

SEQ ID NO: 1259229 - RNA, 12 nt, Human
gaucacaagaug

SEQ ID NO: 1259230 - RNA, 13 nt, Human
gaucacaagaugg

SEQ ID NO: 1259231 - RNA, 14 nt, Human
gaucacaagaugga

SEQ ID NO: 1259232 - RNA, 17 nt, Human
gaucacaagauggaauu

SEQ ID NO: 1259233 - RNA, 22 nt, Human
gaucacuuucucaguuuucaua

SEQ ID NO: 1259234 - RNA, 15 nt, Human
gauagcccuguccug

SEQ ID NO: 1259235 - RNA, 16 nt, Human
gauagcccuguccugg

SEQ ID NO: 1259236 - RNA, 21 nt, Human
gauagcccuguccugguggua

SEQ ID NO: 1259237 - RNA, 17 nt, Human
gauagcccuguccuggu

SEQ ID NO: 1259238 - RNA, 13 nt, Human
gauagcugugacu

SEQ ID NO: 1259239 - RNA, 20 nt, Human
gauaacugaaaauuauuuaa

SEQ ID NO: 1259240 - RNA, 21 nt, Human
gauaacugaaaauuauuuaaa

SEQ ID NO: 1259241 - RNA, 22 nt, Human
gauagauuuucugcuacuuugc

SEQ ID NO: 1259242 - RNA, 21 nt, Human
gagucuauuuacggaacucaa

SEQ ID NO: 1259243 - RNA, 15 nt, Human
gagucuaucaaucaa

SEQ ID NO: 1259244 - RNA, 13 nt, Human
gagucuagauuca

SEQ ID NO: 1259245 - RNA, 17 nt, Human
gagucuagauucaaagg

SEQ ID NO: 1259246 - RNA, 21 nt, Human
gagucuagauucaaagguucu

SEQ ID NO: 1259247 - RNA, 22 nt, Human
gagucuagauucaaagguucua

SEQ ID NO: 1259248 - RNA, 23 nt, Human
gagucuagauucaaagguucuag

SEQ ID NO: 1259249 - RNA, 13 nt, Human
gagucuagauucu

SEQ ID NO: 1259250 - RNA, 14 nt, Human
gagucuagauucuc

SEQ ID NO: 1259251 - RNA, 23 nt, Human
gagucuggugaagcucacuucug

SEQ ID NO: 1259252 - RNA, 20 nt, Human
gagucuugcucugucgccca

SEQ ID NO: 1259253 - RNA, 14 nt, Human
gagucuuugguucu

SEQ ID NO: 1259254 - RNA, 15 nt, Human
gagucuuugguucua

SEQ ID NO: 1259255 - RNA, 16 nt, Human
gagucuuugguucuaa

SEQ ID NO: 1259256 - RNA, 17 nt, Human
gagucuuugguucuaag

SEQ ID NO: 1259257 - RNA, 18 nt, Human
gagucuuugguucuaagg

SEQ ID NO: 1259258 - RNA, 22 nt, Human
gagucuuugguucuaaggaccu

SEQ ID NO: 1259259 - RNA, 14 nt, Human
gagugaauaaaugu

SEQ ID NO: 1259260 - RNA, 15 nt, Human
gagugaauaaauguc

SEQ ID NO: 1259261 - RNA, 19 nt, Human
gaguccuggaugauacuaa

SEQ ID NO: 1259262 - RNA, 14 nt, Human
gaguccuuaaaaug

SEQ ID NO: 1259263 - RNA, 22 nt, Human
gagucguggggugugcugggag

SEQ ID NO: 1259264 - RNA, 11 nt, Human
gagucuaaaga

SEQ ID NO: 1259265 - RNA, 12 nt, Human
gagucuaaagau

SEQ ID NO: 1259266 - RNA, 13 nt, Human
gagucuaaagaug

SEQ ID NO: 1259267 - RNA, 21 nt, Human
gagucuaaagauggaguuucu

SEQ ID NO: 1259268 - RNA, 22 nt, Human
gagucuaaagauggaguuucua

SEQ ID NO: 1259269 - RNA, 11 nt, Human
gagucuagaug

SEQ ID NO: 1259270 - RNA, 16 nt, Human
gagucuagauguuuau

SEQ ID NO: 1259271 - RNA, 11 nt, Human
gagucuagauu

SEQ ID NO: 1259272 - RNA, 21 nt, Human
gagucccugccuggaccagcc

SEQ ID NO: 1259273 - RNA, 23 nt, Human
gagucccugccuggaccagccuc

SEQ ID NO: 1259274 - RNA, 14 nt, Human
gaguauuaaaaugu

SEQ ID NO: 1259275 - RNA, 22 nt, Human
gaguauuaaaauguaugcaugu

SEQ ID NO: 1259276 - RNA, 23 nt, Human
gaguauuaaaauguaugcauguu

SEQ ID NO: 1259277 - RNA, 22 nt, Human
gaguaauccaagcaaaugugaa

SEQ ID NO: 1259278 - RNA, 17 nt, Human
gaguaacauuugcuguu

SEQ ID NO: 1259279 - RNA, 16 nt, Human
gaguaauaugccugcu

SEQ ID NO: 1259280 - RNA, 13 nt, Human
gaguaaucaaucu

SEQ ID NO: 1259281 - RNA, 14 nt, Human
gaguaaugguguag

SEQ ID NO: 1259282 - RNA, 17 nt, Human
gaguaaugguguagaac

SEQ ID NO: 1259283 - RNA, 19 nt, Human
gaguaaugguguagaacac

SEQ ID NO: 1259284 - RNA, 22 nt, Human
gaguaaugguguagaacacuaa

SEQ ID NO: 1259285 - RNA, 21 nt, Human
gaguacuccacacugcacaau

SEQ ID NO: 1259286 - RNA, 16 nt, Human
gaguacuccacacugc

SEQ ID NO: 1259287 - RNA, 17 nt, Human
gaguacuccacacugca

SEQ ID NO: 1259288 - RNA, 19 nt, Human
gaguagaaacugcagggaa

SEQ ID NO: 1259289 - RNA, 20 nt, Human
gaguacuccacacugcacaa

SEQ ID NO: 1259290 - RNA, 14 nt, Human
gaguagaauugcau

SEQ ID NO: 1259291 - RNA, 17 nt, Human
gaguagaauugcauuga

SEQ ID NO: 1259292 - RNA, 18 nt, Human
gagguugaaaaacaaaau

SEQ ID NO: 1259293 - RNA, 20 nt, Human
gaggugucucaggcugccug

SEQ ID NO: 1259294 - RNA, 13 nt, Human
gaggugucucagg

SEQ ID NO: 1259295 - RNA, 14 nt, Human
gaggugucucaggc

SEQ ID NO: 1259296 - RNA, 15 nt, Human
gaggugucucaggcu

SEQ ID NO: 1259297 - RNA, 16 nt, Human
gaggugucucaggcug

SEQ ID NO: 1259298 - RNA, 17 nt, Human
gaggugucucaggcugc

SEQ ID NO: 1259299 - RNA, 19 nt, Human
gaggugucucaggcugccu

SEQ ID NO: 1259300 - RNA, 16 nt, Human
gagguguggagccgag

SEQ ID NO: 1259301 - RNA, 14 nt, Human
gaggugggccgugg

SEQ ID NO: 1259302 - RNA, 15 nt, Human
gagguguccaacugg

SEQ ID NO: 1259303 - RNA, 16 nt, Human
gagguguccaacuggc

SEQ ID NO: 1259304 - RNA, 21 nt, Human
gaggucagcacaucucaacag

SEQ ID NO: 1259305 - RNA, 23 nt, Human
gaggucagcaugucuauucagcu

SEQ ID NO: 1259306 - RNA, 19 nt, Human
gaggugggccguggcccuu

SEQ ID NO: 1259307 - RNA, 14 nt, Human
gagguucuaaggcc

SEQ ID NO: 1259308 - RNA, 14 nt, Human
gagguugggugggc

SEQ ID NO: 1259309 - RNA, 15 nt, Human
gaguaacaauacaaa

SEQ ID NO: 1259310 - RNA, 19 nt, Human
gaguaacaauacaaaugga

SEQ ID NO: 1259311 - RNA, 20 nt, Human
gaguaacaauacaaauggau

SEQ ID NO: 1259312 - RNA, 21 nt, Human
gaguaacaauacaaauggauu

SEQ ID NO: 1259313 - RNA, 13 nt, Human
gaguaacauuugc

SEQ ID NO: 1259314 - RNA, 15 nt, Human
gaguaacauuugcug

SEQ ID NO: 1259315 - RNA, 16 nt, Human
gaguaacauuugcugu

SEQ ID NO: 1259316 - RNA, 12 nt, Human
gagguaaguuuu

SEQ ID NO: 1259317 - RNA, 22 nt, Human
gaggguuucauugucugugaag

SEQ ID NO: 1259318 - RNA, 20 nt, Human
gagggugguucaacaaagaa

SEQ ID NO: 1259319 - RNA, 13 nt, Human
gaggguguccugc

SEQ ID NO: 1259320 - RNA, 19 nt, Human
gagguauuuaucuuuacuu

SEQ ID NO: 1259321 - RNA, 16 nt, Human
gagggugaguuggcuu

SEQ ID NO: 1259322 - RNA, 13 nt, Human
gagggugggaagg

SEQ ID NO: 1259323 - RNA, 17 nt, Human
gagggucugggggcaca

SEQ ID NO: 1259324 - RNA, 15 nt, Human
gagggucggugccuu

SEQ ID NO: 1259325 - RNA, 21 nt, Human
gaggguaggagggugggaagg

SEQ ID NO: 1259326 - RNA, 13 nt, Human
gaggguaggcagg

SEQ ID NO: 1259327 - RNA, 14 nt, Human
gaggguaggcagga

SEQ ID NO: 1259328 - RNA, 15 nt, Human
gaggguaggcaggau

SEQ ID NO: 1259329 - RNA, 22 nt, Human
gaggguaggcaggauuggggaa

SEQ ID NO: 1259330 - RNA, 18 nt, Human
gaggguaggcaggauugg

SEQ ID NO: 1259331 - RNA, 22 nt, Human
gaggcugggaauggaggggcag

SEQ ID NO: 1259332 - RNA, 15 nt, Human
gaggcugguccuaug

SEQ ID NO: 1259333 - RNA, 18 nt, Human
gaggcugguccuauggcc

SEQ ID NO: 1259334 - RNA, 16 nt, Human
gaggcugguccuaugg

SEQ ID NO: 1259335 - RNA, 12 nt, Human
gaggcuguccug

SEQ ID NO: 1259336 - RNA, 14 nt, Human
gaggcuguccugua

SEQ ID NO: 1259337 - RNA, 23 nt, Human
gaggcuguggucacagcggaggu

SEQ ID NO: 1259338 - RNA, 21 nt, Human
gagggagacacuggccccuca

SEQ ID NO: 1259339 - RNA, 20 nt, Human
gagggagggggaaggcaggg

SEQ ID NO: 1259340 - RNA, 18 nt, Human
gagggagugaguggcccu

SEQ ID NO: 1259341 - RNA, 16 nt, Human
gagggaugaugaagag

SEQ ID NO: 1259342 - RNA, 15 nt, Human
gagggguaggggcug

SEQ ID NO: 1259343 - RNA, 17 nt, Human
gagggggaauggcagca

SEQ ID NO: 1259344 - RNA, 23 nt, Human
gaggggcuggggacuugugucug

SEQ ID NO: 1259345 - RNA, 15 nt, Human
gagggguuccucccc

SEQ ID NO: 1259346 - RNA, 22 nt, Human
gagggguuccuccccuccagcu

SEQ ID NO: 1259347 - RNA, 23 nt, Human
gagggguuccuccccuccagcuc

SEQ ID NO: 1259348 - RNA, 17 nt, Human
gagggguaggggcuggg

SEQ ID NO: 1259349 - RNA, 19 nt, Human
gagggguaggggcugggaa

SEQ ID NO: 1259350 - RNA, 15 nt, Human
gaggggugggcuggu

SEQ ID NO: 1259351 - RNA, 21 nt, Human
gagggguguggcuccuuccca

SEQ ID NO: 1259352 - RNA, 14 nt, Human
gagggcagcagcca

SEQ ID NO: 1259353 - RNA, 15 nt, Human
gagggcagcagccag

SEQ ID NO: 1259354 - RNA, 16 nt, Human
gagggcagcagccagc

SEQ ID NO: 1259355 - RNA, 17 nt, Human
gagggcagcagccagcc

SEQ ID NO: 1259356 - RNA, 20 nt, Human
gagggcagcagccagcccug

SEQ ID NO: 1259357 - RNA, 21 nt, Human
gagggcagcagccagcccugc

SEQ ID NO: 1259358 - RNA, 22 nt, Human
gagggcagcagccagcccugcc

SEQ ID NO: 1259359 - RNA, 23 nt, Human
gagggcagcagccagcccugccu

SEQ ID NO: 1259360 - RNA, 12 nt, Human
gagggcagcagg

SEQ ID NO: 1259361 - RNA, 14 nt, Human
gagggcagcagggc

SEQ ID NO: 1259362 - RNA, 15 nt, Human
gagggcagcagggcu

SEQ ID NO: 1259363 - RNA, 18 nt, Human
gagggauucugguuccag

SEQ ID NO: 1259364 - RNA, 21 nt, Human
gagggauucugguuccagggu

SEQ ID NO: 1259365 - RNA, 14 nt, Human
gagggggagagggc

SEQ ID NO: 1259366 - RNA, 17 nt, Human
gaggggcugugggcgug

SEQ ID NO: 1259367 - RNA, 16 nt, Human
gagggccacaugggag

SEQ ID NO: 1259368 - RNA, 16 nt, Human
gagggcagcagggcua

SEQ ID NO: 1259369 - RNA, 19 nt, Human
gagggcagcagggcuaccc

SEQ ID NO: 1259370 - RNA, 18 nt, Human
gagggcaguucgcagcca

SEQ ID NO: 1259371 - RNA, 19 nt, Human
gagggcaguucgcagccac

SEQ ID NO: 1259372 - RNA, 20 nt, Human
gagggcaguucgcagccacc

SEQ ID NO: 1259373 - RNA, 23 nt, Human
gagggcaguucgcagccacccug

SEQ ID NO: 1259374 - RNA, 23 nt, Human
gaggcugggaauggaggggcaga

SEQ ID NO: 1259375 - RNA, 24 nt, Human
gaggcugcucggggugcacaggag

SEQ ID NO: 1259376 - RNA, 23 nt, Human
gaggcugcucggggugcacagga

SEQ ID NO: 1259377 - RNA, 13 nt, Human
gaggcuggcacag

SEQ ID NO: 1259378 - RNA, 21 nt, Human
gaggcgcaugaauuugugaag

SEQ ID NO: 1259379 - RNA, 21 nt, Human
gaggcgaagcguuguccucag

SEQ ID NO: 1259380 - RNA, 19 nt, Human
gaggccuuucccuaagcca

SEQ ID NO: 1259381 - RNA, 22 nt, Human
gaggccuuucccuaagccagcu

SEQ ID NO: 1259382 - RNA, 17 nt, Human
gaggcgccccaacccgu

SEQ ID NO: 1259383 - RNA, 20 nt, Human
gaggcgccccaacccgugga

SEQ ID NO: 1259384 - RNA, 22 nt, Human
gaggcgccccaacccguggagg

SEQ ID NO: 1259385 - RNA, 21 nt, Human
gaggcgccccaacccguggag

SEQ ID NO: 1259386 - RNA, 13 nt, Human
gaggcugcucggg

SEQ ID NO: 1259387 - RNA, 18 nt, Human
gaggcugcucggggugca

SEQ ID NO: 1259388 - RNA, 21 nt, Human
gaggcugcucggggugcacag

SEQ ID NO: 1259389 - RNA, 22 nt, Human
gaggcugcucggggugcacagg

SEQ ID NO: 1259390 - RNA, 20 nt, Human
gaggcgaagcguuguccuca

SEQ ID NO: 1259391 - RNA, 18 nt, Human
gaggccugacugccaagc

SEQ ID NO: 1259392 - RNA, 19 nt, Human
gaggccugacugccaagcc

SEQ ID NO: 1259393 - RNA, 15 nt, Human
gaggccuaggagggu

SEQ ID NO: 1259394 - RNA, 18 nt, Human
gaggccuaccccgcagac

SEQ ID NO: 1259395 - RNA, 15 nt, Human
gaggccuagacucug

SEQ ID NO: 1259396 - RNA, 18 nt, Human
gaggccuaggaggguccu

SEQ ID NO: 1259397 - RNA, 19 nt, Human
gaggccauggacucugucc

SEQ ID NO: 1259398 - RNA, 20 nt, Human
gaggccauggacucuguccu

SEQ ID NO: 1259399 - RNA, 22 nt, Human
gaggccauggacucuguccuga

SEQ ID NO: 1259400 - RNA, 19 nt, Human
gaggccauugugugagccu

SEQ ID NO: 1259401 - RNA, 18 nt, Human
gaggcccacauuggaaga

SEQ ID NO: 1259402 - RNA, 20 nt, Human
gaggcccacauuggaagagc

SEQ ID NO: 1259403 - RNA, 13 nt, Human
gaggcccaggcug

SEQ ID NO: 1259404 - RNA, 14 nt, Human
gaggcccaggcugc

SEQ ID NO: 1259405 - RNA, 15 nt, Human
gaggcccaggcugcc

SEQ ID NO: 1259406 - RNA, 16 nt, Human
gaggcccaggcugccg

SEQ ID NO: 1259407 - RNA, 17 nt, Human
gaggcccaggcugccgu

SEQ ID NO: 1259408 - RNA, 23 nt, Human
gaggccccagccucccugaagcc

SEQ ID NO: 1259409 - RNA, 13 nt, Human
gaggccccagccg

SEQ ID NO: 1259410 - RNA, 18 nt, Human
gaggcccaggcugccguc

SEQ ID NO: 1259411 - RNA, 15 nt, Human
gaggcccaggcuggg

SEQ ID NO: 1259412 - RNA, 16 nt, Human
gaggcccaggcuggga

SEQ ID NO: 1259413 - RNA, 17 nt, Human
gaggcccaggcugggaa

SEQ ID NO: 1259414 - RNA, 23 nt, Human
gaggcccaggcugggaacucauc

SEQ ID NO: 1259415 - RNA, 13 nt, Human
gaggcccaguuca

SEQ ID NO: 1259416 - RNA, 18 nt, Human
gaggcccaguucacccug

SEQ ID NO: 1259417 - RNA, 20 nt, Human
gaggcccaguucacccugau

SEQ ID NO: 1259418 - RNA, 15 nt, Human
gaggccccaacccug

SEQ ID NO: 1259419 - RNA, 12 nt, Human
gaggccccagcc

SEQ ID NO: 1259420 - RNA, 13 nt, Human
gaggccccagccu

SEQ ID NO: 1259421 - RNA, 19 nt, Human
gaggccccagccucccuga

SEQ ID NO: 1259422 - RNA, 22 nt, Human
gaggccccagccucccugaagc

SEQ ID NO: 1259423 - RNA, 14 nt, Human
gaggcccccagccc

SEQ ID NO: 1259424 - RNA, 18 nt, Human
gaggcagagaagaaagaa

SEQ ID NO: 1259425 - RNA, 19 nt, Human
gaggcagagguugcaguga

SEQ ID NO: 1259426 - RNA, 14 nt, Human
gaggcagggaagga

SEQ ID NO: 1259427 - RNA, 23 nt, Human
gaggcagggaacauggggaggag

SEQ ID NO: 1259428 - RNA, 16 nt, Human
gaggcagagaagaaag

SEQ ID NO: 1259429 - RNA, 13 nt, Human
gaggcaaaagaag

SEQ ID NO: 1259430 - RNA, 22 nt, Human
gaggcaaugggagcugaggcca

SEQ ID NO: 1259431 - RNA, 23 nt, Human
gagcccuucuauacccacccaga

SEQ ID NO: 1259432 - RNA, 22 nt, Human
gagcccuucuauacccacccag

SEQ ID NO: 1259433 - RNA, 21 nt, Human
gagcccuucuauacccaccca

SEQ ID NO: 1259434 - RNA, 22 nt, Human
gagcccaggccaggacucugca

SEQ ID NO: 1259435 - RNA, 22 nt, Human
gagcccuguccugccuaaggcu

SEQ ID NO: 1259436 - RNA, 14 nt, Human
gagaugaggccaga

SEQ ID NO: 1259437 - RNA, 13 nt, Human
gagaugaggccag

SEQ ID NO: 1259438 - RNA, 15 nt, Human
gagaugaggccagac

SEQ ID NO: 1259439 - RNA, 22 nt, Human
gagaugauacauccaaagcaga

SEQ ID NO: 1259440 - RNA, 17 nt, Human
gagaugaggccgccaug

SEQ ID NO: 1259441 - RNA, 18 nt, Human
gagaucccaacacugcca

SEQ ID NO: 1259442 - RNA, 19 nt, Human
gagaucccaacacugccag

SEQ ID NO: 1259443 - RNA, 20 nt, Human
gagaucccaacacugccagc

SEQ ID NO: 1259444 - RNA, 18 nt, Human
gagauccagggcaaggcc

SEQ ID NO: 1259445 - RNA, 12 nt, Human
gagauccuccug

SEQ ID NO: 1259446 - RNA, 21 nt, Human
gagaucaccaguguguggcuu

SEQ ID NO: 1259447 - RNA, 21 nt, Human
gagauccaaaagaagccccca

SEQ ID NO: 1259448 - RNA, 22 nt, Human
gagauccaaaagaagcccccag

SEQ ID NO: 1259449 - RNA, 14 nt, Human
gagcagacuacagc

SEQ ID NO: 1259450 - RNA, 20 nt, Human
gagcacugccaggagggaca

SEQ ID NO: 1259451 - RNA, 18 nt, Human
gagcacugccaggaggga

SEQ ID NO: 1259452 - RNA, 19 nt, Human
gagcacugccaggagggac

SEQ ID NO: 1259453 - RNA, 23 nt, Human
gagcagacuggcggggggcccau

SEQ ID NO: 1259454 - RNA, 12 nt, Human
gagcacugccag

SEQ ID NO: 1259455 - RNA, 13 nt, Human
gagcacugccagg

SEQ ID NO: 1259456 - RNA, 14 nt, Human
gagcacugccagga

SEQ ID NO: 1259457 - RNA, 15 nt, Human
gagcacugccaggag

SEQ ID NO: 1259458 - RNA, 16 nt, Human
gagcacugccaggagg

SEQ ID NO: 1259459 - RNA, 17 nt, Human
gagcacugccaggaggg

SEQ ID NO: 1259460 - RNA, 13 nt, Human
gagcacggcucug

SEQ ID NO: 1259461 - RNA, 22 nt, Human
gagcacggcucuguccccagcc

SEQ ID NO: 1259462 - RNA, 23 nt, Human
gagcacggcucuguccccagccu

SEQ ID NO: 1259463 - RNA, 22 nt, Human
gagcacaagaggagauccaggg

SEQ ID NO: 1259464 - RNA, 20 nt, Human
gagcacaaagacccuggcuu

SEQ ID NO: 1259465 - RNA, 20 nt, Human
gagcaagaccccaucucaaa

SEQ ID NO: 1259466 - RNA, 23 nt, Human
gagcaaccguggcccuuccugga

SEQ ID NO: 1259467 - RNA, 15 nt, Human
gagcaaccguggccc

SEQ ID NO: 1259468 - RNA, 16 nt, Human
gagcaaccguggcccu

SEQ ID NO: 1259469 - RNA, 20 nt, Human
gagcaaccguggcccuuccu

SEQ ID NO: 1259470 - RNA, 21 nt, Human
gagcaaccguggcccuuccug

SEQ ID NO: 1259471 - RNA, 22 nt, Human
gagcaaccguggcccuuccugg

SEQ ID NO: 1259472 - RNA, 16 nt, Human
gagcacaaagacccug

SEQ ID NO: 1259473 - RNA, 18 nt, Human
gagcaagcaggaaucaga

SEQ ID NO: 1259474 - RNA, 17 nt, Human
gagccaagggauggaca

SEQ ID NO: 1259475 - RNA, 18 nt, Human
gagccaagggauggacau

SEQ ID NO: 1259476 - RNA, 19 nt, Human
gagccaagggauggacauc

SEQ ID NO: 1259477 - RNA, 22 nt, Human
gagccaagggauggacaucuug

SEQ ID NO: 1259478 - RNA, 18 nt, Human
gagccaaggggcuucagg

SEQ ID NO: 1259479 - RNA, 12 nt, Human
gagccaccaguu

SEQ ID NO: 1259480 - RNA, 15 nt, Human
gagcauuagauuucu

SEQ ID NO: 1259481 - RNA, 21 nt, Human
gagcauuagauuucucauuug

SEQ ID NO: 1259482 - RNA, 15 nt, Human
gagcauuucucauca

SEQ ID NO: 1259483 - RNA, 19 nt, Human
gagcauuucucaucaguag

SEQ ID NO: 1259484 - RNA, 20 nt, Human
gagcauuucucaucaguagu

SEQ ID NO: 1259485 - RNA, 14 nt, Human
gagccaagggaugg

SEQ ID NO: 1259486 - RNA, 15 nt, Human
gagccaagggaugga

SEQ ID NO: 1259487 - RNA, 16 nt, Human
gagccaagggauggac

SEQ ID NO: 1259488 - RNA, 13 nt, Human
gagcagcugagca

SEQ ID NO: 1259489 - RNA, 17 nt, Human
gagcagcgagccugcua

SEQ ID NO: 1259490 - RNA, 14 nt, Human
gagcagcugagcag

SEQ ID NO: 1259491 - RNA, 15 nt, Human
gagcagcugagcagg

SEQ ID NO: 1259492 - RNA, 16 nt, Human
gagcagcugagcaggg

SEQ ID NO: 1259493 - RNA, 17 nt, Human
gagcagcugagcagggc

SEQ ID NO: 1259494 - RNA, 18 nt, Human
gagcagcugagcagggcc

SEQ ID NO: 1259495 - RNA, 19 nt, Human
gagcagcugagcagggccg

SEQ ID NO: 1259496 - RNA, 20 nt, Human
gagcagcugagcagggccgg

SEQ ID NO: 1259497 - RNA, 14 nt, Human
gagcaggaauggga

SEQ ID NO: 1259498 - RNA, 15 nt, Human
gagcaggacuccagg

SEQ ID NO: 1259499 - RNA, 16 nt, Human
gagcaggacuccaggc

SEQ ID NO: 1259500 - RNA, 19 nt, Human
gagcaggacuccaggccca

SEQ ID NO: 1259501 - RNA, 20 nt, Human
gagcaggacuccaggcccaa

SEQ ID NO: 1259502 - RNA, 22 nt, Human
gagcauguuuagacuuuaacau

SEQ ID NO: 1259503 - RNA, 13 nt, Human
gagccaccaguuc

SEQ ID NO: 1259504 - RNA, 22 nt, Human
gagccagggucuccagaaagcc

SEQ ID NO: 1259505 - RNA, 17 nt, Human
gagccagggucuccaga

SEQ ID NO: 1259506 - RNA, 19 nt, Human
gagcccacuguccugggcc

SEQ ID NO: 1259507 - RNA, 24 nt, Human
gagcccacuguccugggccugcag

SEQ ID NO: 1259508 - RNA, 12 nt, Human
gagcccagcucc

SEQ ID NO: 1259509 - RNA, 13 nt, Human
gagcccagcucca

SEQ ID NO: 1259510 - RNA, 14 nt, Human
gagcccagcuccaa

SEQ ID NO: 1259511 - RNA, 12 nt, Human
gagcccagcucu

SEQ ID NO: 1259512 - RNA, 14 nt, Human
gagcccagcucuga

SEQ ID NO: 1259513 - RNA, 21 nt, Human
gagcccagcucugaaaccagu

SEQ ID NO: 1259514 - RNA, 13 nt, Human
gagcccagcuggg

SEQ ID NO: 1259515 - RNA, 19 nt, Human
gagcccagcugggucaggc

SEQ ID NO: 1259516 - RNA, 21 nt, Human
gagcccagcugggucaggcag

SEQ ID NO: 1259517 - RNA, 22 nt, Human
gagcccagcugggucaggcagg

SEQ ID NO: 1259518 - RNA, 12 nt, Human
gagcccaggagc

SEQ ID NO: 1259519 - RNA, 13 nt, Human
gagcccaggagcu

SEQ ID NO: 1259520 - RNA, 17 nt, Human
gagcccaggagcucccc

SEQ ID NO: 1259521 - RNA, 21 nt, Human
gagcccaggagcuccccuccc

SEQ ID NO: 1259522 - RNA, 13 nt, Human
gagcccaggccag

SEQ ID NO: 1259523 - RNA, 16 nt, Human
gagcccaggccaggac

SEQ ID NO: 1259524 - RNA, 17 nt, Human
gagcccaggccaggacu

SEQ ID NO: 1259525 - RNA, 18 nt, Human
gagcccaggccaggacuc

SEQ ID NO: 1259526 - RNA, 21 nt, Human
gagcccaggccaggacucugc

SEQ ID NO: 1259527 - RNA, 23 nt, Human
gagcccaggccaggacucugcag

SEQ ID NO: 1259528 - RNA, 20 nt, Human
gagaaugagagacacacuga

SEQ ID NO: 1259529 - RNA, 21 nt, Human
gagaaugagagacacacugaa

SEQ ID NO: 1259530 - RNA, 15 nt, Human
gagaagccagcuugu

SEQ ID NO: 1259531 - RNA, 20 nt, Human
gagaaugcccuucuccuuau

SEQ ID NO: 1259532 - RNA, 20 nt, Human
gagacagcucugcauacuca

SEQ ID NO: 1259533 - RNA, 19 nt, Human
gagaauggcuuuggucucu

SEQ ID NO: 1259534 - RNA, 19 nt, Human
gagacaggguuucaccaug

SEQ ID NO: 1259535 - RNA, 16 nt, Human
gagacaguucaagaaa

SEQ ID NO: 1259536 - RNA, 18 nt, Human
gagacaguucaagaaagc

SEQ ID NO: 1259537 - RNA, 15 nt, Human
gagacuggguaggaa

SEQ ID NO: 1259538 - RNA, 15 nt, Human
gagacugggcugagg

SEQ ID NO: 1259539 - RNA, 17 nt, Human
gagacugggcugaggga

SEQ ID NO: 1259540 - RNA, 20 nt, Human
gagacugggcugagggagcc

SEQ ID NO: 1259541 - RNA, 21 nt, Human
gagacugggcugagggagccu

SEQ ID NO: 1259542 - RNA, 14 nt, Human
gagacugggaaggc

SEQ ID NO: 1259543 - RNA, 17 nt, Human
gagacugggaaggcuug

SEQ ID NO: 1259544 - RNA, 22 nt, Human
gagacugggaaggcuugggauu

SEQ ID NO: 1259545 - RNA, 13 nt, Human
gagacugggcuga

SEQ ID NO: 1259546 - RNA, 14 nt, Human
gagacugggcugag

SEQ ID NO: 1259547 - RNA, 14 nt, Human
gagagaaaggacuc

SEQ ID NO: 1259548 - RNA, 16 nt, Human
gagagaaaggacuccu

SEQ ID NO: 1259549 - RNA, 11 nt, Human
gagagugugac

SEQ ID NO: 1259550 - RNA, 15 nt, Human
gagauaccagcgagg

SEQ ID NO: 1259551 - RNA, 16 nt, Human
gagaguggcuccuccc

SEQ ID NO: 1259552 - RNA, 21 nt, Human
gagaguggcuccucccggugc

SEQ ID NO: 1259553 - RNA, 14 nt, Human
gagaguggcugggg

SEQ ID NO: 1259554 - RNA, 17 nt, Human
gagaguggcuggggcau

SEQ ID NO: 1259555 - RNA, 20 nt, Human
gagaguggcuggggcaugga

SEQ ID NO: 1259556 - RNA, 12 nt, Human
gagagugggggu

SEQ ID NO: 1259557 - RNA, 15 nt, Human
gagaguggggguggg

SEQ ID NO: 1259558 - RNA, 16 nt, Human
gagagucuagauucuc

SEQ ID NO: 1259559 - RNA, 13 nt, Human
gagagucuagauu

SEQ ID NO: 1259560 - RNA, 20 nt, Human
gagaggggccgaugcccaga

SEQ ID NO: 1259561 - RNA, 21 nt, Human
gagaggggccgaugcccagag

SEQ ID NO: 1259562 - RNA, 13 nt, Human
gagagggggcugg

SEQ ID NO: 1259563 - RNA, 19 nt, Human
gagagggggcuggugggug

SEQ ID NO: 1259564 - RNA, 17 nt, Human
gagaguaaugaggcuug

SEQ ID NO: 1259565 - RNA, 13 nt, Human
gagagacgggccc

SEQ ID NO: 1259566 - RNA, 12 nt, Human
gagagacuuguu

SEQ ID NO: 1259567 - RNA, 20 nt, Human
gagagacuuguuuuggaugc

SEQ ID NO: 1259568 - RNA, 21 nt, Human
gagagaaauaagugcccucuc

SEQ ID NO: 1259569 - RNA, 18 nt, Human
gagagacacuggugggga

SEQ ID NO: 1259570 - RNA, 16 nt, Human
gagagacacugguggg

SEQ ID NO: 1259571 - RNA, 19 nt, Human
gagagagcuucuguugcug

SEQ ID NO: 1259572 - RNA, 22 nt, Human
gagagagcuucuguugcugccu

SEQ ID NO: 1259573 - RNA, 16 nt, Human
gagagcccuucauuug

SEQ ID NO: 1259574 - RNA, 14 nt, Human
gagagcccugaggc

SEQ ID NO: 1259575 - RNA, 19 nt, Human
gagagcccugaggccuaga

SEQ ID NO: 1259576 - RNA, 13 nt, Human
gagagcccuggga

SEQ ID NO: 1259577 - RNA, 14 nt, Human
gagagcccugggac

SEQ ID NO: 1259578 - RNA, 15 nt, Human
gagagcccugggacc

SEQ ID NO: 1259579 - RNA, 14 nt, Human
gagagccugcagga

SEQ ID NO: 1259580 - RNA, 17 nt, Human
gagagccugcaggaucu

SEQ ID NO: 1259581 - RNA, 14 nt, Human
gagagcccaggagc

SEQ ID NO: 1259582 - RNA, 15 nt, Human
gagagcccaggagcu

SEQ ID NO: 1259583 - RNA, 16 nt, Human
gagagcccaggagcuc

SEQ ID NO: 1259584 - RNA, 20 nt, Human
gagagcccaggagcuccccu

SEQ ID NO: 1259585 - RNA, 23 nt, Human
gagagcccgaggaggugucucag

SEQ ID NO: 1259586 - RNA, 14 nt, Human
gagagaucaaagau

SEQ ID NO: 1259587 - RNA, 15 nt, Human
gagagaucaaagaug

SEQ ID NO: 1259588 - RNA, 12 nt, Human
gagagaugugug

SEQ ID NO: 1259589 - RNA, 13 nt, Human
gagagaugugugu

SEQ ID NO: 1259590 - RNA, 14 nt, Human
gagagauguguguu

SEQ ID NO: 1259591 - RNA, 22 nt, Human
gagagauguguguugauacugu

SEQ ID NO: 1259592 - RNA, 22 nt, Human
gagagcaagggaagugguucuu

SEQ ID NO: 1259593 - RNA, 16 nt, Human
gagagcagaggucucc

SEQ ID NO: 1259594 - RNA, 17 nt, Human
gagaaugagagacacac

SEQ ID NO: 1259595 - RNA, 11 nt, Human
gagaagccagc

SEQ ID NO: 1259596 - RNA, 13 nt, Human
gagaagccagcuu

SEQ ID NO: 1259597 - RNA, 14 nt, Human
gagaagccagcuug

SEQ ID NO: 1259598 - RNA, 18 nt, Human
gagaagcauucucauugg

SEQ ID NO: 1259599 - RNA, 22 nt, Human
gagaagaaagaggugaccccag

SEQ ID NO: 1259600 - RNA, 22 nt, Human
gagaacuuccagauccuggaaa

SEQ ID NO: 1259601 - RNA, 23 nt, Human
gagaacuuccagauccuggaaau

SEQ ID NO: 1259602 - RNA, 21 nt, Human
gagaaccuggguugcagacag

SEQ ID NO: 1259603 - RNA, 21 nt, Human
gagaagaaagaacggaagaag

SEQ ID NO: 1259604 - RNA, 16 nt, Human
gagaagaaagaacgga

SEQ ID NO: 1259605 - RNA, 13 nt, Human
gagaagaacugaa

SEQ ID NO: 1259606 - RNA, 14 nt, Human
gagaaauuuauaaa

SEQ ID NO: 1259607 - RNA, 12 nt, Human
gagaaccuggcc

SEQ ID NO: 1259608 - RNA, 13 nt, Human
gagaaccuggccu

SEQ ID NO: 1259609 - RNA, 14 nt, Human
gagaaccuggccuu

SEQ ID NO: 1259610 - RNA, 15 nt, Human
gagaaccuggccuuc

SEQ ID NO: 1259611 - RNA, 16 nt, Human
gagaaccuggccuuca

SEQ ID NO: 1259612 - RNA, 23 nt, Human
gagaaccuggguugcagacagga

SEQ ID NO: 1259613 - RNA, 21 nt, Human
gagaaccuagggugauauuaa

SEQ ID NO: 1259614 - RNA, 22 nt, Human
gagaaccuagggugauauuaac

SEQ ID NO: 1259615 - RNA, 21 nt, Human
gagaaaugaaaaaauauauau

SEQ ID NO: 1259616 - RNA, 17 nt, Human
gagaaauucguguguuu

SEQ ID NO: 1259617 - RNA, 19 nt, Human
gagaaauucguguguuuuu

SEQ ID NO: 1259618 - RNA, 17 nt, Human
gagaaaggggagcccac

SEQ ID NO: 1259619 - RNA, 18 nt, Human
gagaaaggggagcccacu

SEQ ID NO: 1259620 - RNA, 14 nt, Human
gagaaagcucaaag

SEQ ID NO: 1259621 - RNA, 13 nt, Human
gagaaagcugacu

SEQ ID NO: 1259622 - RNA, 15 nt, Human
gagaaagcugacuug

SEQ ID NO: 1259623 - RNA, 20 nt, Human
gagaaagcugacuuggcugg

SEQ ID NO: 1259624 - RNA, 22 nt, Human
gagaaagcugacuuggcuggug

SEQ ID NO: 1259625 - RNA, 21 nt, Human
gagaaagcugacuuggcuggu

SEQ ID NO: 1259626 - RNA, 21 nt, Human
gagaaagggcccugggccugc

SEQ ID NO: 1259627 - RNA, 16 nt, Human
gacuugaagacuuaca

SEQ ID NO: 1259628 - RNA, 13 nt, Human
gacuugaaagaaa

SEQ ID NO: 1259629 - RNA, 15 nt, Human
gacuuggccccugcc

SEQ ID NO: 1259630 - RNA, 12 nt, Human
gacuuggccucu

SEQ ID NO: 1259631 - RNA, 13 nt, Human
gacuuggccucuc

SEQ ID NO: 1259632 - RNA, 14 nt, Human
gacuuggccucucu

SEQ ID NO: 1259633 - RNA, 15 nt, Human
gacuuggccucucuc

SEQ ID NO: 1259634 - RNA, 16 nt, Human
gacuugacaguggaac

SEQ ID NO: 1259635 - RNA, 14 nt, Human
gacuuggcuggugu

SEQ ID NO: 1259636 - RNA, 22 nt, Human
gacuuggcuggugugguacaga

SEQ ID NO: 1259637 - RNA, 23 nt, Human
gacuuggcuggugugguacagag

SEQ ID NO: 1259638 - RNA, 14 nt, Human
gacuugggcacccc

SEQ ID NO: 1259639 - RNA, 18 nt, Human
gacuugggcacccccagc

SEQ ID NO: 1259640 - RNA, 19 nt, Human
gacuugggcacccccagcc

SEQ ID NO: 1259641 - RNA, 20 nt, Human
gacuugggcacccccagccu

SEQ ID NO: 1259642 - RNA, 21 nt, Human
gacuugggcacccccagccug

SEQ ID NO: 1259643 - RNA, 23 nt, Human
gacuugggcacccccagccuggg

SEQ ID NO: 1259644 - RNA, 22 nt, Human
gacuugggcacccccagccugg

SEQ ID NO: 1259645 - RNA, 15 nt, Human
gacuugguugguagg

SEQ ID NO: 1259646 - RNA, 17 nt, Human
gacuugguugguagggu

SEQ ID NO: 1259647 - RNA, 20 nt, Human
gacuugguugguaggguggg

SEQ ID NO: 1259648 - RNA, 15 nt, Human
gagaaaaccuguucu

SEQ ID NO: 1259649 - RNA, 16 nt, Human
gagaaaacuaaagaaa

SEQ ID NO: 1259650 - RNA, 20 nt, Human
gacuuaagcaucuggcucua

SEQ ID NO: 1259651 - RNA, 22 nt, Human
gacuuaagcaucuggcucuaau

SEQ ID NO: 1259652 - RNA, 21 nt, Human
gacuuaagcccagugcacuga

SEQ ID NO: 1259653 - RNA, 19 nt, Human
gacuuaaaauauuccugca

SEQ ID NO: 1259654 - RNA, 17 nt, Human
gacuucuauuuuaaaga

SEQ ID NO: 1259655 - RNA, 14 nt, Human
gacuucucuuugcc

SEQ ID NO: 1259656 - RNA, 18 nt, Human
gacuucucuuugccucaa

SEQ ID NO: 1259657 - RNA, 12 nt, Human
gacuucugagau

SEQ ID NO: 1259658 - RNA, 13 nt, Human
gacuucugccugg

SEQ ID NO: 1259659 - RNA, 14 nt, Human
gacuucugccugga

SEQ ID NO: 1259660 - RNA, 15 nt, Human
gacuucugccuggag

SEQ ID NO: 1259661 - RNA, 16 nt, Human
gacuucugccuggaga

SEQ ID NO: 1259662 - RNA, 17 nt, Human
gacuucugccuggagac

SEQ ID NO: 1259663 - RNA, 13 nt, Human
gacuucugagauc

SEQ ID NO: 1259664 - RNA, 13 nt, Human
gacuucuggggua

SEQ ID NO: 1259665 - RNA, 17 nt, Human
gacuggguaggaaagag

SEQ ID NO: 1259666 - RNA, 14 nt, Human
gacuggggcagggu

SEQ ID NO: 1259667 - RNA, 11 nt, Human
gacuggggcag

SEQ ID NO: 1259668 - RNA, 13 nt, Human
gacuggggcaggg

SEQ ID NO: 1259669 - RNA, 23 nt, Human
gacugggagcccccagccuguca

SEQ ID NO: 1259670 - RNA, 22 nt, Human
gacugggagcccccagccuguc

SEQ ID NO: 1259671 - RNA, 14 nt, Human
gacugggcugaggg

SEQ ID NO: 1259672 - RNA, 15 nt, Human
gacugggcugaggga

SEQ ID NO: 1259673 - RNA, 16 nt, Human
gacugggcugagggag

SEQ ID NO: 1259674 - RNA, 21 nt, Human
gacugggcugagggagccugg

SEQ ID NO: 1259675 - RNA, 21 nt, Human
gacuggaagcuaauuugcauu

SEQ ID NO: 1259676 - RNA, 20 nt, Human
gacuggaagcuaauuugcau

SEQ ID NO: 1259677 - RNA, 13 nt, Human
gacuggacagcuu

SEQ ID NO: 1259678 - RNA, 14 nt, Human
gacuggacagcuug

SEQ ID NO: 1259679 - RNA, 21 nt, Human
gacuggacagcuuguggcaag

SEQ ID NO: 1259680 - RNA, 15 nt, Human
gacuggacagcuugu

SEQ ID NO: 1259681 - RNA, 20 nt, Human
gacugcuugcccuaagcaga

SEQ ID NO: 1259682 - RNA, 21 nt, Human
gacugcuugcccuaagcagaa

SEQ ID NO: 1259683 - RNA, 22 nt, Human
gacugcuugcccuaagcagaaa

SEQ ID NO: 1259684 - RNA, 23 nt, Human
gacugcuugcccuaagcagaaag

SEQ ID NO: 1259685 - RNA, 21 nt, Human
gacugcuuuggaccuaaaugg

SEQ ID NO: 1259686 - RNA, 15 nt, Human
gacuggaacacuaga

SEQ ID NO: 1259687 - RNA, 15 nt, Human
gacugcugguuugua

SEQ ID NO: 1259688 - RNA, 16 nt, Human
gacugcugguuuguag

SEQ ID NO: 1259689 - RNA, 12 nt, Human
gacugcuguggc

SEQ ID NO: 1259690 - RNA, 15 nt, Human
gacugcuguggccag

SEQ ID NO: 1259691 - RNA, 16 nt, Human
gacugcuguggccagg

SEQ ID NO: 1259692 - RNA, 17 nt, Human
gacugcuguggccagga

SEQ ID NO: 1259693 - RNA, 18 nt, Human
gacugcuguggccaggag

SEQ ID NO: 1259694 - RNA, 20 nt, Human
gacugcuguggccaggaggu

SEQ ID NO: 1259695 - RNA, 19 nt, Human
gacugcuguggccaggagg

SEQ ID NO: 1259696 - RNA, 12 nt, Human
gacugcuugccc

SEQ ID NO: 1259697 - RNA, 13 nt, Human
gacugcuugcccu

SEQ ID NO: 1259698 - RNA, 15 nt, Human
gacugcuugcccuaa

SEQ ID NO: 1259699 - RNA, 17 nt, Human
gacugcuugcccuaagc

SEQ ID NO: 1259700 - RNA, 18 nt, Human
gacugcuugcccuaagca

SEQ ID NO: 1259701 - RNA, 24 nt, Human
gacugcauuauauuuauuacugua

SEQ ID NO: 1259702 - RNA, 14 nt, Human
gacugcauuauauu

SEQ ID NO: 1259703 - RNA, 16 nt, Human
gacugcauuauauuua

SEQ ID NO: 1259704 - RNA, 15 nt, Human
gacucuauucuuuaa

SEQ ID NO: 1259705 - RNA, 14 nt, Human
gacugagugggaag

SEQ ID NO: 1259706 - RNA, 15 nt, Human
gacugagugggaagc

SEQ ID NO: 1259707 - RNA, 16 nt, Human
gacucuagaguccaag

SEQ ID NO: 1259708 - RNA, 18 nt, Human
gacucuagaguccaaggu

SEQ ID NO: 1259709 - RNA, 19 nt, Human
gacucuagaguccaagguu

SEQ ID NO: 1259710 - RNA, 18 nt, Human
gacucuauucuuuaacuc

SEQ ID NO: 1259711 - RNA, 14 nt, Human
gacucuauucuuua

SEQ ID NO: 1259712 - RNA, 14 nt, Human
gacucucagucucu

SEQ ID NO: 1259713 - RNA, 16 nt, Human
gacucucagucucuga

SEQ ID NO: 1259714 - RNA, 18 nt, Human
gacucucagucucugagc

SEQ ID NO: 1259715 - RNA, 20 nt, Human
gacucucagucucugagcag

SEQ ID NO: 1259716 - RNA, 14 nt, Human
gacuccucugucca

SEQ ID NO: 1259717 - RNA, 11 nt, Human
gacuccucugu

SEQ ID NO: 1259718 - RNA, 16 nt, Human
gacuccuccuuuuucc

SEQ ID NO: 1259719 - RNA, 13 nt, Human
gacuccuccuuuu

SEQ ID NO: 1259720 - RNA, 17 nt, Human
gacuccuccuuuuucca

SEQ ID NO: 1259721 - RNA, 23 nt, Human
gacuccugcacacgcuccuuccu

SEQ ID NO: 1259722 - RNA, 17 nt, Human
gacuccguuggccacuc

SEQ ID NO: 1259723 - RNA, 16 nt, Human
gacuccguuggccacu

SEQ ID NO: 1259724 - RNA, 14 nt, Human
gacuccuagcuguc

SEQ ID NO: 1259725 - RNA, 19 nt, Human
gacuccuagcuguccuuuu

SEQ ID NO: 1259726 - RNA, 15 nt, Human
gacuccuagcugucc

SEQ ID NO: 1259727 - RNA, 17 nt, Human
gaccucaagugaucugc

SEQ ID NO: 1259728 - RNA, 18 nt, Human
gacuacagucaggaaagg

SEQ ID NO: 1259729 - RNA, 15 nt, Human
gaccuacuguucuaa

SEQ ID NO: 1259730 - RNA, 17 nt, Human
gaccuacuguucuaaag

SEQ ID NO: 1259731 - RNA, 18 nt, Human
gaccuacuguucuaaagc

SEQ ID NO: 1259732 - RNA, 20 nt, Human
gaccuauaccuguguuucuu

SEQ ID NO: 1259733 - RNA, 16 nt, Human
gaccuauaccuguguu

SEQ ID NO: 1259734 - RNA, 12 nt, Human
gacucagcucug

SEQ ID NO: 1259735 - RNA, 12 nt, Human
gacucagccuuc

SEQ ID NO: 1259736 - RNA, 14 nt, Human
gacucagccuucag

SEQ ID NO: 1259737 - RNA, 15 nt, Human
gacucagccuucaga

SEQ ID NO: 1259738 - RNA, 19 nt, Human
gacucagccuucagacaga

SEQ ID NO: 1259739 - RNA, 20 nt, Human
gacucagccuucagacagag

SEQ ID NO: 1259740 - RNA, 14 nt, Human
gacuagaugaugga

SEQ ID NO: 1259741 - RNA, 16 nt, Human
gacuagaugauggaug

SEQ ID NO: 1259742 - RNA, 21 nt, Human
gacuagaugauggaugccaau

SEQ ID NO: 1259743 - RNA, 17 nt, Human
gacuagauggaccugcc

SEQ ID NO: 1259744 - RNA, 17 nt, Human
gacuagauguaguauuu

SEQ ID NO: 1259745 - RNA, 18 nt, Human
gacuagauguaguauuuu

SEQ ID NO: 1259746 - RNA, 18 nt, Human
gacucagacauuggcacc

SEQ ID NO: 1259747 - RNA, 11 nt, Human
gaauguaauca

SEQ ID NO: 1259748 - RNA, 13 nt, Human
gaauguaaucaau

SEQ ID NO: 1259749 - RNA, 16 nt, Human
gaauguaaucaauguu

SEQ ID NO: 1259750 - RNA, 18 nt, Human
gaauguaaucaauguuuc

SEQ ID NO: 1259751 - RNA, 19 nt, Human
gaauguaaucaauguuucu

SEQ ID NO: 1259752 - RNA, 17 nt, Human
gaauggcuauguuuuua

SEQ ID NO: 1259753 - RNA, 19 nt, Human
gaauggcuauguuuuuaau

SEQ ID NO: 1259754 - RNA, 13 nt, Human
gaaugugaagccu

SEQ ID NO: 1259755 - RNA, 14 nt, Human
gaaugugaagccuu

SEQ ID NO: 1259756 - RNA, 15 nt, Human
gaaugugaagccuuc

SEQ ID NO: 1259757 - RNA, 16 nt, Human
gaaugugaagccuucc

SEQ ID NO: 1259758 - RNA, 20 nt, Human
gaaugugaagccuuccccuu

SEQ ID NO: 1259759 - RNA, 19 nt, Human
gaaugugauaaggaaauca

SEQ ID NO: 1259760 - RNA, 18 nt, Human
gaaugugauaaggaaauc

SEQ ID NO: 1259761 - RNA, 18 nt, Human
gaauguggcuugagaaau

SEQ ID NO: 1259762 - RNA, 22 nt, Human
gaauguggccccugaacaagaa

SEQ ID NO: 1259763 - RNA, 12 nt, Human
gaaugugucuuu

SEQ ID NO: 1259764 - RNA, 13 nt, Human
gaaugugucuuua

SEQ ID NO: 1259765 - RNA, 14 nt, Human
gaaugugucuuuag

SEQ ID NO: 1259766 - RNA, 15 nt, Human
gaaugugucuuuaga

SEQ ID NO: 1259767 - RNA, 13 nt, Human
gaauguguuucac

SEQ ID NO: 1259768 - RNA, 14 nt, Human
gaauguguuucaca

SEQ ID NO: 1259769 - RNA, 20 nt, Human
gaauguguuucacaguuuga

SEQ ID NO: 1259770 - RNA, 21 nt, Human
gaauguguuucacaguuugaa

SEQ ID NO: 1259771 - RNA, 22 nt, Human
gaauguguuucacaguuugaaa

SEQ ID NO: 1259772 - RNA, 20 nt, Human
gaauguuaagacuugacagu

SEQ ID NO: 1259773 - RNA, 16 nt, Human
gaauuggagcucgugg

SEQ ID NO: 1259774 - RNA, 22 nt, Human
gaauugauuugcauugaacaca

SEQ ID NO: 1259775 - RNA, 14 nt, Human
gaauugcagaguac

SEQ ID NO: 1259776 - RNA, 12 nt, Human
gaauugcauuga

SEQ ID NO: 1259777 - RNA, 13 nt, Human
gaauugcauugac

SEQ ID NO: 1259778 - RNA, 21 nt, Human
gaauugacccacaagaaauga

SEQ ID NO: 1259779 - RNA, 16 nt, Human
gaauugacccacaaga

SEQ ID NO: 1259780 - RNA, 14 nt, Human
gaauguugggacug

SEQ ID NO: 1259781 - RNA, 20 nt, Human
gaauguuuacacucuuugua

SEQ ID NO: 1259782 - RNA, 21 nt, Human
gaauguuuacacucuuuguaa

SEQ ID NO: 1259783 - RNA, 14 nt, Human
gaauguucucagau

SEQ ID NO: 1259784 - RNA, 20 nt, Human
gaauguugauuacagugcag

SEQ ID NO: 1259785 - RNA, 23 nt, Human
gaauguugggacugcuaaauaaa

SEQ ID NO: 1259786 - RNA, 18 nt, Human
gaaugcacaagaauggau

SEQ ID NO: 1259787 - RNA, 19 nt, Human
gaaugcacaagaauggauc

SEQ ID NO: 1259788 - RNA, 21 nt, Human
gaaugcacaagaauggaucac

SEQ ID NO: 1259789 - RNA, 15 nt, Human
gaaugcuguauaugu

SEQ ID NO: 1259790 - RNA, 20 nt, Human
gaaugcacaagaauggauca

SEQ ID NO: 1259791 - RNA, 23 nt, Human
gaaugcuuaaagaauucaaauuu

SEQ ID NO: 1259792 - RNA, 21 nt, Human
gaaugcuuaaagaauucaaau

SEQ ID NO: 1259793 - RNA, 14 nt, Human
gaaugcuucuaagu

SEQ ID NO: 1259794 - RNA, 22 nt, Human
gaaugcuucuaaguaaauacaa

SEQ ID NO: 1259795 - RNA, 23 nt, Human
gaaugcuucuaaguaaauacaau

SEQ ID NO: 1259796 - RNA, 11 nt, Human
gaauggcagca

SEQ ID NO: 1259797 - RNA, 20 nt, Human
gaaugaacacucuuuugcuu

SEQ ID NO: 1259798 - RNA, 23 nt, Human
gaaugaaauccugcuucagugua

SEQ ID NO: 1259799 - RNA, 17 nt, Human
gaaucuauauuuaacaa

SEQ ID NO: 1259800 - RNA, 13 nt, Human
gaaucucugugcc

SEQ ID NO: 1259801 - RNA, 14 nt, Human
gaaucucugugccu

SEQ ID NO: 1259802 - RNA, 15 nt, Human
gaaucucugugccuu

SEQ ID NO: 1259803 - RNA, 18 nt, Human
gaaucucuuuuugcuuuc

SEQ ID NO: 1259804 - RNA, 15 nt, Human
gaaucugcaauucaa

SEQ ID NO: 1259805 - RNA, 21 nt, Human
gaaucugcaauucaaaaguuc

SEQ ID NO: 1259806 - RNA, 22 nt, Human
gaaucugcaauucaaaaguucc

SEQ ID NO: 1259807 - RNA, 14 nt, Human
gaaaggccagcacu

SEQ ID NO: 1259808 - RNA, 15 nt, Human
gaaaggccagcacuc

SEQ ID NO: 1259809 - RNA, 16 nt, Human
gaaaggccagcacucg

SEQ ID NO: 1259810 - RNA, 21 nt, Human
gaaucaggaauauuuuccaaa

SEQ ID NO: 1259811 - RNA, 23 nt, Human
gaaucaggaauauuuuccaaaga

SEQ ID NO: 1259812 - RNA, 17 nt, Human
gaaucaguuuaaaagca

SEQ ID NO: 1259813 - RNA, 16 nt, Human
gaaucccaaauuugau

SEQ ID NO: 1259814 - RNA, 17 nt, Human
gaaucccaaauuugauu

SEQ ID NO: 1259815 - RNA, 19 nt, Human
gaaucccaaauuugauuga

SEQ ID NO: 1259816 - RNA, 22 nt, Human
gaauccugucgauuagacugga

SEQ ID NO: 1259817 - RNA, 12 nt, Human
gaauccuuucag

SEQ ID NO: 1259818 - RNA, 16 nt, Human
gaaucgcuccugcagc

SEQ ID NO: 1259819 - RNA, 20 nt, Human
gaaucgcuccugcagcccca

SEQ ID NO: 1259820 - RNA, 18 nt, Human
gaaucuacccccagaucc

SEQ ID NO: 1259821 - RNA, 22 nt, Human
gaaucuacccccagauccaagc

SEQ ID NO: 1259822 - RNA, 15 nt, Human
gaaucuacuaauucc

SEQ ID NO: 1259823 - RNA, 13 nt, Human
gaaucuauauuua

SEQ ID NO: 1259824 - RNA, 20 nt, Human
gaauuugugaagguggaaau

SEQ ID NO: 1259825 - RNA, 20 nt, Human
gaauuuguaaugucuugagc

SEQ ID NO: 1259826 - RNA, 14 nt, Human
gaauuugccugcug

SEQ ID NO: 1259827 - RNA, 18 nt, Human
gaauuuggggcuuccaag

SEQ ID NO: 1259828 - RNA, 19 nt, Human
gaauuuggggcuuccaagu

SEQ ID NO: 1259829 - RNA, 17 nt, Human
gaauuugagugcucuga

SEQ ID NO: 1259830 - RNA, 20 nt, Human
gaauuugccugcugggauuc

SEQ ID NO: 1259831 - RNA, 20 nt, Human
gaauuugauaugugaacagu

SEQ ID NO: 1259832 - RNA, 21 nt, Human
gaauuucuucaacucccugcc

SEQ ID NO: 1259833 - RNA, 19 nt, Human
gaauuucuuaacuucuugc

SEQ ID NO: 1259834 - RNA, 21 nt, Human
gaauuucuuaacuucuugcuu

SEQ ID NO: 1259835 - RNA, 19 nt, Human
gaauuucuaggacugaauu

SEQ ID NO: 1259836 - RNA, 20 nt, Human
gaauuucuaggacugaauua

SEQ ID NO: 1259837 - RNA, 16 nt, Human
gaauuguaacuguucu

SEQ ID NO: 1259838 - RNA, 14 nt, Human
gaauuucccucucu

SEQ ID NO: 1259839 - RNA, 13 nt, Human
gaauuucuuaacu

SEQ ID NO: 1259840 - RNA, 14 nt, Human
gaauuucuuaacuu

SEQ ID NO: 1259841 - RNA, 15 nt, Human
gaauuucuuaacuuc

SEQ ID NO: 1259842 - RNA, 16 nt, Human
gaauuucuuaacuucu

SEQ ID NO: 1259843 - RNA, 17 nt, Human
gaauuucuuaacuucuu

SEQ ID NO: 1259844 - RNA, 18 nt, Human
gaauuucuuaacuucuug

SEQ ID NO: 1259845 - RNA, 17 nt, Human
gaauugggagcuuggga

SEQ ID NO: 1259846 - RNA, 24 nt, Human
gaauugcuuguuugcuucaacugu

SEQ ID NO: 1259847 - RNA, 16 nt, Human
gaauugggagcuuggg

SEQ ID NO: 1259848 - RNA, 16 nt, Human
gacaacacccauuuuu

SEQ ID NO: 1259849 - RNA, 16 nt, Human
gacaaaucacauauuu

SEQ ID NO: 1259850 - RNA, 18 nt, Human
gacaaaucacauauuuua

SEQ ID NO: 1259851 - RNA, 20 nt, Human
gacaaaucacauauuuuaaa

SEQ ID NO: 1259852 - RNA, 16 nt, Human
gacaacagacuucuga

SEQ ID NO: 1259853 - RNA, 20 nt, Human
gacaacagguaaaacagggc

SEQ ID NO: 1259854 - RNA, 22 nt, Human
gacaacauuucuauagccaaaa

SEQ ID NO: 1259855 - RNA, 15 nt, Human
gacaaccacuggucu

SEQ ID NO: 1259856 - RNA, 17 nt, Human
gacaaccacuggucugu

SEQ ID NO: 1259857 - RNA, 19 nt, Human
gacaaccacuggucuguag

SEQ ID NO: 1259858 - RNA, 17 nt, Human
gacaacguuucagcgac

SEQ ID NO: 1259859 - RNA, 15 nt, Human
gacaacgugcucuuu

SEQ ID NO: 1259860 - RNA, 17 nt, Human
gacaacugcucccaccu

SEQ ID NO: 1259861 - RNA, 19 nt, Human
gacaacugcucccaccucc

SEQ ID NO: 1259862 - RNA, 21 nt, Human
gacaacugcucccaccuccug

SEQ ID NO: 1259863 - RNA, 22 nt, Human
gacaacugcucccaccuccuga

SEQ ID NO: 1259864 - RNA, 12 nt, Human
gacaacuggcag

SEQ ID NO: 1259865 - RNA, 13 nt, Human
gacaacuggcagg

SEQ ID NO: 1259866 - RNA, 15 nt, Human
gacaacuggcaggca

SEQ ID NO: 1259867 - RNA, 16 nt, Human
gacaacuggcaggcag

SEQ ID NO: 1259868 - RNA, 18 nt, Human
gacaacuggcaggcaggc

SEQ ID NO: 1259869 - RNA, 17 nt, Human
gacaacuggcaggcagg

SEQ ID NO: 1259870 - RNA, 21 nt, Human
gacaacuucuaauugccaugu

SEQ ID NO: 1259871 - RNA, 16 nt, Human
gacaagacccccagca

SEQ ID NO: 1259872 - RNA, 16 nt, Human
gacaaggaaaaaauaa

SEQ ID NO: 1259873 - RNA, 22 nt, Human
gacaagaaaggcugcuguacug

SEQ ID NO: 1259874 - RNA, 15 nt, Human
gacaagacccccagc

SEQ ID NO: 1259875 - RNA, 12 nt, Human
gacaagcuucug

SEQ ID NO: 1259876 - RNA, 13 nt, Human
gacaagcuucuga

SEQ ID NO: 1259877 - RNA, 22 nt, Human
gacaauugagguaaguuuuuug

SEQ ID NO: 1259878 - RNA, 22 nt, Human
gacaauuagauaaauguccauu

SEQ ID NO: 1259879 - RNA, 14 nt, Human
gacaauggaccgga

SEQ ID NO: 1259880 - RNA, 16 nt, Human
gacaauggaccggaga

SEQ ID NO: 1259881 - RNA, 19 nt, Human
gacacaaacacacacaaaa

SEQ ID NO: 1259882 - RNA, 15 nt, Human
gacacaaacacacac

SEQ ID NO: 1259883 - RNA, 13 nt, Human
gacacaggcccuc

SEQ ID NO: 1259884 - RNA, 17 nt, Human
gacacaggcccucccug

SEQ ID NO: 1259885 - RNA, 19 nt, Human
gacacaugaagguaaauaa

SEQ ID NO: 1259886 - RNA, 20 nt, Human
gacacaugaagguaaauaaa

SEQ ID NO: 1259887 - RNA, 21 nt, Human
gacacaugaagguaaauaaaa

SEQ ID NO: 1259888 - RNA, 19 nt, Human
gacacauuuuuuaggaaau

SEQ ID NO: 1259889 - RNA, 20 nt, Human
gacacauuuuuuaggaaaug

SEQ ID NO: 1259890 - RNA, 23 nt, Human
gacacauuuuuuaggaaauguuu

SEQ ID NO: 1259891 - RNA, 15 nt, Human
gacaccaaaguucua

SEQ ID NO: 1259892 - RNA, 14 nt, Human
gacaccaaaguucu

SEQ ID NO: 1259893 - RNA, 16 nt, Human
gaccaccucucaauau

SEQ ID NO: 1259894 - RNA, 17 nt, Human
gaccacgcccguccugc

SEQ ID NO: 1259895 - RNA, 19 nt, Human
gaccacgcccguccugccu

SEQ ID NO: 1259896 - RNA, 21 nt, Human
gaccacgcccguccugccugu

SEQ ID NO: 1259897 - RNA, 13 nt, Human
gaccaccugccca

SEQ ID NO: 1259898 - RNA, 14 nt, Human
gaccaccugcccaa

SEQ ID NO: 1259899 - RNA, 14 nt, Human
gaccacccucacug

SEQ ID NO: 1259900 - RNA, 19 nt, Human
gaccacccucacuggcucu

SEQ ID NO: 1259901 - RNA, 14 nt, Human
gaccacccugagcc

SEQ ID NO: 1259902 - RNA, 15 nt, Human
gaccacccugagccg

SEQ ID NO: 1259903 - RNA, 17 nt, Human
gacaugggacauuugcu

SEQ ID NO: 1259904 - RNA, 16 nt, Human
gacaugcgguagccag

SEQ ID NO: 1259905 - RNA, 17 nt, Human
gacaugcgguagccagc

SEQ ID NO: 1259906 - RNA, 18 nt, Human
gacaugcgguagccagca

SEQ ID NO: 1259907 - RNA, 18 nt, Human
gaccaccccgccugcccu

SEQ ID NO: 1259908 - RNA, 19 nt, Human
gaccaccccgccugcccuc

SEQ ID NO: 1259909 - RNA, 20 nt, Human
gaccaccccgccugcccuca

SEQ ID NO: 1259910 - RNA, 16 nt, Human
gacaugggacauuugc

SEQ ID NO: 1259911 - RNA, 22 nt, Human
gaccacgcccguccugccugug

SEQ ID NO: 1259912 - RNA, 22 nt, Human
gaccaccuuuguuucuccccca

SEQ ID NO: 1259913 - RNA, 13 nt, Human
gaccacggcucga

SEQ ID NO: 1259914 - RNA, 21 nt, Human
gaccacugcagaagacaguau

SEQ ID NO: 1259915 - RNA, 14 nt, Human
gaccacuguuauca

SEQ ID NO: 1259916 - RNA, 17 nt, Human
gaccagaagcuccccca

SEQ ID NO: 1259917 - RNA, 20 nt, Human
gaccagccuccaugcugccu

SEQ ID NO: 1259918 - RNA, 20 nt, Human
gaccagaagcucccccagca

SEQ ID NO: 1259919 - RNA, 21 nt, Human
gaccagccuccaugcugccuc

SEQ ID NO: 1259920 - RNA, 22 nt, Human
gaccagccuccaugcugccucc

SEQ ID NO: 1259921 - RNA, 16 nt, Human
gaccauugucucagag

SEQ ID NO: 1259922 - RNA, 14 nt, Human
gaccagccucucca

SEQ ID NO: 1259923 - RNA, 22 nt, Human
gacccacaagaaaugaaagcag

SEQ ID NO: 1259924 - RNA, 15 nt, Human
gacccacaagaaaug

SEQ ID NO: 1259925 - RNA, 16 nt, Human
gacccaaaaggcagaa

SEQ ID NO: 1259926 - RNA, 12 nt, Human
gacccccaacca

SEQ ID NO: 1259927 - RNA, 21 nt, Human
gacccccaaccaaguggcucc

SEQ ID NO: 1259928 - RNA, 11 nt, Human
gacccugcccu

SEQ ID NO: 1259929 - RNA, 16 nt, Human
gacccuggaggcccca

SEQ ID NO: 1259930 - RNA, 13 nt, Human
gacccuggcuccu

SEQ ID NO: 1259931 - RNA, 23 nt, Human
gacccuggcuccuugugccagag

SEQ ID NO: 1259932 - RNA, 15 nt, Human
gacccuggcuuucau

SEQ ID NO: 1259933 - RNA, 23 nt, Human
gacccuggguaggggaagagaag

SEQ ID NO: 1259934 - RNA, 22 nt, Human
gaccgcuacaccacucuggcag

SEQ ID NO: 1259935 - RNA, 12 nt, Human
gacccuuuucau

SEQ ID NO: 1259936 - RNA, 18 nt, Human
gacccuuuuggguuucug

SEQ ID NO: 1259937 - RNA, 12 nt, Human
gaccgcccccuc

SEQ ID NO: 1259938 - RNA, 14 nt, Human
gaccgcccccuccu

SEQ ID NO: 1259939 - RNA, 15 nt, Human
gaccgcccccuccuc

SEQ ID NO: 1259940 - RNA, 16 nt, Human
gaccgcccccuccucu

SEQ ID NO: 1259941 - RNA, 15 nt, Human
gaccgcccccugucu

SEQ ID NO: 1259942 - RNA, 19 nt, Human
gaccgcuacaccacucugg

SEQ ID NO: 1259943 - RNA, 20 nt, Human
gaccgcuacaccacucuggc

SEQ ID NO: 1259944 - RNA, 21 nt, Human
gaccgcuacaccacucuggca

SEQ ID NO: 1259945 - RNA, 23 nt, Human
gaccgcuacaccacucuggcagc

SEQ ID NO: 1259946 - RNA, 17 nt, Human
gaccggacuuuucugca

SEQ ID NO: 1259947 - RNA, 15 nt, Human
gacagagaggacugu

SEQ ID NO: 1259948 - RNA, 16 nt, Human
gacagagaggacugua

SEQ ID NO: 1259949 - RNA, 13 nt, Human
gacacccaggacu

SEQ ID NO: 1259950 - RNA, 14 nt, Human
gacacccaggacuu

SEQ ID NO: 1259951 - RNA, 19 nt, Human
gacagagaggacuguaggg

SEQ ID NO: 1259952 - RNA, 13 nt, Human
gacagagccagga

SEQ ID NO: 1259953 - RNA, 16 nt, Human
gacagagccaggagaa

SEQ ID NO: 1259954 - RNA, 15 nt, Human
gacagagccaggaga

SEQ ID NO: 1259955 - RNA, 16 nt, Human
gacagaguugauuuuu

SEQ ID NO: 1259956 - RNA, 21 nt, Human
gacagcccaggauacuggcac

SEQ ID NO: 1259957 - RNA, 21 nt, Human
gacagcuuguggcaagugaau

SEQ ID NO: 1259958 - RNA, 20 nt, Human
gacagcuuguaggggagggg

SEQ ID NO: 1259959 - RNA, 17 nt, Human
gacagggaggacgcucu

SEQ ID NO: 1259960 - RNA, 18 nt, Human
gacagggaggacgcucuc

SEQ ID NO: 1259961 - RNA, 20 nt, Human
gacagggaauuaggccccca

SEQ ID NO: 1259962 - RNA, 20 nt, Human
gacaguguuccccgauacca

SEQ ID NO: 1259963 - RNA, 21 nt, Human
gacaguguuccccgauaccau

SEQ ID NO: 1259964 - RNA, 23 nt, Human
gacaguguugaaaauguucagaa

SEQ ID NO: 1259965 - RNA, 14 nt, Human
gacauacuugaagg

SEQ ID NO: 1259966 - RNA, 15 nt, Human
gacauacuugaaggg

SEQ ID NO: 1259967 - RNA, 20 nt, Human
gacauagaauuaacacauga

SEQ ID NO: 1259968 - RNA, 17 nt, Human
gacauacuugaagggcc

SEQ ID NO: 1259969 - RNA, 18 nt, Human
gacauacuugaagggcca

SEQ ID NO: 1259970 - RNA, 19 nt, Human
gacauacuugaagggccag

SEQ ID NO: 1259971 - RNA, 20 nt, Human
gacauacuugaagggccaga

SEQ ID NO: 1259972 - RNA, 22 nt, Human
gacauacuugaagggccagagc

SEQ ID NO: 1259973 - RNA, 23 nt, Human
gacauacuugaagggccagagcc

SEQ ID NO: 1259974 - RNA, 22 nt, Human
gacagcccaggauacuggcaca

SEQ ID NO: 1259975 - RNA, 15 nt, Human
gacauccuccuccca

SEQ ID NO: 1259976 - RNA, 18 nt, Human
gacauccuccucccaccc

SEQ ID NO: 1259977 - RNA, 15 nt, Human
gacaucggaaaaaua

SEQ ID NO: 1259978 - RNA, 11 nt, Human
gacaugaauuu

SEQ ID NO: 1259979 - RNA, 21 nt, Human
gacaugaauuuuagcuuuugu

SEQ ID NO: 1259980 - RNA, 17 nt, Human
gacaugaauuuuagcuu

SEQ ID NO: 1259981 - RNA, 14 nt, Human
gacaugauuuccuu

SEQ ID NO: 1259982 - RNA, 16 nt, Human
gacaugauuuccuuga

SEQ ID NO: 1259983 - RNA, 17 nt, Human
gacaugauuuccuugaa

SEQ ID NO: 1259984 - RNA, 19 nt, Human
gacaugauuuccuugaaug

SEQ ID NO: 1259985 - RNA, 20 nt, Human
gacaugauuuccuugaaugu

SEQ ID NO: 1259986 - RNA, 22 nt, Human
gacaugauuuccuugaaugugg

SEQ ID NO: 1259987 - RNA, 24 nt, Human
gacaugauuuccuugaauguggcu

SEQ ID NO: 1259988 - RNA, 17 nt, Human
cuuuuuauggccuguga

SEQ ID NO: 1259989 - RNA, 13 nt, Human
cuuuuguucgcau

SEQ ID NO: 1259990 - RNA, 22 nt, Human
cuuuuucugcacuauaugcaaa

SEQ ID NO: 1259991 - RNA, 20 nt, Human
cuuuuucugcacuauaugca

SEQ ID NO: 1259992 - RNA, 16 nt, Human
cuuuuucugcacuaua

SEQ ID NO: 1259993 - RNA, 14 nt, Human
cuuuuucugcacua

SEQ ID NO: 1259994 - RNA, 13 nt, Human
cuuuuucugcacu

SEQ ID NO: 1259995 - RNA, 20 nt, Human
cuuuuucucuuuccaugaca

SEQ ID NO: 1259996 - RNA, 19 nt, Human
cuuuguuacuucucuaauu

SEQ ID NO: 1259997 - RNA, 18 nt, Human
cuuuguuaagacugcuga

SEQ ID NO: 1259998 - RNA, 14 nt, Human
cuuuguggcacugg

SEQ ID NO: 1259999 - RNA, 17 nt, Human
cuuugugugcucuccau

SEQ ID NO: 1260000 - RNA, 17 nt, Human
cuuuuugggagagacuu

SEQ ID NO: 1260001 - RNA, 20 nt, Human
cuuuuugggagagacuuguu

SEQ ID NO: 1260002 - RNA, 23 nt, Human
cuuuuuggucgaggaguaacaau

SEQ ID NO: 1260003 - RNA, 19 nt, Human
cuuuuugggagagacuugu

SEQ ID NO: 1260004 - RNA, 18 nt, Human
cuuuuuguauaaaauaga

SEQ ID NO: 1260005 - RNA, 13 nt, Human
cuuuuuguauaaa

SEQ ID NO: 1260006 - RNA, 22 nt, Human
cuuuuugugauaugcacaaugu

SEQ ID NO: 1260007 - RNA, 15 nt, Human
cuuuuuguguuuuuu

SEQ ID NO: 1260008 - RNA, 21 nt, Human
cuuuuuguucugguccuuuuu

SEQ ID NO: 1260009 - RNA, 13 nt, Human
gaaaaagcgaaaa

SEQ ID NO: 1260010 - RNA, 14 nt, Human
gaaaacacugugca

SEQ ID NO: 1260011 - RNA, 21 nt, Human
gaaaacacugugcacaucugu

SEQ ID NO: 1260012 - RNA, 23 nt, Human
gaaaaguuuagccccugaaagcc

SEQ ID NO: 1260013 - RNA, 15 nt, Human
gaaaauauuguuuua

SEQ ID NO: 1260014 - RNA, 22 nt, Human
gaaaauauuguuuuacaauagu

SEQ ID NO: 1260015 - RNA, 18 nt, Human
gaaaaucuuauaauuuaa

SEQ ID NO: 1260016 - RNA, 19 nt, Human
gaaaaucuuuauaaaugua

SEQ ID NO: 1260017 - RNA, 13 nt, Human
gaaaaugaaagcu

SEQ ID NO: 1260018 - RNA, 22 nt, Human
gaaaaucuacacuccagugaga

SEQ ID NO: 1260019 - RNA, 11 nt, Human
gaaaaucauau

SEQ ID NO: 1260020 - RNA, 14 nt, Human
gaaaaguugaauuu

SEQ ID NO: 1260021 - RNA, 15 nt, Human
gaaaaguugaauuuu

SEQ ID NO: 1260022 - RNA, 23 nt, Human
gaaaagcuuagcuuuagaaacag

SEQ ID NO: 1260023 - RNA, 22 nt, Human
gaaaaggcacccccgucaagag

SEQ ID NO: 1260024 - RNA, 12 nt, Human
gaaaaggccugg

SEQ ID NO: 1260025 - RNA, 16 nt, Human
gaaaaggccuggggug

SEQ ID NO: 1260026 - RNA, 13 nt, Human
gaaaaggccuggg

SEQ ID NO: 1260027 - RNA, 14 nt, Human
gaaaaggccugggg

SEQ ID NO: 1260028 - RNA, 16 nt, Human
gaaaacagaacacuua

SEQ ID NO: 1260029 - RNA, 15 nt, Human
gaaaacagaacacuu

SEQ ID NO: 1260030 - RNA, 12 nt, Human
gaaaacaggcac

SEQ ID NO: 1260031 - RNA, 18 nt, Human
gaaaacaggcacugcccu

SEQ ID NO: 1260032 - RNA, 22 nt, Human
gaaagcgccuccaacccuagca

SEQ ID NO: 1260033 - RNA, 17 nt, Human
gaaagcgccuccaaccc

SEQ ID NO: 1260034 - RNA, 14 nt, Human
gaaagccuucuuuu

SEQ ID NO: 1260035 - RNA, 18 nt, Human
gaaagccccacccaggcc

SEQ ID NO: 1260036 - RNA, 14 nt, Human
gaaagccccugccc

SEQ ID NO: 1260037 - RNA, 23 nt, Human
gaaagccccugccccuccucucc

SEQ ID NO: 1260038 - RNA, 10 nt, Human
gaaagccuga

SEQ ID NO: 1260039 - RNA, 12 nt, Human
gaaagccugagu

SEQ ID NO: 1260040 - RNA, 19 nt, Human
gaaagcuauauaagacaag

SEQ ID NO: 1260041 - RNA, 13 nt, Human
gaaagcucuagaa

SEQ ID NO: 1260042 - RNA, 12 nt, Human
gaaagcucuaga

SEQ ID NO: 1260043 - RNA, 15 nt, Human
gaaagcugacuuggc

SEQ ID NO: 1260044 - RNA, 16 nt, Human
gaaagcugacuuggcu

SEQ ID NO: 1260045 - RNA, 18 nt, Human
gaaagcugacuuggcugg

SEQ ID NO: 1260046 - RNA, 19 nt, Human
gaaagcugacuuggcuggu

SEQ ID NO: 1260047 - RNA, 20 nt, Human
gaaagcugacuuggcuggug

SEQ ID NO: 1260048 - RNA, 22 nt, Human
gaaagcugacuuggcuggugug

SEQ ID NO: 1260049 - RNA, 21 nt, Human
gaaagcuugcccuggugccuc

SEQ ID NO: 1260050 - RNA, 17 nt, Human
gaaagcuucaaacugca

SEQ ID NO: 1260051 - RNA, 16 nt, Human
gaaagcuucagugcug

SEQ ID NO: 1260052 - RNA, 18 nt, Human
gaaagcuucagugcugcc

SEQ ID NO: 1260053 - RNA, 21 nt, Human
gaaagcugacuuggcuggugu

SEQ ID NO: 1260054 - RNA, 17 nt, Human
gaaagcugccugguaua

SEQ ID NO: 1260055 - RNA, 13 nt, Human
gaaagccccaccc

SEQ ID NO: 1260056 - RNA, 16 nt, Human
gaaagccccacccagg

SEQ ID NO: 1260057 - RNA, 21 nt, Human
gaaagccccacccaggccagg

SEQ ID NO: 1260058 - RNA, 14 nt, Human
gaaagcagggacuu

SEQ ID NO: 1260059 - RNA, 18 nt, Human
gaaagcaguugagacaag

SEQ ID NO: 1260060 - RNA, 21 nt, Human
gaaagaguacucuuguuuccu

SEQ ID NO: 1260061 - RNA, 20 nt, Human
gaaagaggcugaggccugga

SEQ ID NO: 1260062 - RNA, 21 nt, Human
gaaagaggcugaggccuggac

SEQ ID NO: 1260063 - RNA, 22 nt, Human
gaaagaggcugaggccuggacu

SEQ ID NO: 1260064 - RNA, 22 nt, Human
gaaagcagaacagugauuacca

SEQ ID NO: 1260065 - RNA, 23 nt, Human
gaaagaggugaccccagggcaca

SEQ ID NO: 1260066 - RNA, 21 nt, Human
gaaagaggugaccccagggca

SEQ ID NO: 1260067 - RNA, 17 nt, Human
gaaagcagaacagugau

SEQ ID NO: 1260068 - RNA, 14 nt, Human
gaaagaggugaccc

SEQ ID NO: 1260069 - RNA, 19 nt, Human
gaaagaggugaccccaggg

SEQ ID NO: 1260070 - RNA, 20 nt, Human
gaaagaggugaccccagggc

SEQ ID NO: 1260071 - RNA, 13 nt, Human
gaaagaggaagca

SEQ ID NO: 1260072 - RNA, 16 nt, Human
gaaagaggcaccagga

SEQ ID NO: 1260073 - RNA, 17 nt, Human
gaaagaggcaccaggaa

SEQ ID NO: 1260074 - RNA, 20 nt, Human
gaaagaggcaccaggaagcc

SEQ ID NO: 1260075 - RNA, 21 nt, Human
gaaagaggcaccaggaagccg

SEQ ID NO: 1260076 - RNA, 21 nt, Human
gaaagaggaaugaaguacuca

SEQ ID NO: 1260077 - RNA, 13 nt, Human
gaaagagaaacac

SEQ ID NO: 1260078 - RNA, 18 nt, Human
gaaagagaaacaguuggu

SEQ ID NO: 1260079 - RNA, 17 nt, Human
gaaagagaacuuccaga

SEQ ID NO: 1260080 - RNA, 14 nt, Human
gaaaccuuccaccc

SEQ ID NO: 1260081 - RNA, 16 nt, Human
gaaacgucuucuaaac

SEQ ID NO: 1260082 - RNA, 19 nt, Human
gaaacuaggugcauauuua

SEQ ID NO: 1260083 - RNA, 21 nt, Human
gaaacuagaaagcagagauuu

SEQ ID NO: 1260084 - RNA, 23 nt, Human
gaaacucguuaauuuguaguguu

SEQ ID NO: 1260085 - RNA, 15 nt, Human
gaaacuccagaugcc

SEQ ID NO: 1260086 - RNA, 21 nt, Human
gaaacccugcacccauuagca

SEQ ID NO: 1260087 - RNA, 14 nt, Human
gaaacccugucucu

SEQ ID NO: 1260088 - RNA, 13 nt, Human
gaaaccuacugcc

SEQ ID NO: 1260089 - RNA, 19 nt, Human
gaaaccuacugcccaggca

SEQ ID NO: 1260090 - RNA, 19 nt, Human
gaaaccccuguaggccuca

SEQ ID NO: 1260091 - RNA, 16 nt, Human
gaaacacaacuauauu

SEQ ID NO: 1260092 - RNA, 13 nt, Human
gaaacacagaaac

SEQ ID NO: 1260093 - RNA, 15 nt, Human
gaaaaugauacagca

SEQ ID NO: 1260094 - RNA, 17 nt, Human
gaaaaugauacagcaga

SEQ ID NO: 1260095 - RNA, 13 nt, Human
gaaaccagcuucc

SEQ ID NO: 1260096 - RNA, 17 nt, Human
gaaaccagcuuccuuca

SEQ ID NO: 1260097 - RNA, 19 nt, Human
gaaaccagcuuccuucaga

SEQ ID NO: 1260098 - RNA, 21 nt, Human
gaaaccagcuuccuucagaga

SEQ ID NO: 1260099 - RNA, 22 nt, Human
gaaaccagcuuccuucagagag

SEQ ID NO: 1260100 - RNA, 23 nt, Human
gaaaccagcuuccuucagagagc

SEQ ID NO: 1260101 - RNA, 17 nt, Human
cuuguacuuuauuuucu

SEQ ID NO: 1260102 - RNA, 22 nt, Human
cuuguaggggaggggcuccuuu

SEQ ID NO: 1260103 - RNA, 23 nt, Human
cuuguaggggaggggcuccuuuc

SEQ ID NO: 1260104 - RNA, 23 nt, Human
cuugucaauaaaauccauacauu

SEQ ID NO: 1260105 - RNA, 17 nt, Human
cuuguauauuuuaagaa

SEQ ID NO: 1260106 - RNA, 23 nt, Human
cuuguauauuuuaagaaauaaca

SEQ ID NO: 1260107 - RNA, 19 nt, Human
cuuguauaagauccuagau

SEQ ID NO: 1260108 - RNA, 17 nt, Human
cuuguauaucuuguuuu

SEQ ID NO: 1260109 - RNA, 12 nt, Human
cuuguccagcug

SEQ ID NO: 1260110 - RNA, 13 nt, Human
cuuguccagcuga

SEQ ID NO: 1260111 - RNA, 13 nt, Human
cuugucacgccag

SEQ ID NO: 1260112 - RNA, 16 nt, Human
cuugucacgccagacu

SEQ ID NO: 1260113 - RNA, 18 nt, Human
cuugucacgccagacuuc

SEQ ID NO: 1260114 - RNA, 12 nt, Human
cuugucaugugu

SEQ ID NO: 1260115 - RNA, 13 nt, Human
cuugucaugugua

SEQ ID NO: 1260116 - RNA, 14 nt, Human
cuugucauguguau

SEQ ID NO: 1260117 - RNA, 15 nt, Human
cuugucauguguaua

SEQ ID NO: 1260118 - RNA, 16 nt, Human
cuugucauguguauaa

SEQ ID NO: 1260119 - RNA, 17 nt, Human
cuugucauguguauaaa

SEQ ID NO: 1260120 - RNA, 18 nt, Human
cuugucauguguauaaaa

SEQ ID NO: 1260121 - RNA, 22 nt, Human
cuugucauuguuauauaaucau

SEQ ID NO: 1260122 - RNA, 18 nt, Human
cuugucauuuuuuuucuu

SEQ ID NO: 1260123 - RNA, 19 nt, Human
cuugucauguguauaaaaa

SEQ ID NO: 1260124 - RNA, 19 nt, Human
cuugaguuuaaauuguaau

SEQ ID NO: 1260125 - RNA, 12 nt, Human
cuugaguuuguc

SEQ ID NO: 1260126 - RNA, 16 nt, Human
cuugaguuugucgcuc

SEQ ID NO: 1260127 - RNA, 13 nt, Human
cuugaguuugucg

SEQ ID NO: 1260128 - RNA, 14 nt, Human
cuuggggggguggc

SEQ ID NO: 1260129 - RNA, 16 nt, Human
cuuggggggguggccg

SEQ ID NO: 1260130 - RNA, 18 nt, Human
cuuggggggguggccgcu

SEQ ID NO: 1260131 - RNA, 19 nt, Human
cuuggggggguggccgcug

SEQ ID NO: 1260132 - RNA, 22 nt, Human
cuuggggggguggccgcugagu

SEQ ID NO: 1260133 - RNA, 13 nt, Human
cuuggggggugau

SEQ ID NO: 1260134 - RNA, 20 nt, Human
cuuggggggugaugagggca

SEQ ID NO: 1260135 - RNA, 22 nt, Human
cuuggggggugaugagggcagc

SEQ ID NO: 1260136 - RNA, 24 nt, Human
cuuggggggugaugagggcagcag

SEQ ID NO: 1260137 - RNA, 20 nt, Human
cuuggggguccuccuccagg

SEQ ID NO: 1260138 - RNA, 23 nt, Human
cuuggggguccuccuccagggac

SEQ ID NO: 1260139 - RNA, 21 nt, Human
cuuggggguccuccuccaggg

SEQ ID NO: 1260140 - RNA, 22 nt, Human
cuuggggguccuccuccaggga

SEQ ID NO: 1260141 - RNA, 21 nt, Human
cuuuaucuugaauaauguaag

SEQ ID NO: 1260142 - RNA, 18 nt, Human
cuuuaucuugaauaaugu

SEQ ID NO: 1260143 - RNA, 23 nt, Human
cuuuaucuugaauaauguaagac

SEQ ID NO: 1260144 - RNA, 20 nt, Human
cuuuaugauaauagauucuc

SEQ ID NO: 1260145 - RNA, 19 nt, Human
cuuuaugauaauagauucu

SEQ ID NO: 1260146 - RNA, 23 nt, Human
cuuuauacagcuguauugucuga

SEQ ID NO: 1260147 - RNA, 14 nt, Human
cuuuauacagcugu

SEQ ID NO: 1260148 - RNA, 15 nt, Human
cuuuauagaucagcc

SEQ ID NO: 1260149 - RNA, 13 nt, Human
cuuuauaugaaga

SEQ ID NO: 1260150 - RNA, 22 nt, Human
cuuuauaugaagaaaaucacuu

SEQ ID NO: 1260151 - RNA, 20 nt, Human
cuuuaaaauuacaacuaagu

SEQ ID NO: 1260152 - RNA, 19 nt, Human
cuuuaaaauuacaacuaag

SEQ ID NO: 1260153 - RNA, 17 nt, Human
cuuuaaaauuacaacua

SEQ ID NO: 1260154 - RNA, 16 nt, Human
cuuuaaaauguaaagc

SEQ ID NO: 1260155 - RNA, 19 nt, Human
cuuuaaaauguaaagccau

SEQ ID NO: 1260156 - RNA, 17 nt, Human
cuuuaaaaggaaagaaa

SEQ ID NO: 1260157 - RNA, 17 nt, Human
cuuuaaaauaucuacau

SEQ ID NO: 1260158 - RNA, 18 nt, Human
cuuuaaaaggaaagaaaa

SEQ ID NO: 1260159 - RNA, 16 nt, Human
cuuuaaaaggaaagaa

SEQ ID NO: 1260160 - RNA, 18 nt, Human
cuuuaaaagaugcuuuua

SEQ ID NO: 1260161 - RNA, 15 nt, Human
cuugugucucugugc

SEQ ID NO: 1260162 - RNA, 16 nt, Human
cuugugucaaacagua

SEQ ID NO: 1260163 - RNA, 14 nt, Human
cuugugucccauga

SEQ ID NO: 1260164 - RNA, 21 nt, Human
cuuuaaaauguaaagccaugc

SEQ ID NO: 1260165 - RNA, 21 nt, Human
cuuuaaaauuggguucacagc

SEQ ID NO: 1260166 - RNA, 16 nt, Human
cuuuaccuuuuuucuu

SEQ ID NO: 1260167 - RNA, 15 nt, Human
cuuuagauagcccug

SEQ ID NO: 1260168 - RNA, 19 nt, Human
cuuuagauagcccuguccu

SEQ ID NO: 1260169 - RNA, 20 nt, Human
cuuuagauagcccuguccug

SEQ ID NO: 1260170 - RNA, 21 nt, Human
cuuuagauagcccuguccugg

SEQ ID NO: 1260171 - RNA, 15 nt, Human
cuuuagaucucugaa

SEQ ID NO: 1260172 - RNA, 16 nt, Human
cuuuagaucucugaag

SEQ ID NO: 1260173 - RNA, 16 nt, Human
cuuucucuuucccugg

SEQ ID NO: 1260174 - RNA, 18 nt, Human
cuuucucuuucccugguc

SEQ ID NO: 1260175 - RNA, 21 nt, Human
cuuucucuuucccuggucccu

SEQ ID NO: 1260176 - RNA, 23 nt, Human
cuuucuggauuauucugggggcu

SEQ ID NO: 1260177 - RNA, 14 nt, Human
cuuucucugaggac

SEQ ID NO: 1260178 - RNA, 15 nt, Human
cuuucucugaggaca

SEQ ID NO: 1260179 - RNA, 13 nt, Human
cuuucucugccag

SEQ ID NO: 1260180 - RNA, 14 nt, Human
cuuucucugccagu

SEQ ID NO: 1260181 - RNA, 16 nt, Human
cuuucucugccaguga

SEQ ID NO: 1260182 - RNA, 18 nt, Human
cuuucucugccagugaca

SEQ ID NO: 1260183 - RNA, 15 nt, Human
cuuuccugaauccaa

SEQ ID NO: 1260184 - RNA, 22 nt, Human
cuuuccugaauccaaacuaauc

SEQ ID NO: 1260185 - RNA, 22 nt, Human
cuuucucucuuuauacagcugu

SEQ ID NO: 1260186 - RNA, 12 nt, Human
cuuucucugagg

SEQ ID NO: 1260187 - RNA, 20 nt, Human
cuuucugggcaccggggccu

SEQ ID NO: 1260188 - RNA, 16 nt, Human
cuuucuguaaccauaa

SEQ ID NO: 1260189 - RNA, 11 nt, Human
cuuucuuccuc

SEQ ID NO: 1260190 - RNA, 20 nt, Human
cuuucuuccggccccucccc

SEQ ID NO: 1260191 - RNA, 13 nt, Human
cuuucuguauaua

SEQ ID NO: 1260192 - RNA, 18 nt, Human
cuuucuguauauacuuuu

SEQ ID NO: 1260193 - RNA, 13 nt, Human
cuuucccuccuug

SEQ ID NO: 1260194 - RNA, 14 nt, Human
cuuucccuccuugg

SEQ ID NO: 1260195 - RNA, 15 nt, Human
cuuucccuccuuggu

SEQ ID NO: 1260196 - RNA, 18 nt, Human
cuuucccuccuuggugau

SEQ ID NO: 1260197 - RNA, 13 nt, Human
cuuucccugccuc

SEQ ID NO: 1260198 - RNA, 13 nt, Human
cuuucccuggucc

SEQ ID NO: 1260199 - RNA, 17 nt, Human
cuuucccuucaguaccc

SEQ ID NO: 1260200 - RNA, 20 nt, Human
cuuuauguaguuuuuauaug

SEQ ID NO: 1260201 - RNA, 20 nt, Human
cuuuccauaaauccuugaug

SEQ ID NO: 1260202 - RNA, 23 nt, Human
cuuuauggcagacauugugcuag

SEQ ID NO: 1260203 - RNA, 13 nt, Human
cuuuaugcuugca

SEQ ID NO: 1260204 - RNA, 19 nt, Human
cuuuauguaguuuuuauau

SEQ ID NO: 1260205 - RNA, 21 nt, Human
cuuuaugucuguggauuuuuu

SEQ ID NO: 1260206 - RNA, 13 nt, Human
cuuucccaacacc

SEQ ID NO: 1260207 - RNA, 18 nt, Human
cuuuccauuggaucucau

SEQ ID NO: 1260208 - RNA, 12 nt, Human
cuuuccauuaca

SEQ ID NO: 1260209 - RNA, 15 nt, Human
cuuuccauccauggc

SEQ ID NO: 1260210 - RNA, 18 nt, Human
cuuuccauccauggccag

SEQ ID NO: 1260211 - RNA, 20 nt, Human
cuuuccauccauggccagca

SEQ ID NO: 1260212 - RNA, 21 nt, Human
cuuuccauccauggccagcag

SEQ ID NO: 1260213 - RNA, 22 nt, Human
cuuuccauccauggccagcagc

SEQ ID NO: 1260214 - RNA, 12 nt, Human
cuuucccuaagc

SEQ ID NO: 1260215 - RNA, 17 nt, Human
cuuucccuaagccagcu

SEQ ID NO: 1260216 - RNA, 18 nt, Human
cuuucccuaagccagcug

SEQ ID NO: 1260217 - RNA, 13 nt, Human
cuuucccuacccu

SEQ ID NO: 1260218 - RNA, 15 nt, Human
cuuucccuacccucu

SEQ ID NO: 1260219 - RNA, 16 nt, Human
cuuucccuacccucua

SEQ ID NO: 1260220 - RNA, 18 nt, Human
cuuucccuacccucuaga

SEQ ID NO: 1260221 - RNA, 16 nt, Human
cuuuggcugcaugcga

SEQ ID NO: 1260222 - RNA, 14 nt, Human
cuuuggcugcaugc

SEQ ID NO: 1260223 - RNA, 22 nt, Human
cuuuggcugaaaggaagcugug

SEQ ID NO: 1260224 - RNA, 13 nt, Human
cuuuggcuccccu

SEQ ID NO: 1260225 - RNA, 15 nt, Human
cuuuggcuccccugu

SEQ ID NO: 1260226 - RNA, 14 nt, Human
cuuugucagggagu

SEQ ID NO: 1260227 - RNA, 17 nt, Human
cuuugcucauauuuccc

SEQ ID NO: 1260228 - RNA, 22 nt, Human
cuuugcgcuccuggcccagccu

SEQ ID NO: 1260229 - RNA, 21 nt, Human
cuuugcgcuccuggcccagcc

SEQ ID NO: 1260230 - RNA, 18 nt, Human
cuuugcuaaagacaugaa

SEQ ID NO: 1260231 - RNA, 13 nt, Human
cuuugcgcuccug

SEQ ID NO: 1260232 - RNA, 15 nt, Human
cuuugcgcuccuggc

SEQ ID NO: 1260233 - RNA, 17 nt, Human
cuuugcgcuccuggccc

SEQ ID NO: 1260234 - RNA, 20 nt, Human
cuuugcgcuccuggcccagc

SEQ ID NO: 1260235 - RNA, 14 nt, Human
cuuugugcauucug

SEQ ID NO: 1260236 - RNA, 13 nt, Human
cuuugugcccuau

SEQ ID NO: 1260237 - RNA, 18 nt, Human
cuuugugcccuaucaccc

SEQ ID NO: 1260238 - RNA, 16 nt, Human
cuuugugcacauuuau

SEQ ID NO: 1260239 - RNA, 18 nt, Human
cuuugugcacauuuauuu

SEQ ID NO: 1260240 - RNA, 23 nt, Human
cuuugugcacauuuauuuccucc

SEQ ID NO: 1260241 - RNA, 13 nt, Human
cuuugugcauucu

SEQ ID NO: 1260242 - RNA, 23 nt, Human
cuuugucuacuucaaaaguuugu

SEQ ID NO: 1260243 - RNA, 22 nt, Human
cuuugugaauagaacucugaaa

SEQ ID NO: 1260244 - RNA, 16 nt, Human
cuuugucacuguuuca

SEQ ID NO: 1260245 - RNA, 22 nt, Human
cuuugcauaacguauaaaagcc

SEQ ID NO: 1260246 - RNA, 18 nt, Human
cuuugaccugccucccuu

SEQ ID NO: 1260247 - RNA, 12 nt, Human
cuuugccucaaa

SEQ ID NO: 1260248 - RNA, 15 nt, Human
cuuugaccugccucc

SEQ ID NO: 1260249 - RNA, 14 nt, Human
cuuugaccugccuc

SEQ ID NO: 1260250 - RNA, 22 nt, Human
cuuugcagccggcacagggucu

SEQ ID NO: 1260251 - RNA, 12 nt, Human
cuuucuuccucu

SEQ ID NO: 1260252 - RNA, 13 nt, Human
cuuucuuccucug

SEQ ID NO: 1260253 - RNA, 14 nt, Human
cuuucuuccucugc

SEQ ID NO: 1260254 - RNA, 15 nt, Human
cuuucuuccucugcu

SEQ ID NO: 1260255 - RNA, 13 nt, Human
cuuauauuaugga

SEQ ID NO: 1260256 - RNA, 19 nt, Human
cuuauaucuauauuuuaca

SEQ ID NO: 1260257 - RNA, 16 nt, Human
cuuauaucuggccucu

SEQ ID NO: 1260258 - RNA, 22 nt, Human
cuuauaucuggccucugcuuuc

SEQ ID NO: 1260259 - RNA, 21 nt, Human
cuuauaucuggccucugcuuu

SEQ ID NO: 1260260 - RNA, 21 nt, Human
cuuauauuaauauuccucagu

SEQ ID NO: 1260261 - RNA, 15 nt, Human
cuuauccuccaccgu

SEQ ID NO: 1260262 - RNA, 12 nt, Human
cuuauccucccu

SEQ ID NO: 1260263 - RNA, 14 nt, Human
cuuauccucccugu

SEQ ID NO: 1260264 - RNA, 19 nt, Human
cuuauaggaauugacccac

SEQ ID NO: 1260265 - RNA, 16 nt, Human
cuuauagccucugucu

SEQ ID NO: 1260266 - RNA, 15 nt, Human
cuuauauaauugcca

SEQ ID NO: 1260267 - RNA, 14 nt, Human
cuuauagacaacau

SEQ ID NO: 1260268 - RNA, 16 nt, Human
cuuauacgaguaauau

SEQ ID NO: 1260269 - RNA, 23 nt, Human
cuuaguucaaguccugccucuua

SEQ ID NO: 1260270 - RNA, 17 nt, Human
cuuaguuuguguguugu

SEQ ID NO: 1260271 - RNA, 22 nt, Human
cuuaguuuguguguugucucuu

SEQ ID NO: 1260272 - RNA, 23 nt, Human
cuuaguuuguguguugucucuug

SEQ ID NO: 1260273 - RNA, 16 nt, Human
cuuauacgaaauaauu

SEQ ID NO: 1260274 - RNA, 17 nt, Human
cuuauacgaaauaauug

SEQ ID NO: 1260275 - RNA, 18 nt, Human
cuuauacgaaauaauugu

SEQ ID NO: 1260276 - RNA, 20 nt, Human
cuuauacgaaauaauuguug

SEQ ID NO: 1260277 - RNA, 21 nt, Human
cuuauacgaaauaauuguugu

SEQ ID NO: 1260278 - RNA, 22 nt, Human
cuuauacgaaauaauuguuguu

SEQ ID NO: 1260279 - RNA, 22 nt, Human
cuuagaugcaguucugaagaag

SEQ ID NO: 1260280 - RNA, 16 nt, Human
cuguucugcacacagc

SEQ ID NO: 1260281 - RNA, 21 nt, Human
cuguucucuugggaacugaac

SEQ ID NO: 1260282 - RNA, 12 nt, Human
cuuagucucagu

SEQ ID NO: 1260283 - RNA, 13 nt, Human
cuuagucucaguu

SEQ ID NO: 1260284 - RNA, 18 nt, Human
cuuagucucaguuugugu

SEQ ID NO: 1260285 - RNA, 19 nt, Human
cuuagucucaguuugugug

SEQ ID NO: 1260286 - RNA, 19 nt, Human
cuuagugcaguuauuugcu

SEQ ID NO: 1260287 - RNA, 20 nt, Human
cuuagucucaguuugugugu

SEQ ID NO: 1260288 - RNA, 23 nt, Human
cuuagucucaguuugugugucuu

SEQ ID NO: 1260289 - RNA, 21 nt, Human
cuuagucuagguccuuguugu

SEQ ID NO: 1260290 - RNA, 11 nt, Human
cuuaguguaug

SEQ ID NO: 1260291 - RNA, 15 nt, Human
cuuaguguaugauua

SEQ ID NO: 1260292 - RNA, 15 nt, Human
cuucaaaguuuaaua

SEQ ID NO: 1260293 - RNA, 16 nt, Human
cuucaaaguuuaauaa

SEQ ID NO: 1260294 - RNA, 17 nt, Human
cuucaaagcaaaugucu

SEQ ID NO: 1260295 - RNA, 23 nt, Human
cuucaaacuagggccaagcccag

SEQ ID NO: 1260296 - RNA, 14 nt, Human
cuucaaacuacuuu

SEQ ID NO: 1260297 - RNA, 20 nt, Human
cuucaaaauguuaucuucuc

SEQ ID NO: 1260298 - RNA, 22 nt, Human
cuucaaaauguuaucuucucaa

SEQ ID NO: 1260299 - RNA, 23 nt, Human
cuucaaaauguuaucuucucaag

SEQ ID NO: 1260300 - RNA, 11 nt, Human
cuucaaacuac

SEQ ID NO: 1260301 - RNA, 18 nt, Human
cuuauuucaucauucacu

SEQ ID NO: 1260302 - RNA, 17 nt, Human
cuuauuucaugaaaauu

SEQ ID NO: 1260303 - RNA, 16 nt, Human
cuuauuuguauauggu

SEQ ID NO: 1260304 - RNA, 21 nt, Human
cuucaaaaguuuguuugcuua

SEQ ID NO: 1260305 - RNA, 23 nt, Human
cuuauuuagauucacuuaacaaa

SEQ ID NO: 1260306 - RNA, 22 nt, Human
cuuauuuaugaaaguauuaaaa

SEQ ID NO: 1260307 - RNA, 15 nt, Human
cuuauuucaucauuc

SEQ ID NO: 1260308 - RNA, 17 nt, Human
cuuauuuauuguauucu

SEQ ID NO: 1260309 - RNA, 19 nt, Human
cuuauuuauuguauucugg

SEQ ID NO: 1260310 - RNA, 21 nt, Human
cuuauuuauucauauuuucuu

SEQ ID NO: 1260311 - RNA, 14 nt, Human
cuuauuuauuguau

SEQ ID NO: 1260312 - RNA, 16 nt, Human
cuuauuuauuguauuc

SEQ ID NO: 1260313 - RNA, 23 nt, Human
cuuaucuaaucaugaaacucccu

SEQ ID NO: 1260314 - RNA, 18 nt, Human
cuuaucuacuuccaaacu

SEQ ID NO: 1260315 - RNA, 15 nt, Human
cuuauccucccugua

SEQ ID NO: 1260316 - RNA, 16 nt, Human
cuuauccucccuguaa

SEQ ID NO: 1260317 - RNA, 17 nt, Human
cuuauccucccuguaac

SEQ ID NO: 1260318 - RNA, 18 nt, Human
cuuauccucccuguaacu

SEQ ID NO: 1260319 - RNA, 20 nt, Human
cuuauccucccuguaacuug

SEQ ID NO: 1260320 - RNA, 19 nt, Human
cuuauccucccuguaacuu

SEQ ID NO: 1260321 - RNA, 15 nt, Human
cuuaucgaaacucau

SEQ ID NO: 1260322 - RNA, 16 nt, Human
cuucaacucccugccc

SEQ ID NO: 1260323 - RNA, 20 nt, Human
cuucaagcucugagggaaag

SEQ ID NO: 1260324 - RNA, 16 nt, Human
cuucaaccauucccca

SEQ ID NO: 1260325 - RNA, 20 nt, Human
cuucaaccauuccccauggg

SEQ ID NO: 1260326 - RNA, 19 nt, Human
cuucacaccuacccuccuu

SEQ ID NO: 1260327 - RNA, 17 nt, Human
cuucaccauuuggcaau

SEQ ID NO: 1260328 - RNA, 15 nt, Human
cuucaauuuauaccu

SEQ ID NO: 1260329 - RNA, 17 nt, Human
cuucaauccuugaaggu

SEQ ID NO: 1260330 - RNA, 14 nt, Human
cuucccuuuccuga

SEQ ID NO: 1260331 - RNA, 19 nt, Human
cuuccuaaauauuaugaga

SEQ ID NO: 1260332 - RNA, 22 nt, Human
cuuccuaaauauuaugagaugc

SEQ ID NO: 1260333 - RNA, 16 nt, Human
cuuccuaaauuuuccu

SEQ ID NO: 1260334 - RNA, 19 nt, Human
cuuccuaaauuuuccuguc

SEQ ID NO: 1260335 - RNA, 20 nt, Human
cuuccuaaauuuuccugucc

SEQ ID NO: 1260336 - RNA, 13 nt, Human
cuuccuaauucca

SEQ ID NO: 1260337 - RNA, 17 nt, Human
cuuccuaauuccacagc

SEQ ID NO: 1260338 - RNA, 18 nt, Human
cuuccuaauuccacagcu

SEQ ID NO: 1260339 - RNA, 19 nt, Human
cuuccuaauuccacagcug

SEQ ID NO: 1260340 - RNA, 13 nt, Human
cuuccucccucau

SEQ ID NO: 1260341 - RNA, 21 nt, Human
cuuccuaaauuuuccuguccu

SEQ ID NO: 1260342 - RNA, 15 nt, Human
cuuccucagccagcc

SEQ ID NO: 1260343 - RNA, 16 nt, Human
cuuccucagccagccu

SEQ ID NO: 1260344 - RNA, 17 nt, Human
cuuccucagccagccuc

SEQ ID NO: 1260345 - RNA, 18 nt, Human
cuuccucauccaccccau

SEQ ID NO: 1260346 - RNA, 22 nt, Human
cuuccucauccaccccaucccu

SEQ ID NO: 1260347 - RNA, 23 nt, Human
cuuccucauccaccccaucccuc

SEQ ID NO: 1260348 - RNA, 20 nt, Human
cuucccuuuccugaguccca

SEQ ID NO: 1260349 - RNA, 16 nt, Human
cuucccugugccuccu

SEQ ID NO: 1260350 - RNA, 21 nt, Human
cuucccugugccuccucccuc

SEQ ID NO: 1260351 - RNA, 22 nt, Human
cuucccuguguaguuugugcug

SEQ ID NO: 1260352 - RNA, 12 nt, Human
cuucccuaaucu

SEQ ID NO: 1260353 - RNA, 14 nt, Human
cuucccugugccuc

SEQ ID NO: 1260354 - RNA, 15 nt, Human
cuucccugugccucc

SEQ ID NO: 1260355 - RNA, 23 nt, Human
cuucccuguuuuccccccaaggg

SEQ ID NO: 1260356 - RNA, 19 nt, Human
cuucccgcucagcccuccc

SEQ ID NO: 1260357 - RNA, 23 nt, Human
cuucccgcucagcccucccugcc

SEQ ID NO: 1260358 - RNA, 21 nt, Human
cuuccaggggagguucaguga

SEQ ID NO: 1260359 - RNA, 14 nt, Human
cuucccauccccag

SEQ ID NO: 1260360 - RNA, 15 nt, Human
cuucccauccccagc

SEQ ID NO: 1260361 - RNA, 17 nt, Human
cuucccauccccagcga

SEQ ID NO: 1260362 - RNA, 15 nt, Human
cuucccaucgcuguc

SEQ ID NO: 1260363 - RNA, 18 nt, Human
cuucccccucucccaguu

SEQ ID NO: 1260364 - RNA, 16 nt, Human
cuucccccucucccag

SEQ ID NO: 1260365 - RNA, 17 nt, Human
cuucccccucucccagu

SEQ ID NO: 1260366 - RNA, 18 nt, Human
cuuccccuuauccucccu

SEQ ID NO: 1260367 - RNA, 20 nt, Human
cuuccccuuauccucccugu

SEQ ID NO: 1260368 - RNA, 21 nt, Human
cuuccccuuauccucccugua

SEQ ID NO: 1260369 - RNA, 14 nt, Human
cuuccacccagugc

SEQ ID NO: 1260370 - RNA, 12 nt, Human
cuuccacccagu

SEQ ID NO: 1260371 - RNA, 13 nt, Human
cuuccacccaggg

SEQ ID NO: 1260372 - RNA, 19 nt, Human
cuuccacguacugcagccu

SEQ ID NO: 1260373 - RNA, 20 nt, Human
cuuccacguacugcagccuc

SEQ ID NO: 1260374 - RNA, 14 nt, Human
cuuccacugagggc

SEQ ID NO: 1260375 - RNA, 15 nt, Human
cuuccacugagggca

SEQ ID NO: 1260376 - RNA, 21 nt, Human
cuucauucaagucagcucuuc

SEQ ID NO: 1260377 - RNA, 12 nt, Human
cuucauuucaga

SEQ ID NO: 1260378 - RNA, 15 nt, Human
cuucagggagugagg

SEQ ID NO: 1260379 - RNA, 19 nt, Human
cuucaggcucuucuccuuu

SEQ ID NO: 1260380 - RNA, 22 nt, Human
cuucaggcucuucuccuuucac

SEQ ID NO: 1260381 - RNA, 21 nt, Human
cuucaccauuuggcaaugcca

SEQ ID NO: 1260382 - RNA, 19 nt, Human
cuucaguacccucucagcu

SEQ ID NO: 1260383 - RNA, 22 nt, Human
cuucaguacccucucagcucca

SEQ ID NO: 1260384 - RNA, 23 nt, Human
cuucaguacccucucagcuccag

SEQ ID NO: 1260385 - RNA, 18 nt, Human
cuugaaaauuaacaugaa

SEQ ID NO: 1260386 - RNA, 22 nt, Human
cuugaaaauaagaauagaaaua

SEQ ID NO: 1260387 - RNA, 13 nt, Human
cuugaaagaaaug

SEQ ID NO: 1260388 - RNA, 13 nt, Human
cuugaaaauuaac

SEQ ID NO: 1260389 - RNA, 12 nt, Human
cuugaaaauuaa

SEQ ID NO: 1260390 - RNA, 21 nt, Human
cuugaaagaagaaaagguucu

SEQ ID NO: 1260391 - RNA, 19 nt, Human
cuugaaagaagaaaagguu

SEQ ID NO: 1260392 - RNA, 15 nt, Human
cuugaaauuuuaacc

SEQ ID NO: 1260393 - RNA, 16 nt, Human
cuugaaauuuuaaccu

SEQ ID NO: 1260394 - RNA, 17 nt, Human
cuugaaauuuuaaccua

SEQ ID NO: 1260395 - RNA, 18 nt, Human
cuugaaaaaugcauguug

SEQ ID NO: 1260396 - RNA, 12 nt, Human
cuugaaaaaugc

SEQ ID NO: 1260397 - RNA, 14 nt, Human
cuucuuuagaacag

SEQ ID NO: 1260398 - RNA, 14 nt, Human
cuugaaaaaaaaca

SEQ ID NO: 1260399 - RNA, 16 nt, Human
cuugaaaaaaaacagu

SEQ ID NO: 1260400 - RNA, 18 nt, Human
cuugaaaaaaaacagugg

SEQ ID NO: 1260401 - RNA, 15 nt, Human
cuugaaaaagacauu

SEQ ID NO: 1260402 - RNA, 20 nt, Human
cuugaaaaaaaacaguggau

SEQ ID NO: 1260403 - RNA, 16 nt, Human
cuugaaaauaagaaua

SEQ ID NO: 1260404 - RNA, 16 nt, Human
cuucuuggccauggga

SEQ ID NO: 1260405 - RNA, 16 nt, Human
cuucuuguguguaugc

SEQ ID NO: 1260406 - RNA, 15 nt, Human
cuucuguugcugccu

SEQ ID NO: 1260407 - RNA, 13 nt, Human
cuucuugccucug

SEQ ID NO: 1260408 - RNA, 15 nt, Human
cuucuugccucugug

SEQ ID NO: 1260409 - RNA, 16 nt, Human
cuucuugccucugugc

SEQ ID NO: 1260410 - RNA, 17 nt, Human
cuucuugccucugugcu

SEQ ID NO: 1260411 - RNA, 18 nt, Human
cuucuugccucugugcug

SEQ ID NO: 1260412 - RNA, 20 nt, Human
cuucuugcuucuuucuagaa

SEQ ID NO: 1260413 - RNA, 21 nt, Human
cuucuugcuucuuucuagaaa

SEQ ID NO: 1260414 - RNA, 18 nt, Human
cuucuuggccaugggagg

SEQ ID NO: 1260415 - RNA, 15 nt, Human
cuucuguggcucaca

SEQ ID NO: 1260416 - RNA, 22 nt, Human
cuucuguggcucacagaacccu

SEQ ID NO: 1260417 - RNA, 13 nt, Human
cuucuguggcuca

SEQ ID NO: 1260418 - RNA, 13 nt, Human
cuugaacuccuga

SEQ ID NO: 1260419 - RNA, 16 nt, Human
cuugaacuccugaccu

SEQ ID NO: 1260420 - RNA, 14 nt, Human
cuugaacccgggag

SEQ ID NO: 1260421 - RNA, 23 nt, Human
cuugaacccaggucucccuggau

SEQ ID NO: 1260422 - RNA, 16 nt, Human
cuugaacguuuucuaa

SEQ ID NO: 1260423 - RNA, 17 nt, Human
cuugaacguuuucuaau

SEQ ID NO: 1260424 - RNA, 18 nt, Human
cuugaacguuuucuaauu

SEQ ID NO: 1260425 - RNA, 18 nt, Human
cuugaacuccugaccuca

SEQ ID NO: 1260426 - RNA, 19 nt, Human
cuugaacguuuucuaauug

SEQ ID NO: 1260427 - RNA, 21 nt, Human
cuugaacguuuucuaauugcu

SEQ ID NO: 1260428 - RNA, 12 nt, Human
cuugaagaacug

SEQ ID NO: 1260429 - RNA, 17 nt, Human
cuugaagaacugcaggc

SEQ ID NO: 1260430 - RNA, 18 nt, Human
cuugaagaacugcaggcc

SEQ ID NO: 1260431 - RNA, 20 nt, Human
cuugaagaacugcaggcccu

SEQ ID NO: 1260432 - RNA, 22 nt, Human
cuugaagaacugcaggcccugg

SEQ ID NO: 1260433 - RNA, 22 nt, Human
cuugaacguuuucuaauugcuu

SEQ ID NO: 1260434 - RNA, 13 nt, Human
cuugacccugagc

SEQ ID NO: 1260435 - RNA, 15 nt, Human
cuugacccugagcug

SEQ ID NO: 1260436 - RNA, 14 nt, Human
cuugacccugagcu

SEQ ID NO: 1260437 - RNA, 14 nt, Human
cuugaccugaggcu

SEQ ID NO: 1260438 - RNA, 17 nt, Human
cuugaccugaggcugug

SEQ ID NO: 1260439 - RNA, 20 nt, Human
cuugaccugaggcugugguc

SEQ ID NO: 1260440 - RNA, 23 nt, Human
cuugaccugaggcuguggucaca

SEQ ID NO: 1260441 - RNA, 14 nt, Human
cuugaggucucagc

SEQ ID NO: 1260442 - RNA, 15 nt, Human
cuugaggucucagcc

SEQ ID NO: 1260443 - RNA, 16 nt, Human
cuugaggucucagccc

SEQ ID NO: 1260444 - RNA, 11 nt, Human
cuugagcucua

SEQ ID NO: 1260445 - RNA, 12 nt, Human
cuugagcucuau

SEQ ID NO: 1260446 - RNA, 14 nt, Human
cuugagcucuauua

SEQ ID NO: 1260447 - RNA, 15 nt, Human
cuugagcucuauuau

SEQ ID NO: 1260448 - RNA, 16 nt, Human
cuugagcucuauuaug

SEQ ID NO: 1260449 - RNA, 18 nt, Human
cuugagcucuauuaugaa

SEQ ID NO: 1260450 - RNA, 13 nt, Human
cuucuccacugga

SEQ ID NO: 1260451 - RNA, 16 nt, Human
cuuccuguccagcucc

SEQ ID NO: 1260452 - RNA, 14 nt, Human
cuucuccacuggau

SEQ ID NO: 1260453 - RNA, 15 nt, Human
cuucuccacuggaug

SEQ ID NO: 1260454 - RNA, 15 nt, Human
cuuccucccucauuc

SEQ ID NO: 1260455 - RNA, 22 nt, Human
cuuccuggagcagaagcagcaa

SEQ ID NO: 1260456 - RNA, 19 nt, Human
cuuccuggccgccuggguc

SEQ ID NO: 1260457 - RNA, 11 nt, Human
cuuccuggccg

SEQ ID NO: 1260458 - RNA, 20 nt, Human
cuuccuggggcaucuggcga

SEQ ID NO: 1260459 - RNA, 23 nt, Human
cuuccuggggcaucuggcgaauc

SEQ ID NO: 1260460 - RNA, 23 nt, Human
cuuccugguagaccacugccaua

SEQ ID NO: 1260461 - RNA, 15 nt, Human
cuuccuggugcugga

SEQ ID NO: 1260462 - RNA, 17 nt, Human
cuucuccacuggaugga

SEQ ID NO: 1260463 - RNA, 13 nt, Human
cuucuccccugca

SEQ ID NO: 1260464 - RNA, 14 nt, Human
cuucuccccugcac

SEQ ID NO: 1260465 - RNA, 16 nt, Human
cuucuccccugcacug

SEQ ID NO: 1260466 - RNA, 17 nt, Human
cuucuccccugcacugu

SEQ ID NO: 1260467 - RNA, 18 nt, Human
cuucuccccugcacugua

SEQ ID NO: 1260468 - RNA, 19 nt, Human
cuucuccccugcacuguaa

SEQ ID NO: 1260469 - RNA, 20 nt, Human
cuucuccccugcacuguaaa

SEQ ID NO: 1260470 - RNA, 21 nt, Human
cuucuccccugcacuguaaaa

SEQ ID NO: 1260471 - RNA, 23 nt, Human
cuucuccccugcacuguaaaaug

SEQ ID NO: 1260472 - RNA, 22 nt, Human
cuucuccccugcacuguaaaau

SEQ ID NO: 1260473 - RNA, 13 nt, Human
cuucucccuggaa

SEQ ID NO: 1260474 - RNA, 16 nt, Human
cuucucccuggaauga

SEQ ID NO: 1260475 - RNA, 16 nt, Human
cuucuccucuccuagc

SEQ ID NO: 1260476 - RNA, 13 nt, Human
cuucucucugugg

SEQ ID NO: 1260477 - RNA, 12 nt, Human
cuucucugacuu

SEQ ID NO: 1260478 - RNA, 14 nt, Human
cuucucugacuucu

SEQ ID NO: 1260479 - RNA, 15 nt, Human
cuucucugacuucug

SEQ ID NO: 1260480 - RNA, 16 nt, Human
cuucucugacuucugc

SEQ ID NO: 1260481 - RNA, 17 nt, Human
cuucucugacuucugcc

SEQ ID NO: 1260482 - RNA, 20 nt, Human
cuucucugacuucugccugg

SEQ ID NO: 1260483 - RNA, 14 nt, Human
cuucucuccagcug

SEQ ID NO: 1260484 - RNA, 15 nt, Human
cuucucuccagcuga

SEQ ID NO: 1260485 - RNA, 16 nt, Human
cuucucuccagcugac

SEQ ID NO: 1260486 - RNA, 17 nt, Human
cuucucuccagcugacu

SEQ ID NO: 1260487 - RNA, 18 nt, Human
cuucucuccagcugacua

SEQ ID NO: 1260488 - RNA, 19 nt, Human
cuucucuccagcugacuaa

SEQ ID NO: 1260489 - RNA, 14 nt, Human
cuucucuccagugc

SEQ ID NO: 1260490 - RNA, 13 nt, Human
cuucucucucccu

SEQ ID NO: 1260491 - RNA, 16 nt, Human
cuucucucugugggau

SEQ ID NO: 1260492 - RNA, 15 nt, Human
cuucuguaauugugu

SEQ ID NO: 1260493 - RNA, 20 nt, Human
cuucuguaauuguguggauu

SEQ ID NO: 1260494 - RNA, 13 nt, Human
cuucugcuggggc

SEQ ID NO: 1260495 - RNA, 15 nt, Human
cuucugcuggggccu

SEQ ID NO: 1260496 - RNA, 18 nt, Human
cuucugcuggggccuggg

SEQ ID NO: 1260497 - RNA, 21 nt, Human
cuucugcuggggccugggaca

SEQ ID NO: 1260498 - RNA, 19 nt, Human
cuucugcuggggccuggga

SEQ ID NO: 1260499 - RNA, 21 nt, Human
cuucucugacuucugccugga

SEQ ID NO: 1260500 - RNA, 15 nt, Human
cuucugcccccugca

SEQ ID NO: 1260501 - RNA, 16 nt, Human
cuucugcccccugcag

SEQ ID NO: 1260502 - RNA, 17 nt, Human
cuucugcccccugcaga

SEQ ID NO: 1260503 - RNA, 13 nt, Human
cuucugccuggag

SEQ ID NO: 1260504 - RNA, 14 nt, Human
cuucugccuggaga

SEQ ID NO: 1260505 - RNA, 15 nt, Human
cuucugccuggagac

SEQ ID NO: 1260506 - RNA, 16 nt, Human
cuucugccuggagacu

SEQ ID NO: 1260507 - RNA, 18 nt, Human
cuucugccuuagucucag

SEQ ID NO: 1260508 - RNA, 19 nt, Human
cuucugccuuagucucagu

SEQ ID NO: 1260509 - RNA, 14 nt, Human
cuucugguugaugc

SEQ ID NO: 1260510 - RNA, 16 nt, Human
cuucuggguuccuucc

SEQ ID NO: 1260511 - RNA, 17 nt, Human
cuucuggguuccuuccu

SEQ ID NO: 1260512 - RNA, 23 nt, Human
cuucuggguuccuuccucugagc

SEQ ID NO: 1260513 - RNA, 22 nt, Human
cuucugggagggcagcagggcu

SEQ ID NO: 1260514 - RNA, 23 nt, Human
cuucugggagggcagcagggcua

SEQ ID NO: 1260515 - RNA, 16 nt, Human
cuucugggccugacca

SEQ ID NO: 1260516 - RNA, 21 nt, Human
cuucugggcuucaucuggcaa

SEQ ID NO: 1260517 - RNA, 22 nt, Human
cuucugggcuucaucuggcaac

SEQ ID NO: 1260518 - RNA, 14 nt, Human
cuucuggggcaggc

SEQ ID NO: 1260519 - RNA, 15 nt, Human
cuucuggggcaggcu

SEQ ID NO: 1260520 - RNA, 16 nt, Human
cuucuggggcaggcug

SEQ ID NO: 1260521 - RNA, 19 nt, Human
cuucuggggcaggcugggc

SEQ ID NO: 1260522 - RNA, 20 nt, Human
cuucuggggcaggcugggcc

SEQ ID NO: 1260523 - RNA, 22 nt, Human
cuucuggggcaggcugggccau

SEQ ID NO: 1260524 - RNA, 21 nt, Human
cuucuggggcaggcugggcca

SEQ ID NO: 1260525 - RNA, 15 nt, Human
cuguguggcagucug

SEQ ID NO: 1260526 - RNA, 20 nt, Human
cugugugcuuuuuuugugug

SEQ ID NO: 1260527 - RNA, 12 nt, Human
cuguguggagag

SEQ ID NO: 1260528 - RNA, 15 nt, Human
cuguguggagaggga

SEQ ID NO: 1260529 - RNA, 16 nt, Human
cuguguggagagggaa

SEQ ID NO: 1260530 - RNA, 22 nt, Human
cuguguggagagggaaugugaa

SEQ ID NO: 1260531 - RNA, 23 nt, Human
cuguguggagagggaaugugaaa

SEQ ID NO: 1260532 - RNA, 23 nt, Human
cugugugcucaggagcccuggga

SEQ ID NO: 1260533 - RNA, 13 nt, Human
cugugugcuuuuu

SEQ ID NO: 1260534 - RNA, 21 nt, Human
cugugugcucaggagcccugg

SEQ ID NO: 1260535 - RNA, 20 nt, Human
cugugugcucaggagcccug

SEQ ID NO: 1260536 - RNA, 19 nt, Human
cugugugcucaggagcccu

SEQ ID NO: 1260537 - RNA, 21 nt, Human
cugugggggguaaucccugcu

SEQ ID NO: 1260538 - RNA, 23 nt, Human
cugugggcgugagaccugccccu

SEQ ID NO: 1260539 - RNA, 15 nt, Human
cugugggcuggcagu

SEQ ID NO: 1260540 - RNA, 12 nt, Human
cuguguguguga

SEQ ID NO: 1260541 - RNA, 14 nt, Human
cugugugugugaau

SEQ ID NO: 1260542 - RNA, 16 nt, Human
cugugugugugaauga

SEQ ID NO: 1260543 - RNA, 17 nt, Human
cugugugugugaaugaa

SEQ ID NO: 1260544 - RNA, 18 nt, Human
cugugugugugaaugaac

SEQ ID NO: 1260545 - RNA, 23 nt, Human
cugugugugugaaugaacacucu

SEQ ID NO: 1260546 - RNA, 21 nt, Human
cugugugugugaaugaacacu

SEQ ID NO: 1260547 - RNA, 17 nt, Human
cuguguguuaagcucug

SEQ ID NO: 1260548 - RNA, 18 nt, Human
cuguguguuaagcucugc

SEQ ID NO: 1260549 - RNA, 19 nt, Human
cuguguguuaagcucugcu

SEQ ID NO: 1260550 - RNA, 20 nt, Human
cuguguguuaagcucugcua

SEQ ID NO: 1260551 - RNA, 15 nt, Human
cuguguuuccaucuc

SEQ ID NO: 1260552 - RNA, 23 nt, Human
cuguguuuccaucucaaagaagg

SEQ ID NO: 1260553 - RNA, 13 nt, Human
cuguguuucuugc

SEQ ID NO: 1260554 - RNA, 15 nt, Human
cuguguuucuugccu

SEQ ID NO: 1260555 - RNA, 17 nt, Human
cuguguuucuugccuca

SEQ ID NO: 1260556 - RNA, 18 nt, Human
cuguguuucuugccucau

SEQ ID NO: 1260557 - RNA, 16 nt, Human
cuguguuuggcuuuca

SEQ ID NO: 1260558 - RNA, 17 nt, Human
cuguguuuggcuuucag

SEQ ID NO: 1260559 - RNA, 18 nt, Human
cuguguuuggcuuucagg

SEQ ID NO: 1260560 - RNA, 17 nt, Human
cuguguuuugaaagaau

SEQ ID NO: 1260561 - RNA, 23 nt, Human
cuguguuuggcuuucagggaggc

SEQ ID NO: 1260562 - RNA, 22 nt, Human
cuguguuuggcuuucagggagg

SEQ ID NO: 1260563 - RNA, 16 nt, Human
cuguguuuugaaagaa

SEQ ID NO: 1260564 - RNA, 22 nt, Human
cuguucauuccuccagguauuc

SEQ ID NO: 1260565 - RNA, 14 nt, Human
cuguucauuuccuc

SEQ ID NO: 1260566 - RNA, 17 nt, Human
cuguucauuuccucaaa

SEQ ID NO: 1260567 - RNA, 17 nt, Human
cuguucauuccuccagg

SEQ ID NO: 1260568 - RNA, 16 nt, Human
cuguucauuccuccag

SEQ ID NO: 1260569 - RNA, 15 nt, Human
cuguucauuccucca

SEQ ID NO: 1260570 - RNA, 15 nt, Human
cuguucaguugcacu

SEQ ID NO: 1260571 - RNA, 14 nt, Human
cuguucauggcaga

SEQ ID NO: 1260572 - RNA, 17 nt, Human
cuguucaugaaagauuc

SEQ ID NO: 1260573 - RNA, 18 nt, Human
cuguucaugaaagauuca

SEQ ID NO: 1260574 - RNA, 23 nt, Human
cuguucaugaaagauucaaugcc

SEQ ID NO: 1260575 - RNA, 18 nt, Human
cuguucccauucuugcau

SEQ ID NO: 1260576 - RNA, 13 nt, Human
cuguuccccagag

SEQ ID NO: 1260577 - RNA, 14 nt, Human
cuguuccccagaga

SEQ ID NO: 1260578 - RNA, 15 nt, Human
cuguuccccagagaa

SEQ ID NO: 1260579 - RNA, 16 nt, Human
cuguuccccagagaaa

SEQ ID NO: 1260580 - RNA, 23 nt, Human
cuguucauggcagauguaggagg

SEQ ID NO: 1260581 - RNA, 11 nt, Human
cuguuccaaau

SEQ ID NO: 1260582 - RNA, 14 nt, Human
cuguuccaaauuca

SEQ ID NO: 1260583 - RNA, 17 nt, Human
cuguuccaaauucaguu

SEQ ID NO: 1260584 - RNA, 18 nt, Human
cuguuccaaauucaguuu

SEQ ID NO: 1260585 - RNA, 20 nt, Human
cuguuccaaauucaguuuca

SEQ ID NO: 1260586 - RNA, 21 nt, Human
cuguuccaaauucaguuucau

SEQ ID NO: 1260587 - RNA, 22 nt, Human
cuguuccaaauucaguuucaua

SEQ ID NO: 1260588 - RNA, 20 nt, Human
cuguuccagugguaagcuau

SEQ ID NO: 1260589 - RNA, 19 nt, Human
cuguuacacuuuuuggaag

SEQ ID NO: 1260590 - RNA, 18 nt, Human
cuguuacacuuuuuggaa

SEQ ID NO: 1260591 - RNA, 12 nt, Human
cuguuccuuuua

SEQ ID NO: 1260592 - RNA, 12 nt, Human
cuguucuaaagc

SEQ ID NO: 1260593 - RNA, 17 nt, Human
cuguucuaaagcucuga

SEQ ID NO: 1260594 - RNA, 20 nt, Human
cuguucuacauagaugcuua

SEQ ID NO: 1260595 - RNA, 17 nt, Human
cuguuccugcugcuguc

SEQ ID NO: 1260596 - RNA, 18 nt, Human
cuguuccugcugcugucu

SEQ ID NO: 1260597 - RNA, 21 nt, Human
cuguuccugcugcugucuggg

SEQ ID NO: 1260598 - RNA, 13 nt, Human
cuguuccuucccu

SEQ ID NO: 1260599 - RNA, 22 nt, Human
cuguuccuucccugugccuccu

SEQ ID NO: 1260600 - RNA, 14 nt, Human
cuguuccuuuuaua

SEQ ID NO: 1260601 - RNA, 12 nt, Human
cuguucccccug

SEQ ID NO: 1260602 - RNA, 15 nt, Human
cuguucccccugugc

SEQ ID NO: 1260603 - RNA, 16 nt, Human
cuguucccccugugca

SEQ ID NO: 1260604 - RNA, 17 nt, Human
cuguucccccugugcag

SEQ ID NO: 1260605 - RNA, 12 nt, Human
cuguuccugcug

SEQ ID NO: 1260606 - RNA, 13 nt, Human
cuguuccugcugc

SEQ ID NO: 1260607 - RNA, 14 nt, Human
cuguuccugcugcu

SEQ ID NO: 1260608 - RNA, 15 nt, Human
cuguuccugcugcug

SEQ ID NO: 1260609 - RNA, 16 nt, Human
cuguuccugcugcugu

SEQ ID NO: 1260610 - RNA, 19 nt, Human
cuguucuacauagaugcuu

SEQ ID NO: 1260611 - RNA, 16 nt, Human
cuguucuaaagcucug

SEQ ID NO: 1260612 - RNA, 12 nt, Human
cuguucuaguuu

SEQ ID NO: 1260613 - RNA, 14 nt, Human
cuguucuaguuuuu

SEQ ID NO: 1260614 - RNA, 19 nt, Human
cuguucuaguuuuuuacuu

SEQ ID NO: 1260615 - RNA, 15 nt, Human
cuguucucuugggaa

SEQ ID NO: 1260616 - RNA, 22 nt, Human
cugucuccuaagcuggagugca

SEQ ID NO: 1260617 - RNA, 19 nt, Human
cugucuccuaccucugcuc

SEQ ID NO: 1260618 - RNA, 13 nt, Human
cugucuccuagga

SEQ ID NO: 1260619 - RNA, 21 nt, Human
cugucucccuccucugcccgg

SEQ ID NO: 1260620 - RNA, 20 nt, Human
cugucuccauggcccugcaa

SEQ ID NO: 1260621 - RNA, 23 nt, Human
cugucucaagagggcacuggugg

SEQ ID NO: 1260622 - RNA, 18 nt, Human
cugucucaagcucuuccu

SEQ ID NO: 1260623 - RNA, 20 nt, Human
cugucucaagcucuuccuua

SEQ ID NO: 1260624 - RNA, 12 nt, Human
cugucucaccug

SEQ ID NO: 1260625 - RNA, 14 nt, Human
cugucucaccugga

SEQ ID NO: 1260626 - RNA, 17 nt, Human
cugucucaccuggacuu

SEQ ID NO: 1260627 - RNA, 20 nt, Human
cugugagucuuugguucuaa

SEQ ID NO: 1260628 - RNA, 21 nt, Human
cugugagucuuugguucuaag

SEQ ID NO: 1260629 - RNA, 22 nt, Human
cugugagucuuugguucuaagg

SEQ ID NO: 1260630 - RNA, 23 nt, Human
cugugagucuuugguucuaagga

SEQ ID NO: 1260631 - RNA, 15 nt, Human
cugugaguucucccu

SEQ ID NO: 1260632 - RNA, 22 nt, Human
cugugaguucucccuguacagu

SEQ ID NO: 1260633 - RNA, 16 nt, Human
cugugaguucucccug

SEQ ID NO: 1260634 - RNA, 17 nt, Human
cugugaguucucccugu

SEQ ID NO: 1260635 - RNA, 22 nt, Human
cugugaucugggucucuaaucu

SEQ ID NO: 1260636 - RNA, 16 nt, Human
cugugcaaggccuggu

SEQ ID NO: 1260637 - RNA, 20 nt, Human
cugugcaagguauuacacuc

SEQ ID NO: 1260638 - RNA, 19 nt, Human
cugugcacaaaacccagac

SEQ ID NO: 1260639 - RNA, 20 nt, Human
cugugcacaaaacccagacc

SEQ ID NO: 1260640 - RNA, 18 nt, Human
cugugaguucucccugua

SEQ ID NO: 1260641 - RNA, 13 nt, Human
cugugcacagccc

SEQ ID NO: 1260642 - RNA, 12 nt, Human
cugugcacagcc

SEQ ID NO: 1260643 - RNA, 11 nt, Human
cugugcacagc

SEQ ID NO: 1260644 - RNA, 22 nt, Human
cugugcacaccccacucccaca

SEQ ID NO: 1260645 - RNA, 18 nt, Human
cugugcacaucugugucu

SEQ ID NO: 1260646 - RNA, 19 nt, Human
cugugcacaucugugucuu

SEQ ID NO: 1260647 - RNA, 22 nt, Human
cugugcacaaaacccagaccug

SEQ ID NO: 1260648 - RNA, 17 nt, Human
cugugcacaccccacuc

SEQ ID NO: 1260649 - RNA, 21 nt, Human
cugugcacaccccacucccac

SEQ ID NO: 1260650 - RNA, 20 nt, Human
cugugcacaucugugucuug

SEQ ID NO: 1260651 - RNA, 21 nt, Human
cugugcacaucugugucuugu

SEQ ID NO: 1260652 - RNA, 15 nt, Human
cugugccauguguuu

SEQ ID NO: 1260653 - RNA, 18 nt, Human
cugugccucagagaccag

SEQ ID NO: 1260654 - RNA, 22 nt, Human
cugugccucagagaccagggcu

SEQ ID NO: 1260655 - RNA, 13 nt, Human
cugugccuccuca

SEQ ID NO: 1260656 - RNA, 15 nt, Human
cugugccuccucacc

SEQ ID NO: 1260657 - RNA, 16 nt, Human
cugugccuccucaccc

SEQ ID NO: 1260658 - RNA, 19 nt, Human
cugugccucagagaccagg

SEQ ID NO: 1260659 - RNA, 14 nt, Human
cugugccuccuccc

SEQ ID NO: 1260660 - RNA, 15 nt, Human
cugugccuccucccu

SEQ ID NO: 1260661 - RNA, 16 nt, Human
cugugccuccucccuc

SEQ ID NO: 1260662 - RNA, 11 nt, Human
cugugccucug

SEQ ID NO: 1260663 - RNA, 17 nt, Human
cugugccuccucccucc

SEQ ID NO: 1260664 - RNA, 18 nt, Human
cugugccuccucccuccc

SEQ ID NO: 1260665 - RNA, 21 nt, Human
cugugccuccucccucccucu

SEQ ID NO: 1260666 - RNA, 17 nt, Human
cugugccucgcucccca

SEQ ID NO: 1260667 - RNA, 22 nt, Human
cugugccucgcuccccacucug

SEQ ID NO: 1260668 - RNA, 23 nt, Human
cugugccucgcuccccacucugc

SEQ ID NO: 1260669 - RNA, 24 nt, Human
cugugccucgcuccccacucugcu

SEQ ID NO: 1260670 - RNA, 12 nt, Human
cugugcuggcca

SEQ ID NO: 1260671 - RNA, 13 nt, Human
cugugcuggccag

SEQ ID NO: 1260672 - RNA, 21 nt, Human
cugugcuguuguuaugaugug

SEQ ID NO: 1260673 - RNA, 19 nt, Human
cugugcuguuguuaugaug

SEQ ID NO: 1260674 - RNA, 17 nt, Human
cugugcuguuguuauga

SEQ ID NO: 1260675 - RNA, 17 nt, Human
cugugcuucgggcccuu

SEQ ID NO: 1260676 - RNA, 19 nt, Human
cugugcuucgggcccuucc

SEQ ID NO: 1260677 - RNA, 13 nt, Human
cugugcuguuguu

SEQ ID NO: 1260678 - RNA, 18 nt, Human
cugugcugugugugacgu

SEQ ID NO: 1260679 - RNA, 14 nt, Human
cugugcuguuucaa

SEQ ID NO: 1260680 - RNA, 19 nt, Human
cugugcuguuucaaaguuc

SEQ ID NO: 1260681 - RNA, 16 nt, Human
cugugcuuaugguacc

SEQ ID NO: 1260682 - RNA, 14 nt, Human
cugugcuggccagc

SEQ ID NO: 1260683 - RNA, 11 nt, Human
cugugcugugu

SEQ ID NO: 1260684 - RNA, 13 nt, Human
cugugcugugugu

SEQ ID NO: 1260685 - RNA, 20 nt, Human
cugugcuucgggcccuuccc

SEQ ID NO: 1260686 - RNA, 21 nt, Human
cugugcuucgggcccuuccca

SEQ ID NO: 1260687 - RNA, 17 nt, Human
cugugcuuuuaaaugca

SEQ ID NO: 1260688 - RNA, 21 nt, Human
cuguggcgccgucuccagggg

SEQ ID NO: 1260689 - RNA, 24 nt, Human
cuguggcgccgucuccaggggcug

SEQ ID NO: 1260690 - RNA, 21 nt, Human
cugugggcgugagaccugccc

SEQ ID NO: 1260691 - RNA, 22 nt, Human
cugugggcgugagaccugcccc

SEQ ID NO: 1260692 - RNA, 19 nt, Human
cuguggcaggccagcugug

SEQ ID NO: 1260693 - RNA, 18 nt, Human
cuguggcaugggugaaga

SEQ ID NO: 1260694 - RNA, 12 nt, Human
cuguggccagga

SEQ ID NO: 1260695 - RNA, 17 nt, Human
cuguggcgccgucucca

SEQ ID NO: 1260696 - RNA, 19 nt, Human
cuguggcgccgucuccagg

SEQ ID NO: 1260697 - RNA, 20 nt, Human
cuguggcgccgucuccaggg

SEQ ID NO: 1260698 - RNA, 23 nt, Human
cuguggauuuuuuccuucaaagu

SEQ ID NO: 1260699 - RNA, 17 nt, Human
cuguggcagaguuacag

SEQ ID NO: 1260700 - RNA, 18 nt, Human
cuguggcagaguuacagu

SEQ ID NO: 1260701 - RNA, 19 nt, Human
cuguggcagaguuacaguu

SEQ ID NO: 1260702 - RNA, 22 nt, Human
cuguggcagaguuacaguucug

SEQ ID NO: 1260703 - RNA, 23 nt, Human
cuguggcagaguuacaguucugu

SEQ ID NO: 1260704 - RNA, 23 nt, Human
cuguggcaggccagcugugguuu

SEQ ID NO: 1260705 - RNA, 18 nt, Human
cuguggcaggccagcugu

SEQ ID NO: 1260706 - RNA, 14 nt, Human
cuguauauacuuuu

SEQ ID NO: 1260707 - RNA, 15 nt, Human
cuguauauacuuuuu

SEQ ID NO: 1260708 - RNA, 14 nt, Human
cuguauauucagga

SEQ ID NO: 1260709 - RNA, 22 nt, Human
cuguauauuacagauauuuguc

SEQ ID NO: 1260710 - RNA, 16 nt, Human
cuguaucaggacccag

SEQ ID NO: 1260711 - RNA, 22 nt, Human
cuguaucaggacccagaggaag

SEQ ID NO: 1260712 - RNA, 23 nt, Human
cuguaucaggacccagaggaagg

SEQ ID NO: 1260713 - RNA, 15 nt, Human
cuguauaaaugucuu

SEQ ID NO: 1260714 - RNA, 14 nt, Human
cuguauaaaugucu

SEQ ID NO: 1260715 - RNA, 16 nt, Human
cuguacacaacucacu

SEQ ID NO: 1260716 - RNA, 17 nt, Human
cuguacacaacucacuc

SEQ ID NO: 1260717 - RNA, 20 nt, Human
cuguacacaacucacuccuu

SEQ ID NO: 1260718 - RNA, 22 nt, Human
cuguacacaacucacuccuuuu

SEQ ID NO: 1260719 - RNA, 13 nt, Human
cuguacacugcac

SEQ ID NO: 1260720 - RNA, 15 nt, Human
cuguacacugcacga

SEQ ID NO: 1260721 - RNA, 16 nt, Human
cuguagugcuacaggg

SEQ ID NO: 1260722 - RNA, 20 nt, Human
cuguagugcuacagggucca

SEQ ID NO: 1260723 - RNA, 20 nt, Human
cuguagugucacucaaggcg

SEQ ID NO: 1260724 - RNA, 22 nt, Human
cuguauuuuaaaagaaugauua

SEQ ID NO: 1260725 - RNA, 21 nt, Human
cuguaugaucaaauguuuaau

SEQ ID NO: 1260726 - RNA, 19 nt, Human
cuguaugaucaaauguuua

SEQ ID NO: 1260727 - RNA, 20 nt, Human
cuguauuuuaaaagaaugau

SEQ ID NO: 1260728 - RNA, 23 nt, Human
cuguauccagguucccucccaga

SEQ ID NO: 1260729 - RNA, 18 nt, Human
cuguaugaucaaauguuu

SEQ ID NO: 1260730 - RNA, 17 nt, Human
cuguaugaucaaauguu

SEQ ID NO: 1260731 - RNA, 16 nt, Human
cuguaugaucaaaugu

SEQ ID NO: 1260732 - RNA, 15 nt, Human
cuguaugaucaaaug

SEQ ID NO: 1260733 - RNA, 14 nt, Human
cuguaugaucaaau

SEQ ID NO: 1260734 - RNA, 13 nt, Human
cuguaugaucaaa

SEQ ID NO: 1260735 - RNA, 18 nt, Human
cugucaagccauuuuuac

SEQ ID NO: 1260736 - RNA, 19 nt, Human
cugucaagccauuuuuaca

SEQ ID NO: 1260737 - RNA, 13 nt, Human
cugucaaggcuca

SEQ ID NO: 1260738 - RNA, 14 nt, Human
cugucaaggcucag

SEQ ID NO: 1260739 - RNA, 17 nt, Human
cuguccaggcacugcug

SEQ ID NO: 1260740 - RNA, 17 nt, Human
cuguccagcuccaaccu

SEQ ID NO: 1260741 - RNA, 18 nt, Human
cuguccagcuccaaccug

SEQ ID NO: 1260742 - RNA, 21 nt, Human
cuguccagcuccaaccugcaa

SEQ ID NO: 1260743 - RNA, 16 nt, Human
cuguccaggcacugag

SEQ ID NO: 1260744 - RNA, 12 nt, Human
cuguccagcucc

SEQ ID NO: 1260745 - RNA, 13 nt, Human
cuguccagcucca

SEQ ID NO: 1260746 - RNA, 14 nt, Human
cuguccagcuccaa

SEQ ID NO: 1260747 - RNA, 22 nt, Human
cugucucaagagggcacuggug

SEQ ID NO: 1260748 - RNA, 15 nt, Human
cuguccuccaacacc

SEQ ID NO: 1260749 - RNA, 23 nt, Human
cuguccuccaacaccaagcacag

SEQ ID NO: 1260750 - RNA, 14 nt, Human
cugucuaccugguc

SEQ ID NO: 1260751 - RNA, 20 nt, Human
cugucuacuugcucagguac

SEQ ID NO: 1260752 - RNA, 18 nt, Human
cugucuacuugcucaggu

SEQ ID NO: 1260753 - RNA, 13 nt, Human
cugucuauucuag

SEQ ID NO: 1260754 - RNA, 18 nt, Human
cuguccgagugugccaca

SEQ ID NO: 1260755 - RNA, 21 nt, Human
cuguccguucacauguguggu

SEQ ID NO: 1260756 - RNA, 14 nt, Human
cuguccucagccuu

SEQ ID NO: 1260757 - RNA, 18 nt, Human
cuguccucagccuugcca

SEQ ID NO: 1260758 - RNA, 20 nt, Human
cuguccucagccuugccaga

SEQ ID NO: 1260759 - RNA, 21 nt, Human
cuguccucagccuugccagag

SEQ ID NO: 1260760 - RNA, 22 nt, Human
cuguccucagccuugccagaga

SEQ ID NO: 1260761 - RNA, 19 nt, Human
cuguccaggcacugagaua

SEQ ID NO: 1260762 - RNA, 21 nt, Human
cugucccuccgggaccuggug

SEQ ID NO: 1260763 - RNA, 15 nt, Human
cuguccccugcuaca

SEQ ID NO: 1260764 - RNA, 21 nt, Human
cuguccccugcuacaccuauu

SEQ ID NO: 1260765 - RNA, 14 nt, Human
cuggugcugccucu

SEQ ID NO: 1260766 - RNA, 19 nt, Human
cuggugcugccucuaccug

SEQ ID NO: 1260767 - RNA, 12 nt, Human
cuggugcugcca

SEQ ID NO: 1260768 - RNA, 13 nt, Human
cuggugcugccac

SEQ ID NO: 1260769 - RNA, 20 nt, Human
cuggugcugccacacuucag

SEQ ID NO: 1260770 - RNA, 22 nt, Human
cuggugcugccacacuucaggc

SEQ ID NO: 1260771 - RNA, 21 nt, Human
cugguggcccgacagccuggc

SEQ ID NO: 1260772 - RNA, 22 nt, Human
cugguggcccgacagccuggca

SEQ ID NO: 1260773 - RNA, 23 nt, Human
cugguggcccgacagccuggcac

SEQ ID NO: 1260774 - RNA, 18 nt, Human
cuggucacaggacucugc

SEQ ID NO: 1260775 - RNA, 19 nt, Human
cuggucacaggacucugcc

SEQ ID NO: 1260776 - RNA, 19 nt, Human
cuggucaacuugagcaugu

SEQ ID NO: 1260777 - RNA, 20 nt, Human
cuggucaacuugagcauguu

SEQ ID NO: 1260778 - RNA, 21 nt, Human
cugguacucccucucaggauc

SEQ ID NO: 1260779 - RNA, 17 nt, Human
cugguauuguucucaca

SEQ ID NO: 1260780 - RNA, 23 nt, Human
cuggucccuguuuucccacgagg

SEQ ID NO: 1260781 - RNA, 19 nt, Human
cuggucccuuguauccccu

SEQ ID NO: 1260782 - RNA, 24 nt, Human
cuggucccuuguauccccugcagg

SEQ ID NO: 1260783 - RNA, 22 nt, Human
cuggucccuuguauccccugca

SEQ ID NO: 1260784 - RNA, 15 nt, Human
cugguccgugggacg

SEQ ID NO: 1260785 - RNA, 16 nt, Human
cugguccgugggacgg

SEQ ID NO: 1260786 - RNA, 19 nt, Human
cugguccgugggacggugc

SEQ ID NO: 1260787 - RNA, 21 nt, Human
cugguccgugggacggugccc

SEQ ID NO: 1260788 - RNA, 17 nt, Human
cugguccuauggccuca

SEQ ID NO: 1260789 - RNA, 21 nt, Human
cugguccuauggccucauguu

SEQ ID NO: 1260790 - RNA, 23 nt, Human
cuguacaaaaaaaucuuccaauu

SEQ ID NO: 1260791 - RNA, 22 nt, Human
cuguaaugugcgagggacccag

SEQ ID NO: 1260792 - RNA, 15 nt, Human
cuguaauguuaauau

SEQ ID NO: 1260793 - RNA, 17 nt, Human
cuguaauguuaauauug

SEQ ID NO: 1260794 - RNA, 18 nt, Human
cuguaauguuaauauuga

SEQ ID NO: 1260795 - RNA, 19 nt, Human
cuguaauguuaauauugau

SEQ ID NO: 1260796 - RNA, 18 nt, Human
cuguaauuauaucuaaaa

SEQ ID NO: 1260797 - RNA, 19 nt, Human
cuguaaucauauaauaaau

SEQ ID NO: 1260798 - RNA, 14 nt, Human
cuguaaucuaugaa

SEQ ID NO: 1260799 - RNA, 18 nt, Human
cuguaaugguacugacuu

SEQ ID NO: 1260800 - RNA, 14 nt, Human
cuguaauguuaaua

SEQ ID NO: 1260801 - RNA, 23 nt, Human
cuguaaucacagcuacuugggag

SEQ ID NO: 1260802 - RNA, 13 nt, Human
cugguuccucccc

SEQ ID NO: 1260803 - RNA, 12 nt, Human
cugguuccuccc

SEQ ID NO: 1260804 - RNA, 18 nt, Human
cugguucccguuucucca

SEQ ID NO: 1260805 - RNA, 21 nt, Human
cugguucccguuucuccaccu

SEQ ID NO: 1260806 - RNA, 17 nt, Human
cugguggcccucucccc

SEQ ID NO: 1260807 - RNA, 18 nt, Human
cugguggcccucuccccu

SEQ ID NO: 1260808 - RNA, 20 nt, Human
cugguggcccucuccccugc

SEQ ID NO: 1260809 - RNA, 22 nt, Human
cugguggcccucuccccugccc

SEQ ID NO: 1260810 - RNA, 15 nt, Human
cugggcuucaucugg

SEQ ID NO: 1260811 - RNA, 19 nt, Human
cugggcuucaucuggcaac

SEQ ID NO: 1260812 - RNA, 12 nt, Human
cugggcuuccug

SEQ ID NO: 1260813 - RNA, 13 nt, Human
cugggcuuccugg

SEQ ID NO: 1260814 - RNA, 14 nt, Human
cugggcuuccugga

SEQ ID NO: 1260815 - RNA, 15 nt, Human
cugggcuuccuggag

SEQ ID NO: 1260816 - RNA, 16 nt, Human
cugggcuuccuggagc

SEQ ID NO: 1260817 - RNA, 17 nt, Human
cugggcuuccuggagca

SEQ ID NO: 1260818 - RNA, 22 nt, Human
cugggcuuccuggagcagaagc

SEQ ID NO: 1260819 - RNA, 19 nt, Human
cugggcuuccuggagcaga

SEQ ID NO: 1260820 - RNA, 14 nt, Human
cuggggcuggccuc

SEQ ID NO: 1260821 - RNA, 18 nt, Human
cuggggcuggccucccaa

SEQ ID NO: 1260822 - RNA, 15 nt, Human
cuggggcuggccucc

SEQ ID NO: 1260823 - RNA, 18 nt, Human
cugggggcacaagacuga

SEQ ID NO: 1260824 - RNA, 22 nt, Human
cugggggcacaagacugacgcc

SEQ ID NO: 1260825 - RNA, 20 nt, Human
cugggggcacaagacugacg

SEQ ID NO: 1260826 - RNA, 22 nt, Human
cugggggggauuguaaaauggu

SEQ ID NO: 1260827 - RNA, 12 nt, Human
cugggggguggc

SEQ ID NO: 1260828 - RNA, 13 nt, Human
cugggggguggcc

SEQ ID NO: 1260829 - RNA, 12 nt, Human
cuggggugcagg

SEQ ID NO: 1260830 - RNA, 15 nt, Human
cuggggugcagggau

SEQ ID NO: 1260831 - RNA, 20 nt, Human
cuggggugcagggauguggg

SEQ ID NO: 1260832 - RNA, 18 nt, Human
cuggguaaugaaacaaag

SEQ ID NO: 1260833 - RNA, 16 nt, Human
cuggguaauaaaagug

SEQ ID NO: 1260834 - RNA, 15 nt, Human
cuggguacuucuuga

SEQ ID NO: 1260835 - RNA, 17 nt, Human
cuggguacuucuugaag

SEQ ID NO: 1260836 - RNA, 20 nt, Human
cuggguacuucuugaaggug

SEQ ID NO: 1260837 - RNA, 23 nt, Human
cuggguacuucuugaaggugcug

SEQ ID NO: 1260838 - RNA, 15 nt, Human
cugggggguggccag

SEQ ID NO: 1260839 - RNA, 13 nt, Human
cuggggucccagc

SEQ ID NO: 1260840 - RNA, 14 nt, Human
cuggggucccagca

SEQ ID NO: 1260841 - RNA, 15 nt, Human
cuggggucccagcag

SEQ ID NO: 1260842 - RNA, 16 nt, Human
cuggggucccagcagc

SEQ ID NO: 1260843 - RNA, 18 nt, Human
cuggggucccagcagcug

SEQ ID NO: 1260844 - RNA, 20 nt, Human
cuggggucccagcagcugcc

SEQ ID NO: 1260845 - RNA, 22 nt, Human
cuggggucccagcagcugccag

SEQ ID NO: 1260846 - RNA, 13 nt, Human
cuggggucuggag

SEQ ID NO: 1260847 - RNA, 22 nt, Human
cuggggucuggaguugaucugg

SEQ ID NO: 1260848 - RNA, 21 nt, Human
cuggggugacccggcaccccc

SEQ ID NO: 1260849 - RNA, 21 nt, Human
cuggggugcagggaugugggu

SEQ ID NO: 1260850 - RNA, 23 nt, Human
cugguacaguauggggguuguaa

SEQ ID NO: 1260851 - RNA, 14 nt, Human
cugguacccuccug

SEQ ID NO: 1260852 - RNA, 15 nt, Human
cugguacccuccugg

SEQ ID NO: 1260853 - RNA, 16 nt, Human
cugguacccuccuggc

SEQ ID NO: 1260854 - RNA, 18 nt, Human
cugguacucccucucagg

SEQ ID NO: 1260855 - RNA, 19 nt, Human
cugguacucccucucagga

SEQ ID NO: 1260856 - RNA, 20 nt, Human
cugguacucccucucaggau

SEQ ID NO: 1260857 - RNA, 14 nt, Human
cuggagugcagugg

SEQ ID NO: 1260858 - RNA, 14 nt, Human
cuggcacuuggaga

SEQ ID NO: 1260859 - RNA, 21 nt, Human
cuggcacuuggagacuuguau

SEQ ID NO: 1260860 - RNA, 21 nt, Human
cuggccagacacaggcccucc

SEQ ID NO: 1260861 - RNA, 19 nt, Human
cuggccaguccaggcugcc

SEQ ID NO: 1260862 - RNA, 21 nt, Human
cuggccaguccaggcugccgu

SEQ ID NO: 1260863 - RNA, 13 nt, Human
cuggccagacaca

SEQ ID NO: 1260864 - RNA, 15 nt, Human
cuggccagacacagg

SEQ ID NO: 1260865 - RNA, 17 nt, Human
cuggccagacacaggcc

SEQ ID NO: 1260866 - RNA, 18 nt, Human
cuggccagacacaggccc

SEQ ID NO: 1260867 - RNA, 19 nt, Human
cuggccagacacaggcccu

SEQ ID NO: 1260868 - RNA, 16 nt, Human
cuggcaguccguggga

SEQ ID NO: 1260869 - RNA, 22 nt, Human
cuggcaguccuggaagccagcu

SEQ ID NO: 1260870 - RNA, 19 nt, Human
cuggcaguccgugggacgg

SEQ ID NO: 1260871 - RNA, 20 nt, Human
cuggcaguuuauauuuaacu

SEQ ID NO: 1260872 - RNA, 22 nt, Human
cuggcaguuuauauuuaacucu

SEQ ID NO: 1260873 - RNA, 19 nt, Human
cuggcauacuauguggaug

SEQ ID NO: 1260874 - RNA, 17 nt, Human
cuggcaucgcaccauuc

SEQ ID NO: 1260875 - RNA, 18 nt, Human
cuggcaucgcaccauucu

SEQ ID NO: 1260876 - RNA, 19 nt, Human
cuggcaucgcaccauucug

SEQ ID NO: 1260877 - RNA, 20 nt, Human
cuggcaucgcaccauucuga

SEQ ID NO: 1260878 - RNA, 22 nt, Human
cuggcaucgcaccauucugacu

SEQ ID NO: 1260879 - RNA, 23 nt, Human
cuggcaucgcaccauucugacuc

SEQ ID NO: 1260880 - RNA, 16 nt, Human
cuggccauacuguguc

SEQ ID NO: 1260881 - RNA, 15 nt, Human
cuggccaguguuuaa

SEQ ID NO: 1260882 - RNA, 22 nt, Human
cuggccagugcccugaucccag

SEQ ID NO: 1260883 - RNA, 13 nt, Human
cuggccaguguuu

SEQ ID NO: 1260884 - RNA, 20 nt, Human
cuggccaguguuuaaaacuu

SEQ ID NO: 1260885 - RNA, 22 nt, Human
cuggccaguccaggcugccgug

SEQ ID NO: 1260886 - RNA, 23 nt, Human
cuggccaguccaggcugccgugg

SEQ ID NO: 1260887 - RNA, 17 nt, Human
cuggccagugcccugau

SEQ ID NO: 1260888 - RNA, 20 nt, Human
cuggccagugcccugauccc

SEQ ID NO: 1260889 - RNA, 21 nt, Human
cuggccagugcccugauccca

SEQ ID NO: 1260890 - RNA, 12 nt, Human
cuggccauggag

SEQ ID NO: 1260891 - RNA, 15 nt, Human
cuggccauggagaaa

SEQ ID NO: 1260892 - RNA, 16 nt, Human
cuggccauggagaaag

SEQ ID NO: 1260893 - RNA, 11 nt, Human
cuggcccagcc

SEQ ID NO: 1260894 - RNA, 12 nt, Human
cuggccccaccc

SEQ ID NO: 1260895 - RNA, 13 nt, Human
cuggccccaggac

SEQ ID NO: 1260896 - RNA, 23 nt, Human
cuggccccacccucguggacacc

SEQ ID NO: 1260897 - RNA, 17 nt, Human
cuggccauggagaaagc

SEQ ID NO: 1260898 - RNA, 13 nt, Human
cuggcccaucagg

SEQ ID NO: 1260899 - RNA, 22 nt, Human
cuggcccaucaggguaggcugg

SEQ ID NO: 1260900 - RNA, 17 nt, Human
cuggcccagggcccaga

SEQ ID NO: 1260901 - RNA, 18 nt, Human
cuggcccagggcccagag

SEQ ID NO: 1260902 - RNA, 19 nt, Human
cuggcccagggcccagagc

SEQ ID NO: 1260903 - RNA, 20 nt, Human
cuggcccagggcccagagcc

SEQ ID NO: 1260904 - RNA, 21 nt, Human
cuggcccagggcccagagccc

SEQ ID NO: 1260905 - RNA, 22 nt, Human
cuggcccagggcccagagccca

SEQ ID NO: 1260906 - RNA, 23 nt, Human
cuggcccagggcccagagcccag

SEQ ID NO: 1260907 - RNA, 14 nt, Human
cuggccucugcuuu

SEQ ID NO: 1260908 - RNA, 18 nt, Human
cuggccuggacuguuuuc

SEQ ID NO: 1260909 - RNA, 13 nt, Human
cuggccuggccag

SEQ ID NO: 1260910 - RNA, 14 nt, Human
cuggccuggccagu

SEQ ID NO: 1260911 - RNA, 15 nt, Human
cuggccuggccagug

SEQ ID NO: 1260912 - RNA, 17 nt, Human
cuggccuggccagugcc

SEQ ID NO: 1260913 - RNA, 22 nt, Human
cuggccuggacuguuuucucuc

SEQ ID NO: 1260914 - RNA, 12 nt, Human
cuggccucugcg

SEQ ID NO: 1260915 - RNA, 19 nt, Human
cuggccuggccagugcccu

SEQ ID NO: 1260916 - RNA, 19 nt, Human
cuggccuggccauacugug

SEQ ID NO: 1260917 - RNA, 22 nt, Human
cuggccuucggccuccauccug

SEQ ID NO: 1260918 - RNA, 23 nt, Human
cuggccuucggccuccauccuga

SEQ ID NO: 1260919 - RNA, 18 nt, Human
cuggcggcugggguccca

SEQ ID NO: 1260920 - RNA, 19 nt, Human
cuggcggcuggggucccag

SEQ ID NO: 1260921 - RNA, 22 nt, Human
cuggcggcuggggucccagcag

SEQ ID NO: 1260922 - RNA, 20 nt, Human
cuggcggcuggggucccagc

SEQ ID NO: 1260923 - RNA, 16 nt, Human
cuggcggggggcccau

SEQ ID NO: 1260924 - RNA, 15 nt, Human
cuggcggggggccca

SEQ ID NO: 1260925 - RNA, 13 nt, Human
cuggcuaaagcuc

SEQ ID NO: 1260926 - RNA, 12 nt, Human
cuggcugagggc

SEQ ID NO: 1260927 - RNA, 13 nt, Human
cuggcugagggca

SEQ ID NO: 1260928 - RNA, 23 nt, Human
cuggcugagggcaguucgcagcc

SEQ ID NO: 1260929 - RNA, 15 nt, Human
cuggcugagggcagu

SEQ ID NO: 1260930 - RNA, 19 nt, Human
cuggagaugaggccagacc

SEQ ID NO: 1260931 - RNA, 13 nt, Human
cuggagcacaaag

SEQ ID NO: 1260932 - RNA, 16 nt, Human
cuggagcacaaagacc

SEQ ID NO: 1260933 - RNA, 19 nt, Human
cuggagcacaaagacccug

SEQ ID NO: 1260934 - RNA, 22 nt, Human
cuggagcacaaagacccuggcu

SEQ ID NO: 1260935 - RNA, 23 nt, Human
cuggagcacaaagacccuggcuu

SEQ ID NO: 1260936 - RNA, 20 nt, Human
cuggagaugaggccagacca

SEQ ID NO: 1260937 - RNA, 18 nt, Human
cuggagaugaggccagac

SEQ ID NO: 1260938 - RNA, 17 nt, Human
cuggagaugaggccaga

SEQ ID NO: 1260939 - RNA, 16 nt, Human
cuggagaugaggccag

SEQ ID NO: 1260940 - RNA, 23 nt, Human
cuggagauccuccugcagaccac

SEQ ID NO: 1260941 - RNA, 18 nt, Human
cuggagauccuccugcag

SEQ ID NO: 1260942 - RNA, 20 nt, Human
cuggagauccuccugcagac

SEQ ID NO: 1260943 - RNA, 14 nt, Human
cuggagauccuccu

SEQ ID NO: 1260944 - RNA, 15 nt, Human
cuggagauccuccug

SEQ ID NO: 1260945 - RNA, 16 nt, Human
cuggagauccuccugc

SEQ ID NO: 1260946 - RNA, 17 nt, Human
cuggagauccuccugca

SEQ ID NO: 1260947 - RNA, 22 nt, Human
cuggagcacaauaaauggcugu

SEQ ID NO: 1260948 - RNA, 16 nt, Human
cuggagcucugcccau

SEQ ID NO: 1260949 - RNA, 24 nt, Human
cuggaggcaccugguggccaugcu

SEQ ID NO: 1260950 - RNA, 15 nt, Human
cuggaggcagggaac

SEQ ID NO: 1260951 - RNA, 13 nt, Human
cuggagcucugcc

SEQ ID NO: 1260952 - RNA, 18 nt, Human
cuggaggcaggggcuucc

SEQ ID NO: 1260953 - RNA, 19 nt, Human
cuggaggcaggggcuuccu

SEQ ID NO: 1260954 - RNA, 20 nt, Human
cuggaggcaggggcuuccug

SEQ ID NO: 1260955 - RNA, 21 nt, Human
cuggaggcaggggcuuccugg

SEQ ID NO: 1260956 - RNA, 22 nt, Human
cuggaggcaggggcuuccuggu

SEQ ID NO: 1260957 - RNA, 12 nt, Human
cuggaggcccag

SEQ ID NO: 1260958 - RNA, 13 nt, Human
cuggaggcccagg

SEQ ID NO: 1260959 - RNA, 14 nt, Human
cuggaggcccaggc

SEQ ID NO: 1260960 - RNA, 15 nt, Human
cuggaggcccaggcu

SEQ ID NO: 1260961 - RNA, 17 nt, Human
cuggaggcccaggcugg

SEQ ID NO: 1260962 - RNA, 18 nt, Human
cuggaggcccaggcuggg

SEQ ID NO: 1260963 - RNA, 19 nt, Human
cuggaggcccaggcuggga

SEQ ID NO: 1260964 - RNA, 13 nt, Human
cuggaggcccagu

SEQ ID NO: 1260965 - RNA, 14 nt, Human
cuggaggcccaguu

SEQ ID NO: 1260966 - RNA, 15 nt, Human
cuggaggcccaguuc

SEQ ID NO: 1260967 - RNA, 21 nt, Human
cuggaggcccaguucacccug

SEQ ID NO: 1260968 - RNA, 14 nt, Human
cuggaggccccaac

SEQ ID NO: 1260969 - RNA, 21 nt, Human
cuggagggggaauggcagcag

SEQ ID NO: 1260970 - RNA, 22 nt, Human
cuggagggggaauggcagcagg

SEQ ID NO: 1260971 - RNA, 16 nt, Human
cuggagggguguggcu

SEQ ID NO: 1260972 - RNA, 20 nt, Human
cuggagggguguggcuccuu

SEQ ID NO: 1260973 - RNA, 13 nt, Human
cuggaggggaggg

SEQ ID NO: 1260974 - RNA, 15 nt, Human
cuggagggggaaugg

SEQ ID NO: 1260975 - RNA, 19 nt, Human
cuggagggggaauggcagc

SEQ ID NO: 1260976 - RNA, 20 nt, Human
cuggagggggaauggcagca

SEQ ID NO: 1260977 - RNA, 15 nt, Human
cuggagucaaaacac

SEQ ID NO: 1260978 - RNA, 13 nt, Human
cuggaauuugaaa

SEQ ID NO: 1260979 - RNA, 15 nt, Human
cugcuuccuccugga

SEQ ID NO: 1260980 - RNA, 16 nt, Human
cugcuuccuccuggaa

SEQ ID NO: 1260981 - RNA, 18 nt, Human
cugcuuccuccuggaaau

SEQ ID NO: 1260982 - RNA, 14 nt, Human
cugcuuccagugua

SEQ ID NO: 1260983 - RNA, 16 nt, Human
cugcuucccugaagcu

SEQ ID NO: 1260984 - RNA, 15 nt, Human
cugcuucccugaagc

SEQ ID NO: 1260985 - RNA, 12 nt, Human
cugcuuccuccu

SEQ ID NO: 1260986 - RNA, 13 nt, Human
cugcuuccuccug

SEQ ID NO: 1260987 - RNA, 14 nt, Human
cugcuuccuccugg

SEQ ID NO: 1260988 - RNA, 15 nt, Human
cuggacacucagacc

SEQ ID NO: 1260989 - RNA, 16 nt, Human
cuggacacucagaccu

SEQ ID NO: 1260990 - RNA, 17 nt, Human
cuggacacucagaccug

SEQ ID NO: 1260991 - RNA, 14 nt, Human
cuggaccagccucu

SEQ ID NO: 1260992 - RNA, 18 nt, Human
cuggaccagccucuccac

SEQ ID NO: 1260993 - RNA, 11 nt, Human
cuggacccagc

SEQ ID NO: 1260994 - RNA, 12 nt, Human
cuggacccagcc

SEQ ID NO: 1260995 - RNA, 13 nt, Human
cuggacccagcca

SEQ ID NO: 1260996 - RNA, 14 nt, Human
cuggacccagccag

SEQ ID NO: 1260997 - RNA, 17 nt, Human
cuggacccagccagaac

SEQ ID NO: 1260998 - RNA, 17 nt, Human
cuggacccagccaggcc

SEQ ID NO: 1260999 - RNA, 18 nt, Human
cuggacccagccaggccc

SEQ ID NO: 1261000 - RNA, 19 nt, Human
cuggacccagccaggccca

SEQ ID NO: 1261001 - RNA, 20 nt, Human
cuggacccagccaggcccag

SEQ ID NO: 1261002 - RNA, 21 nt, Human
cuggacccagccaggcccagc

SEQ ID NO: 1261003 - RNA, 22 nt, Human
cuggacccagccaggcccagcc

SEQ ID NO: 1261004 - RNA, 14 nt, Human
cuggacuccucugu

SEQ ID NO: 1261005 - RNA, 17 nt, Human
cuggacuccucugucca

SEQ ID NO: 1261006 - RNA, 18 nt, Human
cuggacuccucuguccag

SEQ ID NO: 1261007 - RNA, 19 nt, Human
cuggacuccucuguccagg

SEQ ID NO: 1261008 - RNA, 20 nt, Human
cuggacuccucuguccaggc

SEQ ID NO: 1261009 - RNA, 15 nt, Human
cuggagaucaccagu

SEQ ID NO: 1261010 - RNA, 20 nt, Human
cuggacccguucauggggga

SEQ ID NO: 1261011 - RNA, 23 nt, Human
cuggacccguucaugggggaggg

SEQ ID NO: 1261012 - RNA, 12 nt, Human
cuggacccugac

SEQ ID NO: 1261013 - RNA, 13 nt, Human
cuggacccugacc

SEQ ID NO: 1261014 - RNA, 20 nt, Human
cuggacccugaccagcuccc

SEQ ID NO: 1261015 - RNA, 21 nt, Human
cuggacccugaccagcucccc

SEQ ID NO: 1261016 - RNA, 19 nt, Human
cuggaccccccuuucacag

SEQ ID NO: 1261017 - RNA, 22 nt, Human
cuggaccccccuuucacaggca

SEQ ID NO: 1261018 - RNA, 23 nt, Human
cuggaccccccuuucacaggcag

SEQ ID NO: 1261019 - RNA, 13 nt, Human
cuggaccccugca

SEQ ID NO: 1261020 - RNA, 14 nt, Human
cuggaccccugcau

SEQ ID NO: 1261021 - RNA, 15 nt, Human
cuggaccccugcauu

SEQ ID NO: 1261022 - RNA, 18 nt, Human
cuggaccccugcauugga

SEQ ID NO: 1261023 - RNA, 23 nt, Human
cuggaccccugcauuggaacugg

SEQ ID NO: 1261024 - RNA, 18 nt, Human
cuggaccucugacagcag

SEQ ID NO: 1261025 - RNA, 19 nt, Human
cuggaccucugacagcagc

SEQ ID NO: 1261026 - RNA, 14 nt, Human
cuggaccucugggu

SEQ ID NO: 1261027 - RNA, 21 nt, Human
cuggaccucugacagcagcau

SEQ ID NO: 1261028 - RNA, 13 nt, Human
cuggaccucacca

SEQ ID NO: 1261029 - RNA, 13 nt, Human
cuggaccucugac

SEQ ID NO: 1261030 - RNA, 15 nt, Human
cuggaccucugacag

SEQ ID NO: 1261031 - RNA, 17 nt, Human
cuggaccucugacagca

SEQ ID NO: 1261032 - RNA, 16 nt, Human
cugcugcuacaauguc

SEQ ID NO: 1261033 - RNA, 12 nt, Human
cugcugcucccu

SEQ ID NO: 1261034 - RNA, 13 nt, Human
cugcugcucccuc

SEQ ID NO: 1261035 - RNA, 14 nt, Human
cugcugcucccuca

SEQ ID NO: 1261036 - RNA, 15 nt, Human
cugcugcucccucag

SEQ ID NO: 1261037 - RNA, 16 nt, Human
cugcugcucccucaga

SEQ ID NO: 1261038 - RNA, 17 nt, Human
cugcugcucccucagac

SEQ ID NO: 1261039 - RNA, 21 nt, Human
cugcugcucccucagacuggg

SEQ ID NO: 1261040 - RNA, 23 nt, Human
cugcugcucccucagacuggggc

SEQ ID NO: 1261041 - RNA, 15 nt, Human
cugcugcucuuggcu

SEQ ID NO: 1261042 - RNA, 21 nt, Human
cugcugcucuuggcuggaccc

SEQ ID NO: 1261043 - RNA, 22 nt, Human
cugcugcucuuggcuggaccca

SEQ ID NO: 1261044 - RNA, 14 nt, Human
cugcugcccucccc

SEQ ID NO: 1261045 - RNA, 15 nt, Human
cugcugcugccugcc

SEQ ID NO: 1261046 - RNA, 14 nt, Human
cugcugcugccugc

SEQ ID NO: 1261047 - RNA, 21 nt, Human
cugcugcugagaaccuggccu

SEQ ID NO: 1261048 - RNA, 22 nt, Human
cugcugcugagaaccuggccuu

SEQ ID NO: 1261049 - RNA, 23 nt, Human
cugcugcucuuggcuggacccag

SEQ ID NO: 1261050 - RNA, 11 nt, Human
cugcugcugag

SEQ ID NO: 1261051 - RNA, 13 nt, Human
cugcugcugagaa

SEQ ID NO: 1261052 - RNA, 14 nt, Human
cugcugcugagaac

SEQ ID NO: 1261053 - RNA, 16 nt, Human
cugcugcugagaaccu

SEQ ID NO: 1261054 - RNA, 17 nt, Human
cugcugcugagaaccug

SEQ ID NO: 1261055 - RNA, 19 nt, Human
cugcugcugagaaccuggc

SEQ ID NO: 1261056 - RNA, 20 nt, Human
cugcugcugagaaccuggcc

SEQ ID NO: 1261057 - RNA, 23 nt, Human
cugcugcugagaaccuggccuuc

SEQ ID NO: 1261058 - RNA, 12 nt, Human
cugcugcugggc

SEQ ID NO: 1261059 - RNA, 13 nt, Human
cugcugcugggcu

SEQ ID NO: 1261060 - RNA, 14 nt, Human
cugcugcugggcuc

SEQ ID NO: 1261061 - RNA, 15 nt, Human
cugcugcugggcuca

SEQ ID NO: 1261062 - RNA, 16 nt, Human
cugcugcugggcucag

SEQ ID NO: 1261063 - RNA, 14 nt, Human
cugcugcugucccu

SEQ ID NO: 1261064 - RNA, 17 nt, Human
cugcugcugggcucagu

SEQ ID NO: 1261065 - RNA, 16 nt, Human
cugcugcugucugggu

SEQ ID NO: 1261066 - RNA, 18 nt, Human
cugcugcugucugggugc

SEQ ID NO: 1261067 - RNA, 17 nt, Human
cugcugcugucugggug

SEQ ID NO: 1261068 - RNA, 15 nt, Human
cugcuggagaggccc

SEQ ID NO: 1261069 - RNA, 18 nt, Human
cugcuggagaggccccag

SEQ ID NO: 1261070 - RNA, 21 nt, Human
cugcuggagaggccccagccg

SEQ ID NO: 1261071 - RNA, 20 nt, Human
cugcuggaguuucauguaca

SEQ ID NO: 1261072 - RNA, 21 nt, Human
cugcuggaguuucauguacaa

SEQ ID NO: 1261073 - RNA, 19 nt, Human
cugcuggagaggccccagc

SEQ ID NO: 1261074 - RNA, 14 nt, Human
cugcuggccucugc

SEQ ID NO: 1261075 - RNA, 15 nt, Human
cugcuggccucugcg

SEQ ID NO: 1261076 - RNA, 21 nt, Human
cugcuggccucugcgaguggu

SEQ ID NO: 1261077 - RNA, 16 nt, Human
cugcuggccucugcga

SEQ ID NO: 1261078 - RNA, 20 nt, Human
cugcuggggaagacaguggc

SEQ ID NO: 1261079 - RNA, 21 nt, Human
cugcuggggaagacaguggcc

SEQ ID NO: 1261080 - RNA, 22 nt, Human
cugcuggggaagacaguggccc

SEQ ID NO: 1261081 - RNA, 14 nt, Human
cugcuggggaagac

SEQ ID NO: 1261082 - RNA, 15 nt, Human
cugcuggggaagaca

SEQ ID NO: 1261083 - RNA, 17 nt, Human
cugcuggggaagacagu

SEQ ID NO: 1261084 - RNA, 18 nt, Human
cugcuggggaagacagug

SEQ ID NO: 1261085 - RNA, 19 nt, Human
cugcuggggaagacagugg

SEQ ID NO: 1261086 - RNA, 12 nt, Human
cugcuggcugcc

SEQ ID NO: 1261087 - RNA, 15 nt, Human
cugcgacuaaacuua

SEQ ID NO: 1261088 - RNA, 14 nt, Human
cugcgacuuucugc

SEQ ID NO: 1261089 - RNA, 16 nt, Human
cugcgacuuucugccu

SEQ ID NO: 1261090 - RNA, 17 nt, Human
cugcgacuuucugccug

SEQ ID NO: 1261091 - RNA, 18 nt, Human
cugcgacuuucugccugg

SEQ ID NO: 1261092 - RNA, 19 nt, Human
cugcgacuuucugccugga

SEQ ID NO: 1261093 - RNA, 20 nt, Human
cugcgacuuucugccuggag

SEQ ID NO: 1261094 - RNA, 15 nt, Human
cugcgagugguuucu

SEQ ID NO: 1261095 - RNA, 14 nt, Human
cugcucuccucuug

SEQ ID NO: 1261096 - RNA, 20 nt, Human
cugcucuccucuugccacug

SEQ ID NO: 1261097 - RNA, 11 nt, Human
cugcucuccuc

SEQ ID NO: 1261098 - RNA, 13 nt, Human
cugcucuccucuu

SEQ ID NO: 1261099 - RNA, 14 nt, Human
cugcucuccucuuc

SEQ ID NO: 1261100 - RNA, 17 nt, Human
cugcucuccucuucuac

SEQ ID NO: 1261101 - RNA, 18 nt, Human
cugcucuccucuucuacu

SEQ ID NO: 1261102 - RNA, 12 nt, Human
cugcucccaagg

SEQ ID NO: 1261103 - RNA, 17 nt, Human
cugcucccaaggggccu

SEQ ID NO: 1261104 - RNA, 18 nt, Human
cugcucccaaggggccug

SEQ ID NO: 1261105 - RNA, 20 nt, Human
cugcucccaaggggccugag

SEQ ID NO: 1261106 - RNA, 21 nt, Human
cugcucccaaggggccugagc

SEQ ID NO: 1261107 - RNA, 23 nt, Human
cugcucccaaggggccugagcag

SEQ ID NO: 1261108 - RNA, 22 nt, Human
cugcucccaaggggccugagca

SEQ ID NO: 1261109 - RNA, 16 nt, Human
cugcucccaccuccug

SEQ ID NO: 1261110 - RNA, 17 nt, Human
cugcucccaccuccuga

SEQ ID NO: 1261111 - RNA, 21 nt, Human
cugcucuccucuugccacugc

SEQ ID NO: 1261112 - RNA, 17 nt, Human
cugcugaaggaauaaau

SEQ ID NO: 1261113 - RNA, 18 nt, Human
cugcugaaggaauaaauu

SEQ ID NO: 1261114 - RNA, 12 nt, Human
cugcugcccagc

SEQ ID NO: 1261115 - RNA, 15 nt, Human
cugcugcccagccuc

SEQ ID NO: 1261116 - RNA, 22 nt, Human
cugcugcccagccuccaagcuc

SEQ ID NO: 1261117 - RNA, 17 nt, Human
cugcugcccauguuuca

SEQ ID NO: 1261118 - RNA, 13 nt, Human
cugcugcccuccc

SEQ ID NO: 1261119 - RNA, 11 nt, Human
cugcugccacu

SEQ ID NO: 1261120 - RNA, 12 nt, Human
cugcugccacug

SEQ ID NO: 1261121 - RNA, 13 nt, Human
cugcugccacuga

SEQ ID NO: 1261122 - RNA, 14 nt, Human
cugcugccacugag

SEQ ID NO: 1261123 - RNA, 15 nt, Human
cugcugccacugagg

SEQ ID NO: 1261124 - RNA, 16 nt, Human
cugcugccacugaggg

SEQ ID NO: 1261125 - RNA, 17 nt, Human
cugcugccacugagggg

SEQ ID NO: 1261126 - RNA, 19 nt, Human
cucccuucaugcauggaaa

SEQ ID NO: 1261127 - RNA, 19 nt, Human
cugcccucauggccccucu

SEQ ID NO: 1261128 - RNA, 12 nt, Human
cugcccucaugg

SEQ ID NO: 1261129 - RNA, 20 nt, Human
cugcccugcgggucacagga

SEQ ID NO: 1261130 - RNA, 22 nt, Human
cugcccugcugagucccaggcu

SEQ ID NO: 1261131 - RNA, 15 nt, Human
cugcccuuccugcag

SEQ ID NO: 1261132 - RNA, 13 nt, Human
cugccggggcagc

SEQ ID NO: 1261133 - RNA, 17 nt, Human
cugccggggcagccccc

SEQ ID NO: 1261134 - RNA, 19 nt, Human
cugccggggcagcccccuc

SEQ ID NO: 1261135 - RNA, 20 nt, Human
cugccggggcagcccccuca

SEQ ID NO: 1261136 - RNA, 23 nt, Human
cugccggggcagcccccucacag

SEQ ID NO: 1261137 - RNA, 15 nt, Human
cugccguaauuuaac

SEQ ID NO: 1261138 - RNA, 23 nt, Human
cugccgguucuuaaauccauccu

SEQ ID NO: 1261139 - RNA, 13 nt, Human
cugccgucagugc

SEQ ID NO: 1261140 - RNA, 19 nt, Human
cugccgucagugcugugcu

SEQ ID NO: 1261141 - RNA, 20 nt, Human
cugccgucagugcugugcug

SEQ ID NO: 1261142 - RNA, 22 nt, Human
cugccguccccuagagucccag

SEQ ID NO: 1261143 - RNA, 21 nt, Human
cugccguccccuagaguccca

SEQ ID NO: 1261144 - RNA, 13 nt, Human
cugccguggggcc

SEQ ID NO: 1261145 - RNA, 20 nt, Human
cugccguggggccgccgccu

SEQ ID NO: 1261146 - RNA, 21 nt, Human
cugccguggggccgccgccuc

SEQ ID NO: 1261147 - RNA, 16 nt, Human
cugccgagcaaccgug

SEQ ID NO: 1261148 - RNA, 21 nt, Human
cugccgagcaaccguggcccu

SEQ ID NO: 1261149 - RNA, 17 nt, Human
cugccgcaacaguuuuu

SEQ ID NO: 1261150 - RNA, 22 nt, Human
cugccgagaguccaucagccuc

SEQ ID NO: 1261151 - RNA, 23 nt, Human
cugccgagaguccaucagccucc

SEQ ID NO: 1261152 - RNA, 14 nt, Human
cugccgagcaaccg

SEQ ID NO: 1261153 - RNA, 21 nt, Human
cugcccuuucugggcaccggg

SEQ ID NO: 1261154 - RNA, 12 nt, Human
cugcccuuguuu

SEQ ID NO: 1261155 - RNA, 20 nt, Human
cugcccuuguuuggggcagg

SEQ ID NO: 1261156 - RNA, 16 nt, Human
cugcccuugaucagcc

SEQ ID NO: 1261157 - RNA, 17 nt, Human
cugcccuugaucagccc

SEQ ID NO: 1261158 - RNA, 21 nt, Human
cugcccuuguuuggggcagga

SEQ ID NO: 1261159 - RNA, 22 nt, Human
cugcccuuguuuggggcaggag

SEQ ID NO: 1261160 - RNA, 23 nt, Human
cugcccuuguuuggggcaggagu

SEQ ID NO: 1261161 - RNA, 21 nt, Human
cugccucucugcaggucccua

SEQ ID NO: 1261162 - RNA, 20 nt, Human
cugccucucugcaggucccu

SEQ ID NO: 1261163 - RNA, 22 nt, Human
cugccucucugcaggucccuaa

SEQ ID NO: 1261164 - RNA, 16 nt, Human
cugccucuucugggag

SEQ ID NO: 1261165 - RNA, 17 nt, Human
cugccucuucugggagg

SEQ ID NO: 1261166 - RNA, 16 nt, Human
cugccucucuuguaau

SEQ ID NO: 1261167 - RNA, 22 nt, Human
cugccucuucugggagggcagc

SEQ ID NO: 1261168 - RNA, 14 nt, Human
cugccuuggccucc

SEQ ID NO: 1261169 - RNA, 17 nt, Human
cugccuuggccucccaa

SEQ ID NO: 1261170 - RNA, 18 nt, Human
cuagaguuuagcuggaaa

SEQ ID NO: 1261171 - RNA, 19 nt, Human
cuagaguuuagcuggaaaa

SEQ ID NO: 1261172 - RNA, 24 nt, Human
cuagagugacucacuaauucauua

SEQ ID NO: 1261173 - RNA, 14 nt, Human
cuagagcacugcca

SEQ ID NO: 1261174 - RNA, 15 nt, Human
cuagagcacugccac

SEQ ID NO: 1261175 - RNA, 20 nt, Human
cuagagcagacuacagcugg

SEQ ID NO: 1261176 - RNA, 18 nt, Human
cuagagcacugccaccag

SEQ ID NO: 1261177 - RNA, 14 nt, Human
cuagagcagggauu

SEQ ID NO: 1261178 - RNA, 15 nt, Human
cuagagcagggauua

SEQ ID NO: 1261179 - RNA, 23 nt, Human
cuagaggccugacugccaagcca

SEQ ID NO: 1261180 - RNA, 21 nt, Human
cuagaggccugacugccaagc

SEQ ID NO: 1261181 - RNA, 18 nt, Human
cuagaggcuuccuucauu

SEQ ID NO: 1261182 - RNA, 19 nt, Human
cuagaggcuuccuucauuu

SEQ ID NO: 1261183 - RNA, 21 nt, Human
cuagaggcuuccuucauuucc

SEQ ID NO: 1261184 - RNA, 23 nt, Human
cuagaggcuuccuucauuuccuc

SEQ ID NO: 1261185 - RNA, 13 nt, Human
cuagacuggugcu

SEQ ID NO: 1261186 - RNA, 17 nt, Human
cuagacuggugcuaaug

SEQ ID NO: 1261187 - RNA, 18 nt, Human
cuagacugugcuaagaga

SEQ ID NO: 1261188 - RNA, 19 nt, Human
cuagagaaauaagaucuuu

SEQ ID NO: 1261189 - RNA, 21 nt, Human
cuagagaaauaagaucuuuuu

SEQ ID NO: 1261190 - RNA, 15 nt, Human
cuagagaagacaggc

SEQ ID NO: 1261191 - RNA, 17 nt, Human
cuagagaagacaggcug

SEQ ID NO: 1261192 - RNA, 22 nt, Human
cuagagaagacaggcuggaaga

SEQ ID NO: 1261193 - RNA, 18 nt, Human
cuagagaagacaggcugg

SEQ ID NO: 1261194 - RNA, 14 nt, Human
cuagaaacuuccaa

SEQ ID NO: 1261195 - RNA, 16 nt, Human
cuagaaacuuccaaau

SEQ ID NO: 1261196 - RNA, 19 nt, Human
cuagaaacaacacuguagu

SEQ ID NO: 1261197 - RNA, 17 nt, Human
cuagaaagcagagauuu

SEQ ID NO: 1261198 - RNA, 18 nt, Human
cuagaaagcagagauuuu

SEQ ID NO: 1261199 - RNA, 21 nt, Human
cuagaaagcagagauuuucaa

SEQ ID NO: 1261200 - RNA, 12 nt, Human
cuacuguucuaa

SEQ ID NO: 1261201 - RNA, 14 nt, Human
cuacuguucuaaag

SEQ ID NO: 1261202 - RNA, 15 nt, Human
cuacuguucuaaagc

SEQ ID NO: 1261203 - RNA, 18 nt, Human
cuacuguucuaaagcucu

SEQ ID NO: 1261204 - RNA, 20 nt, Human
cuacuguucuaaagcucuga

SEQ ID NO: 1261205 - RNA, 22 nt, Human
cuacuguucuaaagcucugaca

SEQ ID NO: 1261206 - RNA, 22 nt, Human
cuacuuacaugcauuacugcau

SEQ ID NO: 1261207 - RNA, 17 nt, Human
cuacuuagcaugucccu

SEQ ID NO: 1261208 - RNA, 22 nt, Human
cuacuuagcaugucccuaccga

SEQ ID NO: 1261209 - RNA, 13 nt, Human
cuacuuuuacuca

SEQ ID NO: 1261210 - RNA, 11 nt, Human
cuagaaaaaca

SEQ ID NO: 1261211 - RNA, 14 nt, Human
cuagaaaaacaggc

SEQ ID NO: 1261212 - RNA, 15 nt, Human
cuagaaaaacaggca

SEQ ID NO: 1261213 - RNA, 17 nt, Human
cuagaaaaacaggcacu

SEQ ID NO: 1261214 - RNA, 16 nt, Human
cuagaaaaacaggcac

SEQ ID NO: 1261215 - RNA, 14 nt, Human
cuagaaacaacacu

SEQ ID NO: 1261216 - RNA, 17 nt, Human
cuagaaacaacacugua

SEQ ID NO: 1261217 - RNA, 18 nt, Human
cuagaaacaacacuguag

SEQ ID NO: 1261218 - RNA, 20 nt, Human
cuagaaacaacacuguagua

SEQ ID NO: 1261219 - RNA, 22 nt, Human
cuaccuccaaagcuucccacgg

SEQ ID NO: 1261220 - RNA, 17 nt, Human
cuaccgagucucuucuc

SEQ ID NO: 1261221 - RNA, 19 nt, Human
cuaccgagucucuucucca

SEQ ID NO: 1261222 - RNA, 18 nt, Human
cuacccuuuuucuccagc

SEQ ID NO: 1261223 - RNA, 19 nt, Human
cuacccuuuuucuccagcu

SEQ ID NO: 1261224 - RNA, 17 nt, Human
cuaccgaaugugucuuu

SEQ ID NO: 1261225 - RNA, 18 nt, Human
cuaccgaaugugucuuua

SEQ ID NO: 1261226 - RNA, 21 nt, Human
cuaccgagucucuucuccacu

SEQ ID NO: 1261227 - RNA, 22 nt, Human
cuaccgagucucuucuccacug

SEQ ID NO: 1261228 - RNA, 23 nt, Human
cuaccgagucucuucuccacugg

SEQ ID NO: 1261229 - RNA, 13 nt, Human
cuaccgaguucaa

SEQ ID NO: 1261230 - RNA, 14 nt, Human
cuaccgaguucaag

SEQ ID NO: 1261231 - RNA, 16 nt, Human
cuaccgucuuuuccug

SEQ ID NO: 1261232 - RNA, 17 nt, Human
cuaccucaggcagcuca

SEQ ID NO: 1261233 - RNA, 18 nt, Human
cuaccucaggcagcucaa

SEQ ID NO: 1261234 - RNA, 13 nt, Human
cuacuggucucuc

SEQ ID NO: 1261235 - RNA, 15 nt, Human
cuacuggucucucua

SEQ ID NO: 1261236 - RNA, 20 nt, Human
cuacuggucucucuaugccu

SEQ ID NO: 1261237 - RNA, 14 nt, Human
cuacugggaaggcu

SEQ ID NO: 1261238 - RNA, 15 nt, Human
cuacuggggaaacug

SEQ ID NO: 1261239 - RNA, 16 nt, Human
cuacuggggaaacugg

SEQ ID NO: 1261240 - RNA, 17 nt, Human
cuacuggggaaacuggc

SEQ ID NO: 1261241 - RNA, 19 nt, Human
cuacuggggaaacuggcca

SEQ ID NO: 1261242 - RNA, 22 nt, Human
cuacuggggaaacuggccaugg

SEQ ID NO: 1261243 - RNA, 20 nt, Human
cuacuggggaaacuggccau

SEQ ID NO: 1261244 - RNA, 21 nt, Human
cuacugccgucagugcugugc

SEQ ID NO: 1261245 - RNA, 15 nt, Human
cuacugcccaggcac

SEQ ID NO: 1261246 - RNA, 21 nt, Human
cuacugcccaggcacugcaaa

SEQ ID NO: 1261247 - RNA, 21 nt, Human
cuacucugugccagagccugg

SEQ ID NO: 1261248 - RNA, 22 nt, Human
cuacucugugccagagccuggg

SEQ ID NO: 1261249 - RNA, 14 nt, Human
cuacugauuccgca

SEQ ID NO: 1261250 - RNA, 23 nt, Human
cuacucuccccacgagggcuggc

SEQ ID NO: 1261251 - RNA, 22 nt, Human
cuacucuccccacgagggcugg

SEQ ID NO: 1261252 - RNA, 13 nt, Human
cuacucugugcca

SEQ ID NO: 1261253 - RNA, 17 nt, Human
cuacucugugccagagc

SEQ ID NO: 1261254 - RNA, 18 nt, Human
cuacucugugccagagcc

SEQ ID NO: 1261255 - RNA, 19 nt, Human
cuacucugugccagagccu

SEQ ID NO: 1261256 - RNA, 20 nt, Human
cuacucugugccagagccug

SEQ ID NO: 1261257 - RNA, 17 nt, Human
cuacucuccccacgagg

SEQ ID NO: 1261258 - RNA, 19 nt, Human
cuacucuccccacgagggc

SEQ ID NO: 1261259 - RNA, 20 nt, Human
cuacucuccccacgagggcu

SEQ ID NO: 1261260 - RNA, 21 nt, Human
cuacucuccccacgagggcug

SEQ ID NO: 1261261 - RNA, 14 nt, Human
cuaggaaauauuua

SEQ ID NO: 1261262 - RNA, 15 nt, Human
cuaggaaauauuuau

SEQ ID NO: 1261263 - RNA, 19 nt, Human
cuaggaaauauuuauuuua

SEQ ID NO: 1261264 - RNA, 20 nt, Human
cuaggaaauauuuauuuuaa

SEQ ID NO: 1261265 - RNA, 23 nt, Human
cuagcuguccuuuuuccucucca

SEQ ID NO: 1261266 - RNA, 23 nt, Human
cuagcugugugaauaccugcuca

SEQ ID NO: 1261267 - RNA, 14 nt, Human
cuaggaaaauaaaa

SEQ ID NO: 1261268 - RNA, 15 nt, Human
cuaggaaaauaaaac

SEQ ID NO: 1261269 - RNA, 12 nt, Human
cuaggaaaauac

SEQ ID NO: 1261270 - RNA, 21 nt, Human
cuagcucuuguugagccgugg

SEQ ID NO: 1261271 - RNA, 17 nt, Human
cuagcugaauguuuuuc

SEQ ID NO: 1261272 - RNA, 18 nt, Human
cuagcugaauguuuuucu

SEQ ID NO: 1261273 - RNA, 19 nt, Human
cuagcugaauguuuuucua

SEQ ID NO: 1261274 - RNA, 20 nt, Human
cuagcugaauguuuuucuaa

SEQ ID NO: 1261275 - RNA, 14 nt, Human
cuagcuggcucugu

SEQ ID NO: 1261276 - RNA, 13 nt, Human
cuagcuggcucug

SEQ ID NO: 1261277 - RNA, 17 nt, Human
cuagcuguccuuuuucc

SEQ ID NO: 1261278 - RNA, 14 nt, Human
cuagcugugggggu

SEQ ID NO: 1261279 - RNA, 14 nt, Human
cuagauaucgacuu

SEQ ID NO: 1261280 - RNA, 21 nt, Human
cuagauaucgacuuguuuuug

SEQ ID NO: 1261281 - RNA, 22 nt, Human
cuagccuuaaucagguccucag

SEQ ID NO: 1261282 - RNA, 15 nt, Human
cuagauacucuuauu

SEQ ID NO: 1261283 - RNA, 11 nt, Human
cuagccuugcu

SEQ ID NO: 1261284 - RNA, 13 nt, Human
cuagccuugcuug

SEQ ID NO: 1261285 - RNA, 14 nt, Human
cuagccuugcuugu

SEQ ID NO: 1261286 - RNA, 22 nt, Human
cuagccuuggccucuuuccuca

SEQ ID NO: 1261287 - RNA, 15 nt, Human
cuagccuugcuuguu

SEQ ID NO: 1261288 - RNA, 14 nt, Human
cuagcgcaguuuuu

SEQ ID NO: 1261289 - RNA, 21 nt, Human
cuagcgcaguuuuuuuuuucu

SEQ ID NO: 1261290 - RNA, 22 nt, Human
cuagcgcaguuuuuuuuuucuu

SEQ ID NO: 1261291 - RNA, 17 nt, Human
cuagcgcuaucucccug

SEQ ID NO: 1261292 - RNA, 20 nt, Human
cuagcgcuaucucccugccu

SEQ ID NO: 1261293 - RNA, 16 nt, Human
cuagcgggauggggcu

SEQ ID NO: 1261294 - RNA, 19 nt, Human
cuagcgggauggggcuccc

SEQ ID NO: 1261295 - RNA, 23 nt, Human
cuauggggaagguuaucagugcu

SEQ ID NO: 1261296 - RNA, 19 nt, Human
cuaugggggcacugaggac

SEQ ID NO: 1261297 - RNA, 22 nt, Human
cuauguaacauguaggaaguag

SEQ ID NO: 1261298 - RNA, 22 nt, Human
cuauguaggaaagaccauuuuu

SEQ ID NO: 1261299 - RNA, 23 nt, Human
cuauguaggaaagaccauuuuuc

SEQ ID NO: 1261300 - RNA, 16 nt, Human
cuauguaucaaaugua

SEQ ID NO: 1261301 - RNA, 18 nt, Human
cuauuaucccagcugccu

SEQ ID NO: 1261302 - RNA, 19 nt, Human
cuauuaucccagcugccua

SEQ ID NO: 1261303 - RNA, 16 nt, Human
cuauuauccccauuuc

SEQ ID NO: 1261304 - RNA, 17 nt, Human
cuauuauccccauuucu

SEQ ID NO: 1261305 - RNA, 19 nt, Human
cuauuaucugucagcugca

SEQ ID NO: 1261306 - RNA, 21 nt, Human
cuauuaugaaugugaagccuu

SEQ ID NO: 1261307 - RNA, 22 nt, Human
cuauuaugaaugugaagccuuc

SEQ ID NO: 1261308 - RNA, 23 nt, Human
cuauuaugaaugugaagccuucc

SEQ ID NO: 1261309 - RNA, 20 nt, Human
cuauuauuuucacuguagaa

SEQ ID NO: 1261310 - RNA, 22 nt, Human
cuauuauuuucacuguagaaug

SEQ ID NO: 1261311 - RNA, 23 nt, Human
cuauucagcuucguuuauuuuca

SEQ ID NO: 1261312 - RNA, 12 nt, Human
cuauucuguccc

SEQ ID NO: 1261313 - RNA, 14 nt, Human
cuauucugucccua

SEQ ID NO: 1261314 - RNA, 15 nt, Human
cuauucugucccuag

SEQ ID NO: 1261315 - RNA, 16 nt, Human
cuauucugucccuagg

SEQ ID NO: 1261316 - RNA, 20 nt, Human
cuauucugucccuagguguu

SEQ ID NO: 1261317 - RNA, 14 nt, Human
cuauucuugaugua

SEQ ID NO: 1261318 - RNA, 16 nt, Human
cuauucuugauguaaa

SEQ ID NO: 1261319 - RNA, 17 nt, Human
cuauucuugauguaaaa

SEQ ID NO: 1261320 - RNA, 18 nt, Human
cuauucuugauguaaaau

SEQ ID NO: 1261321 - RNA, 19 nt, Human
cuauucuugauguaaaauc

SEQ ID NO: 1261322 - RNA, 20 nt, Human
cuauucuugauguaaaaucu

SEQ ID NO: 1261323 - RNA, 22 nt, Human
cuauucuugauguaaaaucuug

SEQ ID NO: 1261324 - RNA, 22 nt, Human
cuauucuuuaacucccauuacc

SEQ ID NO: 1261325 - RNA, 22 nt, Human
cuaugaaguuuuuuuuauacag

SEQ ID NO: 1261326 - RNA, 19 nt, Human
cuaugaacucuguuuucuu

SEQ ID NO: 1261327 - RNA, 13 nt, Human
cuaugaaggcugu

SEQ ID NO: 1261328 - RNA, 16 nt, Human
cuaugauguauacugc

SEQ ID NO: 1261329 - RNA, 14 nt, Human
cuaugauuauuaac

SEQ ID NO: 1261330 - RNA, 20 nt, Human
cuaugauguauacugccacu

SEQ ID NO: 1261331 - RNA, 14 nt, Human
cuaugauguauacu

SEQ ID NO: 1261332 - RNA, 13 nt, Human
cuaugauguauac

SEQ ID NO: 1261333 - RNA, 15 nt, Human
cuaugauuuggaaaa

SEQ ID NO: 1261334 - RNA, 19 nt, Human
cuaugauuuaauuugaaau

SEQ ID NO: 1261335 - RNA, 20 nt, Human
cuaugauuuaauuugaaaua

SEQ ID NO: 1261336 - RNA, 19 nt, Human
cuaugauuuggaaaauaaa

SEQ ID NO: 1261337 - RNA, 15 nt, Human
cuaugccucucuaca

SEQ ID NO: 1261338 - RNA, 16 nt, Human
cuaugccucucuacag

SEQ ID NO: 1261339 - RNA, 17 nt, Human
cuauagcuaaguacaca

SEQ ID NO: 1261340 - RNA, 15 nt, Human
cuauagcuaaguaca

SEQ ID NO: 1261341 - RNA, 23 nt, Human
cuauaccuguguuucuugccuca

SEQ ID NO: 1261342 - RNA, 12 nt, Human
cuauacugcuug

SEQ ID NO: 1261343 - RNA, 21 nt, Human
cuauaguccagcuuuguucuu

SEQ ID NO: 1261344 - RNA, 15 nt, Human
cuauaguucuagaca

SEQ ID NO: 1261345 - RNA, 19 nt, Human
cuauauaagacaagaacuc

SEQ ID NO: 1261346 - RNA, 20 nt, Human
cuauaguuauuaaguucuuu

SEQ ID NO: 1261347 - RNA, 13 nt, Human
cuauaguucuaga

SEQ ID NO: 1261348 - RNA, 14 nt, Human
cuauaguucuagac

SEQ ID NO: 1261349 - RNA, 14 nt, Human
cuauauaccaaagc

SEQ ID NO: 1261350 - RNA, 21 nt, Human
cuauauacucacuuucuagau

SEQ ID NO: 1261351 - RNA, 19 nt, Human
cuaugaaauauuauguuaa

SEQ ID NO: 1261352 - RNA, 19 nt, Human
cuauauaccaaagcacauu

SEQ ID NO: 1261353 - RNA, 19 nt, Human
cuauauagcugaucaguuu

SEQ ID NO: 1261354 - RNA, 16 nt, Human
cuauacccacccagaa

SEQ ID NO: 1261355 - RNA, 15 nt, Human
cuauacccacccaga

SEQ ID NO: 1261356 - RNA, 16 nt, Human
cuauaccaauaaagug

SEQ ID NO: 1261357 - RNA, 15 nt, Human
cuauaccaauaaagu

SEQ ID NO: 1261358 - RNA, 13 nt, Human
cuauaccuguguu

SEQ ID NO: 1261359 - RNA, 19 nt, Human
cuauacgcagcgugcuuua

SEQ ID NO: 1261360 - RNA, 17 nt, Human
cuauacugcauacuuuu

SEQ ID NO: 1261361 - RNA, 19 nt, Human
cuauacugcauacuuuuua

SEQ ID NO: 1261362 - RNA, 21 nt, Human
cuauacugcauacuuuuuaaa

SEQ ID NO: 1261363 - RNA, 23 nt, Human
cuauacugcuuggagcugagcaa

SEQ ID NO: 1261364 - RNA, 13 nt, Human
cuauaauuuaaau

SEQ ID NO: 1261365 - RNA, 12 nt, Human
cuauaauuuaaa

SEQ ID NO: 1261366 - RNA, 23 nt, Human
cucaacuccgugcuuaaccaaag

SEQ ID NO: 1261367 - RNA, 19 nt, Human
cucaaccccuccccuccau

SEQ ID NO: 1261368 - RNA, 21 nt, Human
cucaaccccuccccuccaucc

SEQ ID NO: 1261369 - RNA, 23 nt, Human
cucaaccccuccccuccaucccu

SEQ ID NO: 1261370 - RNA, 22 nt, Human
cucaacaggccucagggcuccu

SEQ ID NO: 1261371 - RNA, 21 nt, Human
cucaacaggccucagggcucc

SEQ ID NO: 1261372 - RNA, 13 nt, Human
cuauuucacugga

SEQ ID NO: 1261373 - RNA, 14 nt, Human
cuauuucacuggag

SEQ ID NO: 1261374 - RNA, 16 nt, Human
cuauuucuuaaacacu

SEQ ID NO: 1261375 - RNA, 19 nt, Human
cuauuugauguaauacuuc

SEQ ID NO: 1261376 - RNA, 16 nt, Human
cuauuugauguaauac

SEQ ID NO: 1261377 - RNA, 15 nt, Human
cuauuucuccuccau

SEQ ID NO: 1261378 - RNA, 16 nt, Human
cuauuucuccuccaug

SEQ ID NO: 1261379 - RNA, 18 nt, Human
cuauuucuuaaacacuug

SEQ ID NO: 1261380 - RNA, 22 nt, Human
cucaagcagcgaccgcccccuc

SEQ ID NO: 1261381 - RNA, 23 nt, Human
cucaagcagcgaccgcccccucc

SEQ ID NO: 1261382 - RNA, 17 nt, Human
cucaaggcggugcuuga

SEQ ID NO: 1261383 - RNA, 23 nt, Human
cucaaggcggugcuugauagaaa

SEQ ID NO: 1261384 - RNA, 14 nt, Human
cucaagguuuuagg

SEQ ID NO: 1261385 - RNA, 19 nt, Human
cucaagguuuuagguucua

SEQ ID NO: 1261386 - RNA, 20 nt, Human
cucaagguuuuagguucuaa

SEQ ID NO: 1261387 - RNA, 22 nt, Human
cucaagguuuuagguucuaaag

SEQ ID NO: 1261388 - RNA, 23 nt, Human
cucaagguuuuagguucuaaagu

SEQ ID NO: 1261389 - RNA, 17 nt, Human
cucacagaacccuugga

SEQ ID NO: 1261390 - RNA, 15 nt, Human
cucacaccugaacug

SEQ ID NO: 1261391 - RNA, 23 nt, Human
cucacacucaugcauuguccucu

SEQ ID NO: 1261392 - RNA, 22 nt, Human
cucacacucaugcauuguccuc

SEQ ID NO: 1261393 - RNA, 18 nt, Human
cucacacuggucugcugu

SEQ ID NO: 1261394 - RNA, 19 nt, Human
cucacacuggucugcuguc

SEQ ID NO: 1261395 - RNA, 19 nt, Human
cuauugcauuuauauguac

SEQ ID NO: 1261396 - RNA, 11 nt, Human
cuauugccucu

SEQ ID NO: 1261397 - RNA, 13 nt, Human
cuauugccucuga

SEQ ID NO: 1261398 - RNA, 17 nt, Human
cuauugccucugagagc

SEQ ID NO: 1261399 - RNA, 17 nt, Human
cuauugcauuuauaugu

SEQ ID NO: 1261400 - RNA, 14 nt, Human
cuauugcauuuaua

SEQ ID NO: 1261401 - RNA, 14 nt, Human
cuauugccucugag

SEQ ID NO: 1261402 - RNA, 17 nt, Human
cuauugcuagagcuccu

SEQ ID NO: 1261403 - RNA, 18 nt, Human
cuauugcuagagcuccuc

SEQ ID NO: 1261404 - RNA, 19 nt, Human
cuauugcuagagcuccucc

SEQ ID NO: 1261405 - RNA, 21 nt, Human
cuauugcuagagcuccucccu

SEQ ID NO: 1261406 - RNA, 11 nt, Human
cuauugguaaa

SEQ ID NO: 1261407 - RNA, 16 nt, Human
cuauuuaaaacuugua

SEQ ID NO: 1261408 - RNA, 17 nt, Human
cuauuuaaaacuuguaa

SEQ ID NO: 1261409 - RNA, 15 nt, Human
cuauuuaaagccucc

SEQ ID NO: 1261410 - RNA, 13 nt, Human
cuauuuaacugac

SEQ ID NO: 1261411 - RNA, 14 nt, Human
cuauuuaacugacu

SEQ ID NO: 1261412 - RNA, 15 nt, Human
cuauuuaacugacua

SEQ ID NO: 1261413 - RNA, 17 nt, Human
cucccucaaccucaucc

SEQ ID NO: 1261414 - RNA, 13 nt, Human
cucccucaaccuc

SEQ ID NO: 1261415 - RNA, 24 nt, Human
cucccgagcuccucuuccaugcug

SEQ ID NO: 1261416 - RNA, 12 nt, Human
cucccgagcucc

SEQ ID NO: 1261417 - RNA, 14 nt, Human
cucccgagcuccuc

SEQ ID NO: 1261418 - RNA, 18 nt, Human
cucccgagcuccucuucc

SEQ ID NO: 1261419 - RNA, 19 nt, Human
cucccgagcuccucuucca

SEQ ID NO: 1261420 - RNA, 21 nt, Human
cuccccugccagggcagggcc

SEQ ID NO: 1261421 - RNA, 22 nt, Human
cuccccuggaacugucucucau

SEQ ID NO: 1261422 - RNA, 19 nt, Human
cuccccugcacuguaaaau

SEQ ID NO: 1261423 - RNA, 21 nt, Human
cuccccuggagggggaauggc

SEQ ID NO: 1261424 - RNA, 14 nt, Human
cuccccuguaccuu

SEQ ID NO: 1261425 - RNA, 22 nt, Human
cucccuucaaccauuccccaug

SEQ ID NO: 1261426 - RNA, 23 nt, Human
cucccuucaaccauuccccaugg

SEQ ID NO: 1261427 - RNA, 21 nt, Human
cucccuucaaccauuccccau

SEQ ID NO: 1261428 - RNA, 18 nt, Human
cucccuggaucagaacag

SEQ ID NO: 1261429 - RNA, 23 nt, Human
cucccuggaucagaacaggagcu

SEQ ID NO: 1261430 - RNA, 12 nt, Human
cucccuggauga

SEQ ID NO: 1261431 - RNA, 13 nt, Human
cucccuggauuuu

SEQ ID NO: 1261432 - RNA, 19 nt, Human
cucccuggauuuuuaccag

SEQ ID NO: 1261433 - RNA, 24 nt, Human
cucccuggauuuuuaccagucuca

SEQ ID NO: 1261434 - RNA, 23 nt, Human
cucccuggaaugaguugaggcca

SEQ ID NO: 1261435 - RNA, 12 nt, Human
cucccuggaaug

SEQ ID NO: 1261436 - RNA, 12 nt, Human
cuccccugccac

SEQ ID NO: 1261437 - RNA, 13 nt, Human
cuccccugccacc

SEQ ID NO: 1261438 - RNA, 18 nt, Human
cuccccugccaccaggcc

SEQ ID NO: 1261439 - RNA, 23 nt, Human
cuccccugccaccaggccaccuc

SEQ ID NO: 1261440 - RNA, 15 nt, Human
cuccccugccagggc

SEQ ID NO: 1261441 - RNA, 16 nt, Human
cuccccugccagggca

SEQ ID NO: 1261442 - RNA, 16 nt, Human
cuccccugaccuguga

SEQ ID NO: 1261443 - RNA, 17 nt, Human
cuccccugaccugugag

SEQ ID NO: 1261444 - RNA, 22 nt, Human
cuccccugaccugugagcccag

SEQ ID NO: 1261445 - RNA, 12 nt, Human
cuccccugcacu

SEQ ID NO: 1261446 - RNA, 13 nt, Human
cuccccugcacug

SEQ ID NO: 1261447 - RNA, 14 nt, Human
cuccccugcacugu

SEQ ID NO: 1261448 - RNA, 15 nt, Human
cuccccugcacugua

SEQ ID NO: 1261449 - RNA, 16 nt, Human
cuccccugcacuguaa

SEQ ID NO: 1261450 - RNA, 17 nt, Human
cuccccugcacuguaaa

SEQ ID NO: 1261451 - RNA, 18 nt, Human
cuccccugcacuguaaaa

SEQ ID NO: 1261452 - RNA, 21 nt, Human
cuccccugcacuguaaaaugu

SEQ ID NO: 1261453 - RNA, 18 nt, Human
cuccccagcccagagaca

SEQ ID NO: 1261454 - RNA, 14 nt, Human
cuccccagcccaga

SEQ ID NO: 1261455 - RNA, 15 nt, Human
cuccccagcccagag

SEQ ID NO: 1261456 - RNA, 16 nt, Human
cuccccagcccagaga

SEQ ID NO: 1261457 - RNA, 17 nt, Human
cuccccagcccagagac

SEQ ID NO: 1261458 - RNA, 16 nt, Human
cuccccucuccuuccu

SEQ ID NO: 1261459 - RNA, 20 nt, Human
cuccccacgucagcugggac

SEQ ID NO: 1261460 - RNA, 16 nt, Human
cuccccacgagggcug

SEQ ID NO: 1261461 - RNA, 12 nt, Human
cuccccacucug

SEQ ID NO: 1261462 - RNA, 13 nt, Human
cuccccacucugc

SEQ ID NO: 1261463 - RNA, 14 nt, Human
cuccccacucugcu

SEQ ID NO: 1261464 - RNA, 16 nt, Human
cuccccacucugcucu

SEQ ID NO: 1261465 - RNA, 17 nt, Human
cuccccacucugcucug

SEQ ID NO: 1261466 - RNA, 20 nt, Human
cuccccacucugcucugaug

SEQ ID NO: 1261467 - RNA, 22 nt, Human
cuccccagcauuccagccccuc

SEQ ID NO: 1261468 - RNA, 23 nt, Human
cuccccagcauuccagccccucu

SEQ ID NO: 1261469 - RNA, 19 nt, Human
cuccccacucugcucugau

SEQ ID NO: 1261470 - RNA, 13 nt, Human
cuccccagcccag

SEQ ID NO: 1261471 - RNA, 19 nt, Human
cuccauggcccugccaugc

SEQ ID NO: 1261472 - RNA, 16 nt, Human
cuccauggcccugcca

SEQ ID NO: 1261473 - RNA, 15 nt, Human
cuccauggcccugcc

SEQ ID NO: 1261474 - RNA, 17 nt, Human
cuccaugcugccuccag

SEQ ID NO: 1261475 - RNA, 19 nt, Human
cuccagcuggguuggaaaa

SEQ ID NO: 1261476 - RNA, 14 nt, Human
cuccaugcugccuc

SEQ ID NO: 1261477 - RNA, 15 nt, Human
cuccaugcugccucc

SEQ ID NO: 1261478 - RNA, 16 nt, Human
cuccaugcugccucca

SEQ ID NO: 1261479 - RNA, 22 nt, Human
cuccagccccucuuggagaagu

SEQ ID NO: 1261480 - RNA, 20 nt, Human
cuccagccccucuuggagaa

SEQ ID NO: 1261481 - RNA, 21 nt, Human
cuccagccccucuuggagaag

SEQ ID NO: 1261482 - RNA, 20 nt, Human
cuccagcugacuaaacuuuu

SEQ ID NO: 1261483 - RNA, 14 nt, Human
cuccagcugccccg

SEQ ID NO: 1261484 - RNA, 11 nt, Human
cuccagcugcc

SEQ ID NO: 1261485 - RNA, 13 nt, Human
cuccagcugcccc

SEQ ID NO: 1261486 - RNA, 22 nt, Human
cuccagcuggccgggagccuga

SEQ ID NO: 1261487 - RNA, 23 nt, Human
cuccagcuggccgggagccugau

SEQ ID NO: 1261488 - RNA, 15 nt, Human
cuccagcugggcucu

SEQ ID NO: 1261489 - RNA, 19 nt, Human
cuccagcugggcucugcaa

SEQ ID NO: 1261490 - RNA, 20 nt, Human
cuccagcugggcucugcaau

SEQ ID NO: 1261491 - RNA, 18 nt, Human
cuccauuuaaacagaugu

SEQ ID NO: 1261492 - RNA, 18 nt, Human
cucccaaacgcccuuucc

SEQ ID NO: 1261493 - RNA, 20 nt, Human
cucccaaacgcccuuuccuc

SEQ ID NO: 1261494 - RNA, 16 nt, Human
cucccaaagugcuggg

SEQ ID NO: 1261495 - RNA, 20 nt, Human
cucccaaagugcugagauua

SEQ ID NO: 1261496 - RNA, 22 nt, Human
cucccaaagugcugagauuaca

SEQ ID NO: 1261497 - RNA, 15 nt, Human
cucccaaaugagcca

SEQ ID NO: 1261498 - RNA, 20 nt, Human
cucccaggcgccccuucccc

SEQ ID NO: 1261499 - RNA, 22 nt, Human
cucccaggcgccccuucccccu

SEQ ID NO: 1261500 - RNA, 17 nt, Human
cucccaggcgccccuuc

SEQ ID NO: 1261501 - RNA, 19 nt, Human
cucccaggcgccccuuccc

SEQ ID NO: 1261502 - RNA, 17 nt, Human
cucccacaagccugagg

SEQ ID NO: 1261503 - RNA, 13 nt, Human
cucccaauucauc

SEQ ID NO: 1261504 - RNA, 19 nt, Human
cucccaauuucagacuccc

SEQ ID NO: 1261505 - RNA, 21 nt, Human
cucccaauuucagacucccau

SEQ ID NO: 1261506 - RNA, 15 nt, Human
cucccacaagccucu

SEQ ID NO: 1261507 - RNA, 21 nt, Human
cucccacaagccucugcccag

SEQ ID NO: 1261508 - RNA, 23 nt, Human
cucccacaagccucugcccaggc

SEQ ID NO: 1261509 - RNA, 15 nt, Human
cucccacaagccuga

SEQ ID NO: 1261510 - RNA, 16 nt, Human
cucccacaagccugag

SEQ ID NO: 1261511 - RNA, 23 nt, Human
cucccacaagccugagggaaagg

SEQ ID NO: 1261512 - RNA, 15 nt, Human
cucccauucaagauu

SEQ ID NO: 1261513 - RNA, 14 nt, Human
cucccauuccugaa

SEQ ID NO: 1261514 - RNA, 15 nt, Human
cucccauuccugaag

SEQ ID NO: 1261515 - RNA, 16 nt, Human
cucccauuccugaaga

SEQ ID NO: 1261516 - RNA, 17 nt, Human
cucccauuccugaagaa

SEQ ID NO: 1261517 - RNA, 19 nt, Human
cucccauuccugaagaacc

SEQ ID NO: 1261518 - RNA, 15 nt, Human
cuccccacgagggcu

SEQ ID NO: 1261519 - RNA, 18 nt, Human
cuccccacgagggcuggc

SEQ ID NO: 1261520 - RNA, 14 nt, Human
cucccauccagggc

SEQ ID NO: 1261521 - RNA, 15 nt, Human
cucccauccagggcc

SEQ ID NO: 1261522 - RNA, 22 nt, Human
cucccauccagggcccccaucu

SEQ ID NO: 1261523 - RNA, 17 nt, Human
cuccaccgcagaaggaa

SEQ ID NO: 1261524 - RNA, 16 nt, Human
cuccaccgcagaagga

SEQ ID NO: 1261525 - RNA, 16 nt, Human
cuccaccaucgucuuc

SEQ ID NO: 1261526 - RNA, 22 nt, Human
cuccaccaucgucuucuuggcc

SEQ ID NO: 1261527 - RNA, 20 nt, Human
cuccaaggggaaucagaacu

SEQ ID NO: 1261528 - RNA, 18 nt, Human
cuccaccgcagaaggaag

SEQ ID NO: 1261529 - RNA, 15 nt, Human
cuccaccuagacugu

SEQ ID NO: 1261530 - RNA, 16 nt, Human
cuccacucaugugacu

SEQ ID NO: 1261531 - RNA, 22 nt, Human
cuccacucaugugacucuuucc

SEQ ID NO: 1261532 - RNA, 13 nt, Human
cuccacugccuuc

SEQ ID NO: 1261533 - RNA, 14 nt, Human
cuccacugccuucg

SEQ ID NO: 1261534 - RNA, 15 nt, Human
cuccacugccuucga

SEQ ID NO: 1261535 - RNA, 16 nt, Human
cuccacugccuucgau

SEQ ID NO: 1261536 - RNA, 13 nt, Human
cuccacuggaugg

SEQ ID NO: 1261537 - RNA, 13 nt, Human
cuccagagggcac

SEQ ID NO: 1261538 - RNA, 20 nt, Human
cuccagagggcacucugcuu

SEQ ID NO: 1261539 - RNA, 21 nt, Human
cuccagagggcacucugcuug

SEQ ID NO: 1261540 - RNA, 20 nt, Human
cuccagaggggcucagguca

SEQ ID NO: 1261541 - RNA, 16 nt, Human
cuccagaugcagggca

SEQ ID NO: 1261542 - RNA, 17 nt, Human
cuccagaugcagggcag

SEQ ID NO: 1261543 - RNA, 18 nt, Human
cuccagaugcagggcagu

SEQ ID NO: 1261544 - RNA, 21 nt, Human
cuccagaugcagggcagucau

SEQ ID NO: 1261545 - RNA, 14 nt, Human
cuccacuggaugga

SEQ ID NO: 1261546 - RNA, 16 nt, Human
cuccacuggauggagg

SEQ ID NO: 1261547 - RNA, 11 nt, Human
cuccagaccug

SEQ ID NO: 1261548 - RNA, 12 nt, Human
cuccagaccuga

SEQ ID NO: 1261549 - RNA, 14 nt, Human
cuccagaccugauc

SEQ ID NO: 1261550 - RNA, 19 nt, Human
cuccagaccugauccugga

SEQ ID NO: 1261551 - RNA, 23 nt, Human
cuccagaccugauccuggaggcc

SEQ ID NO: 1261552 - RNA, 21 nt, Human
cuccagagaguaucugaggca

SEQ ID NO: 1261553 - RNA, 19 nt, Human
cuccagauuagagccugua

SEQ ID NO: 1261554 - RNA, 22 nt, Human
cuccagauuagagccuguaaac

SEQ ID NO: 1261555 - RNA, 16 nt, Human
cuccagccccucuugg

SEQ ID NO: 1261556 - RNA, 18 nt, Human
cuccagccccucuuggag

SEQ ID NO: 1261557 - RNA, 19 nt, Human
cuccagccccucuuggaga

SEQ ID NO: 1261558 - RNA, 13 nt, Human
cucaguugcagcc

SEQ ID NO: 1261559 - RNA, 15 nt, Human
cucaguugauuuucu

SEQ ID NO: 1261560 - RNA, 16 nt, Human
cucaguugauuuucug

SEQ ID NO: 1261561 - RNA, 18 nt, Human
cucaguugauuuucugga

SEQ ID NO: 1261562 - RNA, 20 nt, Human
cucaguugauuuucuggauu

SEQ ID NO: 1261563 - RNA, 20 nt, Human
cucaguugugacuaacuaga

SEQ ID NO: 1261564 - RNA, 15 nt, Human
cucaguuucuugcuu

SEQ ID NO: 1261565 - RNA, 22 nt, Human
cucaguuugugugucuuaauua

SEQ ID NO: 1261566 - RNA, 17 nt, Human
cucaguuuuaucauuuu

SEQ ID NO: 1261567 - RNA, 18 nt, Human
cucaguuuuaucauuuuc

SEQ ID NO: 1261568 - RNA, 13 nt, Human
cucaguuuucaua

SEQ ID NO: 1261569 - RNA, 14 nt, Human
cucaguuuucauaa

SEQ ID NO: 1261570 - RNA, 17 nt, Human
cucauucugaaggagcc

SEQ ID NO: 1261571 - RNA, 19 nt, Human
cucauucugaaggagcccc

SEQ ID NO: 1261572 - RNA, 21 nt, Human
cucauugcucugaauauguca

SEQ ID NO: 1261573 - RNA, 19 nt, Human
cucauuuagccuguccugu

SEQ ID NO: 1261574 - RNA, 22 nt, Human
cuccaaaccacuuuuugcagcu

SEQ ID NO: 1261575 - RNA, 13 nt, Human
cuccaaaccacuu

SEQ ID NO: 1261576 - RNA, 14 nt, Human
cuccaaaaugugcc

SEQ ID NO: 1261577 - RNA, 15 nt, Human
cuccaaaaugugccu

SEQ ID NO: 1261578 - RNA, 22 nt, Human
cuccaaaauguuggucauuuua

SEQ ID NO: 1261579 - RNA, 18 nt, Human
cucauuuuaggcaaauau

SEQ ID NO: 1261580 - RNA, 22 nt, Human
cucauuuuuccguaaaaaugau

SEQ ID NO: 1261581 - RNA, 13 nt, Human
cucauuuuuuaaa

SEQ ID NO: 1261582 - RNA, 16 nt, Human
cuccaaaaugugccua

SEQ ID NO: 1261583 - RNA, 18 nt, Human
cuccaaacugaagcagcc

SEQ ID NO: 1261584 - RNA, 22 nt, Human
cuccaaacugaagcagccucuc

SEQ ID NO: 1261585 - RNA, 23 nt, Human
cuccaaacugaagcagccucucc

SEQ ID NO: 1261586 - RNA, 19 nt, Human
cuccaaggaggggcuguaa

SEQ ID NO: 1261587 - RNA, 20 nt, Human
cuccaaggaggggcuguaaa

SEQ ID NO: 1261588 - RNA, 21 nt, Human
cuccaaggaggggcuguaaaa

SEQ ID NO: 1261589 - RNA, 22 nt, Human
cuccaaggaggggcuguaaaau

SEQ ID NO: 1261590 - RNA, 13 nt, Human
cucauuucaggau

SEQ ID NO: 1261591 - RNA, 12 nt, Human
cucauuucagga

SEQ ID NO: 1261592 - RNA, 12 nt, Human
cucauuuccaag

SEQ ID NO: 1261593 - RNA, 13 nt, Human
cucauuuccaagc

SEQ ID NO: 1261594 - RNA, 14 nt, Human
cucauuuccaagca

SEQ ID NO: 1261595 - RNA, 17 nt, Human
cucauuuccaagcaagu

SEQ ID NO: 1261596 - RNA, 21 nt, Human
cucauuuccaagcaaguauua

SEQ ID NO: 1261597 - RNA, 18 nt, Human
cucauuuagccuguccug

SEQ ID NO: 1261598 - RNA, 23 nt, Human
cucaggagcccugggaggcucug

SEQ ID NO: 1261599 - RNA, 22 nt, Human
cucaggagcccugggaggcucu

SEQ ID NO: 1261600 - RNA, 21 nt, Human
cucaggagcccugggaggcuc

SEQ ID NO: 1261601 - RNA, 20 nt, Human
cucaggagcccugggaggcu

SEQ ID NO: 1261602 - RNA, 17 nt, Human
cucaggagcccugggag

SEQ ID NO: 1261603 - RNA, 16 nt, Human
cucaggagcccuggga

SEQ ID NO: 1261604 - RNA, 15 nt, Human
cucaggagcccuggg

SEQ ID NO: 1261605 - RNA, 14 nt, Human
cucaggagcccugg

SEQ ID NO: 1261606 - RNA, 13 nt, Human
cucaggagcccug

SEQ ID NO: 1261607 - RNA, 12 nt, Human
cucaggagcccu

SEQ ID NO: 1261608 - RNA, 14 nt, Human
cucaggacugcgac

SEQ ID NO: 1261609 - RNA, 14 nt, Human
cucaggacugggag

SEQ ID NO: 1261610 - RNA, 15 nt, Human
cucaggacugggagc

SEQ ID NO: 1261611 - RNA, 23 nt, Human
cucaggacugggagcccccagcc

SEQ ID NO: 1261612 - RNA, 12 nt, Human
cucaggacagau

SEQ ID NO: 1261613 - RNA, 14 nt, Human
cucaggacagaugc

SEQ ID NO: 1261614 - RNA, 16 nt, Human
cucaggacagaugcca

SEQ ID NO: 1261615 - RNA, 18 nt, Human
cucaggacagaugccaca

SEQ ID NO: 1261616 - RNA, 19 nt, Human
cucaggacagaugccacac

SEQ ID NO: 1261617 - RNA, 20 nt, Human
cucaggaccaaagcuuucau

SEQ ID NO: 1261618 - RNA, 21 nt, Human
cucaggaccaaagcuuucaug

SEQ ID NO: 1261619 - RNA, 22 nt, Human
cucaggaccaaagcuuucaugu

SEQ ID NO: 1261620 - RNA, 21 nt, Human
cucaggacacaggccugugua

SEQ ID NO: 1261621 - RNA, 20 nt, Human
cucagcucucaguugcagcc

SEQ ID NO: 1261622 - RNA, 14 nt, Human
cucagcucugggcc

SEQ ID NO: 1261623 - RNA, 23 nt, Human
cucagcucugggccauucuccac

SEQ ID NO: 1261624 - RNA, 23 nt, Human
cucagcucugacauucugauucg

SEQ ID NO: 1261625 - RNA, 11 nt, Human
cucagcugcau

SEQ ID NO: 1261626 - RNA, 18 nt, Human
cucagcugucaaggcuca

SEQ ID NO: 1261627 - RNA, 19 nt, Human
cucagcugucaaggcucag

SEQ ID NO: 1261628 - RNA, 17 nt, Human
cucaggaaccgaggcag

SEQ ID NO: 1261629 - RNA, 18 nt, Human
cucaggaaccgaggcagg

SEQ ID NO: 1261630 - RNA, 19 nt, Human
cucaggaaccgaggcaggg

SEQ ID NO: 1261631 - RNA, 13 nt, Human
cucaggacacagg

SEQ ID NO: 1261632 - RNA, 14 nt, Human
cucaggacacaggc

SEQ ID NO: 1261633 - RNA, 15 nt, Human
cucaggacacaggcc

SEQ ID NO: 1261634 - RNA, 16 nt, Human
cucaggacacaggccu

SEQ ID NO: 1261635 - RNA, 17 nt, Human
cucaggacacaggccug

SEQ ID NO: 1261636 - RNA, 18 nt, Human
cucaggacacaggccugu

SEQ ID NO: 1261637 - RNA, 19 nt, Human
cucaggacacaggccugug

SEQ ID NO: 1261638 - RNA, 20 nt, Human
cucaggacacaggccugugu

SEQ ID NO: 1261639 - RNA, 14 nt, Human
cucagcuuucuaag

SEQ ID NO: 1261640 - RNA, 22 nt, Human
cucaggaaacgagacuuuccau

SEQ ID NO: 1261641 - RNA, 23 nt, Human
cucaggaaacgagacuuuccauu

SEQ ID NO: 1261642 - RNA, 24 nt, Human
cucaggagcccugggaggcucugg

SEQ ID NO: 1261643 - RNA, 14 nt, Human
cucaggagccugug

SEQ ID NO: 1261644 - RNA, 16 nt, Human
cucaggaggcaggacc

SEQ ID NO: 1261645 - RNA, 17 nt, Human
cucaggaggcaggaccu

SEQ ID NO: 1261646 - RNA, 18 nt, Human
cucaggaggcaggaccuu

SEQ ID NO: 1261647 - RNA, 16 nt, Human
cucaggagccugugac

SEQ ID NO: 1261648 - RNA, 20 nt, Human
cucagggcagcgccaggcug

SEQ ID NO: 1261649 - RNA, 14 nt, Human
cucagggccaggcc

SEQ ID NO: 1261650 - RNA, 16 nt, Human
cucagggccaggccuc

SEQ ID NO: 1261651 - RNA, 18 nt, Human
cucagggccaggccucuc

SEQ ID NO: 1261652 - RNA, 13 nt, Human
cucagggccaugc

SEQ ID NO: 1261653 - RNA, 21 nt, Human
cucagggccaggccucucccu

SEQ ID NO: 1261654 - RNA, 15 nt, Human
cucagggccaugcug

SEQ ID NO: 1261655 - RNA, 17 nt, Human
cucagggccaugcugag

SEQ ID NO: 1261656 - RNA, 18 nt, Human
cucagggccaugcugagg

SEQ ID NO: 1261657 - RNA, 19 nt, Human
cucagggccaugcugaggc

SEQ ID NO: 1261658 - RNA, 20 nt, Human
cucagggccaugcugaggcc

SEQ ID NO: 1261659 - RNA, 20 nt, Human
cucagguaaucgaccugccu

SEQ ID NO: 1261660 - RNA, 22 nt, Human
cucagguaaucgaccugccucg

SEQ ID NO: 1261661 - RNA, 24 nt, Human
cucagguaaucgaccugccucggc

SEQ ID NO: 1261662 - RNA, 13 nt, Human
cucaggugcuggg

SEQ ID NO: 1261663 - RNA, 15 nt, Human
cucaggugcuggggc

SEQ ID NO: 1261664 - RNA, 22 nt, Human
cucaggugcuggggccugguuc

SEQ ID NO: 1261665 - RNA, 16 nt, Human
cucaggugcuggggcc

SEQ ID NO: 1261666 - RNA, 17 nt, Human
cucagccccgcguggaa

SEQ ID NO: 1261667 - RNA, 22 nt, Human
cucagccccaccccagggcagc

SEQ ID NO: 1261668 - RNA, 14 nt, Human
cucagcccucccug

SEQ ID NO: 1261669 - RNA, 19 nt, Human
cucagcccucccugccccu

SEQ ID NO: 1261670 - RNA, 20 nt, Human
cucagcccucccugccccuc

SEQ ID NO: 1261671 - RNA, 21 nt, Human
cucagcccucccugccccucc

SEQ ID NO: 1261672 - RNA, 19 nt, Human
cucagccccaccccagggc

SEQ ID NO: 1261673 - RNA, 21 nt, Human
cucagccccaccccagggcag

SEQ ID NO: 1261674 - RNA, 16 nt, Human
cucagccccuuucccu

SEQ ID NO: 1261675 - RNA, 17 nt, Human
cucagcccucacacacc

SEQ ID NO: 1261676 - RNA, 18 nt, Human
cucagcccucacacaccc

SEQ ID NO: 1261677 - RNA, 20 nt, Human
cucagcucacugcaaccucc

SEQ ID NO: 1261678 - RNA, 14 nt, Human
cucagcucacugca

SEQ ID NO: 1261679 - RNA, 20 nt, Human
cucagcucacuacaaccucc

SEQ ID NO: 1261680 - RNA, 15 nt, Human
cucagcucacugcaa

SEQ ID NO: 1261681 - RNA, 21 nt, Human
cucagcucaucuucacugcac

SEQ ID NO: 1261682 - RNA, 15 nt, Human
cucagcuaagcucac

SEQ ID NO: 1261683 - RNA, 15 nt, Human
cucagcucccaaggc

SEQ ID NO: 1261684 - RNA, 19 nt, Human
cucagcuccagguggcucu

SEQ ID NO: 1261685 - RNA, 20 nt, Human
cucagcuccagguggcucug

SEQ ID NO: 1261686 - RNA, 19 nt, Human
cucagcucccaaggcucug

SEQ ID NO: 1261687 - RNA, 14 nt, Human
cucagcucauccau

SEQ ID NO: 1261688 - RNA, 13 nt, Human
cucagcucccaca

SEQ ID NO: 1261689 - RNA, 18 nt, Human
cucagcucccacaagccu

SEQ ID NO: 1261690 - RNA, 22 nt, Human
cucagcucccacaagccucugc

SEQ ID NO: 1261691 - RNA, 20 nt, Human
cucagcucccacaagccucu

SEQ ID NO: 1261692 - RNA, 19 nt, Human
cucacugugucacccaggc

SEQ ID NO: 1261693 - RNA, 16 nt, Human
cucacugcuugaacua

SEQ ID NO: 1261694 - RNA, 18 nt, Human
cucacugcuugaacuagg

SEQ ID NO: 1261695 - RNA, 15 nt, Human
cucacuggcucuccu

SEQ ID NO: 1261696 - RNA, 17 nt, Human
cucacuggcucuccugg

SEQ ID NO: 1261697 - RNA, 18 nt, Human
cucacuggcucuccuggc

SEQ ID NO: 1261698 - RNA, 19 nt, Human
cucacuggcucuccuggcc

SEQ ID NO: 1261699 - RNA, 21 nt, Human
cucacuggcucuccuggcccu

SEQ ID NO: 1261700 - RNA, 20 nt, Human
cucacugcauccuccgccuc

SEQ ID NO: 1261701 - RNA, 15 nt, Human
cucagagccaccccu

SEQ ID NO: 1261702 - RNA, 12 nt, Human
cucagauggcag

SEQ ID NO: 1261703 - RNA, 13 nt, Human
cucagauggcagc

SEQ ID NO: 1261704 - RNA, 14 nt, Human
cucagauggcagcu

SEQ ID NO: 1261705 - RNA, 15 nt, Human
cucagauggcagcuu

SEQ ID NO: 1261706 - RNA, 16 nt, Human
cucagauggcagcuuu

SEQ ID NO: 1261707 - RNA, 21 nt, Human
cucagauggcagcuuuuaaaa

SEQ ID NO: 1261708 - RNA, 17 nt, Human
cucagauggcagcuuuu

SEQ ID NO: 1261709 - RNA, 20 nt, Human
cucagauggcagcuuuuaaa

SEQ ID NO: 1261710 - RNA, 16 nt, Human
cucagaggguguccug

SEQ ID NO: 1261711 - RNA, 19 nt, Human
cucagaggcgcacugugac

SEQ ID NO: 1261712 - RNA, 17 nt, Human
cucagaggcgcacugug

SEQ ID NO: 1261713 - RNA, 18 nt, Human
cucagaggcgcacuguga

SEQ ID NO: 1261714 - RNA, 22 nt, Human
cuaggaaauauuuauuuuaaua

SEQ ID NO: 1261715 - RNA, 20 nt, Human
cuaccaaggucuucuuaaua

SEQ ID NO: 1261716 - RNA, 15 nt, Human
cuaccaaagcaccuu

SEQ ID NO: 1261717 - RNA, 13 nt, Human
cuaccaccagcug

SEQ ID NO: 1261718 - RNA, 14 nt, Human
cuaccaccagcugu

SEQ ID NO: 1261719 - RNA, 15 nt, Human
cuaccaccagcugug

SEQ ID NO: 1261720 - RNA, 16 nt, Human
cuaccaccagcugugu

SEQ ID NO: 1261721 - RNA, 19 nt, Human
cuaccaccagcugugucca

SEQ ID NO: 1261722 - RNA, 18 nt, Human
cuaccaccagcugugucc

SEQ ID NO: 1261723 - RNA, 12 nt, Human
cuaccauuucag

SEQ ID NO: 1261724 - RNA, 13 nt, Human
cuaccauuucaga

SEQ ID NO: 1261725 - RNA, 16 nt, Human
cuaccaaccuguucaa

SEQ ID NO: 1261726 - RNA, 14 nt, Human
cuaccaaagcaccu

SEQ ID NO: 1261727 - RNA, 12 nt, Human
cuacauucauuu

SEQ ID NO: 1261728 - RNA, 18 nt, Human
cuacauuaaacaugacuc

SEQ ID NO: 1261729 - RNA, 23 nt, Human
cuacaugguugaaaccccaucuc

SEQ ID NO: 1261730 - RNA, 13 nt, Human
cuacauguauugc

SEQ ID NO: 1261731 - RNA, 18 nt, Human
cuacauguauugcacauu

SEQ ID NO: 1261732 - RNA, 21 nt, Human
cuacauguauugcacauugua

SEQ ID NO: 1261733 - RNA, 22 nt, Human
cuacauguauugcacauuguaa

SEQ ID NO: 1261734 - RNA, 19 nt, Human
cuaccccauggugcuagga

SEQ ID NO: 1261735 - RNA, 17 nt, Human
cuacccccagcugugcu

SEQ ID NO: 1261736 - RNA, 13 nt, Human
cuacccucuagag

SEQ ID NO: 1261737 - RNA, 14 nt, Human
cuacccucuagaga

SEQ ID NO: 1261738 - RNA, 16 nt, Human
cuacccucuagagaaa

SEQ ID NO: 1261739 - RNA, 12 nt, Human
cuacccugagcu

SEQ ID NO: 1261740 - RNA, 17 nt, Human
cuacccugagcugaggc

SEQ ID NO: 1261741 - RNA, 18 nt, Human
cuacccugagcugaggca

SEQ ID NO: 1261742 - RNA, 13 nt, Human
cuacccuggacuu

SEQ ID NO: 1261743 - RNA, 17 nt, Human
cuacccuggacuugccu

SEQ ID NO: 1261744 - RNA, 16 nt, Human
cuacccuuuuucucca

SEQ ID NO: 1261745 - RNA, 16 nt, Human
cuacccuaaccaaguu

SEQ ID NO: 1261746 - RNA, 19 nt, Human
cuacccccagcugugcuua

SEQ ID NO: 1261747 - RNA, 18 nt, Human
cuacccccagcugugcuu

SEQ ID NO: 1261748 - RNA, 17 nt, Human
cuacagcuggggugcag

SEQ ID NO: 1261749 - RNA, 18 nt, Human
cuacagcuggggugcagg

SEQ ID NO: 1261750 - RNA, 22 nt, Human
cuacagcuggggugcagggaug

SEQ ID NO: 1261751 - RNA, 18 nt, Human
cuacagcuaaucagcauu

SEQ ID NO: 1261752 - RNA, 19 nt, Human
cuacagcuaaucagcauuc

SEQ ID NO: 1261753 - RNA, 14 nt, Human
cuacagaugaguca

SEQ ID NO: 1261754 - RNA, 21 nt, Human
cuacagcuaaucagcauucuc

SEQ ID NO: 1261755 - RNA, 22 nt, Human
cuacagcuaaucagcauucuca

SEQ ID NO: 1261756 - RNA, 18 nt, Human
cuacagccucagaaacca

SEQ ID NO: 1261757 - RNA, 14 nt, Human
cuacagccucagaa

SEQ ID NO: 1261758 - RNA, 15 nt, Human
cuacacucaccugca

SEQ ID NO: 1261759 - RNA, 12 nt, Human
cuacaggccuca

SEQ ID NO: 1261760 - RNA, 16 nt, Human
cuacaggccucacaca

SEQ ID NO: 1261761 - RNA, 20 nt, Human
cuacaggccucacacacaau

SEQ ID NO: 1261762 - RNA, 21 nt, Human
cuacaggcgugagccaccaug

SEQ ID NO: 1261763 - RNA, 15 nt, Human
cuacagggggucugg

SEQ ID NO: 1261764 - RNA, 17 nt, Human
cuacagggggucuggcu

SEQ ID NO: 1261765 - RNA, 19 nt, Human
cuacagggggucuggcugg

SEQ ID NO: 1261766 - RNA, 20 nt, Human
cuacagggggucuggcuggu

SEQ ID NO: 1261767 - RNA, 21 nt, Human
cuacagggggucuggcuggug

SEQ ID NO: 1261768 - RNA, 22 nt, Human
cuacagggggucuggcuggugu

SEQ ID NO: 1261769 - RNA, 23 nt, Human
cuacagggggucuggcugguguu

SEQ ID NO: 1261770 - RNA, 17 nt, Human
cuacaggguccaacaua

SEQ ID NO: 1261771 - RNA, 14 nt, Human
cuacagucaggaaa

SEQ ID NO: 1261772 - RNA, 15 nt, Human
cuacagucaggaaag

SEQ ID NO: 1261773 - RNA, 18 nt, Human
cuacagucaggaaaggaa

SEQ ID NO: 1261774 - RNA, 21 nt, Human
cuacagucaggaaaggaauca

SEQ ID NO: 1261775 - RNA, 17 nt, Human
cuacuggucuuguggaa

SEQ ID NO: 1261776 - RNA, 22 nt, Human
cuaauagggcaauuaauuccuu

SEQ ID NO: 1261777 - RNA, 23 nt, Human
cuaauagaauaaaggcaguuuuc

SEQ ID NO: 1261778 - RNA, 14 nt, Human
cuaauaguauaaac

SEQ ID NO: 1261779 - RNA, 23 nt, Human
cuaauaguuuuauuaauaaacau

SEQ ID NO: 1261780 - RNA, 13 nt, Human
cuaauauauuuaa

SEQ ID NO: 1261781 - RNA, 14 nt, Human
cuaauauauuuaaa

SEQ ID NO: 1261782 - RNA, 15 nt, Human
cuaauauauuuaaaa

SEQ ID NO: 1261783 - RNA, 16 nt, Human
cuaauauauuuaaaaa

SEQ ID NO: 1261784 - RNA, 17 nt, Human
cuaauauauuuaaaaau

SEQ ID NO: 1261785 - RNA, 18 nt, Human
cuaauagaaaaguauguu

SEQ ID NO: 1261786 - RNA, 20 nt, Human
cuaauagaauaaaggcaguu

SEQ ID NO: 1261787 - RNA, 21 nt, Human
cuaauagaauaaaggcaguuu

SEQ ID NO: 1261788 - RNA, 14 nt, Human
cuaauaauuucuaa

SEQ ID NO: 1261789 - RNA, 15 nt, Human
cuaauaauuucuaau

SEQ ID NO: 1261790 - RNA, 16 nt, Human
cuaauaauuucuaaug

SEQ ID NO: 1261791 - RNA, 17 nt, Human
cuaauaauuucuaaugu

SEQ ID NO: 1261792 - RNA, 17 nt, Human
cuaauacagcugagcua

SEQ ID NO: 1261793 - RNA, 18 nt, Human
cuaauaauuucuaauguu

SEQ ID NO: 1261794 - RNA, 19 nt, Human
cuaauacagcaacaauuua

SEQ ID NO: 1261795 - RNA, 23 nt, Human
cuaauacagcaacaauuuaugaa

SEQ ID NO: 1261796 - RNA, 17 nt, Human
cuaauaacaugugaaaa

SEQ ID NO: 1261797 - RNA, 14 nt, Human
cuaaggaaccaaca

SEQ ID NO: 1261798 - RNA, 19 nt, Human
cuaaggaccugaaauucca

SEQ ID NO: 1261799 - RNA, 20 nt, Human
cuaaggaccugaaauuccaa

SEQ ID NO: 1261800 - RNA, 22 nt, Human
cuaaggaccugaaauuccaaag

SEQ ID NO: 1261801 - RNA, 13 nt, Human
cuaaggccuacuu

SEQ ID NO: 1261802 - RNA, 14 nt, Human
cuaaggccuaggau

SEQ ID NO: 1261803 - RNA, 19 nt, Human
cuaaggccuaggauucuaa

SEQ ID NO: 1261804 - RNA, 20 nt, Human
cuaaggccuaggauucuaaa

SEQ ID NO: 1261805 - RNA, 21 nt, Human
cuaaggccuaggauucuaaaa

SEQ ID NO: 1261806 - RNA, 22 nt, Human
cuaaggccuaggauucuaaaau

SEQ ID NO: 1261807 - RNA, 16 nt, Human
cuaaggcuccuguuuu

SEQ ID NO: 1261808 - RNA, 18 nt, Human
cuaaggcucuaugagucu

SEQ ID NO: 1261809 - RNA, 19 nt, Human
cuaaggcucuaugagucua

SEQ ID NO: 1261810 - RNA, 20 nt, Human
cuaaggcucuaugagucuag

SEQ ID NO: 1261811 - RNA, 21 nt, Human
cuaaggcucuaugagucuaga

SEQ ID NO: 1261812 - RNA, 22 nt, Human
cuaaggcucuaugagucuagau

SEQ ID NO: 1261813 - RNA, 23 nt, Human
cuaaggcucuaugagucuagaug

SEQ ID NO: 1261814 - RNA, 11 nt, Human
cuaaggcucug

SEQ ID NO: 1261815 - RNA, 13 nt, Human
cuaaggcucugag

SEQ ID NO: 1261816 - RNA, 14 nt, Human
cuaaggcucugaga

SEQ ID NO: 1261817 - RNA, 15 nt, Human
cuaaggcucugagag

SEQ ID NO: 1261818 - RNA, 19 nt, Human
cuaaggcucugagagucua

SEQ ID NO: 1261819 - RNA, 20 nt, Human
cuaaggcucugagagucuag

SEQ ID NO: 1261820 - RNA, 14 nt, Human
cuaagguucuaagg

SEQ ID NO: 1261821 - RNA, 15 nt, Human
cuaagguucuaaggc

SEQ ID NO: 1261822 - RNA, 16 nt, Human
cuaagguucuaaggcc

SEQ ID NO: 1261823 - RNA, 17 nt, Human
cuaagguucuaaggccu

SEQ ID NO: 1261824 - RNA, 21 nt, Human
cuaagcuucacuguaaaauaa

SEQ ID NO: 1261825 - RNA, 11 nt, Human
cuaagauucua

SEQ ID NO: 1261826 - RNA, 12 nt, Human
cuaagauucuaa

SEQ ID NO: 1261827 - RNA, 13 nt, Human
cuaagauucuaaa

SEQ ID NO: 1261828 - RNA, 16 nt, Human
cuaagcucacguccug

SEQ ID NO: 1261829 - RNA, 14 nt, Human
cuaagauucuaaag

SEQ ID NO: 1261830 - RNA, 15 nt, Human
cuaagauucuaaagg

SEQ ID NO: 1261831 - RNA, 19 nt, Human
cuaagauuacaaaucagaa

SEQ ID NO: 1261832 - RNA, 21 nt, Human
cuaagauuacaaaucagaagu

SEQ ID NO: 1261833 - RNA, 22 nt, Human
cuaagauuacaaaucagaaguc

SEQ ID NO: 1261834 - RNA, 23 nt, Human
cuaagauuacaaaucagaaguca

SEQ ID NO: 1261835 - RNA, 18 nt, Human
cuaagaugugauauucua

SEQ ID NO: 1261836 - RNA, 19 nt, Human
cuaagaugugauauucuaa

SEQ ID NO: 1261837 - RNA, 20 nt, Human
cuaagaugugauauucuaag

SEQ ID NO: 1261838 - RNA, 21 nt, Human
cuaagaugugauauucuaaga

SEQ ID NO: 1261839 - RNA, 22 nt, Human
cuaagaugugauauucuaagac

SEQ ID NO: 1261840 - RNA, 23 nt, Human
cuaagaugugauauucuaagacu

SEQ ID NO: 1261841 - RNA, 22 nt, Human
cuaagaugugcagcauuucacu

SEQ ID NO: 1261842 - RNA, 16 nt, Human
cuacacccagcaauag

SEQ ID NO: 1261843 - RNA, 14 nt, Human
cuacacccagcaau

SEQ ID NO: 1261844 - RNA, 13 nt, Human
cuacacccagcaa

SEQ ID NO: 1261845 - RNA, 12 nt, Human
cuacacccagca

SEQ ID NO: 1261846 - RNA, 11 nt, Human
cuacacccagc

SEQ ID NO: 1261847 - RNA, 19 nt, Human
cuacaccacucuggcagcc

SEQ ID NO: 1261848 - RNA, 20 nt, Human
cuacaccacucuggcagcca

SEQ ID NO: 1261849 - RNA, 21 nt, Human
cuacaccacucuggcagccac

SEQ ID NO: 1261850 - RNA, 22 nt, Human
cuacaccacucuggcagccaca

SEQ ID NO: 1261851 - RNA, 16 nt, Human
cuacacccuuuuccag

SEQ ID NO: 1261852 - RNA, 18 nt, Human
cuacacccuuuuccagcu

SEQ ID NO: 1261853 - RNA, 16 nt, Human
cuacaccuauuauccc

SEQ ID NO: 1261854 - RNA, 17 nt, Human
cuacaccuauuauccca

SEQ ID NO: 1261855 - RNA, 18 nt, Human
cuacaccuauuaucccag

SEQ ID NO: 1261856 - RNA, 23 nt, Human
cuacacgagauacagaauuuuau

SEQ ID NO: 1261857 - RNA, 14 nt, Human
cuacacuaagagag

SEQ ID NO: 1261858 - RNA, 13 nt, Human
cuacaccacucug

SEQ ID NO: 1261859 - RNA, 14 nt, Human
cuacaccacucugg

SEQ ID NO: 1261860 - RNA, 15 nt, Human
cuacaccacucuggc

SEQ ID NO: 1261861 - RNA, 16 nt, Human
cuacaccacucuggca

SEQ ID NO: 1261862 - RNA, 18 nt, Human
cuacaccacucuggcagc

SEQ ID NO: 1261863 - RNA, 14 nt, Human
cuaauuccacagcu

SEQ ID NO: 1261864 - RNA, 15 nt, Human
cuaauuccacaccuu

SEQ ID NO: 1261865 - RNA, 17 nt, Human
cuaauuccacaccuuuu

SEQ ID NO: 1261866 - RNA, 15 nt, Human
cuaauucacagugcu

SEQ ID NO: 1261867 - RNA, 16 nt, Human
cuaauucacagugcuc

SEQ ID NO: 1261868 - RNA, 22 nt, Human
cuaauucacagugcucuuuucu

SEQ ID NO: 1261869 - RNA, 10 nt, Human
cuaauucaua

SEQ ID NO: 1261870 - RNA, 15 nt, Human
cuaauuccacagcug

SEQ ID NO: 1261871 - RNA, 16 nt, Human
cuaauuccacagcugc

SEQ ID NO: 1261872 - RNA, 17 nt, Human
cuaauauggcaaccauu

SEQ ID NO: 1261873 - RNA, 21 nt, Human
cuaaucagcauucucacuccu

SEQ ID NO: 1261874 - RNA, 20 nt, Human
cuaauauggccacaguaguc

SEQ ID NO: 1261875 - RNA, 19 nt, Human
cuaaucagggaggucauuu

SEQ ID NO: 1261876 - RNA, 20 nt, Human
cuaaucagggaggucauuuu

SEQ ID NO: 1261877 - RNA, 21 nt, Human
cuaaucagggaggucauuuug

SEQ ID NO: 1261878 - RNA, 15 nt, Human
cuaaugcgcaggcug

SEQ ID NO: 1261879 - RNA, 16 nt, Human
cuaaugcgcaggcugg

SEQ ID NO: 1261880 - RNA, 19 nt, Human
cuaaugcgcaggcuggccc

SEQ ID NO: 1261881 - RNA, 20 nt, Human
cuaaugcgcaggcuggcccu

SEQ ID NO: 1261882 - RNA, 14 nt, Human
cuaaucaugaaacu

SEQ ID NO: 1261883 - RNA, 22 nt, Human
cuaaugcgcaggcuggcccugc

SEQ ID NO: 1261884 - RNA, 23 nt, Human
cuaaugcgcaggcuggcccugcc

SEQ ID NO: 1261885 - RNA, 18 nt, Human
cuaaugccuuacucuucu

SEQ ID NO: 1261886 - RNA, 14 nt, Human
cuaauggcaugaga

SEQ ID NO: 1261887 - RNA, 22 nt, Human
cuaauuauacccccugcaaagc

SEQ ID NO: 1261888 - RNA, 16 nt, Human
cuaauggcaugagaaa

SEQ ID NO: 1261889 - RNA, 18 nt, Human
cuaauggcaugagaaaua

SEQ ID NO: 1261890 - RNA, 16 nt, Human
cuaauuauauaauauu

SEQ ID NO: 1261891 - RNA, 18 nt, Human
cuaauuauauaauauuuu

SEQ ID NO: 1261892 - RNA, 15 nt, Human
cuaauuauguagcuc

SEQ ID NO: 1261893 - RNA, 17 nt, Human
cuaauuauguagcucuu

SEQ ID NO: 1261894 - RNA, 18 nt, Human
cuaauuauguagcucuuu

SEQ ID NO: 1261895 - RNA, 16 nt, Human
cuaauucaaggaauuu

SEQ ID NO: 1261896 - RNA, 18 nt, Human
cuaauucaaggaauuucu

SEQ ID NO: 1261897 - RNA, 20 nt, Human
cuaauucaaggaauuucuua

SEQ ID NO: 1261898 - RNA, 15 nt, Human
cuaauucaauucaaa

SEQ ID NO: 1261899 - RNA, 16 nt, Human
cuaagauucuaaaggu

SEQ ID NO: 1261900 - RNA, 13 nt, Human
cguuuucaaaauu

SEQ ID NO: 1261901 - RNA, 19 nt, Human
cuaaauucuuucauuuuag

SEQ ID NO: 1261902 - RNA, 20 nt, Human
cuaaaucuuuuauaggauuu

SEQ ID NO: 1261903 - RNA, 19 nt, Human
cuaaauugacacuuaaaaa

SEQ ID NO: 1261904 - RNA, 15 nt, Human
cuaaaugaauguuua

SEQ ID NO: 1261905 - RNA, 12 nt, Human
cuaaaugaaugu

SEQ ID NO: 1261906 - RNA, 14 nt, Human
cuaaaugaauguuu

SEQ ID NO: 1261907 - RNA, 19 nt, Human
cuaaauuuuccuguccucu

SEQ ID NO: 1261908 - RNA, 16 nt, Human
cuaaauuuuccugucc

SEQ ID NO: 1261909 - RNA, 17 nt, Human
cuaaauuuuccuguccu

SEQ ID NO: 1261910 - RNA, 20 nt, Human
cuaacaacauuguagccuca

SEQ ID NO: 1261911 - RNA, 16 nt, Human
cuaacaaccaaagacu

SEQ ID NO: 1261912 - RNA, 12 nt, Human
cuaaccaaguuc

SEQ ID NO: 1261913 - RNA, 21 nt, Human
cuaaccaagcugaguuuccua

SEQ ID NO: 1261914 - RNA, 10 nt, Human
cuaaccaagu

SEQ ID NO: 1261915 - RNA, 15 nt, Human
cuaaccaagcugagu

SEQ ID NO: 1261916 - RNA, 20 nt, Human
cuaaccaagcugaguuuccu

SEQ ID NO: 1261917 - RNA, 21 nt, Human
cuaacauuuuugauaaagccu

SEQ ID NO: 1261918 - RNA, 22 nt, Human
cuaacaagucauagguuaauau

SEQ ID NO: 1261919 - RNA, 22 nt, Human
cuaacaaucagcuccuuccugg

SEQ ID NO: 1261920 - RNA, 12 nt, Human
cuaacagcccuc

SEQ ID NO: 1261921 - RNA, 21 nt, Human
cuaacagcccuccucugcacu

SEQ ID NO: 1261922 - RNA, 22 nt, Human
cuaacagcccuccucugcacuc

SEQ ID NO: 1261923 - RNA, 14 nt, Human
cuaacagggaaggc

SEQ ID NO: 1261924 - RNA, 15 nt, Human
cuaacagggaaggca

SEQ ID NO: 1261925 - RNA, 16 nt, Human
cuaacagggaaggcag

SEQ ID NO: 1261926 - RNA, 17 nt, Human
cuaacagggaaggcagg

SEQ ID NO: 1261927 - RNA, 21 nt, Human
cuaacagggaaggcaggcagg

SEQ ID NO: 1261928 - RNA, 18 nt, Human
cuaacagggaaggcaggc

SEQ ID NO: 1261929 - RNA, 12 nt, Human
cuaacauauaau

SEQ ID NO: 1261930 - RNA, 22 nt, Human
cuaacauauaauguuguuauuu

SEQ ID NO: 1261931 - RNA, 23 nt, Human
cuaacauauaauguuguuauuua

SEQ ID NO: 1261932 - RNA, 14 nt, Human
cuaagagagaauga

SEQ ID NO: 1261933 - RNA, 15 nt, Human
cuaagagagaaugag

SEQ ID NO: 1261934 - RNA, 21 nt, Human
cuaagagaaguuguaaaguau

SEQ ID NO: 1261935 - RNA, 16 nt, Human
cuaagagagcaccugg

SEQ ID NO: 1261936 - RNA, 18 nt, Human
cuaaccauguguuauguu

SEQ ID NO: 1261937 - RNA, 19 nt, Human
cuaacccagguauccaaaa

SEQ ID NO: 1261938 - RNA, 23 nt, Human
cuaacccuauacuguaguauucu

SEQ ID NO: 1261939 - RNA, 23 nt, Human
cuaacccuuugugugcucuccau

SEQ ID NO: 1261940 - RNA, 12 nt, Human
cuaaccucaucu

SEQ ID NO: 1261941 - RNA, 15 nt, Human
cuaaccucaucuucu

SEQ ID NO: 1261942 - RNA, 22 nt, Human
cuaacccuuugugugcucucca

SEQ ID NO: 1261943 - RNA, 17 nt, Human
cuaaccucgggccugcu

SEQ ID NO: 1261944 - RNA, 14 nt, Human
cuaagaggcugccc

SEQ ID NO: 1261945 - RNA, 16 nt, Human
cuaagaggcugcccuc

SEQ ID NO: 1261946 - RNA, 18 nt, Human
cuaagaggcugcccuccu

SEQ ID NO: 1261947 - RNA, 22 nt, Human
cuaagagugcugggcauuuuua

SEQ ID NO: 1261948 - RNA, 23 nt, Human
cuaagaggcugcccuccugugcu

SEQ ID NO: 1261949 - RNA, 12 nt, Human
cuaagaucuuag

SEQ ID NO: 1261950 - RNA, 14 nt, Human
cuaagaucuuagau

SEQ ID NO: 1261951 - RNA, 16 nt, Human
cuaagaucuuagauuc

SEQ ID NO: 1261952 - RNA, 17 nt, Human
cuaagaucuuagauucu

SEQ ID NO: 1261953 - RNA, 20 nt, Human
cuaagaucuuagauucucug

SEQ ID NO: 1261954 - RNA, 15 nt, Human
cuaaaaucugcuugu

SEQ ID NO: 1261955 - RNA, 22 nt, Human
cuaaaaucugcuuguauuccaa

SEQ ID NO: 1261956 - RNA, 17 nt, Human
cuaaaaucuuauaguuc

SEQ ID NO: 1261957 - RNA, 19 nt, Human
cuaaaaucuuauaguucua

SEQ ID NO: 1261958 - RNA, 21 nt, Human
cuaaaaucuuauaguucuagg

SEQ ID NO: 1261959 - RNA, 22 nt, Human
cuaaaaucuuauaguucuaggc

SEQ ID NO: 1261960 - RNA, 14 nt, Human
cuaaaauauuuauu

SEQ ID NO: 1261961 - RNA, 15 nt, Human
cuaaaauauuuauuu

SEQ ID NO: 1261962 - RNA, 23 nt, Human
cuaaaauauuuauuuuuuuuaag

SEQ ID NO: 1261963 - RNA, 18 nt, Human
cuaaaaugugauguucua

SEQ ID NO: 1261964 - RNA, 19 nt, Human
cuaaaaugugauguucuaa

SEQ ID NO: 1261965 - RNA, 20 nt, Human
cuaaaaugugauguucuaag

SEQ ID NO: 1261966 - RNA, 21 nt, Human
cuaaaaugugauguucuaagg

SEQ ID NO: 1261967 - RNA, 22 nt, Human
cuaaaaugugauguucuaaggc

SEQ ID NO: 1261968 - RNA, 23 nt, Human
cuaaaaugugauguucuaaggcu

SEQ ID NO: 1261969 - RNA, 15 nt, Human
cuaaacuaagaugug

SEQ ID NO: 1261970 - RNA, 12 nt, Human
cuaaacugcccc

SEQ ID NO: 1261971 - RNA, 13 nt, Human
cuaaacugccccc

SEQ ID NO: 1261972 - RNA, 19 nt, Human
cuaaacuccaaacauccuc

SEQ ID NO: 1261973 - RNA, 20 nt, Human
cuaaacuccaaacauccucu

SEQ ID NO: 1261974 - RNA, 17 nt, Human
cuaaauauauuuuaaga

SEQ ID NO: 1261975 - RNA, 21 nt, Human
cuaaacugcccccucugcccu

SEQ ID NO: 1261976 - RNA, 20 nt, Human
cuaaacugagacaaugccuu

SEQ ID NO: 1261977 - RNA, 13 nt, Human
cuaaauaaaaugc

SEQ ID NO: 1261978 - RNA, 15 nt, Human
cuaaauaaaaugcua

SEQ ID NO: 1261979 - RNA, 19 nt, Human
cuaaauaaaaugcuagguu

SEQ ID NO: 1261980 - RNA, 21 nt, Human
cuaaauaaaaugcuagguucu

SEQ ID NO: 1261981 - RNA, 22 nt, Human
cuaaauaaaaugcuagguucua

SEQ ID NO: 1261982 - RNA, 15 nt, Human
cuaaauaaaauuugu

SEQ ID NO: 1261983 - RNA, 20 nt, Human
cuaaauaaaauuuguugcau

SEQ ID NO: 1261984 - RNA, 23 nt, Human
cuaaauaaagcuugcaacaaaau

SEQ ID NO: 1261985 - RNA, 16 nt, Human
cuaaauaaagauauug

SEQ ID NO: 1261986 - RNA, 19 nt, Human
cuaaauaccucaaucaguc

SEQ ID NO: 1261987 - RNA, 21 nt, Human
cuaaauacugagaaaaccugu

SEQ ID NO: 1261988 - RNA, 18 nt, Human
cguuuggugcuucucaga

SEQ ID NO: 1261989 - RNA, 20 nt, Human
cguuuguuccccaagacauu

SEQ ID NO: 1261990 - RNA, 11 nt, Human
cguuuguguuc

SEQ ID NO: 1261991 - RNA, 19 nt, Human
cguuuguguucuguuuugu

SEQ ID NO: 1261992 - RNA, 20 nt, Human
cguuuguguucuguuuuguu

SEQ ID NO: 1261993 - RNA, 20 nt, Human
cgggaggcagagguugcagu

SEQ ID NO: 1261994 - RNA, 13 nt, Human
cgggaccuggugc

SEQ ID NO: 1261995 - RNA, 16 nt, Human
cgggaccacccugagc

SEQ ID NO: 1261996 - RNA, 17 nt, Human
cgggaccacccugagcc

SEQ ID NO: 1261997 - RNA, 18 nt, Human
cgggaccacccugagccg

SEQ ID NO: 1261998 - RNA, 19 nt, Human
cguuuguuuguuuguuuaa

SEQ ID NO: 1261999 - RNA, 13 nt, Human
cguuuuaaaaaag

SEQ ID NO: 1262000 - RNA, 16 nt, Human
cguuuuauaagcauca

SEQ ID NO: 1262001 - RNA, 14 nt, Human
cuaaaaaaaagaug

SEQ ID NO: 1262002 - RNA, 15 nt, Human
cuaaaaaaaagauga

SEQ ID NO: 1262003 - RNA, 11 nt, Human
cuaaaaauaaa

SEQ ID NO: 1262004 - RNA, 21 nt, Human
cuaaaaauagacuuaaaucuc

SEQ ID NO: 1262005 - RNA, 23 nt, Human
cuaaaagugggcuugauucugca

SEQ ID NO: 1262006 - RNA, 20 nt, Human
cuaaaagugggcuugauucu

SEQ ID NO: 1262007 - RNA, 14 nt, Human
cuaaaauaaagaaa

SEQ ID NO: 1262008 - RNA, 16 nt, Human
cuaaaauaaagaaaua

SEQ ID NO: 1262009 - RNA, 22 nt, Human
cuaaaauaaagaaauagaacaa

SEQ ID NO: 1262010 - RNA, 15 nt, Human
cuaaaauaauuuugu

SEQ ID NO: 1262011 - RNA, 17 nt, Human
cuaaaauaauuuuguaa

SEQ ID NO: 1262012 - RNA, 18 nt, Human
cuaaaauaauuuuguaau

SEQ ID NO: 1262013 - RNA, 20 nt, Human
cgggaauuuucaucuaggau

SEQ ID NO: 1262014 - RNA, 18 nt, Human
cgggaauuuucaucuagg

SEQ ID NO: 1262015 - RNA, 18 nt, Human
cgggacaccuaggcuagg

SEQ ID NO: 1262016 - RNA, 19 nt, Human
cgggacaccuaggcuaggg

SEQ ID NO: 1262017 - RNA, 16 nt, Human
cggcuugccacacccc

SEQ ID NO: 1262018 - RNA, 19 nt, Human
cggcuucaugccagcuacu

SEQ ID NO: 1262019 - RNA, 15 nt, Human
cgggaaaaagcccac

SEQ ID NO: 1262020 - RNA, 13 nt, Human
cggcuggccaugg

SEQ ID NO: 1262021 - RNA, 20 nt, Human
cggcuggccauggagaaagc

SEQ ID NO: 1262022 - RNA, 21 nt, Human
cggcuggccauggagaaagcu

SEQ ID NO: 1262023 - RNA, 13 nt, Human
cggcugugugugc

SEQ ID NO: 1262024 - RNA, 22 nt, Human
cggcugugugugcacgcgugug

SEQ ID NO: 1262025 - RNA, 15 nt, Human
cggcuucaugccagc

SEQ ID NO: 1262026 - RNA, 16 nt, Human
cggcuucaugccagcu

SEQ ID NO: 1262027 - RNA, 13 nt, Human
cggauccagggag

SEQ ID NO: 1262028 - RNA, 18 nt, Human
cggauccagggaggcugg

SEQ ID NO: 1262029 - RNA, 22 nt, Human
cggauccagggaggcugguccu

SEQ ID NO: 1262030 - RNA, 18 nt, Human
cggagugaguuuuuuagu

SEQ ID NO: 1262031 - RNA, 14 nt, Human
cggagugcggacca

SEQ ID NO: 1262032 - RNA, 23 nt, Human
cggagugcggaccacccucacug

SEQ ID NO: 1262033 - RNA, 22 nt, Human
cggccagccccuggccccagga

SEQ ID NO: 1262034 - RNA, 21 nt, Human
cggauccagggaggcuggucc

SEQ ID NO: 1262035 - RNA, 14 nt, Human
cggauccuaagcau

SEQ ID NO: 1262036 - RNA, 17 nt, Human
cggauccuaagcaucua

SEQ ID NO: 1262037 - RNA, 21 nt, Human
cggcccucaguagucccugca

SEQ ID NO: 1262038 - RNA, 22 nt, Human
cggccuccguccaggagccugg

SEQ ID NO: 1262039 - RNA, 21 nt, Human
cggccuccguccaggagccug

SEQ ID NO: 1262040 - RNA, 12 nt, Human
cggccuccuucu

SEQ ID NO: 1262041 - RNA, 20 nt, Human
cggccuccuucugagcuccu

SEQ ID NO: 1262042 - RNA, 22 nt, Human
cggccuccuucugagcuccugu

SEQ ID NO: 1262043 - RNA, 21 nt, Human
cggccuccuucugagcuccug

SEQ ID NO: 1262044 - RNA, 15 nt, Human
cgcuaaaagaaacuu

SEQ ID NO: 1262045 - RNA, 13 nt, Human
cgcuaaaagaaac

SEQ ID NO: 1262046 - RNA, 16 nt, Human
cgccuuggccuguguu

SEQ ID NO: 1262047 - RNA, 12 nt, Human
cgcccguccugc

SEQ ID NO: 1262048 - RNA, 14 nt, Human
cgcccguccugccu

SEQ ID NO: 1262049 - RNA, 15 nt, Human
cgcccguccugccug

SEQ ID NO: 1262050 - RNA, 17 nt, Human
cgcccguccugccugug

SEQ ID NO: 1262051 - RNA, 13 nt, Human
cgccuuucccagg

SEQ ID NO: 1262052 - RNA, 11 nt, Human
cgcggcuggga

SEQ ID NO: 1262053 - RNA, 12 nt, Human
cgcggcugggag

SEQ ID NO: 1262054 - RNA, 16 nt, Human
cgcggcugggaggagg

SEQ ID NO: 1262055 - RNA, 23 nt, Human
cgcgggagccaugcgcccccucc

SEQ ID NO: 1262056 - RNA, 13 nt, Human
cgcagcccugcuu

SEQ ID NO: 1262057 - RNA, 15 nt, Human
cgcagcccugcuuug

SEQ ID NO: 1262058 - RNA, 24 nt, Human
cgcagcccugcuuugggcugcccu

SEQ ID NO: 1262059 - RNA, 18 nt, Human
cgcccaacuaauuuuugu

SEQ ID NO: 1262060 - RNA, 17 nt, Human
cgcccaaaggacgcacu

SEQ ID NO: 1262061 - RNA, 18 nt, Human
cgcccaaaggacgcacug

SEQ ID NO: 1262062 - RNA, 20 nt, Human
cgcccaaaggacgcacugag

SEQ ID NO: 1262063 - RNA, 22 nt, Human
cgcccaaaggacgcacugagca

SEQ ID NO: 1262064 - RNA, 18 nt, Human
cgcccggcuaauuuuugu

SEQ ID NO: 1262065 - RNA, 16 nt, Human
cggacuuagcugggag

SEQ ID NO: 1262066 - RNA, 21 nt, Human
cggaccaaagggagucugcca

SEQ ID NO: 1262067 - RNA, 23 nt, Human
cggaccaaagggagucugccagg

SEQ ID NO: 1262068 - RNA, 21 nt, Human
cggaccacccucacuggcucu

SEQ ID NO: 1262069 - RNA, 12 nt, Human
cggaccagccug

SEQ ID NO: 1262070 - RNA, 21 nt, Human
cggacaguuccagaaguguga

SEQ ID NO: 1262071 - RNA, 23 nt, Human
cggacaguuccagaagugugacu

SEQ ID NO: 1262072 - RNA, 19 nt, Human
cggaccaaagggagucugc

SEQ ID NO: 1262073 - RNA, 17 nt, Human
cggacuuagcugggaga

SEQ ID NO: 1262074 - RNA, 14 nt, Human
cggacuuuucugca

SEQ ID NO: 1262075 - RNA, 15 nt, Human
cggacuuuucugcaa

SEQ ID NO: 1262076 - RNA, 16 nt, Human
cggacuuuucugcaaa

SEQ ID NO: 1262077 - RNA, 22 nt, Human
cggagucguggggugugcuggg

SEQ ID NO: 1262078 - RNA, 23 nt, Human
cggagucguggggugugcuggga

SEQ ID NO: 1262079 - RNA, 23 nt, Human
cggacuuagaaaaccagcucagc

SEQ ID NO: 1262080 - RNA, 16 nt, Human
cgcuucuugccucugu

SEQ ID NO: 1262081 - RNA, 17 nt, Human
cgcuucuugccucugug

SEQ ID NO: 1262082 - RNA, 18 nt, Human
cgcuucuugccucugugc

SEQ ID NO: 1262083 - RNA, 14 nt, Human
cgcuuuccugaauc

SEQ ID NO: 1262084 - RNA, 22 nt, Human
cgcuccugcuaacggugcucag

SEQ ID NO: 1262085 - RNA, 23 nt, Human
cgcuccugcuaacggugcucagg

SEQ ID NO: 1262086 - RNA, 15 nt, Human
cgcuccuggcccagc

SEQ ID NO: 1262087 - RNA, 16 nt, Human
cgcuccuggcccagcc

SEQ ID NO: 1262088 - RNA, 18 nt, Human
cgcuccuggcccagccuu

SEQ ID NO: 1262089 - RNA, 17 nt, Human
cgcuccuggcccagccu

SEQ ID NO: 1262090 - RNA, 18 nt, Human
cgcuccagcugccccggc

SEQ ID NO: 1262091 - RNA, 16 nt, Human
cgcuccagcugccccg

SEQ ID NO: 1262092 - RNA, 15 nt, Human
cgcuccccacucugc

SEQ ID NO: 1262093 - RNA, 16 nt, Human
cgcuccccacucugcu

SEQ ID NO: 1262094 - RNA, 19 nt, Human
cgcuccccacucugcucug

SEQ ID NO: 1262095 - RNA, 17 nt, Human
cgcuccccacucugcuc

SEQ ID NO: 1262096 - RNA, 14 nt, Human
cgcuccugcagccc

SEQ ID NO: 1262097 - RNA, 18 nt, Human
cgcuccugcagccccagc

SEQ ID NO: 1262098 - RNA, 20 nt, Human
cgcuuaucaacuaaugauuu

SEQ ID NO: 1262099 - RNA, 15 nt, Human
cgcuucuugccucug

SEQ ID NO: 1262100 - RNA, 16 nt, Human
cgcacggcagccacag

SEQ ID NO: 1262101 - RNA, 14 nt, Human
cgcaccugccucag

SEQ ID NO: 1262102 - RNA, 15 nt, Human
cgcaccugccucagg

SEQ ID NO: 1262103 - RNA, 16 nt, Human
cgcaccugccucagga

SEQ ID NO: 1262104 - RNA, 13 nt, Human
cgaugccagccaa

SEQ ID NO: 1262105 - RNA, 12 nt, Human
cgaugcccagag

SEQ ID NO: 1262106 - RNA, 13 nt, Human
cgaugcccagaga

SEQ ID NO: 1262107 - RNA, 14 nt, Human
cgaugcccagagac

SEQ ID NO: 1262108 - RNA, 17 nt, Human
cgcacugugacccccag

SEQ ID NO: 1262109 - RNA, 22 nt, Human
cgcacugugacccccagcuccg

SEQ ID NO: 1262110 - RNA, 14 nt, Human
cgagacuuuccauu

SEQ ID NO: 1262111 - RNA, 16 nt, Human
cgagagaucaaagaug

SEQ ID NO: 1262112 - RNA, 17 nt, Human
cgagagaucaaagauga

SEQ ID NO: 1262113 - RNA, 12 nt, Human
cgagagaugugu

SEQ ID NO: 1262114 - RNA, 13 nt, Human
cgagagaugugug

SEQ ID NO: 1262115 - RNA, 14 nt, Human
cgagagaugugugu

SEQ ID NO: 1262116 - RNA, 17 nt, Human
cgagagauguguguuga

SEQ ID NO: 1262117 - RNA, 15 nt, Human
cgagcgcccagcucc

SEQ ID NO: 1262118 - RNA, 19 nt, Human
cgagcgcccagcuccugac

SEQ ID NO: 1262119 - RNA, 13 nt, Human
cgagcgcccugca

SEQ ID NO: 1262120 - RNA, 14 nt, Human
cgagcgcccugcag

SEQ ID NO: 1262121 - RNA, 15 nt, Human
cgaggacccaggaaa

SEQ ID NO: 1262122 - RNA, 19 nt, Human
cgaggaggcuccagagggc

SEQ ID NO: 1262123 - RNA, 20 nt, Human
cgaggaggcuccagagggca

SEQ ID NO: 1262124 - RNA, 18 nt, Human
cgaggaggugucucaggc

SEQ ID NO: 1262125 - RNA, 20 nt, Human
cgaggaggugucucaggcug

SEQ ID NO: 1262126 - RNA, 21 nt, Human
cgaggaggugucucaggcugc

SEQ ID NO: 1262127 - RNA, 22 nt, Human
cgaggaggugucucaggcugcc

SEQ ID NO: 1262128 - RNA, 12 nt, Human
cgaggaguaaca

SEQ ID NO: 1262129 - RNA, 13 nt, Human
cgaggaguaacaa

SEQ ID NO: 1262130 - RNA, 14 nt, Human
cgaggaguaacaau

SEQ ID NO: 1262131 - RNA, 21 nt, Human
cgaggaguaacaauacaaaug

SEQ ID NO: 1262132 - RNA, 22 nt, Human
cgaggaguaacaauacaaaugg

SEQ ID NO: 1262133 - RNA, 17 nt, Human
cgaggccuaccccgcag

SEQ ID NO: 1262134 - RNA, 23 nt, Human
cgaggccuaccccgcagacaccu

SEQ ID NO: 1262135 - RNA, 15 nt, Human
cgaugcaaugaacac

SEQ ID NO: 1262136 - RNA, 18 nt, Human
cgcccacaggaagccugc

SEQ ID NO: 1262137 - RNA, 16 nt, Human
cgcuuugauucauagu

SEQ ID NO: 1262138 - RNA, 18 nt, Human
ccuguggaucaaauccag

SEQ ID NO: 1262139 - RNA, 12 nt, Human
ccuguggauauu

SEQ ID NO: 1262140 - RNA, 21 nt, Human
ccuguggcgccgucuccaggg

SEQ ID NO: 1262141 - RNA, 15 nt, Human
ccugugggagccucg

SEQ ID NO: 1262142 - RNA, 16 nt, Human
ccugugggagccucgc

SEQ ID NO: 1262143 - RNA, 17 nt, Human
ccugugggagccucgca

SEQ ID NO: 1262144 - RNA, 22 nt, Human
ccuguggcgccgucuccagggg

SEQ ID NO: 1262145 - RNA, 13 nt, Human
ccugugggagccu

SEQ ID NO: 1262146 - RNA, 14 nt, Human
ccugugggagccuc

SEQ ID NO: 1262147 - RNA, 9 nt, Human
ccuguccuc

SEQ ID NO: 1262148 - RNA, 15 nt, Human
ccugugccugacccu

SEQ ID NO: 1262149 - RNA, 14 nt, Human
ccugugcucagccc

SEQ ID NO: 1262150 - RNA, 15 nt, Human
ccugugcucagcccu

SEQ ID NO: 1262151 - RNA, 16 nt, Human
ccugugcucagcccug

SEQ ID NO: 1262152 - RNA, 17 nt, Human
ccugugcucagcccuga

SEQ ID NO: 1262153 - RNA, 21 nt, Human
ccuucaugcauggaaauuccc

SEQ ID NO: 1262154 - RNA, 12 nt, Human
ccuucaugcaug

SEQ ID NO: 1262155 - RNA, 17 nt, Human
ccuucaugacagccucc

SEQ ID NO: 1262156 - RNA, 18 nt, Human
ccuucaugacagccucca

SEQ ID NO: 1262157 - RNA, 22 nt, Human
ccugugggggguaaucccugcu

SEQ ID NO: 1262158 - RNA, 16 nt, Human
ccuguggucacugacu

SEQ ID NO: 1262159 - RNA, 15 nt, Human
ccugugguucugaga

SEQ ID NO: 1262160 - RNA, 19 nt, Human
ccugugguucugagauggc

SEQ ID NO: 1262161 - RNA, 15 nt, Human
ccuucaugcauggaa

SEQ ID NO: 1262162 - RNA, 23 nt, Human
ccuucauucugcaaguauacuag

SEQ ID NO: 1262163 - RNA, 12 nt, Human
ccuucauuuccu

SEQ ID NO: 1262164 - RNA, 13 nt, Human
ccuucauuuccuc

SEQ ID NO: 1262165 - RNA, 14 nt, Human
ccuucauuuccucc

SEQ ID NO: 1262166 - RNA, 15 nt, Human
ccuucauuuccuccg

SEQ ID NO: 1262167 - RNA, 23 nt, Human
ccuuccagcuagugacccacaug

SEQ ID NO: 1262168 - RNA, 19 nt, Human
ccuucuccauggcccugcc

SEQ ID NO: 1262169 - RNA, 13 nt, Human
ccuucucccacuc

SEQ ID NO: 1262170 - RNA, 14 nt, Human
ccuucucccacucu

SEQ ID NO: 1262171 - RNA, 15 nt, Human
ccuucucccacucuc

SEQ ID NO: 1262172 - RNA, 17 nt, Human
ccuucucccacucuccu

SEQ ID NO: 1262173 - RNA, 18 nt, Human
ccuucucccacucuccua

SEQ ID NO: 1262174 - RNA, 20 nt, Human
ccuucucccacucuccuagg

SEQ ID NO: 1262175 - RNA, 12 nt, Human
ccuucuccccag

SEQ ID NO: 1262176 - RNA, 13 nt, Human
ccuucuccccagc

SEQ ID NO: 1262177 - RNA, 14 nt, Human
ccuucuccccagcu

SEQ ID NO: 1262178 - RNA, 17 nt, Human
ccuucuccccagcuccc

SEQ ID NO: 1262179 - RNA, 22 nt, Human
ccuucuccauggcccugccaug

SEQ ID NO: 1262180 - RNA, 11 nt, Human
ccuucuccauc

SEQ ID NO: 1262181 - RNA, 13 nt, Human
ccuucuccaucca

SEQ ID NO: 1262182 - RNA, 16 nt, Human
ccuucuccauccacau

SEQ ID NO: 1262183 - RNA, 22 nt, Human
ccuucuccauccacaugggagc

SEQ ID NO: 1262184 - RNA, 15 nt, Human
ccuucuauuuggggc

SEQ ID NO: 1262185 - RNA, 22 nt, Human
ccuucuauuuggggcuugauga

SEQ ID NO: 1262186 - RNA, 16 nt, Human
ccuucuauuuggggcu

SEQ ID NO: 1262187 - RNA, 18 nt, Human
ccuucuccccagcuccca

SEQ ID NO: 1262188 - RNA, 19 nt, Human
ccuucuccccagcucccag

SEQ ID NO: 1262189 - RNA, 20 nt, Human
ccuucuccccagcucccagg

SEQ ID NO: 1262190 - RNA, 21 nt, Human
ccuucuccccagcucccagga

SEQ ID NO: 1262191 - RNA, 23 nt, Human
ccuucuccccagcucccaggacc

SEQ ID NO: 1262192 - RNA, 13 nt, Human
ccuucuccccugc

SEQ ID NO: 1262193 - RNA, 15 nt, Human
ccuucuccccugcac

SEQ ID NO: 1262194 - RNA, 16 nt, Human
ccuucuccccugcacu

SEQ ID NO: 1262195 - RNA, 17 nt, Human
ccuucuccccugcacug

SEQ ID NO: 1262196 - RNA, 22 nt, Human
ccuucuccccugcacuguaaaa

SEQ ID NO: 1262197 - RNA, 24 nt, Human
ccuucuccccugcacuguaaaaug

SEQ ID NO: 1262198 - RNA, 23 nt, Human
ccuucuccccugcacuguaaaau

SEQ ID NO: 1262199 - RNA, 23 nt, Human
ccuuccauggugugaucgucuga

SEQ ID NO: 1262200 - RNA, 18 nt, Human
ccuuccaugucgccucug

SEQ ID NO: 1262201 - RNA, 18 nt, Human
ccuuccuggacagcugug

SEQ ID NO: 1262202 - RNA, 19 nt, Human
ccuuccuggacagcugugc

SEQ ID NO: 1262203 - RNA, 20 nt, Human
ccuuccuggacagcugugcc

SEQ ID NO: 1262204 - RNA, 21 nt, Human
ccuuccuggacagcugugccu

SEQ ID NO: 1262205 - RNA, 22 nt, Human
ccuuccuggacagcugugccuc

SEQ ID NO: 1262206 - RNA, 20 nt, Human
ccuuccuggagacugcccag

SEQ ID NO: 1262207 - RNA, 12 nt, Human
ccuuccagcucc

SEQ ID NO: 1262208 - RNA, 13 nt, Human
ccuuccagcuccu

SEQ ID NO: 1262209 - RNA, 15 nt, Human
ccuuccagcuccugu

SEQ ID NO: 1262210 - RNA, 16 nt, Human
ccuuccagcuccugua

SEQ ID NO: 1262211 - RNA, 17 nt, Human
ccuuccagcuccuguaa

SEQ ID NO: 1262212 - RNA, 19 nt, Human
ccuucggccuccauccuga

SEQ ID NO: 1262213 - RNA, 22 nt, Human
ccuuccuguuuuucacauuuuc

SEQ ID NO: 1262214 - RNA, 18 nt, Human
ccuucggccuccauccug

SEQ ID NO: 1262215 - RNA, 15 nt, Human
ccuucgggcugugcc

SEQ ID NO: 1262216 - RNA, 16 nt, Human
ccuucgggcugugccc

SEQ ID NO: 1262217 - RNA, 16 nt, Human
ccuucgucuuucccau

SEQ ID NO: 1262218 - RNA, 17 nt, Human
ccuucgucuuucccaug

SEQ ID NO: 1262219 - RNA, 17 nt, Human
ccuucggccuccauccu

SEQ ID NO: 1262220 - RNA, 19 nt, Human
ccuuccuggggcaucuggc

SEQ ID NO: 1262221 - RNA, 17 nt, Human
ccuuccuguuuuucaca

SEQ ID NO: 1262222 - RNA, 19 nt, Human
ccuuccuguuuuucacauu

SEQ ID NO: 1262223 - RNA, 23 nt, Human
ccuugacauuguagagcuucugg

SEQ ID NO: 1262224 - RNA, 16 nt, Human
ccuuggccucuuuccu

SEQ ID NO: 1262225 - RNA, 12 nt, Human
ccuuggccugga

SEQ ID NO: 1262226 - RNA, 13 nt, Human
ccuuggccuggag

SEQ ID NO: 1262227 - RNA, 14 nt, Human
ccuuggccuggagc

SEQ ID NO: 1262228 - RNA, 21 nt, Human
ccuuggccuggagcacaaaga

SEQ ID NO: 1262229 - RNA, 15 nt, Human
ccuuggccuggagca

SEQ ID NO: 1262230 - RNA, 14 nt, Human
ccuuggccuguguu

SEQ ID NO: 1262231 - RNA, 16 nt, Human
ccuugggcucugauga

SEQ ID NO: 1262232 - RNA, 12 nt, Human
ccuugggcuccc

SEQ ID NO: 1262233 - RNA, 13 nt, Human
ccuugggcucccu

SEQ ID NO: 1262234 - RNA, 21 nt, Human
ccuugggcuccgugugggaga

SEQ ID NO: 1262235 - RNA, 14 nt, Human
ccuugggcucugau

SEQ ID NO: 1262236 - RNA, 15 nt, Human
ccuugggcucugaug

SEQ ID NO: 1262237 - RNA, 20 nt, Human
ccuugggcucugaugaaaaa

SEQ ID NO: 1262238 - RNA, 16 nt, Human
ccuugguucccccacu

SEQ ID NO: 1262239 - RNA, 13 nt, Human
ccuugguuccuaa

SEQ ID NO: 1262240 - RNA, 22 nt, Human
ccuugguucuugaggggaccag

SEQ ID NO: 1262241 - RNA, 21 nt, Human
ccuugguugucuggcaaggac

SEQ ID NO: 1262242 - RNA, 22 nt, Human
ccuugguugucuggcaaggacu

SEQ ID NO: 1262243 - RNA, 21 nt, Human
ccuugguuuuuacugcucuga

SEQ ID NO: 1262244 - RNA, 23 nt, Human
ccuugguuuuuacugcucugaga

SEQ ID NO: 1262245 - RNA, 16 nt, Human
ccuuguaauucuaaau

SEQ ID NO: 1262246 - RNA, 19 nt, Human
ccuuguaauucuaaaugaa

SEQ ID NO: 1262247 - RNA, 14 nt, Human
ccuuguagcuccuc

SEQ ID NO: 1262248 - RNA, 15 nt, Human
ccuuguagcuccucc

SEQ ID NO: 1262249 - RNA, 17 nt, Human
ccuuguagcuccucccc

SEQ ID NO: 1262250 - RNA, 20 nt, Human
ccuuguauccccugcaggcu

SEQ ID NO: 1262251 - RNA, 22 nt, Human
cgaagcuaacagggaaggcagg

SEQ ID NO: 1262252 - RNA, 17 nt, Human
cgaagcuaacagggaag

SEQ ID NO: 1262253 - RNA, 23 nt, Human
cgaaggaaaagggcuuucucaau

SEQ ID NO: 1262254 - RNA, 17 nt, Human
cgaaucuacuaauucca

SEQ ID NO: 1262255 - RNA, 12 nt, Human
cgaaucucugug

SEQ ID NO: 1262256 - RNA, 16 nt, Human
cgaaucucugugccuu

SEQ ID NO: 1262257 - RNA, 22 nt, Human
cgaaucucuuuuugcuuucgaa

SEQ ID NO: 1262258 - RNA, 12 nt, Human
cgaaugacacug

SEQ ID NO: 1262259 - RNA, 16 nt, Human
cgaaugacacuguuca

SEQ ID NO: 1262260 - RNA, 13 nt, Human
cgaaugacacugu

SEQ ID NO: 1262261 - RNA, 13 nt, Human
cgaaugugucuuu

SEQ ID NO: 1262262 - RNA, 14 nt, Human
cgaaugugucuuua

SEQ ID NO: 1262263 - RNA, 15 nt, Human
cgaaugugucuuuag

SEQ ID NO: 1262264 - RNA, 16 nt, Human
cgaaugugucuuuaga

SEQ ID NO: 1262265 - RNA, 19 nt, Human
cgaaugugucuuuagauag

SEQ ID NO: 1262266 - RNA, 18 nt, Human
cgaaugugucuuuagaua

SEQ ID NO: 1262267 - RNA, 18 nt, Human
ccuuuuuuuccaucuuua

SEQ ID NO: 1262268 - RNA, 16 nt, Human
cgaaauaauuguuguu

SEQ ID NO: 1262269 - RNA, 19 nt, Human
cgaaauaauuguuguucug

SEQ ID NO: 1262270 - RNA, 20 nt, Human
cgaaauaauuguuguucugu

SEQ ID NO: 1262271 - RNA, 21 nt, Human
cgaaauaauuguuguucuguu

SEQ ID NO: 1262272 - RNA, 22 nt, Human
cgaaauaauuguuguucuguua

SEQ ID NO: 1262273 - RNA, 20 nt, Human
cgaaauaucuauguuuuacc

SEQ ID NO: 1262274 - RNA, 13 nt, Human
cgaaauguuauuu

SEQ ID NO: 1262275 - RNA, 14 nt, Human
cgaaauguuauuuu

SEQ ID NO: 1262276 - RNA, 22 nt, Human
cgaaauguuauuuuuuaauuau

SEQ ID NO: 1262277 - RNA, 15 nt, Human
cgaagcguuguccuc

SEQ ID NO: 1262278 - RNA, 16 nt, Human
cgaagcguuguccuca

SEQ ID NO: 1262279 - RNA, 17 nt, Human
cgaagcguuguccucag

SEQ ID NO: 1262280 - RNA, 21 nt, Human
cgaagcguuguccucagcccc

SEQ ID NO: 1262281 - RNA, 18 nt, Human
cgaagcccagagggucug

SEQ ID NO: 1262282 - RNA, 23 nt, Human
cgaagcccagagggucugggggc

SEQ ID NO: 1262283 - RNA, 13 nt, Human
ccuuugugaaaaa

SEQ ID NO: 1262284 - RNA, 18 nt, Human
ccuuuuuuccccagacuu

SEQ ID NO: 1262285 - RNA, 15 nt, Human
ccuuuuuuccccaga

SEQ ID NO: 1262286 - RNA, 15 nt, Human
ccuuuuuucuguaua

SEQ ID NO: 1262287 - RNA, 12 nt, Human
ccuuuuuugauc

SEQ ID NO: 1262288 - RNA, 13 nt, Human
ccuuuuuugauca

SEQ ID NO: 1262289 - RNA, 14 nt, Human
ccuuuuuuccccag

SEQ ID NO: 1262290 - RNA, 13 nt, Human
ccuuugugaguca

SEQ ID NO: 1262291 - RNA, 16 nt, Human
ccuuugugagucaaua

SEQ ID NO: 1262292 - RNA, 22 nt, Human
ccuuugugcacauuuauuuccu

SEQ ID NO: 1262293 - RNA, 13 nt, Human
ccuuugugcccua

SEQ ID NO: 1262294 - RNA, 14 nt, Human
ccuuugugcccuau

SEQ ID NO: 1262295 - RNA, 14 nt, Human
ccuuugugugcucu

SEQ ID NO: 1262296 - RNA, 17 nt, Human
ccuuugugugcucucca

SEQ ID NO: 1262297 - RNA, 18 nt, Human
ccuuugugugcucuccau

SEQ ID NO: 1262298 - RNA, 20 nt, Human
ccuuugugugcucuccauuc

SEQ ID NO: 1262299 - RNA, 18 nt, Human
ccuuuguuacuucucuaa

SEQ ID NO: 1262300 - RNA, 18 nt, Human
ccuuuguuccccacugga

SEQ ID NO: 1262301 - RNA, 20 nt, Human
ccuuuguuccccacuggagc

SEQ ID NO: 1262302 - RNA, 21 nt, Human
ccuuuguuccccacuggagca

SEQ ID NO: 1262303 - RNA, 23 nt, Human
ccuuuguuggagucaaaaagaac

SEQ ID NO: 1262304 - RNA, 12 nt, Human
ccuuuuaaagaa

SEQ ID NO: 1262305 - RNA, 23 nt, Human
ccuuuguaaauugucagaugcug

SEQ ID NO: 1262306 - RNA, 21 nt, Human
ccuuuguaaauugucagaugc

SEQ ID NO: 1262307 - RNA, 22 nt, Human
ccuuugggcuucagcugccagu

SEQ ID NO: 1262308 - RNA, 19 nt, Human
ccuuugggcuucagcugcc

SEQ ID NO: 1262309 - RNA, 15 nt, Human
ccuugugggccuggg

SEQ ID NO: 1262310 - RNA, 16 nt, Human
ccuugugggccugggc

SEQ ID NO: 1262311 - RNA, 17 nt, Human
ccuugugggccugggcu

SEQ ID NO: 1262312 - RNA, 20 nt, Human
ccuugugggccugggcuccu

SEQ ID NO: 1262313 - RNA, 21 nt, Human
ccuugugggccugggcuccug

SEQ ID NO: 1262314 - RNA, 17 nt, Human
ccuuguauccccugcag

SEQ ID NO: 1262315 - RNA, 19 nt, Human
ccuugucuuauucccuucc

SEQ ID NO: 1262316 - RNA, 21 nt, Human
ccuugucuuauucccuuccug

SEQ ID NO: 1262317 - RNA, 20 nt, Human
ccuugugaaucaagggucag

SEQ ID NO: 1262318 - RNA, 21 nt, Human
ccuugugaugucauacagaga

SEQ ID NO: 1262319 - RNA, 22 nt, Human
ccuugugaugucauacagagaa

SEQ ID NO: 1262320 - RNA, 20 nt, Human
ccuugugaugugcacguaaa

SEQ ID NO: 1262321 - RNA, 12 nt, Human
ccuugugccaga

SEQ ID NO: 1262322 - RNA, 23 nt, Human
ccuugugaugucauacagagaag

SEQ ID NO: 1262323 - RNA, 13 nt, Human
ccuugugcugggg

SEQ ID NO: 1262324 - RNA, 17 nt, Human
ccugcccugccaccugu

SEQ ID NO: 1262325 - RNA, 15 nt, Human
ccugcccugccaccu

SEQ ID NO: 1262326 - RNA, 14 nt, Human
ccugcccugccacc

SEQ ID NO: 1262327 - RNA, 12 nt, Human
ccugcccugcca

SEQ ID NO: 1262328 - RNA, 11 nt, Human
ccugcccugcc

SEQ ID NO: 1262329 - RNA, 17 nt, Human
ccugcccugcccugcca

SEQ ID NO: 1262330 - RNA, 16 nt, Human
ccugcccugcccugcc

SEQ ID NO: 1262331 - RNA, 15 nt, Human
ccugcccugcccugc

SEQ ID NO: 1262332 - RNA, 18 nt, Human
ccugcccugccaccuguc

SEQ ID NO: 1262333 - RNA, 21 nt, Human
ccugcccugccaccugucugu

SEQ ID NO: 1262334 - RNA, 10 nt, Human
ccugcccugg

SEQ ID NO: 1262335 - RNA, 12 nt, Human
ccugcccuggga

SEQ ID NO: 1262336 - RNA, 14 nt, Human
ccugcccugggagg

SEQ ID NO: 1262337 - RNA, 15 nt, Human
ccugcccugggaggc

SEQ ID NO: 1262338 - RNA, 23 nt, Human
ccugcccugguuuccugcccugg

SEQ ID NO: 1262339 - RNA, 20 nt, Human
ccugcccugggaggcaguga

SEQ ID NO: 1262340 - RNA, 22 nt, Human
ccugcccugggaggcagugaug

SEQ ID NO: 1262341 - RNA, 14 nt, Human
ccugcccugguuuc

SEQ ID NO: 1262342 - RNA, 19 nt, Human
ccugcccugguuuccugcc

SEQ ID NO: 1262343 - RNA, 20 nt, Human
ccugcccugguuuccugccc

SEQ ID NO: 1262344 - RNA, 21 nt, Human
ccugcccugguuuccugcccu

SEQ ID NO: 1262345 - RNA, 22 nt, Human
ccugcccugguuuccugcccug

SEQ ID NO: 1262346 - RNA, 12 nt, Human
ccugccucagcc

SEQ ID NO: 1262347 - RNA, 22 nt, Human
ccugccgagcaaccguggcccu

SEQ ID NO: 1262348 - RNA, 22 nt, Human
ccugccuguucccauucuugca

SEQ ID NO: 1262349 - RNA, 12 nt, Human
ccugccuguggc

SEQ ID NO: 1262350 - RNA, 14 nt, Human
ccugccuguggcca

SEQ ID NO: 1262351 - RNA, 14 nt, Human
ccugccgagagucc

SEQ ID NO: 1262352 - RNA, 21 nt, Human
ccugcccuuguuuggggcagg

SEQ ID NO: 1262353 - RNA, 22 nt, Human
ccugccgagaguccaucagccu

SEQ ID NO: 1262354 - RNA, 23 nt, Human
ccugccgagaguccaucagccuc

SEQ ID NO: 1262355 - RNA, 22 nt, Human
ccugcccuuguuuggggcagga

SEQ ID NO: 1262356 - RNA, 17 nt, Human
ccugccaccugucuguc

SEQ ID NO: 1262357 - RNA, 16 nt, Human
ccugccaccugucugu

SEQ ID NO: 1262358 - RNA, 15 nt, Human
ccugccaccugucug

SEQ ID NO: 1262359 - RNA, 14 nt, Human
ccugccaccugucu

SEQ ID NO: 1262360 - RNA, 13 nt, Human
ccugccaccuguc

SEQ ID NO: 1262361 - RNA, 12 nt, Human
ccugccaccugu

SEQ ID NO: 1262362 - RNA, 21 nt, Human
ccugccaccuggaccccugca

SEQ ID NO: 1262363 - RNA, 17 nt, Human
ccugccaccuccugccu

SEQ ID NO: 1262364 - RNA, 13 nt, Human
ccugccaccugga

SEQ ID NO: 1262365 - RNA, 15 nt, Human
ccugccaccuggacc

SEQ ID NO: 1262366 - RNA, 16 nt, Human
ccugccaccuggaccc

SEQ ID NO: 1262367 - RNA, 17 nt, Human
ccugccaccuggacccc

SEQ ID NO: 1262368 - RNA, 22 nt, Human
ccugccaccuggaccccugcau

SEQ ID NO: 1262369 - RNA, 22 nt, Human
ccugccaggaggacccagggcu

SEQ ID NO: 1262370 - RNA, 13 nt, Human
ccugccacucacu

SEQ ID NO: 1262371 - RNA, 15 nt, Human
ccugccacucacuag

SEQ ID NO: 1262372 - RNA, 16 nt, Human
ccugccacucacuagg

SEQ ID NO: 1262373 - RNA, 18 nt, Human
ccugccacucacuaggcc

SEQ ID NO: 1262374 - RNA, 21 nt, Human
ccugccacucacuaggccccc

SEQ ID NO: 1262375 - RNA, 22 nt, Human
ccugccacucacuaggccccca

SEQ ID NO: 1262376 - RNA, 15 nt, Human
ccugccaggaggacc

SEQ ID NO: 1262377 - RNA, 19 nt, Human
ccugccaggaggacccagg

SEQ ID NO: 1262378 - RNA, 23 nt, Human
ccugccaggaggacccagggcuc

SEQ ID NO: 1262379 - RNA, 13 nt, Human
ccugccagggcag

SEQ ID NO: 1262380 - RNA, 17 nt, Human
ccugccagggcagggcc

SEQ ID NO: 1262381 - RNA, 19 nt, Human
ccugccagggcagggcccc

SEQ ID NO: 1262382 - RNA, 15 nt, Human
ccugccccccagccu

SEQ ID NO: 1262383 - RNA, 17 nt, Human
ccugccccccagccucu

SEQ ID NO: 1262384 - RNA, 18 nt, Human
ccugccccccagccucug

SEQ ID NO: 1262385 - RNA, 22 nt, Human
ccugccccccagccucuggcau

SEQ ID NO: 1262386 - RNA, 14 nt, Human
ccugcccccugcag

SEQ ID NO: 1262387 - RNA, 15 nt, Human
ccugcccccugcagg

SEQ ID NO: 1262388 - RNA, 16 nt, Human
ccugcccccugcagga

SEQ ID NO: 1262389 - RNA, 20 nt, Human
ccugcccccugcaggaagga

SEQ ID NO: 1262390 - RNA, 18 nt, Human
ccugcccuaccugcccca

SEQ ID NO: 1262391 - RNA, 21 nt, Human
ccugcccucauggccccucug

SEQ ID NO: 1262392 - RNA, 23 nt, Human
ccugcccucauggccccucugac

SEQ ID NO: 1262393 - RNA, 17 nt, Human
ccugccccugagcccau

SEQ ID NO: 1262394 - RNA, 22 nt, Human
ccugccccuccucucccucauc

SEQ ID NO: 1262395 - RNA, 19 nt, Human
ccugccccuccucucugcc

SEQ ID NO: 1262396 - RNA, 20 nt, Human
ccugccccuccucucugccc

SEQ ID NO: 1262397 - RNA, 21 nt, Human
ccugccccuccucucugcccu

SEQ ID NO: 1262398 - RNA, 22 nt, Human
ccugccccuccucucugcccua

SEQ ID NO: 1262399 - RNA, 14 nt, Human
ccugccccucccuu

SEQ ID NO: 1262400 - RNA, 19 nt, Human
ccugcccccugcaggaagg

SEQ ID NO: 1262401 - RNA, 15 nt, Human
ccugccccucccuuc

SEQ ID NO: 1262402 - RNA, 16 nt, Human
ccugccccucccuuca

SEQ ID NO: 1262403 - RNA, 18 nt, Human
ccugccccucccuucaac

SEQ ID NO: 1262404 - RNA, 18 nt, Human
ccugccccuccucucugc

SEQ ID NO: 1262405 - RNA, 23 nt, Human
ccucuuccuucccugcugugaaa

SEQ ID NO: 1262406 - RNA, 11 nt, Human
ccucuuccuga

SEQ ID NO: 1262407 - RNA, 12 nt, Human
ccucuuccccag

SEQ ID NO: 1262408 - RNA, 13 nt, Human
ccucuuccccaga

SEQ ID NO: 1262409 - RNA, 21 nt, Human
ccucuuccccagacgccuggc

SEQ ID NO: 1262410 - RNA, 22 nt, Human
ccucuuccccagacgccuggcu

SEQ ID NO: 1262411 - RNA, 16 nt, Human
ccucuucccccaagau

SEQ ID NO: 1262412 - RNA, 15 nt, Human
ccucuucccccaaga

SEQ ID NO: 1262413 - RNA, 15 nt, Human
ccucuucuacucacu

SEQ ID NO: 1262414 - RNA, 21 nt, Human
ccucuucuacucacuuuuccc

SEQ ID NO: 1262415 - RNA, 17 nt, Human
ccucuucuauuuuguaa

SEQ ID NO: 1262416 - RNA, 18 nt, Human
ccucuucuauuuuguaaa

SEQ ID NO: 1262417 - RNA, 23 nt, Human
ccucuucuacucacuuuucccac

SEQ ID NO: 1262418 - RNA, 18 nt, Human
ccugaaaacacugugcac

SEQ ID NO: 1262419 - RNA, 22 nt, Human
ccugaaaagguuuaugaaaaag

SEQ ID NO: 1262420 - RNA, 15 nt, Human
ccugaaacaacuugg

SEQ ID NO: 1262421 - RNA, 20 nt, Human
ccuaucuuugccacccucau

SEQ ID NO: 1262422 - RNA, 19 nt, Human
ccuaucuuugccacccuca

SEQ ID NO: 1262423 - RNA, 15 nt, Human
ccuaucuuugccacc

SEQ ID NO: 1262424 - RNA, 13 nt, Human
ccuaucuuugcca

SEQ ID NO: 1262425 - RNA, 16 nt, Human
ccuaugacuugggcac

SEQ ID NO: 1262426 - RNA, 17 nt, Human
ccuaugacuugggcacc

SEQ ID NO: 1262427 - RNA, 22 nt, Human
ccuaugacuugggcacccccag

SEQ ID NO: 1262428 - RNA, 12 nt, Human
ccuaucuuugcc

SEQ ID NO: 1262429 - RNA, 16 nt, Human
ccucuucagaggcccu

SEQ ID NO: 1262430 - RNA, 18 nt, Human
ccucuucauggauggggg

SEQ ID NO: 1262431 - RNA, 12 nt, Human
ccucuuccaguc

SEQ ID NO: 1262432 - RNA, 14 nt, Human
ccucuuccagucuu

SEQ ID NO: 1262433 - RNA, 16 nt, Human
ccucuuccaugcugug

SEQ ID NO: 1262434 - RNA, 18 nt, Human
ccuaugauguauacugcc

SEQ ID NO: 1262435 - RNA, 15 nt, Human
ccuaugauguauacu

SEQ ID NO: 1262436 - RNA, 14 nt, Human
ccuaugauguauac

SEQ ID NO: 1262437 - RNA, 11 nt, Human
ccuaugaugua

SEQ ID NO: 1262438 - RNA, 13 nt, Human
ccucuucagaggc

SEQ ID NO: 1262439 - RNA, 14 nt, Human
ccucuucagaggcc

SEQ ID NO: 1262440 - RNA, 17 nt, Human
ccuaugauauuuucugu

SEQ ID NO: 1262441 - RNA, 20 nt, Human
ccugaagcuaucguaaaauu

SEQ ID NO: 1262442 - RNA, 16 nt, Human
ccugaaggccugaggu

SEQ ID NO: 1262443 - RNA, 23 nt, Human
ccugaaggccugagguuacugga

SEQ ID NO: 1262444 - RNA, 20 nt, Human
ccugaaggggccaugauggc

SEQ ID NO: 1262445 - RNA, 13 nt, Human
ccugaaagaggaa

SEQ ID NO: 1262446 - RNA, 13 nt, Human
ccugaaauuccaa

SEQ ID NO: 1262447 - RNA, 19 nt, Human
ccugccaccuccugccuca

SEQ ID NO: 1262448 - RNA, 16 nt, Human
ccugccaccuccugcc

SEQ ID NO: 1262449 - RNA, 14 nt, Human
ccugccaccuccug

SEQ ID NO: 1262450 - RNA, 13 nt, Human
ccugccaccuccc

SEQ ID NO: 1262451 - RNA, 18 nt, Human
ccugccaccuccccccac

SEQ ID NO: 1262452 - RNA, 14 nt, Human
ccugccacccagcc

SEQ ID NO: 1262453 - RNA, 17 nt, Human
ccugccacccagcccca

SEQ ID NO: 1262454 - RNA, 18 nt, Human
ccugccacccagccccag

SEQ ID NO: 1262455 - RNA, 16 nt, Human
ccugcauuggaacugg

SEQ ID NO: 1262456 - RNA, 18 nt, Human
ccugcauuggaacuggag

SEQ ID NO: 1262457 - RNA, 19 nt, Human
ccugcauuggaacuggagg

SEQ ID NO: 1262458 - RNA, 20 nt, Human
ccugcauuggaacuggaggc

SEQ ID NO: 1262459 - RNA, 21 nt, Human
ccugcauuggaacuggaggca

SEQ ID NO: 1262460 - RNA, 22 nt, Human
ccugcauuggaacuggaggcag

SEQ ID NO: 1262461 - RNA, 23 nt, Human
ccugcauuugugaaaugauggug

SEQ ID NO: 1262462 - RNA, 23 nt, Human
ccugcauuggaacuggaggcagg

SEQ ID NO: 1262463 - RNA, 16 nt, Human
ccugcacuguaaaaug

SEQ ID NO: 1262464 - RNA, 15 nt, Human
ccugcacuguaaaau

SEQ ID NO: 1262465 - RNA, 14 nt, Human
ccugcacuuacuug

SEQ ID NO: 1262466 - RNA, 17 nt, Human
ccugcacuuacuugcuu

SEQ ID NO: 1262467 - RNA, 15 nt, Human
ccugccaccacgccc

SEQ ID NO: 1262468 - RNA, 19 nt, Human
ccugccaccacgcccggcu

SEQ ID NO: 1262469 - RNA, 12 nt, Human
ccugccacagcc

SEQ ID NO: 1262470 - RNA, 12 nt, Human
ccugccaccagg

SEQ ID NO: 1262471 - RNA, 13 nt, Human
ccugccaccaggc

SEQ ID NO: 1262472 - RNA, 14 nt, Human
ccugccaccaggcc

SEQ ID NO: 1262473 - RNA, 15 nt, Human
ccugccaccaggcca

SEQ ID NO: 1262474 - RNA, 18 nt, Human
ccugccaccaggccaccu

SEQ ID NO: 1262475 - RNA, 19 nt, Human
ccugccaccaggccaccuc

SEQ ID NO: 1262476 - RNA, 15 nt, Human
ccugcaccggggccu

SEQ ID NO: 1262477 - RNA, 19 nt, Human
ccugcaccaugcugcuggg

SEQ ID NO: 1262478 - RNA, 17 nt, Human
ccugcaccggggccugg

SEQ ID NO: 1262479 - RNA, 14 nt, Human
ccugcacuggggag

SEQ ID NO: 1262480 - RNA, 21 nt, Human
ccugcacuggggagcccgucu

SEQ ID NO: 1262481 - RNA, 11 nt, Human
ccugcacugua

SEQ ID NO: 1262482 - RNA, 12 nt, Human
ccugcacuguaa

SEQ ID NO: 1262483 - RNA, 13 nt, Human
ccugcacuguaaa

SEQ ID NO: 1262484 - RNA, 14 nt, Human
ccugcacuguaaaa

SEQ ID NO: 1262485 - RNA, 23 nt, Human
ccugcacaaagcccuuccauguc

SEQ ID NO: 1262486 - RNA, 19 nt, Human
ccugcaaagcccagcuuga

SEQ ID NO: 1262487 - RNA, 21 nt, Human
ccugcacacgcuccuuccucu

SEQ ID NO: 1262488 - RNA, 20 nt, Human
ccugcacaauaaaaauguuu

SEQ ID NO: 1262489 - RNA, 19 nt, Human
ccugcacaauaaaaauguu

SEQ ID NO: 1262490 - RNA, 15 nt, Human
ccugcacagugacuu

SEQ ID NO: 1262491 - RNA, 17 nt, Human
ccugcacagugacuucu

SEQ ID NO: 1262492 - RNA, 18 nt, Human
ccugcacagugacuucug

SEQ ID NO: 1262493 - RNA, 20 nt, Human
ccugcacagugacuucugag

SEQ ID NO: 1262494 - RNA, 21 nt, Human
ccugcacagugacuucugaga

SEQ ID NO: 1262495 - RNA, 22 nt, Human
ccugcacagugacuucugagau

SEQ ID NO: 1262496 - RNA, 14 nt, Human
ccugcaaagcccag

SEQ ID NO: 1262497 - RNA, 13 nt, Human
ccugcaaacuggg

SEQ ID NO: 1262498 - RNA, 16 nt, Human
ccugcaaacugggaac

SEQ ID NO: 1262499 - RNA, 20 nt, Human
ccugcaaacugggaaccccu

SEQ ID NO: 1262500 - RNA, 22 nt, Human
ccugcaaacugggaaccccuuu

SEQ ID NO: 1262501 - RNA, 15 nt, Human
ccugcaaagcccagc

SEQ ID NO: 1262502 - RNA, 16 nt, Human
ccugcaaagcccagcu

SEQ ID NO: 1262503 - RNA, 17 nt, Human
ccugcaaagcccagcuu

SEQ ID NO: 1262504 - RNA, 18 nt, Human
ccugcaaagcccagcuug

SEQ ID NO: 1262505 - RNA, 22 nt, Human
ccugcacaaagcccuuccaugu

SEQ ID NO: 1262506 - RNA, 20 nt, Human
ccugcacaaagcccuuccau

SEQ ID NO: 1262507 - RNA, 14 nt, Human
ccugaucagaccac

SEQ ID NO: 1262508 - RNA, 18 nt, Human
ccugaucagaccacggcu

SEQ ID NO: 1262509 - RNA, 19 nt, Human
ccugaucagaccacggcuc

SEQ ID NO: 1262510 - RNA, 13 nt, Human
ccugaucagagcc

SEQ ID NO: 1262511 - RNA, 14 nt, Human
ccugaucccagaga

SEQ ID NO: 1262512 - RNA, 17 nt, Human
ccugaucccagagagcc

SEQ ID NO: 1262513 - RNA, 19 nt, Human
ccugaucccagagagcccg

SEQ ID NO: 1262514 - RNA, 13 nt, Human
ccugauccuggag

SEQ ID NO: 1262515 - RNA, 15 nt, Human
ccugauccuggaggc

SEQ ID NO: 1262516 - RNA, 18 nt, Human
ccugauccuggaggccca

SEQ ID NO: 1262517 - RNA, 19 nt, Human
ccugauccuggaggcccag

SEQ ID NO: 1262518 - RNA, 20 nt, Human
ccugauccuggaggcccagu

SEQ ID NO: 1262519 - RNA, 12 nt, Human
ccugcaaacugg

SEQ ID NO: 1262520 - RNA, 19 nt, Human
ccugaaguaagcaaagacu

SEQ ID NO: 1262521 - RNA, 21 nt, Human
ccugagccccagggagagggg

SEQ ID NO: 1262522 - RNA, 21 nt, Human
ccugaauacccuuuucugacc

SEQ ID NO: 1262523 - RNA, 16 nt, Human
ccugagccggccccag

SEQ ID NO: 1262524 - RNA, 17 nt, Human
ccugagccggccccagg

SEQ ID NO: 1262525 - RNA, 12 nt, Human
ccugagccugcc

SEQ ID NO: 1262526 - RNA, 13 nt, Human
ccugagccugccg

SEQ ID NO: 1262527 - RNA, 14 nt, Human
ccugagccugccga

SEQ ID NO: 1262528 - RNA, 15 nt, Human
ccugagccugccgag

SEQ ID NO: 1262529 - RNA, 16 nt, Human
ccugagccugccgagc

SEQ ID NO: 1262530 - RNA, 17 nt, Human
ccugagccugccgagca

SEQ ID NO: 1262531 - RNA, 20 nt, Human
ccugagccugccgagcaacc

SEQ ID NO: 1262532 - RNA, 21 nt, Human
ccugagccugccgagcaaccg

SEQ ID NO: 1262533 - RNA, 23 nt, Human
ccugagccugccgagcaaccgug

SEQ ID NO: 1262534 - RNA, 19 nt, Human
ccugagcgaguggagucug

SEQ ID NO: 1262535 - RNA, 20 nt, Human
ccugagcgaguggagucugc

SEQ ID NO: 1262536 - RNA, 21 nt, Human
ccugagcgaguggagucugcc

SEQ ID NO: 1262537 - RNA, 22 nt, Human
ccugagcgaguggagucugcca

SEQ ID NO: 1262538 - RNA, 23 nt, Human
ccugagcgaguggagucugccac

SEQ ID NO: 1262539 - RNA, 12 nt, Human
ccugagcucagc

SEQ ID NO: 1262540 - RNA, 13 nt, Human
ccugagcucagcg

SEQ ID NO: 1262541 - RNA, 14 nt, Human
ccugagcucugaua

SEQ ID NO: 1262542 - RNA, 17 nt, Human
ccugagcugaccagccg

SEQ ID NO: 1262543 - RNA, 15 nt, Human
ccugagcugaggcag

SEQ ID NO: 1262544 - RNA, 16 nt, Human
ccugagcugaggcagc

SEQ ID NO: 1262545 - RNA, 14 nt, Human
ccugagcucagcgu

SEQ ID NO: 1262546 - RNA, 17 nt, Human
ccugaggcuccacuugg

SEQ ID NO: 1262547 - RNA, 18 nt, Human
ccugagcugaggcagcag

SEQ ID NO: 1262548 - RNA, 19 nt, Human
ccugaggccuagacucugu

SEQ ID NO: 1262549 - RNA, 14 nt, Human
ccugaggcuccacu

SEQ ID NO: 1262550 - RNA, 13 nt, Human
ccugaggcuccac

SEQ ID NO: 1262551 - RNA, 15 nt, Human
ccugucccaccccca

SEQ ID NO: 1262552 - RNA, 17 nt, Human
ccugucccacccccacc

SEQ ID NO: 1262553 - RNA, 18 nt, Human
ccugucccacccccaccc

SEQ ID NO: 1262554 - RNA, 17 nt, Human
ccugucauacuuuguua

SEQ ID NO: 1262555 - RNA, 19 nt, Human
ccugucaucaucauggcca

SEQ ID NO: 1262556 - RNA, 16 nt, Human
ccugucagcaugaauu

SEQ ID NO: 1262557 - RNA, 17 nt, Human
ccugucagcaugaauuu

SEQ ID NO: 1262558 - RNA, 22 nt, Human
ccugucagcaugaauuuguaau

SEQ ID NO: 1262559 - RNA, 20 nt, Human
ccugucagcaugaauuugua

SEQ ID NO: 1262560 - RNA, 20 nt, Human
ccugucauccagcucacuca

SEQ ID NO: 1262561 - RNA, 20 nt, Human
ccugucaugguguccagaca

SEQ ID NO: 1262562 - RNA, 11 nt, Human
ccugucccacc

SEQ ID NO: 1262563 - RNA, 13 nt, Human
ccugucccacccc

SEQ ID NO: 1262564 - RNA, 14 nt, Human
ccuguauaccuccu

SEQ ID NO: 1262565 - RNA, 19 nt, Human
ccuguauaccuccuccagc

SEQ ID NO: 1262566 - RNA, 16 nt, Human
ccuguaugucuccagu

SEQ ID NO: 1262567 - RNA, 17 nt, Human
ccugucagauccaggag

SEQ ID NO: 1262568 - RNA, 19 nt, Human
ccugucagauccaggagcu

SEQ ID NO: 1262569 - RNA, 20 nt, Human
ccugucagauccaggagcuc

SEQ ID NO: 1262570 - RNA, 22 nt, Human
ccugucagauccaggagcucca

SEQ ID NO: 1262571 - RNA, 23 nt, Human
ccugucagauccaggagcuccag

SEQ ID NO: 1262572 - RNA, 12 nt, Human
ccugucagcaug

SEQ ID NO: 1262573 - RNA, 13 nt, Human
ccugucagcauga

SEQ ID NO: 1262574 - RNA, 19 nt, Human
ccuguaggaagguacugua

SEQ ID NO: 1262575 - RNA, 20 nt, Human
ccuguagccccagugacagc

SEQ ID NO: 1262576 - RNA, 22 nt, Human
ccuguagccccagugacagcua

SEQ ID NO: 1262577 - RNA, 22 nt, Human
ccuggucugguugggcagccag

SEQ ID NO: 1262578 - RNA, 14 nt, Human
ccuguacaguagau

SEQ ID NO: 1262579 - RNA, 20 nt, Human
ccuguacaguagauuuucca

SEQ ID NO: 1262580 - RNA, 21 nt, Human
ccuguacaguagauuuuccaa

SEQ ID NO: 1262581 - RNA, 22 nt, Human
ccuguacaguagauuuuccaaa

SEQ ID NO: 1262582 - RNA, 14 nt, Human
ccuguacaguguua

SEQ ID NO: 1262583 - RNA, 16 nt, Human
ccuguacauuguggga

SEQ ID NO: 1262584 - RNA, 14 nt, Human
ccuguaccccagca

SEQ ID NO: 1262585 - RNA, 17 nt, Human
ccuguaccccagcacuu

SEQ ID NO: 1262586 - RNA, 22 nt, Human
ccuguagaacucaaccucuaca

SEQ ID NO: 1262587 - RNA, 23 nt, Human
ccuguagaacucaaccucuacag

SEQ ID NO: 1262588 - RNA, 13 nt, Human
ccuggucucaccc

SEQ ID NO: 1262589 - RNA, 17 nt, Human
ccuggucucacccugga

SEQ ID NO: 1262590 - RNA, 18 nt, Human
ccuggucucacccuggag

SEQ ID NO: 1262591 - RNA, 21 nt, Human
ccuggucucacccuggaggca

SEQ ID NO: 1262592 - RNA, 19 nt, Human
ccuggucucacccuggagg

SEQ ID NO: 1262593 - RNA, 19 nt, Human
ccuggguccaaugcucagg

SEQ ID NO: 1262594 - RNA, 16 nt, Human
ccuggguuaaguauua

SEQ ID NO: 1262595 - RNA, 18 nt, Human
ccuguggauguaaaguga

SEQ ID NO: 1262596 - RNA, 14 nt, Human
ccuggcccacccca

SEQ ID NO: 1262597 - RNA, 21 nt, Human
ccuggcccaccccacccacuu

SEQ ID NO: 1262598 - RNA, 22 nt, Human
ccuggcccaccccacccacuuc

SEQ ID NO: 1262599 - RNA, 12 nt, Human
ccuggcccagcc

SEQ ID NO: 1262600 - RNA, 13 nt, Human
ccuggcccagccu

SEQ ID NO: 1262601 - RNA, 14 nt, Human
ccuggcccagccuu

SEQ ID NO: 1262602 - RNA, 16 nt, Human
ccuggcccagccuuug

SEQ ID NO: 1262603 - RNA, 15 nt, Human
ccuggcccaucaggg

SEQ ID NO: 1262604 - RNA, 12 nt, Human
ccuggccccagg

SEQ ID NO: 1262605 - RNA, 13 nt, Human
ccuggccccagga

SEQ ID NO: 1262606 - RNA, 18 nt, Human
ccuggccccauggucagc

SEQ ID NO: 1262607 - RNA, 16 nt, Human
ccuggcuuuucacugc

SEQ ID NO: 1262608 - RNA, 23 nt, Human
ccuggcuuucauuuucucucagg

SEQ ID NO: 1262609 - RNA, 17 nt, Human
ccuggcuuuucacugcu

SEQ ID NO: 1262610 - RNA, 18 nt, Human
ccuggcuuuucacugcug

SEQ ID NO: 1262611 - RNA, 22 nt, Human
ccuggcuuucauuuucucucag

SEQ ID NO: 1262612 - RNA, 18 nt, Human
ccugggaaagccccugcc

SEQ ID NO: 1262613 - RNA, 17 nt, Human
ccugggaaauauucccu

SEQ ID NO: 1262614 - RNA, 18 nt, Human
ccugggaaauauucccua

SEQ ID NO: 1262615 - RNA, 15 nt, Human
ccugggacaacugcu

SEQ ID NO: 1262616 - RNA, 18 nt, Human
ccugggacaacugcuccc

SEQ ID NO: 1262617 - RNA, 19 nt, Human
ccugggacaacugcuccca

SEQ ID NO: 1262618 - RNA, 22 nt, Human
ccugggacaacugcucccaccu

SEQ ID NO: 1262619 - RNA, 23 nt, Human
ccugggacaacugcucccaccuc

SEQ ID NO: 1262620 - RNA, 21 nt, Human
ccuggcuccguccaggagccu

SEQ ID NO: 1262621 - RNA, 20 nt, Human
ccuggcuccuugugccagag

SEQ ID NO: 1262622 - RNA, 21 nt, Human
ccuggcuccuugugccagaga

SEQ ID NO: 1262623 - RNA, 22 nt, Human
ccuggcuccuugugccagagaa

SEQ ID NO: 1262624 - RNA, 13 nt, Human
ccuggcucucacc

SEQ ID NO: 1262625 - RNA, 14 nt, Human
ccuggcucucaccu

SEQ ID NO: 1262626 - RNA, 15 nt, Human
ccuggcucucaccuc

SEQ ID NO: 1262627 - RNA, 16 nt, Human
ccuggcucucaccucu

SEQ ID NO: 1262628 - RNA, 21 nt, Human
ccuggcuuucauuuucucuca

SEQ ID NO: 1262629 - RNA, 12 nt, Human
ccugggaggaga

SEQ ID NO: 1262630 - RNA, 17 nt, Human
ccugggaggagagacac

SEQ ID NO: 1262631 - RNA, 23 nt, Human
ccugggaccgcuacaccacucug

SEQ ID NO: 1262632 - RNA, 22 nt, Human
ccugggagaaaucuggcuucug

SEQ ID NO: 1262633 - RNA, 22 nt, Human
ccugggagaaucgcuccugcag

SEQ ID NO: 1262634 - RNA, 22 nt, Human
ccugggguauaaaacuuuccuc

SEQ ID NO: 1262635 - RNA, 14 nt, Human
ccuggggucuggag

SEQ ID NO: 1262636 - RNA, 15 nt, Human
ccuggggugacccgg

SEQ ID NO: 1262637 - RNA, 18 nt, Human
ccuggggugacccggcac

SEQ ID NO: 1262638 - RNA, 18 nt, Human
ccuggguagcgggggagg

SEQ ID NO: 1262639 - RNA, 13 nt, Human
ccuggccacgccc

SEQ ID NO: 1262640 - RNA, 21 nt, Human
ccuggcaguccgugggacggg

SEQ ID NO: 1262641 - RNA, 21 nt, Human
ccuggcaucgcaccauucuga

SEQ ID NO: 1262642 - RNA, 23 nt, Human
ccuggcaucgcaccauucugacu

SEQ ID NO: 1262643 - RNA, 19 nt, Human
ccuggcaugucaacagcgu

SEQ ID NO: 1262644 - RNA, 23 nt, Human
ccugccuguggcgccgucuccag

SEQ ID NO: 1262645 - RNA, 14 nt, Human
ccugcuacaccuau

SEQ ID NO: 1262646 - RNA, 20 nt, Human
ccugcuacaccuauuauccc

SEQ ID NO: 1262647 - RNA, 23 nt, Human
ccugcuacaccuauuaucccagc

SEQ ID NO: 1262648 - RNA, 21 nt, Human
ccugcuacaccuauuauccca

SEQ ID NO: 1262649 - RNA, 13 nt, Human
ccugcuaggccag

SEQ ID NO: 1262650 - RNA, 14 nt, Human
ccugcuaggccaga

SEQ ID NO: 1262651 - RNA, 16 nt, Human
ccugcuaggccagagc

SEQ ID NO: 1262652 - RNA, 13 nt, Human
ccuggacuuuccu

SEQ ID NO: 1262653 - RNA, 14 nt, Human
ccuggacuuuccug

SEQ ID NO: 1262654 - RNA, 16 nt, Human
ccuggagaacuagaga

SEQ ID NO: 1262655 - RNA, 15 nt, Human
ccugcuaggccagag

SEQ ID NO: 1262656 - RNA, 12 nt, Human
ccuggagaacua

SEQ ID NO: 1262657 - RNA, 13 nt, Human
ccuggagaacuag

SEQ ID NO: 1262658 - RNA, 15 nt, Human
ccuggacuuuccugc

SEQ ID NO: 1262659 - RNA, 16 nt, Human
ccuggacuuuccugca

SEQ ID NO: 1262660 - RNA, 17 nt, Human
ccuggacuuuccugcaa

SEQ ID NO: 1262661 - RNA, 19 nt, Human
ccuggacuuuccugcaacu

SEQ ID NO: 1262662 - RNA, 11 nt, Human
ccuaaccaagu

SEQ ID NO: 1262663 - RNA, 13 nt, Human
ccuaacccuuugu

SEQ ID NO: 1262664 - RNA, 18 nt, Human
ccuaaccucgggccugcu

SEQ ID NO: 1262665 - RNA, 12 nt, Human
ccguugcauuug

SEQ ID NO: 1262666 - RNA, 12 nt, Human
ccuaaccugccg

SEQ ID NO: 1262667 - RNA, 13 nt, Human
ccuaaccugccga

SEQ ID NO: 1262668 - RNA, 15 nt, Human
ccuaacgaaguaucc

SEQ ID NO: 1262669 - RNA, 16 nt, Human
ccuacagggggucugg

SEQ ID NO: 1262670 - RNA, 21 nt, Human
ccggggugggguggcugcagc

SEQ ID NO: 1262671 - RNA, 14 nt, Human
ccgugccaagucca

SEQ ID NO: 1262672 - RNA, 21 nt, Human
ccgugccaaguccagguccug

SEQ ID NO: 1262673 - RNA, 20 nt, Human
ccgugccaaguccagguccu

SEQ ID NO: 1262674 - RNA, 23 nt, Human
ccguggcuguggcauccagaguc

SEQ ID NO: 1262675 - RNA, 21 nt, Human
ccguggcccuuccuggacagc

SEQ ID NO: 1262676 - RNA, 16 nt, Human
ccguggcugcuguggg

SEQ ID NO: 1262677 - RNA, 17 nt, Human
ccguggcugcuguggga

SEQ ID NO: 1262678 - RNA, 20 nt, Human
ccguggcugcugugggaaau

SEQ ID NO: 1262679 - RNA, 14 nt, Human
ccguggcccuuccu

SEQ ID NO: 1262680 - RNA, 16 nt, Human
ccguggcccuuccugg

SEQ ID NO: 1262681 - RNA, 17 nt, Human
ccguggcccuuccugga

SEQ ID NO: 1262682 - RNA, 19 nt, Human
ccguggcccuuccuggaca

SEQ ID NO: 1262683 - RNA, 20 nt, Human
ccguggcccuuccuggacag

SEQ ID NO: 1262684 - RNA, 22 nt, Human
ccguggcccuuccuggacagcu

SEQ ID NO: 1262685 - RNA, 11 nt, Human
ccguggcuucc

SEQ ID NO: 1262686 - RNA, 14 nt, Human
ccguucacaugugu

SEQ ID NO: 1262687 - RNA, 14 nt, Human
ccguucacauuuuu

SEQ ID NO: 1262688 - RNA, 15 nt, Human
ccguucaugggggag

SEQ ID NO: 1262689 - RNA, 16 nt, Human
ccguucaugggggagg

SEQ ID NO: 1262690 - RNA, 23 nt, Human
ccguucaugggggagggggcaga

SEQ ID NO: 1262691 - RNA, 16 nt, Human
ccuacuagucaccaga

SEQ ID NO: 1262692 - RNA, 14 nt, Human
ccuacucacacagg

SEQ ID NO: 1262693 - RNA, 15 nt, Human
ccuacucacacaggc

SEQ ID NO: 1262694 - RNA, 16 nt, Human
ccuacucacacaggca

SEQ ID NO: 1262695 - RNA, 22 nt, Human
ccuacucacacaggcauuuccu

SEQ ID NO: 1262696 - RNA, 16 nt, Human
ccuacuccaaaauguu

SEQ ID NO: 1262697 - RNA, 23 nt, Human
ccuacucacacaggcauuuccug

SEQ ID NO: 1262698 - RNA, 19 nt, Human
ccuaccgagucucuucucc

SEQ ID NO: 1262699 - RNA, 20 nt, Human
ccuaccgagucucuucucca

SEQ ID NO: 1262700 - RNA, 21 nt, Human
ccuaccgagucucuucuccac

SEQ ID NO: 1262701 - RNA, 16 nt, Human
ccuaccgagucucuuc

SEQ ID NO: 1262702 - RNA, 17 nt, Human
ccuaccgagucucuucu

SEQ ID NO: 1262703 - RNA, 18 nt, Human
ccuacagggggucuggcu

SEQ ID NO: 1262704 - RNA, 19 nt, Human
ccuacagggggucuggcug

SEQ ID NO: 1262705 - RNA, 21 nt, Human
ccuacagggggucuggcuggu

SEQ ID NO: 1262706 - RNA, 13 nt, Human
ccuacccucuaga

SEQ ID NO: 1262707 - RNA, 14 nt, Human
ccuacccuggacuu

SEQ ID NO: 1262708 - RNA, 16 nt, Human
ccuaggcuaggguggg

SEQ ID NO: 1262709 - RNA, 17 nt, Human
ccuagguguuuuguuca

SEQ ID NO: 1262710 - RNA, 15 nt, Human
ccuaggccugggcag

SEQ ID NO: 1262711 - RNA, 13 nt, Human
ccuaggccugggc

SEQ ID NO: 1262712 - RNA, 23 nt, Human
ccuaggccugggcaguggauggc

SEQ ID NO: 1262713 - RNA, 13 nt, Human
ccuacugcccagg

SEQ ID NO: 1262714 - RNA, 14 nt, Human
ccguggcuucccgc

SEQ ID NO: 1262715 - RNA, 16 nt, Human
ccggggggucucuucu

SEQ ID NO: 1262716 - RNA, 21 nt, Human
ccgggggcagucugagagagg

SEQ ID NO: 1262717 - RNA, 20 nt, Human
ccggggccugggcaggaggg

SEQ ID NO: 1262718 - RNA, 22 nt, Human
ccggggugagggggggcucccu

SEQ ID NO: 1262719 - RNA, 20 nt, Human
ccggggugcccacaggccgc

SEQ ID NO: 1262720 - RNA, 18 nt, Human
ccggggugggguggcugc

SEQ ID NO: 1262721 - RNA, 20 nt, Human
ccggggugggguggcugcag

SEQ ID NO: 1262722 - RNA, 18 nt, Human
ccgggccacuccuuccug

SEQ ID NO: 1262723 - RNA, 17 nt, Human
ccggaggggccuggcag

SEQ ID NO: 1262724 - RNA, 18 nt, Human
ccggcucccuucuacagc

SEQ ID NO: 1262725 - RNA, 14 nt, Human
ccggcuccugguca

SEQ ID NO: 1262726 - RNA, 17 nt, Human
ccggcuccuggucaccu

SEQ ID NO: 1262727 - RNA, 17 nt, Human
ccggcucucaccuggcc

SEQ ID NO: 1262728 - RNA, 15 nt, Human
ccggcuccuggucac

SEQ ID NO: 1262729 - RNA, 13 nt, Human
ccgggccacuccu

SEQ ID NO: 1262730 - RNA, 20 nt, Human
ccgccucgaccucucucaaa

SEQ ID NO: 1262731 - RNA, 14 nt, Human
ccgccugcccucau

SEQ ID NO: 1262732 - RNA, 16 nt, Human
ccgccugcccucaugg

SEQ ID NO: 1262733 - RNA, 22 nt, Human
ccgccuggaugcggauggccgg

SEQ ID NO: 1262734 - RNA, 17 nt, Human
ccgccugggucuccuaa

SEQ ID NO: 1262735 - RNA, 14 nt, Human
ccgccuggccuggc

SEQ ID NO: 1262736 - RNA, 14 nt, Human
ccggaggggccugg

SEQ ID NO: 1262737 - RNA, 20 nt, Human
ccggaggcggugggccuggu

SEQ ID NO: 1262738 - RNA, 15 nt, Human
ccggaggggccuggc

SEQ ID NO: 1262739 - RNA, 16 nt, Human
ccggaggggccuggca

SEQ ID NO: 1262740 - RNA, 18 nt, Human
ccgcucuacaucuucugc

SEQ ID NO: 1262741 - RNA, 19 nt, Human
ccgcucuacaucuucugcc

SEQ ID NO: 1262742 - RNA, 20 nt, Human
ccgacugaaaauauuguuuu

SEQ ID NO: 1262743 - RNA, 14 nt, Human
ccgacugcuuugga

SEQ ID NO: 1262744 - RNA, 20 nt, Human
ccgacucacaccacuagccu

SEQ ID NO: 1262745 - RNA, 14 nt, Human
ccgacucacaccac

SEQ ID NO: 1262746 - RNA, 23 nt, Human
ccgacucacaccacuagccucag

SEQ ID NO: 1262747 - RNA, 19 nt, Human
ccgagaucaguauuuaacu

SEQ ID NO: 1262748 - RNA, 21 nt, Human
ccgagaguccaucagccucca

SEQ ID NO: 1262749 - RNA, 20 nt, Human
ccgagaguccaucagccucc

SEQ ID NO: 1262750 - RNA, 16 nt, Human
ccgacugcuuuggacc

SEQ ID NO: 1262751 - RNA, 17 nt, Human
ccgacugcuuuggaccu

SEQ ID NO: 1262752 - RNA, 15 nt, Human
ccgagaggugggcca

SEQ ID NO: 1262753 - RNA, 19 nt, Human
ccgagaggugggccagucu

SEQ ID NO: 1262754 - RNA, 21 nt, Human
ccgagaggugggccagucugu

SEQ ID NO: 1262755 - RNA, 18 nt, Human
ccgccucagccucccaaa

SEQ ID NO: 1262756 - RNA, 18 nt, Human
ccgcagaaggaaggcagg

SEQ ID NO: 1262757 - RNA, 14 nt, Human
ccgcagacaccuug

SEQ ID NO: 1262758 - RNA, 15 nt, Human
ccgcagaaggaaggc

SEQ ID NO: 1262759 - RNA, 13 nt, Human
ccgcagaaggaag

SEQ ID NO: 1262760 - RNA, 15 nt, Human
ccgcagacaccuugg

SEQ ID NO: 1262761 - RNA, 16 nt, Human
ccgcagacaccuugga

SEQ ID NO: 1262762 - RNA, 19 nt, Human
ccgagucucuucuccacug

SEQ ID NO: 1262763 - RNA, 20 nt, Human
ccgagucucuucuccacugg

SEQ ID NO: 1262764 - RNA, 21 nt, Human
ccgagucucuucuccacugga

SEQ ID NO: 1262765 - RNA, 20 nt, Human
ccgaguagcugagauuauag

SEQ ID NO: 1262766 - RNA, 14 nt, Human
ccgagucucuucuc

SEQ ID NO: 1262767 - RNA, 16 nt, Human
ccgagucucuucucca

SEQ ID NO: 1262768 - RNA, 18 nt, Human
ccgagucucuucuccacu

SEQ ID NO: 1262769 - RNA, 13 nt, Human
ccgaggacccagg

SEQ ID NO: 1262770 - RNA, 17 nt, Human
ccgaggacccaggaaag

SEQ ID NO: 1262771 - RNA, 20 nt, Human
ccgcucuacaucuucugccu

SEQ ID NO: 1262772 - RNA, 14 nt, Human
cccugccucucugc

SEQ ID NO: 1262773 - RNA, 13 nt, Human
cccugccucucug

SEQ ID NO: 1262774 - RNA, 17 nt, Human
cccugccuccugccggc

SEQ ID NO: 1262775 - RNA, 14 nt, Human
cccugccucuccca

SEQ ID NO: 1262776 - RNA, 15 nt, Human
cccugccucucccag

SEQ ID NO: 1262777 - RNA, 19 nt, Human
cccugccucucccaggcag

SEQ ID NO: 1262778 - RNA, 23 nt, Human
cccugcccuuguuuggggcagga

SEQ ID NO: 1262779 - RNA, 18 nt, Human
cccugaggagucugaggu

SEQ ID NO: 1262780 - RNA, 19 nt, Human
cccugaggagucugagguc

SEQ ID NO: 1262781 - RNA, 22 nt, Human
cccugaggagucugagguccug

SEQ ID NO: 1262782 - RNA, 13 nt, Human
cccugaggagucu

SEQ ID NO: 1262783 - RNA, 14 nt, Human
cccugaggagucug

SEQ ID NO: 1262784 - RNA, 15 nt, Human
cccugaggagucuga

SEQ ID NO: 1262785 - RNA, 16 nt, Human
cccugaggagucugag

SEQ ID NO: 1262786 - RNA, 21 nt, Human
cccugaggagucugagguccu

SEQ ID NO: 1262787 - RNA, 19 nt, Human
cccugcagcuuguagccag

SEQ ID NO: 1262788 - RNA, 20 nt, Human
cccugcagcuuguagccagc

SEQ ID NO: 1262789 - RNA, 21 nt, Human
cccugcagcuuguagccagcc

SEQ ID NO: 1262790 - RNA, 22 nt, Human
cccugcagcuuguagccagccg

SEQ ID NO: 1262791 - RNA, 15 nt, Human
cccugcaggaaggag

SEQ ID NO: 1262792 - RNA, 17 nt, Human
cccugcaggaaggagcu

SEQ ID NO: 1262793 - RNA, 18 nt, Human
cccugcaggaaggagcug

SEQ ID NO: 1262794 - RNA, 19 nt, Human
cccugcaggaaggagcugc

SEQ ID NO: 1262795 - RNA, 20 nt, Human
cccugcaggaaggagcugcc

SEQ ID NO: 1262796 - RNA, 21 nt, Human
cccugcaggaaggagcugccu

SEQ ID NO: 1262797 - RNA, 22 nt, Human
cccugcaggaaggagcugccug

SEQ ID NO: 1262798 - RNA, 23 nt, Human
cccugcaggaaggagcugccugg

SEQ ID NO: 1262799 - RNA, 18 nt, Human
cccugcaggcugagugca

SEQ ID NO: 1262800 - RNA, 16 nt, Human
cccugccucucugcag

SEQ ID NO: 1262801 - RNA, 20 nt, Human
cccugccucucccaggcagg

SEQ ID NO: 1262802 - RNA, 15 nt, Human
cccugccucucugca

SEQ ID NO: 1262803 - RNA, 22 nt, Human
cccugccuuaucuugcacccca

SEQ ID NO: 1262804 - RNA, 19 nt, Human
cccugcgggucacaggagg

SEQ ID NO: 1262805 - RNA, 21 nt, Human
cccugcgggucacaggaggga

SEQ ID NO: 1262806 - RNA, 22 nt, Human
cccugcgggugaacaaagcagc

SEQ ID NO: 1262807 - RNA, 17 nt, Human
cccugcgguagauggga

SEQ ID NO: 1262808 - RNA, 13 nt, Human
cccugcuacaccu

SEQ ID NO: 1262809 - RNA, 16 nt, Human
cccugcuacaccuauu

SEQ ID NO: 1262810 - RNA, 16 nt, Human
cccugcucaguaaagc

SEQ ID NO: 1262811 - RNA, 15 nt, Human
cccugcucauccacu

SEQ ID NO: 1262812 - RNA, 17 nt, Human
cccugcucccacagaac

SEQ ID NO: 1262813 - RNA, 13 nt, Human
cccugcugcugcc

SEQ ID NO: 1262814 - RNA, 23 nt, Human
cccugcugagucccaggcugagc

SEQ ID NO: 1262815 - RNA, 13 nt, Human
cccugcugccaug

SEQ ID NO: 1262816 - RNA, 13 nt, Human
cccugcugcccuc

SEQ ID NO: 1262817 - RNA, 21 nt, Human
cccugcugagucccaggcuga

SEQ ID NO: 1262818 - RNA, 16 nt, Human
cccuggugcugccaca

SEQ ID NO: 1262819 - RNA, 15 nt, Human
cccuugaugaagaag

SEQ ID NO: 1262820 - RNA, 13 nt, Human
cccuucccucacc

SEQ ID NO: 1262821 - RNA, 15 nt, Human
cccuugaggucucag

SEQ ID NO: 1262822 - RNA, 18 nt, Human
cccuugaggucucagccc

SEQ ID NO: 1262823 - RNA, 16 nt, Human
cccuugaguccccauu

SEQ ID NO: 1262824 - RNA, 21 nt, Human
cccuugaucagccccacccug

SEQ ID NO: 1262825 - RNA, 15 nt, Human
cccuugccccccugg

SEQ ID NO: 1262826 - RNA, 17 nt, Human
cccuugccccccuggcc

SEQ ID NO: 1262827 - RNA, 18 nt, Human
cccuugccccccuggccu

SEQ ID NO: 1262828 - RNA, 22 nt, Human
cccuugccccccuggccucccc

SEQ ID NO: 1262829 - RNA, 15 nt, Human
cccuugccugugcca

SEQ ID NO: 1262830 - RNA, 19 nt, Human
cccuugccugugccaggug

SEQ ID NO: 1262831 - RNA, 20 nt, Human
cccuugccugugccagguga

SEQ ID NO: 1262832 - RNA, 15 nt, Human
cccuugcugugaauu

SEQ ID NO: 1262833 - RNA, 20 nt, Human
cccuuagaaguuuguuguga

SEQ ID NO: 1262834 - RNA, 12 nt, Human
cccuuagacaga

SEQ ID NO: 1262835 - RNA, 15 nt, Human
cccuuagacagaggc

SEQ ID NO: 1262836 - RNA, 16 nt, Human
cccuuagacagaggcc

SEQ ID NO: 1262837 - RNA, 21 nt, Human
cccuuagacagaggcccucaa

SEQ ID NO: 1262838 - RNA, 22 nt, Human
cccuuagacagaggcccucaag

SEQ ID NO: 1262839 - RNA, 14 nt, Human
cccuuauccucccu

SEQ ID NO: 1262840 - RNA, 20 nt, Human
cccuuccaugucgccucugc

SEQ ID NO: 1262841 - RNA, 16 nt, Human
cccuuccacugagggc

SEQ ID NO: 1262842 - RNA, 13 nt, Human
cccuuccacugag

SEQ ID NO: 1262843 - RNA, 14 nt, Human
cccuucaaccauuc

SEQ ID NO: 1262844 - RNA, 19 nt, Human
cccuuauugcuguccugga

SEQ ID NO: 1262845 - RNA, 21 nt, Human
cccuuauccucccuguaacuu

SEQ ID NO: 1262846 - RNA, 16 nt, Human
cccuuauccucccugu

SEQ ID NO: 1262847 - RNA, 17 nt, Human
cccuuaugacugccaag

SEQ ID NO: 1262848 - RNA, 19 nt, Human
cccuuaugcgguuaauuuu

SEQ ID NO: 1262849 - RNA, 18 nt, Human
cccuucaaccauucccca

SEQ ID NO: 1262850 - RNA, 12 nt, Human
cccuuauuuuca

SEQ ID NO: 1262851 - RNA, 21 nt, Human
cccuggugcacuggccccacc

SEQ ID NO: 1262852 - RNA, 14 nt, Human
cccuguaggccuca

SEQ ID NO: 1262853 - RNA, 15 nt, Human
cccuggugcugccac

SEQ ID NO: 1262854 - RNA, 15 nt, Human
cccuguaggccucag

SEQ ID NO: 1262855 - RNA, 18 nt, Human
cccugucagcaugaauuu

SEQ ID NO: 1262856 - RNA, 15 nt, Human
cccugucagcaugaa

SEQ ID NO: 1262857 - RNA, 20 nt, Human
cccugucauccagcucacuc

SEQ ID NO: 1262858 - RNA, 14 nt, Human
cccuguuccccaga

SEQ ID NO: 1262859 - RNA, 16 nt, Human
cccuguuccccagaga

SEQ ID NO: 1262860 - RNA, 17 nt, Human
cccuguuccccagagaa

SEQ ID NO: 1262861 - RNA, 13 nt, Human
cccuguuccugcu

SEQ ID NO: 1262862 - RNA, 14 nt, Human
cccuguuccugcug

SEQ ID NO: 1262863 - RNA, 15 nt, Human
cccuguuccugcugc

SEQ ID NO: 1262864 - RNA, 16 nt, Human
cccuguuccugcugcu

SEQ ID NO: 1262865 - RNA, 20 nt, Human
cccuguuccugcugcugucu

SEQ ID NO: 1262866 - RNA, 17 nt, Human
cccuguuccugcugcug

SEQ ID NO: 1262867 - RNA, 22 nt, Human
cccuuaaacaguugcacagcau

SEQ ID NO: 1262868 - RNA, 21 nt, Human
cccuuaaacaguugcacagca

SEQ ID NO: 1262869 - RNA, 20 nt, Human
cccuuaaacaguugcacagc

SEQ ID NO: 1262870 - RNA, 22 nt, Human
cccuguuuucccacgaggaauc

SEQ ID NO: 1262871 - RNA, 16 nt, Human
cccuguuuucccccca

SEQ ID NO: 1262872 - RNA, 20 nt, Human
cccuguuuuccccccaaggg

SEQ ID NO: 1262873 - RNA, 14 nt, Human
cccuuaaaggggag

SEQ ID NO: 1262874 - RNA, 15 nt, Human
cccugcuuccugcuu

SEQ ID NO: 1262875 - RNA, 19 nt, Human
cccugcuuccugcuugcca

SEQ ID NO: 1262876 - RNA, 16 nt, Human
cccugcuuccugcuug

SEQ ID NO: 1262877 - RNA, 13 nt, Human
cccugggcuggaa

SEQ ID NO: 1262878 - RNA, 14 nt, Human
cccugggcuggaau

SEQ ID NO: 1262879 - RNA, 18 nt, Human
cccugcugcugccugccu

SEQ ID NO: 1262880 - RNA, 17 nt, Human
cccugcugcugccugcc

SEQ ID NO: 1262881 - RNA, 16 nt, Human
cccugcugcugccugc

SEQ ID NO: 1262882 - RNA, 13 nt, Human
cccuggugcugcc

SEQ ID NO: 1262883 - RNA, 14 nt, Human
cccuggugcugcca

SEQ ID NO: 1262884 - RNA, 13 nt, Human
cccuggggccugu

SEQ ID NO: 1262885 - RNA, 17 nt, Human
cccuggggccuguacug

SEQ ID NO: 1262886 - RNA, 18 nt, Human
cccuggggccuguacugc

SEQ ID NO: 1262887 - RNA, 12 nt, Human
cccuggggccug

SEQ ID NO: 1262888 - RNA, 20 nt, Human
cccuggggccuguacugccu

SEQ ID NO: 1262889 - RNA, 23 nt, Human
cccucguggacaccugcccugcc

SEQ ID NO: 1262890 - RNA, 22 nt, Human
cccucguggacaccugcccugc

SEQ ID NO: 1262891 - RNA, 19 nt, Human
cccucguggacaccugccc

SEQ ID NO: 1262892 - RNA, 18 nt, Human
cccucguggacaccugcc

SEQ ID NO: 1262893 - RNA, 17 nt, Human
cccucguggacaccugc

SEQ ID NO: 1262894 - RNA, 16 nt, Human
cccucguggacaccug

SEQ ID NO: 1262895 - RNA, 16 nt, Human
cccucccuacccuaac

SEQ ID NO: 1262896 - RNA, 15 nt, Human
cccucccuacccuaa

SEQ ID NO: 1262897 - RNA, 14 nt, Human
cccucccugccccu

SEQ ID NO: 1262898 - RNA, 12 nt, Human
cccgcucagccc

SEQ ID NO: 1262899 - RNA, 13 nt, Human
cccgcucagcccu

SEQ ID NO: 1262900 - RNA, 14 nt, Human
cccgcucagcccuc

SEQ ID NO: 1262901 - RNA, 17 nt, Human
cccucccagagcaccug

SEQ ID NO: 1262902 - RNA, 14 nt, Human
cccuccccuucucu

SEQ ID NO: 1262903 - RNA, 14 nt, Human
cccuccccuugccu

SEQ ID NO: 1262904 - RNA, 23 nt, Human
cccuccccuugccugugccaggu

SEQ ID NO: 1262905 - RNA, 21 nt, Human
cccuccccuugccugugccag

SEQ ID NO: 1262906 - RNA, 15 nt, Human
cccgcucagcccucc

SEQ ID NO: 1262907 - RNA, 13 nt, Human
cccucuuccuucc

SEQ ID NO: 1262908 - RNA, 15 nt, Human
cccucuuggagaagu

SEQ ID NO: 1262909 - RNA, 23 nt, Human
cccucuuggagaagucucagcua

SEQ ID NO: 1262910 - RNA, 17 nt, Human
cccucuuuggcuccccu

SEQ ID NO: 1262911 - RNA, 19 nt, Human
cccucuuuggcuccccugu

SEQ ID NO: 1262912 - RNA, 20 nt, Human
cccucuuuggcuccccugua

SEQ ID NO: 1262913 - RNA, 21 nt, Human
cccucuuuggcuccccuguac

SEQ ID NO: 1262914 - RNA, 20 nt, Human
cccucuguguauuugcuuuu

SEQ ID NO: 1262915 - RNA, 17 nt, Human
cccucugggcucugagu

SEQ ID NO: 1262916 - RNA, 20 nt, Human
cccucuguucugcacacagc

SEQ ID NO: 1262917 - RNA, 21 nt, Human
cccucuguucugcacacagca

SEQ ID NO: 1262918 - RNA, 18 nt, Human
cccucuguuccuucccug

SEQ ID NO: 1262919 - RNA, 22 nt, Human
cccucuuccuacuggucucucu

SEQ ID NO: 1262920 - RNA, 14 nt, Human
cccucuuccuacug

SEQ ID NO: 1262921 - RNA, 19 nt, Human
cccucuuccuacuggucuc

SEQ ID NO: 1262922 - RNA, 12 nt, Human
cccucuggcucc

SEQ ID NO: 1262923 - RNA, 16 nt, Human
cccucuggcuccagcu

SEQ ID NO: 1262924 - RNA, 17 nt, Human
cccucuggcuccagcug

SEQ ID NO: 1262925 - RNA, 22 nt, Human
cccucuggcuccagcuggccgg

SEQ ID NO: 1262926 - RNA, 10 nt, Human
cccucugggc

SEQ ID NO: 1262927 - RNA, 11 nt, Human
cccucugggcu

SEQ ID NO: 1262928 - RNA, 12 nt, Human
cccucugggcuc

SEQ ID NO: 1262929 - RNA, 16 nt, Human
cccucugggcucugag

SEQ ID NO: 1262930 - RNA, 20 nt, Human
cccucucccaaaaaacuacu

SEQ ID NO: 1262931 - RNA, 16 nt, Human
cccucucauuuagccu

SEQ ID NO: 1262932 - RNA, 11 nt, Human
cccucucccac

SEQ ID NO: 1262933 - RNA, 12 nt, Human
cccucucccacc

SEQ ID NO: 1262934 - RNA, 13 nt, Human
cccucucccaccc

SEQ ID NO: 1262935 - RNA, 17 nt, Human
cccucucccacccucuu

SEQ ID NO: 1262936 - RNA, 18 nt, Human
cccucucccacccucuuc

SEQ ID NO: 1262937 - RNA, 12 nt, Human
cccucucccagg

SEQ ID NO: 1262938 - RNA, 19 nt, Human
cccucucccacccucuucc

SEQ ID NO: 1262939 - RNA, 13 nt, Human
cccucucccaggc

SEQ ID NO: 1262940 - RNA, 20 nt, Human
cccucucccaggccccauga

SEQ ID NO: 1262941 - RNA, 15 nt, Human
cccucuacagagcuu

SEQ ID NO: 1262942 - RNA, 22 nt, Human
cccucuccccagggaagcagca

SEQ ID NO: 1262943 - RNA, 14 nt, Human
cccucucccaggcc

SEQ ID NO: 1262944 - RNA, 15 nt, Human
cccucuccccugccc

SEQ ID NO: 1262945 - RNA, 18 nt, Human
cccucuccccugcccccu

SEQ ID NO: 1262946 - RNA, 22 nt, Human
cccucuccccugcccccugcag

SEQ ID NO: 1262947 - RNA, 13 nt, Human
cccucucccugca

SEQ ID NO: 1262948 - RNA, 14 nt, Human
cccucucccugcau

SEQ ID NO: 1262949 - RNA, 15 nt, Human
cccucucccugcaug

SEQ ID NO: 1262950 - RNA, 16 nt, Human
cccucucccugcaugg

SEQ ID NO: 1262951 - RNA, 17 nt, Human
cccucucccugcauggc

SEQ ID NO: 1262952 - RNA, 22 nt, Human
cccucucccuugggcucugaug

SEQ ID NO: 1262953 - RNA, 17 nt, Human
cccucuccuuccugugu

SEQ ID NO: 1262954 - RNA, 12 nt, Human
cccucugcccug

SEQ ID NO: 1262955 - RNA, 13 nt, Human
cccucugcccugc

SEQ ID NO: 1262956 - RNA, 14 nt, Human
cccucugcccugcg

SEQ ID NO: 1262957 - RNA, 14 nt, Human
cccucuccuuccug

SEQ ID NO: 1262958 - RNA, 23 nt, Human
ccccuggugcacuggccccaccc

SEQ ID NO: 1262959 - RNA, 18 nt, Human
ccccuggucccucugcag

SEQ ID NO: 1262960 - RNA, 17 nt, Human
ccccuggucccucugca

SEQ ID NO: 1262961 - RNA, 17 nt, Human
ccccugguccccuccuu

SEQ ID NO: 1262962 - RNA, 21 nt, Human
ccccugguccccuccuuccca

SEQ ID NO: 1262963 - RNA, 22 nt, Human
ccccugucucucagggccaggc

SEQ ID NO: 1262964 - RNA, 23 nt, Human
ccccugucucucagggccaggcc

SEQ ID NO: 1262965 - RNA, 11 nt, Human
ccccugugcag

SEQ ID NO: 1262966 - RNA, 18 nt, Human
ccccuggcuuuucacugc

SEQ ID NO: 1262967 - RNA, 22 nt, Human
ccccuggcugggacguggcuca

SEQ ID NO: 1262968 - RNA, 23 nt, Human
ccccuggcugggacguggcucag

SEQ ID NO: 1262969 - RNA, 20 nt, Human
ccccuggcuuuucacugcug

SEQ ID NO: 1262970 - RNA, 22 nt, Human
ccccuggcuuuucacugcuggc

SEQ ID NO: 1262971 - RNA, 13 nt, Human
ccccugggguggc

SEQ ID NO: 1262972 - RNA, 19 nt, Human
ccccugggguggccaccag

SEQ ID NO: 1262973 - RNA, 20 nt, Human
ccccugggguggccaccagu

SEQ ID NO: 1262974 - RNA, 14 nt, Human
cccgacagccuggc

SEQ ID NO: 1262975 - RNA, 16 nt, Human
ccccuucauccucuga

SEQ ID NO: 1262976 - RNA, 14 nt, Human
ccccuuccacugag

SEQ ID NO: 1262977 - RNA, 15 nt, Human
ccccuguucacucua

SEQ ID NO: 1262978 - RNA, 14 nt, Human
ccccuguucaugcc

SEQ ID NO: 1262979 - RNA, 14 nt, Human
ccccugugccuugu

SEQ ID NO: 1262980 - RNA, 19 nt, Human
ccccugugcagccgcugag

SEQ ID NO: 1262981 - RNA, 20 nt, Human
ccccugugcagccgcugagc

SEQ ID NO: 1262982 - RNA, 23 nt, Human
cccgcagugggagcaaacugcau

SEQ ID NO: 1262983 - RNA, 17 nt, Human
cccgagcuccucuucca

SEQ ID NO: 1262984 - RNA, 14 nt, Human
cccgagcuccucuu

SEQ ID NO: 1262985 - RNA, 15 nt, Human
cccgcagacaccuug

SEQ ID NO: 1262986 - RNA, 16 nt, Human
cccgcagacaccuugg

SEQ ID NO: 1262987 - RNA, 15 nt, Human
cccgacagccuggca

SEQ ID NO: 1262988 - RNA, 18 nt, Human
cccgacagccuggcacag

SEQ ID NO: 1262989 - RNA, 17 nt, Human
cccgacuggggcagggu

SEQ ID NO: 1262990 - RNA, 21 nt, Human
cccgagaacauggccuaaggg

SEQ ID NO: 1262991 - RNA, 20 nt, Human
cccgagaaaacaaacccagg

SEQ ID NO: 1262992 - RNA, 12 nt, Human
cccgagcagcug

SEQ ID NO: 1262993 - RNA, 13 nt, Human
cccgagcagcuga

SEQ ID NO: 1262994 - RNA, 15 nt, Human
cccgagcagcugagc

SEQ ID NO: 1262995 - RNA, 16 nt, Human
cccgagcagcugagca

SEQ ID NO: 1262996 - RNA, 19 nt, Human
cccgagcagcugagcaggg

SEQ ID NO: 1262997 - RNA, 21 nt, Human
cccgagcagcugagcagggcc

SEQ ID NO: 1262998 - RNA, 22 nt, Human
cccgagcagcugagcagggccg

SEQ ID NO: 1262999 - RNA, 19 nt, Human
ccccugccucucugcaggu

SEQ ID NO: 1263000 - RNA, 17 nt, Human
ccccugccucucugcag

SEQ ID NO: 1263001 - RNA, 16 nt, Human
ccccugccucucugca

SEQ ID NO: 1263002 - RNA, 15 nt, Human
ccccugccucucugc

SEQ ID NO: 1263003 - RNA, 14 nt, Human
ccccugccucucug

SEQ ID NO: 1263004 - RNA, 13 nt, Human
ccccugccccucc

SEQ ID NO: 1263005 - RNA, 12 nt, Human
ccccucugcccu

SEQ ID NO: 1263006 - RNA, 15 nt, Human
ccccucugaccugca

SEQ ID NO: 1263007 - RNA, 18 nt, Human
ccccucugaccugcacug

SEQ ID NO: 1263008 - RNA, 13 nt, Human
ccccucugcccug

SEQ ID NO: 1263009 - RNA, 14 nt, Human
ccccucugcccugc

SEQ ID NO: 1263010 - RNA, 16 nt, Human
ccccugcccccugcag

SEQ ID NO: 1263011 - RNA, 17 nt, Human
ccccugcccccugcagg

SEQ ID NO: 1263012 - RNA, 18 nt, Human
ccccugcccccugcagga

SEQ ID NO: 1263013 - RNA, 19 nt, Human
ccccugccugcccugguga

SEQ ID NO: 1263014 - RNA, 15 nt, Human
ccccugccugcccug

SEQ ID NO: 1263015 - RNA, 22 nt, Human
ccccugcuuugggcuugggccu

SEQ ID NO: 1263016 - RNA, 14 nt, Human
ccccugcuuugggc

SEQ ID NO: 1263017 - RNA, 20 nt, Human
ccccuggaggcacugaagug

SEQ ID NO: 1263018 - RNA, 15 nt, Human
ccccuggagggggaa

SEQ ID NO: 1263019 - RNA, 12 nt, Human
ccccuggcagag

SEQ ID NO: 1263020 - RNA, 21 nt, Human
ccccuggcagagaugccuccc

SEQ ID NO: 1263021 - RNA, 19 nt, Human
ccccuggccucccccacuu

SEQ ID NO: 1263022 - RNA, 22 nt, Human
ccccuggcagagaugccucccu

SEQ ID NO: 1263023 - RNA, 15 nt, Human
ccccuagccugccuc

SEQ ID NO: 1263024 - RNA, 20 nt, Human
ccccuagcgcuaucucccug

SEQ ID NO: 1263025 - RNA, 18 nt, Human
ccccucaaaucguccagc

SEQ ID NO: 1263026 - RNA, 20 nt, Human
ccccucacaguauugcucac

SEQ ID NO: 1263027 - RNA, 13 nt, Human
ccccucaccccuc

SEQ ID NO: 1263028 - RNA, 22 nt, Human
cccccugugccuugucacgcca

SEQ ID NO: 1263029 - RNA, 21 nt, Human
cccccugugcagccgcugagc

SEQ ID NO: 1263030 - RNA, 23 nt, Human
cccccugucucucagggccaggc

SEQ ID NO: 1263031 - RNA, 21 nt, Human
cccccugccccccagccucug

SEQ ID NO: 1263032 - RNA, 15 nt, Human
cccccugguccccuc

SEQ ID NO: 1263033 - RNA, 17 nt, Human
cccccugguccccuccu

SEQ ID NO: 1263034 - RNA, 12 nt, Human
cccccuguacac

SEQ ID NO: 1263035 - RNA, 20 nt, Human
cccccuguacacaacucacu

SEQ ID NO: 1263036 - RNA, 18 nt, Human
cccccuguacacaacuca

SEQ ID NO: 1263037 - RNA, 12 nt, Human
cccccugugcag

SEQ ID NO: 1263038 - RNA, 21 nt, Human
cccccucuggcuccagcuggc

SEQ ID NO: 1263039 - RNA, 12 nt, Human
cccccucugucc

SEQ ID NO: 1263040 - RNA, 16 nt, Human
cccccucugucuugug

SEQ ID NO: 1263041 - RNA, 12 nt, Human
cccccucuggcu

SEQ ID NO: 1263042 - RNA, 19 nt, Human
cccccucuggcuccagcug

SEQ ID NO: 1263043 - RNA, 12 nt, Human
cccccucccucc

SEQ ID NO: 1263044 - RNA, 13 nt, Human
cccccucccugga

SEQ ID NO: 1263045 - RNA, 16 nt, Human
cccccucccuggauga

SEQ ID NO: 1263046 - RNA, 19 nt, Human
cccccuccgcccugccacu

SEQ ID NO: 1263047 - RNA, 14 nt, Human
cccccucccuggau

SEQ ID NO: 1263048 - RNA, 18 nt, Human
cccccugcaaagcccagc

SEQ ID NO: 1263049 - RNA, 19 nt, Human
cccccugcaaagcccagcu

SEQ ID NO: 1263050 - RNA, 21 nt, Human
cccccugcaaagcccagcuug

SEQ ID NO: 1263051 - RNA, 11 nt, Human
cccccugcagc

SEQ ID NO: 1263052 - RNA, 17 nt, Human
cccccugaccacucaga

SEQ ID NO: 1263053 - RNA, 14 nt, Human
cccccugcagcuug

SEQ ID NO: 1263054 - RNA, 23 nt, Human
cccccugcagcuuguagccagcc

SEQ ID NO: 1263055 - RNA, 12 nt, Human
cccccugcagga

SEQ ID NO: 1263056 - RNA, 14 nt, Human
cccccugcaggaag

SEQ ID NO: 1263057 - RNA, 16 nt, Human
cccccugccccccagc

SEQ ID NO: 1263058 - RNA, 16 nt, Human
cccccagagccacagu

SEQ ID NO: 1263059 - RNA, 16 nt, Human
cccccagagcccaggc

SEQ ID NO: 1263060 - RNA, 23 nt, Human
cccccagagcccaggcucggccu

SEQ ID NO: 1263061 - RNA, 12 nt, Human
cccccagauauc

SEQ ID NO: 1263062 - RNA, 20 nt, Human
cccccagcaaagcccccaga

SEQ ID NO: 1263063 - RNA, 11 nt, Human
cccccagcacu

SEQ ID NO: 1263064 - RNA, 15 nt, Human
cccccagccucuggc

SEQ ID NO: 1263065 - RNA, 11 nt, Human
cccccagccug

SEQ ID NO: 1263066 - RNA, 12 nt, Human
cccccagccugg

SEQ ID NO: 1263067 - RNA, 13 nt, Human
cccccagccuggg

SEQ ID NO: 1263068 - RNA, 14 nt, Human
cccccagccugggc

SEQ ID NO: 1263069 - RNA, 15 nt, Human
cccccagccugggcc

SEQ ID NO: 1263070 - RNA, 16 nt, Human
cccccagccugggccu

SEQ ID NO: 1263071 - RNA, 12 nt, Human
cccccagccugu

SEQ ID NO: 1263072 - RNA, 13 nt, Human
cccccagccuguc

SEQ ID NO: 1263073 - RNA, 13 nt, Human
cccccagcuaaga

SEQ ID NO: 1263074 - RNA, 18 nt, Human
cccccagcuaagaaccug

SEQ ID NO: 1263075 - RNA, 21 nt, Human
cccccagcuaagaaccuggaa

SEQ ID NO: 1263076 - RNA, 15 nt, Human
cccccagcucccacc

SEQ ID NO: 1263077 - RNA, 15 nt, Human
cccccagcuccggcc

SEQ ID NO: 1263078 - RNA, 13 nt, Human
cccccucccccac

SEQ ID NO: 1263079 - RNA, 17 nt, Human
ccccuccacucuuucuu

SEQ ID NO: 1263080 - RNA, 12 nt, Human
ccccuccacucu

SEQ ID NO: 1263081 - RNA, 21 nt, Human
ccccuccaaaaugugccuauu

SEQ ID NO: 1263082 - RNA, 16 nt, Human
ccccuccaaaaugugc

SEQ ID NO: 1263083 - RNA, 20 nt, Human
ccccucauagcccucacccu

SEQ ID NO: 1263084 - RNA, 23 nt, Human
ccccuccaaucccaccaacccuc

SEQ ID NO: 1263085 - RNA, 20 nt, Human
ccccucaucucucugcccaa

SEQ ID NO: 1263086 - RNA, 23 nt, Human
ccccucagccucuccccugccug

SEQ ID NO: 1263087 - RNA, 13 nt, Human
ccccucacccugc

SEQ ID NO: 1263088 - RNA, 16 nt, Human
ccccucacccugccuu

SEQ ID NO: 1263089 - RNA, 12 nt, Human
ccccucaccucc

SEQ ID NO: 1263090 - RNA, 13 nt, Human
ccccucaccuccu

SEQ ID NO: 1263091 - RNA, 14 nt, Human
ccccucaccuccuc

SEQ ID NO: 1263092 - RNA, 15 nt, Human
ccccucccuucaacc

SEQ ID NO: 1263093 - RNA, 16 nt, Human
ccccuccgcccugcca

SEQ ID NO: 1263094 - RNA, 14 nt, Human
ccccucccuggaug

SEQ ID NO: 1263095 - RNA, 18 nt, Human
ccccuccuccuggacucc

SEQ ID NO: 1263096 - RNA, 22 nt, Human
ccccuccuccuggacuccugca

SEQ ID NO: 1263097 - RNA, 17 nt, Human
ccccuccucuagcugug

SEQ ID NO: 1263098 - RNA, 19 nt, Human
ccccuccucuagcuguggg

SEQ ID NO: 1263099 - RNA, 17 nt, Human
ccccuccgcccugccac

SEQ ID NO: 1263100 - RNA, 18 nt, Human
ccccuccgcccugccacu

SEQ ID NO: 1263101 - RNA, 19 nt, Human
ccccuccgcccugccacuc

SEQ ID NO: 1263102 - RNA, 15 nt, Human
ccccuccucucugcc

SEQ ID NO: 1263103 - RNA, 17 nt, Human
ccccuccucucugcccu

SEQ ID NO: 1263104 - RNA, 21 nt, Human
ccccuccucuagcuguggggg

SEQ ID NO: 1263105 - RNA, 14 nt, Human
ccccuccuucccaa

SEQ ID NO: 1263106 - RNA, 12 nt, Human
ccccucucacca

SEQ ID NO: 1263107 - RNA, 13 nt, Human
ccccucucagccc

SEQ ID NO: 1263108 - RNA, 15 nt, Human
ccccucucagcccuc

SEQ ID NO: 1263109 - RNA, 14 nt, Human
ccccucucagcccu

SEQ ID NO: 1263110 - RNA, 17 nt, Human
ccccucucccaguuguc

SEQ ID NO: 1263111 - RNA, 14 nt, Human
ccccucucccugca

SEQ ID NO: 1263112 - RNA, 12 nt, Human
ccccucucccuu

SEQ ID NO: 1263113 - RNA, 18 nt, Human
ccccucucccugcauggc

SEQ ID NO: 1263114 - RNA, 15 nt, Human
ccccucucccuuggg

SEQ ID NO: 1263115 - RNA, 14 nt, Human
ccccucuccuuccu

SEQ ID NO: 1263116 - RNA, 19 nt, Human
ccccucuccuuccugugug

SEQ ID NO: 1263117 - RNA, 22 nt, Human
ccccucucccuugggcucugau

SEQ ID NO: 1263118 - RNA, 15 nt, Human
ccccucuccuucuua

SEQ ID NO: 1263119 - RNA, 17 nt, Human
cccccacugccuuugac

SEQ ID NO: 1263120 - RNA, 14 nt, Human
cccccacucccuca

SEQ ID NO: 1263121 - RNA, 20 nt, Human
cccccaccucugcugccucc

SEQ ID NO: 1263122 - RNA, 15 nt, Human
cccccaccuggcuca

SEQ ID NO: 1263123 - RNA, 20 nt, Human
cccccaccuggcucaccuug

SEQ ID NO: 1263124 - RNA, 15 nt, Human
cccccacccccagcu

SEQ ID NO: 1263125 - RNA, 17 nt, Human
cccccacccccagcuca

SEQ ID NO: 1263126 - RNA, 11 nt, Human
cccccacccug

SEQ ID NO: 1263127 - RNA, 14 nt, Human
cccccacccuguuc

SEQ ID NO: 1263128 - RNA, 18 nt, Human
cccccacccuguuccugc

SEQ ID NO: 1263129 - RNA, 22 nt, Human
cccccagaaaagaaagcuacag

SEQ ID NO: 1263130 - RNA, 22 nt, Human
cccccacuugccucuuccuuga

SEQ ID NO: 1263131 - RNA, 15 nt, Human
cccccagagccacag

SEQ ID NO: 1263132 - RNA, 17 nt, Human
ccccaucauugguaccc

SEQ ID NO: 1263133 - RNA, 16 nt, Human
ccccaucauccucugg

SEQ ID NO: 1263134 - RNA, 17 nt, Human
ccccaucauccucuggc

SEQ ID NO: 1263135 - RNA, 14 nt, Human
ccccaucccaugcu

SEQ ID NO: 1263136 - RNA, 14 nt, Human
cccccacccccagc

SEQ ID NO: 1263137 - RNA, 18 nt, Human
ccccaguaucucuucagu

SEQ ID NO: 1263138 - RNA, 14 nt, Human
ccccaguacacagg

SEQ ID NO: 1263139 - RNA, 12 nt, Human
ccccagggagag

SEQ ID NO: 1263140 - RNA, 12 nt, Human
ccccagggcaca

SEQ ID NO: 1263141 - RNA, 14 nt, Human
ccccagggcacagg

SEQ ID NO: 1263142 - RNA, 15 nt, Human
ccccagggcacagga

SEQ ID NO: 1263143 - RNA, 16 nt, Human
ccccagggcacaggag

SEQ ID NO: 1263144 - RNA, 17 nt, Human
ccccagggcacaggagc

SEQ ID NO: 1263145 - RNA, 18 nt, Human
ccccagggcacaggagcu

SEQ ID NO: 1263146 - RNA, 19 nt, Human
ccccagggcacaggagcua

SEQ ID NO: 1263147 - RNA, 23 nt, Human
ccccagggcacaggagcuaccug

SEQ ID NO: 1263148 - RNA, 22 nt, Human
ccccagggcacaggagcuaccu

SEQ ID NO: 1263149 - RNA, 13 nt, Human
ccccagacacugg

SEQ ID NO: 1263150 - RNA, 15 nt, Human
ccccagacuagaugu

SEQ ID NO: 1263151 - RNA, 18 nt, Human
ccccagacuagauguagu

SEQ ID NO: 1263152 - RNA, 21 nt, Human
ccccaggccugaaagaggcug

SEQ ID NO: 1263153 - RNA, 23 nt, Human
ccccaggccugaaagaggcugag

SEQ ID NO: 1263154 - RNA, 15 nt, Human
ccccaggcucgugga

SEQ ID NO: 1263155 - RNA, 18 nt, Human
ccccaggcucguggacug

SEQ ID NO: 1263156 - RNA, 13 nt, Human
ccccaggcugaag

SEQ ID NO: 1263157 - RNA, 16 nt, Human
ccccagggaagcagca

SEQ ID NO: 1263158 - RNA, 18 nt, Human
ccccagggaagcagcagc

SEQ ID NO: 1263159 - RNA, 20 nt, Human
ccccagggaagcagcagccu

SEQ ID NO: 1263160 - RNA, 22 nt, Human
ccccagggaagcagcagccucg

SEQ ID NO: 1263161 - RNA, 11 nt, Human
ccccagggcac

SEQ ID NO: 1263162 - RNA, 22 nt, Human
ccccauaauuuuuuuuuuccuu

SEQ ID NO: 1263163 - RNA, 15 nt, Human
ccccauacuccuaug

SEQ ID NO: 1263164 - RNA, 13 nt, Human
ccccaucagugcu

SEQ ID NO: 1263165 - RNA, 14 nt, Human
ccccaucagugcuc

SEQ ID NO: 1263166 - RNA, 20 nt, Human
ccccaucagugcucccucac

SEQ ID NO: 1263167 - RNA, 15 nt, Human
ccccagugacagcua

SEQ ID NO: 1263168 - RNA, 22 nt, Human
ccccaguuccuguggcucccuc

SEQ ID NO: 1263169 - RNA, 21 nt, Human
ccccaguuccuguggcucccu

SEQ ID NO: 1263170 - RNA, 20 nt, Human
cccagaaugagacauccagc

SEQ ID NO: 1263171 - RNA, 22 nt, Human
cccagagaaaggggagcccacu

SEQ ID NO: 1263172 - RNA, 18 nt, Human
cccagagacauacuugaa

SEQ ID NO: 1263173 - RNA, 21 nt, Human
cccagagacauacuugaaggg

SEQ ID NO: 1263174 - RNA, 22 nt, Human
cccagagacauacuugaagggc

SEQ ID NO: 1263175 - RNA, 23 nt, Human
cccagagacauacuugaagggcc

SEQ ID NO: 1263176 - RNA, 13 nt, Human
cccagagacccag

SEQ ID NO: 1263177 - RNA, 14 nt, Human
cccagagacccagc

SEQ ID NO: 1263178 - RNA, 15 nt, Human
cccagagacccagcg

SEQ ID NO: 1263179 - RNA, 16 nt, Human
cccaguuccuguggcu

SEQ ID NO: 1263180 - RNA, 18 nt, Human
cccaguuccuguggcucc

SEQ ID NO: 1263181 - RNA, 21 nt, Human
cccaguuccuguggcucccuc

SEQ ID NO: 1263182 - RNA, 19 nt, Human
cccaguugcacucagguga

SEQ ID NO: 1263183 - RNA, 15 nt, Human
cccaguugccaucug

SEQ ID NO: 1263184 - RNA, 17 nt, Human
cccaguugccaucugcg

SEQ ID NO: 1263185 - RNA, 20 nt, Human
cccaguugcacucaggugac

SEQ ID NO: 1263186 - RNA, 15 nt, Human
cccaguuggagcucc

SEQ ID NO: 1263187 - RNA, 16 nt, Human
cccaguuggagcucca

SEQ ID NO: 1263188 - RNA, 17 nt, Human
cccaguuggagcuccag

SEQ ID NO: 1263189 - RNA, 21 nt, Human
cccaguuggagcuccagccug

SEQ ID NO: 1263190 - RNA, 22 nt, Human
cccaguuggagcuccagccuga

SEQ ID NO: 1263191 - RNA, 13 nt, Human
cccaguuguauuu

SEQ ID NO: 1263192 - RNA, 21 nt, Human
cccaucucaugccccuggcug

SEQ ID NO: 1263193 - RNA, 22 nt, Human
cccaucucaugccccuggcugg

SEQ ID NO: 1263194 - RNA, 14 nt, Human
cccaucucuucugg

SEQ ID NO: 1263195 - RNA, 17 nt, Human
cccaucugucugccaac

SEQ ID NO: 1263196 - RNA, 18 nt, Human
cccaugaccccaaagcca

SEQ ID NO: 1263197 - RNA, 13 nt, Human
cccaugagcuccu

SEQ ID NO: 1263198 - RNA, 14 nt, Human
cccaugaccuccag

SEQ ID NO: 1263199 - RNA, 15 nt, Human
cccaugaccuccagc

SEQ ID NO: 1263200 - RNA, 16 nt, Human
cccaugaccuccagcu

SEQ ID NO: 1263201 - RNA, 14 nt, Human
cccaugagcuccuu

SEQ ID NO: 1263202 - RNA, 15 nt, Human
cccaugagcuccuua

SEQ ID NO: 1263203 - RNA, 22 nt, Human
cccaugagcuccuuaaggcucu

SEQ ID NO: 1263204 - RNA, 19 nt, Human
cccaugauuucauguacug

SEQ ID NO: 1263205 - RNA, 17 nt, Human
cccaugauuucauguac

SEQ ID NO: 1263206 - RNA, 16 nt, Human
cccaugauuucaugua

SEQ ID NO: 1263207 - RNA, 23 nt, Human
cccaugaguuggggucuggcagc

SEQ ID NO: 1263208 - RNA, 15 nt, Human
cccaugaucccugug

SEQ ID NO: 1263209 - RNA, 12 nt, Human
cccaugcacugu

SEQ ID NO: 1263210 - RNA, 14 nt, Human
cccaugcacuguga

SEQ ID NO: 1263211 - RNA, 16 nt, Human
cccaugcacugugaag

SEQ ID NO: 1263212 - RNA, 18 nt, Human
cccaugcacugugaagga

SEQ ID NO: 1263213 - RNA, 19 nt, Human
cccaugcacugugaaggac

SEQ ID NO: 1263214 - RNA, 20 nt, Human
cccaugcacugugaaggacc

SEQ ID NO: 1263215 - RNA, 22 nt, Human
cccaugcacugugaaggacccu

SEQ ID NO: 1263216 - RNA, 18 nt, Human
cccaugcuguccauccau

SEQ ID NO: 1263217 - RNA, 15 nt, Human
cccauggacaggcug

SEQ ID NO: 1263218 - RNA, 20 nt, Human
cccauggacaggcuggcucc

SEQ ID NO: 1263219 - RNA, 22 nt, Human
cccauggacaggcuggcuccag

SEQ ID NO: 1263220 - RNA, 12 nt, Human
ccccacccuggg

SEQ ID NO: 1263221 - RNA, 14 nt, Human
ccccacccugggcc

SEQ ID NO: 1263222 - RNA, 15 nt, Human
ccccacccugggccc

SEQ ID NO: 1263223 - RNA, 20 nt, Human
ccccacccugggcccugggc

SEQ ID NO: 1263224 - RNA, 14 nt, Human
ccccacccuggccu

SEQ ID NO: 1263225 - RNA, 23 nt, Human
ccccacccucguggacaccugcc

SEQ ID NO: 1263226 - RNA, 22 nt, Human
ccccacccucguggacaccugc

SEQ ID NO: 1263227 - RNA, 21 nt, Human
ccccacccucguggacaccug

SEQ ID NO: 1263228 - RNA, 21 nt, Human
ccccacccucggggauguguc

SEQ ID NO: 1263229 - RNA, 23 nt, Human
ccccacccucggggauguguccu

SEQ ID NO: 1263230 - RNA, 12 nt, Human
ccccacccucau

SEQ ID NO: 1263231 - RNA, 14 nt, Human
ccccacccccaagg

SEQ ID NO: 1263232 - RNA, 15 nt, Human
ccccacccucgggga

SEQ ID NO: 1263233 - RNA, 17 nt, Human
ccccaccccaaaauuag

SEQ ID NO: 1263234 - RNA, 14 nt, Human
ccccacccacuucu

SEQ ID NO: 1263235 - RNA, 18 nt, Human
ccccacccaggccaggca

SEQ ID NO: 1263236 - RNA, 16 nt, Human
ccccacccacuucugc

SEQ ID NO: 1263237 - RNA, 21 nt, Human
ccccacccaccaacccucagg

SEQ ID NO: 1263238 - RNA, 22 nt, Human
ccccacccaccaacccucaggg

SEQ ID NO: 1263239 - RNA, 13 nt, Human
ccccacccacuuc

SEQ ID NO: 1263240 - RNA, 14 nt, Human
ccccaccccagggc

SEQ ID NO: 1263241 - RNA, 15 nt, Human
ccccaccccagggca

SEQ ID NO: 1263242 - RNA, 16 nt, Human
ccccaccccagggcag

SEQ ID NO: 1263243 - RNA, 20 nt, Human
ccccaccccagggcagccag

SEQ ID NO: 1263244 - RNA, 13 nt, Human
ccccacccccagc

SEQ ID NO: 1263245 - RNA, 16 nt, Human
ccccacccccagcuca

SEQ ID NO: 1263246 - RNA, 17 nt, Human
ccccacccccagcucaa

SEQ ID NO: 1263247 - RNA, 20 nt, Human
ccccacccccagcucaaugg

SEQ ID NO: 1263248 - RNA, 21 nt, Human
cccauucauuccauucuggaa

SEQ ID NO: 1263249 - RNA, 12 nt, Human
cccauucccgca

SEQ ID NO: 1263250 - RNA, 15 nt, Human
cccauucccgcagug

SEQ ID NO: 1263251 - RNA, 16 nt, Human
cccauucccgcagugg

SEQ ID NO: 1263252 - RNA, 18 nt, Human
cccauucccgcaguggga

SEQ ID NO: 1263253 - RNA, 12 nt, Human
cccauuccugaa

SEQ ID NO: 1263254 - RNA, 13 nt, Human
cccauuccugaag

SEQ ID NO: 1263255 - RNA, 18 nt, Human
cccauuccugaagaacca

SEQ ID NO: 1263256 - RNA, 22 nt, Human
cccauucauuccauucuggaag

SEQ ID NO: 1263257 - RNA, 18 nt, Human
cccauucauuccauucug

SEQ ID NO: 1263258 - RNA, 15 nt, Human
cccauucaagauucc

SEQ ID NO: 1263259 - RNA, 18 nt, Human
ccccacaagugcccucca

SEQ ID NO: 1263260 - RNA, 20 nt, Human
ccccacaccagggccagccu

SEQ ID NO: 1263261 - RNA, 13 nt, Human
ccccaagguucuc

SEQ ID NO: 1263262 - RNA, 14 nt, Human
ccccaauccuccca

SEQ ID NO: 1263263 - RNA, 20 nt, Human
ccccacccuggugggccaac

SEQ ID NO: 1263264 - RNA, 14 nt, Human
ccccacccuguucc

SEQ ID NO: 1263265 - RNA, 17 nt, Human
ccccacccuguuccugc

SEQ ID NO: 1263266 - RNA, 18 nt, Human
ccccacccuguuccugcu

SEQ ID NO: 1263267 - RNA, 19 nt, Human
ccccacccuguuccugcug

SEQ ID NO: 1263268 - RNA, 20 nt, Human
ccccacccuguuccugcugc

SEQ ID NO: 1263269 - RNA, 21 nt, Human
ccccacccuguuccugcugcu

SEQ ID NO: 1263270 - RNA, 22 nt, Human
ccccaccguugucucaugccag

SEQ ID NO: 1263271 - RNA, 14 nt, Human
ccccaccuggcuca

SEQ ID NO: 1263272 - RNA, 13 nt, Human
ccccacgagggcu

SEQ ID NO: 1263273 - RNA, 14 nt, Human
ccccacgagggcug

SEQ ID NO: 1263274 - RNA, 15 nt, Human
ccccacgagggcugg

SEQ ID NO: 1263275 - RNA, 16 nt, Human
ccccacgagggcuggc

SEQ ID NO: 1263276 - RNA, 17 nt, Human
ccccacgagggcuggcu

SEQ ID NO: 1263277 - RNA, 18 nt, Human
ccccacgagggcuggcug

SEQ ID NO: 1263278 - RNA, 21 nt, Human
ccccacgagggcuggcuggcc

SEQ ID NO: 1263279 - RNA, 13 nt, Human
ccccacgccacag

SEQ ID NO: 1263280 - RNA, 14 nt, Human
ccccacgccacagc

SEQ ID NO: 1263281 - RNA, 16 nt, Human
ccccacgccacagccc

SEQ ID NO: 1263282 - RNA, 14 nt, Human
ccccacuguaucua

SEQ ID NO: 1263283 - RNA, 13 nt, Human
ccccacuugccuc

SEQ ID NO: 1263284 - RNA, 14 nt, Human
ccccacuugccucu

SEQ ID NO: 1263285 - RNA, 15 nt, Human
ccccacuugccucuu

SEQ ID NO: 1263286 - RNA, 16 nt, Human
ccccacuugccucuuc

SEQ ID NO: 1263287 - RNA, 21 nt, Human
ccccacuugccucuuccuuga

SEQ ID NO: 1263288 - RNA, 15 nt, Human
ccccacuuucuuucu

SEQ ID NO: 1263289 - RNA, 19 nt, Human
ccccacuuguccuuagccu

SEQ ID NO: 1263290 - RNA, 15 nt, Human
ccccacgccacagcc

SEQ ID NO: 1263291 - RNA, 14 nt, Human
ccccacucccacau

SEQ ID NO: 1263292 - RNA, 15 nt, Human
ccccacucccucaca

SEQ ID NO: 1263293 - RNA, 13 nt, Human
ccccacucccuca

SEQ ID NO: 1263294 - RNA, 14 nt, Human
ccccacucccucac

SEQ ID NO: 1263295 - RNA, 12 nt, Human
ccccacuccucu

SEQ ID NO: 1263296 - RNA, 21 nt, Human
ccccacuccucugcugaccug

SEQ ID NO: 1263297 - RNA, 16 nt, Human
ccccacuccucugcug

SEQ ID NO: 1263298 - RNA, 18 nt, Human
cccagaaugagacaucca

SEQ ID NO: 1263299 - RNA, 12 nt, Human
cccagaaugaga

SEQ ID NO: 1263300 - RNA, 22 nt, Human
cccagaauaaguuauugcaguu

SEQ ID NO: 1263301 - RNA, 19 nt, Human
cccagaauaaguuauugca

SEQ ID NO: 1263302 - RNA, 20 nt, Human
cccacggagucguggggugu

SEQ ID NO: 1263303 - RNA, 15 nt, Human
cccacggcuccucga

SEQ ID NO: 1263304 - RNA, 15 nt, Human
cccacggccuuucua

SEQ ID NO: 1263305 - RNA, 15 nt, Human
cccacgucagcuggg

SEQ ID NO: 1263306 - RNA, 14 nt, Human
cccacgccuuaucc

SEQ ID NO: 1263307 - RNA, 16 nt, Human
cccacgcucacccccu

SEQ ID NO: 1263308 - RNA, 15 nt, Human
cccacgcucaccccc

SEQ ID NO: 1263309 - RNA, 19 nt, Human
cccaccgugggcagggagc

SEQ ID NO: 1263310 - RNA, 17 nt, Human
cccaccguugucucaug

SEQ ID NO: 1263311 - RNA, 20 nt, Human
cccaccguugucucaugcca

SEQ ID NO: 1263312 - RNA, 15 nt, Human
cccacaucccugggc

SEQ ID NO: 1263313 - RNA, 16 nt, Human
cccacaucccugggcc

SEQ ID NO: 1263314 - RNA, 17 nt, Human
cccacaucccugggccu

SEQ ID NO: 1263315 - RNA, 18 nt, Human
cccacaucccugggccug

SEQ ID NO: 1263316 - RNA, 19 nt, Human
cccacaucccugggccugc

SEQ ID NO: 1263317 - RNA, 20 nt, Human
cccacaucccugggccugcu

SEQ ID NO: 1263318 - RNA, 21 nt, Human
cccacaucccugggccugcug

SEQ ID NO: 1263319 - RNA, 22 nt, Human
cccacaucccugggccugcugc

SEQ ID NO: 1263320 - RNA, 24 nt, Human
cccacaucccugggccugcugcug

SEQ ID NO: 1263321 - RNA, 23 nt, Human
cccacaucccugggccugcugcu

SEQ ID NO: 1263322 - RNA, 15 nt, Human
cccaccgugggcagg

SEQ ID NO: 1263323 - RNA, 17 nt, Human
cccaccgugggcaggga

SEQ ID NO: 1263324 - RNA, 18 nt, Human
cccaccucagccucccaa

SEQ ID NO: 1263325 - RNA, 16 nt, Human
cccacaggcccuuccu

SEQ ID NO: 1263326 - RNA, 18 nt, Human
cccacaggcccuuccucu

SEQ ID NO: 1263327 - RNA, 19 nt, Human
cccacauagugaugguucc

SEQ ID NO: 1263328 - RNA, 21 nt, Human
cccacagugucaggcacuggg

SEQ ID NO: 1263329 - RNA, 19 nt, Human
cccacagugucaggcacug

SEQ ID NO: 1263330 - RNA, 17 nt, Human
cccacaucccaucgucu

SEQ ID NO: 1263331 - RNA, 13 nt, Human
cccacaucccugg

SEQ ID NO: 1263332 - RNA, 14 nt, Human
cccacaucccuggg

SEQ ID NO: 1263333 - RNA, 13 nt, Human
cccaacccgugga

SEQ ID NO: 1263334 - RNA, 17 nt, Human
cccaacccguggaggcu

SEQ ID NO: 1263335 - RNA, 18 nt, Human
cccaaggggccugagcag

SEQ ID NO: 1263336 - RNA, 17 nt, Human
cccaagguaccauccua

SEQ ID NO: 1263337 - RNA, 22 nt, Human
cccaagguuacuuaauucaacu

SEQ ID NO: 1263338 - RNA, 23 nt, Human
cccaaguagcugggauuacaggu

SEQ ID NO: 1263339 - RNA, 13 nt, Human
cccaagugagucu

SEQ ID NO: 1263340 - RNA, 20 nt, Human
cccaagugagucucucuggg

SEQ ID NO: 1263341 - RNA, 22 nt, Human
cccacacucagauccuccucau

SEQ ID NO: 1263342 - RNA, 23 nt, Human
cccaacagcuggacccugaccag

SEQ ID NO: 1263343 - RNA, 15 nt, Human
cccaacagcuggacc

SEQ ID NO: 1263344 - RNA, 18 nt, Human
cccaaccauuuccucaga

SEQ ID NO: 1263345 - RNA, 17 nt, Human
cccaaccauuuccucag

SEQ ID NO: 1263346 - RNA, 14 nt, Human
ccauuuucugguuc

SEQ ID NO: 1263347 - RNA, 18 nt, Human
ccauuuuguuauugacua

SEQ ID NO: 1263348 - RNA, 14 nt, Human
cccaacacugccag

SEQ ID NO: 1263349 - RNA, 15 nt, Human
cccaacacugccagc

SEQ ID NO: 1263350 - RNA, 16 nt, Human
cccaacacugccagca

SEQ ID NO: 1263351 - RNA, 23 nt, Human
ccauuuuguuauugacuaacagg

SEQ ID NO: 1263352 - RNA, 22 nt, Human
ccauuuuguuauugacuaacag

SEQ ID NO: 1263353 - RNA, 11 nt, Human
ccauuuuuccu

SEQ ID NO: 1263354 - RNA, 12 nt, Human
ccauuuuuccuu

SEQ ID NO: 1263355 - RNA, 20 nt, Human
ccauguuaaccccuccacuc

SEQ ID NO: 1263356 - RNA, 16 nt, Human
ccauguguuauguuuu

SEQ ID NO: 1263357 - RNA, 18 nt, Human
ccauguuagccaggcugg

SEQ ID NO: 1263358 - RNA, 15 nt, Human
ccauguucugucccu

SEQ ID NO: 1263359 - RNA, 22 nt, Human
ccauguucugucccuugccccc

SEQ ID NO: 1263360 - RNA, 20 nt, Human
ccauuaaguaaacaauaaaa

SEQ ID NO: 1263361 - RNA, 18 nt, Human
ccauuaaagaauaugaaa

SEQ ID NO: 1263362 - RNA, 22 nt, Human
ccauuaaccagaucuagucaau

SEQ ID NO: 1263363 - RNA, 17 nt, Human
ccauuaaucaguucauu

SEQ ID NO: 1263364 - RNA, 16 nt, Human
ccauuaccauguaaug

SEQ ID NO: 1263365 - RNA, 12 nt, Human
ccauuaaaccau

SEQ ID NO: 1263366 - RNA, 18 nt, Human
ccauuaaaccaucucccu

SEQ ID NO: 1263367 - RNA, 19 nt, Human
ccauuaaaccaucucccug

SEQ ID NO: 1263368 - RNA, 10 nt, Human
ccauuaaacg

SEQ ID NO: 1263369 - RNA, 23 nt, Human
ccauuaaacgauuuuuaaaaugu

SEQ ID NO: 1263370 - RNA, 12 nt, Human
ccauuaaagaau

SEQ ID NO: 1263371 - RNA, 14 nt, Human
ccauuaaagaauau

SEQ ID NO: 1263372 - RNA, 16 nt, Human
ccauuaaagaauauga

SEQ ID NO: 1263373 - RNA, 20 nt, Human
ccauuaaagaauaugaaaca

SEQ ID NO: 1263374 - RNA, 18 nt, Human
ccaucucugauuuucaaa

SEQ ID NO: 1263375 - RNA, 23 nt, Human
ccaucucugauuuucaaagcuuu

SEQ ID NO: 1263376 - RNA, 15 nt, Human
ccaucugucugccaa

SEQ ID NO: 1263377 - RNA, 19 nt, Human
ccaucuugcccgcucaggc

SEQ ID NO: 1263378 - RNA, 21 nt, Human
ccaucuugcccgcucaggcug

SEQ ID NO: 1263379 - RNA, 20 nt, Human
ccaucuugcuucccuaaucu

SEQ ID NO: 1263380 - RNA, 21 nt, Human
ccaucuugcuucccuaaucua

SEQ ID NO: 1263381 - RNA, 14 nt, Human
ccauguguccuggu

SEQ ID NO: 1263382 - RNA, 17 nt, Human
ccauguguccugguucc

SEQ ID NO: 1263383 - RNA, 15 nt, Human
ccauuugcauuuguu

SEQ ID NO: 1263384 - RNA, 16 nt, Human
ccauuuguucauauua

SEQ ID NO: 1263385 - RNA, 20 nt, Human
ccauuuguucauauuaagaa

SEQ ID NO: 1263386 - RNA, 15 nt, Human
ccauuuguucauauu

SEQ ID NO: 1263387 - RNA, 16 nt, Human
ccauuugcuuuuucac

SEQ ID NO: 1263388 - RNA, 22 nt, Human
ccauuuuaaaguuaguaucuuu

SEQ ID NO: 1263389 - RNA, 20 nt, Human
ccauucugacucgguuucuc

SEQ ID NO: 1263390 - RNA, 22 nt, Human
ccauuugaauuuuuuagugacu

SEQ ID NO: 1263391 - RNA, 19 nt, Human
ccauuucugaggugcacug

SEQ ID NO: 1263392 - RNA, 12 nt, Human
ccauuugcauuu

SEQ ID NO: 1263393 - RNA, 22 nt, Human
ccauuugcauuuguuuauguaa

SEQ ID NO: 1263394 - RNA, 13 nt, Human
ccauucuccugag

SEQ ID NO: 1263395 - RNA, 12 nt, Human
ccauucugacuc

SEQ ID NO: 1263396 - RNA, 13 nt, Human
ccauucugacucg

SEQ ID NO: 1263397 - RNA, 21 nt, Human
ccauucucacaggucccaaau

SEQ ID NO: 1263398 - RNA, 13 nt, Human
ccauucuccacag

SEQ ID NO: 1263399 - RNA, 15 nt, Human
ccauucuccacagca

SEQ ID NO: 1263400 - RNA, 16 nt, Human
ccauucuccacagcaa

SEQ ID NO: 1263401 - RNA, 18 nt, Human
ccauucuccacagcaacc

SEQ ID NO: 1263402 - RNA, 20 nt, Human
ccauuauaaugaauuuagug

SEQ ID NO: 1263403 - RNA, 20 nt, Human
ccauuauaaccuuaauuuau

SEQ ID NO: 1263404 - RNA, 13 nt, Human
ccauuccuuccca

SEQ ID NO: 1263405 - RNA, 16 nt, Human
ccauuccuucccagag

SEQ ID NO: 1263406 - RNA, 15 nt, Human
ccauucgugaaaaca

SEQ ID NO: 1263407 - RNA, 24 nt, Human
ccaggcugggucgcccuggacugu

SEQ ID NO: 1263408 - RNA, 23 nt, Human
ccaggcugggucgcccuggacug

SEQ ID NO: 1263409 - RNA, 22 nt, Human
ccaggcugggucgcccuggacu

SEQ ID NO: 1263410 - RNA, 21 nt, Human
ccaggcugggucgcccuggac

SEQ ID NO: 1263411 - RNA, 16 nt, Human
ccaggcugggucgccc

SEQ ID NO: 1263412 - RNA, 12 nt, Human
ccaggcuggguc

SEQ ID NO: 1263413 - RNA, 23 nt, Human
ccaggcuucugcuggggccuggg

SEQ ID NO: 1263414 - RNA, 21 nt, Human
ccaggccaccuccccagcauu

SEQ ID NO: 1263415 - RNA, 11 nt, Human
ccagcuccuga

SEQ ID NO: 1263416 - RNA, 12 nt, Human
ccagcuccugac

SEQ ID NO: 1263417 - RNA, 20 nt, Human
ccagcuccugacacugcugg

SEQ ID NO: 1263418 - RNA, 23 nt, Human
ccagcuccugacacugcuggaga

SEQ ID NO: 1263419 - RNA, 14 nt, Human
ccagcuccuuuggg

SEQ ID NO: 1263420 - RNA, 13 nt, Human
ccagcuccuuugg

SEQ ID NO: 1263421 - RNA, 21 nt, Human
ccaggagggacaaaggagccu

SEQ ID NO: 1263422 - RNA, 16 nt, Human
ccaggccaccucccca

SEQ ID NO: 1263423 - RNA, 17 nt, Human
ccaggccaccuccccag

SEQ ID NO: 1263424 - RNA, 16 nt, Human
ccaggagggacaaagg

SEQ ID NO: 1263425 - RNA, 17 nt, Human
ccaggagggacaaagga

SEQ ID NO: 1263426 - RNA, 13 nt, Human
ccaggccaccucc

SEQ ID NO: 1263427 - RNA, 17 nt, Human
ccaggguggcagcaaca

SEQ ID NO: 1263428 - RNA, 16 nt, Human
ccaggguggcagcaac

SEQ ID NO: 1263429 - RNA, 14 nt, Human
ccaggguggcagca

SEQ ID NO: 1263430 - RNA, 20 nt, Human
ccagguagaggguguguaag

SEQ ID NO: 1263431 - RNA, 14 nt, Human
ccagggugugugcu

SEQ ID NO: 1263432 - RNA, 16 nt, Human
ccagguacuugagaaa

SEQ ID NO: 1263433 - RNA, 14 nt, Human
ccaggguccuggga

SEQ ID NO: 1263434 - RNA, 16 nt, Human
ccaggguccugggagg

SEQ ID NO: 1263435 - RNA, 23 nt, Human
ccaggguccugggaggagagaca

SEQ ID NO: 1263436 - RNA, 12 nt, Human
ccagggucucca

SEQ ID NO: 1263437 - RNA, 13 nt, Human
ccagggucuccag

SEQ ID NO: 1263438 - RNA, 17 nt, Human
ccagggucuccagaaag

SEQ ID NO: 1263439 - RNA, 15 nt, Human
ccagggucuccagaa

SEQ ID NO: 1263440 - RNA, 16 nt, Human
ccaggcuggucuaaaa

SEQ ID NO: 1263441 - RNA, 17 nt, Human
ccaggcuggucuaaaac

SEQ ID NO: 1263442 - RNA, 20 nt, Human
ccaggcuggucuaaaacucc

SEQ ID NO: 1263443 - RNA, 13 nt, Human
ccaggcuucugcu

SEQ ID NO: 1263444 - RNA, 15 nt, Human
ccaggcuucugcugg

SEQ ID NO: 1263445 - RNA, 16 nt, Human
ccaggcuucugcuggg

SEQ ID NO: 1263446 - RNA, 18 nt, Human
ccaggcuucugcuggggc

SEQ ID NO: 1263447 - RNA, 20 nt, Human
ccaggcuucugcuggggccu

SEQ ID NO: 1263448 - RNA, 17 nt, Human
ccagggaggcugguccu

SEQ ID NO: 1263449 - RNA, 10 nt, Human
ccagggcaca

SEQ ID NO: 1263450 - RNA, 13 nt, Human
ccagggcacagga

SEQ ID NO: 1263451 - RNA, 14 nt, Human
ccagggcacaggag

SEQ ID NO: 1263452 - RNA, 15 nt, Human
ccagggcacaggagc

SEQ ID NO: 1263453 - RNA, 16 nt, Human
ccagggcacaggagcu

SEQ ID NO: 1263454 - RNA, 17 nt, Human
ccagggcacaggagcua

SEQ ID NO: 1263455 - RNA, 22 nt, Human
ccagggcacaggagcuaccugu

SEQ ID NO: 1263456 - RNA, 20 nt, Human
ccagggcacaggagcuaccu

SEQ ID NO: 1263457 - RNA, 17 nt, Human
ccagggcccccaucuca

SEQ ID NO: 1263458 - RNA, 21 nt, Human
ccagggccccucacccugccu

SEQ ID NO: 1263459 - RNA, 22 nt, Human
ccagggccccucacccugccuu

SEQ ID NO: 1263460 - RNA, 11 nt, Human
ccagggccccu

SEQ ID NO: 1263461 - RNA, 15 nt, Human
ccagggccccucucc

SEQ ID NO: 1263462 - RNA, 22 nt, Human
ccagggccccucuccccaggga

SEQ ID NO: 1263463 - RNA, 24 nt, Human
ccagggccccucuccccagggaag

SEQ ID NO: 1263464 - RNA, 20 nt, Human
ccaucaucuauagaaagcua

SEQ ID NO: 1263465 - RNA, 16 nt, Human
ccaucauccucuggcu

SEQ ID NO: 1263466 - RNA, 20 nt, Human
ccauccugaggcuccacuug

SEQ ID NO: 1263467 - RNA, 18 nt, Human
ccauccugaggcuccacu

SEQ ID NO: 1263468 - RNA, 18 nt, Human
ccaucaaggguacacugc

SEQ ID NO: 1263469 - RNA, 13 nt, Human
ccaucauccucug

SEQ ID NO: 1263470 - RNA, 14 nt, Human
ccaucauccucugg

SEQ ID NO: 1263471 - RNA, 15 nt, Human
ccaucauccucuggc

SEQ ID NO: 1263472 - RNA, 13 nt, Human
ccaucaucuccug

SEQ ID NO: 1263473 - RNA, 16 nt, Human
ccauauggauccacug

SEQ ID NO: 1263474 - RNA, 22 nt, Human
ccauaugcuaccaccagcugug

SEQ ID NO: 1263475 - RNA, 17 nt, Human
ccauaugcuaccaccag

SEQ ID NO: 1263476 - RNA, 18 nt, Human
ccauaugcuaccaccagc

SEQ ID NO: 1263477 - RNA, 19 nt, Human
ccauaugcuaccaccagcu

SEQ ID NO: 1263478 - RNA, 21 nt, Human
ccauaugcuaccaccagcugu

SEQ ID NO: 1263479 - RNA, 12 nt, Human
ccauauuaaauu

SEQ ID NO: 1263480 - RNA, 20 nt, Human
ccauauuaaauuuuuuguug

SEQ ID NO: 1263481 - RNA, 22 nt, Human
ccauauuaaauuuuuuguugac

SEQ ID NO: 1263482 - RNA, 23 nt, Human
ccauauuaaauuuuuuguugaca

SEQ ID NO: 1263483 - RNA, 21 nt, Human
ccagguauucguuaucuaaua

SEQ ID NO: 1263484 - RNA, 20 nt, Human
ccagguauucguuaucuaau

SEQ ID NO: 1263485 - RNA, 14 nt, Human
ccagguaggccaag

SEQ ID NO: 1263486 - RNA, 15 nt, Human
ccagguaggccaagg

SEQ ID NO: 1263487 - RNA, 21 nt, Human
ccagguaggccaagguguccu

SEQ ID NO: 1263488 - RNA, 20 nt, Human
ccagguaggggccccucuca

SEQ ID NO: 1263489 - RNA, 22 nt, Human
ccagguauccaaaaauguguaa

SEQ ID NO: 1263490 - RNA, 19 nt, Human
ccagguauccaaaaaugug

SEQ ID NO: 1263491 - RNA, 16 nt, Human
ccagguggccacucca

SEQ ID NO: 1263492 - RNA, 21 nt, Human
ccagguggccacuccagaccc

SEQ ID NO: 1263493 - RNA, 19 nt, Human
ccagguuggcucugccagu

SEQ ID NO: 1263494 - RNA, 20 nt, Human
ccagguuggcucugccaguc

SEQ ID NO: 1263495 - RNA, 24 nt, Human
ccagguuggcucugccaguccugu

SEQ ID NO: 1263496 - RNA, 15 nt, Human
ccagugacagacagg

SEQ ID NO: 1263497 - RNA, 17 nt, Human
ccagugacagacaggcu

SEQ ID NO: 1263498 - RNA, 18 nt, Human
ccagugacagacaggcuc

SEQ ID NO: 1263499 - RNA, 19 nt, Human
ccagugacagacaggcucu

SEQ ID NO: 1263500 - RNA, 21 nt, Human
ccagugacagacaggcucuua

SEQ ID NO: 1263501 - RNA, 12 nt, Human
ccagugacagcu

SEQ ID NO: 1263502 - RNA, 14 nt, Human
ccagugacagcuag

SEQ ID NO: 1263503 - RNA, 16 nt, Human
ccagugaccaaccuuu

SEQ ID NO: 1263504 - RNA, 20 nt, Human
ccagugcacuugcuggaaga

SEQ ID NO: 1263505 - RNA, 14 nt, Human
ccagugcacugaaa

SEQ ID NO: 1263506 - RNA, 16 nt, Human
ccagugcacuugcugg

SEQ ID NO: 1263507 - RNA, 16 nt, Human
ccagaaugagacaucc

SEQ ID NO: 1263508 - RNA, 16 nt, Human
ccagaaugcuguacau

SEQ ID NO: 1263509 - RNA, 17 nt, Human
ccagaaugcuguacauc

SEQ ID NO: 1263510 - RNA, 19 nt, Human
ccagacacaggcccucccu

SEQ ID NO: 1263511 - RNA, 15 nt, Human
ccagaauaaguuauu

SEQ ID NO: 1263512 - RNA, 19 nt, Human
ccagaauaaguuauugcag

SEQ ID NO: 1263513 - RNA, 21 nt, Human
ccagaauaaguuauugcaguu

SEQ ID NO: 1263514 - RNA, 22 nt, Human
ccagaauaaguuauugcaguuu

SEQ ID NO: 1263515 - RNA, 23 nt, Human
ccagaauaaguuauugcaguuua

SEQ ID NO: 1263516 - RNA, 15 nt, Human
ccagaagcuccccca

SEQ ID NO: 1263517 - RNA, 16 nt, Human
ccagaagcucccccag

SEQ ID NO: 1263518 - RNA, 17 nt, Human
ccagaagcucccccagc

SEQ ID NO: 1263519 - RNA, 18 nt, Human
ccagaagcucccccagca

SEQ ID NO: 1263520 - RNA, 20 nt, Human
ccagaagcucccccagcaaa

SEQ ID NO: 1263521 - RNA, 19 nt, Human
ccagaagcucccccagcaa

SEQ ID NO: 1263522 - RNA, 16 nt, Human
ccagaaguaccagacu

SEQ ID NO: 1263523 - RNA, 20 nt, Human
ccagaaguaccagacuagau

SEQ ID NO: 1263524 - RNA, 14 nt, Human
ccagaccauggaca

SEQ ID NO: 1263525 - RNA, 24 nt, Human
ccagaccccuggcuuuucacugcu

SEQ ID NO: 1263526 - RNA, 14 nt, Human
ccagacaucaacag

SEQ ID NO: 1263527 - RNA, 16 nt, Human
ccagacauaaaggaaa

SEQ ID NO: 1263528 - RNA, 17 nt, Human
ccagacauaaaggaaaa

SEQ ID NO: 1263529 - RNA, 18 nt, Human
ccagacauaaaggaaaag

SEQ ID NO: 1263530 - RNA, 14 nt, Human
ccagacaugccaca

SEQ ID NO: 1263531 - RNA, 20 nt, Human
ccagacaugccacaaggacu

SEQ ID NO: 1263532 - RNA, 13 nt, Human
ccagacacccagg

SEQ ID NO: 1263533 - RNA, 14 nt, Human
ccagagaguggcuc

SEQ ID NO: 1263534 - RNA, 15 nt, Human
ccagagaguggcucc

SEQ ID NO: 1263535 - RNA, 16 nt, Human
ccagagaguggcuccu

SEQ ID NO: 1263536 - RNA, 18 nt, Human
ccagagaguggcuccucc

SEQ ID NO: 1263537 - RNA, 22 nt, Human
ccagagaguggcuccucccggu

SEQ ID NO: 1263538 - RNA, 13 nt, Human
ccagagauccaaa

SEQ ID NO: 1263539 - RNA, 13 nt, Human
ccagagccaaggg

SEQ ID NO: 1263540 - RNA, 12 nt, Human
ccagagccacag

SEQ ID NO: 1263541 - RNA, 13 nt, Human
ccagagccacagu

SEQ ID NO: 1263542 - RNA, 14 nt, Human
ccagagccacaguu

SEQ ID NO: 1263543 - RNA, 15 nt, Human
ccagagccacaguuc

SEQ ID NO: 1263544 - RNA, 11 nt, Human
ccagagccagg

SEQ ID NO: 1263545 - RNA, 12 nt, Human
ccagagccaggg

SEQ ID NO: 1263546 - RNA, 22 nt, Human
ccagagccaggggggugaggag

SEQ ID NO: 1263547 - RNA, 23 nt, Human
ccagagccaggggggugaggagc

SEQ ID NO: 1263548 - RNA, 18 nt, Human
ccagaaaccuuuguuugc

SEQ ID NO: 1263549 - RNA, 16 nt, Human
ccagaaccaauuauuu

SEQ ID NO: 1263550 - RNA, 16 nt, Human
ccacuuuuugcagcuu

SEQ ID NO: 1263551 - RNA, 16 nt, Human
ccagaaaacaaaacug

SEQ ID NO: 1263552 - RNA, 13 nt, Human
ccagaaaacaaaa

SEQ ID NO: 1263553 - RNA, 17 nt, Human
ccacuuuuugcagcuuu

SEQ ID NO: 1263554 - RNA, 15 nt, Human
ccacuuuuugcagcu

SEQ ID NO: 1263555 - RNA, 14 nt, Human
ccacuuuuugcagc

SEQ ID NO: 1263556 - RNA, 20 nt, Human
ccagaacuugacccugagcu

SEQ ID NO: 1263557 - RNA, 13 nt, Human
ccacuuuuugcag

SEQ ID NO: 1263558 - RNA, 14 nt, Human
ccacuuuuuagaaa

SEQ ID NO: 1263559 - RNA, 15 nt, Human
ccacuguuuggaaau

SEQ ID NO: 1263560 - RNA, 16 nt, Human
ccacuguguuccuucc

SEQ ID NO: 1263561 - RNA, 15 nt, Human
ccacugugccucaga

SEQ ID NO: 1263562 - RNA, 16 nt, Human
ccacugugccucagag

SEQ ID NO: 1263563 - RNA, 18 nt, Human
ccacugugccucagagac

SEQ ID NO: 1263564 - RNA, 19 nt, Human
ccacugugccucagagacc

SEQ ID NO: 1263565 - RNA, 22 nt, Human
ccacugugccucagagaccagg

SEQ ID NO: 1263566 - RNA, 20 nt, Human
ccacugugccucagagacca

SEQ ID NO: 1263567 - RNA, 13 nt, Human
ccacuguguuccu

SEQ ID NO: 1263568 - RNA, 14 nt, Human
ccacuguuaucaaa

SEQ ID NO: 1263569 - RNA, 18 nt, Human
ccacugugcagguuccca

SEQ ID NO: 1263570 - RNA, 14 nt, Human
ccacugugccucag

SEQ ID NO: 1263571 - RNA, 21 nt, Human
ccagaaugcuguacaucuauu

SEQ ID NO: 1263572 - RNA, 14 nt, Human
ccaccuucccaugc

SEQ ID NO: 1263573 - RNA, 23 nt, Human
ccaccugguacucccucucagga

SEQ ID NO: 1263574 - RNA, 13 nt, Human
ccacugccucuuc

SEQ ID NO: 1263575 - RNA, 16 nt, Human
ccacugccucuuccuc

SEQ ID NO: 1263576 - RNA, 12 nt, Human
ccacugccuucg

SEQ ID NO: 1263577 - RNA, 21 nt, Human
ccacugccuucgauacaccgg

SEQ ID NO: 1263578 - RNA, 18 nt, Human
ccacugcugauauuuucu

SEQ ID NO: 1263579 - RNA, 19 nt, Human
ccacugcugauauuuucuc

SEQ ID NO: 1263580 - RNA, 22 nt, Human
ccacugcugauauuuucucuag

SEQ ID NO: 1263581 - RNA, 20 nt, Human
ccacugcugauauuuucucu

SEQ ID NO: 1263582 - RNA, 14 nt, Human
ccacugcuuuuccc

SEQ ID NO: 1263583 - RNA, 14 nt, Human
ccacugccuucgcu

SEQ ID NO: 1263584 - RNA, 14 nt, Human
ccacuggggcucag

SEQ ID NO: 1263585 - RNA, 15 nt, Human
ccacuggggcucaga

SEQ ID NO: 1263586 - RNA, 18 nt, Human
ccacuggggcucagagcc

SEQ ID NO: 1263587 - RNA, 15 nt, Human
ccacugguucuucuu

SEQ ID NO: 1263588 - RNA, 15 nt, Human
ccacuguccugggcc

SEQ ID NO: 1263589 - RNA, 19 nt, Human
ccacuguccugggccugca

SEQ ID NO: 1263590 - RNA, 20 nt, Human
ccacuguccugggccugcag

SEQ ID NO: 1263591 - RNA, 21 nt, Human
ccacuguccugggccugcaga

SEQ ID NO: 1263592 - RNA, 19 nt, Human
ccacccucguggacaccug

SEQ ID NO: 1263593 - RNA, 13 nt, Human
ccacccugagccg

SEQ ID NO: 1263594 - RNA, 15 nt, Human
ccacccugagccggc

SEQ ID NO: 1263595 - RNA, 20 nt, Human
ccacccucguggacaccugc

SEQ ID NO: 1263596 - RNA, 18 nt, Human
ccacccucguggacaccu

SEQ ID NO: 1263597 - RNA, 17 nt, Human
ccacccucguggacacc

SEQ ID NO: 1263598 - RNA, 19 nt, Human
ccacccucggggauguguc

SEQ ID NO: 1263599 - RNA, 20 nt, Human
ccacccucggggaugugucc

SEQ ID NO: 1263600 - RNA, 22 nt, Human
ccacccucggggauguguccug

SEQ ID NO: 1263601 - RNA, 15 nt, Human
ccacccccaccccca

SEQ ID NO: 1263602 - RNA, 13 nt, Human
ccacccccagcuc

SEQ ID NO: 1263603 - RNA, 16 nt, Human
ccacccccagcucaau

SEQ ID NO: 1263604 - RNA, 14 nt, Human
ccacccccggcagc

SEQ ID NO: 1263605 - RNA, 23 nt, Human
ccaccucucaauauucaauaaag

SEQ ID NO: 1263606 - RNA, 14 nt, Human
ccaccucucaauau

SEQ ID NO: 1263607 - RNA, 13 nt, Human
ccaccucucaaua

SEQ ID NO: 1263608 - RNA, 20 nt, Human
ccaccucuaacagcaccaaa

SEQ ID NO: 1263609 - RNA, 21 nt, Human
ccaccucuaacagcaccaaau

SEQ ID NO: 1263610 - RNA, 21 nt, Human
ccaccucgcagguucaagcaa

SEQ ID NO: 1263611 - RNA, 20 nt, Human
ccaccucgcagguucaagca

SEQ ID NO: 1263612 - RNA, 14 nt, Human
ccaccucuaacagc

SEQ ID NO: 1263613 - RNA, 15 nt, Human
ccaccucuaacagca

SEQ ID NO: 1263614 - RNA, 18 nt, Human
ccaccucuaacagcacca

SEQ ID NO: 1263615 - RNA, 14 nt, Human
ccaccuccugacac

SEQ ID NO: 1263616 - RNA, 19 nt, Human
ccaccuccugacacccuuc

SEQ ID NO: 1263617 - RNA, 21 nt, Human
ccaccuccugacacccuucuc

SEQ ID NO: 1263618 - RNA, 21 nt, Human
ccacccugagccggccccagg

SEQ ID NO: 1263619 - RNA, 22 nt, Human
ccacccugagccggccccaggc

SEQ ID NO: 1263620 - RNA, 15 nt, Human
ccacccugaggaguc

SEQ ID NO: 1263621 - RNA, 21 nt, Human
ccacccugaggagucugaggu

SEQ ID NO: 1263622 - RNA, 23 nt, Human
ccacccugaggagucugaggucc

SEQ ID NO: 1263623 - RNA, 20 nt, Human
ccacccugaguugcuuuuca

SEQ ID NO: 1263624 - RNA, 21 nt, Human
ccacccugaguugcuuuucag

SEQ ID NO: 1263625 - RNA, 13 nt, Human
ccacccugcucau

SEQ ID NO: 1263626 - RNA, 20 nt, Human
ccacccugcucauccacucu

SEQ ID NO: 1263627 - RNA, 13 nt, Human
ccaccucugcugc

SEQ ID NO: 1263628 - RNA, 17 nt, Human
ccaccucugcugccucc

SEQ ID NO: 1263629 - RNA, 11 nt, Human
ccaccuggacc

SEQ ID NO: 1263630 - RNA, 12 nt, Human
ccaccuggaccc

SEQ ID NO: 1263631 - RNA, 17 nt, Human
ccaccuggaccccugca

SEQ ID NO: 1263632 - RNA, 18 nt, Human
ccaccuggaccccugcau

SEQ ID NO: 1263633 - RNA, 19 nt, Human
ccaccuggaccccugcauu

SEQ ID NO: 1263634 - RNA, 21 nt, Human
ccaccuggaccccugcauugg

SEQ ID NO: 1263635 - RNA, 20 nt, Human
ccaccuggaccccugcauug

SEQ ID NO: 1263636 - RNA, 12 nt, Human
ccaccuggcuca

SEQ ID NO: 1263637 - RNA, 15 nt, Human
ccaccuggcucucac

SEQ ID NO: 1263638 - RNA, 18 nt, Human
ccaccuggcucucaccuc

SEQ ID NO: 1263639 - RNA, 19 nt, Human
ccaccuggcucucaccucu

SEQ ID NO: 1263640 - RNA, 22 nt, Human
ccaccuggcucucaccucuagg

SEQ ID NO: 1263641 - RNA, 21 nt, Human
ccaccugguacucccucucag

SEQ ID NO: 1263642 - RNA, 21 nt, Human
ccagccuggggcugaggcuga

SEQ ID NO: 1263643 - RNA, 22 nt, Human
ccagccugggccuauggagagc

SEQ ID NO: 1263644 - RNA, 13 nt, Human
ccagccugggguc

SEQ ID NO: 1263645 - RNA, 18 nt, Human
ccagccugucagauccag

SEQ ID NO: 1263646 - RNA, 10 nt, Human
ccagccuguc

SEQ ID NO: 1263647 - RNA, 15 nt, Human
ccagccuuuguuccc

SEQ ID NO: 1263648 - RNA, 16 nt, Human
ccagccuuuguucccc

SEQ ID NO: 1263649 - RNA, 21 nt, Human
ccagccuuuguuccccacugg

SEQ ID NO: 1263650 - RNA, 23 nt, Human
ccagccuuuguuccccacuggag

SEQ ID NO: 1263651 - RNA, 18 nt, Human
ccagcucccugugccccc

SEQ ID NO: 1263652 - RNA, 19 nt, Human
ccagcucccugugccccca

SEQ ID NO: 1263653 - RNA, 22 nt, Human
ccagcucccugugcccccaggg

SEQ ID NO: 1263654 - RNA, 17 nt, Human
ccagcucccuucuuccc

SEQ ID NO: 1263655 - RNA, 18 nt, Human
ccagcuccggccuguccu

SEQ ID NO: 1263656 - RNA, 19 nt, Human
ccagcuccggccuguccuc

SEQ ID NO: 1263657 - RNA, 20 nt, Human
ccagcuccggccuguccucc

SEQ ID NO: 1263658 - RNA, 19 nt, Human
ccagcuccgcgccaggaug

SEQ ID NO: 1263659 - RNA, 14 nt, Human
ccagccugggccua

SEQ ID NO: 1263660 - RNA, 17 nt, Human
ccagccugggccuaugg

SEQ ID NO: 1263661 - RNA, 19 nt, Human
ccagccugggccuauggag

SEQ ID NO: 1263662 - RNA, 21 nt, Human
ccagccugggccuauggagag

SEQ ID NO: 1263663 - RNA, 12 nt, Human
ccagccugggcc

SEQ ID NO: 1263664 - RNA, 11 nt, Human
ccagccugggc

SEQ ID NO: 1263665 - RNA, 13 nt, Human
ccagccugggccu

SEQ ID NO: 1263666 - RNA, 21 nt, Human
ccagccuggccuccugccucu

SEQ ID NO: 1263667 - RNA, 22 nt, Human
ccagccuggccuccugccucua

SEQ ID NO: 1263668 - RNA, 20 nt, Human
ccagccugggaaagccccug

SEQ ID NO: 1263669 - RNA, 16 nt, Human
ccagccaucaaaaugc

SEQ ID NO: 1263670 - RNA, 18 nt, Human
ccagccaucaaaaugcuu

SEQ ID NO: 1263671 - RNA, 18 nt, Human
ccagccaucaagagacug

SEQ ID NO: 1263672 - RNA, 23 nt, Human
ccagccaucaccuuagaccacca

SEQ ID NO: 1263673 - RNA, 20 nt, Human
ccagccaucaagagacugag

SEQ ID NO: 1263674 - RNA, 13 nt, Human
ccagcccaccccc

SEQ ID NO: 1263675 - RNA, 14 nt, Human
ccagcccacccccg

SEQ ID NO: 1263676 - RNA, 17 nt, Human
ccagcccacccccggca

SEQ ID NO: 1263677 - RNA, 21 nt, Human
ccagcccacccccggcagcag

SEQ ID NO: 1263678 - RNA, 18 nt, Human
ccagcccacccccggcag

SEQ ID NO: 1263679 - RNA, 11 nt, Human
ccagcccagag

SEQ ID NO: 1263680 - RNA, 12 nt, Human
ccagcccagaga

SEQ ID NO: 1263681 - RNA, 13 nt, Human
ccagcccagagac

SEQ ID NO: 1263682 - RNA, 14 nt, Human
ccagcccagagaca

SEQ ID NO: 1263683 - RNA, 22 nt, Human
ccagcccagagacauacuugaa

SEQ ID NO: 1263684 - RNA, 23 nt, Human
ccagcccagagacauacuugaag

SEQ ID NO: 1263685 - RNA, 16 nt, Human
ccagcccagccccacu

SEQ ID NO: 1263686 - RNA, 13 nt, Human
ccagcccagggcu

SEQ ID NO: 1263687 - RNA, 14 nt, Human
ccagcccagggcuc

SEQ ID NO: 1263688 - RNA, 15 nt, Human
ccagcccagggcucc

SEQ ID NO: 1263689 - RNA, 18 nt, Human
ccagccgacccccucucc

SEQ ID NO: 1263690 - RNA, 20 nt, Human
ccagccgacccccucucccu

SEQ ID NO: 1263691 - RNA, 22 nt, Human
ccagccgacccccucucccugc

SEQ ID NO: 1263692 - RNA, 23 nt, Human
ccagccgacccccucucccugca

SEQ ID NO: 1263693 - RNA, 19 nt, Human
ccagccgcgcaucagacug

SEQ ID NO: 1263694 - RNA, 22 nt, Human
ccagccgcuuggcgaugccagc

SEQ ID NO: 1263695 - RNA, 23 nt, Human
ccagccgcuuggcgaugccagcc

SEQ ID NO: 1263696 - RNA, 21 nt, Human
ccagccggggcgaguggcacg

SEQ ID NO: 1263697 - RNA, 20 nt, Human
ccagccggggcgaguggcac

SEQ ID NO: 1263698 - RNA, 23 nt, Human
ccagcccauggagauugaccugg

SEQ ID NO: 1263699 - RNA, 17 nt, Human
ccagcccagggcuccug

SEQ ID NO: 1263700 - RNA, 19 nt, Human
ccagcccagggcuccugca

SEQ ID NO: 1263701 - RNA, 21 nt, Human
ccagcccagggcuccugcacu

SEQ ID NO: 1263702 - RNA, 14 nt, Human
ccagcccauggaga

SEQ ID NO: 1263703 - RNA, 13 nt, Human
ccagcccugccug

SEQ ID NO: 1263704 - RNA, 14 nt, Human
ccagcccugccugg

SEQ ID NO: 1263705 - RNA, 15 nt, Human
ccagcccugccugga

SEQ ID NO: 1263706 - RNA, 16 nt, Human
ccagcccugccuggag

SEQ ID NO: 1263707 - RNA, 17 nt, Human
ccagcccugccuggagg

SEQ ID NO: 1263708 - RNA, 18 nt, Human
ccagcccugccuggagga

SEQ ID NO: 1263709 - RNA, 22 nt, Human
ccagcccugccuggaggaccug

SEQ ID NO: 1263710 - RNA, 21 nt, Human
ccagcccugccuggaggaccu

SEQ ID NO: 1263711 - RNA, 22 nt, Human
ccagcaccggccccauuuaccc

SEQ ID NO: 1263712 - RNA, 19 nt, Human
ccagcaccggaccagccug

SEQ ID NO: 1263713 - RNA, 20 nt, Human
ccagcaccggaccagccugg

SEQ ID NO: 1263714 - RNA, 18 nt, Human
ccagcaccggaccagccu

SEQ ID NO: 1263715 - RNA, 15 nt, Human
ccagcaccuggcauc

SEQ ID NO: 1263716 - RNA, 21 nt, Human
ccagcaccggaccagccuggc

SEQ ID NO: 1263717 - RNA, 23 nt, Human
ccagcaaagcccccagagcccag

SEQ ID NO: 1263718 - RNA, 16 nt, Human
ccagcacacagggcag

SEQ ID NO: 1263719 - RNA, 19 nt, Human
ccagcacagcuuagauuuc

SEQ ID NO: 1263720 - RNA, 20 nt, Human
ccagcacagcuuagauuuca

SEQ ID NO: 1263721 - RNA, 22 nt, Human
ccagcacagcuuagauuucaua

SEQ ID NO: 1263722 - RNA, 13 nt, Human
ccagcacagcuug

SEQ ID NO: 1263723 - RNA, 17 nt, Human
ccagcacagcuugaccu

SEQ ID NO: 1263724 - RNA, 24 nt, Human
ccagauuuuuuacagcugccugca

SEQ ID NO: 1263725 - RNA, 22 nt, Human
ccagauuuuuuaaaauuuauau

SEQ ID NO: 1263726 - RNA, 21 nt, Human
ccagauuugcuaauuuauccu

SEQ ID NO: 1263727 - RNA, 15 nt, Human
ccagcaaagccccca

SEQ ID NO: 1263728 - RNA, 16 nt, Human
ccagcaaagcccccag

SEQ ID NO: 1263729 - RNA, 17 nt, Human
ccagcaaagcccccaga

SEQ ID NO: 1263730 - RNA, 19 nt, Human
ccagcaaagcccccagagc

SEQ ID NO: 1263731 - RNA, 21 nt, Human
ccagcaaagcccccagagccc

SEQ ID NO: 1263732 - RNA, 24 nt, Human
ccagcaaagcccccagagcccagg

SEQ ID NO: 1263733 - RNA, 16 nt, Human
ccagauuuuuacacau

SEQ ID NO: 1263734 - RNA, 11 nt, Human
ccagagcccac

SEQ ID NO: 1263735 - RNA, 17 nt, Human
ccagagcccagcuccaa

SEQ ID NO: 1263736 - RNA, 18 nt, Human
ccagagcccagcuccaag

SEQ ID NO: 1263737 - RNA, 14 nt, Human
ccagagcccaggcu

SEQ ID NO: 1263738 - RNA, 15 nt, Human
ccagagcccaggcuc

SEQ ID NO: 1263739 - RNA, 11 nt, Human
ccagagccugg

SEQ ID NO: 1263740 - RNA, 12 nt, Human
ccagagccuggg

SEQ ID NO: 1263741 - RNA, 13 nt, Human
ccagagccugggg

SEQ ID NO: 1263742 - RNA, 14 nt, Human
ccagagccuggggc

SEQ ID NO: 1263743 - RNA, 15 nt, Human
ccagagccuggggcu

SEQ ID NO: 1263744 - RNA, 16 nt, Human
ccagagccuggggcuc

SEQ ID NO: 1263745 - RNA, 18 nt, Human
ccagagccuggggcucua

SEQ ID NO: 1263746 - RNA, 20 nt, Human
ccagagccuggggcucuaac

SEQ ID NO: 1263747 - RNA, 13 nt, Human
ccagauugacgac

SEQ ID NO: 1263748 - RNA, 18 nt, Human
ccagauugacgacaagug

SEQ ID NO: 1263749 - RNA, 19 nt, Human
ccagauugacgacaagugc

SEQ ID NO: 1263750 - RNA, 21 nt, Human
ccagauugacgacaagugcug

SEQ ID NO: 1263751 - RNA, 21 nt, Human
ggccccugccucucugcaggu

SEQ ID NO: 1263752 - RNA, 19 nt, Human
ggccccugccucucugcag

SEQ ID NO: 1263753 - RNA, 18 nt, Human
ggccccugccucucugca

SEQ ID NO: 1263754 - RNA, 17 nt, Human
ggccccugccucucugc

SEQ ID NO: 1263755 - RNA, 22 nt, Human
ggccagaggcccccagcccagg

SEQ ID NO: 1263756 - RNA, 11 nt, Human
ggccagaggcu

SEQ ID NO: 1263757 - RNA, 17 nt, Human
ggccagauccagccugg

SEQ ID NO: 1263758 - RNA, 18 nt, Human
ggccagauccagccuggg

SEQ ID NO: 1263759 - RNA, 20 nt, Human
ggccagaugcacaucccugg

SEQ ID NO: 1263760 - RNA, 21 nt, Human
ggccagaugcacaucccugga

SEQ ID NO: 1263761 - RNA, 23 nt, Human
ggccagaugcacaucccuggaag

SEQ ID NO: 1263762 - RNA, 18 nt, Human
ggccccagcacagcuuga

SEQ ID NO: 1263763 - RNA, 13 nt, Human
ggccccagccucc

SEQ ID NO: 1263764 - RNA, 14 nt, Human
ggccucauguggcu

SEQ ID NO: 1263765 - RNA, 19 nt, Human
ggcccucaagucuuucucu

SEQ ID NO: 1263766 - RNA, 16 nt, Human
ggccgcccccugcccc

SEQ ID NO: 1263767 - RNA, 18 nt, Human
ggccgcccccugcccccc

SEQ ID NO: 1263768 - RNA, 19 nt, Human
ggccgcccccugcccccca

SEQ ID NO: 1263769 - RNA, 22 nt, Human
ggccgcccccugccccccagcc

SEQ ID NO: 1263770 - RNA, 14 nt, Human
ggccgccgccucuu

SEQ ID NO: 1263771 - RNA, 15 nt, Human
ggccgccugggucca

SEQ ID NO: 1263772 - RNA, 13 nt, Human
ggccgccuggguc

SEQ ID NO: 1263773 - RNA, 11 nt, Human
ggccucagggc

SEQ ID NO: 1263774 - RNA, 13 nt, Human
ggccucagggcuc

SEQ ID NO: 1263775 - RNA, 14 nt, Human
ggccucagggcucc

SEQ ID NO: 1263776 - RNA, 15 nt, Human
ggccucagggcuccu

SEQ ID NO: 1263777 - RNA, 18 nt, Human
ggccucagggcuccuugu

SEQ ID NO: 1263778 - RNA, 16 nt, Human
ggccucagggcuccuu

SEQ ID NO: 1263779 - RNA, 17 nt, Human
ggccucagggcuccuug

SEQ ID NO: 1263780 - RNA, 19 nt, Human
ggccugaugggguggaagg

SEQ ID NO: 1263781 - RNA, 14 nt, Human
ggccugcaaacugg

SEQ ID NO: 1263782 - RNA, 15 nt, Human
ggccugcaaacuggg

SEQ ID NO: 1263783 - RNA, 16 nt, Human
ggccugcaaacuggga

SEQ ID NO: 1263784 - RNA, 18 nt, Human
ggccugcaaacugggaac

SEQ ID NO: 1263785 - RNA, 14 nt, Human
ggccugccaccugg

SEQ ID NO: 1263786 - RNA, 17 nt, Human
ggccugccaccuggacc

SEQ ID NO: 1263787 - RNA, 18 nt, Human
ggccugccaccuggaccc

SEQ ID NO: 1263788 - RNA, 19 nt, Human
ggccugccaccuggacccc

SEQ ID NO: 1263789 - RNA, 23 nt, Human
ggccugccaccuggaccccugca

SEQ ID NO: 1263790 - RNA, 22 nt, Human
ggccugccaccuggaccccugc

SEQ ID NO: 1263791 - RNA, 12 nt, Human
ggccugccagga

SEQ ID NO: 1263792 - RNA, 13 nt, Human
ggccugccaggag

SEQ ID NO: 1263793 - RNA, 14 nt, Human
ggccugccaggagg

SEQ ID NO: 1263794 - RNA, 17 nt, Human
ggccugcccagugcacu

SEQ ID NO: 1263795 - RNA, 15 nt, Human
ggccugcccaguugc

SEQ ID NO: 1263796 - RNA, 13 nt, Human
ggccugcccccac

SEQ ID NO: 1263797 - RNA, 12 nt, Human
ggccugccccca

SEQ ID NO: 1263798 - RNA, 14 nt, Human
ggccuggcagccgu

SEQ ID NO: 1263799 - RNA, 15 nt, Human
ggccuggcagccgug

SEQ ID NO: 1263800 - RNA, 17 nt, Human
ggccuguuuggccucuc

SEQ ID NO: 1263801 - RNA, 18 nt, Human
ggccuguuuggccucucu

SEQ ID NO: 1263802 - RNA, 17 nt, Human
ggccuucagggagugag

SEQ ID NO: 1263803 - RNA, 12 nt, Human
ggccuucacaau

SEQ ID NO: 1263804 - RNA, 20 nt, Human
ggccuucacaaucugucagu

SEQ ID NO: 1263805 - RNA, 19 nt, Human
ggccuuacuuaaacccagc

SEQ ID NO: 1263806 - RNA, 15 nt, Human
ggccuuaggaagagc

SEQ ID NO: 1263807 - RNA, 17 nt, Human
ggccuuauugcauccca

SEQ ID NO: 1263808 - RNA, 11 nt, Human
ggccugccugu

SEQ ID NO: 1263809 - RNA, 15 nt, Human
ggccugcuaaggucu

SEQ ID NO: 1263810 - RNA, 13 nt, Human
ggccugcuccaga

SEQ ID NO: 1263811 - RNA, 14 nt, Human
ggccugcuccagac

SEQ ID NO: 1263812 - RNA, 15 nt, Human
ggccugcuccagacc

SEQ ID NO: 1263813 - RNA, 16 nt, Human
ggccugcuccagaccu

SEQ ID NO: 1263814 - RNA, 17 nt, Human
ggccugcuccagaccug

SEQ ID NO: 1263815 - RNA, 18 nt, Human
ggccugcuccagaccuga

SEQ ID NO: 1263816 - RNA, 10 nt, Human
ggccugcugc

SEQ ID NO: 1263817 - RNA, 11 nt, Human
ggccugcugcu

SEQ ID NO: 1263818 - RNA, 13 nt, Human
ggccugcugcuga

SEQ ID NO: 1263819 - RNA, 14 nt, Human
ggccugcugcugag

SEQ ID NO: 1263820 - RNA, 15 nt, Human
ggccugcugcugaga

SEQ ID NO: 1263821 - RNA, 16 nt, Human
ggccugcugcugagaa

SEQ ID NO: 1263822 - RNA, 18 nt, Human
ggccugcugcugagaacc

SEQ ID NO: 1263823 - RNA, 19 nt, Human
ggccugcugcugagaaccu

SEQ ID NO: 1263824 - RNA, 23 nt, Human
ggccugcugcugagaaccuggcc

SEQ ID NO: 1263825 - RNA, 20 nt, Human
ggccugcugcugagaaccug

SEQ ID NO: 1263826 - RNA, 22 nt, Human
ggccugcugcugagaaccuggc

SEQ ID NO: 1263827 - RNA, 20 nt, Human
ggccuggagauccuccugca

SEQ ID NO: 1263828 - RNA, 22 nt, Human
ggccuggagcacaaagacccug

SEQ ID NO: 1263829 - RNA, 17 nt, Human
ggcuagacuagucucaa

SEQ ID NO: 1263830 - RNA, 23 nt, Human
ggcuacuucggggcugggaaguc

SEQ ID NO: 1263831 - RNA, 18 nt, Human
ggcuacuucggggcuggg

SEQ ID NO: 1263832 - RNA, 19 nt, Human
ggcuacccugagcugaggc

SEQ ID NO: 1263833 - RNA, 13 nt, Human
ggcuacucugugc

SEQ ID NO: 1263834 - RNA, 15 nt, Human
ggcuacucugugcca

SEQ ID NO: 1263835 - RNA, 16 nt, Human
ggcuacucugugccag

SEQ ID NO: 1263836 - RNA, 18 nt, Human
ggcuacucugugccagag

SEQ ID NO: 1263837 - RNA, 19 nt, Human
ggcuacucugugccagagc

SEQ ID NO: 1263838 - RNA, 20 nt, Human
ggcuacucugugccagagcc

SEQ ID NO: 1263839 - RNA, 21 nt, Human
ggcuacucugugccagagccu

SEQ ID NO: 1263840 - RNA, 22 nt, Human
ggcuacucugugccagagccug

SEQ ID NO: 1263841 - RNA, 23 nt, Human
ggcuacucugugccagagccugg

SEQ ID NO: 1263842 - RNA, 24 nt, Human
ggcuacucugugccagagccuggg

SEQ ID NO: 1263843 - RNA, 14 nt, Human
ggcuaccaggaaag

SEQ ID NO: 1263844 - RNA, 18 nt, Human
ggcuacagagaagccuuc

SEQ ID NO: 1263845 - RNA, 19 nt, Human
ggcuacagagaagccuuca

SEQ ID NO: 1263846 - RNA, 14 nt, Human
ggcuacagagaagc

SEQ ID NO: 1263847 - RNA, 15 nt, Human
ggcuacagagaagcc

SEQ ID NO: 1263848 - RNA, 16 nt, Human
ggcuacagagaagccu

SEQ ID NO: 1263849 - RNA, 17 nt, Human
ggcuacagagaagccuu

SEQ ID NO: 1263850 - RNA, 22 nt, Human
ggcuacaccuuagccugcccuc

SEQ ID NO: 1263851 - RNA, 13 nt, Human
ggcuaauuuuugu

SEQ ID NO: 1263852 - RNA, 23 nt, Human
ggcuacaccuuagccugcccucc

SEQ ID NO: 1263853 - RNA, 11 nt, Human
ggcuacagaga

SEQ ID NO: 1263854 - RNA, 12 nt, Human
ggcuacagagaa

SEQ ID NO: 1263855 - RNA, 13 nt, Human
ggcuacagagaag

SEQ ID NO: 1263856 - RNA, 18 nt, Human
ggcuaauuuuuguuuugu

SEQ ID NO: 1263857 - RNA, 12 nt, Human
ggcuaauuuaac

SEQ ID NO: 1263858 - RNA, 13 nt, Human
ggcuaauuuaaca

SEQ ID NO: 1263859 - RNA, 23 nt, Human
ggcgugaucucagcucacugcaa

SEQ ID NO: 1263860 - RNA, 17 nt, Human
ggcgugagccaccucgc

SEQ ID NO: 1263861 - RNA, 17 nt, Human
ggcgugagaccugcccc

SEQ ID NO: 1263862 - RNA, 18 nt, Human
ggcgugagaccugccccu

SEQ ID NO: 1263863 - RNA, 14 nt, Human
ggcgugagaccugc

SEQ ID NO: 1263864 - RNA, 16 nt, Human
ggcgugagaccugccc

SEQ ID NO: 1263865 - RNA, 17 nt, Human
ggcgaugccagccaagc

SEQ ID NO: 1263866 - RNA, 18 nt, Human
ggcgaugccagccaagcu

SEQ ID NO: 1263867 - RNA, 20 nt, Human
ggcuaagcuucacuguaaaa

SEQ ID NO: 1263868 - RNA, 13 nt, Human
ggcguuuguaaug

SEQ ID NO: 1263869 - RNA, 15 nt, Human
ggcuaagacuuccua

SEQ ID NO: 1263870 - RNA, 22 nt, Human
ggccuucggccuccauccugag

SEQ ID NO: 1263871 - RNA, 18 nt, Human
ggccuucggccuccaucc

SEQ ID NO: 1263872 - RNA, 16 nt, Human
ggccuucggccuccau

SEQ ID NO: 1263873 - RNA, 22 nt, Human
ggccuucccuguuuucccccca

SEQ ID NO: 1263874 - RNA, 16 nt, Human
ggcucacucagcacuu

SEQ ID NO: 1263875 - RNA, 22 nt, Human
ggcucacucagcacuuggcccu

SEQ ID NO: 1263876 - RNA, 14 nt, Human
ggcucacucagcca

SEQ ID NO: 1263877 - RNA, 23 nt, Human
ggcucacugcaaccuccaccucc

SEQ ID NO: 1263878 - RNA, 17 nt, Human
ggcucccugacugggag

SEQ ID NO: 1263879 - RNA, 18 nt, Human
ggcucccugacugggagu

SEQ ID NO: 1263880 - RNA, 13 nt, Human
ggcucccuccgcc

SEQ ID NO: 1263881 - RNA, 20 nt, Human
ggcucccuguaaccucuuca

SEQ ID NO: 1263882 - RNA, 15 nt, Human
ggcucccggaauucc

SEQ ID NO: 1263883 - RNA, 17 nt, Human
ggcucccuccgccccca

SEQ ID NO: 1263884 - RNA, 21 nt, Human
ggcucccuguaaccucuucag

SEQ ID NO: 1263885 - RNA, 16 nt, Human
ggcucccuggggggag

SEQ ID NO: 1263886 - RNA, 14 nt, Human
ggcucggccugccc

SEQ ID NO: 1263887 - RNA, 18 nt, Human
ggcucggccugcccccac

SEQ ID NO: 1263888 - RNA, 15 nt, Human
ggcucggccugcccc

SEQ ID NO: 1263889 - RNA, 13 nt, Human
ggcucguggacug

SEQ ID NO: 1263890 - RNA, 19 nt, Human
ggcucguggacugaguggg

SEQ ID NO: 1263891 - RNA, 23 nt, Human
ggcucguggacugagugggaagc

SEQ ID NO: 1263892 - RNA, 18 nt, Human
ggcucguugacuggcugu

SEQ ID NO: 1263893 - RNA, 14 nt, Human
ggcucuaacgccug

SEQ ID NO: 1263894 - RNA, 15 nt, Human
ggcucuaacgccuga

SEQ ID NO: 1263895 - RNA, 16 nt, Human
ggcucuaacgccugag

SEQ ID NO: 1263896 - RNA, 17 nt, Human
ggcucuaacgccugagc

SEQ ID NO: 1263897 - RNA, 18 nt, Human
ggcucuaacgccugagcc

SEQ ID NO: 1263898 - RNA, 19 nt, Human
ggcucuaacgccugagccc

SEQ ID NO: 1263899 - RNA, 22 nt, Human
ggcucuaacgccugagcccagg

SEQ ID NO: 1263900 - RNA, 23 nt, Human
ggcucuaacgccugagcccaggg

SEQ ID NO: 1263901 - RNA, 17 nt, Human
ggcucuaauucacagug

SEQ ID NO: 1263902 - RNA, 19 nt, Human
ggcucuaauucacagugcu

SEQ ID NO: 1263903 - RNA, 19 nt, Human
ggcucuugauaccccccuc

SEQ ID NO: 1263904 - RNA, 20 nt, Human
ggcucuugauaccccccucu

SEQ ID NO: 1263905 - RNA, 21 nt, Human
ggcucuugauaccccccucug

SEQ ID NO: 1263906 - RNA, 12 nt, Human
ggcugcccuggu

SEQ ID NO: 1263907 - RNA, 10 nt, Human
ggcugcccuu

SEQ ID NO: 1263908 - RNA, 11 nt, Human
ggcugcccuuu

SEQ ID NO: 1263909 - RNA, 14 nt, Human
ggcugcccuuucug

SEQ ID NO: 1263910 - RNA, 18 nt, Human
ggcugcccuuucugggca

SEQ ID NO: 1263911 - RNA, 15 nt, Human
ggcugccggggcagc

SEQ ID NO: 1263912 - RNA, 16 nt, Human
ggcugccguggggccg

SEQ ID NO: 1263913 - RNA, 23 nt, Human
ggcugccguggggccgccgccuc

SEQ ID NO: 1263914 - RNA, 15 nt, Human
ggcugccguccccua

SEQ ID NO: 1263915 - RNA, 16 nt, Human
ggcuggccaguccagg

SEQ ID NO: 1263916 - RNA, 20 nt, Human
ggcuggccaguccaggcugc

SEQ ID NO: 1263917 - RNA, 21 nt, Human
ggcuggccaguccaggcugcc

SEQ ID NO: 1263918 - RNA, 13 nt, Human
ggcugaaagacag

SEQ ID NO: 1263919 - RNA, 15 nt, Human
ggcugaccaugcuca

SEQ ID NO: 1263920 - RNA, 15 nt, Human
ggcugccccucucac

SEQ ID NO: 1263921 - RNA, 13 nt, Human
ggcugcccuccug

SEQ ID NO: 1263922 - RNA, 14 nt, Human
ggcugcccuccugu

SEQ ID NO: 1263923 - RNA, 18 nt, Human
ggcugcccuccugugcuc

SEQ ID NO: 1263924 - RNA, 20 nt, Human
ggcugcccuccugugcucag

SEQ ID NO: 1263925 - RNA, 22 nt, Human
ggcugcccuccugugcucagcc

SEQ ID NO: 1263926 - RNA, 23 nt, Human
ggcugcccuccugugcucagccc

SEQ ID NO: 1263927 - RNA, 22 nt, Human
ggcuggccaguccaggcugccg

SEQ ID NO: 1263928 - RNA, 13 nt, Human
ggcuggccaugga

SEQ ID NO: 1263929 - RNA, 18 nt, Human
ggcuggccauggagaaag

SEQ ID NO: 1263930 - RNA, 19 nt, Human
ggcuggccauggagaaagc

SEQ ID NO: 1263931 - RNA, 23 nt, Human
ggcuggccucacccaccccugca

SEQ ID NO: 1263932 - RNA, 20 nt, Human
ggcuggccucccaaaugagc

SEQ ID NO: 1263933 - RNA, 18 nt, Human
aaaaaaacaguggaucac

SEQ ID NO: 1263934 - RNA, 19 nt, Human
aaaaaaaccugagauuuau

SEQ ID NO: 1263935 - RNA, 14 nt, Human
aaaaaaagaucugu

SEQ ID NO: 1263936 - RNA, 10 nt, Human
aaaaaacuac

SEQ ID NO: 1263937 - RNA, 13 nt, Human
aaaaaaauguauu

SEQ ID NO: 1263938 - RNA, 19 nt, Human
aaaaaaauugaaauguaag

SEQ ID NO: 1263939 - RNA, 12 nt, Human
aaaaaaagauga

SEQ ID NO: 1263940 - RNA, 14 nt, Human
aaaaauaaaaaaca

SEQ ID NO: 1263941 - RNA, 13 nt, Human
aaaaaguuuguuu

SEQ ID NO: 1263942 - RNA, 16 nt, Human
aaaaaguuuuaguuuu

SEQ ID NO: 1263943 - RNA, 23 nt, Human
aaaaagccaguuuggguaaaaua

SEQ ID NO: 1263944 - RNA, 13 nt, Human
aaaaaggcaguua

SEQ ID NO: 1263945 - RNA, 17 nt, Human
aaaaagccaguuugggu

SEQ ID NO: 1263946 - RNA, 17 nt, Human
aaaaagcccaccauuug

SEQ ID NO: 1263947 - RNA, 16 nt, Human
ggcugguaucucagaa

SEQ ID NO: 1263948 - RNA, 18 nt, Human
ggcugguaucucagaaag

SEQ ID NO: 1263949 - RNA, 13 nt, Human
aaaaauacaaaaa

SEQ ID NO: 1263950 - RNA, 12 nt, Human
aaaaauaaagaa

SEQ ID NO: 1263951 - RNA, 18 nt, Human
aaaaauaaucaaaagcua

SEQ ID NO: 1263952 - RNA, 17 nt, Human
aaaaauaauuuuuauau

SEQ ID NO: 1263953 - RNA, 14 nt, Human
aaaaauacucagau

SEQ ID NO: 1263954 - RNA, 13 nt, Human
aaaaauacucaga

SEQ ID NO: 1263955 - RNA, 15 nt, Human
ggaggcucuggagcc

SEQ ID NO: 1263956 - RNA, 15 nt, Human
ggaggcucagguccc

SEQ ID NO: 1263957 - RNA, 15 nt, Human
ggaggcuccagaggg

SEQ ID NO: 1263958 - RNA, 16 nt, Human
ggaggcuccagagggc

SEQ ID NO: 1263959 - RNA, 18 nt, Human
ggaggcuccagagggcac

SEQ ID NO: 1263960 - RNA, 20 nt, Human
ggaggcggauguugaaguga

SEQ ID NO: 1263961 - RNA, 16 nt, Human
ggaggcggugggccug

SEQ ID NO: 1263962 - RNA, 21 nt, Human
ggaggcucacccccuucucca

SEQ ID NO: 1263963 - RNA, 15 nt, Human
ggaggggggagggaa

SEQ ID NO: 1263964 - RNA, 16 nt, Human
ggaggggggagggaag

SEQ ID NO: 1263965 - RNA, 14 nt, Human
ggagggggagaggg

SEQ ID NO: 1263966 - RNA, 14 nt, Human
ggagggggauccga

SEQ ID NO: 1263967 - RNA, 11 nt, Human
ggaggcugcuc

SEQ ID NO: 1263968 - RNA, 12 nt, Human
ggaggcugcucg

SEQ ID NO: 1263969 - RNA, 14 nt, Human
ggaggcugcucggg

SEQ ID NO: 1263970 - RNA, 22 nt, Human
ggaggcugcucggggugcacag

SEQ ID NO: 1263971 - RNA, 23 nt, Human
ggaggcugcucggggugcacagg

SEQ ID NO: 1263972 - RNA, 18 nt, Human
ggaggcugcugcugcucu

SEQ ID NO: 1263973 - RNA, 13 nt, Human
ggaggcugguccu

SEQ ID NO: 1263974 - RNA, 16 nt, Human
ggagggaagcucuugg

SEQ ID NO: 1263975 - RNA, 15 nt, Human
ggagggaagggagcc

SEQ ID NO: 1263976 - RNA, 16 nt, Human
ggagggaagggagcca

SEQ ID NO: 1263977 - RNA, 13 nt, Human
ggagggugggaag

SEQ ID NO: 1263978 - RNA, 14 nt, Human
ggagggugggaagg

SEQ ID NO: 1263979 - RNA, 20 nt, Human
ggaggguuucauugucugug

SEQ ID NO: 1263980 - RNA, 21 nt, Human
ggaggguuucauugucuguga

SEQ ID NO: 1263981 - RNA, 19 nt, Human
ggaggugggccguggcccu

SEQ ID NO: 1263982 - RNA, 15 nt, Human
ggaggugggccgugg

SEQ ID NO: 1263983 - RNA, 16 nt, Human
ggagugugcguggugg

SEQ ID NO: 1263984 - RNA, 24 nt, Human
ggaguguccucuucccucucugca

SEQ ID NO: 1263985 - RNA, 23 nt, Human
ggagugggguggugucagacccu

SEQ ID NO: 1263986 - RNA, 14 nt, Human
ggagugggugggga

SEQ ID NO: 1263987 - RNA, 15 nt, Human
ggaguggguggggag

SEQ ID NO: 1263988 - RNA, 20 nt, Human
ggagugguuuaggcuauuug

SEQ ID NO: 1263989 - RNA, 20 nt, Human
ggaguguaugacugcacaug

SEQ ID NO: 1263990 - RNA, 13 nt, Human
ggaguguccucuu

SEQ ID NO: 1263991 - RNA, 20 nt, Human
ggaguguccucuucccucuc

SEQ ID NO: 1263992 - RNA, 17 nt, Human
ggagugugugugagugu

SEQ ID NO: 1263993 - RNA, 12 nt, Human
ggaguguucccc

SEQ ID NO: 1263994 - RNA, 20 nt, Human
ggaguguuccccuuccacug

SEQ ID NO: 1263995 - RNA, 15 nt, Human
ggaguuaagaccugg

SEQ ID NO: 1263996 - RNA, 16 nt, Human
ggaguuaagaccuggc

SEQ ID NO: 1263997 - RNA, 18 nt, Human
ggaguuaagaccuggcag

SEQ ID NO: 1263998 - RNA, 23 nt, Human
ggaguuaagaccuggcagcucug

SEQ ID NO: 1263999 - RNA, 22 nt, Human
ggaguuagggacugaccagcag

SEQ ID NO: 1264000 - RNA, 13 nt, Human
ggaguuagggacu

SEQ ID NO: 1264001 - RNA, 19 nt, Human
ggaguuagggacugaccag

SEQ ID NO: 1264002 - RNA, 14 nt, Human
ggauuguaguccca

SEQ ID NO: 1264003 - RNA, 21 nt, Human
ggaugggguauggauucuaaa

SEQ ID NO: 1264004 - RNA, 16 nt, Human
ggaugguaguuuuuuc

SEQ ID NO: 1264005 - RNA, 20 nt, Human
ggaugguaguuuuuucaucu

SEQ ID NO: 1264006 - RNA, 21 nt, Human
ggauggucuuacagcaggcag

SEQ ID NO: 1264007 - RNA, 12 nt, Human
ggauggugucuc

SEQ ID NO: 1264008 - RNA, 15 nt, Human
ggaugggggaacuca

SEQ ID NO: 1264009 - RNA, 17 nt, Human
ggaugggggaacucaga

SEQ ID NO: 1264010 - RNA, 21 nt, Human
ggaugggggaacucagaucca

SEQ ID NO: 1264011 - RNA, 22 nt, Human
ggaugggggaacucagauccag

SEQ ID NO: 1264012 - RNA, 23 nt, Human
ggaugggggaacucagauccagg

SEQ ID NO: 1264013 - RNA, 16 nt, Human
ggauuuaaaagccugc

SEQ ID NO: 1264014 - RNA, 17 nt, Human
ggauuuaaaagccugcu

SEQ ID NO: 1264015 - RNA, 18 nt, Human
ggauuuaaaagccugcuc

SEQ ID NO: 1264016 - RNA, 19 nt, Human
ggauuuaaaagccugcuca

SEQ ID NO: 1264017 - RNA, 19 nt, Human
ggauggucuuacagcaggc

SEQ ID NO: 1264018 - RNA, 21 nt, Human
ggaucucccugagaugggcuu

SEQ ID NO: 1264019 - RNA, 22 nt, Human
ggaucucuucuuaauguacaua

SEQ ID NO: 1264020 - RNA, 21 nt, Human
ggaucucuucuuaauguacau

SEQ ID NO: 1264021 - RNA, 16 nt, Human
ggauccuguguggaga

SEQ ID NO: 1264022 - RNA, 14 nt, Human
ggaucuauuucaug

SEQ ID NO: 1264023 - RNA, 21 nt, Human
ggaucuauuucauguuuuuga

SEQ ID NO: 1264024 - RNA, 15 nt, Human
ggaucucaccaggca

SEQ ID NO: 1264025 - RNA, 16 nt, Human
ggaucucaccaggcag

SEQ ID NO: 1264026 - RNA, 17 nt, Human
ggaucucaccaggcagc

SEQ ID NO: 1264027 - RNA, 22 nt, Human
ggaucucaccaggcagccucug

SEQ ID NO: 1264028 - RNA, 17 nt, Human
ggaucucauuggacccu

SEQ ID NO: 1264029 - RNA, 24 nt, Human
ggaucucauuggacccuuccaugg

SEQ ID NO: 1264030 - RNA, 23 nt, Human
ggcaucaucucagcucacugcaa

SEQ ID NO: 1264031 - RNA, 17 nt, Human
ggcaucaucucagcuca

SEQ ID NO: 1264032 - RNA, 20 nt, Human
ggcaucaguguccuuggcag

SEQ ID NO: 1264033 - RNA, 16 nt, Human
ggcauccagagucccu

SEQ ID NO: 1264034 - RNA, 18 nt, Human
ggcauccagagucccugc

SEQ ID NO: 1264035 - RNA, 22 nt, Human
ggcaucggggagccgggagccu

SEQ ID NO: 1264036 - RNA, 18 nt, Human
ggcaucgcaccauucuga

SEQ ID NO: 1264037 - RNA, 21 nt, Human
ggcaucgcaccauucugacuc

SEQ ID NO: 1264038 - RNA, 20 nt, Human
ggcaucgcaauguaagacuc

SEQ ID NO: 1264039 - RNA, 12 nt, Human
ggcauuuccugg

SEQ ID NO: 1264040 - RNA, 15 nt, Human
ggcauuuccugggug

SEQ ID NO: 1264041 - RNA, 18 nt, Human
ggcauuuccuggguggcu

SEQ ID NO: 1264042 - RNA, 16 nt, Human
ggcauuuccugggugg

SEQ ID NO: 1264043 - RNA, 20 nt, Human
ggcauuugcaggguccucuu

SEQ ID NO: 1264044 - RNA, 21 nt, Human
ggcauuugcaggguccucuuc

SEQ ID NO: 1264045 - RNA, 23 nt, Human
ggcaucggggagccgggagccug

SEQ ID NO: 1264046 - RNA, 16 nt, Human
ggccagaccauggaca

SEQ ID NO: 1264047 - RNA, 15 nt, Human
ggccaagcugaggug

SEQ ID NO: 1264048 - RNA, 20 nt, Human
ggccaagcugaggugcccag

SEQ ID NO: 1264049 - RNA, 22 nt, Human
ggccaagcugaggugcccagga

SEQ ID NO: 1264050 - RNA, 23 nt, Human
ggccaagcugaggugcccaggag

SEQ ID NO: 1264051 - RNA, 15 nt, Human
ggccaaggaccugag

SEQ ID NO: 1264052 - RNA, 19 nt, Human
ggccaaggaccugagaccu

SEQ ID NO: 1264053 - RNA, 16 nt, Human
ggccaaggaccugaga

SEQ ID NO: 1264054 - RNA, 21 nt, Human
ggccagaggcccccagcccag

SEQ ID NO: 1264055 - RNA, 18 nt, Human
ggcauuuuacuguacaga

SEQ ID NO: 1264056 - RNA, 17 nt, Human
ggcauuuguuucuuucu

SEQ ID NO: 1264057 - RNA, 23 nt, Human
ggcauuuguuucuuucucugagg

SEQ ID NO: 1264058 - RNA, 22 nt, Human
ggccaagagaugcagugccagg

SEQ ID NO: 1264059 - RNA, 19 nt, Human
ggccaagagaaacuuccua

SEQ ID NO: 1264060 - RNA, 15 nt, Human
ggccaagaagcagug

SEQ ID NO: 1264061 - RNA, 13 nt, Human
ggcaggggcuucc

SEQ ID NO: 1264062 - RNA, 14 nt, Human
ggcaggggcuuccu

SEQ ID NO: 1264063 - RNA, 15 nt, Human
ggcaggggcuuccug

SEQ ID NO: 1264064 - RNA, 12 nt, Human
ggcagggggcug

SEQ ID NO: 1264065 - RNA, 13 nt, Human
ggcagggggcugc

SEQ ID NO: 1264066 - RNA, 14 nt, Human
ggcagggggcugcu

SEQ ID NO: 1264067 - RNA, 15 nt, Human
ggcagggggcugcug

SEQ ID NO: 1264068 - RNA, 16 nt, Human
ggcagggggcugcugc

SEQ ID NO: 1264069 - RNA, 17 nt, Human
ggcagggggcugcugcu

SEQ ID NO: 1264070 - RNA, 18 nt, Human
ggcagggggcugcugcug

SEQ ID NO: 1264071 - RNA, 22 nt, Human
ggcagggggcugcugcugggcu

SEQ ID NO: 1264072 - RNA, 14 nt, Human
ggauuuauuuaaaa

SEQ ID NO: 1264073 - RNA, 19 nt, Human
ggauuuauuuaaaauagca

SEQ ID NO: 1264074 - RNA, 14 nt, Human
ggauuuauuuuucc

SEQ ID NO: 1264075 - RNA, 20 nt, Human
ggauuucaugauuucauuuc

SEQ ID NO: 1264076 - RNA, 23 nt, Human
ggauuuccugcuuugggaagccg

SEQ ID NO: 1264077 - RNA, 11 nt, Human
ggcaaaagcuu

SEQ ID NO: 1264078 - RNA, 12 nt, Human
ggauuuuuacca

SEQ ID NO: 1264079 - RNA, 23 nt, Human
ggauuuuuguuuuguuuuuacaa

SEQ ID NO: 1264080 - RNA, 12 nt, Human
ggauuuuuucca

SEQ ID NO: 1264081 - RNA, 12 nt, Human
ggcaaaacucua

SEQ ID NO: 1264082 - RNA, 13 nt, Human
ggcaccagacacc

SEQ ID NO: 1264083 - RNA, 14 nt, Human
ggcacugcuaggcu

SEQ ID NO: 1264084 - RNA, 14 nt, Human
ggcacacagcuacu

SEQ ID NO: 1264085 - RNA, 14 nt, Human
ggcagccccaggcc

SEQ ID NO: 1264086 - RNA, 16 nt, Human
ggcagccucuucaaaa

SEQ ID NO: 1264087 - RNA, 18 nt, Human
ggcagccccaggccaaag

SEQ ID NO: 1264088 - RNA, 16 nt, Human
ggcagccucugggggg

SEQ ID NO: 1264089 - RNA, 19 nt, Human
ggcagccucuggggggugg

SEQ ID NO: 1264090 - RNA, 20 nt, Human
ggcagccucugggggguggc

SEQ ID NO: 1264091 - RNA, 23 nt, Human
ggcagccucugggggguggccag

SEQ ID NO: 1264092 - RNA, 15 nt, Human
ggcagcccagccagc

SEQ ID NO: 1264093 - RNA, 16 nt, Human
ggcagcccagccagcg

SEQ ID NO: 1264094 - RNA, 18 nt, Human
ggcagcccagccagcguc

SEQ ID NO: 1264095 - RNA, 22 nt, Human
ggcagcagugugaggccagggc

SEQ ID NO: 1264096 - RNA, 17 nt, Human
ggcagcauccccuugaa

SEQ ID NO: 1264097 - RNA, 20 nt, Human
ggcagccacacuucucagga

SEQ ID NO: 1264098 - RNA, 21 nt, Human
ggcagccacacuucucaggac

SEQ ID NO: 1264099 - RNA, 11 nt, Human
ggcagccagac

SEQ ID NO: 1264100 - RNA, 13 nt, Human
ggcagccagacca

SEQ ID NO: 1264101 - RNA, 14 nt, Human
ggcagccagaccag

SEQ ID NO: 1264102 - RNA, 15 nt, Human
ggcagccagaccagc

SEQ ID NO: 1264103 - RNA, 16 nt, Human
ggcagccagcaucugg

SEQ ID NO: 1264104 - RNA, 19 nt, Human
ggcagccagcaucugggcc

SEQ ID NO: 1264105 - RNA, 21 nt, Human
ggcagccagggagagcccagg

SEQ ID NO: 1264106 - RNA, 20 nt, Human
ggcagccagcaucugggccu

SEQ ID NO: 1264107 - RNA, 15 nt, Human
ggcagccagugcccu

SEQ ID NO: 1264108 - RNA, 17 nt, Human
ggcagccagugcccuga

SEQ ID NO: 1264109 - RNA, 19 nt, Human
ggcagccagugcccugagc

SEQ ID NO: 1264110 - RNA, 20 nt, Human
ggcagccagugcccugagcc

SEQ ID NO: 1264111 - RNA, 22 nt, Human
ggcagccagugcccugagccag

SEQ ID NO: 1264112 - RNA, 23 nt, Human
ggcagccagugcccugagccagg

SEQ ID NO: 1264113 - RNA, 11 nt, Human
ggcagcccagc

SEQ ID NO: 1264114 - RNA, 12 nt, Human
ggcagcccagcc

SEQ ID NO: 1264115 - RNA, 13 nt, Human
ggcagcccagcca

SEQ ID NO: 1264116 - RNA, 14 nt, Human
ggcagcccagccag

SEQ ID NO: 1264117 - RNA, 14 nt, Human
ggcagccuugugau

SEQ ID NO: 1264118 - RNA, 14 nt, Human
ggcaggagggaggu

SEQ ID NO: 1264119 - RNA, 14 nt, Human
ggcagcgccaggcu

SEQ ID NO: 1264120 - RNA, 21 nt, Human
ggcagcgccaggcugaccaca

SEQ ID NO: 1264121 - RNA, 14 nt, Human
ggcaggaguagcug

SEQ ID NO: 1264122 - RNA, 17 nt, Human
ggcaggaguagcugagc

SEQ ID NO: 1264123 - RNA, 18 nt, Human
ggcaggaguagcugagcu

SEQ ID NO: 1264124 - RNA, 19 nt, Human
ggcaggaguagcugagcuc

SEQ ID NO: 1264125 - RNA, 15 nt, Human
ggcaggauuggggaa

SEQ ID NO: 1264126 - RNA, 22 nt, Human
ggcaggauuggggaagagagcc

SEQ ID NO: 1264127 - RNA, 17 nt, Human
ggcaggauuggggaaga

SEQ ID NO: 1264128 - RNA, 14 nt, Human
ggcaggcugggcca

SEQ ID NO: 1264129 - RNA, 15 nt, Human
ggcaggcugggccau

SEQ ID NO: 1264130 - RNA, 16 nt, Human
ggcaggcugggccaug

SEQ ID NO: 1264131 - RNA, 22 nt, Human
ggcaggcugggccauguccaaa

SEQ ID NO: 1264132 - RNA, 17 nt, Human
ggcagggaacaugggga

SEQ ID NO: 1264133 - RNA, 18 nt, Human
ggcagggaacauggggag

SEQ ID NO: 1264134 - RNA, 20 nt, Human
ggcagggaacauggggagga

SEQ ID NO: 1264135 - RNA, 14 nt, Human
ggcagggaccacac

SEQ ID NO: 1264136 - RNA, 12 nt, Human
ggcaggggccgg

SEQ ID NO: 1264137 - RNA, 21 nt, Human
ggcaggggccuccaugggccc

SEQ ID NO: 1264138 - RNA, 14 nt, Human
ggcaggggccugga

SEQ ID NO: 1264139 - RNA, 16 nt, Human
ggcaggggccuggaga

SEQ ID NO: 1264140 - RNA, 17 nt, Human
ggcaggggccuggagau

SEQ ID NO: 1264141 - RNA, 16 nt, Human
ggcagggccccaggca

SEQ ID NO: 1264142 - RNA, 10 nt, Human
ggcagggagg

SEQ ID NO: 1264143 - RNA, 22 nt, Human
ggcagggagcggccggccagcc

SEQ ID NO: 1264144 - RNA, 17 nt, Human
ggcagggagggccuggg

SEQ ID NO: 1264145 - RNA, 18 nt, Human
ggcagggagggccugggc

SEQ ID NO: 1264146 - RNA, 19 nt, Human
ggcagggagggccugggcc

SEQ ID NO: 1264147 - RNA, 20 nt, Human
ggcagggagggccugggccc

SEQ ID NO: 1264148 - RNA, 17 nt, Human
gguuuucacauuggaaa

SEQ ID NO: 1264149 - RNA, 17 nt, Human
gguuuuaauuuaguaaa

SEQ ID NO: 1264150 - RNA, 15 nt, Human
gguuuuagguucuaa

SEQ ID NO: 1264151 - RNA, 16 nt, Human
gguuuuagguucuaaa

SEQ ID NO: 1264152 - RNA, 17 nt, Human
gguuuuauaaggcugau

SEQ ID NO: 1264153 - RNA, 15 nt, Human
gguuugguguauggu

SEQ ID NO: 1264154 - RNA, 22 nt, Human
gguuugguuugcagcgacuggc

SEQ ID NO: 1264155 - RNA, 14 nt, Human
gguuuuaacuuugu

SEQ ID NO: 1264156 - RNA, 15 nt, Human
gguuuuaacuuuguu

SEQ ID NO: 1264157 - RNA, 21 nt, Human
gguuuuaauuuaguaaaccaa

SEQ ID NO: 1264158 - RNA, 16 nt, Human
gguuuccugcccuggg

SEQ ID NO: 1264159 - RNA, 19 nt, Human
gguuuccugcccugggagg

SEQ ID NO: 1264160 - RNA, 19 nt, Human
gguuucccuacugaagccc

SEQ ID NO: 1264161 - RNA, 21 nt, Human
gguuucuaagcauaaaagaug

SEQ ID NO: 1264162 - RNA, 12 nt, Human
gguuuccugccc

SEQ ID NO: 1264163 - RNA, 13 nt, Human
gguuuccugcccu

SEQ ID NO: 1264164 - RNA, 15 nt, Human
gguuuccugcccugg

SEQ ID NO: 1264165 - RNA, 22 nt, Human
gguucucaauuccaacaguuua

SEQ ID NO: 1264166 - RNA, 21 nt, Human
gguucucaauuccaacaguuu

SEQ ID NO: 1264167 - RNA, 13 nt, Human
gguuucagcacua

SEQ ID NO: 1264168 - RNA, 19 nt, Human
gguuucagcacuagccaaa

SEQ ID NO: 1264169 - RNA, 17 nt, Human
gguuucagcacuagcca

SEQ ID NO: 1264170 - RNA, 16 nt, Human
gguuucauguuaguua

SEQ ID NO: 1264171 - RNA, 17 nt, Human
aaaguauguuagugcaa

SEQ ID NO: 1264172 - RNA, 17 nt, Human
aaagugggcuugauucu

SEQ ID NO: 1264173 - RNA, 22 nt, Human
aaaguggguuuuuuaguugaau

SEQ ID NO: 1264174 - RNA, 16 nt, Human
aaaguauguauuauuu

SEQ ID NO: 1264175 - RNA, 17 nt, Human
aaaguauguauuauuua

SEQ ID NO: 1264176 - RNA, 19 nt, Human
aaaguauguauuauuuaca

SEQ ID NO: 1264177 - RNA, 17 nt, Human
aaaguggguuuuuuagu

SEQ ID NO: 1264178 - RNA, 19 nt, Human
aaaguacaaccauagagga

SEQ ID NO: 1264179 - RNA, 15 nt, Human
aaaguacacucugcu

SEQ ID NO: 1264180 - RNA, 17 nt, Human
aaaguacacucugcugu

SEQ ID NO: 1264181 - RNA, 14 nt, Human
aaaguacuuguagu

SEQ ID NO: 1264182 - RNA, 15 nt, Human
aaaguacuuguaguu

SEQ ID NO: 1264183 - RNA, 16 nt, Human
aaaguacuuguaguuc

SEQ ID NO: 1264184 - RNA, 22 nt, Human
gguggggggggggcgcggcugg

SEQ ID NO: 1264185 - RNA, 21 nt, Human
gguggggagagacgggcccug

SEQ ID NO: 1264186 - RNA, 16 nt, Human
gguguggagccgaggc

SEQ ID NO: 1264187 - RNA, 12 nt, Human
gguguggcuccu

SEQ ID NO: 1264188 - RNA, 14 nt, Human
ggugugguacagag

SEQ ID NO: 1264189 - RNA, 15 nt, Human
ggugugguacagaga

SEQ ID NO: 1264190 - RNA, 16 nt, Human
ggugugguacagagaa

SEQ ID NO: 1264191 - RNA, 17 nt, Human
ggugugguacagagaag

SEQ ID NO: 1264192 - RNA, 19 nt, Human
ggugugguacagagaagcc

SEQ ID NO: 1264193 - RNA, 20 nt, Human
ggugugguacagagaagcca

SEQ ID NO: 1264194 - RNA, 23 nt, Human
ggugugguacagagaagccagcu

SEQ ID NO: 1264195 - RNA, 21 nt, Human
ggugugguacagagaagccag

SEQ ID NO: 1264196 - RNA, 23 nt, Human
ggugugucccccucuguccaggc

SEQ ID NO: 1264197 - RNA, 12 nt, Human
ggugugucugcu

SEQ ID NO: 1264198 - RNA, 13 nt, Human
gguguuaacagaa

SEQ ID NO: 1264199 - RNA, 15 nt, Human
gguguuaacagaagg

SEQ ID NO: 1264200 - RNA, 14 nt, Human
gguguuaauuuuug

SEQ ID NO: 1264201 - RNA, 21 nt, Human
gguguuaucaccgugggcucc

SEQ ID NO: 1264202 - RNA, 22 nt, Human
gguguuauuuggaaccuuguuu

SEQ ID NO: 1264203 - RNA, 12 nt, Human
gguguuauuugg

SEQ ID NO: 1264204 - RNA, 11 nt, Human
gguguucuaag

SEQ ID NO: 1264205 - RNA, 21 nt, Human
gguguugccaaauauguccug

SEQ ID NO: 1264206 - RNA, 22 nt, Human
gguguugccaaauauguccugg

SEQ ID NO: 1264207 - RNA, 13 nt, Human
gguguucuaagau

SEQ ID NO: 1264208 - RNA, 17 nt, Human
gguguugccaguugucc

SEQ ID NO: 1264209 - RNA, 13 nt, Human
gguucccaagcuc

SEQ ID NO: 1264210 - RNA, 16 nt, Human
gguucccaagcucaga

SEQ ID NO: 1264211 - RNA, 15 nt, Human
gguuccgcuuggagc

SEQ ID NO: 1264212 - RNA, 21 nt, Human
gguuccgcuuggagcagaggg

SEQ ID NO: 1264213 - RNA, 22 nt, Human
gguuccgcuuggagcagagggg

SEQ ID NO: 1264214 - RNA, 23 nt, Human
gguuccgcuuggagcagaggggc

SEQ ID NO: 1264215 - RNA, 16 nt, Human
gguuccggcauggaca

SEQ ID NO: 1264216 - RNA, 15 nt, Human
gguuccuuuuauuag

SEQ ID NO: 1264217 - RNA, 14 nt, Human
gguucuaaaaggug

SEQ ID NO: 1264218 - RNA, 11 nt, Human
gguucuaaagu

SEQ ID NO: 1264219 - RNA, 12 nt, Human
gguucuaaaguu

SEQ ID NO: 1264220 - RNA, 13 nt, Human
gguucuaaaguuc

SEQ ID NO: 1264221 - RNA, 14 nt, Human
gguucuaaaguucu

SEQ ID NO: 1264222 - RNA, 15 nt, Human
gguucuaaaguucua

SEQ ID NO: 1264223 - RNA, 17 nt, Human
gguucuaaaguucuaag

SEQ ID NO: 1264224 - RNA, 22 nt, Human
gguucuaaaguucuaagauucu

SEQ ID NO: 1264225 - RNA, 11 nt, Human
gguucuaaggc

SEQ ID NO: 1264226 - RNA, 12 nt, Human
gguucuaaggcc

SEQ ID NO: 1264227 - RNA, 23 nt, Human
gguucuaaggccuaggauucuaa

SEQ ID NO: 1264228 - RNA, 15 nt, Human
gguucuagguuucaa

SEQ ID NO: 1264229 - RNA, 21 nt, Human
aaaguaaaaacaaagaaauua

SEQ ID NO: 1264230 - RNA, 12 nt, Human
aaagguuuuuuu

SEQ ID NO: 1264231 - RNA, 18 nt, Human
aaagguuuuuuuucaguu

SEQ ID NO: 1264232 - RNA, 22 nt, Human
aaagguuuaaaugaacaagaga

SEQ ID NO: 1264233 - RNA, 20 nt, Human
aaagguuuaagaaauagaau

SEQ ID NO: 1264234 - RNA, 15 nt, Human
aaagguuuacagaau

SEQ ID NO: 1264235 - RNA, 16 nt, Human
aaagguuuacagaauu

SEQ ID NO: 1264236 - RNA, 16 nt, Human
aaagguuuaugaaaaa

SEQ ID NO: 1264237 - RNA, 18 nt, Human
aaagguuuaugaaaaaga

SEQ ID NO: 1264238 - RNA, 22 nt, Human
aaagguuuaugaaaaagaagaa

SEQ ID NO: 1264239 - RNA, 21 nt, Human
aaagguuuggaaggagcagaa

SEQ ID NO: 1264240 - RNA, 19 nt, Human
aaagguuuaugaaaaagaa

SEQ ID NO: 1264241 - RNA, 14 nt, Human
aaagguuuuccucu

SEQ ID NO: 1264242 - RNA, 23 nt, Human
gguggcuuuugcgguucaggaaa

SEQ ID NO: 1264243 - RNA, 14 nt, Human
gguggcuuuugcgg

SEQ ID NO: 1264244 - RNA, 16 nt, Human
ggugggcugguaucuc

SEQ ID NO: 1264245 - RNA, 12 nt, Human
ggugggccuggu

SEQ ID NO: 1264246 - RNA, 18 nt, Human
aaagguucaugcaaacuu

SEQ ID NO: 1264247 - RNA, 19 nt, Human
aaaggugugagacugggaa

SEQ ID NO: 1264248 - RNA, 17 nt, Human
aaaggugugagacuggg

SEQ ID NO: 1264249 - RNA, 19 nt, Human
aaagguuagagaauaaauu

SEQ ID NO: 1264250 - RNA, 13 nt, Human
aaagguucuaggu

SEQ ID NO: 1264251 - RNA, 20 nt, Human
aaagguucuagguuucaaag

SEQ ID NO: 1264252 - RNA, 21 nt, Human
aaagguucuagguuucaaaga

SEQ ID NO: 1264253 - RNA, 13 nt, Human
aaagguuuaaaug

SEQ ID NO: 1264254 - RNA, 14 nt, Human
aaagguuuaaauga

SEQ ID NO: 1264255 - RNA, 16 nt, Human
aaagguuuaaaugaac

SEQ ID NO: 1264256 - RNA, 18 nt, Human
aaagguuuaaaugaacaa

SEQ ID NO: 1264257 - RNA, 20 nt, Human
aaagguuuaaaugaacaaga

SEQ ID NO: 1264258 - RNA, 21 nt, Human
aaagguuuaaaugaacaagag

SEQ ID NO: 1264259 - RNA, 23 nt, Human
aaaggggucggcugaccaugcuc

SEQ ID NO: 1264260 - RNA, 24 nt, Human
aaaggggucggcugaccaugcuca

SEQ ID NO: 1264261 - RNA, 23 nt, Human
aaaggugacaucggaaaaauaau

SEQ ID NO: 1264262 - RNA, 20 nt, Human
aaagggcuguuauaaucuuu

SEQ ID NO: 1264263 - RNA, 22 nt, Human
aaagggcuguuauaaucuuuca

SEQ ID NO: 1264264 - RNA, 17 nt, Human
aaagggcccuccuuccu

SEQ ID NO: 1264265 - RNA, 11 nt, Human
aaaggggagac

SEQ ID NO: 1264266 - RNA, 14 nt, Human
aaagggggauuccc

SEQ ID NO: 1264267 - RNA, 16 nt, Human
aaagcuuaaaacuuug

SEQ ID NO: 1264268 - RNA, 19 nt, Human
aaagggcccuccuuccuaa

SEQ ID NO: 1264269 - RNA, 14 nt, Human
aaagcuuaaaacuu

SEQ ID NO: 1264270 - RNA, 15 nt, Human
aaagcuuaaaacuuu

SEQ ID NO: 1264271 - RNA, 19 nt, Human
aaagcuuaaaacuuugaag

SEQ ID NO: 1264272 - RNA, 13 nt, Human
gguggcagcaaca

SEQ ID NO: 1264273 - RNA, 14 nt, Human
gguggcagcaacaa

SEQ ID NO: 1264274 - RNA, 14 nt, Human
aaagcagagauuuu

SEQ ID NO: 1264275 - RNA, 15 nt, Human
aaagcagagauuuuc

SEQ ID NO: 1264276 - RNA, 16 nt, Human
aaagcagagauuuuca

SEQ ID NO: 1264277 - RNA, 14 nt, Human
aaagcagaggccaa

SEQ ID NO: 1264278 - RNA, 16 nt, Human
aaagcagaacagugau

SEQ ID NO: 1264279 - RNA, 15 nt, Human
gguggacucgccugu

SEQ ID NO: 1264280 - RNA, 19 nt, Human
aaacuuuaugcuaagugaa

SEQ ID NO: 1264281 - RNA, 12 nt, Human
aaacuuuaugcu

SEQ ID NO: 1264282 - RNA, 17 nt, Human
ggugcugccucuaccug

SEQ ID NO: 1264283 - RNA, 23 nt, Human
ggugcuggagguuggaucuugau

SEQ ID NO: 1264284 - RNA, 12 nt, Human
ggugcugggaga

SEQ ID NO: 1264285 - RNA, 18 nt, Human
ggugcugggagaggcagc

SEQ ID NO: 1264286 - RNA, 19 nt, Human
ggugcugggagaggcagcc

SEQ ID NO: 1264287 - RNA, 14 nt, Human
aaagcuguguggca

SEQ ID NO: 1264288 - RNA, 18 nt, Human
aaagcuguguguuuggaa

SEQ ID NO: 1264289 - RNA, 14 nt, Human
aaagcugauuuuuu

SEQ ID NO: 1264290 - RNA, 18 nt, Human
aaagcugguuuaauguuu

SEQ ID NO: 1264291 - RNA, 15 nt, Human
aaagcaguauuuuuc

SEQ ID NO: 1264292 - RNA, 16 nt, Human
aaagcaguauuuuucu

SEQ ID NO: 1264293 - RNA, 13 nt, Human
aaagcuagaauug

SEQ ID NO: 1264294 - RNA, 14 nt, Human
aaagcuagaauuga

SEQ ID NO: 1264295 - RNA, 20 nt, Human
aaagcuagaauugaguguuu

SEQ ID NO: 1264296 - RNA, 18 nt, Human
aaagcugacuuggcuggu

SEQ ID NO: 1264297 - RNA, 17 nt, Human
aaagcagccuggccaac

SEQ ID NO: 1264298 - RNA, 19 nt, Human
aaagcagaauaguauuuuu

SEQ ID NO: 1264299 - RNA, 12 nt, Human
aaagcagccacg

SEQ ID NO: 1264300 - RNA, 15 nt, Human
aaagcagccacgagg

SEQ ID NO: 1264301 - RNA, 21 nt, Human
aaagcagguugauaaaucauu

SEQ ID NO: 1264302 - RNA, 22 nt, Human
aaagcagguucuuguuggugca

SEQ ID NO: 1264303 - RNA, 17 nt, Human
aaagcagguucuuguug

SEQ ID NO: 1264304 - RNA, 19 nt, Human
aaagcagguucuuguuggu

SEQ ID NO: 1264305 - RNA, 17 nt, Human
aaagcagguuucaagga

SEQ ID NO: 1264306 - RNA, 14 nt, Human
aaagcagguucuug

SEQ ID NO: 1264307 - RNA, 15 nt, Human
aaagcagguucuugu

SEQ ID NO: 1264308 - RNA, 16 nt, Human
aaagcagguucuuguu

SEQ ID NO: 1264309 - RNA, 14 nt, Human
aaauauauaucaaa

SEQ ID NO: 1264310 - RNA, 18 nt, Human
aaauauaugcuaagucuu

SEQ ID NO: 1264311 - RNA, 12 nt, Human
aaauauauauua

SEQ ID NO: 1264312 - RNA, 13 nt, Human
aaauauauauuau

SEQ ID NO: 1264313 - RNA, 14 nt, Human
aaauauauauuaua

SEQ ID NO: 1264314 - RNA, 17 nt, Human
aaauauauauuauacuu

SEQ ID NO: 1264315 - RNA, 22 nt, Human
aaauauauauuauacuuguaau

SEQ ID NO: 1264316 - RNA, 12 nt, Human
aaauauauuauu

SEQ ID NO: 1264317 - RNA, 13 nt, Human
aaauauauuauua

SEQ ID NO: 1264318 - RNA, 16 nt, Human
aaauauauuauuacuu

SEQ ID NO: 1264319 - RNA, 19 nt, Human
aaauauauuauuacuugua

SEQ ID NO: 1264320 - RNA, 23 nt, Human
aaauauauuauuacuuguaaaua

SEQ ID NO: 1264321 - RNA, 12 nt, Human
aaauauauuuaa

SEQ ID NO: 1264322 - RNA, 20 nt, Human
aaauauauuuaagauaauua

SEQ ID NO: 1264323 - RNA, 21 nt, Human
aaauauauuuaagauaauuau

SEQ ID NO: 1264324 - RNA, 22 nt, Human
aaauauauuuuaagacgaaaca

SEQ ID NO: 1264325 - RNA, 16 nt, Human
aaauauauuuuaagac

SEQ ID NO: 1264326 - RNA, 22 nt, Human
aaauauauuuaagauaauuaua

SEQ ID NO: 1264327 - RNA, 21 nt, Human
aaauauauuauuacuuguaaa

SEQ ID NO: 1264328 - RNA, 22 nt, Human
aaauaucacuugucaauaaaau

SEQ ID NO: 1264329 - RNA, 20 nt, Human
aaauaucccuccuguuggga

SEQ ID NO: 1264330 - RNA, 23 nt, Human
aaauaucccuccuguugggagag

SEQ ID NO: 1264331 - RNA, 17 nt, Human
aaauaucuauguuuuac

SEQ ID NO: 1264332 - RNA, 20 nt, Human
aaauacgugggcauucaaau

SEQ ID NO: 1264333 - RNA, 21 nt, Human
aaauacgugggcauucaaaug

SEQ ID NO: 1264334 - RNA, 22 nt, Human
aaauacgugggcauucaaaugu

SEQ ID NO: 1264335 - RNA, 15 nt, Human
aaauacggugggggu

SEQ ID NO: 1264336 - RNA, 23 nt, Human
aaauauacuuuuacaaguaacaa

SEQ ID NO: 1264337 - RNA, 18 nt, Human
aaauauagaucaguuaua

SEQ ID NO: 1264338 - RNA, 22 nt, Human
aaauauacuuuuacaaguaaca

SEQ ID NO: 1264339 - RNA, 12 nt, Human
aaauauauacua

SEQ ID NO: 1264340 - RNA, 16 nt, Human
aaauauauacuaaaca

SEQ ID NO: 1264341 - RNA, 14 nt, Human
aaauauauacucaa

SEQ ID NO: 1264342 - RNA, 20 nt, Human
guacacaauaagcaaaaaca

SEQ ID NO: 1264343 - RNA, 18 nt, Human
guacacaauaagcaaaaa

SEQ ID NO: 1264344 - RNA, 16 nt, Human
guacacagcaccagaa

SEQ ID NO: 1264345 - RNA, 20 nt, Human
aaauauuccugcauuuguga

SEQ ID NO: 1264346 - RNA, 18 nt, Human
aaaucagcuauuuuguga

SEQ ID NO: 1264347 - RNA, 16 nt, Human
aaauaugccuuuuuga

SEQ ID NO: 1264348 - RNA, 15 nt, Human
aaauauggacacuua

SEQ ID NO: 1264349 - RNA, 16 nt, Human
aaauauggacacuuaa

SEQ ID NO: 1264350 - RNA, 20 nt, Human
aaauauggacacuuaauacu

SEQ ID NO: 1264351 - RNA, 18 nt, Human
aaauauggacugcucagg

SEQ ID NO: 1264352 - RNA, 19 nt, Human
aaauauggucuuuugguua

SEQ ID NO: 1264353 - RNA, 13 nt, Human
aaauauguaccaa

SEQ ID NO: 1264354 - RNA, 17 nt, Human
aaauauguauaacuuua

SEQ ID NO: 1264355 - RNA, 16 nt, Human
aaauauguccuggggu

SEQ ID NO: 1264356 - RNA, 15 nt, Human
aaauaucuugaaagg

SEQ ID NO: 1264357 - RNA, 17 nt, Human
aaauaugaagaacugag

SEQ ID NO: 1264358 - RNA, 20 nt, Human
aaauaugaagacauaaaccc

SEQ ID NO: 1264359 - RNA, 15 nt, Human
aaauaugauguuaaa

SEQ ID NO: 1264360 - RNA, 21 nt, Human
aaauaugauguuaaaaaaaua

SEQ ID NO: 1264361 - RNA, 21 nt, Human
guaaagcccauuuuuaaaaua

SEQ ID NO: 1264362 - RNA, 24 nt, Human
guaaacugugcaccaagcaggaaa

SEQ ID NO: 1264363 - RNA, 20 nt, Human
guaaagcuaaaauaaagaaa

SEQ ID NO: 1264364 - RNA, 16 nt, Human
guaaagcuugucugau

SEQ ID NO: 1264365 - RNA, 22 nt, Human
guaaacuaucuuggugaauuuu

SEQ ID NO: 1264366 - RNA, 16 nt, Human
guaaacucaaaauauu

SEQ ID NO: 1264367 - RNA, 23 nt, Human
guaaacucaaaauauuuguacau

SEQ ID NO: 1264368 - RNA, 15 nt, Human
guaaagcuaaaauaa

SEQ ID NO: 1264369 - RNA, 14 nt, Human
guaaaguacuugua

SEQ ID NO: 1264370 - RNA, 15 nt, Human
guaaaguacuuguag

SEQ ID NO: 1264371 - RNA, 16 nt, Human
guaaaguacuuguagu

SEQ ID NO: 1264372 - RNA, 17 nt, Human
guaaaguacuuguaguu

SEQ ID NO: 1264373 - RNA, 22 nt, Human
guaaaguaucaggauacuauau

SEQ ID NO: 1264374 - RNA, 15 nt, Human
guaaaguauguauua

SEQ ID NO: 1264375 - RNA, 17 nt, Human
guaaaguauguauuauu

SEQ ID NO: 1264376 - RNA, 22 nt, Human
guaaaguauguauuauuuacau

SEQ ID NO: 1264377 - RNA, 23 nt, Human
guaaaguauguauuauuuacauu

SEQ ID NO: 1264378 - RNA, 15 nt, Human
guaaagucaaggaga

SEQ ID NO: 1264379 - RNA, 13 nt, Human
guaaauuuguacu

SEQ ID NO: 1264380 - RNA, 15 nt, Human
guaaauuuguacuau

SEQ ID NO: 1264381 - RNA, 20 nt, Human
guaaauuuguacuauuuaac

SEQ ID NO: 1264382 - RNA, 22 nt, Human
guaaauuuguacuauuuaacug

SEQ ID NO: 1264383 - RNA, 13 nt, Human
guaacaaaaauaa

SEQ ID NO: 1264384 - RNA, 13 nt, Human
guaacaagccaga

SEQ ID NO: 1264385 - RNA, 14 nt, Human
guaacaagccagau

SEQ ID NO: 1264386 - RNA, 15 nt, Human
guaacaagccagauu

SEQ ID NO: 1264387 - RNA, 16 nt, Human
guaacaagccagauuu

SEQ ID NO: 1264388 - RNA, 23 nt, Human
guaacaagccagauuuuuuaaaa

SEQ ID NO: 1264389 - RNA, 23 nt, Human
guaacauguguuaaguauuuuca

SEQ ID NO: 1264390 - RNA, 14 nt, Human
guaacauuugcugu

SEQ ID NO: 1264391 - RNA, 19 nt, Human
guaacauuugcuguuuuaa

SEQ ID NO: 1264392 - RNA, 22 nt, Human
guaacauuugcuguuuuaaaca

SEQ ID NO: 1264393 - RNA, 15 nt, Human
aaaguguauuuguua

SEQ ID NO: 1264394 - RNA, 18 nt, Human
aaagugucaacucuuugu

SEQ ID NO: 1264395 - RNA, 21 nt, Human
aaaguggguuuuuuaguugaa

SEQ ID NO: 1264396 - RNA, 14 nt, Human
aaaguguuuucucu

SEQ ID NO: 1264397 - RNA, 20 nt, Human
aaauaauguguaguucaugu

SEQ ID NO: 1264398 - RNA, 23 nt, Human
aaaguguuuucucugaacacauu

SEQ ID NO: 1264399 - RNA, 17 nt, Human
aaaguguuuucucugaa

SEQ ID NO: 1264400 - RNA, 21 nt, Human
aaaguguuuucucugaacaca

SEQ ID NO: 1264401 - RNA, 13 nt, Human
aaaguuaaguuga

SEQ ID NO: 1264402 - RNA, 21 nt, Human
aaauaauguguaguucaugua

SEQ ID NO: 1264403 - RNA, 21 nt, Human
aaauaauuauauaacuguauu

SEQ ID NO: 1264404 - RNA, 22 nt, Human
aaauaauuauauaacuguauuu

SEQ ID NO: 1264405 - RNA, 23 nt, Human
aaauaauuauauaacuguauuug

SEQ ID NO: 1264406 - RNA, 23 nt, Human
guaaaaugugggauuauggguca

SEQ ID NO: 1264407 - RNA, 20 nt, Human
guaaacaaacuguguaacug

SEQ ID NO: 1264408 - RNA, 11 nt, Human
guaaacaauau

SEQ ID NO: 1264409 - RNA, 19 nt, Human
guaaacagauggcacuuug

SEQ ID NO: 1264410 - RNA, 13 nt, Human
guaaguuuuuuga

SEQ ID NO: 1264411 - RNA, 19 nt, Human
guaaguugggcuugcuauu

SEQ ID NO: 1264412 - RNA, 17 nt, Human
guaaguugggcuugcua

SEQ ID NO: 1264413 - RNA, 18 nt, Human
guaaguugggcuugcuau

SEQ ID NO: 1264414 - RNA, 23 nt, Human
guaaguugggcuugcuauucugu

SEQ ID NO: 1264415 - RNA, 17 nt, Human
guaacuaacuaaaacaa

SEQ ID NO: 1264416 - RNA, 19 nt, Human
guaacuaacugcauacacu

SEQ ID NO: 1264417 - RNA, 16 nt, Human
guaacuaacuaaaaca

SEQ ID NO: 1264418 - RNA, 12 nt, Human
guaacuacuuua

SEQ ID NO: 1264419 - RNA, 14 nt, Human
guaacuacuuuaua

SEQ ID NO: 1264420 - RNA, 13 nt, Human
guaacucaucugu

SEQ ID NO: 1264421 - RNA, 18 nt, Human
guaaccucuucagaggcc

SEQ ID NO: 1264422 - RNA, 20 nt, Human
guaaccucuucagaggcccu

SEQ ID NO: 1264423 - RNA, 16 nt, Human
guaacgcgucuuccug

SEQ ID NO: 1264424 - RNA, 17 nt, Human
guaacgcgucuuccuga

SEQ ID NO: 1264425 - RNA, 13 nt, Human
guaacuaaaauaa

SEQ ID NO: 1264426 - RNA, 15 nt, Human
guaacuaaaauaauu

SEQ ID NO: 1264427 - RNA, 20 nt, Human
guaacuaaaauaauuuugua

SEQ ID NO: 1264428 - RNA, 22 nt, Human
guaacuaaaauaauuuuguaau

SEQ ID NO: 1264429 - RNA, 22 nt, Human
guaauaccucuaauaguauaaa

SEQ ID NO: 1264430 - RNA, 17 nt, Human
guaauacuucuugugug

SEQ ID NO: 1264431 - RNA, 18 nt, Human
guaauacuucuugugugu

SEQ ID NO: 1264432 - RNA, 21 nt, Human
guaauaccucuaauaguauaa

SEQ ID NO: 1264433 - RNA, 22 nt, Human
guaauacaaacuaauuuaguaa

SEQ ID NO: 1264434 - RNA, 12 nt, Human
guaauaauaaag

SEQ ID NO: 1264435 - RNA, 16 nt, Human
guaauaauaaagaaua

SEQ ID NO: 1264436 - RNA, 21 nt, Human
guaauaaaauucaacaaacau

SEQ ID NO: 1264437 - RNA, 20 nt, Human
guaauaaaauucaacaaaca

SEQ ID NO: 1264438 - RNA, 15 nt, Human
guaauaaacuuuaau

SEQ ID NO: 1264439 - RNA, 15 nt, Human
guaauaagguuuuaa

SEQ ID NO: 1264440 - RNA, 21 nt, Human
guaauaagguuuuaauuuagu

SEQ ID NO: 1264441 - RNA, 23 nt, Human
guaauacuucuuguguguaugca

SEQ ID NO: 1264442 - RNA, 19 nt, Human
guaauauugacuuguauau

SEQ ID NO: 1264443 - RNA, 20 nt, Human
guaauauugacuuguauauu

SEQ ID NO: 1264444 - RNA, 22 nt, Human
guaaucaaucuacucaaagcau

SEQ ID NO: 1264445 - RNA, 12 nt, Human
guacaaaauaaa

SEQ ID NO: 1264446 - RNA, 14 nt, Human
guacaaaauaaaca

SEQ ID NO: 1264447 - RNA, 16 nt, Human
guacaaaauaaacaaa

SEQ ID NO: 1264448 - RNA, 15 nt, Human
guaauuuuuuucacc

SEQ ID NO: 1264449 - RNA, 21 nt, Human
guacaaaaaaaucuuccaauu

SEQ ID NO: 1264450 - RNA, 22 nt, Human
guacaaccuguucugcuuuccu

SEQ ID NO: 1264451 - RNA, 23 nt, Human
guacaaccacacccacacucaga

SEQ ID NO: 1264452 - RNA, 15 nt, Human
guacaagaagcauuu

SEQ ID NO: 1264453 - RNA, 21 nt, Human
guacaagaagcauuuuguaag

SEQ ID NO: 1264454 - RNA, 15 nt, Human
guaaucgaccugccu

SEQ ID NO: 1264455 - RNA, 12 nt, Human
guaauccuguag

SEQ ID NO: 1264456 - RNA, 18 nt, Human
guaaucccugcuuuuugu

SEQ ID NO: 1264457 - RNA, 22 nt, Human
guaauccucaagaaauaaaagg

SEQ ID NO: 1264458 - RNA, 14 nt, Human
guaaucaauguuuc

SEQ ID NO: 1264459 - RNA, 13 nt, Human
guaaucccugcuu

SEQ ID NO: 1264460 - RNA, 17 nt, Human
guaaucgaccugccucg

SEQ ID NO: 1264461 - RNA, 18 nt, Human
gguaaguuuuuugaaauu

SEQ ID NO: 1264462 - RNA, 19 nt, Human
gguaagcaacauggcuuug

SEQ ID NO: 1264463 - RNA, 18 nt, Human
gguaacugcuuucuguuc

SEQ ID NO: 1264464 - RNA, 24 nt, Human
gguaacuuuugugaauuaggcugu

SEQ ID NO: 1264465 - RNA, 23 nt, Human
gguaagaaguuuuaaaaagccag

SEQ ID NO: 1264466 - RNA, 16 nt, Human
gguaagcaacauggcu

SEQ ID NO: 1264467 - RNA, 17 nt, Human
gguaagcaacauggcuu

SEQ ID NO: 1264468 - RNA, 21 nt, Human
gguaggaauagcaugucacua

SEQ ID NO: 1264469 - RNA, 17 nt, Human
gguaggagggugggaag

SEQ ID NO: 1264470 - RNA, 18 nt, Human
gguaggccaagguguccu

SEQ ID NO: 1264471 - RNA, 21 nt, Human
gguaggccaagguguccuaca

SEQ ID NO: 1264472 - RNA, 23 nt, Human
gguaggccaagguguccuacaga

SEQ ID NO: 1264473 - RNA, 24 nt, Human
gguaggccaagguguccuacagaa

SEQ ID NO: 1264474 - RNA, 14 nt, Human
gguaggggccccuc

SEQ ID NO: 1264475 - RNA, 18 nt, Human
gguaggggccccucucag

SEQ ID NO: 1264476 - RNA, 19 nt, Human
gguaggggccccucucagc

SEQ ID NO: 1264477 - RNA, 21 nt, Human
gguaggggccccucucagccc

SEQ ID NO: 1264478 - RNA, 11 nt, Human
gguaggggcug

SEQ ID NO: 1264479 - RNA, 13 nt, Human
gguaggggcuggg

SEQ ID NO: 1264480 - RNA, 14 nt, Human
gguaggggcuggga

SEQ ID NO: 1264481 - RNA, 16 nt, Human
gguaggggcugggaac

SEQ ID NO: 1264482 - RNA, 13 nt, Human
gguagggggcugg

SEQ ID NO: 1264483 - RNA, 17 nt, Human
gguagggggcuggagga

SEQ ID NO: 1264484 - RNA, 23 nt, Human
gguagggggcuggaggagcccag

SEQ ID NO: 1264485 - RNA, 13 nt, Human
gguagggguuggg

SEQ ID NO: 1264486 - RNA, 14 nt, Human
gguaggguaaauca

SEQ ID NO: 1264487 - RNA, 15 nt, Human
gguaggguaaaucag

SEQ ID NO: 1264488 - RNA, 16 nt, Human
gguaggguaaaucagu

SEQ ID NO: 1264489 - RNA, 11 nt, Human
gguaggguggg

SEQ ID NO: 1264490 - RNA, 23 nt, Human
gguagggugggccuucagggagu

SEQ ID NO: 1264491 - RNA, 15 nt, Human
gguagguucagccaa

SEQ ID NO: 1264492 - RNA, 16 nt, Human
gguagguucagccaag

SEQ ID NO: 1264493 - RNA, 17 nt, Human
gguagguucagccaagg

SEQ ID NO: 1264494 - RNA, 14 nt, Human
gguauaccucacuu

SEQ ID NO: 1264495 - RNA, 19 nt, Human
gguauaucuagguuuauga

SEQ ID NO: 1264496 - RNA, 21 nt, Human
gguauaucuagguuuaugaca

SEQ ID NO: 1264497 - RNA, 12 nt, Human
gguauauuuucc

SEQ ID NO: 1264498 - RNA, 18 nt, Human
gguagguucagccaaggu

SEQ ID NO: 1264499 - RNA, 19 nt, Human
gguagguucagccaagguu

SEQ ID NO: 1264500 - RNA, 23 nt, Human
gguauaguucaugucugcuauca

SEQ ID NO: 1264501 - RNA, 13 nt, Human
gguauauacuuug

SEQ ID NO: 1264502 - RNA, 16 nt, Human
gguauauccaaaagcu

SEQ ID NO: 1264503 - RNA, 14 nt, Human
ggucagugcaaaua

SEQ ID NO: 1264504 - RNA, 20 nt, Human
gguaugaacuugaggacaca

SEQ ID NO: 1264505 - RNA, 19 nt, Human
gguaugaacuugaggacac

SEQ ID NO: 1264506 - RNA, 16 nt, Human
gguaugaacuugagga

SEQ ID NO: 1264507 - RNA, 20 nt, Human
gguaucucagaaagugccug

SEQ ID NO: 1264508 - RNA, 18 nt, Human
gguauccccccaucuugc

SEQ ID NO: 1264509 - RNA, 15 nt, Human
gguaucucagaaagu

SEQ ID NO: 1264510 - RNA, 19 nt, Human
gguaucucagaaagugccu

SEQ ID NO: 1264511 - RNA, 15 nt, Human
aaacuuuaucacuua

SEQ ID NO: 1264512 - RNA, 14 nt, Human
aaacuucguuuaau

SEQ ID NO: 1264513 - RNA, 17 nt, Human
aaacuucguuuaaugaa

SEQ ID NO: 1264514 - RNA, 17 nt, Human
aaacuuccccaucuucu

SEQ ID NO: 1264515 - RNA, 11 nt, Human
gguccagcucu

SEQ ID NO: 1264516 - RNA, 12 nt, Human
gguccagcucug

SEQ ID NO: 1264517 - RNA, 13 nt, Human
gguccagcucugg

SEQ ID NO: 1264518 - RNA, 14 nt, Human
gguccagcucugga

SEQ ID NO: 1264519 - RNA, 15 nt, Human
gguccagcucuggag

SEQ ID NO: 1264520 - RNA, 16 nt, Human
gguccagcucuggagg

SEQ ID NO: 1264521 - RNA, 22 nt, Human
gguccagcucuggaggggaggg

SEQ ID NO: 1264522 - RNA, 11 nt, Human
gguccaggaga

SEQ ID NO: 1264523 - RNA, 13 nt, Human
gguccaggcugug

SEQ ID NO: 1264524 - RNA, 22 nt, Human
gguaaaucagacuaugaaguuu

SEQ ID NO: 1264525 - RNA, 15 nt, Human
gguaaaucaguaaga

SEQ ID NO: 1264526 - RNA, 22 nt, Human
ggguuuuuuaguugaauuuuuu

SEQ ID NO: 1264527 - RNA, 22 nt, Human
gguaaaaaaaaauuacuguuua

SEQ ID NO: 1264528 - RNA, 16 nt, Human
gguaaaaaauuuauaa

SEQ ID NO: 1264529 - RNA, 13 nt, Human
gguaaaacacuug

SEQ ID NO: 1264530 - RNA, 14 nt, Human
gguaaaaaauuuau

SEQ ID NO: 1264531 - RNA, 18 nt, Human
gguaaaacagggccacau

SEQ ID NO: 1264532 - RNA, 13 nt, Human
gguaaaauacuuc

SEQ ID NO: 1264533 - RNA, 23 nt, Human
gguaaaauacuuuuacucugccu

SEQ ID NO: 1264534 - RNA, 13 nt, Human
gguaaaaugccau

SEQ ID NO: 1264535 - RNA, 15 nt, Human
gguaaagacuggcuu

SEQ ID NO: 1264536 - RNA, 16 nt, Human
gguaaagacuggcuuu

SEQ ID NO: 1264537 - RNA, 20 nt, Human
gguaaaguuaaguugagaua

SEQ ID NO: 1264538 - RNA, 15 nt, Human
gguaaauaaaaagaa

SEQ ID NO: 1264539 - RNA, 19 nt, Human
gguaaauaaaaagaaaggc

SEQ ID NO: 1264540 - RNA, 23 nt, Human
ggguuuuuauuuccuaugaugua

SEQ ID NO: 1264541 - RNA, 18 nt, Human
ggguuuuguauucucuga

SEQ ID NO: 1264542 - RNA, 20 nt, Human
ggguguccccaacagcgccc

SEQ ID NO: 1264543 - RNA, 15 nt, Human
ggguggcugcagccu

SEQ ID NO: 1264544 - RNA, 17 nt, Human
ggguggcugcagccuca

SEQ ID NO: 1264545 - RNA, 15 nt, Human
gggugguggugauag

SEQ ID NO: 1264546 - RNA, 15 nt, Human
gggugguggccuggu

SEQ ID NO: 1264547 - RNA, 17 nt, Human
ggguguccugcaccggg

SEQ ID NO: 1264548 - RNA, 21 nt, Human
ggguguccugcaccggggccu

SEQ ID NO: 1264549 - RNA, 13 nt, Human
ggguggugucaga

SEQ ID NO: 1264550 - RNA, 18 nt, Human
ggguguaaaaccuggaga

SEQ ID NO: 1264551 - RNA, 13 nt, Human
aaacgcaucuagu

SEQ ID NO: 1264552 - RNA, 17 nt, Human
aaacuaaaaaauuaaac

SEQ ID NO: 1264553 - RNA, 14 nt, Human
aaacuaaaaacuag

SEQ ID NO: 1264554 - RNA, 19 nt, Human
aaacuaaagaaauuucuca

SEQ ID NO: 1264555 - RNA, 19 nt, Human
aaacuguuggaauggauuu

SEQ ID NO: 1264556 - RNA, 16 nt, Human
aaacuguuucuuuaaa

SEQ ID NO: 1264557 - RNA, 18 nt, Human
aaacuguuucuuuaaaau

SEQ ID NO: 1264558 - RNA, 16 nt, Human
aaacuuaaauguuauu

SEQ ID NO: 1264559 - RNA, 17 nt, Human
aaacuuaaauguuauua

SEQ ID NO: 1264560 - RNA, 21 nt, Human
aaacuuaaauguuauuaucug

SEQ ID NO: 1264561 - RNA, 15 nt, Human
aaacuuaagccaauu

SEQ ID NO: 1264562 - RNA, 16 nt, Human
aaacuuaauuuaauau

SEQ ID NO: 1264563 - RNA, 17 nt, Human
aaacuuaauuuaauauu

SEQ ID NO: 1264564 - RNA, 20 nt, Human
aaacuuaugcugauuuauuu

SEQ ID NO: 1264565 - RNA, 19 nt, Human
aaacuucagacauagaauu

SEQ ID NO: 1264566 - RNA, 18 nt, Human
ggguggcuacucugugcc

SEQ ID NO: 1264567 - RNA, 19 nt, Human
ggguggcuacucugugcca

SEQ ID NO: 1264568 - RNA, 20 nt, Human
ggguggcuacucugugccag

SEQ ID NO: 1264569 - RNA, 23 nt, Human
ggguggcuacucugugccagagc

SEQ ID NO: 1264570 - RNA, 13 nt, Human
ggguggcugcagc

SEQ ID NO: 1264571 - RNA, 10 nt, Human
aaaccacuuu

SEQ ID NO: 1264572 - RNA, 13 nt, Human
aaaccagcucagc

SEQ ID NO: 1264573 - RNA, 12 nt, Human
aaaccagcuucc

SEQ ID NO: 1264574 - RNA, 13 nt, Human
aaaccagcuuccu

SEQ ID NO: 1264575 - RNA, 16 nt, Human
aaaccagcuuccuuca

SEQ ID NO: 1264576 - RNA, 17 nt, Human
aaaccagcuuccuucag

SEQ ID NO: 1264577 - RNA, 18 nt, Human
aaaccagcuuccuucaga

SEQ ID NO: 1264578 - RNA, 19 nt, Human
aaaccagcuuccuucagag

SEQ ID NO: 1264579 - RNA, 16 nt, Human
aaaccaggacccuguc

SEQ ID NO: 1264580 - RNA, 20 nt, Human
aaaccagcuuccuucagaga

SEQ ID NO: 1264581 - RNA, 14 nt, Human
aaaccugcuuuuca

SEQ ID NO: 1264582 - RNA, 15 nt, Human
aaaccugcuuuucaa

SEQ ID NO: 1264583 - RNA, 20 nt, Human
aaaccugcuuuucaaugugu

SEQ ID NO: 1264584 - RNA, 11 nt, Human
aaaccuggaga

SEQ ID NO: 1264585 - RNA, 19 nt, Human
aaaccuggagaugguggau

SEQ ID NO: 1264586 - RNA, 20 nt, Human
aaaccacuuuuugcagcuuu

SEQ ID NO: 1264587 - RNA, 12 nt, Human
aaaccacugaaa

SEQ ID NO: 1264588 - RNA, 16 nt, Human
aaaccacugaaaaaau

SEQ ID NO: 1264589 - RNA, 17 nt, Human
aaaccacugaaaaaaua

SEQ ID NO: 1264590 - RNA, 18 nt, Human
aaaccacugaaaaaauau

SEQ ID NO: 1264591 - RNA, 13 nt, Human
aaacauuuucucc

SEQ ID NO: 1264592 - RNA, 12 nt, Human
aaacauuuucug

SEQ ID NO: 1264593 - RNA, 16 nt, Human
aaacauuuucuggcca

SEQ ID NO: 1264594 - RNA, 23 nt, Human
aaaccuuccacccagugcugaau

SEQ ID NO: 1264595 - RNA, 16 nt, Human
aaaccuuccacccagu

SEQ ID NO: 1264596 - RNA, 17 nt, Human
aaacgagacuuuccauu

SEQ ID NO: 1264597 - RNA, 20 nt, Human
aaacgauuuuuaaaauguac

SEQ ID NO: 1264598 - RNA, 12 nt, Human
aaaccuguucua

SEQ ID NO: 1264599 - RNA, 17 nt, Human
aaaccuucacuuaggaa

SEQ ID NO: 1264600 - RNA, 14 nt, Human
aaacauuugcugaa

SEQ ID NO: 1264601 - RNA, 15 nt, Human
ggguccggcagcuuc

SEQ ID NO: 1264602 - RNA, 16 nt, Human
ggguccggcagcuucu

SEQ ID NO: 1264603 - RNA, 15 nt, Human
ggguccuccuccagg

SEQ ID NO: 1264604 - RNA, 16 nt, Human
ggguccuccuccaggg

SEQ ID NO: 1264605 - RNA, 18 nt, Human
ggguccuccuccagggac

SEQ ID NO: 1264606 - RNA, 20 nt, Human
ggguccuccuccagggacag

SEQ ID NO: 1264607 - RNA, 15 nt, Human
ggguccucugagacu

SEQ ID NO: 1264608 - RNA, 19 nt, Human
ggguccucugagacuccag

SEQ ID NO: 1264609 - RNA, 13 nt, Human
ggguccucuucug

SEQ ID NO: 1264610 - RNA, 19 nt, Human
ggguccucuucugggccug

SEQ ID NO: 1264611 - RNA, 18 nt, Human
ggggucccagcagcugcc

SEQ ID NO: 1264612 - RNA, 23 nt, Human
gggguccuccuccagggacagca

SEQ ID NO: 1264613 - RNA, 19 nt, Human
gggguccuggagcagacca

SEQ ID NO: 1264614 - RNA, 22 nt, Human
ggguauggcguaaguacagaga

SEQ ID NO: 1264615 - RNA, 13 nt, Human
ggguauggcguaa

SEQ ID NO: 1264616 - RNA, 13 nt, Human
gggucaaguuauu

SEQ ID NO: 1264617 - RNA, 12 nt, Human
gggucacaggaa

SEQ ID NO: 1264618 - RNA, 23 nt, Human
gggucaaguuauuaauuucuuca

SEQ ID NO: 1264619 - RNA, 21 nt, Human
gggucaggccuuugagcucag

SEQ ID NO: 1264620 - RNA, 20 nt, Human
aaaauguaugcauguugucu

SEQ ID NO: 1264621 - RNA, 15 nt, Human
aaaauguaugucugg

SEQ ID NO: 1264622 - RNA, 11 nt, Human
aaaauguauuu

SEQ ID NO: 1264623 - RNA, 13 nt, Human
aaaauguauuuua

SEQ ID NO: 1264624 - RNA, 15 nt, Human
aaaauguauuuuaug

SEQ ID NO: 1264625 - RNA, 16 nt, Human
aaaauguauuuuaugu

SEQ ID NO: 1264626 - RNA, 17 nt, Human
aaaauguauuuuauguu

SEQ ID NO: 1264627 - RNA, 18 nt, Human
aaaauguauuuuauguua

SEQ ID NO: 1264628 - RNA, 22 nt, Human
aaaaugguccaauuaguuuccu

SEQ ID NO: 1264629 - RNA, 14 nt, Human
aaaauguaaagcca

SEQ ID NO: 1264630 - RNA, 19 nt, Human
aaaauguaaaggagucaaa

SEQ ID NO: 1264631 - RNA, 22 nt, Human
aaaauguaagauuauagauucu

SEQ ID NO: 1264632 - RNA, 23 nt, Human
aaaauguaagauuauagauucua

SEQ ID NO: 1264633 - RNA, 16 nt, Human
aaaauguaugcauguu

SEQ ID NO: 1264634 - RNA, 22 nt, Human
aaaauguauuuuauguuauaua

SEQ ID NO: 1264635 - RNA, 14 nt, Human
aaaauguccuugug

SEQ ID NO: 1264636 - RNA, 15 nt, Human
ggggacagguccuca

SEQ ID NO: 1264637 - RNA, 15 nt, Human
ggggccccucucagc

SEQ ID NO: 1264638 - RNA, 17 nt, Human
ggggccccucucagccc

SEQ ID NO: 1264639 - RNA, 19 nt, Human
ggggccccucucagcccuc

SEQ ID NO: 1264640 - RNA, 18 nt, Human
ggggccccucucagcccu

SEQ ID NO: 1264641 - RNA, 21 nt, Human
ggggcccgcgauguggaacug

SEQ ID NO: 1264642 - RNA, 13 nt, Human
gggguagggggcu

SEQ ID NO: 1264643 - RNA, 20 nt, Human
gggguauuucaauuaccuuc

SEQ ID NO: 1264644 - RNA, 12 nt, Human
ggggucccagca

SEQ ID NO: 1264645 - RNA, 14 nt, Human
ggggucccagcagc

SEQ ID NO: 1264646 - RNA, 19 nt, Human
ggggguuccguguccaccc

SEQ ID NO: 1264647 - RNA, 23 nt, Human
ggggguggccgcugaguggcagg

SEQ ID NO: 1264648 - RNA, 15 nt, Human
gggggcacaagacug

SEQ ID NO: 1264649 - RNA, 16 nt, Human
gggggcacaagacuga

SEQ ID NO: 1264650 - RNA, 12 nt, Human
gggggcagaagu

SEQ ID NO: 1264651 - RNA, 23 nt, Human
ggggcccggacgcccaggacccc

SEQ ID NO: 1264652 - RNA, 16 nt, Human
gggggcugaggagcag

SEQ ID NO: 1264653 - RNA, 16 nt, Human
gggggcuggaggagcc

SEQ ID NO: 1264654 - RNA, 22 nt, Human
gggggcagucugagagaggcca

SEQ ID NO: 1264655 - RNA, 21 nt, Human
gggggcagcacaggagggcgg

SEQ ID NO: 1264656 - RNA, 15 nt, Human
aaaauauuuguacau

SEQ ID NO: 1264657 - RNA, 20 nt, Human
aaaauauucaauaagagauu

SEQ ID NO: 1264658 - RNA, 19 nt, Human
aaaauauuguuuuacaaua

SEQ ID NO: 1264659 - RNA, 20 nt, Human
aaaauauuguuuuacaauag

SEQ ID NO: 1264660 - RNA, 12 nt, Human
aaaauauuuuga

SEQ ID NO: 1264661 - RNA, 22 nt, Human
aaaauaugaccacacuccagcu

SEQ ID NO: 1264662 - RNA, 15 nt, Human
aaaauauuccugcau

SEQ ID NO: 1264663 - RNA, 19 nt, Human
aaaauagacaaauagaaaa

SEQ ID NO: 1264664 - RNA, 21 nt, Human
aaaauaucaccaaaaaccuau

SEQ ID NO: 1264665 - RNA, 22 nt, Human
aaaauaucuacauuaauauacu

SEQ ID NO: 1264666 - RNA, 13 nt, Human
aaaauaucuacau

SEQ ID NO: 1264667 - RNA, 20 nt, Human
aaaauacuugucuguuuuaa

SEQ ID NO: 1264668 - RNA, 11 nt, Human
aaaauacuuuu

SEQ ID NO: 1264669 - RNA, 16 nt, Human
aaaauacuuuuacucu

SEQ ID NO: 1264670 - RNA, 22 nt, Human
aaaauacuuuuacucugccuac

SEQ ID NO: 1264671 - RNA, 21 nt, Human
aaaauacuuuuacucugccua

SEQ ID NO: 1264672 - RNA, 15 nt, Human
aaaauagacaaauag

SEQ ID NO: 1264673 - RNA, 13 nt, Human
aaaauagacacuc

SEQ ID NO: 1264674 - RNA, 22 nt, Human
aaaauagauaagaguagaaacu

SEQ ID NO: 1264675 - RNA, 12 nt, Human
aaaaugagaaau

SEQ ID NO: 1264676 - RNA, 11 nt, Human
aaaaugagaaa

SEQ ID NO: 1264677 - RNA, 17 nt, Human
aaaaugacaaucaugug

SEQ ID NO: 1264678 - RNA, 20 nt, Human
aaaaugacaaucaugugugu

SEQ ID NO: 1264679 - RNA, 18 nt, Human
aaaaugacaaucaugugu

SEQ ID NO: 1264680 - RNA, 13 nt, Human
aaaauauuuugaa

SEQ ID NO: 1264681 - RNA, 19 nt, Human
aaaaucucccauuuuggaa

SEQ ID NO: 1264682 - RNA, 21 nt, Human
aaaaucucccauuuuggaauu

SEQ ID NO: 1264683 - RNA, 15 nt, Human
aaaaucucuccacuu

SEQ ID NO: 1264684 - RNA, 16 nt, Human
aaaaucucuccacuuu

SEQ ID NO: 1264685 - RNA, 18 nt, Human
aaaaucucuccacuuuca

SEQ ID NO: 1264686 - RNA, 19 nt, Human
aaaaucucuccacuuucag

SEQ ID NO: 1264687 - RNA, 20 nt, Human
aaaaucucuccacuuucagc

SEQ ID NO: 1264688 - RNA, 22 nt, Human
aaaaucucuccacuuucagcug

SEQ ID NO: 1264689 - RNA, 21 nt, Human
aaaaucucuccacuuucagcu

SEQ ID NO: 1264690 - RNA, 20 nt, Human
aaaaucugucacguagaacu

SEQ ID NO: 1264691 - RNA, 16 nt, Human
gggccagacaugccac

SEQ ID NO: 1264692 - RNA, 22 nt, Human
aaaaugcuuuuuauuucugcau

SEQ ID NO: 1264693 - RNA, 16 nt, Human
aaaaugcuuacauuug

SEQ ID NO: 1264694 - RNA, 23 nt, Human
aaaaugcuguauuagucacagag

SEQ ID NO: 1264695 - RNA, 13 nt, Human
aaaaugcuuuuua

SEQ ID NO: 1264696 - RNA, 18 nt, Human
aaaaugcuuuuuauuucu

SEQ ID NO: 1264697 - RNA, 19 nt, Human
aaaaugcuuuuuauuucug

SEQ ID NO: 1264698 - RNA, 23 nt, Human
aaaaugccaugaugccucugucu

SEQ ID NO: 1264699 - RNA, 11 nt, Human
aaaauaauuuu

SEQ ID NO: 1264700 - RNA, 19 nt, Human
aaaauaauuuuaaacaaag

SEQ ID NO: 1264701 - RNA, 20 nt, Human
aaaauaauuuuaaacaaagg

SEQ ID NO: 1264702 - RNA, 16 nt, Human
aaaauaauacugcuga

SEQ ID NO: 1264703 - RNA, 23 nt, Human
aaaauaaucaaaagcuauuuaaa

SEQ ID NO: 1264704 - RNA, 23 nt, Human
aaaauaauacugcugagauacau

SEQ ID NO: 1264705 - RNA, 20 nt, Human
aaaauaauuauauaacugua

SEQ ID NO: 1264706 - RNA, 16 nt, Human
aaaauaagaauagaaa

SEQ ID NO: 1264707 - RNA, 13 nt, Human
aaaauaagcaggu

SEQ ID NO: 1264708 - RNA, 14 nt, Human
aaaauaagcaggug

SEQ ID NO: 1264709 - RNA, 19 nt, Human
aaaauaagcagguggaucu

SEQ ID NO: 1264710 - RNA, 14 nt, Human
aaaauaagucaaca

SEQ ID NO: 1264711 - RNA, 18 nt, Human
aaaauaagucaacaguaa

SEQ ID NO: 1264712 - RNA, 16 nt, Human
aaaauaagucaacagu

SEQ ID NO: 1264713 - RNA, 16 nt, Human
aaaauaauuuuuauau

SEQ ID NO: 1264714 - RNA, 17 nt, Human
aaaauaauuuuuauauu

SEQ ID NO: 1264715 - RNA, 20 nt, Human
aaaauaauuuuuauauuuga

SEQ ID NO: 1264716 - RNA, 13 nt, Human
aaaauaauuuugu

SEQ ID NO: 1264717 - RNA, 14 nt, Human
aaaauaauuuugua

SEQ ID NO: 1264718 - RNA, 12 nt, Human
aaaauacauugu

SEQ ID NO: 1264719 - RNA, 17 nt, Human
aaaauacaagacugcca

SEQ ID NO: 1264720 - RNA, 10 nt, Human
aaaauacaug

SEQ ID NO: 1264721 - RNA, 19 nt, Human
aaaaggacaucagcaaaca

SEQ ID NO: 1264722 - RNA, 17 nt, Human
aaaaggacaucagcaaa

SEQ ID NO: 1264723 - RNA, 21 nt, Human
ggcugguccuauggccucaug

SEQ ID NO: 1264724 - RNA, 13 nt, Human
ggcugguccaggg

SEQ ID NO: 1264725 - RNA, 23 nt, Human
ggcugguccagggcuagugacuu

SEQ ID NO: 1264726 - RNA, 13 nt, Human
ggcuggucucaaa

SEQ ID NO: 1264727 - RNA, 14 nt, Human
aaaaggauaaguga

SEQ ID NO: 1264728 - RNA, 13 nt, Human
aaaaggcaguuac

SEQ ID NO: 1264729 - RNA, 12 nt, Human
aaaaggccuggg

SEQ ID NO: 1264730 - RNA, 11 nt, Human
aaaaggccugg

SEQ ID NO: 1264731 - RNA, 15 nt, Human
aaaagguauuaaauu

SEQ ID NO: 1264732 - RNA, 19 nt, Human
aaaagguucuuacugcuug

SEQ ID NO: 1264733 - RNA, 15 nt, Human
aaaauggucucuaac

SEQ ID NO: 1264734 - RNA, 18 nt, Human
aaaaugguuuaaaugguc

SEQ ID NO: 1264735 - RNA, 16 nt, Human
aaaaugguuuaaaugg

SEQ ID NO: 1264736 - RNA, 23 nt, Human
aaaauggccauuugcuuuuucac

SEQ ID NO: 1264737 - RNA, 16 nt, Human
aaaaugggcacuuaaa

SEQ ID NO: 1264738 - RNA, 12 nt, Human
gggcucccugac

SEQ ID NO: 1264739 - RNA, 20 nt, Human
gggcugccggggcagccccc

SEQ ID NO: 1264740 - RNA, 23 nt, Human
gggcucccuccgcccccagguag

SEQ ID NO: 1264741 - RNA, 17 nt, Human
gggcugccuucuggccu

SEQ ID NO: 1264742 - RNA, 12 nt, Human
gggcugcuuccu

SEQ ID NO: 1264743 - RNA, 17 nt, Human
gggcugcuuccuccugg

SEQ ID NO: 1264744 - RNA, 17 nt, Human
gggcugcugcugggcuc

SEQ ID NO: 1264745 - RNA, 21 nt, Human
gggcugcugcugggcucagug

SEQ ID NO: 1264746 - RNA, 20 nt, Human
gggcuaggaaauccagggug

SEQ ID NO: 1264747 - RNA, 14 nt, Human
gggcucccuccgcc

SEQ ID NO: 1264748 - RNA, 22 nt, Human
gggcucaggucacauaaaacuu

SEQ ID NO: 1264749 - RNA, 22 nt, Human
gggccugcugcugagaaccugg

SEQ ID NO: 1264750 - RNA, 23 nt, Human
gggcuccagccccucuuggagaa

SEQ ID NO: 1264751 - RNA, 13 nt, Human
gggccaggcuggg

SEQ ID NO: 1264752 - RNA, 10 nt, Human
gggccaggcc

SEQ ID NO: 1264753 - RNA, 19 nt, Human
gggccaugcugaggccugg

SEQ ID NO: 1264754 - RNA, 20 nt, Human
gggccaugcugaggccuggg

SEQ ID NO: 1264755 - RNA, 18 nt, Human
gggccagauccagccugg

SEQ ID NO: 1264756 - RNA, 11 nt, Human
gggccagagcc

SEQ ID NO: 1264757 - RNA, 12 nt, Human
gggccagagcca

SEQ ID NO: 1264758 - RNA, 13 nt, Human
gggccagagccag

SEQ ID NO: 1264759 - RNA, 14 nt, Human
gggccagagccagg

SEQ ID NO: 1264760 - RNA, 15 nt, Human
gggccagagccaggg

SEQ ID NO: 1264761 - RNA, 12 nt, Human
gggccagaggcu

SEQ ID NO: 1264762 - RNA, 13 nt, Human
gggccagauccag

SEQ ID NO: 1264763 - RNA, 14 nt, Human
gggccagauccagc

SEQ ID NO: 1264764 - RNA, 16 nt, Human
gggccagauccagccu

SEQ ID NO: 1264765 - RNA, 17 nt, Human
gggccagauccagccug

SEQ ID NO: 1264766 - RNA, 19 nt, Human
gggccagauccagccuggg

SEQ ID NO: 1264767 - RNA, 23 nt, Human
gggccaugcugaggccugggccg

SEQ ID NO: 1264768 - RNA, 21 nt, Human
gggccaugcugaggccugggc

SEQ ID NO: 1264769 - RNA, 14 nt, Human
gggccauguccaaa

SEQ ID NO: 1264770 - RNA, 15 nt, Human
gggccauguccaaag

SEQ ID NO: 1264771 - RNA, 16 nt, Human
gggccauguccaaaga

SEQ ID NO: 1264772 - RNA, 17 nt, Human
gggccauguccaaagag

SEQ ID NO: 1264773 - RNA, 21 nt, Human
gggccauguccaaagaggcug

SEQ ID NO: 1264774 - RNA, 22 nt, Human
gggccauguccaaagaggcugc

SEQ ID NO: 1264775 - RNA, 23 nt, Human
gggccauguccaaagaggcugcc

SEQ ID NO: 1264776 - RNA, 16 nt, Human
gggccauucuccacag

SEQ ID NO: 1264777 - RNA, 18 nt, Human
gggccauucuccacagca

SEQ ID NO: 1264778 - RNA, 17 nt, Human
gggccgccgccucuuuc

SEQ ID NO: 1264779 - RNA, 12 nt, Human
gggccgcugcca

SEQ ID NO: 1264780 - RNA, 16 nt, Human
gggccggggaacuggc

SEQ ID NO: 1264781 - RNA, 17 nt, Human
gggccggggaacuggcc

SEQ ID NO: 1264782 - RNA, 19 nt, Human
gggccggggaacuggccaa

SEQ ID NO: 1264783 - RNA, 20 nt, Human
gggccggggaacuggccaag

SEQ ID NO: 1264784 - RNA, 23 nt, Human
gggccggggaacuggccaagcug

SEQ ID NO: 1264785 - RNA, 18 nt, Human
gggcgugagaccugcccc

SEQ ID NO: 1264786 - RNA, 19 nt, Human
gggcgugagaccugccccu

SEQ ID NO: 1264787 - RNA, 15 nt, Human
gggcgugguggugag

SEQ ID NO: 1264788 - RNA, 22 nt, Human
gggcuacccugagcugaggcag

SEQ ID NO: 1264789 - RNA, 20 nt, Human
gggccugcugcugagaaccu

SEQ ID NO: 1264790 - RNA, 16 nt, Human
gggccugccaccugga

SEQ ID NO: 1264791 - RNA, 18 nt, Human
gggccugccaccuggacc

SEQ ID NO: 1264792 - RNA, 19 nt, Human
gggccugccaccuggaccc

SEQ ID NO: 1264793 - RNA, 23 nt, Human
gggccugccaccuggaccccugc

SEQ ID NO: 1264794 - RNA, 14 nt, Human
gggccugcccagug

SEQ ID NO: 1264795 - RNA, 12 nt, Human
gggccugccuca

SEQ ID NO: 1264796 - RNA, 14 nt, Human
gggccugccucacc

SEQ ID NO: 1264797 - RNA, 15 nt, Human
gggccugccucacca

SEQ ID NO: 1264798 - RNA, 13 nt, Human
gggccugcuccag

SEQ ID NO: 1264799 - RNA, 14 nt, Human
gggccugcuccaga

SEQ ID NO: 1264800 - RNA, 15 nt, Human
gggccugcuccagac

SEQ ID NO: 1264801 - RNA, 17 nt, Human
gggccugcuccagaccu

SEQ ID NO: 1264802 - RNA, 18 nt, Human
gggccugcuccagaccug

SEQ ID NO: 1264803 - RNA, 11 nt, Human
gggccugcugc

SEQ ID NO: 1264804 - RNA, 12 nt, Human
gggccugcugcu

SEQ ID NO: 1264805 - RNA, 13 nt, Human
gggccugcugcug

SEQ ID NO: 1264806 - RNA, 15 nt, Human
gggccugcugcugag

SEQ ID NO: 1264807 - RNA, 16 nt, Human
gggccugcugcugaga

SEQ ID NO: 1264808 - RNA, 17 nt, Human
gggccugcugcugagaa

SEQ ID NO: 1264809 - RNA, 18 nt, Human
gggccugcugcugagaac

SEQ ID NO: 1264810 - RNA, 19 nt, Human
gggccugcugcugagaacc

SEQ ID NO: 1264811 - RNA, 20 nt, Human
gggccucaccgagugggggc

SEQ ID NO: 1264812 - RNA, 11 nt, Human
gggccugccac

SEQ ID NO: 1264813 - RNA, 13 nt, Human
gggccugccaccu

SEQ ID NO: 1264814 - RNA, 15 nt, Human
gcccccugcaggaag

SEQ ID NO: 1264815 - RNA, 16 nt, Human
gcccccugcaggaagg

SEQ ID NO: 1264816 - RNA, 18 nt, Human
gcccccugcaggaaggag

SEQ ID NO: 1264817 - RNA, 20 nt, Human
gcccccugcaggaaggagcu

SEQ ID NO: 1264818 - RNA, 21 nt, Human
gcccccugcaggaaggagcug

SEQ ID NO: 1264819 - RNA, 22 nt, Human
gcccccugcaggaaggagcugc

SEQ ID NO: 1264820 - RNA, 24 nt, Human
gcccccugcaggaaggagcugccu

SEQ ID NO: 1264821 - RNA, 17 nt, Human
gcccccucugcccugcg

SEQ ID NO: 1264822 - RNA, 17 nt, Human
gcccccugaccacucag

SEQ ID NO: 1264823 - RNA, 18 nt, Human
gcccccugaccacucaga

SEQ ID NO: 1264824 - RNA, 19 nt, Human
gcccccugaccacucagag

SEQ ID NO: 1264825 - RNA, 20 nt, Human
gcccccugaccacucagaga

SEQ ID NO: 1264826 - RNA, 11 nt, Human
gcccccugcag

SEQ ID NO: 1264827 - RNA, 12 nt, Human
gcccccugcaga

SEQ ID NO: 1264828 - RNA, 12 nt, Human
gcccccugcagg

SEQ ID NO: 1264829 - RNA, 13 nt, Human
gcccccugcagga

SEQ ID NO: 1264830 - RNA, 15 nt, Human
gcccccucugcccug

SEQ ID NO: 1264831 - RNA, 16 nt, Human
gcccccucugcccugc

SEQ ID NO: 1264832 - RNA, 21 nt, Human
gcccccagcuaagaaccugga

SEQ ID NO: 1264833 - RNA, 22 nt, Human
gcccccagcuaagaaccuggaa

SEQ ID NO: 1264834 - RNA, 23 nt, Human
gcccccagcuaagaaccuggaac

SEQ ID NO: 1264835 - RNA, 15 nt, Human
gcccccagagccaca

SEQ ID NO: 1264836 - RNA, 16 nt, Human
gcccccagagccacag

SEQ ID NO: 1264837 - RNA, 17 nt, Human
gcccccagagccacagu

SEQ ID NO: 1264838 - RNA, 13 nt, Human
gcccccagagccc

SEQ ID NO: 1264839 - RNA, 16 nt, Human
gcccccagagcccagg

SEQ ID NO: 1264840 - RNA, 17 nt, Human
gcccccagagcccaggc

SEQ ID NO: 1264841 - RNA, 19 nt, Human
gcccccagagcccaggcuc

SEQ ID NO: 1264842 - RNA, 17 nt, Human
gcccccagcccagggcu

SEQ ID NO: 1264843 - RNA, 18 nt, Human
gcccccagcccagggcuc

SEQ ID NO: 1264844 - RNA, 21 nt, Human
gcccccagcccagggcuccug

SEQ ID NO: 1264845 - RNA, 22 nt, Human
gcccccagcccagggcuccugc

SEQ ID NO: 1264846 - RNA, 18 nt, Human
gcccccagagcccaggcu

SEQ ID NO: 1264847 - RNA, 15 nt, Human
gcccccagcccccuc

SEQ ID NO: 1264848 - RNA, 18 nt, Human
gcccccagcccccuccug

SEQ ID NO: 1264849 - RNA, 12 nt, Human
gcccccagccug

SEQ ID NO: 1264850 - RNA, 13 nt, Human
gcccccagccugu

SEQ ID NO: 1264851 - RNA, 14 nt, Human
gcccccagccuguc

SEQ ID NO: 1264852 - RNA, 16 nt, Human
gcccccagccugucag

SEQ ID NO: 1264853 - RNA, 21 nt, Human
gcccccagccugucagaucca

SEQ ID NO: 1264854 - RNA, 22 nt, Human
gcccccagccugucagauccag

SEQ ID NO: 1264855 - RNA, 15 nt, Human
gcccccagcuaagaa

SEQ ID NO: 1264856 - RNA, 11 nt, Human
gccccaaaagg

SEQ ID NO: 1264857 - RNA, 15 nt, Human
gccccaacccgugga

SEQ ID NO: 1264858 - RNA, 17 nt, Human
gccccaacccguggagg

SEQ ID NO: 1264859 - RNA, 19 nt, Human
gccccaacccguggaggcu

SEQ ID NO: 1264860 - RNA, 21 nt, Human
gccccaacccguggaggcugc

SEQ ID NO: 1264861 - RNA, 23 nt, Human
gccccaacccguggaggcugcuc

SEQ ID NO: 1264862 - RNA, 22 nt, Human
gccccaacccguggaggcugcu

SEQ ID NO: 1264863 - RNA, 14 nt, Human
gcccccacuugccu

SEQ ID NO: 1264864 - RNA, 16 nt, Human
gcccccacuugccucu

SEQ ID NO: 1264865 - RNA, 17 nt, Human
gcccccacuugccucuu

SEQ ID NO: 1264866 - RNA, 21 nt, Human
gcccccacuugccucuuccuu

SEQ ID NO: 1264867 - RNA, 11 nt, Human
gcccccagagc

SEQ ID NO: 1264868 - RNA, 14 nt, Human
gccauuaacaaaug

SEQ ID NO: 1264869 - RNA, 13 nt, Human
gcauuuagaugua

SEQ ID NO: 1264870 - RNA, 19 nt, Human
gcauuuaggccaugggaca

SEQ ID NO: 1264871 - RNA, 12 nt, Human
gcauuuagaugu

SEQ ID NO: 1264872 - RNA, 19 nt, Human
gccauucuuucccaacacc

SEQ ID NO: 1264873 - RNA, 12 nt, Human
gccauucuuucc

SEQ ID NO: 1264874 - RNA, 17 nt, Human
gccauugacuucuuccc

SEQ ID NO: 1264875 - RNA, 22 nt, Human
gcccacuguacuugcucuugau

SEQ ID NO: 1264876 - RNA, 17 nt, Human
gcccacgcucacccccu

SEQ ID NO: 1264877 - RNA, 15 nt, Human
gcccacuguccuggg

SEQ ID NO: 1264878 - RNA, 20 nt, Human
gcccacuguacuugcucuug

SEQ ID NO: 1264879 - RNA, 15 nt, Human
gcccacuguacuugc

SEQ ID NO: 1264880 - RNA, 20 nt, Human
gccauuggcuauuuaaaacu

SEQ ID NO: 1264881 - RNA, 20 nt, Human
gcccacugugccucagagac

SEQ ID NO: 1264882 - RNA, 22 nt, Human
gcccacugugccucagagacca

SEQ ID NO: 1264883 - RNA, 23 nt, Human
gcccacugugccucagagaccag

SEQ ID NO: 1264884 - RNA, 19 nt, Human
gcccacuuacauuuacaaa

SEQ ID NO: 1264885 - RNA, 17 nt, Human
gcccacuguccugggcc

SEQ ID NO: 1264886 - RNA, 18 nt, Human
gcccacuguccugggccu

SEQ ID NO: 1264887 - RNA, 21 nt, Human
gcccacuguccugggccugca

SEQ ID NO: 1264888 - RNA, 23 nt, Human
gcccacuguccugggccugcaga

SEQ ID NO: 1264889 - RNA, 24 nt, Human
gcccacuguccugggccugcagaa

SEQ ID NO: 1264890 - RNA, 16 nt, Human
gcccacugugccucag

SEQ ID NO: 1264891 - RNA, 11 nt, Human
gcccaggaagu

SEQ ID NO: 1264892 - RNA, 18 nt, Human
gcccaggaagucucaucu

SEQ ID NO: 1264893 - RNA, 20 nt, Human
gcccaggaagucucaucugg

SEQ ID NO: 1264894 - RNA, 15 nt, Human
gcccaggcacugcaa

SEQ ID NO: 1264895 - RNA, 15 nt, Human
gcccaggauacuggc

SEQ ID NO: 1264896 - RNA, 17 nt, Human
gcccaggauacuggcac

SEQ ID NO: 1264897 - RNA, 20 nt, Human
gcccaggauacuggcacaga

SEQ ID NO: 1264898 - RNA, 23 nt, Human
gcccaggauacuggcacagaggu

SEQ ID NO: 1264899 - RNA, 22 nt, Human
gcccaggauacuggcacagagg

SEQ ID NO: 1264900 - RNA, 21 nt, Human
gcccaggaagucucaucuggg

SEQ ID NO: 1264901 - RNA, 21 nt, Human
gcccaggaccccauggcagug

SEQ ID NO: 1264902 - RNA, 13 nt, Human
gcccaggacccca

SEQ ID NO: 1264903 - RNA, 16 nt, Human
gcccaggcacugcaaa

SEQ ID NO: 1264904 - RNA, 11 nt, Human
gcccaggccag

SEQ ID NO: 1264905 - RNA, 15 nt, Human
gcccaggccaggacu

SEQ ID NO: 1264906 - RNA, 16 nt, Human
gcccaggccaggacuc

SEQ ID NO: 1264907 - RNA, 19 nt, Human
gcccaggccaggacucugc

SEQ ID NO: 1264908 - RNA, 20 nt, Human
gcccaggccaggacucugca

SEQ ID NO: 1264909 - RNA, 21 nt, Human
gcccaggccaggacucugcag

SEQ ID NO: 1264910 - RNA, 22 nt, Human
gcccaggccaggacucugcagc

SEQ ID NO: 1264911 - RNA, 24 nt, Human
gcccaggccaggacucugcagccu

SEQ ID NO: 1264912 - RNA, 23 nt, Human
gcccaggccaggacucugcagcc

SEQ ID NO: 1264913 - RNA, 20 nt, Human
gccuacagaacuucagaaag

SEQ ID NO: 1264914 - RNA, 21 nt, Human
gccuacagaacuucagaaaga

SEQ ID NO: 1264915 - RNA, 12 nt, Human
gccuagaaacaa

SEQ ID NO: 1264916 - RNA, 16 nt, Human
gccuagaaacaacacu

SEQ ID NO: 1264917 - RNA, 18 nt, Human
gccuagaaacaacacugu

SEQ ID NO: 1264918 - RNA, 20 nt, Human
gccuagaaacaacacuguag

SEQ ID NO: 1264919 - RNA, 14 nt, Human
gccuagaccagcag

SEQ ID NO: 1264920 - RNA, 16 nt, Human
gccuagaccagcagac

SEQ ID NO: 1264921 - RNA, 22 nt, Human
gccuagaccagcagacagagcc

SEQ ID NO: 1264922 - RNA, 23 nt, Human
gccuagaccagcagacagagcca

SEQ ID NO: 1264923 - RNA, 13 nt, Human
gccuagaggccug

SEQ ID NO: 1264924 - RNA, 13 nt, Human
gccuagacucugu

SEQ ID NO: 1264925 - RNA, 19 nt, Human
gccuccugaguagcuggga

SEQ ID NO: 1264926 - RNA, 16 nt, Human
gccucgaaacacagaa

SEQ ID NO: 1264927 - RNA, 15 nt, Human
gccuccauccugagg

SEQ ID NO: 1264928 - RNA, 14 nt, Human
gccuccauccugag

SEQ ID NO: 1264929 - RNA, 13 nt, Human
gccuccauccuga

SEQ ID NO: 1264930 - RNA, 15 nt, Human
gccucauguggcugg

SEQ ID NO: 1264931 - RNA, 16 nt, Human
gccucauguggcugga

SEQ ID NO: 1264932 - RNA, 17 nt, Human
gccucauguggcuggaa

SEQ ID NO: 1264933 - RNA, 22 nt, Human
gccucauguccacugguucuuc

SEQ ID NO: 1264934 - RNA, 19 nt, Human
gccucaugucaaauauuua

SEQ ID NO: 1264935 - RNA, 13 nt, Human
gccucauguggcu

SEQ ID NO: 1264936 - RNA, 14 nt, Human
gccucauguggcug

SEQ ID NO: 1264937 - RNA, 19 nt, Human
gccucaugcuaagacucag

SEQ ID NO: 1264938 - RNA, 20 nt, Human
gcccugccaccugucugucu

SEQ ID NO: 1264939 - RNA, 11 nt, Human
gcccugccacu

SEQ ID NO: 1264940 - RNA, 12 nt, Human
gcccugccacuc

SEQ ID NO: 1264941 - RNA, 13 nt, Human
gcccugccacuca

SEQ ID NO: 1264942 - RNA, 19 nt, Human
gcccugccacucacuaggc

SEQ ID NO: 1264943 - RNA, 20 nt, Human
gcccugccacucacuaggcc

SEQ ID NO: 1264944 - RNA, 21 nt, Human
gcccugccacucacuaggccc

SEQ ID NO: 1264945 - RNA, 23 nt, Human
gcccccugcaggaaggagcugcc

SEQ ID NO: 1264946 - RNA, 13 nt, Human
gcccccugccccc

SEQ ID NO: 1264947 - RNA, 15 nt, Human
gcccguccugccugu

SEQ ID NO: 1264948 - RNA, 16 nt, Human
gcccguccugccugug

SEQ ID NO: 1264949 - RNA, 17 nt, Human
gcccguccugccugugg

SEQ ID NO: 1264950 - RNA, 18 nt, Human
gcccguccugccuguggc

SEQ ID NO: 1264951 - RNA, 13 nt, Human
gcccgucucagug

SEQ ID NO: 1264952 - RNA, 14 nt, Human
gcccgucucagugu

SEQ ID NO: 1264953 - RNA, 17 nt, Human
gccggaucugagggaga

SEQ ID NO: 1264954 - RNA, 15 nt, Human
gccggaucugaggga

SEQ ID NO: 1264955 - RNA, 13 nt, Human
gccggcacagggu

SEQ ID NO: 1264956 - RNA, 21 nt, Human
gccggcacagggucugcucuu

SEQ ID NO: 1264957 - RNA, 12 nt, Human
gcccuuccaugu

SEQ ID NO: 1264958 - RNA, 21 nt, Human
gcccuuccaugucgccucugc

SEQ ID NO: 1264959 - RNA, 15 nt, Human
gcccuuccaaacucu

SEQ ID NO: 1264960 - RNA, 22 nt, Human
gcccuuccaugucgccucugca

SEQ ID NO: 1264961 - RNA, 12 nt, Human
gcccuuccucuc

SEQ ID NO: 1264962 - RNA, 14 nt, Human
gcccuuccucucca

SEQ ID NO: 1264963 - RNA, 15 nt, Human
gcccuuccucuccac

SEQ ID NO: 1264964 - RNA, 11 nt, Human
gcccugccugg

SEQ ID NO: 1264965 - RNA, 12 nt, Human
gcccugccugga

SEQ ID NO: 1264966 - RNA, 13 nt, Human
gcccugccuggag

SEQ ID NO: 1264967 - RNA, 14 nt, Human
gcccugccuggagg

SEQ ID NO: 1264968 - RNA, 15 nt, Human
gcccugccuggagga

SEQ ID NO: 1264969 - RNA, 16 nt, Human
gcccugccuggaggac

SEQ ID NO: 1264970 - RNA, 18 nt, Human
gcccugccuggaggaccu

SEQ ID NO: 1264971 - RNA, 19 nt, Human
gcccugccuggaggaccug

SEQ ID NO: 1264972 - RNA, 20 nt, Human
gcccugcgggucacaggagg

SEQ ID NO: 1264973 - RNA, 20 nt, Human
gcccugccuggaggaccuga

SEQ ID NO: 1264974 - RNA, 21 nt, Human
gcccugccuggaggaccugag

SEQ ID NO: 1264975 - RNA, 23 nt, Human
gcccugccuggaggaccugagcc

SEQ ID NO: 1264976 - RNA, 18 nt, Human
gcccugcgguagauggga

SEQ ID NO: 1264977 - RNA, 22 nt, Human
gcccugccuggaggaccugagc

SEQ ID NO: 1264978 - RNA, 19 nt, Human
gcccuuaugacugccaaga

SEQ ID NO: 1264979 - RNA, 17 nt, Human
gcccuuauuuucaagaa

SEQ ID NO: 1264980 - RNA, 18 nt, Human
gcccuuauuuucaagaaa

SEQ ID NO: 1264981 - RNA, 20 nt, Human
gcccuuauuuucaagaaacu

SEQ ID NO: 1264982 - RNA, 16 nt, Human
gcucagagcaguguuu

SEQ ID NO: 1264983 - RNA, 18 nt, Human
gcucagaggcgcacugug

SEQ ID NO: 1264984 - RNA, 19 nt, Human
gcucagaggcgcacuguga

SEQ ID NO: 1264985 - RNA, 20 nt, Human
gcucagaggcgcacugugac

SEQ ID NO: 1264986 - RNA, 21 nt, Human
gcucagaggcgcacugugacc

SEQ ID NO: 1264987 - RNA, 17 nt, Human
gcucagaaaauaucccu

SEQ ID NO: 1264988 - RNA, 18 nt, Human
gcucagaaguuucuucuu

SEQ ID NO: 1264989 - RNA, 15 nt, Human
gcucacuucugggcu

SEQ ID NO: 1264990 - RNA, 23 nt, Human
gcucacuucugggcuucaucugg

SEQ ID NO: 1264991 - RNA, 15 nt, Human
gcucaacuugcaaaa

SEQ ID NO: 1264992 - RNA, 23 nt, Human
gcucaacucucuuauugccucac

SEQ ID NO: 1264993 - RNA, 15 nt, Human
gcucaagcagcgacc

SEQ ID NO: 1264994 - RNA, 21 nt, Human
gcucaagcagcgaccgccccc

SEQ ID NO: 1264995 - RNA, 22 nt, Human
gcucaagcagcgaccgcccccu

SEQ ID NO: 1264996 - RNA, 23 nt, Human
gcucaagcagcgaccgcccccuc

SEQ ID NO: 1264997 - RNA, 23 nt, Human
gcucaggagcccugggaggcucu

SEQ ID NO: 1264998 - RNA, 22 nt, Human
gcucaggagcccugggaggcuc

SEQ ID NO: 1264999 - RNA, 18 nt, Human
gcucagaggguguccugc

SEQ ID NO: 1265000 - RNA, 19 nt, Human
gcucagaggguguccugca

SEQ ID NO: 1265001 - RNA, 22 nt, Human
gcuaaguacacaauaagcaaaa

SEQ ID NO: 1265002 - RNA, 21 nt, Human
gcuaaguacacaauaagcaaa

SEQ ID NO: 1265003 - RNA, 20 nt, Human
gcuaaguacacaauaagcaa

SEQ ID NO: 1265004 - RNA, 16 nt, Human
gcuaagguucuaaggc

SEQ ID NO: 1265005 - RNA, 17 nt, Human
gcuaagguucuaaggcc

SEQ ID NO: 1265006 - RNA, 15 nt, Human
gcuaagggguggggc

SEQ ID NO: 1265007 - RNA, 16 nt, Human
gcuaagggguggggcu

SEQ ID NO: 1265008 - RNA, 14 nt, Human
gcuaagguucuaag

SEQ ID NO: 1265009 - RNA, 15 nt, Human
gcuaagguucuaagg

SEQ ID NO: 1265010 - RNA, 21 nt, Human
gcuaguaauuggaaaggcagc

SEQ ID NO: 1265011 - RNA, 22 nt, Human
gcuaguuauacuuauuuguaua

SEQ ID NO: 1265012 - RNA, 17 nt, Human
gcuaggguggggagaga

SEQ ID NO: 1265013 - RNA, 18 nt, Human
gcuaggguggggagagac

SEQ ID NO: 1265014 - RNA, 19 nt, Human
gcuauguuuugacauuuuu

SEQ ID NO: 1265015 - RNA, 16 nt, Human
gcuauguuuuuaaugu

SEQ ID NO: 1265016 - RNA, 18 nt, Human
gcuauguuuuuaauguau

SEQ ID NO: 1265017 - RNA, 20 nt, Human
gcucaaacaaugacaaagca

SEQ ID NO: 1265018 - RNA, 21 nt, Human
gcucaaacaaugacaaagcag

SEQ ID NO: 1265019 - RNA, 22 nt, Human
gcucaaacaaugacaaagcaga

SEQ ID NO: 1265020 - RNA, 23 nt, Human
gcucaaacaaugacaaagcagau

SEQ ID NO: 1265021 - RNA, 22 nt, Human
gcucaaagguuuggaaggagca

SEQ ID NO: 1265022 - RNA, 23 nt, Human
gcucaaagguuuggaaggagcag

SEQ ID NO: 1265023 - RNA, 18 nt, Human
gcuauuauuuucacugua

SEQ ID NO: 1265024 - RNA, 21 nt, Human
gcuauuauuuucacuguagaa

SEQ ID NO: 1265025 - RNA, 17 nt, Human
gcuauuauuuucacugu

SEQ ID NO: 1265026 - RNA, 21 nt, Human
gcuaggaauuguguuuauaau

SEQ ID NO: 1265027 - RNA, 12 nt, Human
gcuaggaaugaa

SEQ ID NO: 1265028 - RNA, 13 nt, Human
gcuaggaaugaaa

SEQ ID NO: 1265029 - RNA, 18 nt, Human
gcuaggaaugaaauccug

SEQ ID NO: 1265030 - RNA, 23 nt, Human
gcuaggcucugucuggaagaugg

SEQ ID NO: 1265031 - RNA, 19 nt, Human
gccuucucuaaacauuuca

SEQ ID NO: 1265032 - RNA, 14 nt, Human
gccuucucuguuca

SEQ ID NO: 1265033 - RNA, 16 nt, Human
gccuucucuguucauu

SEQ ID NO: 1265034 - RNA, 14 nt, Human
gccuucuggccuug

SEQ ID NO: 1265035 - RNA, 19 nt, Human
gccuucugguguuggacaa

SEQ ID NO: 1265036 - RNA, 23 nt, Human
gccuucuuuugggggucaacagu

SEQ ID NO: 1265037 - RNA, 23 nt, Human
gccuguggccaugacccugccuc

SEQ ID NO: 1265038 - RNA, 19 nt, Human
gccuucgucuuucccaugg

SEQ ID NO: 1265039 - RNA, 17 nt, Human
gccuucucaugauccaa

SEQ ID NO: 1265040 - RNA, 21 nt, Human
gccuggcuggcugagggcagu

SEQ ID NO: 1265041 - RNA, 22 nt, Human
gccuguggccaugacccugccu

SEQ ID NO: 1265042 - RNA, 17 nt, Human
gccucugggggguggcc

SEQ ID NO: 1265043 - RNA, 20 nt, Human
gccucugggggguggccagg

SEQ ID NO: 1265044 - RNA, 23 nt, Human
gccucugggggguggccaggccg

SEQ ID NO: 1265045 - RNA, 21 nt, Human
gccucugggggguggccaggc

SEQ ID NO: 1265046 - RNA, 16 nt, Human
gccuggcuccguccag

SEQ ID NO: 1265047 - RNA, 21 nt, Human
gccuggcugcugaucgccuuc

SEQ ID NO: 1265048 - RNA, 12 nt, Human
gccuggcuggcu

SEQ ID NO: 1265049 - RNA, 14 nt, Human
gccuggcuggcuga

SEQ ID NO: 1265050 - RNA, 15 nt, Human
gccuggcuggcugag

SEQ ID NO: 1265051 - RNA, 16 nt, Human
gccuggcuggcugagg

SEQ ID NO: 1265052 - RNA, 17 nt, Human
gccuggcuggcugaggg

SEQ ID NO: 1265053 - RNA, 18 nt, Human
gccuggcuggcugagggc

SEQ ID NO: 1265054 - RNA, 20 nt, Human
gccuggcuggcugagggcag

SEQ ID NO: 1265055 - RNA, 12 nt, Human
gccuugccagag

SEQ ID NO: 1265056 - RNA, 13 nt, Human
gccuugccagaga

SEQ ID NO: 1265057 - RNA, 14 nt, Human
gcgcaggcuggccc

SEQ ID NO: 1265058 - RNA, 19 nt, Human
gcgcaggccgugacgucug

SEQ ID NO: 1265059 - RNA, 15 nt, Human
gcgcaggcuggcccu

SEQ ID NO: 1265060 - RNA, 16 nt, Human
gcgcaggcuggcccug

SEQ ID NO: 1265061 - RNA, 16 nt, Human
gcguucuuguaauuuu

SEQ ID NO: 1265062 - RNA, 17 nt, Human
gcguucuuguaauuuua

SEQ ID NO: 1265063 - RNA, 22 nt, Human
gcguucuuguaauuuuacacgc

SEQ ID NO: 1265064 - RNA, 11 nt, Human
gcuaaggcucu

SEQ ID NO: 1265065 - RNA, 16 nt, Human
gcguuccuuucuuuuc

SEQ ID NO: 1265066 - RNA, 11 nt, Human
gcguucuugua

SEQ ID NO: 1265067 - RNA, 14 nt, Human
gcguucuuguaauu

SEQ ID NO: 1265068 - RNA, 15 nt, Human
gcguucuuguaauuu

SEQ ID NO: 1265069 - RNA, 13 nt, Human
gcguuccuuucuu

SEQ ID NO: 1265070 - RNA, 15 nt, Human
gcguuccuuucuuuu

SEQ ID NO: 1265071 - RNA, 22 nt, Human
gcguuauuggucggcagccuuc

SEQ ID NO: 1265072 - RNA, 21 nt, Human
gcguuaacaguuccuuucaaa

SEQ ID NO: 1265073 - RNA, 16 nt, Human
gcggcuggccauggag

SEQ ID NO: 1265074 - RNA, 18 nt, Human
gcggcuggccauggagaa

SEQ ID NO: 1265075 - RNA, 19 nt, Human
gcggcuggccauggagaaa

SEQ ID NO: 1265076 - RNA, 20 nt, Human
gcggcuggccauggagaaag

SEQ ID NO: 1265077 - RNA, 13 nt, Human
gcggcugggagga

SEQ ID NO: 1265078 - RNA, 17 nt, Human
gcggcuggggucccagc

SEQ ID NO: 1265079 - RNA, 18 nt, Human
gcggcuggggucccagca

SEQ ID NO: 1265080 - RNA, 19 nt, Human
gcggcuggggucccagcag

SEQ ID NO: 1265081 - RNA, 20 nt, Human
gcggcuggggucccagcagc

SEQ ID NO: 1265082 - RNA, 21 nt, Human
gcggcuggggucccagcagcu

SEQ ID NO: 1265083 - RNA, 22 nt, Human
gcggcuggggucccagcagcug

SEQ ID NO: 1265084 - RNA, 12 nt, Human
gcggcugugugu

SEQ ID NO: 1265085 - RNA, 21 nt, Human
gcgggagccaugcgcccccuc

SEQ ID NO: 1265086 - RNA, 21 nt, Human
gcguggaacucgugucuggca

SEQ ID NO: 1265087 - RNA, 13 nt, Human
gcggauggccgga

SEQ ID NO: 1265088 - RNA, 16 nt, Human
gcggcagauggggaga

SEQ ID NO: 1265089 - RNA, 12 nt, Human
gcggcuccucag

SEQ ID NO: 1265090 - RNA, 14 nt, Human
gcggcuccucaggg

SEQ ID NO: 1265091 - RNA, 15 nt, Human
gcggcaggggccugg

SEQ ID NO: 1265092 - RNA, 16 nt, Human
gcggcaggggccugga

SEQ ID NO: 1265093 - RNA, 19 nt, Human
gcggcaggggccuggagau

SEQ ID NO: 1265094 - RNA, 13 nt, Human
gcggcaucaggcu

SEQ ID NO: 1265095 - RNA, 14 nt, Human
gcuuuggaagccau

SEQ ID NO: 1265096 - RNA, 21 nt, Human
gcuuuggaaguuuagcucuga

SEQ ID NO: 1265097 - RNA, 23 nt, Human
gcuuuggaaguuuagcucugaga

SEQ ID NO: 1265098 - RNA, 14 nt, Human
gcuuuggaaguuuu

SEQ ID NO: 1265099 - RNA, 18 nt, Human
gcuuugcccugcugcccu

SEQ ID NO: 1265100 - RNA, 19 nt, Human
gcuuugcccugcugcccuc

SEQ ID NO: 1265101 - RNA, 23 nt, Human
gcuuugcccugcugcccuccccc

SEQ ID NO: 1265102 - RNA, 17 nt, Human
gcuuugcccuucuuucu

SEQ ID NO: 1265103 - RNA, 16 nt, Human
gcuuugcuaccaaagc

SEQ ID NO: 1265104 - RNA, 13 nt, Human
gcuguuucaaagu

SEQ ID NO: 1265105 - RNA, 15 nt, Human
gcuguuuacuaggga

SEQ ID NO: 1265106 - RNA, 16 nt, Human
gcuguuuauuaaucuu

SEQ ID NO: 1265107 - RNA, 19 nt, Human
gcuguuugagauucucaaa

SEQ ID NO: 1265108 - RNA, 17 nt, Human
gcuuaaucagauagaua

SEQ ID NO: 1265109 - RNA, 15 nt, Human
gcuuaaucuuugaaa

SEQ ID NO: 1265110 - RNA, 11 nt, Human
gcuuuccugaa

SEQ ID NO: 1265111 - RNA, 12 nt, Human
gcuuuccugaau

SEQ ID NO: 1265112 - RNA, 22 nt, Human
gcuuuccugaauccaaacuaau

SEQ ID NO: 1265113 - RNA, 11 nt, Human
gcuuuccugcc

SEQ ID NO: 1265114 - RNA, 12 nt, Human
gcuuuccugccc

SEQ ID NO: 1265115 - RNA, 14 nt, Human
gcuuuccugcccca

SEQ ID NO: 1265116 - RNA, 17 nt, Human
gcuuuccugccccaggc

SEQ ID NO: 1265117 - RNA, 19 nt, Human
gcuuuccugccccaggccu

SEQ ID NO: 1265118 - RNA, 16 nt, Human
gcuuucgaacugcuag

SEQ ID NO: 1265119 - RNA, 21 nt, Human
gcuuugauguuccuuccagug

SEQ ID NO: 1265120 - RNA, 12 nt, Human
gcuuugauucau

SEQ ID NO: 1265121 - RNA, 15 nt, Human
gcuuugauucauagu

SEQ ID NO: 1265122 - RNA, 20 nt, Human
gcuuugauucauaguaacuu

SEQ ID NO: 1265123 - RNA, 20 nt, Human
gcuuuucccuuuuuuuaagu

SEQ ID NO: 1265124 - RNA, 21 nt, Human
gcuuuucccuuuuuuuaagua

SEQ ID NO: 1265125 - RNA, 16 nt, Human
gcuuuucccuuuguga

SEQ ID NO: 1265126 - RNA, 23 nt, Human
gcuuuugcgguucaggaaaauug

SEQ ID NO: 1265127 - RNA, 20 nt, Human
gcuuuugcccauuuugaauc

SEQ ID NO: 1265128 - RNA, 21 nt, Human
gcuuuugcccauuuugaauca

SEQ ID NO: 1265129 - RNA, 19 nt, Human
ggaaagcgccuccaacccu

SEQ ID NO: 1265130 - RNA, 16 nt, Human
ggaaagccccugcccc

SEQ ID NO: 1265131 - RNA, 21 nt, Human
ggaaagcuuuucuauuuuaau

SEQ ID NO: 1265132 - RNA, 23 nt, Human
ggaaagcgccuccaacccuagca

SEQ ID NO: 1265133 - RNA, 16 nt, Human
ggaaaggccagcacuc

SEQ ID NO: 1265134 - RNA, 12 nt, Human
ggaaaggccagc

SEQ ID NO: 1265135 - RNA, 19 nt, Human
ggaaagcagccuggccaac

SEQ ID NO: 1265136 - RNA, 16 nt, Human
ggaaagcaagaaucag

SEQ ID NO: 1265137 - RNA, 11 nt, Human
ggaaagcaggu

SEQ ID NO: 1265138 - RNA, 20 nt, Human
ggaaagcccauaugcuacca

SEQ ID NO: 1265139 - RNA, 21 nt, Human
ggaaagaagaaggugggagga

SEQ ID NO: 1265140 - RNA, 13 nt, Human
ggaaagcaaagca

SEQ ID NO: 1265141 - RNA, 16 nt, Human
ggaaagcaaagcacag

SEQ ID NO: 1265142 - RNA, 17 nt, Human
ggaaagcaaagcacaga

SEQ ID NO: 1265143 - RNA, 20 nt, Human
ggaaagcaaagcacagagag

SEQ ID NO: 1265144 - RNA, 21 nt, Human
ggaaagcaaagcacagagagu

SEQ ID NO: 1265145 - RNA, 21 nt, Human
ggaaagcaagaaucagagaag

SEQ ID NO: 1265146 - RNA, 16 nt, Human
ggaaaaaauaacaaug

SEQ ID NO: 1265147 - RNA, 21 nt, Human
gcuuuuguuuccuuuuucaga

SEQ ID NO: 1265148 - RNA, 17 nt, Human
gcuuuuuuuguguguau

SEQ ID NO: 1265149 - RNA, 21 nt, Human
gcuuuuuuuguguguauuugc

SEQ ID NO: 1265150 - RNA, 22 nt, Human
gcuuuuuuuguguguauuugcu

SEQ ID NO: 1265151 - RNA, 15 nt, Human
gcuuuuuuuuccuuc

SEQ ID NO: 1265152 - RNA, 18 nt, Human
gcuuuuggauuggacaaa

SEQ ID NO: 1265153 - RNA, 21 nt, Human
gcuuuugugggggacuguaag

SEQ ID NO: 1265154 - RNA, 11 nt, Human
gcuuuuggcaa

SEQ ID NO: 1265155 - RNA, 23 nt, Human
gcuuuugugggggacuguaaguu

SEQ ID NO: 1265156 - RNA, 23 nt, Human
gcuuuuguuuccuuuuucagaua

SEQ ID NO: 1265157 - RNA, 21 nt, Human
ggaaacagcaucuccaagcag

SEQ ID NO: 1265158 - RNA, 18 nt, Human
ggaaacaguugcauguag

SEQ ID NO: 1265159 - RNA, 17 nt, Human
ggaaacaguugcaugua

SEQ ID NO: 1265160 - RNA, 14 nt, Human
ggaaacucagggcu

SEQ ID NO: 1265161 - RNA, 16 nt, Human
ggaaacuccugugacc

SEQ ID NO: 1265162 - RNA, 17 nt, Human
ggaaacuccugugacca

SEQ ID NO: 1265163 - RNA, 17 nt, Human
ggaaacuggccauggcc

SEQ ID NO: 1265164 - RNA, 15 nt, Human
ggaaaucccuucaua

SEQ ID NO: 1265165 - RNA, 16 nt, Human
ggaaauccaggguggu

SEQ ID NO: 1265166 - RNA, 19 nt, Human
ggaaaucaggguuaguauu

SEQ ID NO: 1265167 - RNA, 13 nt, Human
ggaaaucuuaaac

SEQ ID NO: 1265168 - RNA, 16 nt, Human
ggaagccagcuuuccc

SEQ ID NO: 1265169 - RNA, 17 nt, Human
ggaagcccauccugacc

SEQ ID NO: 1265170 - RNA, 14 nt, Human
ggaagcccauccug

SEQ ID NO: 1265171 - RNA, 19 nt, Human
ggacacauguccaguggga

SEQ ID NO: 1265172 - RNA, 21 nt, Human
ggacacaguuccugggaacau

SEQ ID NO: 1265173 - RNA, 16 nt, Human
ggacaccccgacuuuu

SEQ ID NO: 1265174 - RNA, 13 nt, Human
ggacacaugucca

SEQ ID NO: 1265175 - RNA, 12 nt, Human
ggacacaugucc

SEQ ID NO: 1265176 - RNA, 16 nt, Human
ggacacaguuccuggg

SEQ ID NO: 1265177 - RNA, 17 nt, Human
ggacacaguuccuggga

SEQ ID NO: 1265178 - RNA, 18 nt, Human
ggacacaguuccugggaa

SEQ ID NO: 1265179 - RNA, 19 nt, Human
ggacacaguuccugggaac

SEQ ID NO: 1265180 - RNA, 13 nt, Human
ggacacaggccug

SEQ ID NO: 1265181 - RNA, 14 nt, Human
ggacacaggccugu

SEQ ID NO: 1265182 - RNA, 16 nt, Human
ggacacaggccugugu

SEQ ID NO: 1265183 - RNA, 23 nt, Human
ggacacaggccuguguagcugug

SEQ ID NO: 1265184 - RNA, 14 nt, Human
ggacacaguuccug

SEQ ID NO: 1265185 - RNA, 11 nt, Human
ggacacaggcc

SEQ ID NO: 1265186 - RNA, 12 nt, Human
ggacacaggccu

SEQ ID NO: 1265187 - RNA, 17 nt, Human
ggaaugagcugaaggug

SEQ ID NO: 1265188 - RNA, 19 nt, Human
ggaauacucuuauaucuau

SEQ ID NO: 1265189 - RNA, 12 nt, Human
ggaauacuuuuu

SEQ ID NO: 1265190 - RNA, 17 nt, Human
ggaauacuuuuuguuau

SEQ ID NO: 1265191 - RNA, 19 nt, Human
ggaauacugaacaucugag

SEQ ID NO: 1265192 - RNA, 14 nt, Human
ggaauagcauguca

SEQ ID NO: 1265193 - RNA, 17 nt, Human
ggaauagcaugucacua

SEQ ID NO: 1265194 - RNA, 15 nt, Human
ggaauauaauuguuu

SEQ ID NO: 1265195 - RNA, 14 nt, Human
ggaagccugcaguc

SEQ ID NO: 1265196 - RNA, 15 nt, Human
ggaagccguccuggc

SEQ ID NO: 1265197 - RNA, 20 nt, Human
ggaagccgugcucgccccag

SEQ ID NO: 1265198 - RNA, 13 nt, Human
ggaagccucagau

SEQ ID NO: 1265199 - RNA, 22 nt, Human
ggaagccucagauuccuuccca

SEQ ID NO: 1265200 - RNA, 20 nt, Human
ggaagcgcgagggccucaaa

SEQ ID NO: 1265201 - RNA, 17 nt, Human
ggacagucaccucaugg

SEQ ID NO: 1265202 - RNA, 18 nt, Human
ggacagucaccucaugga

SEQ ID NO: 1265203 - RNA, 21 nt, Human
ggacagucaccucauggaauu

SEQ ID NO: 1265204 - RNA, 20 nt, Human
ggacagguccucaguguccu

SEQ ID NO: 1265205 - RNA, 15 nt, Human
ggacagggcauggcc

SEQ ID NO: 1265206 - RNA, 15 nt, Human
ggacaggcuggcucc

SEQ ID NO: 1265207 - RNA, 23 nt, Human
ggacaggcuggcuccagaugcag

SEQ ID NO: 1265208 - RNA, 22 nt, Human
ggacagggcauggccagguggc

SEQ ID NO: 1265209 - RNA, 12 nt, Human
ggacaccugccc

SEQ ID NO: 1265210 - RNA, 11 nt, Human
ggacaccugcc

SEQ ID NO: 1265211 - RNA, 10 nt, Human
ggacaccugc

SEQ ID NO: 1265212 - RNA, 16 nt, Human
ggacaccuaggcuagg

SEQ ID NO: 1265213 - RNA, 13 nt, Human
ggacaccugcccu

SEQ ID NO: 1265214 - RNA, 16 nt, Human
ggacaccugcccugcc

SEQ ID NO: 1265215 - RNA, 15 nt, Human
ggacaccugcccugc

SEQ ID NO: 1265216 - RNA, 14 nt, Human
ggacaccugcccug

SEQ ID NO: 1265217 - RNA, 13 nt, Human
ggacaggcuggcu

SEQ ID NO: 1265218 - RNA, 15 nt, Human
ggacaucagcaaaca

SEQ ID NO: 1265219 - RNA, 14 nt, Human
ggacaucagcaaac

SEQ ID NO: 1265220 - RNA, 12 nt, Human
ggacaucagcaa

SEQ ID NO: 1265221 - RNA, 13 nt, Human
ggacauccuccuc

SEQ ID NO: 1265222 - RNA, 22 nt, Human
ggacaguuccagaagugugacu

SEQ ID NO: 1265223 - RNA, 20 nt, Human
ggacaguuuaccaguugccu

SEQ ID NO: 1265224 - RNA, 23 nt, Human
ggacaguuuaccaguugccuuuu

SEQ ID NO: 1265225 - RNA, 14 nt, Human
ggacaugcuuagca

SEQ ID NO: 1265226 - RNA, 16 nt, Human
ggacauccuccuccca

SEQ ID NO: 1265227 - RNA, 16 nt, Human
ggacaugcgguagcca

SEQ ID NO: 1265228 - RNA, 19 nt, Human
ggacaugcgguagccagca

SEQ ID NO: 1265229 - RNA, 21 nt, Human
ggacaugcgguagccagcaca

SEQ ID NO: 1265230 - RNA, 13 nt, Human
ggacaugcuuagc

SEQ ID NO: 1265231 - RNA, 20 nt, Human
gcuguauuuuaaaagaauga

SEQ ID NO: 1265232 - RNA, 21 nt, Human
gcuguauuuuaaaagaaugau

SEQ ID NO: 1265233 - RNA, 15 nt, Human
gcuguauagcugcuu

SEQ ID NO: 1265234 - RNA, 12 nt, Human
gcugugaggcug

SEQ ID NO: 1265235 - RNA, 13 nt, Human
gcugugaggcugu

SEQ ID NO: 1265236 - RNA, 14 nt, Human
gcugugaggcuguc

SEQ ID NO: 1265237 - RNA, 15 nt, Human
gcugugaggcugucc

SEQ ID NO: 1265238 - RNA, 16 nt, Human
gcugugaggcuguccu

SEQ ID NO: 1265239 - RNA, 17 nt, Human
gcugugaggcuguccug

SEQ ID NO: 1265240 - RNA, 18 nt, Human
gcugugaggcuguccugu

SEQ ID NO: 1265241 - RNA, 20 nt, Human
gcugugagucuuugguucua

SEQ ID NO: 1265242 - RNA, 22 nt, Human
gcugugagucuuugguucuaag

SEQ ID NO: 1265243 - RNA, 18 nt, Human
gcugugaguucucccugu

SEQ ID NO: 1265244 - RNA, 19 nt, Human
gcugugaguucucccugua

SEQ ID NO: 1265245 - RNA, 20 nt, Human
gcugugauacgaugcuucaa

SEQ ID NO: 1265246 - RNA, 16 nt, Human
gcuguaguaggcauuu

SEQ ID NO: 1265247 - RNA, 23 nt, Human
gcuguaguaggcauuuuuaccau

SEQ ID NO: 1265248 - RNA, 17 nt, Human
gcugugcgcccagggcu

SEQ ID NO: 1265249 - RNA, 16 nt, Human
gcugugcgugugugug

SEQ ID NO: 1265250 - RNA, 14 nt, Human
gcugugccucugcc

SEQ ID NO: 1265251 - RNA, 15 nt, Human
gcugugccucugccu

SEQ ID NO: 1265252 - RNA, 16 nt, Human
gcugugccucugccug

SEQ ID NO: 1265253 - RNA, 16 nt, Human
gcugugcgcccagggc

SEQ ID NO: 1265254 - RNA, 18 nt, Human
gcugugcgcccagggcug

SEQ ID NO: 1265255 - RNA, 16 nt, Human
gcugugcuauggugcu

SEQ ID NO: 1265256 - RNA, 17 nt, Human
gcugugcuauggugcuc

SEQ ID NO: 1265257 - RNA, 17 nt, Human
gcuguuguuaugaugug

SEQ ID NO: 1265258 - RNA, 19 nt, Human
gcuguuguuaugaugugcu

SEQ ID NO: 1265259 - RNA, 15 nt, Human
gcuguuguuaugaug

SEQ ID NO: 1265260 - RNA, 14 nt, Human
gcuguuguuaugau

SEQ ID NO: 1265261 - RNA, 13 nt, Human
gcuguuguuauga

SEQ ID NO: 1265262 - RNA, 21 nt, Human
gcugggaauggaggggcagag

SEQ ID NO: 1265263 - RNA, 17 nt, Human
gcugggccauguccaaa

SEQ ID NO: 1265264 - RNA, 19 nt, Human
gcugggccauguccaaaga

SEQ ID NO: 1265265 - RNA, 20 nt, Human
gcugggccauguccaaagag

SEQ ID NO: 1265266 - RNA, 12 nt, Human
gcuggcuggccu

SEQ ID NO: 1265267 - RNA, 15 nt, Human
gcuggcuugggcagc

SEQ ID NO: 1265268 - RNA, 15 nt, Human
gcuggcugagggcag

SEQ ID NO: 1265269 - RNA, 22 nt, Human
gcugggaacagugugcaaggca

SEQ ID NO: 1265270 - RNA, 14 nt, Human
gcugggccccugcc

SEQ ID NO: 1265271 - RNA, 13 nt, Human
gcugggccccugc

SEQ ID NO: 1265272 - RNA, 12 nt, Human
gcugggccccug

SEQ ID NO: 1265273 - RNA, 20 nt, Human
gcugggccccugccucucug

SEQ ID NO: 1265274 - RNA, 18 nt, Human
gcugggccccugccucuc

SEQ ID NO: 1265275 - RNA, 14 nt, Human
gcugguagagcagg

SEQ ID NO: 1265276 - RNA, 15 nt, Human
gcugguaucucagaa

SEQ ID NO: 1265277 - RNA, 15 nt, Human
gcugcucuuggcugg

SEQ ID NO: 1265278 - RNA, 18 nt, Human
gcugcucuuggcuggacc

SEQ ID NO: 1265279 - RNA, 21 nt, Human
gcugcucuuggcuggacccag

SEQ ID NO: 1265280 - RNA, 22 nt, Human
gcugcucuuggcuggacccagc

SEQ ID NO: 1265281 - RNA, 23 nt, Human
gcugcucuuggcuggacccagcc

SEQ ID NO: 1265282 - RNA, 11 nt, Human
gcuggcugccu

SEQ ID NO: 1265283 - RNA, 16 nt, Human
gcuggcugagggcagu

SEQ ID NO: 1265284 - RNA, 14 nt, Human
gcuggcugccuuag

SEQ ID NO: 1265285 - RNA, 20 nt, Human
gcuggcugccuuagaaccuu

SEQ ID NO: 1265286 - RNA, 13 nt, Human
gcuggcucugagc

SEQ ID NO: 1265287 - RNA, 16 nt, Human
gcuggcucugagcgcc

SEQ ID NO: 1265288 - RNA, 19 nt, Human
gcuggcucugugagggugc

SEQ ID NO: 1265289 - RNA, 20 nt, Human
gcuggagagcauagggucug

SEQ ID NO: 1265290 - RNA, 19 nt, Human
gcugaggccacacucagca

SEQ ID NO: 1265291 - RNA, 21 nt, Human
gcugaggccacacucagcaca

SEQ ID NO: 1265292 - RNA, 15 nt, Human
gcugaggugcccagg

SEQ ID NO: 1265293 - RNA, 16 nt, Human
gcugaggugcccagga

SEQ ID NO: 1265294 - RNA, 17 nt, Human
gcugaggugcccaggag

SEQ ID NO: 1265295 - RNA, 18 nt, Human
gcugaggugcccaggaga

SEQ ID NO: 1265296 - RNA, 13 nt, Human
gcugaggcagcag

SEQ ID NO: 1265297 - RNA, 23 nt, Human
gcugaggcagcagugugaggcca

SEQ ID NO: 1265298 - RNA, 18 nt, Human
gcugagcaaaucaccaca

SEQ ID NO: 1265299 - RNA, 12 nt, Human
gcugagcaggcc

SEQ ID NO: 1265300 - RNA, 14 nt, Human
gcugagcaggccac

SEQ ID NO: 1265301 - RNA, 13 nt, Human
gcugagcagggcc

SEQ ID NO: 1265302 - RNA, 14 nt, Human
gcugagcagggccg

SEQ ID NO: 1265303 - RNA, 16 nt, Human
gcugagcagggccggg

SEQ ID NO: 1265304 - RNA, 20 nt, Human
gcugaggugcccaggagaag

SEQ ID NO: 1265305 - RNA, 12 nt, Human
gcugcaagguac

SEQ ID NO: 1265306 - RNA, 20 nt, Human
gcugcaagguacucugguga

SEQ ID NO: 1265307 - RNA, 18 nt, Human
gcugcaagcacagcccuu

SEQ ID NO: 1265308 - RNA, 20 nt, Human
gcugccccuggugcacuggc

SEQ ID NO: 1265309 - RNA, 21 nt, Human
gcugcccuacagcacccugug

SEQ ID NO: 1265310 - RNA, 12 nt, Human
gcugcccuccug

SEQ ID NO: 1265311 - RNA, 21 nt, Human
gcugcccuccugugcucagcc

SEQ ID NO: 1265312 - RNA, 14 nt, Human
gcugcagccucagg

SEQ ID NO: 1265313 - RNA, 15 nt, Human
gcugcagccucagga

SEQ ID NO: 1265314 - RNA, 16 nt, Human
gcugcagccucaggac

SEQ ID NO: 1265315 - RNA, 18 nt, Human
gcugcagccucaggacug

SEQ ID NO: 1265316 - RNA, 19 nt, Human
gcugcagccucaggacugg

SEQ ID NO: 1265317 - RNA, 21 nt, Human
gcugcagccucaggacuggga

SEQ ID NO: 1265318 - RNA, 22 nt, Human
gcugcagccucaggacugggag

SEQ ID NO: 1265319 - RNA, 23 nt, Human
gcugcagccucaggacugggagc

SEQ ID NO: 1265320 - RNA, 16 nt, Human
gcugcagccugcgcca

SEQ ID NO: 1265321 - RNA, 15 nt, Human
gcugcccccaccucu

SEQ ID NO: 1265322 - RNA, 15 nt, Human
gcugcccccagagcc

SEQ ID NO: 1265323 - RNA, 20 nt, Human
gcugcccccagagccacagu

SEQ ID NO: 1265324 - RNA, 21 nt, Human
gcugcccccagagccacaguu

SEQ ID NO: 1265325 - RNA, 13 nt, Human
gcugccccggccc

SEQ ID NO: 1265326 - RNA, 15 nt, Human
gcugccccggccccu

SEQ ID NO: 1265327 - RNA, 16 nt, Human
gcugccccggccccuc

SEQ ID NO: 1265328 - RNA, 22 nt, Human
gcugccccggccccucccccug

SEQ ID NO: 1265329 - RNA, 23 nt, Human
gcugccccggccccucccccuga

SEQ ID NO: 1265330 - RNA, 22 nt, Human
gcugccccucaucucucugccc

SEQ ID NO: 1265331 - RNA, 13 nt, Human
gcugccccucuca

SEQ ID NO: 1265332 - RNA, 14 nt, Human
gcugccccucucac

SEQ ID NO: 1265333 - RNA, 15 nt, Human
gcugccccucucacc

SEQ ID NO: 1265334 - RNA, 16 nt, Human
gcugccccucucacca

SEQ ID NO: 1265335 - RNA, 18 nt, Human
gcugccccucucaccaaa

SEQ ID NO: 1265336 - RNA, 14 nt, Human
gcugccucuucccu

SEQ ID NO: 1265337 - RNA, 18 nt, Human
gcugccucuucccucuuc

SEQ ID NO: 1265338 - RNA, 21 nt, Human
gcugccucccuuguggcagca

SEQ ID NO: 1265339 - RNA, 21 nt, Human
gcugccucuaccugacacucc

SEQ ID NO: 1265340 - RNA, 13 nt, Human
gcugccucaugcu

SEQ ID NO: 1265341 - RNA, 21 nt, Human
gcugccuccccucuccuuccu

SEQ ID NO: 1265342 - RNA, 18 nt, Human
gcugccucccucugcugu

SEQ ID NO: 1265343 - RNA, 23 nt, Human
gcugcucuugaacuccugaccuc

SEQ ID NO: 1265344 - RNA, 11 nt, Human
gcugccugagu

SEQ ID NO: 1265345 - RNA, 21 nt, Human
gcugccugagucgugaccugc

SEQ ID NO: 1265346 - RNA, 22 nt, Human
gcugccugagucgugaccugcu

SEQ ID NO: 1265347 - RNA, 18 nt, Human
gcaaaauuauagaaguuu

SEQ ID NO: 1265348 - RNA, 23 nt, Human
gcaaaauuauagaaguuuagauu

SEQ ID NO: 1265349 - RNA, 15 nt, Human
gcaaaaucaguuuuc

SEQ ID NO: 1265350 - RNA, 13 nt, Human
gcaaaaucaguuu

SEQ ID NO: 1265351 - RNA, 20 nt, Human
gcaaaauaauuuuaaacaaa

SEQ ID NO: 1265352 - RNA, 13 nt, Human
gcaaaauaauuuu

SEQ ID NO: 1265353 - RNA, 15 nt, Human
gcaaaauaauuuuaa

SEQ ID NO: 1265354 - RNA, 22 nt, Human
gcaacaggguauggacuaucug

SEQ ID NO: 1265355 - RNA, 17 nt, Human
gcaacaguuugacauuu

SEQ ID NO: 1265356 - RNA, 13 nt, Human
gcaacauccaaaa

SEQ ID NO: 1265357 - RNA, 17 nt, Human
gcaacauccaaaauagu

SEQ ID NO: 1265358 - RNA, 14 nt, Human
gcaacaugaugagg

SEQ ID NO: 1265359 - RNA, 16 nt, Human
gcaacaugaugaggua

SEQ ID NO: 1265360 - RNA, 13 nt, Human
gcaacauggcuuu

SEQ ID NO: 1265361 - RNA, 22 nt, Human
gcaacaugaugagguaguaccu

SEQ ID NO: 1265362 - RNA, 14 nt, Human
gcaaccauuugaaa

SEQ ID NO: 1265363 - RNA, 19 nt, Human
gcaaccccaggcugaagca

SEQ ID NO: 1265364 - RNA, 11 nt, Human
gcaaccaggaa

SEQ ID NO: 1265365 - RNA, 15 nt, Human
gcaaccaggaacagc

SEQ ID NO: 1265366 - RNA, 17 nt, Human
gcaaccaggaacagcaa

SEQ ID NO: 1265367 - RNA, 20 nt, Human
gcaaccaggaacagcaaaug

SEQ ID NO: 1265368 - RNA, 16 nt, Human
gcaaccucuuggccug

SEQ ID NO: 1265369 - RNA, 23 nt, Human
gcaaccucuuggccugaucagac

SEQ ID NO: 1265370 - RNA, 20 nt, Human
gcaaccuucgccaccugggu

SEQ ID NO: 1265371 - RNA, 21 nt, Human
gcaaaaacaaaaagaaaagaa

SEQ ID NO: 1265372 - RNA, 20 nt, Human
gcaaaaacaaaaagaaaaga

SEQ ID NO: 1265373 - RNA, 23 nt, Human
gcaaaaauaguuuggauauguaa

SEQ ID NO: 1265374 - RNA, 19 nt, Human
gcaaaagcuuacaaauacu

SEQ ID NO: 1265375 - RNA, 15 nt, Human
gcaaaaacaaaaaga

SEQ ID NO: 1265376 - RNA, 17 nt, Human
gcaaaaaauguuuuugg

SEQ ID NO: 1265377 - RNA, 17 nt, Human
gcaaaaaagaaaaccuu

SEQ ID NO: 1265378 - RNA, 15 nt, Human
gcaaaaaagaaaacc

SEQ ID NO: 1265379 - RNA, 18 nt, Human
gcaaaaaagaaaaccuuu

SEQ ID NO: 1265380 - RNA, 18 nt, Human
gauuuauuuaaaauagca

SEQ ID NO: 1265381 - RNA, 16 nt, Human
gauuuaauuugaaaua

SEQ ID NO: 1265382 - RNA, 21 nt, Human
gauuuauuaauauauauuauc

SEQ ID NO: 1265383 - RNA, 12 nt, Human
gauuuauuuaaa

SEQ ID NO: 1265384 - RNA, 21 nt, Human
gauuuaauauaaaguuuuaua

SEQ ID NO: 1265385 - RNA, 23 nt, Human
gauuuaauauaaaguuuuauaua

SEQ ID NO: 1265386 - RNA, 19 nt, Human
gauuuaaucugccaagggc

SEQ ID NO: 1265387 - RNA, 16 nt, Human
gaugauuucaguucua

SEQ ID NO: 1265388 - RNA, 19 nt, Human
gaugauuucaguucuagga

SEQ ID NO: 1265389 - RNA, 22 nt, Human
gaugauuucaguucuaggaaaa

SEQ ID NO: 1265390 - RNA, 23 nt, Human
gaugauuucaguucuaggaaaau

SEQ ID NO: 1265391 - RNA, 17 nt, Human
gauggaaaauucauuuu

SEQ ID NO: 1265392 - RNA, 17 nt, Human
gauggaacacggccaca

SEQ ID NO: 1265393 - RNA, 21 nt, Human
gaugauccccacgccacagcc

SEQ ID NO: 1265394 - RNA, 19 nt, Human
gaugauugacaacacccau

SEQ ID NO: 1265395 - RNA, 19 nt, Human
gaugauacuaauaaacuaa

SEQ ID NO: 1265396 - RNA, 13 nt, Human
gaugaucaauuau

SEQ ID NO: 1265397 - RNA, 20 nt, Human
gaugaucaauuauaguuucu

SEQ ID NO: 1265398 - RNA, 22 nt, Human
gaugaucaauuauaguuucuga

SEQ ID NO: 1265399 - RNA, 15 nt, Human
gaugauccccacgcc

SEQ ID NO: 1265400 - RNA, 16 nt, Human
gaugauccccacgcca

SEQ ID NO: 1265401 - RNA, 20 nt, Human
gaugauccccacgccacagc

SEQ ID NO: 1265402 - RNA, 12 nt, Human
gaucuggaaccc

SEQ ID NO: 1265403 - RNA, 14 nt, Human
gaucuggaacccag

SEQ ID NO: 1265404 - RNA, 23 nt, Human
gaucugauugaccguguuggucu

SEQ ID NO: 1265405 - RNA, 16 nt, Human
gaucugauugaccgug

SEQ ID NO: 1265406 - RNA, 23 nt, Human
gaucugauaggguuugugacagg

SEQ ID NO: 1265407 - RNA, 20 nt, Human
gaucugcagggggugugucu

SEQ ID NO: 1265408 - RNA, 18 nt, Human
gaucuggaaccucagccu

SEQ ID NO: 1265409 - RNA, 19 nt, Human
gaucuggaaccucagccug

SEQ ID NO: 1265410 - RNA, 20 nt, Human
gaucuggaaccucagccugg

SEQ ID NO: 1265411 - RNA, 21 nt, Human
gaucuggaaccucagccuggc

SEQ ID NO: 1265412 - RNA, 15 nt, Human
gaucuggaacccaga

SEQ ID NO: 1265413 - RNA, 16 nt, Human
gaucuggaacccagac

SEQ ID NO: 1265414 - RNA, 17 nt, Human
gaucuggaacccagacu

SEQ ID NO: 1265415 - RNA, 18 nt, Human
gaucuggaacccagacuc

SEQ ID NO: 1265416 - RNA, 20 nt, Human
gaucuggaacccagacucag

SEQ ID NO: 1265417 - RNA, 12 nt, Human
gaucuggaaccu

SEQ ID NO: 1265418 - RNA, 16 nt, Human
gaucuggaaccucagc

SEQ ID NO: 1265419 - RNA, 17 nt, Human
gaucuggaaccucagcc

SEQ ID NO: 1265420 - RNA, 21 nt, Human
gauccacccgccucagccucc

SEQ ID NO: 1265421 - RNA, 18 nt, Human
gauccacucgccucagcc

SEQ ID NO: 1265422 - RNA, 19 nt, Human
gauccacuggcuggacaaa

SEQ ID NO: 1265423 - RNA, 17 nt, Human
gaucccaacacugccag

SEQ ID NO: 1265424 - RNA, 13 nt, Human
gauccacuggcug

SEQ ID NO: 1265425 - RNA, 12 nt, Human
gauccagccugg

SEQ ID NO: 1265426 - RNA, 18 nt, Human
gaucccaacacugccagc

SEQ ID NO: 1265427 - RNA, 19 nt, Human
gaucccaacacugccagca

SEQ ID NO: 1265428 - RNA, 21 nt, Human
gaucccaaguagaaucucagu

SEQ ID NO: 1265429 - RNA, 21 nt, Human
gaucccagagagcccgaggag

SEQ ID NO: 1265430 - RNA, 17 nt, Human
gaucccagagagcccga

SEQ ID NO: 1265431 - RNA, 15 nt, Human
gaucccaugagcucc

SEQ ID NO: 1265432 - RNA, 13 nt, Human
gaucugagggaga

SEQ ID NO: 1265433 - RNA, 17 nt, Human
gaucugaugcaagcaag

SEQ ID NO: 1265434 - RNA, 22 nt, Human
gaucugagucagagccaugucu

SEQ ID NO: 1265435 - RNA, 17 nt, Human
gaucugagucagagcca

SEQ ID NO: 1265436 - RNA, 19 nt, Human
gaucugauaggguuuguga

SEQ ID NO: 1265437 - RNA, 11 nt, Human
gaucucugaag

SEQ ID NO: 1265438 - RNA, 14 nt, Human
gaucucugaagcca

SEQ ID NO: 1265439 - RNA, 19 nt, Human
gaucucugaagccacaaau

SEQ ID NO: 1265440 - RNA, 12 nt, Human
gauacugaaaua

SEQ ID NO: 1265441 - RNA, 18 nt, Human
gauaccauauacagcuca

SEQ ID NO: 1265442 - RNA, 17 nt, Human
gauacugcgacuuucug

SEQ ID NO: 1265443 - RNA, 18 nt, Human
gauacugcgacuuucugc

SEQ ID NO: 1265444 - RNA, 19 nt, Human
gauacugcgacuuucugcc

SEQ ID NO: 1265445 - RNA, 20 nt, Human
gauacugcgacuuucugccu

SEQ ID NO: 1265446 - RNA, 21 nt, Human
gauacugcgacuuucugccug

SEQ ID NO: 1265447 - RNA, 23 nt, Human
gauacugcgacuuucugccugga

SEQ ID NO: 1265448 - RNA, 13 nt, Human
gauacuggcacag

SEQ ID NO: 1265449 - RNA, 16 nt, Human
gauacuggcacagagg

SEQ ID NO: 1265450 - RNA, 14 nt, Human
gauacauacagaau

SEQ ID NO: 1265451 - RNA, 17 nt, Human
gauacauccaaagcaga

SEQ ID NO: 1265452 - RNA, 20 nt, Human
gauacauccaaagcagacag

SEQ ID NO: 1265453 - RNA, 21 nt, Human
gauacauccaaagcagacagc

SEQ ID NO: 1265454 - RNA, 23 nt, Human
gauacauccaaagcagacagcuc

SEQ ID NO: 1265455 - RNA, 15 nt, Human
gauaccagcgaggag

SEQ ID NO: 1265456 - RNA, 22 nt, Human
gauaccagcgaggaggcuccag

SEQ ID NO: 1265457 - RNA, 13 nt, Human
gauaccagcugga

SEQ ID NO: 1265458 - RNA, 12 nt, Human
gauccacccgcc

SEQ ID NO: 1265459 - RNA, 15 nt, Human
gauccaagcuaagca

SEQ ID NO: 1265460 - RNA, 17 nt, Human
gauccaagcuaagcacu

SEQ ID NO: 1265461 - RNA, 22 nt, Human
gauccaagcuaagcacugccac

SEQ ID NO: 1265462 - RNA, 13 nt, Human
gauccaaaagaag

SEQ ID NO: 1265463 - RNA, 18 nt, Human
gaucaaauguuuaaucau

SEQ ID NO: 1265464 - RNA, 20 nt, Human
gaucaaauguuuaaucauau

SEQ ID NO: 1265465 - RNA, 16 nt, Human
gauccaaaagaagccc

SEQ ID NO: 1265466 - RNA, 19 nt, Human
gauccaaaagaagccccca

SEQ ID NO: 1265467 - RNA, 20 nt, Human
gauccaaaagaagcccccag

SEQ ID NO: 1265468 - RNA, 22 nt, Human
gauccaaaagaagcccccagcu

SEQ ID NO: 1265469 - RNA, 23 nt, Human
gauccaaaagaagcccccagcua

SEQ ID NO: 1265470 - RNA, 19 nt, Human
gauccaacuaaugccuuac

SEQ ID NO: 1265471 - RNA, 20 nt, Human
gauccaacuaaugccuuacu

SEQ ID NO: 1265472 - RNA, 21 nt, Human
gauauuuucaacgcagcccug

SEQ ID NO: 1265473 - RNA, 22 nt, Human
gauauuuucaacgcagcccugc

SEQ ID NO: 1265474 - RNA, 23 nt, Human
gauauuuucaacgcagcccugcu

SEQ ID NO: 1265475 - RNA, 15 nt, Human
gauauuuucugugcc

SEQ ID NO: 1265476 - RNA, 21 nt, Human
gauauuuucugugccugaaua

SEQ ID NO: 1265477 - RNA, 14 nt, Human
gauauuuucucuag

SEQ ID NO: 1265478 - RNA, 16 nt, Human
gaucaaaaacuauuug

SEQ ID NO: 1265479 - RNA, 22 nt, Human
gaucaaaccccgaccaccugcc

SEQ ID NO: 1265480 - RNA, 12 nt, Human
gaucaaagauga

SEQ ID NO: 1265481 - RNA, 15 nt, Human
gaucaaagaugaaaa

SEQ ID NO: 1265482 - RNA, 18 nt, Human
gaucaaagaugaaaagua

SEQ ID NO: 1265483 - RNA, 16 nt, Human
gaucaaauguuuaauc

SEQ ID NO: 1265484 - RNA, 14 nt, Human
gaucaaauguuuaa

SEQ ID NO: 1265485 - RNA, 18 nt, Human
gauacuuugauauuuuca

SEQ ID NO: 1265486 - RNA, 20 nt, Human
gauacuuggauuuaguuuca

SEQ ID NO: 1265487 - RNA, 12 nt, Human
gauacuguugca

SEQ ID NO: 1265488 - RNA, 13 nt, Human
gauacuuggauuu

SEQ ID NO: 1265489 - RNA, 23 nt, Human
gauacuuggauuuaguuucagua

SEQ ID NO: 1265490 - RNA, 13 nt, Human
gauagaaaugcca

SEQ ID NO: 1265491 - RNA, 14 nt, Human
gauagaaaugccaa

SEQ ID NO: 1265492 - RNA, 19 nt, Human
gauagaaaugccaagcacu

SEQ ID NO: 1265493 - RNA, 12 nt, Human
gauagaaugaca

SEQ ID NO: 1265494 - RNA, 19 nt, Human
gauauuuucaacgcagccc

SEQ ID NO: 1265495 - RNA, 22 nt, Human
gauauuugucaugcugggauuu

SEQ ID NO: 1265496 - RNA, 15 nt, Human
gauauuucuagcuua

SEQ ID NO: 1265497 - RNA, 21 nt, Human
gcaucccucacccauccuaga

SEQ ID NO: 1265498 - RNA, 16 nt, Human
gcauccauucuccuga

SEQ ID NO: 1265499 - RNA, 17 nt, Human
gcauccauucuccugag

SEQ ID NO: 1265500 - RNA, 12 nt, Human
gcaucccugggc

SEQ ID NO: 1265501 - RNA, 15 nt, Human
gcaucccugggccuu

SEQ ID NO: 1265502 - RNA, 17 nt, Human
gcaucccugggccuugg

SEQ ID NO: 1265503 - RNA, 18 nt, Human
gcaucccugggccuuggg

SEQ ID NO: 1265504 - RNA, 20 nt, Human
gcaucccugggccuugggcu

SEQ ID NO: 1265505 - RNA, 19 nt, Human
gcaucccugggccuugggc

SEQ ID NO: 1265506 - RNA, 15 nt, Human
gcauccgcaggugcu

SEQ ID NO: 1265507 - RNA, 16 nt, Human
gcauccgcaggugcug

SEQ ID NO: 1265508 - RNA, 17 nt, Human
gcauccgcaggugcugg

SEQ ID NO: 1265509 - RNA, 20 nt, Human
gcauccgcaggugcuggucc

SEQ ID NO: 1265510 - RNA, 18 nt, Human
gcauccgcaggugcuggu

SEQ ID NO: 1265511 - RNA, 18 nt, Human
gcauccuccacaauagca

SEQ ID NO: 1265512 - RNA, 12 nt, Human
gcauccuccagc

SEQ ID NO: 1265513 - RNA, 13 nt, Human
gcauccuccagcc

SEQ ID NO: 1265514 - RNA, 11 nt, Human
gcauccagccu

SEQ ID NO: 1265515 - RNA, 19 nt, Human
gcauccauucuccugagga

SEQ ID NO: 1265516 - RNA, 22 nt, Human
gcauccagagucccugccugga

SEQ ID NO: 1265517 - RNA, 23 nt, Human
gcauccagagucccugccuggac

SEQ ID NO: 1265518 - RNA, 21 nt, Human
gcauccagagucccugccugg

SEQ ID NO: 1265519 - RNA, 20 nt, Human
gcaucuagcaugucgucaaa

SEQ ID NO: 1265520 - RNA, 23 nt, Human
gcaucgucaugcacaguauuugu

SEQ ID NO: 1265521 - RNA, 19 nt, Human
gcaucuaaguuauaagacu

SEQ ID NO: 1265522 - RNA, 22 nt, Human
gcaucuaaguuauaagacucuc

SEQ ID NO: 1265523 - RNA, 21 nt, Human
gcaucuagaggcuuccuucau

SEQ ID NO: 1265524 - RNA, 22 nt, Human
gcaucuagaggcuuccuucauu

SEQ ID NO: 1265525 - RNA, 23 nt, Human
gcaucuagaggcuuccuucauuu

SEQ ID NO: 1265526 - RNA, 15 nt, Human
gcauggcuauuuuau

SEQ ID NO: 1265527 - RNA, 17 nt, Human
gcauccuccgccucccg

SEQ ID NO: 1265528 - RNA, 14 nt, Human
gcauccuccagccc

SEQ ID NO: 1265529 - RNA, 15 nt, Human
gcauccuccagcccc

SEQ ID NO: 1265530 - RNA, 17 nt, Human
gcauccuccagccccug

SEQ ID NO: 1265531 - RNA, 14 nt, Human
gcauccucuggagc

SEQ ID NO: 1265532 - RNA, 16 nt, Human
gcauccucuggagcca

SEQ ID NO: 1265533 - RNA, 18 nt, Human
gcauccucuggagccagc

SEQ ID NO: 1265534 - RNA, 20 nt, Human
gcauccucuggagccagccg

SEQ ID NO: 1265535 - RNA, 17 nt, Human
gcaucggggagccggga

SEQ ID NO: 1265536 - RNA, 15 nt, Human
gcauggucacacacu

SEQ ID NO: 1265537 - RNA, 18 nt, Human
gcauggucacacacugau

SEQ ID NO: 1265538 - RNA, 19 nt, Human
gcauggucccacaucccug

SEQ ID NO: 1265539 - RNA, 20 nt, Human
gcauggucccacaucccugg

SEQ ID NO: 1265540 - RNA, 21 nt, Human
gcauggucccacaucccuggg

SEQ ID NO: 1265541 - RNA, 23 nt, Human
gcauggucccacaucccugggcc

SEQ ID NO: 1265542 - RNA, 15 nt, Human
gcauggugccccagg

SEQ ID NO: 1265543 - RNA, 16 nt, Human
gcauggugccccagga

SEQ ID NO: 1265544 - RNA, 17 nt, Human
gcauggugccccaggac

SEQ ID NO: 1265545 - RNA, 18 nt, Human
gcauggugccccaggacc

SEQ ID NO: 1265546 - RNA, 19 nt, Human
gcauggugccccaggacca

SEQ ID NO: 1265547 - RNA, 20 nt, Human
gcauggugccccaggaccag

SEQ ID NO: 1265548 - RNA, 21 nt, Human
gcauggugccccaggaccagc

SEQ ID NO: 1265549 - RNA, 23 nt, Human
gcauggugccccaggaccagcuc

SEQ ID NO: 1265550 - RNA, 15 nt, Human
gcaugguguucuccu

SEQ ID NO: 1265551 - RNA, 16 nt, Human
gcaugguguucuccug

SEQ ID NO: 1265552 - RNA, 17 nt, Human
gcauguaacgcaaguuc

SEQ ID NO: 1265553 - RNA, 21 nt, Human
gcauguaacgcaaguucccag

SEQ ID NO: 1265554 - RNA, 17 nt, Human
gcaugguguucuccugc

SEQ ID NO: 1265555 - RNA, 18 nt, Human
gcaugguguucuccugcu

SEQ ID NO: 1265556 - RNA, 20 nt, Human
gcaugguguucuccugcugc

SEQ ID NO: 1265557 - RNA, 13 nt, Human
gcaugguuucagc

SEQ ID NO: 1265558 - RNA, 14 nt, Human
gcaugguuucagca

SEQ ID NO: 1265559 - RNA, 16 nt, Human
gcaugguuucagcacu

SEQ ID NO: 1265560 - RNA, 17 nt, Human
gcaugguuucagcacua

SEQ ID NO: 1265561 - RNA, 20 nt, Human
gcauuuaaccccccuguaca

SEQ ID NO: 1265562 - RNA, 21 nt, Human
gcauuuaaccccccuguacac

SEQ ID NO: 1265563 - RNA, 22 nt, Human
gcauuuaaccccccuguacaca

SEQ ID NO: 1265564 - RNA, 15 nt, Human
gcaguuuauauuuaa

SEQ ID NO: 1265565 - RNA, 18 nt, Human
gcaguuuauauuuaacuc

SEQ ID NO: 1265566 - RNA, 14 nt, Human
gcaguuuaucauuc

SEQ ID NO: 1265567 - RNA, 15 nt, Human
gcaguuuaucauuca

SEQ ID NO: 1265568 - RNA, 22 nt, Human
gcaguuguugcccacagcugua

SEQ ID NO: 1265569 - RNA, 13 nt, Human
gcaguugucucug

SEQ ID NO: 1265570 - RNA, 14 nt, Human
gcaguugucucugu

SEQ ID NO: 1265571 - RNA, 15 nt, Human
gcaguugucucuguu

SEQ ID NO: 1265572 - RNA, 16 nt, Human
gcaguugucucuguuu

SEQ ID NO: 1265573 - RNA, 23 nt, Human
gcagucucuauaccaauaaagug

SEQ ID NO: 1265574 - RNA, 22 nt, Human
gcagucucuauaccaauaaagu

SEQ ID NO: 1265575 - RNA, 21 nt, Human
gcagucucuauaccaauaaag

SEQ ID NO: 1265576 - RNA, 20 nt, Human
gcagucucuauaccaauaaa

SEQ ID NO: 1265577 - RNA, 18 nt, Human
gcagucucuauaccaaua

SEQ ID NO: 1265578 - RNA, 20 nt, Human
gcagugaaugauucaguguu

SEQ ID NO: 1265579 - RNA, 23 nt, Human
gcagugagagaguggcuggggca

SEQ ID NO: 1265580 - RNA, 22 nt, Human
gcagugagagaguggcuggggc

SEQ ID NO: 1265581 - RNA, 17 nt, Human
gcagucucuauaccaau

SEQ ID NO: 1265582 - RNA, 17 nt, Human
gcagcugccaggagcac

SEQ ID NO: 1265583 - RNA, 17 nt, Human
gcagucgugccuguguc

SEQ ID NO: 1265584 - RNA, 18 nt, Human
gcagucgugccugugucc

SEQ ID NO: 1265585 - RNA, 19 nt, Human
gcagucgugccugugucca

SEQ ID NO: 1265586 - RNA, 16 nt, Human
gcagcugagcagggcc

SEQ ID NO: 1265587 - RNA, 17 nt, Human
gcagcugagcagggccg

SEQ ID NO: 1265588 - RNA, 18 nt, Human
gcagcugagcagggccgg

SEQ ID NO: 1265589 - RNA, 19 nt, Human
gcagcugagcagggccggg

SEQ ID NO: 1265590 - RNA, 21 nt, Human
gcagcugagcagggccgggga

SEQ ID NO: 1265591 - RNA, 20 nt, Human
gcagcugagcagggccgggg

SEQ ID NO: 1265592 - RNA, 21 nt, Human
gcagcugccaggagcacggcu

SEQ ID NO: 1265593 - RNA, 20 nt, Human
gcagcucuggacagccccac

SEQ ID NO: 1265594 - RNA, 12 nt, Human
gcagcugagcag

SEQ ID NO: 1265595 - RNA, 14 nt, Human
gcagcugagcaggg

SEQ ID NO: 1265596 - RNA, 15 nt, Human
gcagcugagcagggc

SEQ ID NO: 1265597 - RNA, 13 nt, Human
gcagcuccucugu

SEQ ID NO: 1265598 - RNA, 20 nt, Human
gcagcuccucugucucgagc

SEQ ID NO: 1265599 - RNA, 16 nt, Human
gcagcuccucugucuc

SEQ ID NO: 1265600 - RNA, 21 nt, Human
gcagccagggagagcccagga

SEQ ID NO: 1265601 - RNA, 16 nt, Human
gcagccagugcccuga

SEQ ID NO: 1265602 - RNA, 17 nt, Human
gcagccagugcccugag

SEQ ID NO: 1265603 - RNA, 18 nt, Human
gcagccagugcccugagc

SEQ ID NO: 1265604 - RNA, 19 nt, Human
gcagccagugcccugagcc

SEQ ID NO: 1265605 - RNA, 19 nt, Human
gcagccagcaucugggccu

SEQ ID NO: 1265606 - RNA, 11 nt, Human
gcagccagccc

SEQ ID NO: 1265607 - RNA, 17 nt, Human
gcagccagcaucugggc

SEQ ID NO: 1265608 - RNA, 13 nt, Human
gcagccagcccug

SEQ ID NO: 1265609 - RNA, 14 nt, Human
gcagccagcccugc

SEQ ID NO: 1265610 - RNA, 15 nt, Human
gcagccagcccugcc

SEQ ID NO: 1265611 - RNA, 16 nt, Human
gcagccagcccugccu

SEQ ID NO: 1265612 - RNA, 17 nt, Human
gcagccagcccugccug

SEQ ID NO: 1265613 - RNA, 18 nt, Human
gcagccagcccugccugg

SEQ ID NO: 1265614 - RNA, 19 nt, Human
gcagccagcccugccugga

SEQ ID NO: 1265615 - RNA, 20 nt, Human
gcagccagcccugccuggag

SEQ ID NO: 1265616 - RNA, 22 nt, Human
gcagccagcccugccuggagga

SEQ ID NO: 1265617 - RNA, 21 nt, Human
gcagccagcccugccuggagg

SEQ ID NO: 1265618 - RNA, 12 nt, Human
gcagccagggag

SEQ ID NO: 1265619 - RNA, 14 nt, Human
gcagccagggagag

SEQ ID NO: 1265620 - RNA, 15 nt, Human
gcagccagggagagc

SEQ ID NO: 1265621 - RNA, 16 nt, Human
gcagccagggagagcc

SEQ ID NO: 1265622 - RNA, 17 nt, Human
gcagccagggagagccc

SEQ ID NO: 1265623 - RNA, 18 nt, Human
gcagccagggagagccca

SEQ ID NO: 1265624 - RNA, 19 nt, Human
gcagccagggagagcccag

SEQ ID NO: 1265625 - RNA, 20 nt, Human
gcagccagggagagcccagg

SEQ ID NO: 1265626 - RNA, 22 nt, Human
gcagaaaaaccaacaucuacaa

SEQ ID NO: 1265627 - RNA, 16 nt, Human
gcagaaaacccuuggg

SEQ ID NO: 1265628 - RNA, 17 nt, Human
gcagaaaacccuugggc

SEQ ID NO: 1265629 - RNA, 22 nt, Human
gcagaaaacccuugggccagaa

SEQ ID NO: 1265630 - RNA, 21 nt, Human
gcagaaaacccuugggccaga

SEQ ID NO: 1265631 - RNA, 13 nt, Human
gcagaacagugau

SEQ ID NO: 1265632 - RNA, 12 nt, Human
gcagaacaguga

SEQ ID NO: 1265633 - RNA, 17 nt, Human
gcagaaaauucugugcc

SEQ ID NO: 1265634 - RNA, 19 nt, Human
gcagaaagcaucccucacc

SEQ ID NO: 1265635 - RNA, 19 nt, Human
gcagaaccggagagccagc

SEQ ID NO: 1265636 - RNA, 20 nt, Human
gcagaaccggagagccagcu

SEQ ID NO: 1265637 - RNA, 22 nt, Human
gcagaacagugauuaccaggga

SEQ ID NO: 1265638 - RNA, 18 nt, Human
gcagaacagugauuacca

SEQ ID NO: 1265639 - RNA, 23 nt, Human
gcagagcugauggagaaggaagg

SEQ ID NO: 1265640 - RNA, 12 nt, Human
gcagagcuggcu

SEQ ID NO: 1265641 - RNA, 13 nt, Human
gcagagcuggcuc

SEQ ID NO: 1265642 - RNA, 14 nt, Human
gcagagcuggcucu

SEQ ID NO: 1265643 - RNA, 15 nt, Human
gcagagcuggcucug

SEQ ID NO: 1265644 - RNA, 17 nt, Human
gcagagcuggcucugag

SEQ ID NO: 1265645 - RNA, 23 nt, Human
gcagagcuggcucugagcgccuc

SEQ ID NO: 1265646 - RNA, 12 nt, Human
gcagagcuggug

SEQ ID NO: 1265647 - RNA, 13 nt, Human
gcagagcuggugc

SEQ ID NO: 1265648 - RNA, 22 nt, Human
gcagagcugauggagaaggaag

SEQ ID NO: 1265649 - RNA, 21 nt, Human
gcagagcugauggagaaggaa

SEQ ID NO: 1265650 - RNA, 21 nt, Human
gcagagcuggugcggcuggcc

SEQ ID NO: 1265651 - RNA, 14 nt, Human
gcagagcuggugcg

SEQ ID NO: 1265652 - RNA, 18 nt, Human
gcagaggcaguaccuggg

SEQ ID NO: 1265653 - RNA, 21 nt, Human
gcagaggcaguaccugggcaa

SEQ ID NO: 1265654 - RNA, 12 nt, Human
gcagaggccaga

SEQ ID NO: 1265655 - RNA, 12 nt, Human
gcagagggcugg

SEQ ID NO: 1265656 - RNA, 13 nt, Human
gcagagggcugga

SEQ ID NO: 1265657 - RNA, 14 nt, Human
gcagagggcuggag

SEQ ID NO: 1265658 - RNA, 16 nt, Human
gcagagggcuggaggc

SEQ ID NO: 1265659 - RNA, 15 nt, Human
gcagaggccagaggc

SEQ ID NO: 1265660 - RNA, 14 nt, Human
gcagaggcccacau

SEQ ID NO: 1265661 - RNA, 21 nt, Human
gcagaggcccacauuggaaga

SEQ ID NO: 1265662 - RNA, 20 nt, Human
gcagaggcccaggcugccgu

SEQ ID NO: 1265663 - RNA, 14 nt, Human
gcagaggccugggc

SEQ ID NO: 1265664 - RNA, 17 nt, Human
gcagaggccugggcugg

SEQ ID NO: 1265665 - RNA, 20 nt, Human
gcagaggccugggcugggaa

SEQ ID NO: 1265666 - RNA, 22 nt, Human
gcagaggccugggcugggaaaa

SEQ ID NO: 1265667 - RNA, 17 nt, Human
gcagagggcuggaggcc

SEQ ID NO: 1265668 - RNA, 18 nt, Human
gcagagggcuggaggccc

SEQ ID NO: 1265669 - RNA, 19 nt, Human
gcagagggcuggaggccca

SEQ ID NO: 1265670 - RNA, 20 nt, Human
gcagagggcuggaggcccag

SEQ ID NO: 1265671 - RNA, 21 nt, Human
gcagagggcuggaggcccagg

SEQ ID NO: 1265672 - RNA, 23 nt, Human
gcagagggcuggaggcccaggcu

SEQ ID NO: 1265673 - RNA, 24 nt, Human
gcagagggcuggaggcccaggcug

SEQ ID NO: 1265674 - RNA, 15 nt, Human
gcagcagugugaggc

SEQ ID NO: 1265675 - RNA, 19 nt, Human
gcagcagugugaggccagg

SEQ ID NO: 1265676 - RNA, 20 nt, Human
gcagcagugugaggccaggg

SEQ ID NO: 1265677 - RNA, 21 nt, Human
gcagcagugugaggccagggc

SEQ ID NO: 1265678 - RNA, 22 nt, Human
gcagcagugugaggccagggca

SEQ ID NO: 1265679 - RNA, 23 nt, Human
gcagcagugugaggccagggcag

SEQ ID NO: 1265680 - RNA, 23 nt, Human
gcagcaucggacaagacccccag

SEQ ID NO: 1265681 - RNA, 14 nt, Human
gcagcaucucuacc

SEQ ID NO: 1265682 - RNA, 22 nt, Human
gcagcaucucuaccuucucccc

SEQ ID NO: 1265683 - RNA, 20 nt, Human
gcagcaucucuaccuucucc

SEQ ID NO: 1265684 - RNA, 13 nt, Human
gcagcauuucacu

SEQ ID NO: 1265685 - RNA, 14 nt, Human
gcagcauuucacuu

SEQ ID NO: 1265686 - RNA, 18 nt, Human
gcagccacacuucucagg

SEQ ID NO: 1265687 - RNA, 19 nt, Human
gcagccacacuucucagga

SEQ ID NO: 1265688 - RNA, 20 nt, Human
gcagccacacuucucaggac

SEQ ID NO: 1265689 - RNA, 21 nt, Human
gcagccacacuucucaggaca

SEQ ID NO: 1265690 - RNA, 22 nt, Human
gcagccacacuucucaggacac

SEQ ID NO: 1265691 - RNA, 21 nt, Human
gagauugugccccugcacucc

SEQ ID NO: 1265692 - RNA, 20 nt, Human
gagaugcuagaacucccuuu

SEQ ID NO: 1265693 - RNA, 15 nt, Human
gagaugccucccuga

SEQ ID NO: 1265694 - RNA, 15 nt, Human
gagaugucuuggaac

SEQ ID NO: 1265695 - RNA, 16 nt, Human
gagaugucuuggaaca

SEQ ID NO: 1265696 - RNA, 16 nt, Human
gagaugcuagaacucc

SEQ ID NO: 1265697 - RNA, 14 nt, Human
gagaugccucccug

SEQ ID NO: 1265698 - RNA, 15 nt, Human
gagauuauguucuuu

SEQ ID NO: 1265699 - RNA, 15 nt, Human
gagauuaccuccuga

SEQ ID NO: 1265700 - RNA, 14 nt, Human
gagauuacaggcau

SEQ ID NO: 1265701 - RNA, 17 nt, Human
gagauucaguuuucauu

SEQ ID NO: 1265702 - RNA, 17 nt, Human
gagauguguguugauac

SEQ ID NO: 1265703 - RNA, 18 nt, Human
gagauguguguugauacu

SEQ ID NO: 1265704 - RNA, 21 nt, Human
gagauguguguugauacuguu

SEQ ID NO: 1265705 - RNA, 23 nt, Human
gagauguguguugauacuguugc

SEQ ID NO: 1265706 - RNA, 22 nt, Human
gagauguguguugauacuguug

SEQ ID NO: 1265707 - RNA, 22 nt, Human
gagagcuucuguugcugccuca

SEQ ID NO: 1265708 - RNA, 17 nt, Human
gagaggacaagaugggu

SEQ ID NO: 1265709 - RNA, 20 nt, Human
gagaggacuguagggagggc

SEQ ID NO: 1265710 - RNA, 12 nt, Human
gagaggcccugg

SEQ ID NO: 1265711 - RNA, 13 nt, Human
gagaggcccugga

SEQ ID NO: 1265712 - RNA, 24 nt, Human
gagaggcccuggaucagcguggcc

SEQ ID NO: 1265713 - RNA, 15 nt, Human
gagaggccuuuugga

SEQ ID NO: 1265714 - RNA, 18 nt, Human
gagaggccuuuuggaaug

SEQ ID NO: 1265715 - RNA, 21 nt, Human
gagaggcccuggaucagcgug

SEQ ID NO: 1265716 - RNA, 15 nt, Human
gagagggaaugugaa

SEQ ID NO: 1265717 - RNA, 14 nt, Human
gagagggaauguga

SEQ ID NO: 1265718 - RNA, 13 nt, Human
gagagcuaggagc

SEQ ID NO: 1265719 - RNA, 14 nt, Human
gagagcuaggagca

SEQ ID NO: 1265720 - RNA, 22 nt, Human
gagagcuaggagcaaagccugu

SEQ ID NO: 1265721 - RNA, 19 nt, Human
gagagcuaggagcaaagcc

SEQ ID NO: 1265722 - RNA, 16 nt, Human
gagacgggcccuggug

SEQ ID NO: 1265723 - RNA, 19 nt, Human
gagacuccagaccugaggc

SEQ ID NO: 1265724 - RNA, 22 nt, Human
gacuuuuuauggcacuaguauu

SEQ ID NO: 1265725 - RNA, 18 nt, Human
gacuuuuauuuccaguga

SEQ ID NO: 1265726 - RNA, 16 nt, Human
gacuuuuugcauuuaa

SEQ ID NO: 1265727 - RNA, 20 nt, Human
gagaaaaagaaaaaauauau

SEQ ID NO: 1265728 - RNA, 13 nt, Human
gagaaggagcaga

SEQ ID NO: 1265729 - RNA, 22 nt, Human
gagaaggauaggccuucauuaa

SEQ ID NO: 1265730 - RNA, 16 nt, Human
gagaaguauacauaag

SEQ ID NO: 1265731 - RNA, 15 nt, Human
gagaagucacagggc

SEQ ID NO: 1265732 - RNA, 17 nt, Human
gagaagugugccuucuc

SEQ ID NO: 1265733 - RNA, 23 nt, Human
gagacgggacugcggaggaagga

SEQ ID NO: 1265734 - RNA, 21 nt, Human
gagaccggccugccaggagga

SEQ ID NO: 1265735 - RNA, 20 nt, Human
gagaccggccugccaggagg

SEQ ID NO: 1265736 - RNA, 15 nt, Human
gagaccggccugcca

SEQ ID NO: 1265737 - RNA, 17 nt, Human
gagaccggccugccagg

SEQ ID NO: 1265738 - RNA, 18 nt, Human
gagaccggccugccagga

SEQ ID NO: 1265739 - RNA, 19 nt, Human
gagaccggccugccaggag

SEQ ID NO: 1265740 - RNA, 16 nt, Human
gagaaguuguaaagua

SEQ ID NO: 1265741 - RNA, 20 nt, Human
gagaauaaauugauuuuuau

SEQ ID NO: 1265742 - RNA, 21 nt, Human
gagaaucuacccccagaucca

SEQ ID NO: 1265743 - RNA, 15 nt, Human
gagaaucuauauuua

SEQ ID NO: 1265744 - RNA, 22 nt, Human
gagaaucuauauuuaacaagau

SEQ ID NO: 1265745 - RNA, 17 nt, Human
gagcuguuuacuaggga

SEQ ID NO: 1265746 - RNA, 23 nt, Human
gagcuggagaugaggccagacca

SEQ ID NO: 1265747 - RNA, 22 nt, Human
gagcuggagaugaggccagacc

SEQ ID NO: 1265748 - RNA, 12 nt, Human
gagcccugggac

SEQ ID NO: 1265749 - RNA, 12 nt, Human
gagcuggcucug

SEQ ID NO: 1265750 - RNA, 20 nt, Human
gagcccugggaggcucugga

SEQ ID NO: 1265751 - RNA, 19 nt, Human
gagcccugggaggcucugg

SEQ ID NO: 1265752 - RNA, 18 nt, Human
gagcccugggaggcucug

SEQ ID NO: 1265753 - RNA, 16 nt, Human
gagcccugggaggcuc

SEQ ID NO: 1265754 - RNA, 12 nt, Human
gagcccugggag

SEQ ID NO: 1265755 - RNA, 17 nt, Human
gagcccugaggccuaga

SEQ ID NO: 1265756 - RNA, 22 nt, Human
gagccccuucugcucagcucug

SEQ ID NO: 1265757 - RNA, 17 nt, Human
gagccccuucugcucag

SEQ ID NO: 1265758 - RNA, 20 nt, Human
gagccccuucugcucagcuc

SEQ ID NO: 1265759 - RNA, 21 nt, Human
gagccccuucugcucagcucu

SEQ ID NO: 1265760 - RNA, 12 nt, Human
gagccccuccua

SEQ ID NO: 1265761 - RNA, 14 nt, Human
gagcagucaggaaa

SEQ ID NO: 1265762 - RNA, 13 nt, Human
gagcaguccuugg

SEQ ID NO: 1265763 - RNA, 14 nt, Human
gagcaguccuuggc

SEQ ID NO: 1265764 - RNA, 16 nt, Human
gagcaguccuuggccu

SEQ ID NO: 1265765 - RNA, 17 nt, Human
gagcaguccuuggccug

SEQ ID NO: 1265766 - RNA, 20 nt, Human
gagcccagggaggccgaagc

SEQ ID NO: 1265767 - RNA, 15 nt, Human
gaggacccaggacag

SEQ ID NO: 1265768 - RNA, 14 nt, Human
gaggacccaggaca

SEQ ID NO: 1265769 - RNA, 11 nt, Human
gaggacccagg

SEQ ID NO: 1265770 - RNA, 12 nt, Human
gaggacccagga

SEQ ID NO: 1265771 - RNA, 21 nt, Human
gaggacgcucucuggccuucg

SEQ ID NO: 1265772 - RNA, 16 nt, Human
gaggacccagggcucu

SEQ ID NO: 1265773 - RNA, 14 nt, Human
gaggacuugugucu

SEQ ID NO: 1265774 - RNA, 16 nt, Human
gaggacuugugucucu

SEQ ID NO: 1265775 - RNA, 17 nt, Human
gaggacuugugucucug

SEQ ID NO: 1265776 - RNA, 20 nt, Human
gaggacccaggaaaggcagg

SEQ ID NO: 1265777 - RNA, 14 nt, Human
gaggacccagggcu

SEQ ID NO: 1265778 - RNA, 15 nt, Human
gaggacccagggcuc

SEQ ID NO: 1265779 - RNA, 20 nt, Human
gaggacuguagggagggcgg

SEQ ID NO: 1265780 - RNA, 21 nt, Human
gaggacuguagggagggcggc

SEQ ID NO: 1265781 - RNA, 14 nt, Human
gaggagaaacugga

SEQ ID NO: 1265782 - RNA, 12 nt, Human
gaggagaaacug

SEQ ID NO: 1265783 - RNA, 18 nt, Human
gaggacuugugucucugu

SEQ ID NO: 1265784 - RNA, 22 nt, Human
gaggacuugugucucugugcuu

SEQ ID NO: 1265785 - RNA, 15 nt, Human
gaggagcagcaggag

SEQ ID NO: 1265786 - RNA, 16 nt, Human
gaggagcagcaggagg

SEQ ID NO: 1265787 - RNA, 21 nt, Human
gaggagcagcaggagggggga

SEQ ID NO: 1265788 - RNA, 20 nt, Human
gaggagcagcaggagggggg

SEQ ID NO: 1265789 - RNA, 17 nt, Human
gaggagaugcuccuugg

SEQ ID NO: 1265790 - RNA, 18 nt, Human
gaggagauucugccuuug

SEQ ID NO: 1265791 - RNA, 16 nt, Human
gaggggcagagccagg

SEQ ID NO: 1265792 - RNA, 20 nt, Human
gaggggcagagccaggaaga

SEQ ID NO: 1265793 - RNA, 13 nt, Human
gaggggcagagcc

SEQ ID NO: 1265794 - RNA, 12 nt, Human
gagggccugggc

SEQ ID NO: 1265795 - RNA, 22 nt, Human
gagggccucaaaggcccgcucu

SEQ ID NO: 1265796 - RNA, 21 nt, Human
gaggggaccaggagugggugg

SEQ ID NO: 1265797 - RNA, 17 nt, Human
gaggggaccaggagugg

SEQ ID NO: 1265798 - RNA, 11 nt, Human
gaggggagggg

SEQ ID NO: 1265799 - RNA, 19 nt, Human
gaggcauggucugcccucu

SEQ ID NO: 1265800 - RNA, 15 nt, Human
gaggcuccacuuggu

SEQ ID NO: 1265801 - RNA, 18 nt, Human
gaggcugagaugggagaa

SEQ ID NO: 1265802 - RNA, 18 nt, Human
gaggcuccacuuggucug

SEQ ID NO: 1265803 - RNA, 17 nt, Human
gaggcuccacuuggucu

SEQ ID NO: 1265804 - RNA, 21 nt, Human
gacauuuuacauuaaauuuuu

SEQ ID NO: 1265805 - RNA, 15 nt, Human
gacauuuuacauuaa

SEQ ID NO: 1265806 - RNA, 14 nt, Human
gacauuuuacauua

SEQ ID NO: 1265807 - RNA, 13 nt, Human
gacauuuuacauu

SEQ ID NO: 1265808 - RNA, 20 nt, Human
gacauuuuaaaaaaugguca

SEQ ID NO: 1265809 - RNA, 22 nt, Human
gacauuugggagacaugugaca

SEQ ID NO: 1265810 - RNA, 23 nt, Human
gacauuugggagacaugugacau

SEQ ID NO: 1265811 - RNA, 19 nt, Human
gacauuguagagcuucugg

SEQ ID NO: 1265812 - RNA, 23 nt, Human
gacauuggcaccuaauccaggca

SEQ ID NO: 1265813 - RNA, 14 nt, Human
gacauugcguuuga

SEQ ID NO: 1265814 - RNA, 21 nt, Human
gacauugcguuugaccuuuua

SEQ ID NO: 1265815 - RNA, 18 nt, Human
gacagucaccucauggaa

SEQ ID NO: 1265816 - RNA, 12 nt, Human
gacagcucugca

SEQ ID NO: 1265817 - RNA, 21 nt, Human
gacaguccgucaaaacagauu

SEQ ID NO: 1265818 - RNA, 12 nt, Human
gacaugugacau

SEQ ID NO: 1265819 - RNA, 16 nt, Human
gacaugugacauuuau

SEQ ID NO: 1265820 - RNA, 20 nt, Human
gacaugugacauuuauauau

SEQ ID NO: 1265821 - RNA, 17 nt, Human
gacauguggggccaggu

SEQ ID NO: 1265822 - RNA, 14 nt, Human
gacagccccacccu

SEQ ID NO: 1265823 - RNA, 15 nt, Human
gacagccccacccug

SEQ ID NO: 1265824 - RNA, 23 nt, Human
gacagcccaggauacuggcacag

SEQ ID NO: 1265825 - RNA, 23 nt, Human
gacacuuuaauuaccaaccuguu

SEQ ID NO: 1265826 - RNA, 14 nt, Human
gacacugcucuaac

SEQ ID NO: 1265827 - RNA, 20 nt, Human
gacacugcucuaacagcccu

SEQ ID NO: 1265828 - RNA, 21 nt, Human
gacacugcucuaacagcccuc

SEQ ID NO: 1265829 - RNA, 13 nt, Human
gacacugcuggag

SEQ ID NO: 1265830 - RNA, 12 nt, Human
gacacuggcaug

SEQ ID NO: 1265831 - RNA, 13 nt, Human
gacacuggccccu

SEQ ID NO: 1265832 - RNA, 14 nt, Human
gacacuggccccuc

SEQ ID NO: 1265833 - RNA, 15 nt, Human
gacacuggccccuca

SEQ ID NO: 1265834 - RNA, 14 nt, Human
gacacuggugggga

SEQ ID NO: 1265835 - RNA, 16 nt, Human
gacacugguuugaaga

SEQ ID NO: 1265836 - RNA, 20 nt, Human
gaccucaguuuuaucauuuu

SEQ ID NO: 1265837 - RNA, 21 nt, Human
gaccucaguuuuaucauuuuc

SEQ ID NO: 1265838 - RNA, 14 nt, Human
gaccuccagcuguu

SEQ ID NO: 1265839 - RNA, 16 nt, Human
gaccuccagcuuuccu

SEQ ID NO: 1265840 - RNA, 18 nt, Human
gaccuccagcuuuccugu

SEQ ID NO: 1265841 - RNA, 19 nt, Human
gaccuccagcuuuccugua

SEQ ID NO: 1265842 - RNA, 14 nt, Human
gacgccaggguaug

SEQ ID NO: 1265843 - RNA, 13 nt, Human
gacgccugaggaa

SEQ ID NO: 1265844 - RNA, 14 nt, Human
gacgccugaggaac

SEQ ID NO: 1265845 - RNA, 14 nt, Human
gacgccuggcugcu

SEQ ID NO: 1265846 - RNA, 15 nt, Human
gacgccuggcugcug

SEQ ID NO: 1265847 - RNA, 16 nt, Human
gacgccuggcugcuga

SEQ ID NO: 1265848 - RNA, 12 nt, Human
gacgccuggggg

SEQ ID NO: 1265849 - RNA, 14 nt, Human
gacgcucucuggcc

SEQ ID NO: 1265850 - RNA, 15 nt, Human
gacgcucucuggccu

SEQ ID NO: 1265851 - RNA, 22 nt, Human
gaccucagguaaucgaccugcc

SEQ ID NO: 1265852 - RNA, 23 nt, Human
gaccucagguaaucgaccugccu

SEQ ID NO: 1265853 - RNA, 18 nt, Human
gacccugaccagcucccc

SEQ ID NO: 1265854 - RNA, 23 nt, Human
gacccugaccagcucccccuccc

SEQ ID NO: 1265855 - RNA, 16 nt, Human
gacccugagcugacca

SEQ ID NO: 1265856 - RNA, 20 nt, Human
gacccugagcugaccagccg

SEQ ID NO: 1265857 - RNA, 16 nt, Human
gacccugaaggggcca

SEQ ID NO: 1265858 - RNA, 17 nt, Human
gacccugaccagcuccc

SEQ ID NO: 1265859 - RNA, 20 nt, Human
gacccggcacccccugcagc

SEQ ID NO: 1265860 - RNA, 19 nt, Human
gacccggcacccccugcag

SEQ ID NO: 1265861 - RNA, 16 nt, Human
gaccccugagcuugca

SEQ ID NO: 1265862 - RNA, 17 nt, Human
gacccggaggggccugg

SEQ ID NO: 1265863 - RNA, 11 nt, Human
gaccccugcau

SEQ ID NO: 1265864 - RNA, 18 nt, Human
gacccggaggggccuggc

SEQ ID NO: 1265865 - RNA, 19 nt, Human
gacccggaggggccuggca

SEQ ID NO: 1265866 - RNA, 20 nt, Human
gacccggaggggccuggcag

SEQ ID NO: 1265867 - RNA, 17 nt, Human
gacccggcacccccugc

SEQ ID NO: 1265868 - RNA, 14 nt, Human
gaaugaauggcuaa

SEQ ID NO: 1265869 - RNA, 19 nt, Human
gaauauugccauuaugcuu

SEQ ID NO: 1265870 - RNA, 11 nt, Human
gaauaugccuu

SEQ ID NO: 1265871 - RNA, 22 nt, Human
gaauaucuccgucaacucauau

SEQ ID NO: 1265872 - RNA, 16 nt, Human
gaauauccaugaccua

SEQ ID NO: 1265873 - RNA, 15 nt, Human
gaauaucuguaaugg

SEQ ID NO: 1265874 - RNA, 17 nt, Human
gaauaucuguaauggua

SEQ ID NO: 1265875 - RNA, 14 nt, Human
gaauaugaaacaua

SEQ ID NO: 1265876 - RNA, 17 nt, Human
gaauaugaaacauagau

SEQ ID NO: 1265877 - RNA, 14 nt, Human
gaaugauuaugaau

SEQ ID NO: 1265878 - RNA, 16 nt, Human
gaaugaguugaggcca

SEQ ID NO: 1265879 - RNA, 20 nt, Human
gaaugaauggcuaagcaaaa

SEQ ID NO: 1265880 - RNA, 15 nt, Human
gaaugaauggcuaag

SEQ ID NO: 1265881 - RNA, 22 nt, Human
gaaugauuaugaauuacauuug

SEQ ID NO: 1265882 - RNA, 16 nt, Human
gaaugaucugauugac

SEQ ID NO: 1265883 - RNA, 13 nt, Human
gaaugaucugauu

SEQ ID NO: 1265884 - RNA, 15 nt, Human
gaaugauucaguguu

SEQ ID NO: 1265885 - RNA, 14 nt, Human
gaaugauuucaugc

SEQ ID NO: 1265886 - RNA, 13 nt, Human
gaauuacauuugu

SEQ ID NO: 1265887 - RNA, 22 nt, Human
gaauuaauaucccuacauguau

SEQ ID NO: 1265888 - RNA, 21 nt, Human
gaauuaauaucccuacaugua

SEQ ID NO: 1265889 - RNA, 15 nt, Human
gaauuacauuuguau

SEQ ID NO: 1265890 - RNA, 18 nt, Human
gaauuacauuuguauaaa

SEQ ID NO: 1265891 - RNA, 19 nt, Human
gaauuacgugcucuguggg

SEQ ID NO: 1265892 - RNA, 15 nt, Human
gaauuacgugcucug

SEQ ID NO: 1265893 - RNA, 20 nt, Human
gaauuacauuuguauaaaau

SEQ ID NO: 1265894 - RNA, 14 nt, Human
gaaugauuuuucuu

SEQ ID NO: 1265895 - RNA, 16 nt, Human
gaaugauuuuucuuua

SEQ ID NO: 1265896 - RNA, 18 nt, Human
gaaugauuuuucuuuaca

SEQ ID NO: 1265897 - RNA, 15 nt, Human
gaauuaacacaugau

SEQ ID NO: 1265898 - RNA, 14 nt, Human
gaauuaacacauga

SEQ ID NO: 1265899 - RNA, 14 nt, Human
gaauguuuuucuaa

SEQ ID NO: 1265900 - RNA, 13 nt, Human
gaauuaaacuuuu

SEQ ID NO: 1265901 - RNA, 20 nt, Human
gaauuaaacuuuuaauucau

SEQ ID NO: 1265902 - RNA, 14 nt, Human
gaauuaaaguacuu

SEQ ID NO: 1265903 - RNA, 22 nt, Human
gaauuaaaguggaccaauaggg

SEQ ID NO: 1265904 - RNA, 12 nt, Human
gaauuaaauaaa

SEQ ID NO: 1265905 - RNA, 20 nt, Human
gaauuaaauaaacccuuccu

SEQ ID NO: 1265906 - RNA, 14 nt, Human
gacaaaaagcuacu

SEQ ID NO: 1265907 - RNA, 19 nt, Human
gacaaacaccucccaggag

SEQ ID NO: 1265908 - RNA, 22 nt, Human
gacaaacaccucccaggagaca

SEQ ID NO: 1265909 - RNA, 16 nt, Human
gaauuauuuuuuuucu

SEQ ID NO: 1265910 - RNA, 15 nt, Human
gaauuuuuuuuaaca

SEQ ID NO: 1265911 - RNA, 16 nt, Human
gaauuuuuuuuaacau

SEQ ID NO: 1265912 - RNA, 17 nt, Human
gaauuuuuuuuaacauu

SEQ ID NO: 1265913 - RNA, 19 nt, Human
gaauuuuuuuuaacauucc

SEQ ID NO: 1265914 - RNA, 20 nt, Human
gaauuuuuuuuaacauuccu

SEQ ID NO: 1265915 - RNA, 21 nt, Human
gaauuuuuuuuaacauuccuc

SEQ ID NO: 1265916 - RNA, 22 nt, Human
gaauuuuuuuuuccuagcccuc

SEQ ID NO: 1265917 - RNA, 18 nt, Human
gacaaaaaauuaaagcau

SEQ ID NO: 1265918 - RNA, 13 nt, Human
gacaaagaaccuu

SEQ ID NO: 1265919 - RNA, 15 nt, Human
gacaaacuuugcauc

SEQ ID NO: 1265920 - RNA, 13 nt, Human
gacaaaggagccu

SEQ ID NO: 1265921 - RNA, 14 nt, Human
gacaaaggagccug

SEQ ID NO: 1265922 - RNA, 15 nt, Human
gacaaaggagccugu

SEQ ID NO: 1265923 - RNA, 16 nt, Human
gacaaaggagccugug

SEQ ID NO: 1265924 - RNA, 17 nt, Human
gacaaaggagccuguga

SEQ ID NO: 1265925 - RNA, 18 nt, Human
gacaaaggagccugugaa

SEQ ID NO: 1265926 - RNA, 13 nt, Human
gacaaaggcaagc

SEQ ID NO: 1265927 - RNA, 19 nt, Human
gaauuauuacaguguuuau

SEQ ID NO: 1265928 - RNA, 16 nt, Human
gaauuauucaauuuau

SEQ ID NO: 1265929 - RNA, 12 nt, Human
gaauuauuuugu

SEQ ID NO: 1265930 - RNA, 15 nt, Human
gaauuaggcuguaac

SEQ ID NO: 1265931 - RNA, 16 nt, Human
gaauuaggcuguaacu

SEQ ID NO: 1265932 - RNA, 17 nt, Human
gaauuaggcuguaacua

SEQ ID NO: 1265933 - RNA, 18 nt, Human
gaauuaggcuguaacuac

SEQ ID NO: 1265934 - RNA, 19 nt, Human
gaauuaggcuguaacuacu

SEQ ID NO: 1265935 - RNA, 23 nt, Human
gaauuaggcuguaacuacuuuau

SEQ ID NO: 1265936 - RNA, 20 nt, Human
gaauuauucaauuuauuuga

SEQ ID NO: 1265937 - RNA, 18 nt, Human
gacaaagguuuuccucuu

SEQ ID NO: 1265938 - RNA, 17 nt, Human
gacaaauagaaaauggu

SEQ ID NO: 1265939 - RNA, 18 nt, Human
gacaaauagaaaaugguc

SEQ ID NO: 1265940 - RNA, 19 nt, Human
gacacagaaaauguugaga

SEQ ID NO: 1265941 - RNA, 21 nt, Human
gacacagaaaauguugagaau

SEQ ID NO: 1265942 - RNA, 21 nt, Human
cugcccugguuuccugcccug

SEQ ID NO: 1265943 - RNA, 23 nt, Human
cugcccuggugcugccacacuuc

SEQ ID NO: 1265944 - RNA, 17 nt, Human
cugcccugguuuccugc

SEQ ID NO: 1265945 - RNA, 18 nt, Human
cugcccugguuuccugcc

SEQ ID NO: 1265946 - RNA, 19 nt, Human
cugcccugguuuccugccc

SEQ ID NO: 1265947 - RNA, 12 nt, Human
cugcccuggugc

SEQ ID NO: 1265948 - RNA, 13 nt, Human
cugcccuggugcu

SEQ ID NO: 1265949 - RNA, 14 nt, Human
cugcccuggugcug

SEQ ID NO: 1265950 - RNA, 15 nt, Human
cugcccuggugcugc

SEQ ID NO: 1265951 - RNA, 16 nt, Human
cugcccuggugcugcc

SEQ ID NO: 1265952 - RNA, 12 nt, Human
cugcccccugca

SEQ ID NO: 1265953 - RNA, 13 nt, Human
cugcccccugcag

SEQ ID NO: 1265954 - RNA, 14 nt, Human
cugcccccugcaga

SEQ ID NO: 1265955 - RNA, 15 nt, Human
cugcccccugcagaa

SEQ ID NO: 1265956 - RNA, 14 nt, Human
cugcccccugcagg

SEQ ID NO: 1265957 - RNA, 15 nt, Human
cugcccccugcagga

SEQ ID NO: 1265958 - RNA, 16 nt, Human
cugcccccugcaggaa

SEQ ID NO: 1265959 - RNA, 22 nt, Human
cugcccccugcaggaaggagcu

SEQ ID NO: 1265960 - RNA, 23 nt, Human
cugcccccugcaggaaggagcug

SEQ ID NO: 1265961 - RNA, 18 nt, Human
cugcccccugcugccaug

SEQ ID NO: 1265962 - RNA, 13 nt, Human
cugcccccugcug

SEQ ID NO: 1265963 - RNA, 20 nt, Human
cugcccugguuuccugcccu

SEQ ID NO: 1265964 - RNA, 17 nt, Human
cugcccugguggcccuc

SEQ ID NO: 1265965 - RNA, 18 nt, Human
cugcccugguggcccucu

SEQ ID NO: 1265966 - RNA, 22 nt, Human
cugccuccugccggcuccuugg

SEQ ID NO: 1265967 - RNA, 15 nt, Human
cugccuccugccggc

SEQ ID NO: 1265968 - RNA, 23 nt, Human
cugccuccugccggcuccuuggu

SEQ ID NO: 1265969 - RNA, 15 nt, Human
cugccucgaaacaca

SEQ ID NO: 1265970 - RNA, 18 nt, Human
cugccucgaaacacagaa

SEQ ID NO: 1265971 - RNA, 19 nt, Human
cugccucgaaacacagaaa

SEQ ID NO: 1265972 - RNA, 15 nt, Human
cugccucuacuggga

SEQ ID NO: 1265973 - RNA, 17 nt, Human
cugccucuacugggaag

SEQ ID NO: 1265974 - RNA, 18 nt, Human
cugccucuacugggaagg

SEQ ID NO: 1265975 - RNA, 19 nt, Human
cugccucuacugggaaggc

SEQ ID NO: 1265976 - RNA, 22 nt, Human
cugccucuacugggaaggcuac

SEQ ID NO: 1265977 - RNA, 22 nt, Human
cugccucucaucaacugaauga

SEQ ID NO: 1265978 - RNA, 13 nt, Human
cugccucucccag

SEQ ID NO: 1265979 - RNA, 14 nt, Human
cugccucucccagg

SEQ ID NO: 1265980 - RNA, 15 nt, Human
cugccucucccaggc

SEQ ID NO: 1265981 - RNA, 17 nt, Human
cugccucucccaggcag

SEQ ID NO: 1265982 - RNA, 24 nt, Human
cugccugucccuaccccauggugc

SEQ ID NO: 1265983 - RNA, 21 nt, Human
cugccugucccuaccccaugg

SEQ ID NO: 1265984 - RNA, 19 nt, Human
cugccuguucccauucuug

SEQ ID NO: 1265985 - RNA, 15 nt, Human
cugccuguucccauu

SEQ ID NO: 1265986 - RNA, 15 nt, Human
cugcuagaacauggu

SEQ ID NO: 1265987 - RNA, 13 nt, Human
cugcuacuuauau

SEQ ID NO: 1265988 - RNA, 21 nt, Human
cugcuacuuauauaauugcca

SEQ ID NO: 1265989 - RNA, 16 nt, Human
cugcucaacuugcaaa

SEQ ID NO: 1265990 - RNA, 18 nt, Human
cugcuauuaggccagcaa

SEQ ID NO: 1265991 - RNA, 14 nt, Human
cugcuauuugaagu

SEQ ID NO: 1265992 - RNA, 15 nt, Human
cugcuaucauuauuc

SEQ ID NO: 1265993 - RNA, 21 nt, Human
cugcuaugguuuucuccaaga

SEQ ID NO: 1265994 - RNA, 21 nt, Human
cugcuauuaggccagcaagcg

SEQ ID NO: 1265995 - RNA, 15 nt, Human
cugcugagaaccugg

SEQ ID NO: 1265996 - RNA, 22 nt, Human
cugcugagcucugagaggcccu

SEQ ID NO: 1265997 - RNA, 17 nt, Human
cugcuauuuuucauccu

SEQ ID NO: 1265998 - RNA, 16 nt, Human
cugcugagaaccuggc

SEQ ID NO: 1265999 - RNA, 17 nt, Human
cugcugagaaccuggcc

SEQ ID NO: 1266000 - RNA, 18 nt, Human
cugcugagaaccuggccu

SEQ ID NO: 1266001 - RNA, 19 nt, Human
cugcugagaaccuggccuu

SEQ ID NO: 1266002 - RNA, 20 nt, Human
cugcugagaaccuggccuuc

SEQ ID NO: 1266003 - RNA, 20 nt, Human
cugcugagauacauacagaa

SEQ ID NO: 1266004 - RNA, 19 nt, Human
cugcugagauacauacaga

SEQ ID NO: 1266005 - RNA, 13 nt, Human
cugcugagcucug

SEQ ID NO: 1266006 - RNA, 14 nt, Human
cugcugagcucuga

SEQ ID NO: 1266007 - RNA, 15 nt, Human
cugcugagcucugag

SEQ ID NO: 1266008 - RNA, 16 nt, Human
cugcugagcucugaga

SEQ ID NO: 1266009 - RNA, 17 nt, Human
cugcugagcucugagag

SEQ ID NO: 1266010 - RNA, 18 nt, Human
cugcugagcucugagagg

SEQ ID NO: 1266011 - RNA, 19 nt, Human
cugcugagcucugagaggc

SEQ ID NO: 1266012 - RNA, 21 nt, Human
cugcugagcucugagaggccc

SEQ ID NO: 1266013 - RNA, 23 nt, Human
cugcugagcucugagaggcccug

SEQ ID NO: 1266014 - RNA, 13 nt, Human
cuggcagccgugc

SEQ ID NO: 1266015 - RNA, 12 nt, Human
cuggcucuguga

SEQ ID NO: 1266016 - RNA, 17 nt, Human
cuggcagccgugccuuc

SEQ ID NO: 1266017 - RNA, 18 nt, Human
cuggcagccgugccuuca

SEQ ID NO: 1266018 - RNA, 14 nt, Human
cuggcccuauuuag

SEQ ID NO: 1266019 - RNA, 19 nt, Human
cuggcagccgugccuucag

SEQ ID NO: 1266020 - RNA, 19 nt, Human
cuggcucccacaggcccuu

SEQ ID NO: 1266021 - RNA, 22 nt, Human
cuggcucccacaggcccuuccu

SEQ ID NO: 1266022 - RNA, 17 nt, Human
cuggccgaguccaagcu

SEQ ID NO: 1266023 - RNA, 18 nt, Human
cuggccgaguccaagcug

SEQ ID NO: 1266024 - RNA, 20 nt, Human
cuggccgaguccaagcuggg

SEQ ID NO: 1266025 - RNA, 23 nt, Human
cuggccgaguccaagcugggaga

SEQ ID NO: 1266026 - RNA, 21 nt, Human
cuggccgcccccagcccccuc

SEQ ID NO: 1266027 - RNA, 13 nt, Human
cuggccgcccccu

SEQ ID NO: 1266028 - RNA, 14 nt, Human
cuggccgcccccug

SEQ ID NO: 1266029 - RNA, 22 nt, Human
cuggccgcccccugccccccag

SEQ ID NO: 1266030 - RNA, 17 nt, Human
cuggccgccugggucca

SEQ ID NO: 1266031 - RNA, 19 nt, Human
cuggauccaucaggccacu

SEQ ID NO: 1266032 - RNA, 20 nt, Human
cuggaucuccauucucucag

SEQ ID NO: 1266033 - RNA, 20 nt, Human
cuggaaaccuuccacccagu

SEQ ID NO: 1266034 - RNA, 17 nt, Human
cuggaaaccuuccaccc

SEQ ID NO: 1266035 - RNA, 17 nt, Human
cuggaaaauaauacugc

SEQ ID NO: 1266036 - RNA, 20 nt, Human
cuggaaaauaauacugcuga

SEQ ID NO: 1266037 - RNA, 23 nt, Human
cuggaaaauaauacugcugagau

SEQ ID NO: 1266038 - RNA, 23 nt, Human
cuggaaaaguauguuagugcaaa

SEQ ID NO: 1266039 - RNA, 14 nt, Human
cuggaaaacagaac

SEQ ID NO: 1266040 - RNA, 16 nt, Human
cuggaaaacagaacac

SEQ ID NO: 1266041 - RNA, 17 nt, Human
cuggaaaacagaacacu

SEQ ID NO: 1266042 - RNA, 18 nt, Human
cuggaaaacagaacacuu

SEQ ID NO: 1266043 - RNA, 19 nt, Human
cuggaaaacagaacacuua

SEQ ID NO: 1266044 - RNA, 24 nt, Human
cugcuuccaauuuucuggaauaca

SEQ ID NO: 1266045 - RNA, 19 nt, Human
cugcuucaguguauggaaa

SEQ ID NO: 1266046 - RNA, 21 nt, Human
cugcuucaguguauggaaaua

SEQ ID NO: 1266047 - RNA, 18 nt, Human
cuggacucucagucucug

SEQ ID NO: 1266048 - RNA, 19 nt, Human
cuggacucucagucucuga

SEQ ID NO: 1266049 - RNA, 20 nt, Human
cuggacucucagucucugag

SEQ ID NO: 1266050 - RNA, 21 nt, Human
cuggacucucagucucugagc

SEQ ID NO: 1266051 - RNA, 22 nt, Human
cuggacuccucuguccaggcac

SEQ ID NO: 1266052 - RNA, 23 nt, Human
cuggacuccucuguccaggcacu

SEQ ID NO: 1266053 - RNA, 23 nt, Human
cuggacucuaaagucuguugauu

SEQ ID NO: 1266054 - RNA, 14 nt, Human
cuggacucucaguc

SEQ ID NO: 1266055 - RNA, 17 nt, Human
cuggacucucagucucu

SEQ ID NO: 1266056 - RNA, 11 nt, Human
cuggaaagaag

SEQ ID NO: 1266057 - RNA, 23 nt, Human
cuggaaagcuuuucuauuuuaau

SEQ ID NO: 1266058 - RNA, 14 nt, Human
cuggagaacuagag

SEQ ID NO: 1266059 - RNA, 15 nt, Human
cuggagaacuagaga

SEQ ID NO: 1266060 - RNA, 23 nt, Human
cuggacucucagucucugagcag

SEQ ID NO: 1266061 - RNA, 13 nt, Human
cuggagaaagggc

SEQ ID NO: 1266062 - RNA, 23 nt, Human
cuggagaaagggcccugggccug

SEQ ID NO: 1266063 - RNA, 19 nt, Human
cuggagaagacccuccccg

SEQ ID NO: 1266064 - RNA, 17 nt, Human
cuggauccaucaggcca

SEQ ID NO: 1266065 - RNA, 16 nt, Human
cuggaguuagggacug

SEQ ID NO: 1266066 - RNA, 19 nt, Human
cuggaucagcguggccuug

SEQ ID NO: 1266067 - RNA, 17 nt, Human
cuggaguuagggacuga

SEQ ID NO: 1266068 - RNA, 16 nt, Human
cugugaacugaacucu

SEQ ID NO: 1266069 - RNA, 13 nt, Human
cugugaacugaac

SEQ ID NO: 1266070 - RNA, 15 nt, Human
cugugaacugaacuc

SEQ ID NO: 1266071 - RNA, 15 nt, Human
cugugagcccagcug

SEQ ID NO: 1266072 - RNA, 23 nt, Human
cugugagaugcuagaacucccuu

SEQ ID NO: 1266073 - RNA, 15 nt, Human
cugugaaugccacug

SEQ ID NO: 1266074 - RNA, 16 nt, Human
cugugaaugccacugc

SEQ ID NO: 1266075 - RNA, 20 nt, Human
cugugaaugccacugccuuc

SEQ ID NO: 1266076 - RNA, 21 nt, Human
cugugaaugccacugccuucg

SEQ ID NO: 1266077 - RNA, 13 nt, Human
cugugaauuaagc

SEQ ID NO: 1266078 - RNA, 14 nt, Human
cugugagcccagcu

SEQ ID NO: 1266079 - RNA, 15 nt, Human
cuguguagcugugac

SEQ ID NO: 1266080 - RNA, 16 nt, Human
cuguguagcugugacc

SEQ ID NO: 1266081 - RNA, 17 nt, Human
cuguguagcugugaccu

SEQ ID NO: 1266082 - RNA, 18 nt, Human
cuguguagcugugaccug

SEQ ID NO: 1266083 - RNA, 19 nt, Human
cuguguagcugugaccugc

SEQ ID NO: 1266084 - RNA, 20 nt, Human
cuguguagcugugaccugcu

SEQ ID NO: 1266085 - RNA, 23 nt, Human
cuguguagcugugaccugcugag

SEQ ID NO: 1266086 - RNA, 22 nt, Human
cuguguagcugugaccugcuga

SEQ ID NO: 1266087 - RNA, 15 nt, Human
cuguguauuccaaga

SEQ ID NO: 1266088 - RNA, 19 nt, Human
cuguguauuccaagacaug

SEQ ID NO: 1266089 - RNA, 14 nt, Human
cuguguauuugcuu

SEQ ID NO: 1266090 - RNA, 15 nt, Human
cuguguauuugcuuu

SEQ ID NO: 1266091 - RNA, 16 nt, Human
cuguguauuugcuuuu

SEQ ID NO: 1266092 - RNA, 22 nt, Human
cuguguccaugcgcucagggcc

SEQ ID NO: 1266093 - RNA, 23 nt, Human
cuguguccaugcgcucagggcca

SEQ ID NO: 1266094 - RNA, 21 nt, Human
cuguguccaaaaccgccagcu

SEQ ID NO: 1266095 - RNA, 22 nt, Human
cuguguccaaaaccgccagcuc

SEQ ID NO: 1266096 - RNA, 13 nt, Human
cuguguccaugcg

SEQ ID NO: 1266097 - RNA, 18 nt, Human
cuguguccaugcgcucag

SEQ ID NO: 1266098 - RNA, 19 nt, Human
cuguguccaugcgcucagg

SEQ ID NO: 1266099 - RNA, 21 nt, Human
cuguguccaugcgcucagggc

SEQ ID NO: 1266100 - RNA, 13 nt, Human
cuguuagcagaca

SEQ ID NO: 1266101 - RNA, 15 nt, Human
cuguuagcagacagg

SEQ ID NO: 1266102 - RNA, 13 nt, Human
cuguucacucuac

SEQ ID NO: 1266103 - RNA, 14 nt, Human
cuguuaugcuguga

SEQ ID NO: 1266104 - RNA, 23 nt, Human
cuguuaucaaacaccaacauaaa

SEQ ID NO: 1266105 - RNA, 14 nt, Human
cuguuauauuucau

SEQ ID NO: 1266106 - RNA, 17 nt, Human
cuguuauauuucaucau

SEQ ID NO: 1266107 - RNA, 19 nt, Human
cuguuaucaaaacuuucuu

SEQ ID NO: 1266108 - RNA, 19 nt, Human
cuguuaugcugugacacau

SEQ ID NO: 1266109 - RNA, 22 nt, Human
cuuaaaauaaugaauacauuuc

SEQ ID NO: 1266110 - RNA, 12 nt, Human
cuuaaaauacaa

SEQ ID NO: 1266111 - RNA, 13 nt, Human
cuuaaaauacaag

SEQ ID NO: 1266112 - RNA, 12 nt, Human
cuuaaaauaagc

SEQ ID NO: 1266113 - RNA, 13 nt, Human
cuuaaaauaagca

SEQ ID NO: 1266114 - RNA, 14 nt, Human
cuuaaaauaagcag

SEQ ID NO: 1266115 - RNA, 15 nt, Human
cuuaaaauaagcagg

SEQ ID NO: 1266116 - RNA, 21 nt, Human
cuuaaaaaugguuuaaauggu

SEQ ID NO: 1266117 - RNA, 12 nt, Human
cuuaaaaccugc

SEQ ID NO: 1266118 - RNA, 15 nt, Human
cuuaaaaccugcuuu

SEQ ID NO: 1266119 - RNA, 23 nt, Human
cuuaaaaccugcuuuucaaugug

SEQ ID NO: 1266120 - RNA, 12 nt, Human
cuuaaaacuccu

SEQ ID NO: 1266121 - RNA, 12 nt, Human
cuuaaaacuuug

SEQ ID NO: 1266122 - RNA, 20 nt, Human
cuuaaaaaugguuuaaaugg

SEQ ID NO: 1266123 - RNA, 13 nt, Human
cuuaaaaaugguu

SEQ ID NO: 1266124 - RNA, 21 nt, Human
cuguuguuaugaugugcuuaa

SEQ ID NO: 1266125 - RNA, 23 nt, Human
cuguuguuaugaugugcuuaaca

SEQ ID NO: 1266126 - RNA, 19 nt, Human
cuguuguuaugaugugcuu

SEQ ID NO: 1266127 - RNA, 17 nt, Human
cuguuguuaugaugugc

SEQ ID NO: 1266128 - RNA, 15 nt, Human
cuguuguuaugaugu

SEQ ID NO: 1266129 - RNA, 14 nt, Human
cuguuguuaugaug

SEQ ID NO: 1266130 - RNA, 23 nt, Human
cuuaaagaauucaaauuuuaucu

SEQ ID NO: 1266131 - RNA, 22 nt, Human
cuuaaacaguugcacagcaucu

SEQ ID NO: 1266132 - RNA, 15 nt, Human
cuuaaaccuucaguu

SEQ ID NO: 1266133 - RNA, 23 nt, Human
cuuaaaccuucaguuaugauuuu

SEQ ID NO: 1266134 - RNA, 14 nt, Human
cuuaaacuaaaugu

SEQ ID NO: 1266135 - RNA, 15 nt, Human
cuuaaacuaaaugug

SEQ ID NO: 1266136 - RNA, 20 nt, Human
cuuaaacaguugcacagcau

SEQ ID NO: 1266137 - RNA, 19 nt, Human
cuuaaacaguugcacagca

SEQ ID NO: 1266138 - RNA, 18 nt, Human
cuuaaacaguugcacagc

SEQ ID NO: 1266139 - RNA, 14 nt, Human
cuuaaaauacaaga

SEQ ID NO: 1266140 - RNA, 16 nt, Human
cuuaaaauacaagacu

SEQ ID NO: 1266141 - RNA, 19 nt, Human
cuuaaaauacaagacugcc

SEQ ID NO: 1266142 - RNA, 18 nt, Human
cuuaaaauacaagacugc

SEQ ID NO: 1266143 - RNA, 15 nt, Human
cuguuggcaggcugg

SEQ ID NO: 1266144 - RNA, 16 nt, Human
cuguuggcaggcuggc

SEQ ID NO: 1266145 - RNA, 18 nt, Human
cuguuggcaggcuggcca

SEQ ID NO: 1266146 - RNA, 19 nt, Human
cuguuggcaggcuggccag

SEQ ID NO: 1266147 - RNA, 14 nt, Human
cuguugcugccuca

SEQ ID NO: 1266148 - RNA, 22 nt, Human
cuguuguuaucuguuugagaaa

SEQ ID NO: 1266149 - RNA, 13 nt, Human
cuguuguuaucug

SEQ ID NO: 1266150 - RNA, 14 nt, Human
cuggucuguaggga

SEQ ID NO: 1266151 - RNA, 12 nt, Human
cuggugccucac

SEQ ID NO: 1266152 - RNA, 19 nt, Human
cuggucugcuguuccagug

SEQ ID NO: 1266153 - RNA, 21 nt, Human
cuggucugguugggcagccag

SEQ ID NO: 1266154 - RNA, 17 nt, Human
cuggucucucuaugccu

SEQ ID NO: 1266155 - RNA, 21 nt, Human
cuggucucucuaugccucucu

SEQ ID NO: 1266156 - RNA, 23 nt, Human
cuggucucucuaugccucucuac

SEQ ID NO: 1266157 - RNA, 24 nt, Human
cuggucucucuaugccucucuaca

SEQ ID NO: 1266158 - RNA, 14 nt, Human
cuggucucuccuug

SEQ ID NO: 1266159 - RNA, 20 nt, Human
cugucuacacuaagagagaa

SEQ ID NO: 1266160 - RNA, 17 nt, Human
cuguccuuuuuccucuc

SEQ ID NO: 1266161 - RNA, 15 nt, Human
cugucguuaaaaaca

SEQ ID NO: 1266162 - RNA, 23 nt, Human
cuguccugucaucaucauggcca

SEQ ID NO: 1266163 - RNA, 20 nt, Human
cuguccugucaucaucaugg

SEQ ID NO: 1266164 - RNA, 21 nt, Human
cuguccugucaucaucauggc

SEQ ID NO: 1266165 - RNA, 17 nt, Human
cuguccuugaaggacua

SEQ ID NO: 1266166 - RNA, 20 nt, Human
cuguccuugaaggacuaaua

SEQ ID NO: 1266167 - RNA, 13 nt, Human
cuguccuuucuag

SEQ ID NO: 1266168 - RNA, 20 nt, Human
cuguccuuucuagagcacug

SEQ ID NO: 1266169 - RNA, 21 nt, Human
cuguccuuucuagagcacugc

SEQ ID NO: 1266170 - RNA, 22 nt, Human
cuguccuuucuagagcacugcc

SEQ ID NO: 1266171 - RNA, 23 nt, Human
cuguccuuucuagagcacugcca

SEQ ID NO: 1266172 - RNA, 21 nt, Human
cuguaggaagguacuguauga

SEQ ID NO: 1266173 - RNA, 14 nt, Human
cugucaggauugcg

SEQ ID NO: 1266174 - RNA, 15 nt, Human
cugucaggauugcga

SEQ ID NO: 1266175 - RNA, 17 nt, Human
cugucaggauugcgaga

SEQ ID NO: 1266176 - RNA, 19 nt, Human
cugucaggauugcgagaga

SEQ ID NO: 1266177 - RNA, 21 nt, Human
cugucaggauugcgagagaug

SEQ ID NO: 1266178 - RNA, 22 nt, Human
cugucaggauugcgagagaugu

SEQ ID NO: 1266179 - RNA, 24 nt, Human
cugucaggauugcgagagaugugu

SEQ ID NO: 1266180 - RNA, 23 nt, Human
cugucaggauugcgagagaugug

SEQ ID NO: 1266181 - RNA, 13 nt, Human
cugucagucacag

SEQ ID NO: 1266182 - RNA, 14 nt, Human
cugucagucacagc

SEQ ID NO: 1266183 - RNA, 15 nt, Human
cugucagucacagcc

SEQ ID NO: 1266184 - RNA, 17 nt, Human
cugucagucacagccac

SEQ ID NO: 1266185 - RNA, 20 nt, Human
cuguaggaagguacuguaug

SEQ ID NO: 1266186 - RNA, 19 nt, Human
cuguaggaagguacuguau

SEQ ID NO: 1266187 - RNA, 18 nt, Human
cuguaggaagguacugua

SEQ ID NO: 1266188 - RNA, 17 nt, Human
cuguaggaagguacugu

SEQ ID NO: 1266189 - RNA, 15 nt, Human
cuguagcucuaaaau

SEQ ID NO: 1266190 - RNA, 14 nt, Human
cuguaggaaaccca

SEQ ID NO: 1266191 - RNA, 22 nt, Human
cuguagccuaaacuccaaacau

SEQ ID NO: 1266192 - RNA, 17 nt, Human
cuguagccccagugaca

SEQ ID NO: 1266193 - RNA, 18 nt, Human
cuguagccccagugacag

SEQ ID NO: 1266194 - RNA, 20 nt, Human
cuguagccccagugacagcu

SEQ ID NO: 1266195 - RNA, 21 nt, Human
cuguagccccagugacagcua

SEQ ID NO: 1266196 - RNA, 22 nt, Human
cugucaugguguccagacagag

SEQ ID NO: 1266197 - RNA, 18 nt, Human
cugucagucacagccacc

SEQ ID NO: 1266198 - RNA, 14 nt, Human
cugucaucugugca

SEQ ID NO: 1266199 - RNA, 21 nt, Human
cugucaucugugcacugccca

SEQ ID NO: 1266200 - RNA, 15 nt, Human
cugucaucugugcac

SEQ ID NO: 1266201 - RNA, 20 nt, Human
cuguaagaaaauaucacuug

SEQ ID NO: 1266202 - RNA, 22 nt, Human
cuguaacuugauccauuucuaa

SEQ ID NO: 1266203 - RNA, 23 nt, Human
cuguaacuugauccauuucuaau

SEQ ID NO: 1266204 - RNA, 13 nt, Human
cuguaagaaaccu

SEQ ID NO: 1266205 - RNA, 21 nt, Human
cuguaagaaaccuacugccca

SEQ ID NO: 1266206 - RNA, 22 nt, Human
cuguaagaaaccuacugcccag

SEQ ID NO: 1266207 - RNA, 14 nt, Human
cuguaaagaguugc

SEQ ID NO: 1266208 - RNA, 12 nt, Human
cuguaaagaugu

SEQ ID NO: 1266209 - RNA, 16 nt, Human
cuguaaagauguuuau

SEQ ID NO: 1266210 - RNA, 21 nt, Human
cuguaaagauguuuauuucag

SEQ ID NO: 1266211 - RNA, 22 nt, Human
cuguaaagauguuuauuucagg

SEQ ID NO: 1266212 - RNA, 13 nt, Human
cuguaaagcaaaa

SEQ ID NO: 1266213 - RNA, 16 nt, Human
cuguaaagcaaaagau

SEQ ID NO: 1266214 - RNA, 23 nt, Human
cuguaaagcuaaaauaaagaaau

SEQ ID NO: 1266215 - RNA, 21 nt, Human
cuguaaauaaugugcacugaa

SEQ ID NO: 1266216 - RNA, 18 nt, Human
cuguaaagcuaaaauaaa

SEQ ID NO: 1266217 - RNA, 14 nt, Human
cuguaaaucuacac

SEQ ID NO: 1266218 - RNA, 18 nt, Human
cuguaaaucuacacacgg

SEQ ID NO: 1266219 - RNA, 16 nt, Human
cuguaacaagccagau

SEQ ID NO: 1266220 - RNA, 20 nt, Human
cuguacuugcucuugaugcc

SEQ ID NO: 1266221 - RNA, 19 nt, Human
cuguacuugcucuugaugc

SEQ ID NO: 1266222 - RNA, 16 nt, Human
cuguacuugcucuuga

SEQ ID NO: 1266223 - RNA, 21 nt, Human
cuguacuugcucuugaugccu

SEQ ID NO: 1266224 - RNA, 13 nt, Human
cuguagaguugcu

SEQ ID NO: 1266225 - RNA, 15 nt, Human
cuguagaguugcuga

SEQ ID NO: 1266226 - RNA, 16 nt, Human
cuguagaguugcugag

SEQ ID NO: 1266227 - RNA, 23 nt, Human
cuguagaguugcugagagggcuc

SEQ ID NO: 1266228 - RNA, 17 nt, Human
cuguagaguugcugaga

SEQ ID NO: 1266229 - RNA, 16 nt, Human
cuguagcacuuacugg

SEQ ID NO: 1266230 - RNA, 17 nt, Human
cugguuuucacauuaga

SEQ ID NO: 1266231 - RNA, 19 nt, Human
cuuuuaugugaaacauguu

SEQ ID NO: 1266232 - RNA, 14 nt, Human
cuuuuauuaaugca

SEQ ID NO: 1266233 - RNA, 16 nt, Human
cuuuuauuaaugcacu

SEQ ID NO: 1266234 - RNA, 19 nt, Human
cuuuuauuaaugcacuuuc

SEQ ID NO: 1266235 - RNA, 17 nt, Human
cuuuuauugacacagaa

SEQ ID NO: 1266236 - RNA, 18 nt, Human
cuuuuauugacacagaaa

SEQ ID NO: 1266237 - RNA, 18 nt, Human
cuuuuggaagguauuuaa

SEQ ID NO: 1266238 - RNA, 17 nt, Human
cuuuugcuuuuggcaaa

SEQ ID NO: 1266239 - RNA, 16 nt, Human
cuuuugcuuuugccca

SEQ ID NO: 1266240 - RNA, 18 nt, Human
cuuuugcuuuugcccauu

SEQ ID NO: 1266241 - RNA, 15 nt, Human
cuuuugcuuuuggca

SEQ ID NO: 1266242 - RNA, 18 nt, Human
cuuuugggggucaacagu

SEQ ID NO: 1266243 - RNA, 17 nt, Human
cuuuuggguuucugccc

SEQ ID NO: 1266244 - RNA, 19 nt, Human
cuuuuggguuucugcccug

SEQ ID NO: 1266245 - RNA, 20 nt, Human
cuuuuggguuucugcccugc

SEQ ID NO: 1266246 - RNA, 20 nt, Human
cuuuugguaaagacuggcuu

SEQ ID NO: 1266247 - RNA, 21 nt, Human
cuuuugguaaagacuggcuuu

SEQ ID NO: 1266248 - RNA, 11 nt, Human
cuuuuguauua

SEQ ID NO: 1266249 - RNA, 12 nt, Human
cuuuuguauuaa

SEQ ID NO: 1266250 - RNA, 13 nt, Human
cuuuuguauuaag

SEQ ID NO: 1266251 - RNA, 14 nt, Human
cuuuuguauuaaga

SEQ ID NO: 1266252 - RNA, 23 nt, Human
cuuuugcgguucaggaaaauuga

SEQ ID NO: 1266253 - RNA, 20 nt, Human
cuuuugccuuuugcaaccag

SEQ ID NO: 1266254 - RNA, 22 nt, Human
cuuuugcucuuagcugucugcu

SEQ ID NO: 1266255 - RNA, 14 nt, Human
cuuuugcuuuauuc

SEQ ID NO: 1266256 - RNA, 11 nt, Human
cuuuugcuuuu

SEQ ID NO: 1266257 - RNA, 14 nt, Human
gaaaaaauauauau

SEQ ID NO: 1266258 - RNA, 11 nt, Human
gaaaaaauaua

SEQ ID NO: 1266259 - RNA, 12 nt, Human
gaaaaaauauau

SEQ ID NO: 1266260 - RNA, 21 nt, Human
cuuuuuuuuuuuuuaauaaau

SEQ ID NO: 1266261 - RNA, 17 nt, Human
cuuuuguauuaagaaag

SEQ ID NO: 1266262 - RNA, 11 nt, Human
cuuuugucuac

SEQ ID NO: 1266263 - RNA, 19 nt, Human
cuuuugucuacacacccug

SEQ ID NO: 1266264 - RNA, 19 nt, Human
cuuuugugggggacuguaa

SEQ ID NO: 1266265 - RNA, 21 nt, Human
cuuuugugggggacuguaagu

SEQ ID NO: 1266266 - RNA, 12 nt, Human
cuuuuuuuguau

SEQ ID NO: 1266267 - RNA, 13 nt, Human
cuuuuuuuguaua

SEQ ID NO: 1266268 - RNA, 16 nt, Human
cuuuuuuuguauaguu

SEQ ID NO: 1266269 - RNA, 21 nt, Human
cuuuuuuuguauaguuaacac

SEQ ID NO: 1266270 - RNA, 13 nt, Human
cuuuuuuugugug

SEQ ID NO: 1266271 - RNA, 21 nt, Human
cuuuuuuuguguguauuugcu

SEQ ID NO: 1266272 - RNA, 22 nt, Human
cuuuuuuuguguguauuugcua

SEQ ID NO: 1266273 - RNA, 15 nt, Human
cuuuuuuuuccuucu

SEQ ID NO: 1266274 - RNA, 17 nt, Human
cuuuuuuuucuauuuca

SEQ ID NO: 1266275 - RNA, 18 nt, Human
cuuuuuuuucuauuucac

SEQ ID NO: 1266276 - RNA, 14 nt, Human
cuuuuuuuucuuua

SEQ ID NO: 1266277 - RNA, 15 nt, Human
cuuuuuuuucuuuaa

SEQ ID NO: 1266278 - RNA, 16 nt, Human
gaaaagcagacauuuu

SEQ ID NO: 1266279 - RNA, 15 nt, Human
gaaaagcagacauuu

SEQ ID NO: 1266280 - RNA, 18 nt, Human
gaaaagcaucagaaagag

SEQ ID NO: 1266281 - RNA, 23 nt, Human
gaaaagcauggcuugaauaagga

SEQ ID NO: 1266282 - RNA, 22 nt, Human
gaaaagccuggguuugguguau

SEQ ID NO: 1266283 - RNA, 14 nt, Human
gaaaauuaacauga

SEQ ID NO: 1266284 - RNA, 20 nt, Human
gaaaagccuggguuuggugu

SEQ ID NO: 1266285 - RNA, 13 nt, Human
gaaaagcuaagag

SEQ ID NO: 1266286 - RNA, 21 nt, Human
gaaaauguugagaaucccaaa

SEQ ID NO: 1266287 - RNA, 18 nt, Human
gaaaauuaggauuucaug

SEQ ID NO: 1266288 - RNA, 22 nt, Human
gaaaauuaggauuucaugauuu

SEQ ID NO: 1266289 - RNA, 20 nt, Human
gaaaauuaagggccgauuua

SEQ ID NO: 1266290 - RNA, 23 nt, Human
gaaaauuaagggccgauuuaauu

SEQ ID NO: 1266291 - RNA, 14 nt, Human
gaaaauuacaaaaa

SEQ ID NO: 1266292 - RNA, 18 nt, Human
gaaaacuuguauuaugug

SEQ ID NO: 1266293 - RNA, 10 nt, Human
gaaaacuuca

SEQ ID NO: 1266294 - RNA, 19 nt, Human
gaaaacugcaacuuguaaa

SEQ ID NO: 1266295 - RNA, 21 nt, Human
gaaaaaauauauguauauaca

SEQ ID NO: 1266296 - RNA, 18 nt, Human
gaaaacuccaccuuccca

SEQ ID NO: 1266297 - RNA, 16 nt, Human
gaaaacucuuugcugc

SEQ ID NO: 1266298 - RNA, 16 nt, Human
gaaaauuuuuguagua

SEQ ID NO: 1266299 - RNA, 13 nt, Human
gaaaauuuuugua

SEQ ID NO: 1266300 - RNA, 14 nt, Human
gaaaauuagacugu

SEQ ID NO: 1266301 - RNA, 16 nt, Human
gaaaauuagacuguga

SEQ ID NO: 1266302 - RNA, 14 nt, Human
gaaacaaaaacacu

SEQ ID NO: 1266303 - RNA, 19 nt, Human
gaaacaaaaacacuaaaaa

SEQ ID NO: 1266304 - RNA, 23 nt, Human
gaaacaaaaacacuaaaaauaaa

SEQ ID NO: 1266305 - RNA, 13 nt, Human
gaaacaaaauaca

SEQ ID NO: 1266306 - RNA, 18 nt, Human
gaaaauuagacugugauu

SEQ ID NO: 1266307 - RNA, 12 nt, Human
gaaacuuggcuc

SEQ ID NO: 1266308 - RNA, 18 nt, Human
gaaagaaguggggacaga

SEQ ID NO: 1266309 - RNA, 20 nt, Human
gaaagaaguguggggauuuu

SEQ ID NO: 1266310 - RNA, 13 nt, Human
gaaagaauagaac

SEQ ID NO: 1266311 - RNA, 16 nt, Human
gaaagaagaaaagguu

SEQ ID NO: 1266312 - RNA, 15 nt, Human
gaaagaagaaggugg

SEQ ID NO: 1266313 - RNA, 23 nt, Human
gaaacuucagcgguuuauauaag

SEQ ID NO: 1266314 - RNA, 19 nt, Human
gaaacuuaaauguuauuau

SEQ ID NO: 1266315 - RNA, 21 nt, Human
gaaacuuaaauguuauuaucu

SEQ ID NO: 1266316 - RNA, 15 nt, Human
gaaagacgcacuuug

SEQ ID NO: 1266317 - RNA, 17 nt, Human
gaaagacgcacuuuggc

SEQ ID NO: 1266318 - RNA, 19 nt, Human
gaaagacgcacuuuggcuu

SEQ ID NO: 1266319 - RNA, 16 nt, Human
gaaagacagcuucuca

SEQ ID NO: 1266320 - RNA, 17 nt, Human
gaaagacagcuucucau

SEQ ID NO: 1266321 - RNA, 19 nt, Human
gaaagaccaggccaauguc

SEQ ID NO: 1266322 - RNA, 16 nt, Human
gaaagaccauuuuucc

SEQ ID NO: 1266323 - RNA, 19 nt, Human
gaaauauuugugacaaaaa

SEQ ID NO: 1266324 - RNA, 20 nt, Human
gaaauauuuuaaaaucagcu

SEQ ID NO: 1266325 - RNA, 13 nt, Human
gaaagguuuuuuu

SEQ ID NO: 1266326 - RNA, 17 nt, Human
gaaaguacacucugcug

SEQ ID NO: 1266327 - RNA, 18 nt, Human
gaaaguacacucugcugu

SEQ ID NO: 1266328 - RNA, 19 nt, Human
gaaaguacacucugcuguu

SEQ ID NO: 1266329 - RNA, 22 nt, Human
gaaaguacacucugcuguuuga

SEQ ID NO: 1266330 - RNA, 20 nt, Human
gaaaguacacucugcuguuu

SEQ ID NO: 1266331 - RNA, 13 nt, Human
gaaauauuuuaaa

SEQ ID NO: 1266332 - RNA, 15 nt, Human
gaaaucaacuugcuu

SEQ ID NO: 1266333 - RNA, 18 nt, Human
gaaaugaaagcagggacu

SEQ ID NO: 1266334 - RNA, 18 nt, Human
gaacaaauuuacagagac

SEQ ID NO: 1266335 - RNA, 17 nt, Human
gaaauuuuucuucuuga

SEQ ID NO: 1266336 - RNA, 17 nt, Human
gaacaaauuuacagaga

SEQ ID NO: 1266337 - RNA, 23 nt, Human
gaacaaauuuacagagacagaaa

SEQ ID NO: 1266338 - RNA, 15 nt, Human
gaaauuuuucuucuu

SEQ ID NO: 1266339 - RNA, 17 nt, Human
gaacaagagaagcauuc

SEQ ID NO: 1266340 - RNA, 15 nt, Human
gaacaagagaagcau

SEQ ID NO: 1266341 - RNA, 16 nt, Human
gaacaagagaagcauu

SEQ ID NO: 1266342 - RNA, 23 nt, Human
cuugauguaaaaucuugucaugu

SEQ ID NO: 1266343 - RNA, 19 nt, Human
cuugauguaaggaugggca

SEQ ID NO: 1266344 - RNA, 20 nt, Human
cuugaugucuuuguuaagac

SEQ ID NO: 1266345 - RNA, 21 nt, Human
cuugauguaaggaugggcaug

SEQ ID NO: 1266346 - RNA, 16 nt, Human
cuugauggcuaacuua

SEQ ID NO: 1266347 - RNA, 21 nt, Human
cuugauggcuaacuuacaaag

SEQ ID NO: 1266348 - RNA, 17 nt, Human
cuugaugggauucugga

SEQ ID NO: 1266349 - RNA, 18 nt, Human
cuugaugggauucuggac

SEQ ID NO: 1266350 - RNA, 19 nt, Human
cuugaugggauucuggaca

SEQ ID NO: 1266351 - RNA, 13 nt, Human
cuugauguaaaau

SEQ ID NO: 1266352 - RNA, 14 nt, Human
cuugauguaaaauc

SEQ ID NO: 1266353 - RNA, 15 nt, Human
cuugauguaaaaucu

SEQ ID NO: 1266354 - RNA, 17 nt, Human
cuugauguaaaaucuug

SEQ ID NO: 1266355 - RNA, 18 nt, Human
cuugauguaaaaucuugu

SEQ ID NO: 1266356 - RNA, 20 nt, Human
cuugauguaaaaucuuguca

SEQ ID NO: 1266357 - RNA, 21 nt, Human
cuugauguaaaaucuugucau

SEQ ID NO: 1266358 - RNA, 22 nt, Human
cuugauguaaaaucuugucaug

SEQ ID NO: 1266359 - RNA, 13 nt, Human
cuugauucugcag

SEQ ID NO: 1266360 - RNA, 17 nt, Human
cuugauucugcaguaaa

SEQ ID NO: 1266361 - RNA, 20 nt, Human
cuugauucugcaguaaaucu

SEQ ID NO: 1266362 - RNA, 21 nt, Human
cuugauucugcaguaaaucuu

SEQ ID NO: 1266363 - RNA, 22 nt, Human
cuugauucugcaguaaaucuuu

SEQ ID NO: 1266364 - RNA, 19 nt, Human
cuugauugguguugccagu

SEQ ID NO: 1266365 - RNA, 21 nt, Human
cuugauuuaucacacaaagca

SEQ ID NO: 1266366 - RNA, 22 nt, Human
cuugauuuaucacacaaagcag

SEQ ID NO: 1266367 - RNA, 18 nt, Human
cuugccucaaugccagua

SEQ ID NO: 1266368 - RNA, 23 nt, Human
cuugccucauuuuuuuccuugca

SEQ ID NO: 1266369 - RNA, 13 nt, Human
cuugccucauuuu

SEQ ID NO: 1266370 - RNA, 24 nt, Human
cuugccucugcacacccuccagag

SEQ ID NO: 1266371 - RNA, 14 nt, Human
cuugccucugcaca

SEQ ID NO: 1266372 - RNA, 15 nt, Human
cuugccucugcacac

SEQ ID NO: 1266373 - RNA, 19 nt, Human
cuuucacaggcagccagug

SEQ ID NO: 1266374 - RNA, 13 nt, Human
cuuucacagcucc

SEQ ID NO: 1266375 - RNA, 14 nt, Human
cuuucacagcuccu

SEQ ID NO: 1266376 - RNA, 15 nt, Human
cuuucacagcuccuc

SEQ ID NO: 1266377 - RNA, 18 nt, Human
cuuucacagcuccuccca

SEQ ID NO: 1266378 - RNA, 13 nt, Human
cuuucacaggcag

SEQ ID NO: 1266379 - RNA, 14 nt, Human
cuuucacaggcagc

SEQ ID NO: 1266380 - RNA, 15 nt, Human
cuuucacaggcagcc

SEQ ID NO: 1266381 - RNA, 21 nt, Human
cuuuaacugccguaauuuaac

SEQ ID NO: 1266382 - RNA, 23 nt, Human
cuuuaacugccguaauuuaacuu

SEQ ID NO: 1266383 - RNA, 19 nt, Human
cuuuaacuuaauugcuaug

SEQ ID NO: 1266384 - RNA, 15 nt, Human
cuuuaacuuaaauag

SEQ ID NO: 1266385 - RNA, 18 nt, Human
cuuuaacuucuguuuuac

SEQ ID NO: 1266386 - RNA, 15 nt, Human
cuuuaagaguuuaaa

SEQ ID NO: 1266387 - RNA, 19 nt, Human
cuuuaagaguuuaaaauca

SEQ ID NO: 1266388 - RNA, 22 nt, Human
cuuuaagaguuuaaaaucauca

SEQ ID NO: 1266389 - RNA, 20 nt, Human
cuuuaagaguuuaaaaucau

SEQ ID NO: 1266390 - RNA, 21 nt, Human
cuuuaaugauaugcuuguaac

SEQ ID NO: 1266391 - RNA, 22 nt, Human
cuuuaaugauaugcuuguaacu

SEQ ID NO: 1266392 - RNA, 18 nt, Human
cuuucaauacagauauau

SEQ ID NO: 1266393 - RNA, 19 nt, Human
cuuucaauacagauauauu

SEQ ID NO: 1266394 - RNA, 20 nt, Human
cuuucaauacagauauauuu

SEQ ID NO: 1266395 - RNA, 20 nt, Human
cuugucuuauucccuuccug

SEQ ID NO: 1266396 - RNA, 16 nt, Human
cuugguucccccacug

SEQ ID NO: 1266397 - RNA, 19 nt, Human
cuugguucccccacugauc

SEQ ID NO: 1266398 - RNA, 16 nt, Human
cuugguuccuucccaa

SEQ ID NO: 1266399 - RNA, 19 nt, Human
cuugguucuugaggggacc

SEQ ID NO: 1266400 - RNA, 22 nt, Human
cuugguucuugaggggaccagg

SEQ ID NO: 1266401 - RNA, 14 nt, Human
cuugguugaggaaa

SEQ ID NO: 1266402 - RNA, 15 nt, Human
cuugguugaggaaac

SEQ ID NO: 1266403 - RNA, 16 nt, Human
cuugguugaggaaaca

SEQ ID NO: 1266404 - RNA, 23 nt, Human
cuugguucuugaggggaccagga

SEQ ID NO: 1266405 - RNA, 23 nt, Human
cuuggucucagugucaaugcagc

SEQ ID NO: 1266406 - RNA, 15 nt, Human
cuugguccuugauuu

SEQ ID NO: 1266407 - RNA, 13 nt, Human
cuugguuccccca

SEQ ID NO: 1266408 - RNA, 15 nt, Human
cuucucuuugccuca

SEQ ID NO: 1266409 - RNA, 21 nt, Human
cuucuuacuuggaacugaagg

SEQ ID NO: 1266410 - RNA, 22 nt, Human
cuucuuacuuggaacugaaggg

SEQ ID NO: 1266411 - RNA, 19 nt, Human
cuucuuauggaauugauuu

SEQ ID NO: 1266412 - RNA, 23 nt, Human
cuucuuauggaauugauuugcau

SEQ ID NO: 1266413 - RNA, 22 nt, Human
cuucuuauggaauugauuugca

SEQ ID NO: 1266414 - RNA, 22 nt, Human
cuucuuagcuaucauugcuucc

SEQ ID NO: 1266415 - RNA, 22 nt, Human
cuucuugaaauuuuaaccuaug

SEQ ID NO: 1266416 - RNA, 12 nt, Human
cuucuugaaggu

SEQ ID NO: 1266417 - RNA, 17 nt, Human
cuuccucuucccccaag

SEQ ID NO: 1266418 - RNA, 16 nt, Human
cuucuaauugccaugu

SEQ ID NO: 1266419 - RNA, 12 nt, Human
cuuccucugcug

SEQ ID NO: 1266420 - RNA, 13 nt, Human
cuuccucugcuga

SEQ ID NO: 1266421 - RNA, 15 nt, Human
cuuccucuccugucu

SEQ ID NO: 1266422 - RNA, 19 nt, Human
cuuccucuccugucucccu

SEQ ID NO: 1266423 - RNA, 11 nt, Human
cuuccucugcu

SEQ ID NO: 1266424 - RNA, 16 nt, Human
cuuccucuccacugcc

SEQ ID NO: 1266425 - RNA, 17 nt, Human
cuuccucuccacugccu

SEQ ID NO: 1266426 - RNA, 19 nt, Human
cuuccucuccacugccuuc

SEQ ID NO: 1266427 - RNA, 21 nt, Human
cuuccucuccacugccuucga

SEQ ID NO: 1266428 - RNA, 17 nt, Human
cuucuauacccacccag

SEQ ID NO: 1266429 - RNA, 13 nt, Human
cuucuauucuagc

SEQ ID NO: 1266430 - RNA, 20 nt, Human
cuucuauucuagccugcauu

SEQ ID NO: 1266431 - RNA, 21 nt, Human
cuucuauucuagccugcauug

SEQ ID NO: 1266432 - RNA, 13 nt, Human
cuucuauugccuc

SEQ ID NO: 1266433 - RNA, 14 nt, Human
cuucuauugccucu

SEQ ID NO: 1266434 - RNA, 16 nt, Human
cuucuauugccucuga

SEQ ID NO: 1266435 - RNA, 18 nt, Human
cuucuauugccucugaga

SEQ ID NO: 1266436 - RNA, 14 nt, Human
cuucuauuggucuc

SEQ ID NO: 1266437 - RNA, 19 nt, Human
cuucuauugccucugagag

SEQ ID NO: 1266438 - RNA, 22 nt, Human
cuucuauugccucugagagcau

SEQ ID NO: 1266439 - RNA, 22 nt, Human
cuucucugacuucugccuggag

SEQ ID NO: 1266440 - RNA, 24 nt, Human
cuucuauugccucugagagcauca

SEQ ID NO: 1266441 - RNA, 18 nt, Human
cuucuauacccacccaga

SEQ ID NO: 1266442 - RNA, 15 nt, Human
cuucuauacccaccc

SEQ ID NO: 1266443 - RNA, 20 nt, Human
cuucuacucacuuuucccac

SEQ ID NO: 1266444 - RNA, 18 nt, Human
cuucuacucacuuuuccc

SEQ ID NO: 1266445 - RNA, 19 nt, Human
cuucuacucacuuuuccca

SEQ ID NO: 1266446 - RNA, 23 nt, Human
cuucuacucacuuuucccacucc

SEQ ID NO: 1266447 - RNA, 15 nt, Human
cuucuaauugccaug

SEQ ID NO: 1266448 - RNA, 16 nt, Human
cuucucuuugccucaa

SEQ ID NO: 1266449 - RNA, 17 nt, Human
cuucugaacucaaacug

SEQ ID NO: 1266450 - RNA, 18 nt, Human
cuucugaacucaaacuga

SEQ ID NO: 1266451 - RNA, 22 nt, Human
cuucugaacucaaacugaggaa

SEQ ID NO: 1266452 - RNA, 13 nt, Human
cuucucuuugccu

SEQ ID NO: 1266453 - RNA, 23 nt, Human
cuucccaaaguccugggauuaca

SEQ ID NO: 1266454 - RNA, 14 nt, Human
cuuccauuugcaag

SEQ ID NO: 1266455 - RNA, 16 nt, Human
cuucccaaagcaagca

SEQ ID NO: 1266456 - RNA, 13 nt, Human
cuuccauuugcaa

SEQ ID NO: 1266457 - RNA, 23 nt, Human
cuucccaagugagucucucuggg

SEQ ID NO: 1266458 - RNA, 17 nt, Human
cuucccaagggcugccg

SEQ ID NO: 1266459 - RNA, 20 nt, Human
cuuacauuagcaguuugcuu

SEQ ID NO: 1266460 - RNA, 14 nt, Human
cuuccauauggauc

SEQ ID NO: 1266461 - RNA, 16 nt, Human
cuuaaauacagcuuuu

SEQ ID NO: 1266462 - RNA, 18 nt, Human
cuuaaagaauucaaauuu

SEQ ID NO: 1266463 - RNA, 17 nt, Human
cuuaaagaauucaaauu

SEQ ID NO: 1266464 - RNA, 15 nt, Human
cuuaaagaauucaaa

SEQ ID NO: 1266465 - RNA, 16 nt, Human
cuuacaguaggagccc

SEQ ID NO: 1266466 - RNA, 23 nt, Human
cuuacaguaggagcccagcucug

SEQ ID NO: 1266467 - RNA, 12 nt, Human
cuuacaugauuc

SEQ ID NO: 1266468 - RNA, 18 nt, Human
cuuacaugcauuacugca

SEQ ID NO: 1266469 - RNA, 19 nt, Human
cuuacaugcauuacugcau

SEQ ID NO: 1266470 - RNA, 16 nt, Human
caggcacacaccacca

SEQ ID NO: 1266471 - RNA, 12 nt, Human
caggcacacagc

SEQ ID NO: 1266472 - RNA, 13 nt, Human
caggcacacagcu

SEQ ID NO: 1266473 - RNA, 14 nt, Human
caggcacacagcua

SEQ ID NO: 1266474 - RNA, 23 nt, Human
caggcacacagcuacucucccca

SEQ ID NO: 1266475 - RNA, 20 nt, Human
caggcacacagcuacucucc

SEQ ID NO: 1266476 - RNA, 15 nt, Human
caggccacuugauga

SEQ ID NO: 1266477 - RNA, 22 nt, Human
caggcagaggcccaggcugccg

SEQ ID NO: 1266478 - RNA, 13 nt, Human
caggcagauccag

SEQ ID NO: 1266479 - RNA, 20 nt, Human
caggcaccaggacuagggcu

SEQ ID NO: 1266480 - RNA, 15 nt, Human
caggcaccaaaagaa

SEQ ID NO: 1266481 - RNA, 16 nt, Human
caggcaccaaaagaag

SEQ ID NO: 1266482 - RNA, 19 nt, Human
caggcaccaaaagaaguaa

SEQ ID NO: 1266483 - RNA, 14 nt, Human
caggcaccaggcag

SEQ ID NO: 1266484 - RNA, 14 nt, Human
caggcagaggccca

SEQ ID NO: 1266485 - RNA, 15 nt, Human
caggcagaggcccag

SEQ ID NO: 1266486 - RNA, 17 nt, Human
caggcagaggcccaggc

SEQ ID NO: 1266487 - RNA, 18 nt, Human
caggcagaggcccaggcu

SEQ ID NO: 1266488 - RNA, 19 nt, Human
caggcagaggcccaggcug

SEQ ID NO: 1266489 - RNA, 20 nt, Human
caggcagaggcccaggcugc

SEQ ID NO: 1266490 - RNA, 21 nt, Human
caggcagaggcccaggcugcc

SEQ ID NO: 1266491 - RNA, 13 nt, Human
caggccagagcca

SEQ ID NO: 1266492 - RNA, 14 nt, Human
caggcagauccagg

SEQ ID NO: 1266493 - RNA, 18 nt, Human
caggcugggaacucaucu

SEQ ID NO: 1266494 - RNA, 16 nt, Human
caggcuggcuccagau

SEQ ID NO: 1266495 - RNA, 12 nt, Human
caggcugggaac

SEQ ID NO: 1266496 - RNA, 20 nt, Human
caggcuggcuccagaugcag

SEQ ID NO: 1266497 - RNA, 17 nt, Human
caggcuggcuccagaug

SEQ ID NO: 1266498 - RNA, 18 nt, Human
caggcuggcuccagaugc

SEQ ID NO: 1266499 - RNA, 15 nt, Human
cagggagcggccggc

SEQ ID NO: 1266500 - RNA, 17 nt, Human
cagggagcggccggcca

SEQ ID NO: 1266501 - RNA, 19 nt, Human
cagggagcggccggccagc

SEQ ID NO: 1266502 - RNA, 21 nt, Human
cagggagcggccggccagccc

SEQ ID NO: 1266503 - RNA, 23 nt, Human
cagggagcggccggccagccccu

SEQ ID NO: 1266504 - RNA, 12 nt, Human
cagggaguguuc

SEQ ID NO: 1266505 - RNA, 19 nt, Human
cagggauaaggccuguggg

SEQ ID NO: 1266506 - RNA, 17 nt, Human
caggggaacacugggga

SEQ ID NO: 1266507 - RNA, 15 nt, Human
cagggcucuguaagu

SEQ ID NO: 1266508 - RNA, 22 nt, Human
cagggcuccagccccucuugga

SEQ ID NO: 1266509 - RNA, 13 nt, Human
cagggcuccagcc

SEQ ID NO: 1266510 - RNA, 16 nt, Human
cagggcuccagccccu

SEQ ID NO: 1266511 - RNA, 21 nt, Human
caggggaacacuggggacuug

SEQ ID NO: 1266512 - RNA, 20 nt, Human
cagucugacuguuuccauca

SEQ ID NO: 1266513 - RNA, 17 nt, Human
cagucugagagaggcca

SEQ ID NO: 1266514 - RNA, 14 nt, Human
cagucucugagcag

SEQ ID NO: 1266515 - RNA, 12 nt, Human
cagugcaucuca

SEQ ID NO: 1266516 - RNA, 15 nt, Human
cagugcaucucagcc

SEQ ID NO: 1266517 - RNA, 16 nt, Human
cagugcaucucagccc

SEQ ID NO: 1266518 - RNA, 17 nt, Human
cagugcaucucagccca

SEQ ID NO: 1266519 - RNA, 18 nt, Human
cagugcaucucagcccac

SEQ ID NO: 1266520 - RNA, 22 nt, Human
cagugggaggugagaccaccuc

SEQ ID NO: 1266521 - RNA, 22 nt, Human
cagugggaggguaccagcagaa

SEQ ID NO: 1266522 - RNA, 14 nt, Human
caguggggaaugaa

SEQ ID NO: 1266523 - RNA, 21 nt, Human
cagugggaggugagaccaccu

SEQ ID NO: 1266524 - RNA, 13 nt, Human
caguggggcagag

SEQ ID NO: 1266525 - RNA, 21 nt, Human
caguggggcagaggcaguacc

SEQ ID NO: 1266526 - RNA, 20 nt, Human
caguggggaggggcuguggg

SEQ ID NO: 1266527 - RNA, 15 nt, Human
caguggggcagucau

SEQ ID NO: 1266528 - RNA, 16 nt, Human
cagucaccucauggaa

SEQ ID NO: 1266529 - RNA, 15 nt, Human
cagucacauuccaag

SEQ ID NO: 1266530 - RNA, 19 nt, Human
cagucaccucauggaauug

SEQ ID NO: 1266531 - RNA, 21 nt, Human
caguaaaccacugaaaaaaua

SEQ ID NO: 1266532 - RNA, 18 nt, Human
caguaaaccacugaaaaa

SEQ ID NO: 1266533 - RNA, 15 nt, Human
caguaaagcacuugc

SEQ ID NO: 1266534 - RNA, 15 nt, Human
cagucaauauuuuua

SEQ ID NO: 1266535 - RNA, 12 nt, Human
cagucacagcca

SEQ ID NO: 1266536 - RNA, 13 nt, Human
cagucacagccac

SEQ ID NO: 1266537 - RNA, 14 nt, Human
cagucacagccacc

SEQ ID NO: 1266538 - RNA, 16 nt, Human
cagucacagccacccc

SEQ ID NO: 1266539 - RNA, 21 nt, Human
cagucacucuagucaaugaca

SEQ ID NO: 1266540 - RNA, 24 nt, Human
cagucacucuagucaaugacauga

SEQ ID NO: 1266541 - RNA, 15 nt, Human
cagucacucuaguca

SEQ ID NO: 1266542 - RNA, 20 nt, Human
cagucacucuagucaaugac

SEQ ID NO: 1266543 - RNA, 23 nt, Human
caguaaagaacaucccuccuggg

SEQ ID NO: 1266544 - RNA, 14 nt, Human
caguaaaccacuga

SEQ ID NO: 1266545 - RNA, 16 nt, Human
caguaaaccacugaaa

SEQ ID NO: 1266546 - RNA, 22 nt, Human
cagguugucugaagucacugca

SEQ ID NO: 1266547 - RNA, 23 nt, Human
cagguugucugaagucacugcac

SEQ ID NO: 1266548 - RNA, 13 nt, Human
cagauccuggaaa

SEQ ID NO: 1266549 - RNA, 12 nt, Human
cagauccuggaa

SEQ ID NO: 1266550 - RNA, 18 nt, Human
cagaucaucuuggaacug

SEQ ID NO: 1266551 - RNA, 15 nt, Human
cagaucaucuuggaa

SEQ ID NO: 1266552 - RNA, 16 nt, Human
cagaucaguaaagaac

SEQ ID NO: 1266553 - RNA, 16 nt, Human
cagaucaguguaccau

SEQ ID NO: 1266554 - RNA, 19 nt, Human
cagauccccaagccuggca

SEQ ID NO: 1266555 - RNA, 13 nt, Human
cagauccuccuca

SEQ ID NO: 1266556 - RNA, 14 nt, Human
cagauccuccucau

SEQ ID NO: 1266557 - RNA, 16 nt, Human
cagauccuccucauuc

SEQ ID NO: 1266558 - RNA, 21 nt, Human
cagaguaauccaagcaaaugu

SEQ ID NO: 1266559 - RNA, 17 nt, Human
cagagguugcagugagc

SEQ ID NO: 1266560 - RNA, 15 nt, Human
cagagguccacaaca

SEQ ID NO: 1266561 - RNA, 20 nt, Human
cagagguccacaacacacag

SEQ ID NO: 1266562 - RNA, 22 nt, Human
cagagguagucucacugcuuga

SEQ ID NO: 1266563 - RNA, 15 nt, Human
cagaauaucacagaa

SEQ ID NO: 1266564 - RNA, 17 nt, Human
cagaggguguccugcac

SEQ ID NO: 1266565 - RNA, 17 nt, Human
cagagggucugggggca

SEQ ID NO: 1266566 - RNA, 13 nt, Human
cagaaucccuuaa

SEQ ID NO: 1266567 - RNA, 18 nt, Human
cagaaucccuuaacaguu

SEQ ID NO: 1266568 - RNA, 16 nt, Human
cagagggucugggggc

SEQ ID NO: 1266569 - RNA, 13 nt, Human
cagcauaauacuu

SEQ ID NO: 1266570 - RNA, 17 nt, Human
cagcagugugaggccag

SEQ ID NO: 1266571 - RNA, 19 nt, Human
cagcagugugaggccaggg

SEQ ID NO: 1266572 - RNA, 20 nt, Human
cagcagugugaggccagggc

SEQ ID NO: 1266573 - RNA, 22 nt, Human
cagcagugugaggccagggcag

SEQ ID NO: 1266574 - RNA, 23 nt, Human
cagccaggggagcagaggggcag

SEQ ID NO: 1266575 - RNA, 17 nt, Human
cagccaggggagcagag

SEQ ID NO: 1266576 - RNA, 16 nt, Human
cagccagggcucaauc

SEQ ID NO: 1266577 - RNA, 15 nt, Human
cagccaggggagcag

SEQ ID NO: 1266578 - RNA, 14 nt, Human
cagccagggagagc

SEQ ID NO: 1266579 - RNA, 15 nt, Human
cagccagggagagcc

SEQ ID NO: 1266580 - RNA, 16 nt, Human
cagccagggagagccc

SEQ ID NO: 1266581 - RNA, 17 nt, Human
cagccagggagagccca

SEQ ID NO: 1266582 - RNA, 18 nt, Human
cagccagggagagcccag

SEQ ID NO: 1266583 - RNA, 19 nt, Human
cagccagggagagcccagg

SEQ ID NO: 1266584 - RNA, 20 nt, Human
cagccagggagagcccagga

SEQ ID NO: 1266585 - RNA, 21 nt, Human
cagccagggagagcccaggag

SEQ ID NO: 1266586 - RNA, 22 nt, Human
cagccagggagagcccaggagc

SEQ ID NO: 1266587 - RNA, 24 nt, Human
cagccagggagagcccaggagcuc

SEQ ID NO: 1266588 - RNA, 13 nt, Human
cagcaucaggguu

SEQ ID NO: 1266589 - RNA, 23 nt, Human
cagcaucaggguuaagaagacuu

SEQ ID NO: 1266590 - RNA, 20 nt, Human
cagcauccccuugaacucuu

SEQ ID NO: 1266591 - RNA, 19 nt, Human
cagcauccccuugaacucu

SEQ ID NO: 1266592 - RNA, 12 nt, Human
cagcauccgcag

SEQ ID NO: 1266593 - RNA, 17 nt, Human
cagcauccgcaggugcu

SEQ ID NO: 1266594 - RNA, 20 nt, Human
cagcauccgcaggugcuggu

SEQ ID NO: 1266595 - RNA, 11 nt, Human
cagccagccuc

SEQ ID NO: 1266596 - RNA, 14 nt, Human
cagccagccucgcc

SEQ ID NO: 1266597 - RNA, 23 nt, Human
cagccagccucgcccauccccuu

SEQ ID NO: 1266598 - RNA, 19 nt, Human
cagccagccucgcccaucc

SEQ ID NO: 1266599 - RNA, 19 nt, Human
cagccagcgucggucugug

SEQ ID NO: 1266600 - RNA, 22 nt, Human
cagccagcgucggucugugccc

SEQ ID NO: 1266601 - RNA, 23 nt, Human
cagccagcgucggucugugcccc

SEQ ID NO: 1266602 - RNA, 18 nt, Human
cagcuuagaguuggccau

SEQ ID NO: 1266603 - RNA, 22 nt, Human
cagcugccuggaagagcagccc

SEQ ID NO: 1266604 - RNA, 14 nt, Human
cagcuccucugucu

SEQ ID NO: 1266605 - RNA, 12 nt, Human
cagcuccucugu

SEQ ID NO: 1266606 - RNA, 11 nt, Human
cagcugugcuu

SEQ ID NO: 1266607 - RNA, 12 nt, Human
cagcuguggcag

SEQ ID NO: 1266608 - RNA, 17 nt, Human
cagcuguggcagaguua

SEQ ID NO: 1266609 - RNA, 16 nt, Human
cagcuguggcagaguu

SEQ ID NO: 1266610 - RNA, 14 nt, Human
cagcugugcuuaug

SEQ ID NO: 1266611 - RNA, 23 nt, Human
cagcuguugagccccuccuaguu

SEQ ID NO: 1266612 - RNA, 15 nt, Human
cagcuguuuuguuga

SEQ ID NO: 1266613 - RNA, 16 nt, Human
cagcuguuuuguugac

SEQ ID NO: 1266614 - RNA, 17 nt, Human
cagcuguuuuguugaca

SEQ ID NO: 1266615 - RNA, 19 nt, Human
cagcuguuuuguugacauu

SEQ ID NO: 1266616 - RNA, 22 nt, Human
cagcuguuuuguugacauucug

SEQ ID NO: 1266617 - RNA, 23 nt, Human
cagcuguuuuguugacauucuga

SEQ ID NO: 1266618 - RNA, 15 nt, Human
cagcucccaccuccc

SEQ ID NO: 1266619 - RNA, 21 nt, Human
cagcucccaccuccccuuggg

SEQ ID NO: 1266620 - RNA, 11 nt, Human
cagcucccagg

SEQ ID NO: 1266621 - RNA, 18 nt, Human
cagcucccaggaccacag

SEQ ID NO: 1266622 - RNA, 24 nt, Human
cagcucccaggaccacaggcucag

SEQ ID NO: 1266623 - RNA, 14 nt, Human
cagcucccccuccc

SEQ ID NO: 1266624 - RNA, 15 nt, Human
cagcucccccucccu

SEQ ID NO: 1266625 - RNA, 16 nt, Human
cagcucccccucccuc

SEQ ID NO: 1266626 - RNA, 18 nt, Human
cagcucccccucccuccc

SEQ ID NO: 1266627 - RNA, 20 nt, Human
cagcucccccucccuccccu

SEQ ID NO: 1266628 - RNA, 21 nt, Human
cagcuccggccuguccuccaa

SEQ ID NO: 1266629 - RNA, 16 nt, Human
cagcuccggccugucc

SEQ ID NO: 1266630 - RNA, 14 nt, Human
cagcuccucccaca

SEQ ID NO: 1266631 - RNA, 14 nt, Human
cagcucccugugcc

SEQ ID NO: 1266632 - RNA, 18 nt, Human
cagcucccugugccccca

SEQ ID NO: 1266633 - RNA, 19 nt, Human
cagcucccugugcccccag

SEQ ID NO: 1266634 - RNA, 20 nt, Human
cagcucccugugcccccagg

SEQ ID NO: 1266635 - RNA, 22 nt, Human
cagcucccugugcccccagggu

SEQ ID NO: 1266636 - RNA, 18 nt, Human
cagcgcccaaaggacgca

SEQ ID NO: 1266637 - RNA, 13 nt, Human
cagccucuggggg

SEQ ID NO: 1266638 - RNA, 22 nt, Human
cagccucugggggguggccagg

SEQ ID NO: 1266639 - RNA, 13 nt, Human
cagccucuggcau

SEQ ID NO: 1266640 - RNA, 18 nt, Human
cagcgccaggcugaccac

SEQ ID NO: 1266641 - RNA, 19 nt, Human
cagcgccaggcugaccaca

SEQ ID NO: 1266642 - RNA, 20 nt, Human
cagcgccaggcugaccacag

SEQ ID NO: 1266643 - RNA, 21 nt, Human
cagcgccaggcugaccacagc

SEQ ID NO: 1266644 - RNA, 22 nt, Human
cagcgccaggcugaccacagca

SEQ ID NO: 1266645 - RNA, 21 nt, Human
cagcgcccaaaggacgcacug

SEQ ID NO: 1266646 - RNA, 20 nt, Human
cagcccuuggggguccuccu

SEQ ID NO: 1266647 - RNA, 23 nt, Human
cagcccuuggggguccuccucca

SEQ ID NO: 1266648 - RNA, 14 nt, Human
cagcccuuuugucu

SEQ ID NO: 1266649 - RNA, 16 nt, Human
cagcccuuuugucucu

SEQ ID NO: 1266650 - RNA, 14 nt, Human
cagccgacccccuc

SEQ ID NO: 1266651 - RNA, 15 nt, Human
cagccgacccccucu

SEQ ID NO: 1266652 - RNA, 20 nt, Human
cagccgcugagcgaggagau

SEQ ID NO: 1266653 - RNA, 22 nt, Human
cagccgacccccucucccugca

SEQ ID NO: 1266654 - RNA, 19 nt, Human
cagccgcugagcgaggaga

SEQ ID NO: 1266655 - RNA, 20 nt, Human
caugcucuccaaaccacuuu

SEQ ID NO: 1266656 - RNA, 16 nt, Human
caugcuaucucugugu

SEQ ID NO: 1266657 - RNA, 12 nt, Human
caugcaaacucu

SEQ ID NO: 1266658 - RNA, 14 nt, Human
caugcuaauuauau

SEQ ID NO: 1266659 - RNA, 23 nt, Human
caugcuaucucugugugcacaaa

SEQ ID NO: 1266660 - RNA, 12 nt, Human
caugcuccuuac

SEQ ID NO: 1266661 - RNA, 19 nt, Human
caugcugaaggcugaaaga

SEQ ID NO: 1266662 - RNA, 15 nt, Human
caugcugaggccugg

SEQ ID NO: 1266663 - RNA, 22 nt, Human
caugcugcuggggaagacagug

SEQ ID NO: 1266664 - RNA, 17 nt, Human
caugcugcuggggaaga

SEQ ID NO: 1266665 - RNA, 21 nt, Human
caugcugcuggggaagacagu

SEQ ID NO: 1266666 - RNA, 17 nt, Human
caugcuggaaaauaaua

SEQ ID NO: 1266667 - RNA, 22 nt, Human
caugcuggaaaauaauacugcu

SEQ ID NO: 1266668 - RNA, 23 nt, Human
caugcuggaaaauaauacugcug

SEQ ID NO: 1266669 - RNA, 13 nt, Human
caugcugggauuu

SEQ ID NO: 1266670 - RNA, 14 nt, Human
caugcugggauuuc

SEQ ID NO: 1266671 - RNA, 19 nt, Human
caugcugggauuuccaacu

SEQ ID NO: 1266672 - RNA, 12 nt, Human
cauggcuaucug

SEQ ID NO: 1266673 - RNA, 14 nt, Human
cauggcuauuuuau

SEQ ID NO: 1266674 - RNA, 15 nt, Human
cauggcuauuuuaua

SEQ ID NO: 1266675 - RNA, 17 nt, Human
cauggcuauuuuauauu

SEQ ID NO: 1266676 - RNA, 14 nt, Human
caugauguuuagaa

SEQ ID NO: 1266677 - RNA, 20 nt, Human
caugauuucauguacugcau

SEQ ID NO: 1266678 - RNA, 21 nt, Human
caugauuuuaaguuucucugc

SEQ ID NO: 1266679 - RNA, 18 nt, Human
caugauuuccuugaaugu

SEQ ID NO: 1266680 - RNA, 22 nt, Human
caugauuuuaaguuucucugca

SEQ ID NO: 1266681 - RNA, 24 nt, Human
caugauuuuaaguuucucugcaga

SEQ ID NO: 1266682 - RNA, 24 nt, Human
caugauuuugaaaucaugaagaua

SEQ ID NO: 1266683 - RNA, 19 nt, Human
caugauuucauguacugca

SEQ ID NO: 1266684 - RNA, 17 nt, Human
caugauuucauguacug

SEQ ID NO: 1266685 - RNA, 16 nt, Human
caugauuucauguacu

SEQ ID NO: 1266686 - RNA, 14 nt, Human
caugauuucaugua

SEQ ID NO: 1266687 - RNA, 13 nt, Human
caugauuucaugu

SEQ ID NO: 1266688 - RNA, 12 nt, Human
caugauuuccuu

SEQ ID NO: 1266689 - RNA, 14 nt, Human
caugauuuccuuga

SEQ ID NO: 1266690 - RNA, 16 nt, Human
caugauuuccuugaau

SEQ ID NO: 1266691 - RNA, 17 nt, Human
caugauuuccuugaaug

SEQ ID NO: 1266692 - RNA, 13 nt, Human
cauuauaaaaaga

SEQ ID NO: 1266693 - RNA, 16 nt, Human
cauuauaaccuuaauu

SEQ ID NO: 1266694 - RNA, 18 nt, Human
cauuauaaccuuaauuua

SEQ ID NO: 1266695 - RNA, 13 nt, Human
cauuauaaugaau

SEQ ID NO: 1266696 - RNA, 14 nt, Human
cauuauaaugaauu

SEQ ID NO: 1266697 - RNA, 15 nt, Human
cauuauaaugaauuu

SEQ ID NO: 1266698 - RNA, 19 nt, Human
cauguugucuaagaaauug

SEQ ID NO: 1266699 - RNA, 15 nt, Human
cauguuuagacuuua

SEQ ID NO: 1266700 - RNA, 19 nt, Human
cauuauauuuauuacugua

SEQ ID NO: 1266701 - RNA, 14 nt, Human
cauucguucugugg

SEQ ID NO: 1266702 - RNA, 13 nt, Human
cauucgugaaaac

SEQ ID NO: 1266703 - RNA, 15 nt, Human
cauucuacugaaaag

SEQ ID NO: 1266704 - RNA, 21 nt, Human
cauucuagagugcauauauuu

SEQ ID NO: 1266705 - RNA, 18 nt, Human
cauucuccacagcaaccc

SEQ ID NO: 1266706 - RNA, 15 nt, Human
cauucuccacagcaa

SEQ ID NO: 1266707 - RNA, 17 nt, Human
cauucuccacagcaacc

SEQ ID NO: 1266708 - RNA, 20 nt, Human
cauguuggccaggcugcucu

SEQ ID NO: 1266709 - RNA, 20 nt, Human
cauguuggccaggcuggucu

SEQ ID NO: 1266710 - RNA, 21 nt, Human
cauguuggccaggcuggucua

SEQ ID NO: 1266711 - RNA, 15 nt, Human
cauguugggaaacuu

SEQ ID NO: 1266712 - RNA, 19 nt, Human
cauguugggaaacuuggcu

SEQ ID NO: 1266713 - RNA, 20 nt, Human
cauguugggaaacuuggcuc

SEQ ID NO: 1266714 - RNA, 21 nt, Human
cauguugggaaacuuggcucg

SEQ ID NO: 1266715 - RNA, 14 nt, Human
cauguuaguuaccu

SEQ ID NO: 1266716 - RNA, 21 nt, Human
cauguuaguuaccuuauaguu

SEQ ID NO: 1266717 - RNA, 22 nt, Human
cauguuaguuaccuuauaguua

SEQ ID NO: 1266718 - RNA, 24 nt, Human
cauguuaguuaccuuauaguuacu

SEQ ID NO: 1266719 - RNA, 14 nt, Human
cauguuauuuguaa

SEQ ID NO: 1266720 - RNA, 14 nt, Human
caugucaaacguga

SEQ ID NO: 1266721 - RNA, 19 nt, Human
caugucaaacgugaaaaug

SEQ ID NO: 1266722 - RNA, 20 nt, Human
cauguauuuggugauuacau

SEQ ID NO: 1266723 - RNA, 15 nt, Human
cauguauuuggugau

SEQ ID NO: 1266724 - RNA, 14 nt, Human
caugucaaacaaau

SEQ ID NO: 1266725 - RNA, 15 nt, Human
caugucaaacaaaua

SEQ ID NO: 1266726 - RNA, 16 nt, Human
caugucccuaccgagu

SEQ ID NO: 1266727 - RNA, 22 nt, Human
caugucccuaccgagucucuuc

SEQ ID NO: 1266728 - RNA, 15 nt, Human
caugucaacagcguu

SEQ ID NO: 1266729 - RNA, 14 nt, Human
caugucaacagcgu

SEQ ID NO: 1266730 - RNA, 23 nt, Human
caugucccuaccgagucucuucu

SEQ ID NO: 1266731 - RNA, 13 nt, Human
cauguccugccua

SEQ ID NO: 1266732 - RNA, 22 nt, Human
cauguccugccuauuaucuguc

SEQ ID NO: 1266733 - RNA, 14 nt, Human
cauguccuguaaag

SEQ ID NO: 1266734 - RNA, 15 nt, Human
cauguccuguaaagg

SEQ ID NO: 1266735 - RNA, 24 nt, Human
cauguuaguaauaccucuaauagu

SEQ ID NO: 1266736 - RNA, 20 nt, Human
cauguuaguaauaccucuaa

SEQ ID NO: 1266737 - RNA, 19 nt, Human
cauguuaguaauaccucua

SEQ ID NO: 1266738 - RNA, 18 nt, Human
cauguuaguaauaccucu

SEQ ID NO: 1266739 - RNA, 17 nt, Human
cauguuaguaauaccuc

SEQ ID NO: 1266740 - RNA, 16 nt, Human
cauguuaguaauaccu

SEQ ID NO: 1266741 - RNA, 14 nt, Human
cauguuaguaauac

SEQ ID NO: 1266742 - RNA, 13 nt, Human
cauguuagccagg

SEQ ID NO: 1266743 - RNA, 16 nt, Human
cauguuagcccuuccu

SEQ ID NO: 1266744 - RNA, 20 nt, Human
cauguagaaaauuuguuauu

SEQ ID NO: 1266745 - RNA, 18 nt, Human
cauguaggaaguaggaag

SEQ ID NO: 1266746 - RNA, 16 nt, Human
cauguaguaacacuaa

SEQ ID NO: 1266747 - RNA, 19 nt, Human
caucuggaaccaucagaaa

SEQ ID NO: 1266748 - RNA, 17 nt, Human
caucuggaaccaucaga

SEQ ID NO: 1266749 - RNA, 12 nt, Human
caucuggaacca

SEQ ID NO: 1266750 - RNA, 16 nt, Human
caucugcuucaggccc

SEQ ID NO: 1266751 - RNA, 17 nt, Human
caucuggagagaacagg

SEQ ID NO: 1266752 - RNA, 17 nt, Human
caucugugcacugccca

SEQ ID NO: 1266753 - RNA, 18 nt, Human
caucugugcacugcccau

SEQ ID NO: 1266754 - RNA, 21 nt, Human
caucugugcacugcccaugga

SEQ ID NO: 1266755 - RNA, 11 nt, Human
caucugugucu

SEQ ID NO: 1266756 - RNA, 13 nt, Human
caucugugucuug

SEQ ID NO: 1266757 - RNA, 14 nt, Human
caucugugucuugu

SEQ ID NO: 1266758 - RNA, 12 nt, Human
cauccuggaaua

SEQ ID NO: 1266759 - RNA, 16 nt, Human
caucgcaccauucuga

SEQ ID NO: 1266760 - RNA, 18 nt, Human
caucgcaccauucugacu

SEQ ID NO: 1266761 - RNA, 19 nt, Human
caucgcaccauucugacuc

SEQ ID NO: 1266762 - RNA, 14 nt, Human
caucggaaaaauaa

SEQ ID NO: 1266763 - RNA, 15 nt, Human
caucggaaaaauaau

SEQ ID NO: 1266764 - RNA, 16 nt, Human
caucggaaaaauaauc

SEQ ID NO: 1266765 - RNA, 19 nt, Human
caucggacaagacccccag

SEQ ID NO: 1266766 - RNA, 21 nt, Human
caucggacaagacccccagca

SEQ ID NO: 1266767 - RNA, 20 nt, Human
caucggacaagacccccagc

SEQ ID NO: 1266768 - RNA, 17 nt, Human
caucgucuucuuggcca

SEQ ID NO: 1266769 - RNA, 14 nt, Human
caucugcugguccg

SEQ ID NO: 1266770 - RNA, 19 nt, Human
caucugcugguccguggga

SEQ ID NO: 1266771 - RNA, 22 nt, Human
caucacuuaacggaccaaagca

SEQ ID NO: 1266772 - RNA, 14 nt, Human
caucacuuguacaa

SEQ ID NO: 1266773 - RNA, 15 nt, Human
caucacuuguacaaa

SEQ ID NO: 1266774 - RNA, 22 nt, Human
cauccccuugaggucucagccc

SEQ ID NO: 1266775 - RNA, 17 nt, Human
caucccguguucuccuu

SEQ ID NO: 1266776 - RNA, 21 nt, Human
caucccguguucuccuuuucc

SEQ ID NO: 1266777 - RNA, 17 nt, Human
caucccgagcaccucca

SEQ ID NO: 1266778 - RNA, 19 nt, Human
cauccccuugaacucuuca

SEQ ID NO: 1266779 - RNA, 16 nt, Human
caucccgucuucucca

SEQ ID NO: 1266780 - RNA, 18 nt, Human
caucccgucuucuccaac

SEQ ID NO: 1266781 - RNA, 14 nt, Human
caucccguguucuc

SEQ ID NO: 1266782 - RNA, 16 nt, Human
caucccguguucuccu

SEQ ID NO: 1266783 - RNA, 15 nt, Human
cauauuaagaaugau

SEQ ID NO: 1266784 - RNA, 19 nt, Human
cauauuaagaaugaucuga

SEQ ID NO: 1266785 - RNA, 13 nt, Human
cauauuaagaaug

SEQ ID NO: 1266786 - RNA, 14 nt, Human
cauauguuugguaa

SEQ ID NO: 1266787 - RNA, 17 nt, Human
cauauggauccacuggc

SEQ ID NO: 1266788 - RNA, 18 nt, Human
cauauggauccacuggcu

SEQ ID NO: 1266789 - RNA, 23 nt, Human
cauaugcuaccaccagcuguguc

SEQ ID NO: 1266790 - RNA, 21 nt, Human
cauaugcuaccaccagcugug

SEQ ID NO: 1266791 - RNA, 22 nt, Human
cauaugcuaccaccagcugugu

SEQ ID NO: 1266792 - RNA, 16 nt, Human
ccaccgcagaaggaag

SEQ ID NO: 1266793 - RNA, 15 nt, Human
ccaccgcagaaggaa

SEQ ID NO: 1266794 - RNA, 18 nt, Human
ccaccgaagccgccugug

SEQ ID NO: 1266795 - RNA, 17 nt, Human
ccaccgcccagagaccc

SEQ ID NO: 1266796 - RNA, 13 nt, Human
ccaccgcccagag

SEQ ID NO: 1266797 - RNA, 13 nt, Human
ccacgcccggcua

SEQ ID NO: 1266798 - RNA, 16 nt, Human
ccacgacugucuccau

SEQ ID NO: 1266799 - RNA, 15 nt, Human
ccacgacugucucca

SEQ ID NO: 1266800 - RNA, 15 nt, Human
ccacgcccguccugc

SEQ ID NO: 1266801 - RNA, 17 nt, Human
ccacgcccguccugccu

SEQ ID NO: 1266802 - RNA, 18 nt, Human
ccacgcccguccugccug

SEQ ID NO: 1266803 - RNA, 20 nt, Human
ccaccuuuguuucuccccca

SEQ ID NO: 1266804 - RNA, 16 nt, Human
ccaccuuuguuucucc

SEQ ID NO: 1266805 - RNA, 14 nt, Human
ccacgaaggagccc

SEQ ID NO: 1266806 - RNA, 16 nt, Human
ccacgacacugcagcc

SEQ ID NO: 1266807 - RNA, 17 nt, Human
ccacgacacugcagccc

SEQ ID NO: 1266808 - RNA, 15 nt, Human
ccacgacuggccagg

SEQ ID NO: 1266809 - RNA, 14 nt, Human
ccacgacugucucc

SEQ ID NO: 1266810 - RNA, 18 nt, Human
ccacgacuggccagggcc

SEQ ID NO: 1266811 - RNA, 23 nt, Human
ccacgcccguccugccuguggcg

SEQ ID NO: 1266812 - RNA, 19 nt, Human
ccacgcccguccugccugu

SEQ ID NO: 1266813 - RNA, 20 nt, Human
ccacgcccguccugccugug

SEQ ID NO: 1266814 - RNA, 21 nt, Human
ccacgcccguccugccugugg

SEQ ID NO: 1266815 - RNA, 22 nt, Human
ccacgcccguccugccuguggc

SEQ ID NO: 1266816 - RNA, 14 nt, Human
ccacagcugccucu

SEQ ID NO: 1266817 - RNA, 14 nt, Human
ccaccacagccagc

SEQ ID NO: 1266818 - RNA, 15 nt, Human
ccaccacagccagca

SEQ ID NO: 1266819 - RNA, 18 nt, Human
ccaccacagccagcaccu

SEQ ID NO: 1266820 - RNA, 20 nt, Human
ccaccacagccagcaccugg

SEQ ID NO: 1266821 - RNA, 14 nt, Human
ccacagcugcucaa

SEQ ID NO: 1266822 - RNA, 21 nt, Human
ccaccacagccagcaccuggc

SEQ ID NO: 1266823 - RNA, 12 nt, Human
ccaccaguucuc

SEQ ID NO: 1266824 - RNA, 15 nt, Human
ccacccugggcccug

SEQ ID NO: 1266825 - RNA, 16 nt, Human
ccacccugggcccugg

SEQ ID NO: 1266826 - RNA, 17 nt, Human
ccacccugggcccuggg

SEQ ID NO: 1266827 - RNA, 20 nt, Human
ccacccugggcccugggcug

SEQ ID NO: 1266828 - RNA, 22 nt, Human
ccacccugggcccugggcugga

SEQ ID NO: 1266829 - RNA, 15 nt, Human
ccacccuguuccugc

SEQ ID NO: 1266830 - RNA, 16 nt, Human
ccacccuguuccugcu

SEQ ID NO: 1266831 - RNA, 17 nt, Human
ccacccuguuccugcug

SEQ ID NO: 1266832 - RNA, 18 nt, Human
ccacccuguuccugcugc

SEQ ID NO: 1266833 - RNA, 19 nt, Human
ccacccuguuccugcugcu

SEQ ID NO: 1266834 - RNA, 17 nt, Human
ccacagccagcaccugg

SEQ ID NO: 1266835 - RNA, 18 nt, Human
ccacagccagcaccuggc

SEQ ID NO: 1266836 - RNA, 19 nt, Human
ccacagccagcaccuggca

SEQ ID NO: 1266837 - RNA, 22 nt, Human
ccacagccagcaccuggcaucg

SEQ ID NO: 1266838 - RNA, 11 nt, Human
ccacagccagg

SEQ ID NO: 1266839 - RNA, 16 nt, Human
ccacagccuccccugc

SEQ ID NO: 1266840 - RNA, 19 nt, Human
ccacagccuccccugccag

SEQ ID NO: 1266841 - RNA, 20 nt, Human
ccacagccuccccugccagg

SEQ ID NO: 1266842 - RNA, 15 nt, Human
ccacagccagcaccu

SEQ ID NO: 1266843 - RNA, 19 nt, Human
ccacagcaaccccaggcug

SEQ ID NO: 1266844 - RNA, 20 nt, Human
ccacagcaaccccaggcuga

SEQ ID NO: 1266845 - RNA, 14 nt, Human
ccacagcacagcca

SEQ ID NO: 1266846 - RNA, 12 nt, Human
ccacuccucuga

SEQ ID NO: 1266847 - RNA, 20 nt, Human
ccacuccgagaggugggcca

SEQ ID NO: 1266848 - RNA, 16 nt, Human
ccacuccgagaggugg

SEQ ID NO: 1266849 - RNA, 17 nt, Human
ccacuccgagagguggg

SEQ ID NO: 1266850 - RNA, 19 nt, Human
ccacuccgagaggugggcc

SEQ ID NO: 1266851 - RNA, 23 nt, Human
ccacuccgagaggugggccaguc

SEQ ID NO: 1266852 - RNA, 13 nt, Human
ccacuccucugac

SEQ ID NO: 1266853 - RNA, 19 nt, Human
cauuuguauaaaauaauuu

SEQ ID NO: 1266854 - RNA, 20 nt, Human
cauuuguauaaaauaauuuu

SEQ ID NO: 1266855 - RNA, 16 nt, Human
cauuuguguugaagag

SEQ ID NO: 1266856 - RNA, 22 nt, Human
cauuuguggguuuuuauuuccu

SEQ ID NO: 1266857 - RNA, 23 nt, Human
cauuuguggguuuuuauuuccua

SEQ ID NO: 1266858 - RNA, 19 nt, Human
cauuuguguacacagucag

SEQ ID NO: 1266859 - RNA, 17 nt, Human
cauuuguggguuuuuau

SEQ ID NO: 1266860 - RNA, 22 nt, Human
cauuuuuugggcagcaauuuaa

SEQ ID NO: 1266861 - RNA, 19 nt, Human
cauuuuuugggcagcaauu

SEQ ID NO: 1266862 - RNA, 18 nt, Human
cauuuuuugggcagcaau

SEQ ID NO: 1266863 - RNA, 18 nt, Human
cauuuuuuuccuugcaaa

SEQ ID NO: 1266864 - RNA, 20 nt, Human
cauuuguguugaagagguuu

SEQ ID NO: 1266865 - RNA, 14 nt, Human
cauuuuuuaggaaa

SEQ ID NO: 1266866 - RNA, 15 nt, Human
cauuuuuuaggaaau

SEQ ID NO: 1266867 - RNA, 11 nt, Human
ccaaaacugcu

SEQ ID NO: 1266868 - RNA, 12 nt, Human
ccaaaacugcuc

SEQ ID NO: 1266869 - RNA, 23 nt, Human
ccaaaagauugcugaaauuuuau

SEQ ID NO: 1266870 - RNA, 22 nt, Human
ccaaaagaagcccccagcuaag

SEQ ID NO: 1266871 - RNA, 16 nt, Human
ccaaaagauugcugaa

SEQ ID NO: 1266872 - RNA, 19 nt, Human
ccaaaagauugcugaaauu

SEQ ID NO: 1266873 - RNA, 22 nt, Human
ccaaaagauugcugaaauuuua

SEQ ID NO: 1266874 - RNA, 17 nt, Human
ccaaauguucaucaaug

SEQ ID NO: 1266875 - RNA, 18 nt, Human
ccaaauguucaucaauga

SEQ ID NO: 1266876 - RNA, 15 nt, Human
ccaacuccuaguucu

SEQ ID NO: 1266877 - RNA, 19 nt, Human
ccaacuccuaguucuagaa

SEQ ID NO: 1266878 - RNA, 23 nt, Human
ccaacuccuaguucuagaaaaac

SEQ ID NO: 1266879 - RNA, 12 nt, Human
ccaacuccuucc

SEQ ID NO: 1266880 - RNA, 14 nt, Human
ccaacuccuuccag

SEQ ID NO: 1266881 - RNA, 16 nt, Human
ccaacuccuuccagcu

SEQ ID NO: 1266882 - RNA, 15 nt, Human
ccaacuccuuccagc

SEQ ID NO: 1266883 - RNA, 15 nt, Human
ccaacugaccaccuu

SEQ ID NO: 1266884 - RNA, 14 nt, Human
ccaagcucugcagu

SEQ ID NO: 1266885 - RNA, 15 nt, Human
ccaagcucugcaguc

SEQ ID NO: 1266886 - RNA, 12 nt, Human
ccaagcugaggu

SEQ ID NO: 1266887 - RNA, 13 nt, Human
ccaagcugaggug

SEQ ID NO: 1266888 - RNA, 15 nt, Human
ccaagcugaggugcc

SEQ ID NO: 1266889 - RNA, 17 nt, Human
ccaagcugaggugccca

SEQ ID NO: 1266890 - RNA, 19 nt, Human
ccaagcugaggugcccagg

SEQ ID NO: 1266891 - RNA, 20 nt, Human
ccaagcugaggugcccagga

SEQ ID NO: 1266892 - RNA, 21 nt, Human
ccaagcugaggugcccaggag

SEQ ID NO: 1266893 - RNA, 22 nt, Human
ccaagcugaggugcccaggaga

SEQ ID NO: 1266894 - RNA, 23 nt, Human
ccaagcugaggugcccaggagaa

SEQ ID NO: 1266895 - RNA, 15 nt, Human
ccaagcugaguuucc

SEQ ID NO: 1266896 - RNA, 16 nt, Human
ccaagcugaguuuccu

SEQ ID NO: 1266897 - RNA, 17 nt, Human
ccaagcugaguuuccua

SEQ ID NO: 1266898 - RNA, 18 nt, Human
ccaagcugaguuuccuau

SEQ ID NO: 1266899 - RNA, 19 nt, Human
ccaagcugaguuuccuaug

SEQ ID NO: 1266900 - RNA, 23 nt, Human
ccaagcugccuccccucuccuuc

SEQ ID NO: 1266901 - RNA, 22 nt, Human
ccaaucaaucuugcauguaacg

SEQ ID NO: 1266902 - RNA, 16 nt, Human
ccaaucaaucuugcau

SEQ ID NO: 1266903 - RNA, 12 nt, Human
ccaaucauuuua

SEQ ID NO: 1266904 - RNA, 14 nt, Human
ccaaucauuuuaau

SEQ ID NO: 1266905 - RNA, 12 nt, Human
ccaaugaaauga

SEQ ID NO: 1266906 - RNA, 22 nt, Human
ccaaucauuuuaauuauuauuc

SEQ ID NO: 1266907 - RNA, 14 nt, Human
ccaaugagcuuucu

SEQ ID NO: 1266908 - RNA, 15 nt, Human
ccaaugagcuuucug

SEQ ID NO: 1266909 - RNA, 16 nt, Human
ccaaugagcuuucuga

SEQ ID NO: 1266910 - RNA, 18 nt, Human
ccaaugagcuuucugaac

SEQ ID NO: 1266911 - RNA, 20 nt, Human
ccaaugagcuuucugaacag

SEQ ID NO: 1266912 - RNA, 21 nt, Human
ccaaugagcuuucugaacagc

SEQ ID NO: 1266913 - RNA, 23 nt, Human
ccaaugagcuuucugaacagcug

SEQ ID NO: 1266914 - RNA, 22 nt, Human
ccaaugagcuuucugaacagcu

SEQ ID NO: 1266915 - RNA, 20 nt, Human
ccaauggguuuuucccugua

SEQ ID NO: 1266916 - RNA, 15 nt, Human
ccaauguacccaccg

SEQ ID NO: 1266917 - RNA, 12 nt, Human
ccaaugucuuga

SEQ ID NO: 1266918 - RNA, 14 nt, Human
ccaaugucuggaga

SEQ ID NO: 1266919 - RNA, 15 nt, Human
ccaaugucuggagac

SEQ ID NO: 1266920 - RNA, 16 nt, Human
ccaaugucuggagacc

SEQ ID NO: 1266921 - RNA, 22 nt, Human
ccaaugucuggagaccaccagg

SEQ ID NO: 1266922 - RNA, 18 nt, Human
ccaaugcaccuaaagaaa

SEQ ID NO: 1266923 - RNA, 17 nt, Human
auugauccagaaagaaa

SEQ ID NO: 1266924 - RNA, 16 nt, Human
auugauccagaaagaa

SEQ ID NO: 1266925 - RNA, 20 nt, Human
auugagcucucugcccuuga

SEQ ID NO: 1266926 - RNA, 11 nt, Human
auugagagaau

SEQ ID NO: 1266927 - RNA, 15 nt, Human
auugagcucucucau

SEQ ID NO: 1266928 - RNA, 20 nt, Human
auugagaaaaauauauacua

SEQ ID NO: 1266929 - RNA, 18 nt, Human
auugagaagaaaaacuca

SEQ ID NO: 1266930 - RNA, 21 nt, Human
auugagaagaaaaacucaauu

SEQ ID NO: 1266931 - RNA, 13 nt, Human
auuccugaacagg

SEQ ID NO: 1266932 - RNA, 15 nt, Human
auuccugaagaacca

SEQ ID NO: 1266933 - RNA, 16 nt, Human
auuccugaagaaccag

SEQ ID NO: 1266934 - RNA, 19 nt, Human
auuccugaagaaccagucc

SEQ ID NO: 1266935 - RNA, 22 nt, Human
auuccugaccuccgccauccac

SEQ ID NO: 1266936 - RNA, 18 nt, Human
auuccugaccuccgccau

SEQ ID NO: 1266937 - RNA, 18 nt, Human
auucugaccuuaaaugca

SEQ ID NO: 1266938 - RNA, 18 nt, Human
auucugacucgguuucuc

SEQ ID NO: 1266939 - RNA, 20 nt, Human
auucugacucgguuucucca

SEQ ID NO: 1266940 - RNA, 11 nt, Human
auucucugagc

SEQ ID NO: 1266941 - RNA, 13 nt, Human
auucucugagcug

SEQ ID NO: 1266942 - RNA, 17 nt, Human
auucugaguuuuguguu

SEQ ID NO: 1266943 - RNA, 22 nt, Human
auucugaguuuuguguuuguug

SEQ ID NO: 1266944 - RNA, 23 nt, Human
auucugaguuuuguguuuguugu

SEQ ID NO: 1266945 - RNA, 16 nt, Human
auucugauguacucua

SEQ ID NO: 1266946 - RNA, 18 nt, Human
auucugauguacucuaaa

SEQ ID NO: 1266947 - RNA, 23 nt, Human
auucugauguacucuaaauacug

SEQ ID NO: 1266948 - RNA, 20 nt, Human
auucugauucgaaugacacu

SEQ ID NO: 1266949 - RNA, 21 nt, Human
auucugauucgaaugacacug

SEQ ID NO: 1266950 - RNA, 22 nt, Human
auucugauucgaaugacacugu

SEQ ID NO: 1266951 - RNA, 17 nt, Human
auucuugguugaggaaa

SEQ ID NO: 1266952 - RNA, 18 nt, Human
auucuugguugaggaaac

SEQ ID NO: 1266953 - RNA, 21 nt, Human
auuauguuaaaacugggacag

SEQ ID NO: 1266954 - RNA, 15 nt, Human
auuauguguguuuug

SEQ ID NO: 1266955 - RNA, 17 nt, Human
auuaugugguuuuagau

SEQ ID NO: 1266956 - RNA, 13 nt, Human
auucaagauuccc

SEQ ID NO: 1266957 - RNA, 16 nt, Human
auucaaggaauuucuu

SEQ ID NO: 1266958 - RNA, 18 nt, Human
auucacaagacccaaaag

SEQ ID NO: 1266959 - RNA, 21 nt, Human
auucaauuugauguggugaaa

SEQ ID NO: 1266960 - RNA, 14 nt, Human
auucacaaacuuuu

SEQ ID NO: 1266961 - RNA, 22 nt, Human
auucacaaacuuuuauacucuu

SEQ ID NO: 1266962 - RNA, 16 nt, Human
auucaauuugaugugg

SEQ ID NO: 1266963 - RNA, 12 nt, Human
auucacaaaaau

SEQ ID NO: 1266964 - RNA, 15 nt, Human
auucacaaaaauuga

SEQ ID NO: 1266965 - RNA, 13 nt, Human
auucacaaacuuu

SEQ ID NO: 1266966 - RNA, 12 nt, Human
auucaagauucc

SEQ ID NO: 1266967 - RNA, 20 nt, Human
auucaaggaauuucuuaacu

SEQ ID NO: 1266968 - RNA, 19 nt, Human
auucaaggaauuucuuaac

SEQ ID NO: 1266969 - RNA, 17 nt, Human
auucaaggaauuucuua

SEQ ID NO: 1266970 - RNA, 18 nt, Human
auucaaggaauuucuuaa

SEQ ID NO: 1266971 - RNA, 21 nt, Human
auuauguguguuuuaaaauga

SEQ ID NO: 1266972 - RNA, 20 nt, Human
auuauguguguuuuaaaaug

SEQ ID NO: 1266973 - RNA, 15 nt, Human
auuauguguguuuua

SEQ ID NO: 1266974 - RNA, 14 nt, Human
auuaugugguuuua

SEQ ID NO: 1266975 - RNA, 16 nt, Human
auuaugugguuuuaga

SEQ ID NO: 1266976 - RNA, 17 nt, Human
auuaaauaagauucuaa

SEQ ID NO: 1266977 - RNA, 15 nt, Human
auuaaauuggaaagc

SEQ ID NO: 1266978 - RNA, 17 nt, Human
auuaaauuggaaagcag

SEQ ID NO: 1266979 - RNA, 17 nt, Human
auucacaaacuuuuaua

SEQ ID NO: 1266980 - RNA, 16 nt, Human
auucauauuuucuuuc

SEQ ID NO: 1266981 - RNA, 20 nt, Human
auucauauuuucuuucaaaa

SEQ ID NO: 1266982 - RNA, 17 nt, Human
auucauccaaguuaaau

SEQ ID NO: 1266983 - RNA, 18 nt, Human
auucauccaaguuaaaug

SEQ ID NO: 1266984 - RNA, 20 nt, Human
auucauccaaguuaaaugua

SEQ ID NO: 1266985 - RNA, 13 nt, Human
auucauuucacug

SEQ ID NO: 1266986 - RNA, 15 nt, Human
auucauuucacugua

SEQ ID NO: 1266987 - RNA, 19 nt, Human
auucauuucacuguagcuc

SEQ ID NO: 1266988 - RNA, 18 nt, Human
auucauuuuaacaucuga

SEQ ID NO: 1266989 - RNA, 19 nt, Human
auucauccaaguuaaaugu

SEQ ID NO: 1266990 - RNA, 13 nt, Human
auucaugacuaug

SEQ ID NO: 1266991 - RNA, 21 nt, Human
auucauuuuaacaucugagaa

SEQ ID NO: 1266992 - RNA, 14 nt, Human
auucauuuucucua

SEQ ID NO: 1266993 - RNA, 16 nt, Human
auucauuuucucuaau

SEQ ID NO: 1266994 - RNA, 15 nt, Human
auucauuuucucuaa

SEQ ID NO: 1266995 - RNA, 17 nt, Human
auucauuuuuuaaauuc

SEQ ID NO: 1266996 - RNA, 20 nt, Human
auuccaaagaguagaauugc

SEQ ID NO: 1266997 - RNA, 17 nt, Human
auuccaaagaacagccu

SEQ ID NO: 1266998 - RNA, 20 nt, Human
auuccucuacuaacaaucag

SEQ ID NO: 1266999 - RNA, 14 nt, Human
auuguucucagaau

SEQ ID NO: 1267000 - RNA, 17 nt, Human
auuguucucagaauccc

SEQ ID NO: 1267001 - RNA, 17 nt, Human
auuguugaaaaaguuug

SEQ ID NO: 1267002 - RNA, 18 nt, Human
auuguugaaaaaguuugu

SEQ ID NO: 1267003 - RNA, 20 nt, Human
auuguugaaaaaguuuguuu

SEQ ID NO: 1267004 - RNA, 19 nt, Human
auuguugaaaaaguuuguu

SEQ ID NO: 1267005 - RNA, 13 nt, Human
auuguuucaauug

SEQ ID NO: 1267006 - RNA, 22 nt, Human
auugauccagaaagaaaacuug

SEQ ID NO: 1267007 - RNA, 19 nt, Human
auugauccagaaagaaaac

SEQ ID NO: 1267008 - RNA, 18 nt, Human
auugauccagaaagaaaa

SEQ ID NO: 1267009 - RNA, 18 nt, Human
auugaugggauuugguca

SEQ ID NO: 1267010 - RNA, 14 nt, Human
auugaugauccauu

SEQ ID NO: 1267011 - RNA, 15 nt, Human
auuguaaaaauggca

SEQ ID NO: 1267012 - RNA, 14 nt, Human
auuguaaaacaggu

SEQ ID NO: 1267013 - RNA, 13 nt, Human
auuguaaaagcau

SEQ ID NO: 1267014 - RNA, 13 nt, Human
auuguaaaauggu

SEQ ID NO: 1267015 - RNA, 19 nt, Human
auuguaaaagcauuuugua

SEQ ID NO: 1267016 - RNA, 20 nt, Human
auuguaaaagcauuuuguaa

SEQ ID NO: 1267017 - RNA, 21 nt, Human
auuguaaaagcauuuuguaau

SEQ ID NO: 1267018 - RNA, 23 nt, Human
auuguaaaagcauuuuguaauaa

SEQ ID NO: 1267019 - RNA, 23 nt, Human
auuguaauaggcguaacuaauuu

SEQ ID NO: 1267020 - RNA, 14 nt, Human
auuguaaauauugu

SEQ ID NO: 1267021 - RNA, 17 nt, Human
auuguaaaauaauucug

SEQ ID NO: 1267022 - RNA, 13 nt, Human
auuguaaaauaau

SEQ ID NO: 1267023 - RNA, 15 nt, Human
auuucuaugaaauau

SEQ ID NO: 1267024 - RNA, 18 nt, Human
auuucuaugaaauauuau

SEQ ID NO: 1267025 - RNA, 14 nt, Human
auuucaucuauuuu

SEQ ID NO: 1267026 - RNA, 20 nt, Human
auuucuaugaaauauuaugu

SEQ ID NO: 1267027 - RNA, 24 nt, Human
auuucucagaagucuuucagcaag

SEQ ID NO: 1267028 - RNA, 20 nt, Human
auuucuccuccaugggagaa

SEQ ID NO: 1267029 - RNA, 23 nt, Human
auuucuguguugccaagcuccaa

SEQ ID NO: 1267030 - RNA, 15 nt, Human
auuucuguguugcca

SEQ ID NO: 1267031 - RNA, 16 nt, Human
auuucagcagcugcag

SEQ ID NO: 1267032 - RNA, 18 nt, Human
auuucagauucccagagc

SEQ ID NO: 1267033 - RNA, 13 nt, Human
auuucaucuauuu

SEQ ID NO: 1267034 - RNA, 14 nt, Human
auuucaagguucua

SEQ ID NO: 1267035 - RNA, 15 nt, Human
auuucaagguucuaa

SEQ ID NO: 1267036 - RNA, 17 nt, Human
auuucaagguucuaacc

SEQ ID NO: 1267037 - RNA, 11 nt, Human
auuucaaguuc

SEQ ID NO: 1267038 - RNA, 16 nt, Human
auuucaaguuccaagu

SEQ ID NO: 1267039 - RNA, 22 nt, Human
auuucaaguuccaaguugcuaa

SEQ ID NO: 1267040 - RNA, 23 nt, Human
auuucaaguuccaaguugcuaau

SEQ ID NO: 1267041 - RNA, 18 nt, Human
auuucagacucccauucc

SEQ ID NO: 1267042 - RNA, 23 nt, Human
auuucagacucccauuccugaag

SEQ ID NO: 1267043 - RNA, 16 nt, Human
auuucagagaggccuu

SEQ ID NO: 1267044 - RNA, 22 nt, Human
auuucagagaggccuuuuggaa

SEQ ID NO: 1267045 - RNA, 23 nt, Human
auuucagagugacuacacacagu

SEQ ID NO: 1267046 - RNA, 23 nt, Human
auuuauaccucaauuuucacugu

SEQ ID NO: 1267047 - RNA, 21 nt, Human
auuuauauuguaaauauugug

SEQ ID NO: 1267048 - RNA, 20 nt, Human
auuuauauuguaaauauugu

SEQ ID NO: 1267049 - RNA, 21 nt, Human
auuuaucaaacccuagccuug

SEQ ID NO: 1267050 - RNA, 19 nt, Human
auuuaucacacaaagcaga

SEQ ID NO: 1267051 - RNA, 14 nt, Human
auuuaucacacaaa

SEQ ID NO: 1267052 - RNA, 17 nt, Human
auuuaucacacaaagca

SEQ ID NO: 1267053 - RNA, 12 nt, Human
auuucaagguuc

SEQ ID NO: 1267054 - RNA, 13 nt, Human
auuucaagguucu

SEQ ID NO: 1267055 - RNA, 14 nt, Human
auuuaaugcugugg

SEQ ID NO: 1267056 - RNA, 17 nt, Human
auuuaauggggaggaca

SEQ ID NO: 1267057 - RNA, 14 nt, Human
auuuaauguuuuca

SEQ ID NO: 1267058 - RNA, 13 nt, Human
auuuaauauuaca

SEQ ID NO: 1267059 - RNA, 14 nt, Human
auuuaauauuacag

SEQ ID NO: 1267060 - RNA, 16 nt, Human
auuuaauauuacagau

SEQ ID NO: 1267061 - RNA, 17 nt, Human
auuuaauauuacagaua

SEQ ID NO: 1267062 - RNA, 14 nt, Human
auuuaauauuuacu

SEQ ID NO: 1267063 - RNA, 15 nt, Human
auuuaauauuuacuc

SEQ ID NO: 1267064 - RNA, 16 nt, Human
auuuaauauuuacucu

SEQ ID NO: 1267065 - RNA, 22 nt, Human
caaauccagccugcugccugcu

SEQ ID NO: 1267066 - RNA, 16 nt, Human
caaaucaggcuuuugu

SEQ ID NO: 1267067 - RNA, 13 nt, Human
caaaucaggcuuu

SEQ ID NO: 1267068 - RNA, 13 nt, Human
caaaucauuuguu

SEQ ID NO: 1267069 - RNA, 14 nt, Human
caaaucauuuguuu

SEQ ID NO: 1267070 - RNA, 16 nt, Human
caaaucauuuguuuaa

SEQ ID NO: 1267071 - RNA, 17 nt, Human
caaaucauuuguuuaaa

SEQ ID NO: 1267072 - RNA, 18 nt, Human
caaaucauuuguuuaaaa

SEQ ID NO: 1267073 - RNA, 20 nt, Human
caaagaucuguccucagccu

SEQ ID NO: 1267074 - RNA, 21 nt, Human
caaagaucuguccucagccuu

SEQ ID NO: 1267075 - RNA, 12 nt, Human
caaagaugaaaa

SEQ ID NO: 1267076 - RNA, 18 nt, Human
caaagaugaaugaagcaa

SEQ ID NO: 1267077 - RNA, 20 nt, Human
caaagaugaaugaagcaaau

SEQ ID NO: 1267078 - RNA, 18 nt, Human
caaaguaaugacagaaca

SEQ ID NO: 1267079 - RNA, 15 nt, Human
caacaaagaaacaaa

SEQ ID NO: 1267080 - RNA, 20 nt, Human
caacaaagaaacaaagaugu

SEQ ID NO: 1267081 - RNA, 15 nt, Human
caaauuuuucugcuu

SEQ ID NO: 1267082 - RNA, 20 nt, Human
caaauuuuucugcuuuaaaa

SEQ ID NO: 1267083 - RNA, 14 nt, Human
caacaaaagaagcc

SEQ ID NO: 1267084 - RNA, 22 nt, Human
caacaaaagaagcccggcuccu

SEQ ID NO: 1267085 - RNA, 14 nt, Human
caacaauuuaugaa

SEQ ID NO: 1267086 - RNA, 16 nt, Human
caacaauuuaugaauu

SEQ ID NO: 1267087 - RNA, 17 nt, Human
caacaauuuaugaauug

SEQ ID NO: 1267088 - RNA, 18 nt, Human
caacaauuuaugaauuga

SEQ ID NO: 1267089 - RNA, 13 nt, Human
caacaauuucuac

SEQ ID NO: 1267090 - RNA, 18 nt, Human
caacaauuucuacuuuga

SEQ ID NO: 1267091 - RNA, 19 nt, Human
caacaauuucuacuuugaa

SEQ ID NO: 1267092 - RNA, 20 nt, Human
caacaauuucuacuuugaag

SEQ ID NO: 1267093 - RNA, 14 nt, Human
caaaucgaaugaaa

SEQ ID NO: 1267094 - RNA, 19 nt, Human
caaaucguccagcgaccuu

SEQ ID NO: 1267095 - RNA, 21 nt, Human
caaaucguccagcgaccuucc

SEQ ID NO: 1267096 - RNA, 18 nt, Human
caaaucuaccacuguaug

SEQ ID NO: 1267097 - RNA, 14 nt, Human
caaaucuaccacug

SEQ ID NO: 1267098 - RNA, 13 nt, Human
caaaugcagcuuu

SEQ ID NO: 1267099 - RNA, 21 nt, Human
caaaugcaaaaacucuuugag

SEQ ID NO: 1267100 - RNA, 19 nt, Human
caaaugcaaaaacucuuug

SEQ ID NO: 1267101 - RNA, 19 nt, Human
caaauuuugaguugccaca

SEQ ID NO: 1267102 - RNA, 14 nt, Human
caaaugaguaacau

SEQ ID NO: 1267103 - RNA, 18 nt, Human
caaaugaguaacauuugc

SEQ ID NO: 1267104 - RNA, 19 nt, Human
caaaugaguaacauuugcu

SEQ ID NO: 1267105 - RNA, 21 nt, Human
caaaugaguaacauuugcugu

SEQ ID NO: 1267106 - RNA, 18 nt, Human
caacaccucuuggggagu

SEQ ID NO: 1267107 - RNA, 13 nt, Human
caacacaaagauu

SEQ ID NO: 1267108 - RNA, 23 nt, Human
caagaauuucuaggacugaauua

SEQ ID NO: 1267109 - RNA, 13 nt, Human
caagacacaguga

SEQ ID NO: 1267110 - RNA, 13 nt, Human
caagacccccagc

SEQ ID NO: 1267111 - RNA, 14 nt, Human
caagacccccagca

SEQ ID NO: 1267112 - RNA, 16 nt, Human
caagacccccagcacu

SEQ ID NO: 1267113 - RNA, 13 nt, Human
caagaagggacug

SEQ ID NO: 1267114 - RNA, 18 nt, Human
caagaagggacugagaga

SEQ ID NO: 1267115 - RNA, 14 nt, Human
caagaagugaagaa

SEQ ID NO: 1267116 - RNA, 16 nt, Human
caagaagggacugaga

SEQ ID NO: 1267117 - RNA, 17 nt, Human
caagaauaaucacgcuu

SEQ ID NO: 1267118 - RNA, 18 nt, Human
caagaauaaucacgcuuu

SEQ ID NO: 1267119 - RNA, 20 nt, Human
caagaauaaucacgcuuucc

SEQ ID NO: 1267120 - RNA, 16 nt, Human
caaccccagacacugg

SEQ ID NO: 1267121 - RNA, 17 nt, Human
caacuaugauuuggaaa

SEQ ID NO: 1267122 - RNA, 18 nt, Human
caacuaugauuuggaaaa

SEQ ID NO: 1267123 - RNA, 19 nt, Human
caacuaugauuuggaaaau

SEQ ID NO: 1267124 - RNA, 22 nt, Human
caacuaugauuuggaaaauaaa

SEQ ID NO: 1267125 - RNA, 19 nt, Human
caacccaaauguucaucaa

SEQ ID NO: 1267126 - RNA, 14 nt, Human
caaccauuccccau

SEQ ID NO: 1267127 - RNA, 13 nt, Human
caaccauuuccuc

SEQ ID NO: 1267128 - RNA, 16 nt, Human
caaccauuuccucaga

SEQ ID NO: 1267129 - RNA, 14 nt, Human
caaccauuugaaac

SEQ ID NO: 1267130 - RNA, 17 nt, Human
caaccauuuccucagac

SEQ ID NO: 1267131 - RNA, 18 nt, Human
caacccaaccucauccuc

SEQ ID NO: 1267132 - RNA, 14 nt, Human
caacccaaugggcu

SEQ ID NO: 1267133 - RNA, 14 nt, Human
caaccacuggucug

SEQ ID NO: 1267134 - RNA, 22 nt, Human
caaccacuggucuguagggauu

SEQ ID NO: 1267135 - RNA, 23 nt, Human
caaccacuggucuguagggauuu

SEQ ID NO: 1267136 - RNA, 14 nt, Human
caaccaugucauuu

SEQ ID NO: 1267137 - RNA, 16 nt, Human
caaccaugucauuuca

SEQ ID NO: 1267138 - RNA, 22 nt, Human
caaccaugucauuucagaaguu

SEQ ID NO: 1267139 - RNA, 18 nt, Human
caaccauuauaaccuuaa

SEQ ID NO: 1267140 - RNA, 22 nt, Human
caaccauuauaaccuuaauuua

SEQ ID NO: 1267141 - RNA, 13 nt, Human
caaccauuccaga

SEQ ID NO: 1267142 - RNA, 14 nt, Human
caaccauuccagac

SEQ ID NO: 1267143 - RNA, 16 nt, Human
caaccauuccagacug

SEQ ID NO: 1267144 - RNA, 22 nt, Human
caaccauuccagacugcuucca

SEQ ID NO: 1267145 - RNA, 17 nt, Human
caaaccacuuuuugcag

SEQ ID NO: 1267146 - RNA, 19 nt, Human
caaaccacgccucuugacc

SEQ ID NO: 1267147 - RNA, 22 nt, Human
caaaccacgccucuugaccagg

SEQ ID NO: 1267148 - RNA, 16 nt, Human
caaaaguuacauguuu

SEQ ID NO: 1267149 - RNA, 17 nt, Human
caaaccacgccucuuga

SEQ ID NO: 1267150 - RNA, 19 nt, Human
caaaccacuuuuugcagcu

SEQ ID NO: 1267151 - RNA, 20 nt, Human
caaaccacuuuuugcagcuu

SEQ ID NO: 1267152 - RNA, 18 nt, Human
caaaaguuacauguuugc

SEQ ID NO: 1267153 - RNA, 22 nt, Human
caaaagcccauucauuccauuc

SEQ ID NO: 1267154 - RNA, 20 nt, Human
caaaagcccauucauuccau

SEQ ID NO: 1267155 - RNA, 21 nt, Human
caaaagcuauuuaaagcaucu

SEQ ID NO: 1267156 - RNA, 23 nt, Human
caaaagcgugagcuuaaaauaca

SEQ ID NO: 1267157 - RNA, 17 nt, Human
auuuuuuuuuccuagcc

SEQ ID NO: 1267158 - RNA, 14 nt, Human
caaaaaaaaauaca

SEQ ID NO: 1267159 - RNA, 22 nt, Human
caaaaaaaaauuuuaaagaccc

SEQ ID NO: 1267160 - RNA, 21 nt, Human
caaaaaaaaauuuuaaagacc

SEQ ID NO: 1267161 - RNA, 22 nt, Human
auuuuuaauuaauugggccagc

SEQ ID NO: 1267162 - RNA, 17 nt, Human
auuuuuacaauguaauu

SEQ ID NO: 1267163 - RNA, 18 nt, Human
auuuuuacaauguaauua

SEQ ID NO: 1267164 - RNA, 19 nt, Human
auuuuuacaauguaauuau

SEQ ID NO: 1267165 - RNA, 14 nt, Human
auuuuuacagaauu

SEQ ID NO: 1267166 - RNA, 16 nt, Human
auuuuuacagaauugc

SEQ ID NO: 1267167 - RNA, 22 nt, Human
auuuuuacagaauugcuuguuu

SEQ ID NO: 1267168 - RNA, 16 nt, Human
auuuuuacauucugaa

SEQ ID NO: 1267169 - RNA, 17 nt, Human
auuuuuacauucugaau

SEQ ID NO: 1267170 - RNA, 17 nt, Human
auuuuuacaucuaaacu

SEQ ID NO: 1267171 - RNA, 11 nt, Human
auuuuuaccag

SEQ ID NO: 1267172 - RNA, 12 nt, Human
auuuuuaccagu

SEQ ID NO: 1267173 - RNA, 17 nt, Human
auuuuauagcuacuaau

SEQ ID NO: 1267174 - RNA, 23 nt, Human
auuuuauaugcuuacugauauau

SEQ ID NO: 1267175 - RNA, 18 nt, Human
auuuuauauuacacuaca

SEQ ID NO: 1267176 - RNA, 15 nt, Human
auuuuauauuacacu

SEQ ID NO: 1267177 - RNA, 20 nt, Human
auuuguuucuuucucugagg

SEQ ID NO: 1267178 - RNA, 14 nt, Human
auuuugaguugcca

SEQ ID NO: 1267179 - RNA, 22 nt, Human
auuuuaucugccucucuuguaa

SEQ ID NO: 1267180 - RNA, 21 nt, Human
auuuuaucugccucucuugua

SEQ ID NO: 1267181 - RNA, 20 nt, Human
auuuuaucccucaccuguag

SEQ ID NO: 1267182 - RNA, 23 nt, Human
auuuucuugauguagcagaauau

SEQ ID NO: 1267183 - RNA, 14 nt, Human
auuuucuuucaaaa

SEQ ID NO: 1267184 - RNA, 16 nt, Human
auuuucuuucuguaac

SEQ ID NO: 1267185 - RNA, 23 nt, Human
auuuucuuuguguagcuuugcuc

SEQ ID NO: 1267186 - RNA, 24 nt, Human
auuuugacauaaaguugauaaaga

SEQ ID NO: 1267187 - RNA, 22 nt, Human
auuuugagaaagucuuauuuau

SEQ ID NO: 1267188 - RNA, 17 nt, Human
auuuugacauaaaguug

SEQ ID NO: 1267189 - RNA, 20 nt, Human
cacugaacuuugcugagccu

SEQ ID NO: 1267190 - RNA, 11 nt, Human
cacugaagaag

SEQ ID NO: 1267191 - RNA, 16 nt, Human
cacugaaaaaauauau

SEQ ID NO: 1267192 - RNA, 17 nt, Human
cacugaaaaaauauaug

SEQ ID NO: 1267193 - RNA, 20 nt, Human
cacugaaaaaucuaagugau

SEQ ID NO: 1267194 - RNA, 23 nt, Human
cacugaaaaaucuaagugauaua

SEQ ID NO: 1267195 - RNA, 17 nt, Human
cacucuugaaaaaugca

SEQ ID NO: 1267196 - RNA, 14 nt, Human
cacucuuaugcugu

SEQ ID NO: 1267197 - RNA, 18 nt, Human
cacucuuaugcuguaccc

SEQ ID NO: 1267198 - RNA, 19 nt, Human
cacucuuaugcuguaccca

SEQ ID NO: 1267199 - RNA, 21 nt, Human
cacucuuaugcuguacccagu

SEQ ID NO: 1267200 - RNA, 18 nt, Human
cacuccccgaagucuuuu

SEQ ID NO: 1267201 - RNA, 19 nt, Human
cacuccccgaagucuuuug

SEQ ID NO: 1267202 - RNA, 15 nt, Human
cacuagccucagggg

SEQ ID NO: 1267203 - RNA, 19 nt, Human
cacuagccucaggggucug

SEQ ID NO: 1267204 - RNA, 13 nt, Human
cacuacugacaug

SEQ ID NO: 1267205 - RNA, 15 nt, Human
cacuacugacaugug

SEQ ID NO: 1267206 - RNA, 22 nt, Human
cacuagcucuuguugagccgug

SEQ ID NO: 1267207 - RNA, 17 nt, Human
cacuaggcccccacuug

SEQ ID NO: 1267208 - RNA, 20 nt, Human
cacuaggcccccacuugccu

SEQ ID NO: 1267209 - RNA, 21 nt, Human
cacuaggcccccacuugccuc

SEQ ID NO: 1267210 - RNA, 22 nt, Human
cacuaggcccccacuugccucu

SEQ ID NO: 1267211 - RNA, 23 nt, Human
cacuaggcccccacuugccucuu

SEQ ID NO: 1267212 - RNA, 22 nt, Human
cacucccaccugacacaccagg

SEQ ID NO: 1267213 - RNA, 23 nt, Human
cacucccaccugacacaccaggc

SEQ ID NO: 1267214 - RNA, 12 nt, Human
cacuagcucuug

SEQ ID NO: 1267215 - RNA, 15 nt, Human
cacuccccaaccccc

SEQ ID NO: 1267216 - RNA, 14 nt, Human
cacuccccacaucc

SEQ ID NO: 1267217 - RNA, 13 nt, Human
cacggcagccaca

SEQ ID NO: 1267218 - RNA, 20 nt, Human
cacggcaccugggcccuggg

SEQ ID NO: 1267219 - RNA, 21 nt, Human
cacggcaccugggcccugggg

SEQ ID NO: 1267220 - RNA, 17 nt, Human
cacggauuugugucugu

SEQ ID NO: 1267221 - RNA, 17 nt, Human
cacggcaaaggaagacg

SEQ ID NO: 1267222 - RNA, 19 nt, Human
cacggcaccugggcccugg

SEQ ID NO: 1267223 - RNA, 23 nt, Human
cacggagucguggggugugcugg

SEQ ID NO: 1267224 - RNA, 12 nt, Human
cacuacacccag

SEQ ID NO: 1267225 - RNA, 13 nt, Human
cacuacaaccucc

SEQ ID NO: 1267226 - RNA, 14 nt, Human
cacuacaaccuccg

SEQ ID NO: 1267227 - RNA, 11 nt, Human
cacuaauucau

SEQ ID NO: 1267228 - RNA, 12 nt, Human
cacuaauucaua

SEQ ID NO: 1267229 - RNA, 22 nt, Human
cacuaauucauuaaucugccuc

SEQ ID NO: 1267230 - RNA, 20 nt, Human
cacggcagccacagcuuggg

SEQ ID NO: 1267231 - RNA, 22 nt, Human
cacggcaccugggcccuggggc

SEQ ID NO: 1267232 - RNA, 16 nt, Human
cacuaauauauuuaaa

SEQ ID NO: 1267233 - RNA, 17 nt, Human
cacuaauauauuuaaaa

SEQ ID NO: 1267234 - RNA, 19 nt, Human
cacuaauauauuuaaaaau

SEQ ID NO: 1267235 - RNA, 20 nt, Human
cacuaauauauuuaaaaaua

SEQ ID NO: 1267236 - RNA, 21 nt, Human
cacuaauauauuuaaaaauaa

SEQ ID NO: 1267237 - RNA, 23 nt, Human
cacuacgccuggcugauuuuugu

SEQ ID NO: 1267238 - RNA, 18 nt, Human
cacuacacccagcaauag

SEQ ID NO: 1267239 - RNA, 17 nt, Human
cacuacacccagcaaua

SEQ ID NO: 1267240 - RNA, 16 nt, Human
cacuacacccagcaau

SEQ ID NO: 1267241 - RNA, 15 nt, Human
cacuacacccagcaa

SEQ ID NO: 1267242 - RNA, 14 nt, Human
cacuacacccagca

SEQ ID NO: 1267243 - RNA, 13 nt, Human
cacuacucagcau

SEQ ID NO: 1267244 - RNA, 14 nt, Human
cacuacucagcaug

SEQ ID NO: 1267245 - RNA, 20 nt, Human
caccuaccaccacgcccggc

SEQ ID NO: 1267246 - RNA, 18 nt, Human
caccuaccgaguucaagu

SEQ ID NO: 1267247 - RNA, 18 nt, Human
caccuacucacacaggca

SEQ ID NO: 1267248 - RNA, 19 nt, Human
caccuaugucauuucauuu

SEQ ID NO: 1267249 - RNA, 20 nt, Human
caccuaugucauuucauuuc

SEQ ID NO: 1267250 - RNA, 23 nt, Human
caccuaugucauuucauuuccua

SEQ ID NO: 1267251 - RNA, 17 nt, Human
caccuacucacacaggc

SEQ ID NO: 1267252 - RNA, 15 nt, Human
caccuauuaucccag

SEQ ID NO: 1267253 - RNA, 17 nt, Human
caccuauuaucccagcu

SEQ ID NO: 1267254 - RNA, 18 nt, Human
caccuauuaucccagcug

SEQ ID NO: 1267255 - RNA, 19 nt, Human
caccuauuaucccagcugc

SEQ ID NO: 1267256 - RNA, 21 nt, Human
caccuauuaucccagcugccu

SEQ ID NO: 1267257 - RNA, 13 nt, Human
caccuauuuccau

SEQ ID NO: 1267258 - RNA, 21 nt, Human
caccuacaugagguacugaga

SEQ ID NO: 1267259 - RNA, 17 nt, Human
caccuaauccaggcaga

SEQ ID NO: 1267260 - RNA, 14 nt, Human
caccguugucucau

SEQ ID NO: 1267261 - RNA, 19 nt, Human
caccguugucucaugccag

SEQ ID NO: 1267262 - RNA, 12 nt, Human
caccuaaagaaa

SEQ ID NO: 1267263 - RNA, 13 nt, Human
caccuaaagaaaa

SEQ ID NO: 1267264 - RNA, 17 nt, Human
caccuaaagaaaaacaa

SEQ ID NO: 1267265 - RNA, 15 nt, Human
caccuaacucuucuu

SEQ ID NO: 1267266 - RNA, 14 nt, Human
caccguucauucag

SEQ ID NO: 1267267 - RNA, 13 nt, Human
caccguucugugc

SEQ ID NO: 1267268 - RNA, 14 nt, Human
caccguucugugca

SEQ ID NO: 1267269 - RNA, 15 nt, Human
caccguucugugcac

SEQ ID NO: 1267270 - RNA, 13 nt, Human
caccguugucuca

SEQ ID NO: 1267271 - RNA, 14 nt, Human
caccuuuauucugg

SEQ ID NO: 1267272 - RNA, 14 nt, Human
caccuuuaaagugu

SEQ ID NO: 1267273 - RNA, 14 nt, Human
caccuuuagguucu

SEQ ID NO: 1267274 - RNA, 15 nt, Human
caccuuuagguucuu

SEQ ID NO: 1267275 - RNA, 23 nt, Human
caccuugcuccuccuucugcugc

SEQ ID NO: 1267276 - RNA, 23 nt, Human
caccuugugcuggggacaggucc

SEQ ID NO: 1267277 - RNA, 22 nt, Human
caccuuggacauccuccuccca

SEQ ID NO: 1267278 - RNA, 17 nt, Human
caccuuggcaccagaca

SEQ ID NO: 1267279 - RNA, 16 nt, Human
caccuuggacauccuc

SEQ ID NO: 1267280 - RNA, 17 nt, Human
caccuuggacauccucc

SEQ ID NO: 1267281 - RNA, 18 nt, Human
caccuuggacauccuccu

SEQ ID NO: 1267282 - RNA, 21 nt, Human
caccuuggacauccuccuccc

SEQ ID NO: 1267283 - RNA, 16 nt, Human
cagaaguuugcacuau

SEQ ID NO: 1267284 - RNA, 18 nt, Human
cagaaguuugcacuaucu

SEQ ID NO: 1267285 - RNA, 22 nt, Human
cagaaguuugcacuaucuuuca

SEQ ID NO: 1267286 - RNA, 15 nt, Human
cagaauaaguuauug

SEQ ID NO: 1267287 - RNA, 17 nt, Human
cagaauaaguuauugca

SEQ ID NO: 1267288 - RNA, 18 nt, Human
cagaauaaguuauugcag

SEQ ID NO: 1267289 - RNA, 19 nt, Human
cagaauaaguuauugcagu

SEQ ID NO: 1267290 - RNA, 20 nt, Human
cagaauaaguuauugcaguu

SEQ ID NO: 1267291 - RNA, 22 nt, Human
cagaauauuagugaccucagcu

SEQ ID NO: 1267292 - RNA, 21 nt, Human
cagaauaaguuauugcaguuu

SEQ ID NO: 1267293 - RNA, 23 nt, Human
cagaauaaguuauugcaguuuau

SEQ ID NO: 1267294 - RNA, 15 nt, Human
cagaauacauacaaa

SEQ ID NO: 1267295 - RNA, 15 nt, Human
cagaauagccacauu

SEQ ID NO: 1267296 - RNA, 21 nt, Human
cagaauagccacauuuggaau

SEQ ID NO: 1267297 - RNA, 22 nt, Human
cagaauagccacauuuggaaua

SEQ ID NO: 1267298 - RNA, 14 nt, Human
cagaauaguauuuu

SEQ ID NO: 1267299 - RNA, 17 nt, Human
cagaauaucacagaaaa

SEQ ID NO: 1267300 - RNA, 13 nt, Human
cagaauaugucag

SEQ ID NO: 1267301 - RNA, 15 nt, Human
cagaacacauaauuc

SEQ ID NO: 1267302 - RNA, 19 nt, Human
cagaacacauuucaaauga

SEQ ID NO: 1267303 - RNA, 16 nt, Human
cagaacaaaugaagac

SEQ ID NO: 1267304 - RNA, 14 nt, Human
cagaacaaaugaag

SEQ ID NO: 1267305 - RNA, 12 nt, Human
cagaacaaauga

SEQ ID NO: 1267306 - RNA, 21 nt, Human
cagaaauuguauauuguaauu

SEQ ID NO: 1267307 - RNA, 22 nt, Human
cagaaauuguauauuguaauuu

SEQ ID NO: 1267308 - RNA, 17 nt, Human
cagaaauuuaauucaga

SEQ ID NO: 1267309 - RNA, 15 nt, Human
cagaaguuucucagc

SEQ ID NO: 1267310 - RNA, 19 nt, Human
cagaaguuaguuuguauau

SEQ ID NO: 1267311 - RNA, 18 nt, Human
cagaaguuaguuuguaua

SEQ ID NO: 1267312 - RNA, 13 nt, Human
cagaagugugacu

SEQ ID NO: 1267313 - RNA, 17 nt, Human
cagaagugugacuggcu

SEQ ID NO: 1267314 - RNA, 16 nt, Human
cagaaguuaguuugua

SEQ ID NO: 1267315 - RNA, 13 nt, Human
cagaagucuuuca

SEQ ID NO: 1267316 - RNA, 17 nt, Human
cagaagucuuucagcaa

SEQ ID NO: 1267317 - RNA, 12 nt, Human
cagaagugcauc

SEQ ID NO: 1267318 - RNA, 14 nt, Human
cagaagugcaucug

SEQ ID NO: 1267319 - RNA, 16 nt, Human
cagaaauucaauuugg

SEQ ID NO: 1267320 - RNA, 20 nt, Human
cagaaauucaauuuggauuu

SEQ ID NO: 1267321 - RNA, 12 nt, Human
cagaaauuguau

SEQ ID NO: 1267322 - RNA, 13 nt, Human
cagaaauuguaua

SEQ ID NO: 1267323 - RNA, 14 nt, Human
cagaaauuguauau

SEQ ID NO: 1267324 - RNA, 15 nt, Human
cagaaauuguauauu

SEQ ID NO: 1267325 - RNA, 16 nt, Human
cagaaauuguauauug

SEQ ID NO: 1267326 - RNA, 18 nt, Human
cagaaauuguauauugua

SEQ ID NO: 1267327 - RNA, 19 nt, Human
cagaaauuguauauuguaa

SEQ ID NO: 1267328 - RNA, 22 nt, Human
cacuguuucacuacucagcaug

SEQ ID NO: 1267329 - RNA, 21 nt, Human
cacuguuucacuacucagcau

SEQ ID NO: 1267330 - RNA, 21 nt, Human
cacuguuuauacacuguguaa

SEQ ID NO: 1267331 - RNA, 19 nt, Human
cacuguuuauacacugugu

SEQ ID NO: 1267332 - RNA, 20 nt, Human
cacuguuuagaacacacaca

SEQ ID NO: 1267333 - RNA, 17 nt, Human
cacuuagaaauugcauu

SEQ ID NO: 1267334 - RNA, 19 nt, Human
cacuuagaaauugcauuuc

SEQ ID NO: 1267335 - RNA, 16 nt, Human
cacuuacuugcuuauu

SEQ ID NO: 1267336 - RNA, 21 nt, Human
cacuuacuuuuucuggucucu

SEQ ID NO: 1267337 - RNA, 15 nt, Human
cacuuacugguagga

SEQ ID NO: 1267338 - RNA, 21 nt, Human
cacuuacugguaggaccaagc

SEQ ID NO: 1267339 - RNA, 20 nt, Human
cacuuggucugugagaugcu

SEQ ID NO: 1267340 - RNA, 20 nt, Human
cacuuagaaauugcauuucc

SEQ ID NO: 1267341 - RNA, 12 nt, Human
cacuuguacaaa

SEQ ID NO: 1267342 - RNA, 17 nt, Human
cacuuguacaaaauaaa

SEQ ID NO: 1267343 - RNA, 20 nt, Human
cacuuguaauuuuguaucuu

SEQ ID NO: 1267344 - RNA, 19 nt, Human
cacuuguccuuagccugga

SEQ ID NO: 1267345 - RNA, 20 nt, Human
cacuuguccuuagccuggac

SEQ ID NO: 1267346 - RNA, 21 nt, Human
cacuuguccuuagccuggacc

SEQ ID NO: 1267347 - RNA, 22 nt, Human
cacuuguccuuagccuggaccu

SEQ ID NO: 1267348 - RNA, 16 nt, Human
cacuggggaaaacucc

SEQ ID NO: 1267349 - RNA, 18 nt, Human
cacuggggacuuggccuc

SEQ ID NO: 1267350 - RNA, 19 nt, Human
cacuggggacuuggccucu

SEQ ID NO: 1267351 - RNA, 20 nt, Human
cacuggggacuuggccucuc

SEQ ID NO: 1267352 - RNA, 21 nt, Human
cacuggggacuuggccucucu

SEQ ID NO: 1267353 - RNA, 21 nt, Human
cacuggggagcccgucucagu

SEQ ID NO: 1267354 - RNA, 13 nt, Human
cacugguggcccg

SEQ ID NO: 1267355 - RNA, 21 nt, Human
cacugguggcccgacagccug

SEQ ID NO: 1267356 - RNA, 22 nt, Human
cacugguggcccgacagccugg

SEQ ID NO: 1267357 - RNA, 22 nt, Human
cacuggggagcccgucucagug

SEQ ID NO: 1267358 - RNA, 14 nt, Human
cacuggucugcugu

SEQ ID NO: 1267359 - RNA, 15 nt, Human
cacuggucugcuguc

SEQ ID NO: 1267360 - RNA, 16 nt, Human
cacuggucugcuguuc

SEQ ID NO: 1267361 - RNA, 21 nt, Human
cacuggucugcuguuccagug

SEQ ID NO: 1267362 - RNA, 20 nt, Human
cacuggucuguuugcauuug

SEQ ID NO: 1267363 - RNA, 13 nt, Human
cacuggggcaggg

SEQ ID NO: 1267364 - RNA, 15 nt, Human
cacuggggcaggggc

SEQ ID NO: 1267365 - RNA, 19 nt, Human
cacuggggcaggggccggg

SEQ ID NO: 1267366 - RNA, 23 nt, Human
cacuggucacggauuugugucug

SEQ ID NO: 1267367 - RNA, 21 nt, Human
cacuuucaaucuucaauccuu

SEQ ID NO: 1267368 - RNA, 11 nt, Human
cacuuucagcu

SEQ ID NO: 1267369 - RNA, 12 nt, Human
cacuuucagcug

SEQ ID NO: 1267370 - RNA, 13 nt, Human
cacuuucagcugu

SEQ ID NO: 1267371 - RNA, 14 nt, Human
cacuuucagcuguc

SEQ ID NO: 1267372 - RNA, 15 nt, Human
cacuuucagcugucu

SEQ ID NO: 1267373 - RNA, 16 nt, Human
cacuuucagcugucuu

SEQ ID NO: 1267374 - RNA, 17 nt, Human
cacuuucagcugucuuu

SEQ ID NO: 1267375 - RNA, 18 nt, Human
cacuuucagcugucuuuu

SEQ ID NO: 1267376 - RNA, 13 nt, Human
cacuuucccaccc

SEQ ID NO: 1267377 - RNA, 21 nt, Human
cacagggccuuuggcaggugc

SEQ ID NO: 1267378 - RNA, 18 nt, Human
cacagggcaguaccugag

SEQ ID NO: 1267379 - RNA, 21 nt, Human
cacagggcaguaccugagggu

SEQ ID NO: 1267380 - RNA, 20 nt, Human
cacagggagugcacauaucc

SEQ ID NO: 1267381 - RNA, 11 nt, Human
cacagggcagu

SEQ ID NO: 1267382 - RNA, 15 nt, Human
cacagggcaguaccu

SEQ ID NO: 1267383 - RNA, 16 nt, Human
cacagggucugcucuu

SEQ ID NO: 1267384 - RNA, 17 nt, Human
cacagggucugcucuuu

SEQ ID NO: 1267385 - RNA, 19 nt, Human
cacagggucugcucuuucu

SEQ ID NO: 1267386 - RNA, 23 nt, Human
cacagggucugcucuuucucugc

SEQ ID NO: 1267387 - RNA, 21 nt, Human
cacaggucccaaauggcccug

SEQ ID NO: 1267388 - RNA, 12 nt, Human
cacagcuaugaa

SEQ ID NO: 1267389 - RNA, 22 nt, Human
cacagcuaugaaggcuguacac

SEQ ID NO: 1267390 - RNA, 16 nt, Human
cacagcuacucucccc

SEQ ID NO: 1267391 - RNA, 19 nt, Human
cacagacagggucaaagug

SEQ ID NO: 1267392 - RNA, 21 nt, Human
cacagcggagguguggagccg

SEQ ID NO: 1267393 - RNA, 19 nt, Human
cacagaagugcuuucuucu

SEQ ID NO: 1267394 - RNA, 14 nt, Human
cacaggucccaaau

SEQ ID NO: 1267395 - RNA, 13 nt, Human
cacaggucuagac

SEQ ID NO: 1267396 - RNA, 14 nt, Human
cacaggucuagacu

SEQ ID NO: 1267397 - RNA, 16 nt, Human
cacaguagucuugaug

SEQ ID NO: 1267398 - RNA, 12 nt, Human
cacaucccuggg

SEQ ID NO: 1267399 - RNA, 22 nt, Human
cacaucccugggccugcugcug

SEQ ID NO: 1267400 - RNA, 13 nt, Human
cacaucccugggc

SEQ ID NO: 1267401 - RNA, 14 nt, Human
cacaucccugggcc

SEQ ID NO: 1267402 - RNA, 15 nt, Human
cacaucccugggccu

SEQ ID NO: 1267403 - RNA, 16 nt, Human
cacaucccugggccug

SEQ ID NO: 1267404 - RNA, 17 nt, Human
cacaucccugggccugc

SEQ ID NO: 1267405 - RNA, 18 nt, Human
cacaucccugggccugcu

SEQ ID NO: 1267406 - RNA, 20 nt, Human
cacaucccugggccugcugc

SEQ ID NO: 1267407 - RNA, 21 nt, Human
cacaucccugggccugcugcu

SEQ ID NO: 1267408 - RNA, 22 nt, Human
cacauccuccacguucugcuca

SEQ ID NO: 1267409 - RNA, 19 nt, Human
cacaucgcagauucucccu

SEQ ID NO: 1267410 - RNA, 17 nt, Human
cacaucuaaccucaucu

SEQ ID NO: 1267411 - RNA, 13 nt, Human
cacauuucuaaaa

SEQ ID NO: 1267412 - RNA, 17 nt, Human
cacauuucuaaaaucuu

SEQ ID NO: 1267413 - RNA, 19 nt, Human
cacauuugcuuuuugugau

SEQ ID NO: 1267414 - RNA, 16 nt, Human
cacauuuggaauacuu

SEQ ID NO: 1267415 - RNA, 17 nt, Human
cacauuuggaauacuuu

SEQ ID NO: 1267416 - RNA, 19 nt, Human
cacauuuggaauacuuuuu

SEQ ID NO: 1267417 - RNA, 21 nt, Human
cacauuugcuuuuugugauau

SEQ ID NO: 1267418 - RNA, 18 nt, Human
cacauuuuccuuuucaaa

SEQ ID NO: 1267419 - RNA, 17 nt, Human
cacauuugucuucuuuc

SEQ ID NO: 1267420 - RNA, 23 nt, Human
cacauuugucuucuuucugucuu

SEQ ID NO: 1267421 - RNA, 15 nt, Human
cacauuuuaaaagug

SEQ ID NO: 1267422 - RNA, 17 nt, Human
cacauuuuuuaggaaau

SEQ ID NO: 1267423 - RNA, 14 nt, Human
caccaaaaaccuau

SEQ ID NO: 1267424 - RNA, 15 nt, Human
caccaaaacugcucc

SEQ ID NO: 1267425 - RNA, 17 nt, Human
caccaggcgcuaauuca

SEQ ID NO: 1267426 - RNA, 23 nt, Human
caccaggcgcuaauucaaggaau

SEQ ID NO: 1267427 - RNA, 21 nt, Human
caccaggcugagguccugauc

SEQ ID NO: 1267428 - RNA, 14 nt, Human
caccagcugugucc

SEQ ID NO: 1267429 - RNA, 15 nt, Human
caccagcugugucca

SEQ ID NO: 1267430 - RNA, 15 nt, Human
caccaggcagccucu

SEQ ID NO: 1267431 - RNA, 13 nt, Human
caccaggccaccu

SEQ ID NO: 1267432 - RNA, 14 nt, Human
caccaggccaccuc

SEQ ID NO: 1267433 - RNA, 15 nt, Human
caccaggccaccucc

SEQ ID NO: 1267434 - RNA, 19 nt, Human
caccaggccaccuccccag

SEQ ID NO: 1267435 - RNA, 22 nt, Human
caccaggccaccuccccagcau

SEQ ID NO: 1267436 - RNA, 18 nt, Human
caccaggcagccucuggg

SEQ ID NO: 1267437 - RNA, 13 nt, Human
caauaaaaauguu

SEQ ID NO: 1267438 - RNA, 17 nt, Human
caauaaaaauguuuaac

SEQ ID NO: 1267439 - RNA, 14 nt, Human
caaguauuagaaua

SEQ ID NO: 1267440 - RNA, 16 nt, Human
caaguagaaucucagu

SEQ ID NO: 1267441 - RNA, 22 nt, Human
caaguagauaggaagaaagaag

SEQ ID NO: 1267442 - RNA, 24 nt, Human
caaguacaaccacacccacacuca

SEQ ID NO: 1267443 - RNA, 19 nt, Human
caaguacaaccacacccac

SEQ ID NO: 1267444 - RNA, 13 nt, Human
caaguagaaucuc

SEQ ID NO: 1267445 - RNA, 23 nt, Human
caaguagaaucucaguugauuuu

SEQ ID NO: 1267446 - RNA, 13 nt, Human
caagauucagcua

SEQ ID NO: 1267447 - RNA, 15 nt, Human
caagacccccagcac

SEQ ID NO: 1267448 - RNA, 17 nt, Human
caagauuauaauauuuu

SEQ ID NO: 1267449 - RNA, 10 nt, Human
caagauuccg

SEQ ID NO: 1267450 - RNA, 18 nt, Human
caagauuccggauccuaa

SEQ ID NO: 1267451 - RNA, 12 nt, Human
caagauucuaga

SEQ ID NO: 1267452 - RNA, 19 nt, Human
caagauuccggauccuaag

SEQ ID NO: 1267453 - RNA, 22 nt, Human
caagauuccggauccuaagcau

SEQ ID NO: 1267454 - RNA, 20 nt, Human
caaguauuagaauaccacag

SEQ ID NO: 1267455 - RNA, 17 nt, Human
caaguucuaagauucua

SEQ ID NO: 1267456 - RNA, 18 nt, Human
caaguucuaagauucuaa

SEQ ID NO: 1267457 - RNA, 20 nt, Human
caaguucuaagauucuaaug

SEQ ID NO: 1267458 - RNA, 21 nt, Human
caaguucuaagauucuaauga

SEQ ID NO: 1267459 - RNA, 19 nt, Human
caaguugaggacuucuugc

SEQ ID NO: 1267460 - RNA, 15 nt, Human
caaguugcuaauaca

SEQ ID NO: 1267461 - RNA, 15 nt, Human
caaguuggagucacu

SEQ ID NO: 1267462 - RNA, 13 nt, Human
caaguuggaguca

SEQ ID NO: 1267463 - RNA, 19 nt, Human
caaguugugccaaauuauu

SEQ ID NO: 1267464 - RNA, 18 nt, Human
caaguugugcuugagcca

SEQ ID NO: 1267465 - RNA, 18 nt, Human
caaguugugccaaauuau

SEQ ID NO: 1267466 - RNA, 21 nt, Human
caaguuguuccuuaagucaga

SEQ ID NO: 1267467 - RNA, 22 nt, Human
caaguuguuccuuaagucagaa

SEQ ID NO: 1267468 - RNA, 19 nt, Human
caaguuguucgggccaagg

SEQ ID NO: 1267469 - RNA, 16 nt, Human
cacaagacugcacauc

SEQ ID NO: 1267470 - RNA, 11 nt, Human
cacaagacuga

SEQ ID NO: 1267471 - RNA, 20 nt, Human
cacaagacugacgccagggu

SEQ ID NO: 1267472 - RNA, 18 nt, Human
cacaagacugcacaucaa

SEQ ID NO: 1267473 - RNA, 15 nt, Human
cacaagauugguguu

SEQ ID NO: 1267474 - RNA, 17 nt, Human
cacaagauugguguuuu

SEQ ID NO: 1267475 - RNA, 22 nt, Human
cacaagauugguguuuuuuucu

SEQ ID NO: 1267476 - RNA, 23 nt, Human
cacaagauugguguuuuuuucua

SEQ ID NO: 1267477 - RNA, 12 nt, Human
caauuuaaaaaa

SEQ ID NO: 1267478 - RNA, 22 nt, Human
cacaagccucugcccaggcacu

SEQ ID NO: 1267479 - RNA, 12 nt, Human
cacaagccugag

SEQ ID NO: 1267480 - RNA, 13 nt, Human
cacaagccugagg

SEQ ID NO: 1267481 - RNA, 15 nt, Human
cacaagccugaggga

SEQ ID NO: 1267482 - RNA, 15 nt, Human
cacaagccucugccc

SEQ ID NO: 1267483 - RNA, 20 nt, Human
cacaagccucugcccaggca

SEQ ID NO: 1267484 - RNA, 12 nt, Human
caauauuucaga

SEQ ID NO: 1267485 - RNA, 20 nt, Human
caauauuucagauaaucaca

SEQ ID NO: 1267486 - RNA, 21 nt, Human
caauauuucagauaaucacaa

SEQ ID NO: 1267487 - RNA, 14 nt, Human
caaugcuguauuuu

SEQ ID NO: 1267488 - RNA, 15 nt, Human
caaugcuguauuuua

SEQ ID NO: 1267489 - RNA, 17 nt, Human
caauucuucccuaucuu

SEQ ID NO: 1267490 - RNA, 15 nt, Human
caauuguguagccuu

SEQ ID NO: 1267491 - RNA, 20 nt, Human
caauucuucccuaucuuugc

SEQ ID NO: 1267492 - RNA, 16 nt, Human
caauuguguagccuuu

SEQ ID NO: 1267493 - RNA, 17 nt, Human
caauuguguagccuuuu

SEQ ID NO: 1267494 - RNA, 20 nt, Human
caauuguguagccuuuuugu

SEQ ID NO: 1267495 - RNA, 18 nt, Human
caauuguguagccuuuuu

SEQ ID NO: 1267496 - RNA, 19 nt, Human
caauucuccugccucagcc

SEQ ID NO: 1267497 - RNA, 17 nt, Human
caauucuccugccucag

SEQ ID NO: 1267498 - RNA, 14 nt, Human
caauggaccggaga

SEQ ID NO: 1267499 - RNA, 12 nt, Human
ccaucccugcgu

SEQ ID NO: 1267500 - RNA, 13 nt, Human
ccaucccuggccc

SEQ ID NO: 1267501 - RNA, 16 nt, Human
ccaucccuggcccccu

SEQ ID NO: 1267502 - RNA, 19 nt, Human
ccaucccuggcccccuccc

SEQ ID NO: 1267503 - RNA, 23 nt, Human
ccaucccuggcccccucccugga

SEQ ID NO: 1267504 - RNA, 22 nt, Human
ccaucccuggcccccucccugg

SEQ ID NO: 1267505 - RNA, 17 nt, Human
ccauccuacccccugug

SEQ ID NO: 1267506 - RNA, 13 nt, Human
ccaguuugcuuug

SEQ ID NO: 1267507 - RNA, 20 nt, Human
ccaguuuggguaaaauacuu

SEQ ID NO: 1267508 - RNA, 22 nt, Human
ccaguuuggguaaaauacuuuu

SEQ ID NO: 1267509 - RNA, 14 nt, Human
ccaguuuuuauuaa

SEQ ID NO: 1267510 - RNA, 13 nt, Human
ccauacauuugug

SEQ ID NO: 1267511 - RNA, 14 nt, Human
ccauacauuugugu

SEQ ID NO: 1267512 - RNA, 20 nt, Human
ccauaauuuuuuuuuuccuu

SEQ ID NO: 1267513 - RNA, 13 nt, Human
ccauaacugaaca

SEQ ID NO: 1267514 - RNA, 11 nt, Human
ccauugaaggc

SEQ ID NO: 1267515 - RNA, 12 nt, Human
ccauugaaggcu

SEQ ID NO: 1267516 - RNA, 17 nt, Human
ccauugaaggcuuaaac

SEQ ID NO: 1267517 - RNA, 21 nt, Human
ccauugaaggcuuaaacccau

SEQ ID NO: 1267518 - RNA, 13 nt, Human
ccauugaauucuu

SEQ ID NO: 1267519 - RNA, 22 nt, Human
ccauugaauucuugguugagga

SEQ ID NO: 1267520 - RNA, 24 nt, Human
ccauugaggcuugguuccuuccca

SEQ ID NO: 1267521 - RNA, 19 nt, Human
ccauuuaaauuuuuuuccu

SEQ ID NO: 1267522 - RNA, 20 nt, Human
ccauuuaauggggaggacaa

SEQ ID NO: 1267523 - RNA, 17 nt, Human
ccauuuacauguuuuaa

SEQ ID NO: 1267524 - RNA, 20 nt, Human
ccauuuacauguuuuaaaga

SEQ ID NO: 1267525 - RNA, 22 nt, Human
ccauuuacauguuuuaaagaaa

SEQ ID NO: 1267526 - RNA, 16 nt, Human
ccauuuagguuucuga

SEQ ID NO: 1267527 - RNA, 21 nt, Human
ccauuuagguuucugaguucc

SEQ ID NO: 1267528 - RNA, 11 nt, Human
ccauuucuaau

SEQ ID NO: 1267529 - RNA, 12 nt, Human
ccauuucuaauu

SEQ ID NO: 1267530 - RNA, 13 nt, Human
ccauuucuaauua

SEQ ID NO: 1267531 - RNA, 14 nt, Human
ccauuucuaauuau

SEQ ID NO: 1267532 - RNA, 21 nt, Human
ccauuucuaauuauguagcuc

SEQ ID NO: 1267533 - RNA, 23 nt, Human
ccauuucuaauuauguagcucuu

SEQ ID NO: 1267534 - RNA, 17 nt, Human
ccaguauuuaacuucug

SEQ ID NO: 1267535 - RNA, 22 nt, Human
ccaguauuuaacuucugaggaa

SEQ ID NO: 1267536 - RNA, 17 nt, Human
ccaguauuuagaagcca

SEQ ID NO: 1267537 - RNA, 18 nt, Human
ccaguauuuagaagccaa

SEQ ID NO: 1267538 - RNA, 14 nt, Human
ccagucaaccuggg

SEQ ID NO: 1267539 - RNA, 15 nt, Human
ccagggggcaagagg

SEQ ID NO: 1267540 - RNA, 22 nt, Human
ccaggggcucccuccgccccca

SEQ ID NO: 1267541 - RNA, 14 nt, Human
ccagucccccugcc

SEQ ID NO: 1267542 - RNA, 17 nt, Human
ccaguccccccacccuc

SEQ ID NO: 1267543 - RNA, 15 nt, Human
ccaguccccccaccc

SEQ ID NO: 1267544 - RNA, 23 nt, Human
ccagggggagcugggccuggucu

SEQ ID NO: 1267545 - RNA, 14 nt, Human
ccaguauuuuaaaa

SEQ ID NO: 1267546 - RNA, 14 nt, Human
ccagucaggcccag

SEQ ID NO: 1267547 - RNA, 17 nt, Human
ccaggcaacuugggaac

SEQ ID NO: 1267548 - RNA, 12 nt, Human
ccaggcaaggcu

SEQ ID NO: 1267549 - RNA, 22 nt, Human
ccaggauguacaaggacagccc

SEQ ID NO: 1267550 - RNA, 16 nt, Human
ccaggauggcgcagga

SEQ ID NO: 1267551 - RNA, 17 nt, Human
ccaggauggcgcaggaa

SEQ ID NO: 1267552 - RNA, 19 nt, Human
ccaggaguggguggggagu

SEQ ID NO: 1267553 - RNA, 18 nt, Human
ccaggaggugccacugga

SEQ ID NO: 1267554 - RNA, 21 nt, Human
ccaggaggugccacuggagug

SEQ ID NO: 1267555 - RNA, 19 nt, Human
ccaggaggugccacuggag

SEQ ID NO: 1267556 - RNA, 14 nt, Human
ccaggcaaggcugu

SEQ ID NO: 1267557 - RNA, 15 nt, Human
ccaggcaaggcugug

SEQ ID NO: 1267558 - RNA, 16 nt, Human
ccaggcaaggcugugg

SEQ ID NO: 1267559 - RNA, 11 nt, Human
ccaggcuggga

SEQ ID NO: 1267560 - RNA, 15 nt, Human
ccaggggcucccucc

SEQ ID NO: 1267561 - RNA, 16 nt, Human
ccaggggcucccuccg

SEQ ID NO: 1267562 - RNA, 20 nt, Human
ccaggggcugcuuccuccug

SEQ ID NO: 1267563 - RNA, 21 nt, Human
ccaggggcugcuuccuccugg

SEQ ID NO: 1267564 - RNA, 22 nt, Human
ccaggggcugcuuccuccugga

SEQ ID NO: 1267565 - RNA, 23 nt, Human
ccaggggcugcuuccuccuggaa

SEQ ID NO: 1267566 - RNA, 22 nt, Human
ccaggagggacaaaggagccug

SEQ ID NO: 1267567 - RNA, 23 nt, Human
ccaggagggacaaaggagccugu

SEQ ID NO: 1267568 - RNA, 24 nt, Human
ccaggagggacaaaggagccugug

SEQ ID NO: 1267569 - RNA, 15 nt, Human
ccagcuaauuuuugu

SEQ ID NO: 1267570 - RNA, 11 nt, Human
ccagcucagca

SEQ ID NO: 1267571 - RNA, 12 nt, Human
ccagcucagcac

SEQ ID NO: 1267572 - RNA, 15 nt, Human
ccagcucagcacugc

SEQ ID NO: 1267573 - RNA, 13 nt, Human
ccagcucaggaca

SEQ ID NO: 1267574 - RNA, 19 nt, Human
ccagcucaggacagaugcc

SEQ ID NO: 1267575 - RNA, 23 nt, Human
ccagcucaggacagaugccacac

SEQ ID NO: 1267576 - RNA, 20 nt, Human
ccagcucaggacagaugcca

SEQ ID NO: 1267577 - RNA, 19 nt, Human
ccagccccuuagacagagg

SEQ ID NO: 1267578 - RNA, 16 nt, Human
ccagcgucggucugug

SEQ ID NO: 1267579 - RNA, 17 nt, Human
ccagcgucggucugugc

SEQ ID NO: 1267580 - RNA, 19 nt, Human
ccagcgucggucugugccc

SEQ ID NO: 1267581 - RNA, 18 nt, Human
ccagcgucggucugugcc

SEQ ID NO: 1267582 - RNA, 13 nt, Human
ccagcuaagaacc

SEQ ID NO: 1267583 - RNA, 14 nt, Human
ccagcuaagaaccu

SEQ ID NO: 1267584 - RNA, 15 nt, Human
ccagcuaagaaccug

SEQ ID NO: 1267585 - RNA, 17 nt, Human
ccagcuaagaaccugga

SEQ ID NO: 1267586 - RNA, 18 nt, Human
ccagcuaagaaccuggaa

SEQ ID NO: 1267587 - RNA, 19 nt, Human
ccagcuaagaaccuggaac

SEQ ID NO: 1267588 - RNA, 15 nt, Human
ccagcuaaggggugg

SEQ ID NO: 1267589 - RNA, 16 nt, Human
ccagcuaagggguggg

SEQ ID NO: 1267590 - RNA, 18 nt, Human
ccagcuaauaacugaucu

SEQ ID NO: 1267591 - RNA, 13 nt, Human
ccagccccuggcc

SEQ ID NO: 1267592 - RNA, 21 nt, Human
ccagccccuggccccaggacc

SEQ ID NO: 1267593 - RNA, 23 nt, Human
ccagccccuggccccaggaccug

SEQ ID NO: 1267594 - RNA, 19 nt, Human
ccagccccuguagaacuca

SEQ ID NO: 1267595 - RNA, 18 nt, Human
ccagccccuuagacagag

SEQ ID NO: 1267596 - RNA, 18 nt, Human
ccagcuugaaaccuucac

SEQ ID NO: 1267597 - RNA, 20 nt, Human
ccagcuugaaaccuucacuu

SEQ ID NO: 1267598 - RNA, 13 nt, Human
ccagcuuccuuca

SEQ ID NO: 1267599 - RNA, 14 nt, Human
ccagcuuccuucag

SEQ ID NO: 1267600 - RNA, 15 nt, Human
ccagcuuccuucaga

SEQ ID NO: 1267601 - RNA, 23 nt, Human
ccagcuuccuucagagagcagug

SEQ ID NO: 1267602 - RNA, 20 nt, Human
ccagcuuccuucagagagca

SEQ ID NO: 1267603 - RNA, 13 nt, Human
ccagcucagcacu

SEQ ID NO: 1267604 - RNA, 18 nt, Human
ccaggaacagcaaaugca

SEQ ID NO: 1267605 - RNA, 23 nt, Human
ccacucugcucugaugcaucaga

SEQ ID NO: 1267606 - RNA, 23 nt, Human
ccacucuggagcauuucucauca

SEQ ID NO: 1267607 - RNA, 14 nt, Human
ccacucuccuaggc

SEQ ID NO: 1267608 - RNA, 13 nt, Human
ccacucuccuagg

SEQ ID NO: 1267609 - RNA, 13 nt, Human
ccacucugcucug

SEQ ID NO: 1267610 - RNA, 14 nt, Human
ccacucugcucuga

SEQ ID NO: 1267611 - RNA, 15 nt, Human
ccacucugcucugau

SEQ ID NO: 1267612 - RNA, 18 nt, Human
ccacucugcucugaugca

SEQ ID NO: 1267613 - RNA, 13 nt, Human
ccacucugcuucu

SEQ ID NO: 1267614 - RNA, 14 nt, Human
ccacucugcuucuc

SEQ ID NO: 1267615 - RNA, 17 nt, Human
ccacucugcuucucuga

SEQ ID NO: 1267616 - RNA, 19 nt, Human
ccacucugcuucucugacu

SEQ ID NO: 1267617 - RNA, 20 nt, Human
ccacucugcuucucugacuu

SEQ ID NO: 1267618 - RNA, 23 nt, Human
cccaggaaucaguuuaaaagcac

SEQ ID NO: 1267619 - RNA, 22 nt, Human
cccaggaagucucaucugggga

SEQ ID NO: 1267620 - RNA, 21 nt, Human
cccaggacaagcaugguccca

SEQ ID NO: 1267621 - RNA, 16 nt, Human
cccaggacaagcaugg

SEQ ID NO: 1267622 - RNA, 12 nt, Human
cccaggcuggga

SEQ ID NO: 1267623 - RNA, 13 nt, Human
cccaggcugggaa

SEQ ID NO: 1267624 - RNA, 21 nt, Human
cccaggcugggaacucaucug

SEQ ID NO: 1267625 - RNA, 14 nt, Human
cccaggcugggaac

SEQ ID NO: 1267626 - RNA, 22 nt, Human
cccagcugugcuuaugguacca

SEQ ID NO: 1267627 - RNA, 15 nt, Human
cccaggaacugggcc

SEQ ID NO: 1267628 - RNA, 15 nt, Human
cccagcccacccccg

SEQ ID NO: 1267629 - RNA, 13 nt, Human
cccagcccacccc

SEQ ID NO: 1267630 - RNA, 18 nt, Human
cccagcacuuguguuguc

SEQ ID NO: 1267631 - RNA, 21 nt, Human
cccagcacugcuugaggaaaa

SEQ ID NO: 1267632 - RNA, 15 nt, Human
cccagcagcugccag

SEQ ID NO: 1267633 - RNA, 14 nt, Human
cccagcagcugcca

SEQ ID NO: 1267634 - RNA, 19 nt, Human
cccauuuauagauggggga

SEQ ID NO: 1267635 - RNA, 12 nt, Human
cccauuucagcu

SEQ ID NO: 1267636 - RNA, 13 nt, Human
cccauuucagcug

SEQ ID NO: 1267637 - RNA, 14 nt, Human
ccccagcaaagccc

SEQ ID NO: 1267638 - RNA, 22 nt, Human
ccccagcaaagcccccagagcc

SEQ ID NO: 1267639 - RNA, 24 nt, Human
ccccagcaaagcccccagagccca

SEQ ID NO: 1267640 - RNA, 23 nt, Human
cccauaauuuuuuuuuuccuuuu

SEQ ID NO: 1267641 - RNA, 22 nt, Human
cccauaauuuuuuuuuuccuuu

SEQ ID NO: 1267642 - RNA, 23 nt, Human
cccaguuucuaaacuggagacug

SEQ ID NO: 1267643 - RNA, 14 nt, Human
cccagggcuccugc

SEQ ID NO: 1267644 - RNA, 15 nt, Human
cccagggcuccugca

SEQ ID NO: 1267645 - RNA, 13 nt, Human
cccagggcucugu

SEQ ID NO: 1267646 - RNA, 16 nt, Human
cccagggcucuguaag

SEQ ID NO: 1267647 - RNA, 14 nt, Human
cccagggcugggag

SEQ ID NO: 1267648 - RNA, 16 nt, Human
cccagggcugggagga

SEQ ID NO: 1267649 - RNA, 17 nt, Human
cccagggcugggaggaa

SEQ ID NO: 1267650 - RNA, 20 nt, Human
cccagggcugggaggaagga

SEQ ID NO: 1267651 - RNA, 21 nt, Human
cccagggcugggaggaaggac

SEQ ID NO: 1267652 - RNA, 21 nt, Human
cccagggcuguaacugccagg

SEQ ID NO: 1267653 - RNA, 23 nt, Human
cccagggcuguaacugccaggcu

SEQ ID NO: 1267654 - RNA, 19 nt, Human
cccaggggaacacugggga

SEQ ID NO: 1267655 - RNA, 19 nt, Human
cccaguuucuaaacuggag

SEQ ID NO: 1267656 - RNA, 20 nt, Human
cccaguuucuaaacuggaga

SEQ ID NO: 1267657 - RNA, 21 nt, Human
cccaguuucuaaacuggagac

SEQ ID NO: 1267658 - RNA, 22 nt, Human
cccaguuucuaaacuggagacu

SEQ ID NO: 1267659 - RNA, 14 nt, Human
cccucacacuggga

SEQ ID NO: 1267660 - RNA, 13 nt, Human
cccucacacuggg

SEQ ID NO: 1267661 - RNA, 12 nt, Human
cccucacacugg

SEQ ID NO: 1267662 - RNA, 10 nt, Human
cccucacacu

SEQ ID NO: 1267663 - RNA, 15 nt, Human
cccucacacacccug

SEQ ID NO: 1267664 - RNA, 23 nt, Human
cccucaagucuuucucuuucccu

SEQ ID NO: 1267665 - RNA, 14 nt, Human
cccucacacacccu

SEQ ID NO: 1267666 - RNA, 21 nt, Human
cccuaucuuugccacccucau

SEQ ID NO: 1267667 - RNA, 14 nt, Human
cccuaucuguauuc

SEQ ID NO: 1267668 - RNA, 19 nt, Human
cccuaucuuugccacccuc

SEQ ID NO: 1267669 - RNA, 16 nt, Human
cccuaucuuugccacc

SEQ ID NO: 1267670 - RNA, 14 nt, Human
cccuaucuuugcca

SEQ ID NO: 1267671 - RNA, 12 nt, Human
cccggcugcccu

SEQ ID NO: 1267672 - RNA, 13 nt, Human
cccggcugcccuu

SEQ ID NO: 1267673 - RNA, 18 nt, Human
ccccuucuccccugcacu

SEQ ID NO: 1267674 - RNA, 14 nt, Human
ccccuucugcucag

SEQ ID NO: 1267675 - RNA, 19 nt, Human
ccccuucugcucagcucug

SEQ ID NO: 1267676 - RNA, 20 nt, Human
ccccuucugcucagcucugg

SEQ ID NO: 1267677 - RNA, 21 nt, Human
ccccuucugcucagcucuggg

SEQ ID NO: 1267678 - RNA, 18 nt, Human
ccccuugacaacuggcag

SEQ ID NO: 1267679 - RNA, 23 nt, Human
ccccuugacaacuggcaggcagg

SEQ ID NO: 1267680 - RNA, 19 nt, Human
ccccuugaggucucagccc

SEQ ID NO: 1267681 - RNA, 22 nt, Human
ccccuugaggucucagccccuu

SEQ ID NO: 1267682 - RNA, 13 nt, Human
cccucagagccac

SEQ ID NO: 1267683 - RNA, 15 nt, Human
cccucagacuggggc

SEQ ID NO: 1267684 - RNA, 16 nt, Human
cccucagacuggggca

SEQ ID NO: 1267685 - RNA, 19 nt, Human
cccucacuggcucuccugg

SEQ ID NO: 1267686 - RNA, 20 nt, Human
cccucacuggcucuccuggc

SEQ ID NO: 1267687 - RNA, 18 nt, Human
ccccugcaggaaggagcu

SEQ ID NO: 1267688 - RNA, 19 nt, Human
ccccugcaggaaggagcug

SEQ ID NO: 1267689 - RNA, 20 nt, Human
ccccugcaggaaggagcugc

SEQ ID NO: 1267690 - RNA, 21 nt, Human
ccccugcaggaaggagcugcc

SEQ ID NO: 1267691 - RNA, 23 nt, Human
ccccugcaggaaggagcugccug

SEQ ID NO: 1267692 - RNA, 22 nt, Human
ccccugcaggaaggagcugccu

SEQ ID NO: 1267693 - RNA, 21 nt, Human
ccccugcauuggaacuggagg

SEQ ID NO: 1267694 - RNA, 22 nt, Human
ccccugcauuggaacuggaggc

SEQ ID NO: 1267695 - RNA, 18 nt, Human
ccccuucuauuuggggcu

SEQ ID NO: 1267696 - RNA, 12 nt, Human
ccccuucucccc

SEQ ID NO: 1267697 - RNA, 19 nt, Human
ccccuucuccccugcacug

SEQ ID NO: 1267698 - RNA, 18 nt, Human
ccccugcacuccagccug

SEQ ID NO: 1267699 - RNA, 16 nt, Human
ccccugcaaagcccag

SEQ ID NO: 1267700 - RNA, 17 nt, Human
ccccugcaaagcccagc

SEQ ID NO: 1267701 - RNA, 11 nt, Human
ccccugcacug

SEQ ID NO: 1267702 - RNA, 18 nt, Human
ccccugcacuguaaaaug

SEQ ID NO: 1267703 - RNA, 14 nt, Human
ccccugcacuguaa

SEQ ID NO: 1267704 - RNA, 16 nt, Human
ccccugcacuguaaaa

SEQ ID NO: 1267705 - RNA, 17 nt, Human
ccccugcacuguaaaau

SEQ ID NO: 1267706 - RNA, 22 nt, Human
ccccugcagcuuguagccagcc

SEQ ID NO: 1267707 - RNA, 23 nt, Human
ccccugcagcuuguagccagccg

SEQ ID NO: 1267708 - RNA, 14 nt, Human
ccccugcaggaagg

SEQ ID NO: 1267709 - RNA, 15 nt, Human
ccccugcaggaagga

SEQ ID NO: 1267710 - RNA, 15 nt, Human
ccccugcaaagccca

SEQ ID NO: 1267711 - RNA, 20 nt, Human
ccccugaccugugagcccag

SEQ ID NO: 1267712 - RNA, 20 nt, Human
ccccugaccacucagagaca

SEQ ID NO: 1267713 - RNA, 18 nt, Human
ccccugaccacucagaga

SEQ ID NO: 1267714 - RNA, 22 nt, Human
ccccugaccacucagagacaug

SEQ ID NO: 1267715 - RNA, 15 nt, Human
ccccugaccugugag

SEQ ID NO: 1267716 - RNA, 16 nt, Human
ccccauucccgcagug

SEQ ID NO: 1267717 - RNA, 12 nt, Human
ccccaucuugcu

SEQ ID NO: 1267718 - RNA, 14 nt, Human
ccccaucuugcuuc

SEQ ID NO: 1267719 - RNA, 13 nt, Human
ccccaugaccucc

SEQ ID NO: 1267720 - RNA, 16 nt, Human
ccccaugaccuccagc

SEQ ID NO: 1267721 - RNA, 15 nt, Human
ccccaugaccuccag

SEQ ID NO: 1267722 - RNA, 13 nt, Human
ccccaugcacugu

SEQ ID NO: 1267723 - RNA, 19 nt, Human
ccccaugcacugugaagga

SEQ ID NO: 1267724 - RNA, 23 nt, Human
ccccaugcacugugaaggacccu

SEQ ID NO: 1267725 - RNA, 23 nt, Human
ccccauuccugggaaauauuccc

SEQ ID NO: 1267726 - RNA, 23 nt, Human
ccucauggaauuggagcucgugg

SEQ ID NO: 1267727 - RNA, 16 nt, Human
ccucaggacugggagc

SEQ ID NO: 1267728 - RNA, 15 nt, Human
ccucauggccccucu

SEQ ID NO: 1267729 - RNA, 16 nt, Human
ccucauggccccucug

SEQ ID NO: 1267730 - RNA, 17 nt, Human
ccucaggacugggagcc

SEQ ID NO: 1267731 - RNA, 14 nt, Human
ccucaggacuggga

SEQ ID NO: 1267732 - RNA, 15 nt, Human
ccucaggacugggag

SEQ ID NO: 1267733 - RNA, 17 nt, Human
ccucagccuugccagag

SEQ ID NO: 1267734 - RNA, 18 nt, Human
ccucagccuugccagaga

SEQ ID NO: 1267735 - RNA, 19 nt, Human
ccucagccuugccagagau

SEQ ID NO: 1267736 - RNA, 20 nt, Human
ccucagccuugccagagauc

SEQ ID NO: 1267737 - RNA, 21 nt, Human
ccucagccuugccagagaucc

SEQ ID NO: 1267738 - RNA, 13 nt, Human
ccucaggacuggg

SEQ ID NO: 1267739 - RNA, 20 nt, Human
ccucaaaaagauuuccccau

SEQ ID NO: 1267740 - RNA, 14 nt, Human
ccucaaaacaaagg

SEQ ID NO: 1267741 - RNA, 23 nt, Human
ccucaaaauuuaacaguuaccug

SEQ ID NO: 1267742 - RNA, 14 nt, Human
ccucaaagaaagug

SEQ ID NO: 1267743 - RNA, 16 nt, Human
ccucaaagaaagugua

SEQ ID NO: 1267744 - RNA, 21 nt, Human
ccucaaagcaagcauucagaa

SEQ ID NO: 1267745 - RNA, 16 nt, Human
ccucaaaggcccgcuc

SEQ ID NO: 1267746 - RNA, 20 nt, Human
ccucagccuggccagacaca

SEQ ID NO: 1267747 - RNA, 21 nt, Human
ccucagccuggccagacacag

SEQ ID NO: 1267748 - RNA, 22 nt, Human
ccucagccuggccagacacagg

SEQ ID NO: 1267749 - RNA, 12 nt, Human
ccucagccuggg

SEQ ID NO: 1267750 - RNA, 13 nt, Human
ccucagccugggc

SEQ ID NO: 1267751 - RNA, 14 nt, Human
ccucagccugggcg

SEQ ID NO: 1267752 - RNA, 16 nt, Human
ccucagccugggcgcu

SEQ ID NO: 1267753 - RNA, 17 nt, Human
ccucagccugggcgcug

SEQ ID NO: 1267754 - RNA, 20 nt, Human
ccucagccugggcgcugguc

SEQ ID NO: 1267755 - RNA, 21 nt, Human
ccucagccugggcgcuggucc

SEQ ID NO: 1267756 - RNA, 12 nt, Human
ccucagccuuaa

SEQ ID NO: 1267757 - RNA, 18 nt, Human
ccucccauguucaagcga

SEQ ID NO: 1267758 - RNA, 18 nt, Human
ccuccaacccuagcaaaa

SEQ ID NO: 1267759 - RNA, 19 nt, Human
ccuccaacaccaagcacag

SEQ ID NO: 1267760 - RNA, 18 nt, Human
ccucauuuuuuuccuugc

SEQ ID NO: 1267761 - RNA, 17 nt, Human
ccuccaaaaugugccua

SEQ ID NO: 1267762 - RNA, 19 nt, Human
ccuccaaagcuucccacgg

SEQ ID NO: 1267763 - RNA, 22 nt, Human
ccuccaaaaugugccuauugcu

SEQ ID NO: 1267764 - RNA, 15 nt, Human
ccucauguccacugg

SEQ ID NO: 1267765 - RNA, 23 nt, Human
ccucauuuuugaauacaggcaua

SEQ ID NO: 1267766 - RNA, 18 nt, Human
ccucauggccccucugac

SEQ ID NO: 1267767 - RNA, 22 nt, Human
ccucauggccccucugaccugc

SEQ ID NO: 1267768 - RNA, 21 nt, Human
ccucauguacauacccuggcc

SEQ ID NO: 1267769 - RNA, 19 nt, Human
ccuccaacccuagcaaaag

SEQ ID NO: 1267770 - RNA, 17 nt, Human
ccggccccucccccuga

SEQ ID NO: 1267771 - RNA, 14 nt, Human
ccggccugccagga

SEQ ID NO: 1267772 - RNA, 15 nt, Human
ccggccugccaggag

SEQ ID NO: 1267773 - RNA, 18 nt, Human
ccggccugccaggaggac

SEQ ID NO: 1267774 - RNA, 16 nt, Human
ccggccugccaggagg

SEQ ID NO: 1267775 - RNA, 21 nt, Human
cccugucucucagggccaggc

SEQ ID NO: 1267776 - RNA, 22 nt, Human
cccugucucucagggccaggcc

SEQ ID NO: 1267777 - RNA, 18 nt, Human
ccggccccaguacacagg

SEQ ID NO: 1267778 - RNA, 16 nt, Human
ccgcagugggagcaaa

SEQ ID NO: 1267779 - RNA, 17 nt, Human
ccgcagugggagcaaac

SEQ ID NO: 1267780 - RNA, 22 nt, Human
ccugucuuauccuccaccgucu

SEQ ID NO: 1267781 - RNA, 22 nt, Human
ccugucugucugucugucccaa

SEQ ID NO: 1267782 - RNA, 17 nt, Human
ccugucuuauccuccac

SEQ ID NO: 1267783 - RNA, 19 nt, Human
ccugucuucagagaaccca

SEQ ID NO: 1267784 - RNA, 21 nt, Human
ccugucugucugucuguccca

SEQ ID NO: 1267785 - RNA, 20 nt, Human
ccugucugucugucuguccc

SEQ ID NO: 1267786 - RNA, 22 nt, Human
ccugucgauuagacuggacagc

SEQ ID NO: 1267787 - RNA, 15 nt, Human
ccugucucaccugga

SEQ ID NO: 1267788 - RNA, 21 nt, Human
ccugucucucagggccaggcc

SEQ ID NO: 1267789 - RNA, 18 nt, Human
ccugugacuucagcucug

SEQ ID NO: 1267790 - RNA, 15 nt, Human
ccugugaccacaaca

SEQ ID NO: 1267791 - RNA, 18 nt, Human
ccugugaccacaacauga

SEQ ID NO: 1267792 - RNA, 19 nt, Human
ccugugaccacaacaugag

SEQ ID NO: 1267793 - RNA, 16 nt, Human
ccugugaacugaacuc

SEQ ID NO: 1267794 - RNA, 17 nt, Human
ccugugaacugaacucu

SEQ ID NO: 1267795 - RNA, 14 nt, Human
ccugugaacccagg

SEQ ID NO: 1267796 - RNA, 15 nt, Human
ccugugaacccagga

SEQ ID NO: 1267797 - RNA, 16 nt, Human
ccugugaacccaggac

SEQ ID NO: 1267798 - RNA, 17 nt, Human
ccugugaacccaggaca

SEQ ID NO: 1267799 - RNA, 18 nt, Human
ccugugaacccaggacaa

SEQ ID NO: 1267800 - RNA, 16 nt, Human
ccugugaaugccacug

SEQ ID NO: 1267801 - RNA, 17 nt, Human
ccugugaaugccacugc

SEQ ID NO: 1267802 - RNA, 19 nt, Human
ccugugaaugccacugccu

SEQ ID NO: 1267803 - RNA, 21 nt, Human
ccugugaaugccacugccuuc

SEQ ID NO: 1267804 - RNA, 22 nt, Human
ccugugaaugccacugccuucg

SEQ ID NO: 1267805 - RNA, 23 nt, Human
ccugggggccuggcuggcugagg

SEQ ID NO: 1267806 - RNA, 12 nt, Human
ccugggggccug

SEQ ID NO: 1267807 - RNA, 13 nt, Human
ccugggggccugg

SEQ ID NO: 1267808 - RNA, 14 nt, Human
ccugggggccuggc

SEQ ID NO: 1267809 - RNA, 15 nt, Human
ccugggggccuggcu

SEQ ID NO: 1267810 - RNA, 17 nt, Human
ccugggggccuggcugg

SEQ ID NO: 1267811 - RNA, 19 nt, Human
ccugggggccuggcuggcu

SEQ ID NO: 1267812 - RNA, 13 nt, Human
ccuggggccugua

SEQ ID NO: 1267813 - RNA, 14 nt, Human
ccuggggccuguac

SEQ ID NO: 1267814 - RNA, 16 nt, Human
ccuggggccuguacug

SEQ ID NO: 1267815 - RNA, 18 nt, Human
ccuggggccuguacugcc

SEQ ID NO: 1267816 - RNA, 19 nt, Human
ccuggggccuguacugccu

SEQ ID NO: 1267817 - RNA, 20 nt, Human
ccuggggccuguacugccug

SEQ ID NO: 1267818 - RNA, 21 nt, Human
ccuggggccuguacugccugc

SEQ ID NO: 1267819 - RNA, 23 nt, Human
ccuggggccuguacugccugcuu

SEQ ID NO: 1267820 - RNA, 22 nt, Human
ccuggggccuguacugccugcu

SEQ ID NO: 1267821 - RNA, 15 nt, Human
ccugggcccucucug

SEQ ID NO: 1267822 - RNA, 18 nt, Human
ccugggcccucucugcuc

SEQ ID NO: 1267823 - RNA, 14 nt, Human
ccugggcccugggc

SEQ ID NO: 1267824 - RNA, 15 nt, Human
ccugggcccugggcu

SEQ ID NO: 1267825 - RNA, 16 nt, Human
ccugggcccugggcug

SEQ ID NO: 1267826 - RNA, 18 nt, Human
ccugggcccugggcugga

SEQ ID NO: 1267827 - RNA, 19 nt, Human
ccugggcccugggcuggaa

SEQ ID NO: 1267828 - RNA, 14 nt, Human
ccugggcccugggg

SEQ ID NO: 1267829 - RNA, 15 nt, Human
ccugggcccuggggc

SEQ ID NO: 1267830 - RNA, 16 nt, Human
ccugggcccuggggcc

SEQ ID NO: 1267831 - RNA, 17 nt, Human
ccugggcccuggggccu

SEQ ID NO: 1267832 - RNA, 18 nt, Human
ccugggcccuggggccug

SEQ ID NO: 1267833 - RNA, 20 nt, Human
ccugggcccuggggccugua

SEQ ID NO: 1267834 - RNA, 21 nt, Human
ccugggcccuggggccuguac

SEQ ID NO: 1267835 - RNA, 22 nt, Human
ccugggcccuggggccuguacu

SEQ ID NO: 1267836 - RNA, 13 nt, Human
ccugggccgcugc

SEQ ID NO: 1267837 - RNA, 16 nt, Human
ccugggccgcugccac

SEQ ID NO: 1267838 - RNA, 17 nt, Human
ccugggccgcugccacg

SEQ ID NO: 1267839 - RNA, 17 nt, Human
ccugggccuauggagag

SEQ ID NO: 1267840 - RNA, 18 nt, Human
ccugggccuauggagagc

SEQ ID NO: 1267841 - RNA, 19 nt, Human
ccugggccuauggagagcc

SEQ ID NO: 1267842 - RNA, 20 nt, Human
ccugggccuauggagagccc

SEQ ID NO: 1267843 - RNA, 21 nt, Human
ccugggccuauggagagcccu

SEQ ID NO: 1267844 - RNA, 22 nt, Human
ccugggccuauggagagcccug

SEQ ID NO: 1267845 - RNA, 12 nt, Human
ccugggccugca

SEQ ID NO: 1267846 - RNA, 23 nt, Human
ccugggccuauggagagcccugg

SEQ ID NO: 1267847 - RNA, 13 nt, Human
ccugggccugccu

SEQ ID NO: 1267848 - RNA, 15 nt, Human
ccugggccugccuca

SEQ ID NO: 1267849 - RNA, 13 nt, Human
ccugggccugcug

SEQ ID NO: 1267850 - RNA, 14 nt, Human
ccugggccugcugc

SEQ ID NO: 1267851 - RNA, 15 nt, Human
ccugggccugcugcu

SEQ ID NO: 1267852 - RNA, 16 nt, Human
ccugggccugcugcug

SEQ ID NO: 1267853 - RNA, 17 nt, Human
ccugggccugcugcuga

SEQ ID NO: 1267854 - RNA, 18 nt, Human
ccugggccugcugcugag

SEQ ID NO: 1267855 - RNA, 19 nt, Human
ccugggccugcugcugaga

SEQ ID NO: 1267856 - RNA, 20 nt, Human
ccugggccugcugcugagaa

SEQ ID NO: 1267857 - RNA, 13 nt, Human
ccugggccuuggg

SEQ ID NO: 1267858 - RNA, 17 nt, Human
ccugggccuugggcucc

SEQ ID NO: 1267859 - RNA, 15 nt, Human
ccuguaaucacagcu

SEQ ID NO: 1267860 - RNA, 20 nt, Human
ccuguaaucauauaauaaau

SEQ ID NO: 1267861 - RNA, 17 nt, Human
ccuguccugccuaaggc

SEQ ID NO: 1267862 - RNA, 11 nt, Human
ccuguccugcc

SEQ ID NO: 1267863 - RNA, 21 nt, Human
ccuguccucuuucagcuccug

SEQ ID NO: 1267864 - RNA, 22 nt, Human
ccuguccucuuucagcuccuga

SEQ ID NO: 1267865 - RNA, 19 nt, Human
ccuguccugccuaaggcug

SEQ ID NO: 1267866 - RNA, 12 nt, Human
ccuguccugccu

SEQ ID NO: 1267867 - RNA, 19 nt, Human
ccuguccuuagccuaggcc

SEQ ID NO: 1267868 - RNA, 15 nt, Human
ccuguccugguggua

SEQ ID NO: 1267869 - RNA, 21 nt, Human
ccuguccuuuaccaaagauga

SEQ ID NO: 1267870 - RNA, 16 nt, Human
ccugucgauuagacug

SEQ ID NO: 1267871 - RNA, 13 nt, Human
ccugguuuccugc

SEQ ID NO: 1267872 - RNA, 14 nt, Human
ccugguuuccugcc

SEQ ID NO: 1267873 - RNA, 16 nt, Human
ccugguuuccugcccu

SEQ ID NO: 1267874 - RNA, 15 nt, Human
ccugguuuccugccc

SEQ ID NO: 1267875 - RNA, 14 nt, Human
ccugguggccaugc

SEQ ID NO: 1267876 - RNA, 16 nt, Human
ccugguggccaugcuc

SEQ ID NO: 1267877 - RNA, 18 nt, Human
ccugguggccaugcuccu

SEQ ID NO: 1267878 - RNA, 20 nt, Human
ccugguggccaugcuccucu

SEQ ID NO: 1267879 - RNA, 24 nt, Human
ccugguggccaugcuccucuuccc

SEQ ID NO: 1267880 - RNA, 12 nt, Human
ccugguggcccu

SEQ ID NO: 1267881 - RNA, 16 nt, Human
ccugguggcccucucc

SEQ ID NO: 1267882 - RNA, 18 nt, Human
ccugguggcccucucccc

SEQ ID NO: 1267883 - RNA, 21 nt, Human
ccugguggcccucuccccugc

SEQ ID NO: 1267884 - RNA, 22 nt, Human
ccugguggcccucuccccugcc

SEQ ID NO: 1267885 - RNA, 23 nt, Human
ccugguggcccucuccccugccc

SEQ ID NO: 1267886 - RNA, 14 nt, Human
ccuggugggccaac

SEQ ID NO: 1267887 - RNA, 23 nt, Human
ccuggugggccaacaaagaacac

SEQ ID NO: 1267888 - RNA, 13 nt, Human
ccugguggggcag

SEQ ID NO: 1267889 - RNA, 16 nt, Human
ccuggccuagaccagc

SEQ ID NO: 1267890 - RNA, 17 nt, Human
ccuggccuagaccagca

SEQ ID NO: 1267891 - RNA, 20 nt, Human
ccuggccuagaccagcagac

SEQ ID NO: 1267892 - RNA, 20 nt, Human
ccugggccccaguuguauuu

SEQ ID NO: 1267893 - RNA, 11 nt, Human
ccugggcccuc

SEQ ID NO: 1267894 - RNA, 14 nt, Human
ccugggcccucucu

SEQ ID NO: 1267895 - RNA, 21 nt, Human
ccuggccgcccccugcccccc

SEQ ID NO: 1267896 - RNA, 22 nt, Human
ccuggccgcccccugcccccca

SEQ ID NO: 1267897 - RNA, 16 nt, Human
ccuggccgccuggguc

SEQ ID NO: 1267898 - RNA, 18 nt, Human
ccuggccgccugggucca

SEQ ID NO: 1267899 - RNA, 16 nt, Human
ccugccucccuucaug

SEQ ID NO: 1267900 - RNA, 11 nt, Human
ccugccuccug

SEQ ID NO: 1267901 - RNA, 16 nt, Human
ccugccuccccugccu

SEQ ID NO: 1267902 - RNA, 12 nt, Human
ccugccucuacu

SEQ ID NO: 1267903 - RNA, 20 nt, Human
ccugccucucaucaacugaa

SEQ ID NO: 1267904 - RNA, 21 nt, Human
ccugccucuacugggaaggcu

SEQ ID NO: 1267905 - RNA, 12 nt, Human
ccugcugcuccc

SEQ ID NO: 1267906 - RNA, 13 nt, Human
ccugcugcucccu

SEQ ID NO: 1267907 - RNA, 14 nt, Human
ccugcugcucccuc

SEQ ID NO: 1267908 - RNA, 21 nt, Human
ccugcugcugagaaccuggcc

SEQ ID NO: 1267909 - RNA, 22 nt, Human
ccugcugcugagaaccuggccu

SEQ ID NO: 1267910 - RNA, 23 nt, Human
ccugcugcugagaaccuggccuu

SEQ ID NO: 1267911 - RNA, 24 nt, Human
ccugcugcugagaaccuggccuuc

SEQ ID NO: 1267912 - RNA, 15 nt, Human
ccugcugcucccuca

SEQ ID NO: 1267913 - RNA, 16 nt, Human
ccugcugcucccucag

SEQ ID NO: 1267914 - RNA, 18 nt, Human
ccugcugcucccucagac

SEQ ID NO: 1267915 - RNA, 17 nt, Human
ccugcugcucccucaga

SEQ ID NO: 1267916 - RNA, 14 nt, Human
ccugcugcugagaa

SEQ ID NO: 1267917 - RNA, 15 nt, Human
ccugcugcugagaac

SEQ ID NO: 1267918 - RNA, 16 nt, Human
ccugcugcugagaacc

SEQ ID NO: 1267919 - RNA, 17 nt, Human
ccugcugcugagaaccu

SEQ ID NO: 1267920 - RNA, 19 nt, Human
ccugcugcugagaaccugg

SEQ ID NO: 1267921 - RNA, 20 nt, Human
ccugcugcugagaaccuggc

SEQ ID NO: 1267922 - RNA, 24 nt, Human
ccugccccaacucuccccugaccu

SEQ ID NO: 1267923 - RNA, 17 nt, Human
ccugccccagggcuccc

SEQ ID NO: 1267924 - RNA, 16 nt, Human
ccugccccaggccuga

SEQ ID NO: 1267925 - RNA, 18 nt, Human
ccugccccaggccugaaa

SEQ ID NO: 1267926 - RNA, 14 nt, Human
ccugccccaggccu

SEQ ID NO: 1267927 - RNA, 15 nt, Human
ccugcccccaaucca

SEQ ID NO: 1267928 - RNA, 16 nt, Human
ccugcccccaauccau

SEQ ID NO: 1267929 - RNA, 16 nt, Human
ccugagucccaucccu

SEQ ID NO: 1267930 - RNA, 19 nt, Human
ccugagucguacagaaagc

SEQ ID NO: 1267931 - RNA, 21 nt, Human
ccugagucguacagaaagcug

SEQ ID NO: 1267932 - RNA, 22 nt, Human
ccugagucguacagaaagcugc

SEQ ID NO: 1267933 - RNA, 11 nt, Human
ccugaguccca

SEQ ID NO: 1267934 - RNA, 23 nt, Human
ccugagucacccuaccugugccu

SEQ ID NO: 1267935 - RNA, 18 nt, Human
ccugagucgugaccugcu

SEQ ID NO: 1267936 - RNA, 21 nt, Human
ccugagucgugaccugcuagg

SEQ ID NO: 1267937 - RNA, 22 nt, Human
ccugagucgugaccugcuaggc

SEQ ID NO: 1267938 - RNA, 14 nt, Human
ccucuuucagcucc

SEQ ID NO: 1267939 - RNA, 15 nt, Human
ccucuuucagcuccu

SEQ ID NO: 1267940 - RNA, 18 nt, Human
ccucuuucagcuccugac

SEQ ID NO: 1267941 - RNA, 16 nt, Human
ccucuuucagcuccug

SEQ ID NO: 1267942 - RNA, 13 nt, Human
ccugaccacucag

SEQ ID NO: 1267943 - RNA, 21 nt, Human
ccugaguagcugggauuacag

SEQ ID NO: 1267944 - RNA, 21 nt, Human
ccugaccaguugcagucacuc

SEQ ID NO: 1267945 - RNA, 15 nt, Human
ccugaccacucagag

SEQ ID NO: 1267946 - RNA, 16 nt, Human
ccugaccacucagaga

SEQ ID NO: 1267947 - RNA, 17 nt, Human
ccugaccacucagagac

SEQ ID NO: 1267948 - RNA, 18 nt, Human
ccugaccacucagagaca

SEQ ID NO: 1267949 - RNA, 20 nt, Human
ccugaccacucagagacaug

SEQ ID NO: 1267950 - RNA, 14 nt, Human
ccugaccagcuccc

SEQ ID NO: 1267951 - RNA, 14 nt, Human
ccugaccagcugcu

SEQ ID NO: 1267952 - RNA, 15 nt, Human
ccugaccagcugcuc

SEQ ID NO: 1267953 - RNA, 20 nt, Human
ccugaccagcugcuccgagg

SEQ ID NO: 1267954 - RNA, 21 nt, Human
ccugaccagcugcuccgagga

SEQ ID NO: 1267955 - RNA, 22 nt, Human
ccugaccagcugcuccgaggac

SEQ ID NO: 1267956 - RNA, 12 nt, Human
ccugaccaguug

SEQ ID NO: 1267957 - RNA, 13 nt, Human
ccugaccaguugc

SEQ ID NO: 1267958 - RNA, 20 nt, Human
ccugaccaguugcagucacu

SEQ ID NO: 1267959 - RNA, 23 nt, Human
ccugaccaguugcagucacucua

SEQ ID NO: 1267960 - RNA, 23 nt, Human
ccucuuucaagcagucgugccug

SEQ ID NO: 1267961 - RNA, 12 nt, Human
ccucuuucagcu

SEQ ID NO: 1267962 - RNA, 13 nt, Human
ccucuuucagcuc

SEQ ID NO: 1267963 - RNA, 14 nt, Human
cuaauucuaaugug

SEQ ID NO: 1267964 - RNA, 17 nt, Human
cuaauaaaaagcuuuug

SEQ ID NO: 1267965 - RNA, 18 nt, Human
cuaauaaaaagcuuuugu

SEQ ID NO: 1267966 - RNA, 20 nt, Human
cuaauaaaaagcuuuugucu

SEQ ID NO: 1267967 - RNA, 22 nt, Human
cuaauaaaaagcuuuugucuac

SEQ ID NO: 1267968 - RNA, 17 nt, Human
cuaaguuauaagacucu

SEQ ID NO: 1267969 - RNA, 21 nt, Human
cuaaguuauaagacucucaca

SEQ ID NO: 1267970 - RNA, 15 nt, Human
cuaauucuaugccug

SEQ ID NO: 1267971 - RNA, 16 nt, Human
cuaauucuauuaaagu

SEQ ID NO: 1267972 - RNA, 20 nt, Human
cuaauucuauuaaagugcua

SEQ ID NO: 1267973 - RNA, 15 nt, Human
cuaauucuuccuuug

SEQ ID NO: 1267974 - RNA, 18 nt, Human
cuaauucuuccuuuguaa

SEQ ID NO: 1267975 - RNA, 13 nt, Human
cuaauugccaugu

SEQ ID NO: 1267976 - RNA, 13 nt, Human
cuaauuuauaaaa

SEQ ID NO: 1267977 - RNA, 14 nt, Human
cuaauuuauaaaaa

SEQ ID NO: 1267978 - RNA, 14 nt, Human
cuaaguaaauacaa

SEQ ID NO: 1267979 - RNA, 15 nt, Human
cuaaguaaauacaau

SEQ ID NO: 1267980 - RNA, 16 nt, Human
cuaaguaaauacaauu

SEQ ID NO: 1267981 - RNA, 17 nt, Human
cuaaguaaauacaauuu

SEQ ID NO: 1267982 - RNA, 18 nt, Human
cuaaguaaauacaauuuu

SEQ ID NO: 1267983 - RNA, 19 nt, Human
cuaaguaaauacaauuuuu

SEQ ID NO: 1267984 - RNA, 17 nt, Human
cuaaguaaauaggaauu

SEQ ID NO: 1267985 - RNA, 17 nt, Human
cuaaguguuucauaaau

SEQ ID NO: 1267986 - RNA, 15 nt, Human
cuaaguuaauuuaaa

SEQ ID NO: 1267987 - RNA, 17 nt, Human
cuaaguuaauuuaaagu

SEQ ID NO: 1267988 - RNA, 21 nt, Human
cuaaguuaauuuaaaguuguu

SEQ ID NO: 1267989 - RNA, 11 nt, Human
cgugugugugu

SEQ ID NO: 1267990 - RNA, 23 nt, Human
cgugugggagaccggccugccag

SEQ ID NO: 1267991 - RNA, 21 nt, Human
cuaccuguugagcaucacaga

SEQ ID NO: 1267992 - RNA, 12 nt, Human
cuaccugugccu

SEQ ID NO: 1267993 - RNA, 13 nt, Human
cuaccugugccug

SEQ ID NO: 1267994 - RNA, 11 nt, Human
cuaccugugug

SEQ ID NO: 1267995 - RNA, 17 nt, Human
cuaccuguguggacagg

SEQ ID NO: 1267996 - RNA, 22 nt, Human
cuaccuguugagcaucacagaa

SEQ ID NO: 1267997 - RNA, 17 nt, Human
cuacguuaccaggcagg

SEQ ID NO: 1267998 - RNA, 16 nt, Human
cuacgcuguccagaaa

SEQ ID NO: 1267999 - RNA, 14 nt, Human
cuacguauuuaaua

SEQ ID NO: 1268000 - RNA, 14 nt, Human
cuacucacuuuucc

SEQ ID NO: 1268001 - RNA, 15 nt, Human
cuacucacuuuuccc

SEQ ID NO: 1268002 - RNA, 19 nt, Human
cuacucacuuuucccacuc

SEQ ID NO: 1268003 - RNA, 21 nt, Human
cuacucacuuuucccacucca

SEQ ID NO: 1268004 - RNA, 20 nt, Human
cuacaugagguacugagagu

SEQ ID NO: 1268005 - RNA, 14 nt, Human
cuacaugaaacaga

SEQ ID NO: 1268006 - RNA, 16 nt, Human
cuacauaugaucuguc

SEQ ID NO: 1268007 - RNA, 14 nt, Human
cuacaucuucugcc

SEQ ID NO: 1268008 - RNA, 15 nt, Human
cuacaucuucugccu

SEQ ID NO: 1268009 - RNA, 16 nt, Human
cuacaucuucugccuu

SEQ ID NO: 1268010 - RNA, 10 nt, Human
cuacaugaaa

SEQ ID NO: 1268011 - RNA, 13 nt, Human
cuacaugaaacag

SEQ ID NO: 1268012 - RNA, 22 nt, Human
cuacaugaucuagagccaguua

SEQ ID NO: 1268013 - RNA, 21 nt, Human
cuaccugccccacuuguccuu

SEQ ID NO: 1268014 - RNA, 19 nt, Human
cuaccugcucagcccugca

SEQ ID NO: 1268015 - RNA, 16 nt, Human
cuaccuggucucuccu

SEQ ID NO: 1268016 - RNA, 17 nt, Human
cuaauuuauaaaaaggu

SEQ ID NO: 1268017 - RNA, 21 nt, Human
cuaauuuauccugaaauuuca

SEQ ID NO: 1268018 - RNA, 23 nt, Human
cuaauuuauccugaaauuucaga

SEQ ID NO: 1268019 - RNA, 17 nt, Human
cuaauuucaaaaugcuu

SEQ ID NO: 1268020 - RNA, 18 nt, Human
cuaauuucaaaaugcuuu

SEQ ID NO: 1268021 - RNA, 19 nt, Human
cuaauuucaaaaugcuuuu

SEQ ID NO: 1268022 - RNA, 22 nt, Human
cuaauuucaaaaugcuuuuuau

SEQ ID NO: 1268023 - RNA, 16 nt, Human
cuacagucucgucucu

SEQ ID NO: 1268024 - RNA, 15 nt, Human
cuacaguuuuaacug

SEQ ID NO: 1268025 - RNA, 23 nt, Human
cuagaauuugauaugugaacagu

SEQ ID NO: 1268026 - RNA, 14 nt, Human
cuagaauuucuuua

SEQ ID NO: 1268027 - RNA, 21 nt, Human
cuagaauuugauuauuaacau

SEQ ID NO: 1268028 - RNA, 13 nt, Human
cuagacaagccag

SEQ ID NO: 1268029 - RNA, 14 nt, Human
cuagacaagccaga

SEQ ID NO: 1268030 - RNA, 16 nt, Human
cuagacaagccagaac

SEQ ID NO: 1268031 - RNA, 17 nt, Human
cuagacaagccagaacu

SEQ ID NO: 1268032 - RNA, 14 nt, Human
cuagacacaugaag

SEQ ID NO: 1268033 - RNA, 13 nt, Human
cuagaacucccuu

SEQ ID NO: 1268034 - RNA, 12 nt, Human
cuagaacucccu

SEQ ID NO: 1268035 - RNA, 14 nt, Human
cuagaacccucugu

SEQ ID NO: 1268036 - RNA, 11 nt, Human
cuacucagcau

SEQ ID NO: 1268037 - RNA, 18 nt, Human
cuaucguaaaauuaagaa

SEQ ID NO: 1268038 - RNA, 20 nt, Human
cuauccaaucaaucuugcau

SEQ ID NO: 1268039 - RNA, 23 nt, Human
cuauccaaucaaucuugcaugua

SEQ ID NO: 1268040 - RNA, 19 nt, Human
cuaucauugcuuccuccuc

SEQ ID NO: 1268041 - RNA, 20 nt, Human
cuaucauugcuuccuccucc

SEQ ID NO: 1268042 - RNA, 20 nt, Human
cuaucguucucucuuugcau

SEQ ID NO: 1268043 - RNA, 18 nt, Human
cuaucauugcuuccuccu

SEQ ID NO: 1268044 - RNA, 20 nt, Human
cuaguuuucuccucccagga

SEQ ID NO: 1268045 - RNA, 18 nt, Human
cuaguuuucuccucccag

SEQ ID NO: 1268046 - RNA, 19 nt, Human
cuaguuuucuccucccagg

SEQ ID NO: 1268047 - RNA, 16 nt, Human
cuaguuuucuccuccc

SEQ ID NO: 1268048 - RNA, 17 nt, Human
cuaguuuucuccuccca

SEQ ID NO: 1268049 - RNA, 22 nt, Human
cucaaaccaaaucacugaacuu

SEQ ID NO: 1268050 - RNA, 19 nt, Human
cucaaaccaaaucacugaa

SEQ ID NO: 1268051 - RNA, 18 nt, Human
cucaaaccaaaucacuga

SEQ ID NO: 1268052 - RNA, 15 nt, Human
cucaaacaaugacaa

SEQ ID NO: 1268053 - RNA, 20 nt, Human
cucaaacaaugacaaagcag

SEQ ID NO: 1268054 - RNA, 13 nt, Human
cucaaacaauuga

SEQ ID NO: 1268055 - RNA, 21 nt, Human
cucaaacaaugacaaagcaga

SEQ ID NO: 1268056 - RNA, 13 nt, Human
cucaaaauauuug

SEQ ID NO: 1268057 - RNA, 18 nt, Human
cucaaaauauuuguacau

SEQ ID NO: 1268058 - RNA, 13 nt, Human
cucaaacaaugac

SEQ ID NO: 1268059 - RNA, 18 nt, Human
cuauuuuuuuuuuuuugu

SEQ ID NO: 1268060 - RNA, 20 nt, Human
cuauuaaaagacucauccgu

SEQ ID NO: 1268061 - RNA, 19 nt, Human
cuauuaaaagacucauccg

SEQ ID NO: 1268062 - RNA, 19 nt, Human
cuauuaaagugcuaagguu

SEQ ID NO: 1268063 - RNA, 23 nt, Human
cuauuaaagugcuaagguucuaa

SEQ ID NO: 1268064 - RNA, 20 nt, Human
cuauuaaagugcuaagguuc

SEQ ID NO: 1268065 - RNA, 21 nt, Human
cuauuaaagugcuaagguucu

SEQ ID NO: 1268066 - RNA, 22 nt, Human
cuauuaaagugcuaagguucua

SEQ ID NO: 1268067 - RNA, 19 nt, Human
cucaauauucaauaaagcu

SEQ ID NO: 1268068 - RNA, 18 nt, Human
cucaauauucaauaaagc

SEQ ID NO: 1268069 - RNA, 17 nt, Human
cucaauauucaauaaag

SEQ ID NO: 1268070 - RNA, 16 nt, Human
cucaauauucaauaaa

SEQ ID NO: 1268071 - RNA, 14 nt, Human
cucaauaaaguaca

SEQ ID NO: 1268072 - RNA, 16 nt, Human
cucaauaaaugauucu

SEQ ID NO: 1268073 - RNA, 20 nt, Human
cucaauaaaauuauagcucu

SEQ ID NO: 1268074 - RNA, 19 nt, Human
cucaaacuccugaccucag

SEQ ID NO: 1268075 - RNA, 15 nt, Human
cucaauaaaauuaua

SEQ ID NO: 1268076 - RNA, 14 nt, Human
cucaaacuccugac

SEQ ID NO: 1268077 - RNA, 19 nt, Human
cucaauucuucccuaucuu

SEQ ID NO: 1268078 - RNA, 14 nt, Human
cucaauucuucccu

SEQ ID NO: 1268079 - RNA, 16 nt, Human
cucaauugcuuuguaa

SEQ ID NO: 1268080 - RNA, 16 nt, Human
cucaauuucugaacac

SEQ ID NO: 1268081 - RNA, 11 nt, Human
cucacaaaaga

SEQ ID NO: 1268082 - RNA, 15 nt, Human
cucaauuuucacugu

SEQ ID NO: 1268083 - RNA, 22 nt, Human
cucacaaaccaugcaaaugcua

SEQ ID NO: 1268084 - RNA, 17 nt, Human
cucaauuuucacugugu

SEQ ID NO: 1268085 - RNA, 23 nt, Human
cucaauuuuaucccucaccugua

SEQ ID NO: 1268086 - RNA, 21 nt, Human
cucaaugagcauguuuagacu

SEQ ID NO: 1268087 - RNA, 13 nt, Human
cucaauggacugg

SEQ ID NO: 1268088 - RNA, 18 nt, Human
ccuuuuuauuugcaugug

SEQ ID NO: 1268089 - RNA, 17 nt, Human
ccuuuuuauuugcaugu

SEQ ID NO: 1268090 - RNA, 12 nt, Human
ccuuuuucaaug

SEQ ID NO: 1268091 - RNA, 21 nt, Human
ccuuuuucaaugaauuuuaua

SEQ ID NO: 1268092 - RNA, 19 nt, Human
ccuuuuuguauaaaauaga

SEQ ID NO: 1268093 - RNA, 14 nt, Human
ccuuuuuguauaaa

SEQ ID NO: 1268094 - RNA, 12 nt, Human
cgacaagugcug

SEQ ID NO: 1268095 - RNA, 16 nt, Human
cgacacggucggggca

SEQ ID NO: 1268096 - RNA, 12 nt, Human
cgacagccuggc

SEQ ID NO: 1268097 - RNA, 13 nt, Human
cgacagccuggca

SEQ ID NO: 1268098 - RNA, 21 nt, Human
cgacacugcagccccacccag

SEQ ID NO: 1268099 - RNA, 14 nt, Human
cgacagccuggcac

SEQ ID NO: 1268100 - RNA, 23 nt, Human
cgacccccucucccugcauggca

SEQ ID NO: 1268101 - RNA, 17 nt, Human
cgacugaaaauauuguu

SEQ ID NO: 1268102 - RNA, 22 nt, Human
cgacucugugcuggccagcgag

SEQ ID NO: 1268103 - RNA, 19 nt, Human
cgacucacaccacuagccu

SEQ ID NO: 1268104 - RNA, 16 nt, Human
cgacucugugcuggcc

SEQ ID NO: 1268105 - RNA, 16 nt, Human
cgacuccguuggccac

SEQ ID NO: 1268106 - RNA, 19 nt, Human
cgacuccguuggccacucc

SEQ ID NO: 1268107 - RNA, 14 nt, Human
cgacuaauuucaaa

SEQ ID NO: 1268108 - RNA, 21 nt, Human
cgacucacaccacuagccuca

SEQ ID NO: 1268109 - RNA, 18 nt, Human
cgacugaaaauauuguuu

SEQ ID NO: 1268110 - RNA, 14 nt, Human
cgacugcaacagga

SEQ ID NO: 1268111 - RNA, 17 nt, Human
cgacuggccagggccac

SEQ ID NO: 1268112 - RNA, 20 nt, Human
cgacuggccagggccacgcu

SEQ ID NO: 1268113 - RNA, 20 nt, Human
cgacucugugcuggccagcg

SEQ ID NO: 1268114 - RNA, 14 nt, Human
cgacuggccagggc

SEQ ID NO: 1268115 - RNA, 15 nt, Human
cgacuggccagggcc

SEQ ID NO: 1268116 - RNA, 18 nt, Human
ccuuuaauuguaaaguaa

SEQ ID NO: 1268117 - RNA, 12 nt, Human
ccuuuacaugag

SEQ ID NO: 1268118 - RNA, 18 nt, Human
ccuuuacaugaggacucu

SEQ ID NO: 1268119 - RNA, 15 nt, Human
ccuuucacaaccuuc

SEQ ID NO: 1268120 - RNA, 14 nt, Human
ccuuucacaggcag

SEQ ID NO: 1268121 - RNA, 22 nt, Human
ccuuucacaggcagccagugcc

SEQ ID NO: 1268122 - RNA, 18 nt, Human
ccuuuugacacugcucua

SEQ ID NO: 1268123 - RNA, 16 nt, Human
ccuuuugaggagcccc

SEQ ID NO: 1268124 - RNA, 21 nt, Human
ccuuuugaggagccccagcua

SEQ ID NO: 1268125 - RNA, 23 nt, Human
ccuuuugaggagccccagcuacc

SEQ ID NO: 1268126 - RNA, 11 nt, Human
ccuuuugcaaa

SEQ ID NO: 1268127 - RNA, 19 nt, Human
ccuuuuuaauaugcuuaaa

SEQ ID NO: 1268128 - RNA, 14 nt, Human
ccuuucaggaucua

SEQ ID NO: 1268129 - RNA, 19 nt, Human
ccuuucaggaucuauuuuu

SEQ ID NO: 1268130 - RNA, 17 nt, Human
ccuuucaggaucuauuu

SEQ ID NO: 1268131 - RNA, 19 nt, Human
ccuuuccaccacagccagc

SEQ ID NO: 1268132 - RNA, 13 nt, Human
ccuuuugacacug

SEQ ID NO: 1268133 - RNA, 15 nt, Human
ccuuuugacacugcu

SEQ ID NO: 1268134 - RNA, 17 nt, Human
ccuugccccccuggccu

SEQ ID NO: 1268135 - RNA, 22 nt, Human
ccuugcugcaagcacagcccuu

SEQ ID NO: 1268136 - RNA, 12 nt, Human
ccuugcugugaa

SEQ ID NO: 1268137 - RNA, 16 nt, Human
ccuugcuuaccucuca

SEQ ID NO: 1268138 - RNA, 18 nt, Human
ccuugcuuaugacaucac

SEQ ID NO: 1268139 - RNA, 17 nt, Human
ccuugcuuaccucucag

SEQ ID NO: 1268140 - RNA, 16 nt, Human
ccuugccccccuggcc

SEQ ID NO: 1268141 - RNA, 21 nt, Human
ccuugccccccuggccucccc

SEQ ID NO: 1268142 - RNA, 17 nt, Human
cgccuccaacccuagca

SEQ ID NO: 1268143 - RNA, 16 nt, Human
cgccuccaacccuagc

SEQ ID NO: 1268144 - RNA, 21 nt, Human
cgccucacugcaaccuucacc

SEQ ID NO: 1268145 - RNA, 17 nt, Human
cgccacuggggcucaga

SEQ ID NO: 1268146 - RNA, 18 nt, Human
cgccacuggggcucagag

SEQ ID NO: 1268147 - RNA, 13 nt, Human
cgccacuggggcu

SEQ ID NO: 1268148 - RNA, 15 nt, Human
cgccacuggggcuca

SEQ ID NO: 1268149 - RNA, 19 nt, Human
cgccacuggggcucagagc

SEQ ID NO: 1268150 - RNA, 13 nt, Human
cgccucugcauuc

SEQ ID NO: 1268151 - RNA, 16 nt, Human
cgccuccauccaaggc

SEQ ID NO: 1268152 - RNA, 18 nt, Human
cgccuccauccaaggcca

SEQ ID NO: 1268153 - RNA, 15 nt, Human
cgccucuugaccagg

SEQ ID NO: 1268154 - RNA, 17 nt, Human
cgccucuugaccaggcu

SEQ ID NO: 1268155 - RNA, 15 nt, Human
cgccucuuucaagca

SEQ ID NO: 1268156 - RNA, 20 nt, Human
cgccugacaaccacuggucu

SEQ ID NO: 1268157 - RNA, 21 nt, Human
cgccugacaaccacuggucug

SEQ ID NO: 1268158 - RNA, 23 nt, Human
cgccugacaaccacuggucugua

SEQ ID NO: 1268159 - RNA, 11 nt, Human
cgccugagccc

SEQ ID NO: 1268160 - RNA, 13 nt, Human
cgccugagcccag

SEQ ID NO: 1268161 - RNA, 14 nt, Human
cgccugagcccagg

SEQ ID NO: 1268162 - RNA, 15 nt, Human
cgccugagcccaggg

SEQ ID NO: 1268163 - RNA, 16 nt, Human
cgccugagcccaggga

SEQ ID NO: 1268164 - RNA, 17 nt, Human
cgccugagcccagggag

SEQ ID NO: 1268165 - RNA, 18 nt, Human
cgccugagcccagggagg

SEQ ID NO: 1268166 - RNA, 19 nt, Human
cgccugagcccagggaggc

SEQ ID NO: 1268167 - RNA, 21 nt, Human
cgccugagcccagggaggccg

SEQ ID NO: 1268168 - RNA, 20 nt, Human
cgccugaggaacccuuacag

SEQ ID NO: 1268169 - RNA, 17 nt, Human
cgccugaggcaauuaga

SEQ ID NO: 1268170 - RNA, 20 nt, Human
cgccugagcccagggaggcc

SEQ ID NO: 1268171 - RNA, 21 nt, Human
cgccuggcaguccgugggacg

SEQ ID NO: 1268172 - RNA, 19 nt, Human
cgccuggcugcagccugcg

SEQ ID NO: 1268173 - RNA, 20 nt, Human
cgagucauucguucugugga

SEQ ID NO: 1268174 - RNA, 13 nt, Human
cgaguccaagcug

SEQ ID NO: 1268175 - RNA, 14 nt, Human
cgaguccaagcugg

SEQ ID NO: 1268176 - RNA, 15 nt, Human
cgaguccaagcuggg

SEQ ID NO: 1268177 - RNA, 16 nt, Human
cgagucucuucuccac

SEQ ID NO: 1268178 - RNA, 15 nt, Human
cgauauacucuagau

SEQ ID NO: 1268179 - RNA, 18 nt, Human
cgagucauucguucugug

SEQ ID NO: 1268180 - RNA, 19 nt, Human
cgagucauucguucugugg

SEQ ID NO: 1268181 - RNA, 13 nt, Human
cgcaggcuggccc

SEQ ID NO: 1268182 - RNA, 16 nt, Human
cgcauggucacacacu

SEQ ID NO: 1268183 - RNA, 19 nt, Human
cgcauggucacacacugau

SEQ ID NO: 1268184 - RNA, 23 nt, Human
cggaggaaggaggacccaggaca

SEQ ID NO: 1268185 - RNA, 21 nt, Human
cggaggaaggaggacccagga

SEQ ID NO: 1268186 - RNA, 20 nt, Human
cggaggaaggaggacccagg

SEQ ID NO: 1268187 - RNA, 19 nt, Human
cggaggaaggaggacccag

SEQ ID NO: 1268188 - RNA, 14 nt, Human
cggaggacucacca

SEQ ID NO: 1268189 - RNA, 15 nt, Human
cgcugccagcucugu

SEQ ID NO: 1268190 - RNA, 19 nt, Human
cgcugccagcucuguauca

SEQ ID NO: 1268191 - RNA, 20 nt, Human
cgccuggguccaaugcucag

SEQ ID NO: 1268192 - RNA, 14 nt, Human
cgccuggccuggcc

SEQ ID NO: 1268193 - RNA, 15 nt, Human
cggcuccccaugugu

SEQ ID NO: 1268194 - RNA, 17 nt, Human
cggcuccccaugugucc

SEQ ID NO: 1268195 - RNA, 20 nt, Human
cggcuccccauguguccugg

SEQ ID NO: 1268196 - RNA, 15 nt, Human
cgggccaaggaccug

SEQ ID NO: 1268197 - RNA, 18 nt, Human
cgggccaaggaccugaga

SEQ ID NO: 1268198 - RNA, 17 nt, Human
cgggccuguccacaggc

SEQ ID NO: 1268199 - RNA, 22 nt, Human
cgggccuguccacaggcuucug

SEQ ID NO: 1268200 - RNA, 15 nt, Human
cggggaacuggccaa

SEQ ID NO: 1268201 - RNA, 17 nt, Human
cggggaacuggccaagc

SEQ ID NO: 1268202 - RNA, 22 nt, Human
cggggaacuggccaagcugagg

SEQ ID NO: 1268203 - RNA, 13 nt, Human
cggggaaggauuu

SEQ ID NO: 1268204 - RNA, 20 nt, Human
cggggaacuggccaagcuga

SEQ ID NO: 1268205 - RNA, 15 nt, Human
cgugaucucagcuca

SEQ ID NO: 1268206 - RNA, 14 nt, Human
cgugaucucagcuc

SEQ ID NO: 1268207 - RNA, 24 nt, Human
cgugauccacccgccucagccucc

SEQ ID NO: 1268208 - RNA, 17 nt, Human
cgugauccacccgccuc

SEQ ID NO: 1268209 - RNA, 13 nt, Human
cgugauccacccg

SEQ ID NO: 1268210 - RNA, 23 nt, Human
cgugaucaaguugaggggcuucc

SEQ ID NO: 1268211 - RNA, 18 nt, Human
cguggugcgagugcguga

SEQ ID NO: 1268212 - RNA, 13 nt, Human
cgugguggucccu

SEQ ID NO: 1268213 - RNA, 15 nt, Human
cgugguggucccugg

SEQ ID NO: 1268214 - RNA, 17 nt, Human
cgugguggucccugggu

SEQ ID NO: 1268215 - RNA, 14 nt, Human
cguaaaauuaagaa

SEQ ID NO: 1268216 - RNA, 16 nt, Human
cguaaaaaugauuuca

SEQ ID NO: 1268217 - RNA, 12 nt, Human
cguaaagauuug

SEQ ID NO: 1268218 - RNA, 23 nt, Human
cgguguuuaagacauuuuuggaa

SEQ ID NO: 1268219 - RNA, 13 nt, Human
cgguguucuaaga

SEQ ID NO: 1268220 - RNA, 18 nt, Human
cgguuauaaaaaaugguu

SEQ ID NO: 1268221 - RNA, 20 nt, Human
cgguuauaaaaaaugguuca

SEQ ID NO: 1268222 - RNA, 21 nt, Human
cgguuauaaaaaaugguucag

SEQ ID NO: 1268223 - RNA, 11 nt, Human
cgguuucucca

SEQ ID NO: 1268224 - RNA, 21 nt, Human
cugaggaaauugcuuuguauu

SEQ ID NO: 1268225 - RNA, 23 nt, Human
cugaggacaagagaaaaaagcca

SEQ ID NO: 1268226 - RNA, 14 nt, Human
cugaggacagaugc

SEQ ID NO: 1268227 - RNA, 15 nt, Human
cugaggacagaugcc

SEQ ID NO: 1268228 - RNA, 20 nt, Human
cugaggacagaugccuccuu

SEQ ID NO: 1268229 - RNA, 13 nt, Human
cugagauggcucc

SEQ ID NO: 1268230 - RNA, 16 nt, Human
cugagauggcucccag

SEQ ID NO: 1268231 - RNA, 17 nt, Human
cugagauggcucccagg

SEQ ID NO: 1268232 - RNA, 18 nt, Human
cugagauggcucccaggg

SEQ ID NO: 1268233 - RNA, 20 nt, Human
cugagauggcucccaggggc

SEQ ID NO: 1268234 - RNA, 21 nt, Human
cugagauggcucccaggggcu

SEQ ID NO: 1268235 - RNA, 20 nt, Human
cugagaugggcuucccaagg

SEQ ID NO: 1268236 - RNA, 21 nt, Human
cugagauaugaacauauuguu

SEQ ID NO: 1268237 - RNA, 23 nt, Human
cugagauaugaacauauuguuga

SEQ ID NO: 1268238 - RNA, 20 nt, Human
cugaggugcccaggagaaga

SEQ ID NO: 1268239 - RNA, 13 nt, Human
cugaguacuccac

SEQ ID NO: 1268240 - RNA, 15 nt, Human
cugaguacuccacac

SEQ ID NO: 1268241 - RNA, 16 nt, Human
cugaguacuccacacu

SEQ ID NO: 1268242 - RNA, 18 nt, Human
cugaguacuccacacugc

SEQ ID NO: 1268243 - RNA, 19 nt, Human
cugaguacuccacacugca

SEQ ID NO: 1268244 - RNA, 23 nt, Human
cugaguacuccacacugcacaau

SEQ ID NO: 1268245 - RNA, 14 nt, Human
cugaggaccagcca

SEQ ID NO: 1268246 - RNA, 18 nt, Human
cugaggacagaugccucc

SEQ ID NO: 1268247 - RNA, 22 nt, Human
cugaggacuuaaaauauuccug

SEQ ID NO: 1268248 - RNA, 14 nt, Human
cugaggacugauuu

SEQ ID NO: 1268249 - RNA, 22 nt, Human
cugaggacugauuucagaguga

SEQ ID NO: 1268250 - RNA, 14 nt, Human
cugaggagcagcag

SEQ ID NO: 1268251 - RNA, 21 nt, Human
cugaggagcagcaggaggggg

SEQ ID NO: 1268252 - RNA, 23 nt, Human
cugaggagcagcaggagggggga

SEQ ID NO: 1268253 - RNA, 12 nt, Human
cugaggagucug

SEQ ID NO: 1268254 - RNA, 15 nt, Human
cugaggagucugagg

SEQ ID NO: 1268255 - RNA, 16 nt, Human
cugaggagucugaggu

SEQ ID NO: 1268256 - RNA, 17 nt, Human
cugaggagucugagguc

SEQ ID NO: 1268257 - RNA, 18 nt, Human
cugaggagucugaggucc

SEQ ID NO: 1268258 - RNA, 16 nt, Human
cugaggugcacuggga

SEQ ID NO: 1268259 - RNA, 17 nt, Human
cugaggugcacugggag

SEQ ID NO: 1268260 - RNA, 18 nt, Human
cugaggugcacugggagg

SEQ ID NO: 1268261 - RNA, 13 nt, Human
cugaggugcccag

SEQ ID NO: 1268262 - RNA, 14 nt, Human
cugaggugcccagg

SEQ ID NO: 1268263 - RNA, 15 nt, Human
cugaggugcccagga

SEQ ID NO: 1268264 - RNA, 16 nt, Human
cugaggugcccaggag

SEQ ID NO: 1268265 - RNA, 17 nt, Human
cugaggugcccaggaga

SEQ ID NO: 1268266 - RNA, 18 nt, Human
cugaggugcccaggagaa

SEQ ID NO: 1268267 - RNA, 19 nt, Human
cugaggugcccaggagaag

SEQ ID NO: 1268268 - RNA, 17 nt, Human
cugaggugccuguccca

SEQ ID NO: 1268269 - RNA, 19 nt, Human
cugaggugccugucccacc

SEQ ID NO: 1268270 - RNA, 22 nt, Human
cugaggugccugucccaccccc

SEQ ID NO: 1268271 - RNA, 14 nt, Human
cugaguagcuggga

SEQ ID NO: 1268272 - RNA, 15 nt, Human
cugaguagcugggau

SEQ ID NO: 1268273 - RNA, 20 nt, Human
cugaguagcugggauuacag

SEQ ID NO: 1268274 - RNA, 16 nt, Human
cugaguauuaaaaugu

SEQ ID NO: 1268275 - RNA, 21 nt, Human
cugaguauuaaaauguaugca

SEQ ID NO: 1268276 - RNA, 22 nt, Human
cugaguauuaaaauguaugcau

SEQ ID NO: 1268277 - RNA, 23 nt, Human
cugaguauuaaaauguaugcaug

SEQ ID NO: 1268278 - RNA, 15 nt, Human
cugagucaaguuguu

SEQ ID NO: 1268279 - RNA, 16 nt, Human
cugagucaaguuguuc

SEQ ID NO: 1268280 - RNA, 20 nt, Human
cugaccccaaacaccuucca

SEQ ID NO: 1268281 - RNA, 21 nt, Human
cugaccccaaacaccuuccag

SEQ ID NO: 1268282 - RNA, 22 nt, Human
cugaccccaaacaccuuccagc

SEQ ID NO: 1268283 - RNA, 15 nt, Human
cugaccccaucaccu

SEQ ID NO: 1268284 - RNA, 14 nt, Human
cugaccugcacugg

SEQ ID NO: 1268285 - RNA, 13 nt, Human
cugaccugcugac

SEQ ID NO: 1268286 - RNA, 14 nt, Human
cugaccugcugacc

SEQ ID NO: 1268287 - RNA, 15 nt, Human
cugaccugcugaccu

SEQ ID NO: 1268288 - RNA, 19 nt, Human
cugaccugcugaccugugc

SEQ ID NO: 1268289 - RNA, 20 nt, Human
cugaccugcugaccugugca

SEQ ID NO: 1268290 - RNA, 10 nt, Human
cugaccuggc

SEQ ID NO: 1268291 - RNA, 12 nt, Human
cugaccuggccc

SEQ ID NO: 1268292 - RNA, 13 nt, Human
cugaccuggcccc

SEQ ID NO: 1268293 - RNA, 14 nt, Human
cugaccuggccccc

SEQ ID NO: 1268294 - RNA, 17 nt, Human
cugaccuggcccccuca

SEQ ID NO: 1268295 - RNA, 20 nt, Human
cugaccuggcccccucagug

SEQ ID NO: 1268296 - RNA, 13 nt, Human
cugagaccugaag

SEQ ID NO: 1268297 - RNA, 18 nt, Human
cugagacuaaucuuauuc

SEQ ID NO: 1268298 - RNA, 22 nt, Human
cugagaccaaggcuuucucuac

SEQ ID NO: 1268299 - RNA, 21 nt, Human
cugagaccaaggcuuucucua

SEQ ID NO: 1268300 - RNA, 16 nt, Human
cugagacgucaugagg

SEQ ID NO: 1268301 - RNA, 18 nt, Human
cugagacgucaugaggag

SEQ ID NO: 1268302 - RNA, 13 nt, Human
cugagagaggcca

SEQ ID NO: 1268303 - RNA, 14 nt, Human
cugagagaaaauaa

SEQ ID NO: 1268304 - RNA, 14 nt, Human
cugagagaggccau

SEQ ID NO: 1268305 - RNA, 21 nt, Human
cugagagaggccauucuuucc

SEQ ID NO: 1268306 - RNA, 22 nt, Human
cugagagaggccauucuuuccc

SEQ ID NO: 1268307 - RNA, 19 nt, Human
cugagagaugcagaaauau

SEQ ID NO: 1268308 - RNA, 22 nt, Human
cugagagcaucaggccuagagg

SEQ ID NO: 1268309 - RNA, 17 nt, Human
cugagaggacagagaga

SEQ ID NO: 1268310 - RNA, 17 nt, Human
cugagagggcucgaggg

SEQ ID NO: 1268311 - RNA, 16 nt, Human
cugagaggcccuggau

SEQ ID NO: 1268312 - RNA, 14 nt, Human
cugagagucuagau

SEQ ID NO: 1268313 - RNA, 15 nt, Human
cugagagucuagauu

SEQ ID NO: 1268314 - RNA, 17 nt, Human
cugagagucuagauucu

SEQ ID NO: 1268315 - RNA, 22 nt, Human
cugagagucuagauucucuggc

SEQ ID NO: 1268316 - RNA, 17 nt, Human
cugagauacauacagaa

SEQ ID NO: 1268317 - RNA, 19 nt, Human
cugagauacauacagaauu

SEQ ID NO: 1268318 - RNA, 18 nt, Human
cugagauaccagcgagga

SEQ ID NO: 1268319 - RNA, 12 nt, Human
cugagauaugaa

SEQ ID NO: 1268320 - RNA, 15 nt, Human
cugagauaugaacau

SEQ ID NO: 1268321 - RNA, 16 nt, Human
cugagauaugaacaua

SEQ ID NO: 1268322 - RNA, 20 nt, Human
cugagaggacagagagaaau

SEQ ID NO: 1268323 - RNA, 21 nt, Human
cugagaggacagagagaaaua

SEQ ID NO: 1268324 - RNA, 13 nt, Human
cugagaggcccug

SEQ ID NO: 1268325 - RNA, 14 nt, Human
cugagaggcccugg

SEQ ID NO: 1268326 - RNA, 15 nt, Human
cugagaggcccugga

SEQ ID NO: 1268327 - RNA, 14 nt, Human
cugagaggcugucu

SEQ ID NO: 1268328 - RNA, 15 nt, Human
cugacaacagacuuc

SEQ ID NO: 1268329 - RNA, 18 nt, Human
cugacaacagacuucuga

SEQ ID NO: 1268330 - RNA, 19 nt, Human
cugacaacagacuucugaa

SEQ ID NO: 1268331 - RNA, 22 nt, Human
cugacaacauuucuauagccaa

SEQ ID NO: 1268332 - RNA, 14 nt, Human
cugacaacauuucu

SEQ ID NO: 1268333 - RNA, 13 nt, Human
cugacaagcucca

SEQ ID NO: 1268334 - RNA, 23 nt, Human
cugacaagauuauaauauuuuaa

SEQ ID NO: 1268335 - RNA, 14 nt, Human
cugacaagccaucu

SEQ ID NO: 1268336 - RNA, 18 nt, Human
cugacaagcuccauuuaa

SEQ ID NO: 1268337 - RNA, 20 nt, Human
cugacaaccacuggucugua

SEQ ID NO: 1268338 - RNA, 18 nt, Human
cugacaaccacuggucug

SEQ ID NO: 1268339 - RNA, 21 nt, Human
cucuugaugccuggcggggug

SEQ ID NO: 1268340 - RNA, 16 nt, Human
cucuugaugccuggcg

SEQ ID NO: 1268341 - RNA, 15 nt, Human
cucuugaugccuggc

SEQ ID NO: 1268342 - RNA, 13 nt, Human
cucuugaugccug

SEQ ID NO: 1268343 - RNA, 21 nt, Human
cucuugauuauccauauugag

SEQ ID NO: 1268344 - RNA, 22 nt, Human
cucuuuuccuuugguccuucaa

SEQ ID NO: 1268345 - RNA, 21 nt, Human
cucuuuugcuuuauuccagaa

SEQ ID NO: 1268346 - RNA, 13 nt, Human
cucuuuuuaaagu

SEQ ID NO: 1268347 - RNA, 21 nt, Human
cucuuuuuccaacuuggcugc

SEQ ID NO: 1268348 - RNA, 12 nt, Human
cucuuuuuccaa

SEQ ID NO: 1268349 - RNA, 15 nt, Human
cugaaacaacuugga

SEQ ID NO: 1268350 - RNA, 16 nt, Human
cugaaacaacuuggaa

SEQ ID NO: 1268351 - RNA, 20 nt, Human
cugaaacaacuuggaaagau

SEQ ID NO: 1268352 - RNA, 14 nt, Human
cugaaaccaguguu

SEQ ID NO: 1268353 - RNA, 19 nt, Human
cugaaacucauagacacug

SEQ ID NO: 1268354 - RNA, 22 nt, Human
cugaaacucacacaacuaggaa

SEQ ID NO: 1268355 - RNA, 22 nt, Human
cugaagcuaucguaaaauuaag

SEQ ID NO: 1268356 - RNA, 21 nt, Human
cugaagcuaucguaaaauuaa

SEQ ID NO: 1268357 - RNA, 15 nt, Human
cugaaagacaauaua

SEQ ID NO: 1268358 - RNA, 14 nt, Human
cugaaagagaaaca

SEQ ID NO: 1268359 - RNA, 21 nt, Human
cugaagcccucccagguguua

SEQ ID NO: 1268360 - RNA, 13 nt, Human
cugaagcccuugu

SEQ ID NO: 1268361 - RNA, 23 nt, Human
cugaagccuuugcauuuuggaga

SEQ ID NO: 1268362 - RNA, 15 nt, Human
cugaagcucccacag

SEQ ID NO: 1268363 - RNA, 12 nt, Human
cugaaggagccc

SEQ ID NO: 1268364 - RNA, 13 nt, Human
cugaaggagcccc

SEQ ID NO: 1268365 - RNA, 16 nt, Human
cugacaaaauacuugu

SEQ ID NO: 1268366 - RNA, 22 nt, Human
cugaauuuuuaaacaaguauuu

SEQ ID NO: 1268367 - RNA, 21 nt, Human
cugaaggagccccauuccugg

SEQ ID NO: 1268368 - RNA, 13 nt, Human
cugaaggccugag

SEQ ID NO: 1268369 - RNA, 15 nt, Human
cugaaggccugaggu

SEQ ID NO: 1268370 - RNA, 19 nt, Human
cugaaggccugagguuacu

SEQ ID NO: 1268371 - RNA, 22 nt, Human
cucuuagaugcaguucugaaga

SEQ ID NO: 1268372 - RNA, 17 nt, Human
cucuuagcagcuuccag

SEQ ID NO: 1268373 - RNA, 18 nt, Human
cucuuagcagcuuccaga

SEQ ID NO: 1268374 - RNA, 19 nt, Human
cucuuagcagcuuccagau

SEQ ID NO: 1268375 - RNA, 18 nt, Human
cucuucacucuucaaaug

SEQ ID NO: 1268376 - RNA, 16 nt, Human
cucuucaacugaccag

SEQ ID NO: 1268377 - RNA, 17 nt, Human
cucuucaacugaccagc

SEQ ID NO: 1268378 - RNA, 20 nt, Human
cucuucaacugaccagccuc

SEQ ID NO: 1268379 - RNA, 15 nt, Human
cucuucaaaugccug

SEQ ID NO: 1268380 - RNA, 14 nt, Human
cucuuauuucauca

SEQ ID NO: 1268381 - RNA, 13 nt, Human
cucuuauuucauc

SEQ ID NO: 1268382 - RNA, 22 nt, Human
cucuuauugccucacuucaggu

SEQ ID NO: 1268383 - RNA, 17 nt, Human
cucuuauugccucacuu

SEQ ID NO: 1268384 - RNA, 20 nt, Human
cucuuauugccucacuucag

SEQ ID NO: 1268385 - RNA, 14 nt, Human
cucuuauugccuca

SEQ ID NO: 1268386 - RNA, 13 nt, Human
cucuucagaggcc

SEQ ID NO: 1268387 - RNA, 17 nt, Human
cucuucagaggcccucg

SEQ ID NO: 1268388 - RNA, 17 nt, Human
cucugcaggucccuaau

SEQ ID NO: 1268389 - RNA, 16 nt, Human
cucugcaggucccuaa

SEQ ID NO: 1268390 - RNA, 15 nt, Human
cucugcaggucccua

SEQ ID NO: 1268391 - RNA, 14 nt, Human
cucugcaggucccu

SEQ ID NO: 1268392 - RNA, 18 nt, Human
cucugcaggucccuaaua

SEQ ID NO: 1268393 - RNA, 18 nt, Human
cucugcagaaacuacuga

SEQ ID NO: 1268394 - RNA, 17 nt, Human
cucugcagacuucccag

SEQ ID NO: 1268395 - RNA, 18 nt, Human
cucugcagacuucccagc

SEQ ID NO: 1268396 - RNA, 23 nt, Human
cucucccggagguugggugggcc

SEQ ID NO: 1268397 - RNA, 16 nt, Human
cucuccccugccugcc

SEQ ID NO: 1268398 - RNA, 15 nt, Human
cucuccccugaccug

SEQ ID NO: 1268399 - RNA, 17 nt, Human
cucuccccugaccugug

SEQ ID NO: 1268400 - RNA, 12 nt, Human
cucuccccugcc

SEQ ID NO: 1268401 - RNA, 15 nt, Human
cucuccccugccccc

SEQ ID NO: 1268402 - RNA, 19 nt, Human
cucuccccugcccccugca

SEQ ID NO: 1268403 - RNA, 20 nt, Human
cucuccccugcccccugcag

SEQ ID NO: 1268404 - RNA, 22 nt, Human
cucuccccugcccccugcagga

SEQ ID NO: 1268405 - RNA, 21 nt, Human
cucuccccugcccccugcagg

SEQ ID NO: 1268406 - RNA, 14 nt, Human
cucuccccugccug

SEQ ID NO: 1268407 - RNA, 21 nt, Human
cucuccccuggaacugucucu

SEQ ID NO: 1268408 - RNA, 17 nt, Human
cucugguggcacaggag

SEQ ID NO: 1268409 - RNA, 14 nt, Human
cucugucagucaca

SEQ ID NO: 1268410 - RNA, 16 nt, Human
cucugucagucacagc

SEQ ID NO: 1268411 - RNA, 17 nt, Human
cucugucagucacagcc

SEQ ID NO: 1268412 - RNA, 19 nt, Human
cucugucagucacagccac

SEQ ID NO: 1268413 - RNA, 12 nt, Human
cucuguccaggc

SEQ ID NO: 1268414 - RNA, 20 nt, Human
cucugucagucacagccacc

SEQ ID NO: 1268415 - RNA, 14 nt, Human
cucuguccaggcac

SEQ ID NO: 1268416 - RNA, 19 nt, Human
cucuguccaggcacugaga

SEQ ID NO: 1268417 - RNA, 16 nt, Human
cucuggucgcuccugc

SEQ ID NO: 1268418 - RNA, 17 nt, Human
cucuggucgcuccugcc

SEQ ID NO: 1268419 - RNA, 18 nt, Human
cucuggucgcuccugccc

SEQ ID NO: 1268420 - RNA, 20 nt, Human
cucuggucgcuccugcccac

SEQ ID NO: 1268421 - RNA, 23 nt, Human
cucuggugagucaccacuucagg

SEQ ID NO: 1268422 - RNA, 13 nt, Human
cucuggugccucc

SEQ ID NO: 1268423 - RNA, 14 nt, Human
cucuggugccucca

SEQ ID NO: 1268424 - RNA, 16 nt, Human
cucuggugccuccaga

SEQ ID NO: 1268425 - RNA, 18 nt, Human
cucuggugccuccagagg

SEQ ID NO: 1268426 - RNA, 19 nt, Human
cucugcagacuucccagcu

SEQ ID NO: 1268427 - RNA, 22 nt, Human
cucugcagacuucccagcuagg

SEQ ID NO: 1268428 - RNA, 15 nt, Human
cucugguaaccucuu

SEQ ID NO: 1268429 - RNA, 17 nt, Human
cucugguaauauugacu

SEQ ID NO: 1268430 - RNA, 16 nt, Human
cucugggggguggcca

SEQ ID NO: 1268431 - RNA, 19 nt, Human
cucugggggguggccaggc

SEQ ID NO: 1268432 - RNA, 21 nt, Human
cucugggggguggccaggccg

SEQ ID NO: 1268433 - RNA, 15 nt, Human
cucuggggugggcag

SEQ ID NO: 1268434 - RNA, 20 nt, Human
cucugggggguggccaggcc

SEQ ID NO: 1268435 - RNA, 13 nt, Human
cuccaagaauuuc

SEQ ID NO: 1268436 - RNA, 21 nt, Human
cuccaaccugcaaagaucugu

SEQ ID NO: 1268437 - RNA, 16 nt, Human
cucaugugugcaacag

SEQ ID NO: 1268438 - RNA, 23 nt, Human
cucauguuaaauaggcggggcuu

SEQ ID NO: 1268439 - RNA, 18 nt, Human
cucaugugacucuuucca

SEQ ID NO: 1268440 - RNA, 12 nt, Human
cucauguggcug

SEQ ID NO: 1268441 - RNA, 13 nt, Human
cucauguggcugg

SEQ ID NO: 1268442 - RNA, 14 nt, Human
cucauguggcugga

SEQ ID NO: 1268443 - RNA, 15 nt, Human
cucauguggcuggaa

SEQ ID NO: 1268444 - RNA, 12 nt, Human
cucaugccucag

SEQ ID NO: 1268445 - RNA, 16 nt, Human
cucaugccccuggcug

SEQ ID NO: 1268446 - RNA, 17 nt, Human
cucaugccccuggcugg

SEQ ID NO: 1268447 - RNA, 16 nt, Human
cucaugccucagccuc

SEQ ID NO: 1268448 - RNA, 14 nt, Human
cuccaagaauuucu

SEQ ID NO: 1268449 - RNA, 14 nt, Human
cuccaagagcuaca

SEQ ID NO: 1268450 - RNA, 20 nt, Human
cuccaagagcuacauaauuu

SEQ ID NO: 1268451 - RNA, 12 nt, Human
cuccaagauucu

SEQ ID NO: 1268452 - RNA, 13 nt, Human
cuccaagauucua

SEQ ID NO: 1268453 - RNA, 14 nt, Human
cuccaagauucuag

SEQ ID NO: 1268454 - RNA, 15 nt, Human
cuccaagauucuaga

SEQ ID NO: 1268455 - RNA, 16 nt, Human
cuccaagauucuagau

SEQ ID NO: 1268456 - RNA, 17 nt, Human
cuccaagauucuagaug

SEQ ID NO: 1268457 - RNA, 22 nt, Human
cuccaagcccagcccauggaga

SEQ ID NO: 1268458 - RNA, 13 nt, Human
cuccacuggcucc

SEQ ID NO: 1268459 - RNA, 15 nt, Human
cuccacuuggucugu

SEQ ID NO: 1268460 - RNA, 13 nt, Human
cuccacuuggucu

SEQ ID NO: 1268461 - RNA, 22 nt, Human
cuccacuuggucugugagaugc

SEQ ID NO: 1268462 - RNA, 21 nt, Human
cuccacuuggucugugagaug

SEQ ID NO: 1268463 - RNA, 17 nt, Human
cuccacuuggucuguga

SEQ ID NO: 1268464 - RNA, 16 nt, Human
cuccacuuggucugug

SEQ ID NO: 1268465 - RNA, 17 nt, Human
cuccaagcccagcccau

SEQ ID NO: 1268466 - RNA, 15 nt, Human
cuccaagccccaucu

SEQ ID NO: 1268467 - RNA, 18 nt, Human
cuccaagauucuagauga

SEQ ID NO: 1268468 - RNA, 13 nt, Human
cuccaagcagcuu

SEQ ID NO: 1268469 - RNA, 16 nt, Human
cuccaagcagcuuaga

SEQ ID NO: 1268470 - RNA, 19 nt, Human
cuccaagcagcuuagaguu

SEQ ID NO: 1268471 - RNA, 14 nt, Human
cuccaagcuccauc

SEQ ID NO: 1268472 - RNA, 17 nt, Human
cuccaagccccaucuuc

SEQ ID NO: 1268473 - RNA, 18 nt, Human
cuccaagccccaucuucu

SEQ ID NO: 1268474 - RNA, 18 nt, Human
cuccaagcuccaucucca

SEQ ID NO: 1268475 - RNA, 19 nt, Human
cuccaagcuccaucuccac

SEQ ID NO: 1268476 - RNA, 13 nt, Human
cucagucucccuc

SEQ ID NO: 1268477 - RNA, 13 nt, Human
cucaguaauuuag

SEQ ID NO: 1268478 - RNA, 18 nt, Human
cucaguaauuuagaaauc

SEQ ID NO: 1268479 - RNA, 19 nt, Human
cucaguaauuuagaaauca

SEQ ID NO: 1268480 - RNA, 22 nt, Human
cucaguaauuuagaaaucauuu

SEQ ID NO: 1268481 - RNA, 13 nt, Human
cucaguaauuugu

SEQ ID NO: 1268482 - RNA, 13 nt, Human
cucaguaccccau

SEQ ID NO: 1268483 - RNA, 16 nt, Human
cucaguaaagcacuug

SEQ ID NO: 1268484 - RNA, 15 nt, Human
cucagucucccuccc

SEQ ID NO: 1268485 - RNA, 16 nt, Human
cucagucucccucccu

SEQ ID NO: 1268486 - RNA, 17 nt, Human
cucagucucccucccuu

SEQ ID NO: 1268487 - RNA, 14 nt, Human
cucaucugcugguc

SEQ ID NO: 1268488 - RNA, 15 nt, Human
cucaucugcuggucc

SEQ ID NO: 1268489 - RNA, 16 nt, Human
cucaucugcugguccg

SEQ ID NO: 1268490 - RNA, 20 nt, Human
cucaucugcugguccguggg

SEQ ID NO: 1268491 - RNA, 12 nt, Human
cucaucugggga

SEQ ID NO: 1268492 - RNA, 19 nt, Human
cucaucuggggagcaggca

SEQ ID NO: 1268493 - RNA, 20 nt, Human
cucaucuggggagcaggcag

SEQ ID NO: 1268494 - RNA, 21 nt, Human
cucaucuggggagcaggcagc

SEQ ID NO: 1268495 - RNA, 12 nt, Human
cucaucugucac

SEQ ID NO: 1268496 - RNA, 14 nt, Human
cucaucugucacca

SEQ ID NO: 1268497 - RNA, 13 nt, Human
cucaucugucccu

SEQ ID NO: 1268498 - RNA, 15 nt, Human
cucaucugucccucc

SEQ ID NO: 1268499 - RNA, 17 nt, Human
cucaucugucccuccgg

SEQ ID NO: 1268500 - RNA, 18 nt, Human
cucaucugucccuccggg

SEQ ID NO: 1268501 - RNA, 22 nt, Human
cucaugccaguaacaggcucaa

SEQ ID NO: 1268502 - RNA, 16 nt, Human
cucaugcauuguccuc

SEQ ID NO: 1268503 - RNA, 14 nt, Human
cucaugccccuggc

SEQ ID NO: 1268504 - RNA, 23 nt, Human
cuccacuuggucugugagaugcu

SEQ ID NO: 1268505 - RNA, 17 nt, Human
cuccacuuggcauuagc

SEQ ID NO: 1268506 - RNA, 13 nt, Human
cuccacuuucagc

SEQ ID NO: 1268507 - RNA, 14 nt, Human
cuccacuuucagcu

SEQ ID NO: 1268508 - RNA, 15 nt, Human
cuccacuuucagcug

SEQ ID NO: 1268509 - RNA, 16 nt, Human
cuccacuuucagcugu

SEQ ID NO: 1268510 - RNA, 17 nt, Human
cuccacuuucagcuguc

SEQ ID NO: 1268511 - RNA, 20 nt, Human
cuccacuuucagcugucuuu

SEQ ID NO: 1268512 - RNA, 18 nt, Human
cuccacuuucagcugucu

SEQ ID NO: 1268513 - RNA, 19 nt, Human
cuccacuuucagcugucuu

SEQ ID NO: 1268514 - RNA, 14 nt, Human
cuccaggggcugcu

SEQ ID NO: 1268515 - RNA, 15 nt, Human
cuccaggggcugcuu

SEQ ID NO: 1268516 - RNA, 18 nt, Human
cuccaggggcugcuuccu

SEQ ID NO: 1268517 - RNA, 21 nt, Human
cuccaggggcugcuuccuccu

SEQ ID NO: 1268518 - RNA, 23 nt, Human
cucccacaugggcccaggccuca

SEQ ID NO: 1268519 - RNA, 22 nt, Human
cucccacaugggcccaggccuc

SEQ ID NO: 1268520 - RNA, 18 nt, Human
cucccaccuccccuuggg

SEQ ID NO: 1268521 - RNA, 13 nt, Human
cucccaccuccug

SEQ ID NO: 1268522 - RNA, 14 nt, Human
cucccaccuccuga

SEQ ID NO: 1268523 - RNA, 15 nt, Human
cucccaccuccugac

SEQ ID NO: 1268524 - RNA, 21 nt, Human
cucccaccuccugacacccuu

SEQ ID NO: 1268525 - RNA, 14 nt, Human
cucccaccugacac

SEQ ID NO: 1268526 - RNA, 15 nt, Human
cucccaccugacaca

SEQ ID NO: 1268527 - RNA, 20 nt, Human
cucccaccugacacaccagg

SEQ ID NO: 1268528 - RNA, 21 nt, Human
cucccaccugacacaccaggc

SEQ ID NO: 1268529 - RNA, 14 nt, Human
cuccccaugugucc

SEQ ID NO: 1268530 - RNA, 18 nt, Human
cuccccauguguccuggu

SEQ ID NO: 1268531 - RNA, 20 nt, Human
cuccccauguguccugguuc

SEQ ID NO: 1268532 - RNA, 21 nt, Human
cuccccauguguccugguucc

SEQ ID NO: 1268533 - RNA, 16 nt, Human
cucccccaacagcugg

SEQ ID NO: 1268534 - RNA, 18 nt, Human
cucuauaccaauaaagug

SEQ ID NO: 1268535 - RNA, 16 nt, Human
cucuaaagcaaauuua

SEQ ID NO: 1268536 - RNA, 13 nt, Human
cucuaaaaucugc

SEQ ID NO: 1268537 - RNA, 15 nt, Human
cucuaaaauuauaaa

SEQ ID NO: 1268538 - RNA, 17 nt, Human
cucuaaaauuauaaaug

SEQ ID NO: 1268539 - RNA, 23 nt, Human
cucguugacuggcuguguguugg

SEQ ID NO: 1268540 - RNA, 19 nt, Human
cucguuuguguucuguuuu

SEQ ID NO: 1268541 - RNA, 13 nt, Human
cucguuuguguuc

SEQ ID NO: 1268542 - RNA, 19 nt, Human
cucuauaccaauaaaguga

SEQ ID NO: 1268543 - RNA, 12 nt, Human
cucuaaagcaaa

SEQ ID NO: 1268544 - RNA, 22 nt, Human
cucuauauuguucagcaugcaa

SEQ ID NO: 1268545 - RNA, 15 nt, Human
cucuaucaccaagga

SEQ ID NO: 1268546 - RNA, 21 nt, Human
cucuauauaccaaagcacauu

SEQ ID NO: 1268547 - RNA, 18 nt, Human
cucuauccucucuuccuc

SEQ ID NO: 1268548 - RNA, 23 nt, Human
cucucaccauuuggauccugugu

SEQ ID NO: 1268549 - RNA, 16 nt, Human
cucucaccauuuggau

SEQ ID NO: 1268550 - RNA, 14 nt, Human
cucucaccucuagg

SEQ ID NO: 1268551 - RNA, 14 nt, Human
cucucaccuggccc

SEQ ID NO: 1268552 - RNA, 23 nt, Human
cucucacggccacacagcugccg

SEQ ID NO: 1268553 - RNA, 12 nt, Human
cucucagcucca

SEQ ID NO: 1268554 - RNA, 13 nt, Human
cucucagcuccag

SEQ ID NO: 1268555 - RNA, 15 nt, Human
cucucagcuccaggu

SEQ ID NO: 1268556 - RNA, 17 nt, Human
cucucaggaccaaagcu

SEQ ID NO: 1268557 - RNA, 13 nt, Human
cucucaggaucca

SEQ ID NO: 1268558 - RNA, 14 nt, Human
cucucaggauccaa

SEQ ID NO: 1268559 - RNA, 16 nt, Human
cucucaggauccaagc

SEQ ID NO: 1268560 - RNA, 14 nt, Human
cucguguguuucua

SEQ ID NO: 1268561 - RNA, 20 nt, Human
cucguugacuggcugugugu

SEQ ID NO: 1268562 - RNA, 14 nt, Human
cucguuaauuugua

SEQ ID NO: 1268563 - RNA, 15 nt, Human
cucgugucuggcaca

SEQ ID NO: 1268564 - RNA, 18 nt, Human
cuccuggggguucuuucu

SEQ ID NO: 1268565 - RNA, 12 nt, Human
cuccugggcccu

SEQ ID NO: 1268566 - RNA, 14 nt, Human
cuccugggcccucu

SEQ ID NO: 1268567 - RNA, 20 nt, Human
cuccuggggguucuuucuuc

SEQ ID NO: 1268568 - RNA, 22 nt, Human
cuccuggggguucuuucuuccu

SEQ ID NO: 1268569 - RNA, 23 nt, Human
cuccuggggguucuuucuuccuc

SEQ ID NO: 1268570 - RNA, 19 nt, Human
cuccuggguucaagcgauu

SEQ ID NO: 1268571 - RNA, 21 nt, Human
cuccuggguuuuguauucucu

SEQ ID NO: 1268572 - RNA, 22 nt, Human
cuccuggguuuuguauucucug

SEQ ID NO: 1268573 - RNA, 20 nt, Human
cucccccaggggcugucccg

SEQ ID NO: 1268574 - RNA, 13 nt, Human
cucccccaucucu

SEQ ID NO: 1268575 - RNA, 15 nt, Human
cucccccccaugcac

SEQ ID NO: 1268576 - RNA, 13 nt, Human
cucccccccaugc

SEQ ID NO: 1268577 - RNA, 21 nt, Human
cucccccaacagcuggacccu

SEQ ID NO: 1268578 - RNA, 19 nt, Human
cucccccaccguugucuca

SEQ ID NO: 1268579 - RNA, 22 nt, Human
cucccccaccguugucucaugc

SEQ ID NO: 1268580 - RNA, 13 nt, Human
cucccccacuuuc

SEQ ID NO: 1268581 - RNA, 19 nt, Human
cucccccacuuucuuucuu

SEQ ID NO: 1268582 - RNA, 12 nt, Human
cucccccagcaa

SEQ ID NO: 1268583 - RNA, 20 nt, Human
cucccccagcaaagccccca

SEQ ID NO: 1268584 - RNA, 21 nt, Human
cucccccagcaaagcccccag

SEQ ID NO: 1268585 - RNA, 22 nt, Human
cucccccagcaaagcccccaga

SEQ ID NO: 1268586 - RNA, 15 nt, Human
cuccuggaucucccu

SEQ ID NO: 1268587 - RNA, 16 nt, Human
cuccuggaucucccug

SEQ ID NO: 1268588 - RNA, 19 nt, Human
cuccuggaucucccugaga

SEQ ID NO: 1268589 - RNA, 21 nt, Human
cuccuggaucucccugagaug

SEQ ID NO: 1268590 - RNA, 18 nt, Human
cuccuggcugucugaggc

SEQ ID NO: 1268591 - RNA, 19 nt, Human
cuccuggcugucugaggcu

SEQ ID NO: 1268592 - RNA, 14 nt, Human
cuccuggcuuccca

SEQ ID NO: 1268593 - RNA, 23 nt, Human
cuccuggcuucccauccccagcg

SEQ ID NO: 1268594 - RNA, 21 nt, Human
cuccuggcuucccauccccag

SEQ ID NO: 1268595 - RNA, 11 nt, Human
cuccucuucca

SEQ ID NO: 1268596 - RNA, 15 nt, Human
cuccuggacuccugc

SEQ ID NO: 1268597 - RNA, 18 nt, Human
cuccucuucaacugacca

SEQ ID NO: 1268598 - RNA, 23 nt, Human
cuccucuucaacugaccagccuc

SEQ ID NO: 1268599 - RNA, 23 nt, Human
cuccucugugaccaaugucuuga

SEQ ID NO: 1268600 - RNA, 22 nt, Human
cuccucugugaccaaugucuug

SEQ ID NO: 1268601 - RNA, 13 nt, Human
cuccucugugacc

SEQ ID NO: 1268602 - RNA, 19 nt, Human
cuccucucugcccuaaugc

SEQ ID NO: 1268603 - RNA, 22 nt, Human
cuccuaagcaacuaggccuuca

SEQ ID NO: 1268604 - RNA, 14 nt, Human
cuccuaagcaccug

SEQ ID NO: 1268605 - RNA, 22 nt, Human
cuccuaagcaccuguaaugugc

SEQ ID NO: 1268606 - RNA, 13 nt, Human
cuccucucugccc

SEQ ID NO: 1268607 - RNA, 14 nt, Human
cuccucucugcccu

SEQ ID NO: 1268608 - RNA, 15 nt, Human
cuccucucugcccua

SEQ ID NO: 1268609 - RNA, 17 nt, Human
cuccguuagcuccugug

SEQ ID NO: 1268610 - RNA, 18 nt, Human
cuccguuagcuccugugg

SEQ ID NO: 1268611 - RNA, 21 nt, Human
cuccguuagcuccuguggccc

SEQ ID NO: 1268612 - RNA, 22 nt, Human
cuccguuagcuccuguggcccc

SEQ ID NO: 1268613 - RNA, 12 nt, Human
cuccguuggcca

SEQ ID NO: 1268614 - RNA, 20 nt, Human
cuccguuggccacuccgaga

SEQ ID NO: 1268615 - RNA, 17 nt, Human
cuccuaaaguacuggga

SEQ ID NO: 1268616 - RNA, 19 nt, Human
auugguguuuuuuucuaug

SEQ ID NO: 1268617 - RNA, 13 nt, Human
auugguguugcca

SEQ ID NO: 1268618 - RNA, 16 nt, Human
auugguguugccaguu

SEQ ID NO: 1268619 - RNA, 21 nt, Human
auugguguugccaguuguccu

SEQ ID NO: 1268620 - RNA, 22 nt, Human
auugguguugccaguuguccuc

SEQ ID NO: 1268621 - RNA, 19 nt, Human
auugguguaagguacuuuc

SEQ ID NO: 1268622 - RNA, 13 nt, Human
auuguauucagag

SEQ ID NO: 1268623 - RNA, 12 nt, Human
auuguauucugg

SEQ ID NO: 1268624 - RNA, 18 nt, Human
auugguguuuuuuucuau

SEQ ID NO: 1268625 - RNA, 18 nt, Human
auuguccaauccuauguu

SEQ ID NO: 1268626 - RNA, 16 nt, Human
auugugauuagacaga

SEQ ID NO: 1268627 - RNA, 22 nt, Human
auugugauuagacagaacaccu

SEQ ID NO: 1268628 - RNA, 18 nt, Human
auugugauucugccuuug

SEQ ID NO: 1268629 - RNA, 23 nt, Human
auugugaucagaccauaauguua

SEQ ID NO: 1268630 - RNA, 20 nt, Human
auugugguuuauauauuuaa

SEQ ID NO: 1268631 - RNA, 21 nt, Human
auugugguuuauauauuuaaa

SEQ ID NO: 1268632 - RNA, 14 nt, Human
auuguguagccuuu

SEQ ID NO: 1268633 - RNA, 15 nt, Human
auuguguagccuuuu

SEQ ID NO: 1268634 - RNA, 16 nt, Human
auuguguagccuuuuu

SEQ ID NO: 1268635 - RNA, 18 nt, Human
auuguguagccuuuuugu

SEQ ID NO: 1268636 - RNA, 22 nt, Human
auuguguagccuuuuuguauaa

SEQ ID NO: 1268637 - RNA, 17 nt, Human
auugugucagacuguuu

SEQ ID NO: 1268638 - RNA, 17 nt, Human
auugugucccauucccc

SEQ ID NO: 1268639 - RNA, 15 nt, Human
auugugcauucuaga

SEQ ID NO: 1268640 - RNA, 20 nt, Human
auugugcaguacuuugugca

SEQ ID NO: 1268641 - RNA, 20 nt, Human
auugugcaauguaaauauuu

SEQ ID NO: 1268642 - RNA, 15 nt, Human
auugugcaaugugua

SEQ ID NO: 1268643 - RNA, 16 nt, Human
auugugcaauguguau

SEQ ID NO: 1268644 - RNA, 17 nt, Human
auugugcaauguguaua

SEQ ID NO: 1268645 - RNA, 18 nt, Human
auugugcaauguguauaa

SEQ ID NO: 1268646 - RNA, 21 nt, Human
auugugcaauguguauaaaca

SEQ ID NO: 1268647 - RNA, 22 nt, Human
auugugcaauguguauaaacaa

SEQ ID NO: 1268648 - RNA, 23 nt, Human
auugugauuagacagaacaccua

SEQ ID NO: 1268649 - RNA, 15 nt, Human
auugugauuggccug

SEQ ID NO: 1268650 - RNA, 16 nt, Human
auugugauuggccugu

SEQ ID NO: 1268651 - RNA, 15 nt, Human
auugugcaauguaaa

SEQ ID NO: 1268652 - RNA, 17 nt, Human
auugugcaauguaaaua

SEQ ID NO: 1268653 - RNA, 18 nt, Human
auugugcaauguaaauau

SEQ ID NO: 1268654 - RNA, 14 nt, Human
auuuaaaacagaca

SEQ ID NO: 1268655 - RNA, 24 nt, Human
auucugucucuggauuauauuaug

SEQ ID NO: 1268656 - RNA, 14 nt, Human
auucugucuugaag

SEQ ID NO: 1268657 - RNA, 20 nt, Human
auucugugccuuguuuuuug

SEQ ID NO: 1268658 - RNA, 19 nt, Human
auucugguuccaggguccc

SEQ ID NO: 1268659 - RNA, 23 nt, Human
auucugguuccagggucccucug

SEQ ID NO: 1268660 - RNA, 17 nt, Human
auucugggggcugcagu

SEQ ID NO: 1268661 - RNA, 18 nt, Human
auucugucccuagguguu

SEQ ID NO: 1268662 - RNA, 14 nt, Human
auucugcaaguaua

SEQ ID NO: 1268663 - RNA, 17 nt, Human
auucugcaguaaaucuu

SEQ ID NO: 1268664 - RNA, 18 nt, Human
auucugcaguaaaucuuu

SEQ ID NO: 1268665 - RNA, 20 nt, Human
auucugcaguaaaucuuuua

SEQ ID NO: 1268666 - RNA, 21 nt, Human
auucugcaguaaaucuuuuac

SEQ ID NO: 1268667 - RNA, 23 nt, Human
auucugcaguaaaucuuuuacaa

SEQ ID NO: 1268668 - RNA, 13 nt, Human
auucugcuccuuc

SEQ ID NO: 1268669 - RNA, 13 nt, Human
auucugcuggccu

SEQ ID NO: 1268670 - RNA, 16 nt, Human
auucugcuggccucug

SEQ ID NO: 1268671 - RNA, 18 nt, Human
auucugcuggccucugcg

SEQ ID NO: 1268672 - RNA, 19 nt, Human
auucugcuggccucugcga

SEQ ID NO: 1268673 - RNA, 22 nt, Human
auucuggacaggauguguuugc

SEQ ID NO: 1268674 - RNA, 15 nt, Human
auucuggacaggaug

SEQ ID NO: 1268675 - RNA, 12 nt, Human
auucuggaccuc

SEQ ID NO: 1268676 - RNA, 16 nt, Human
auucuggaccucuggg

SEQ ID NO: 1268677 - RNA, 16 nt, Human
auucugggggcugcag

SEQ ID NO: 1268678 - RNA, 16 nt, Human
auucugguuccagggu

SEQ ID NO: 1268679 - RNA, 21 nt, Human
auucuucaagaucccauuuga

SEQ ID NO: 1268680 - RNA, 18 nt, Human
auucuucaagaucccauu

SEQ ID NO: 1268681 - RNA, 17 nt, Human
auucuuauuucaugaaa

SEQ ID NO: 1268682 - RNA, 12 nt, Human
auucuuccuuug

SEQ ID NO: 1268683 - RNA, 13 nt, Human
auucuuccuuugu

SEQ ID NO: 1268684 - RNA, 12 nt, Human
auucuucuagag

SEQ ID NO: 1268685 - RNA, 13 nt, Human
auucuucuagagu

SEQ ID NO: 1268686 - RNA, 14 nt, Human
auucuucuagaguu

SEQ ID NO: 1268687 - RNA, 15 nt, Human
auucuucucuguugu

SEQ ID NO: 1268688 - RNA, 16 nt, Human
auucuucucuguuguc

SEQ ID NO: 1268689 - RNA, 15 nt, Human
auucuucucuuccuu

SEQ ID NO: 1268690 - RNA, 21 nt, Human
auucuucucuuccuuuuauca

SEQ ID NO: 1268691 - RNA, 22 nt, Human
auucuuuuauacucagcuuucu

SEQ ID NO: 1268692 - RNA, 17 nt, Human
auugggggaggaaaagu

SEQ ID NO: 1268693 - RNA, 13 nt, Human
auugggguaguug

SEQ ID NO: 1268694 - RNA, 12 nt, Human
auugggguuauu

SEQ ID NO: 1268695 - RNA, 14 nt, Human
auugggguuauuuu

SEQ ID NO: 1268696 - RNA, 15 nt, Human
auuggguaucaccac

SEQ ID NO: 1268697 - RNA, 16 nt, Human
auugggccagcuuuuc

SEQ ID NO: 1268698 - RNA, 18 nt, Human
auugacccacaagaaaug

SEQ ID NO: 1268699 - RNA, 22 nt, Human
auugaaaauguccaggaaagug

SEQ ID NO: 1268700 - RNA, 21 nt, Human
auugacccacaagaaaugaaa

SEQ ID NO: 1268701 - RNA, 14 nt, Human
auuugaaccaauaa

SEQ ID NO: 1268702 - RNA, 20 nt, Human
auuugaacuuuuuauugauu

SEQ ID NO: 1268703 - RNA, 16 nt, Human
auuugaagaacaugug

SEQ ID NO: 1268704 - RNA, 15 nt, Human
auuugaaauaagaau

SEQ ID NO: 1268705 - RNA, 16 nt, Human
auuugaaauaagaauu

SEQ ID NO: 1268706 - RNA, 14 nt, Human
auuugaaauauuga

SEQ ID NO: 1268707 - RNA, 21 nt, Human
auuucuuuuuuaaaugaagaa

SEQ ID NO: 1268708 - RNA, 23 nt, Human
auuucuuuuugggagagacuugu

SEQ ID NO: 1268709 - RNA, 20 nt, Human
auuucuuuuugggagagacu

SEQ ID NO: 1268710 - RNA, 21 nt, Human
auuucuuuuugggagagacuu

SEQ ID NO: 1268711 - RNA, 18 nt, Human
auuucuuuuuuaaaugaa

SEQ ID NO: 1268712 - RNA, 22 nt, Human
auuucuuuuuuaaaugaagaaa

SEQ ID NO: 1268713 - RNA, 15 nt, Human
auuuccccuccuucc

SEQ ID NO: 1268714 - RNA, 16 nt, Human
auuuccccuccuuccc

SEQ ID NO: 1268715 - RNA, 21 nt, Human
auuucuaauuauguagcucuu

SEQ ID NO: 1268716 - RNA, 22 nt, Human
auuucuaauuauguagcucuuu

SEQ ID NO: 1268717 - RNA, 17 nt, Human
auuucuaccauuucaga

SEQ ID NO: 1268718 - RNA, 18 nt, Human
auuucuaccauuucagag

SEQ ID NO: 1268719 - RNA, 18 nt, Human
auuucuacuuugaaguca

SEQ ID NO: 1268720 - RNA, 16 nt, Human
auuucuagcuuaucua

SEQ ID NO: 1268721 - RNA, 18 nt, Human
auuucuagcuuaucuacu

SEQ ID NO: 1268722 - RNA, 21 nt, Human
auuucuagcuuaucuacuucc

SEQ ID NO: 1268723 - RNA, 19 nt, Human
auuuauuuuaauaauguuu

SEQ ID NO: 1268724 - RNA, 20 nt, Human
auuuauuuuaauaauguuuc

SEQ ID NO: 1268725 - RNA, 21 nt, Human
auuuauuuuaauaauguuuca

SEQ ID NO: 1268726 - RNA, 15 nt, Human
auuucaaaaugauuu

SEQ ID NO: 1268727 - RNA, 13 nt, Human
auuucaaaaugcu

SEQ ID NO: 1268728 - RNA, 14 nt, Human
auuucaaaaugcuu

SEQ ID NO: 1268729 - RNA, 15 nt, Human
auuucaaaaugcuuu

SEQ ID NO: 1268730 - RNA, 21 nt, Human
auuucaaaaugcuuuuuauua

SEQ ID NO: 1268731 - RNA, 16 nt, Human
auuucaaacggccuca

SEQ ID NO: 1268732 - RNA, 16 nt, Human
auuucaaaaugcuuuu

SEQ ID NO: 1268733 - RNA, 17 nt, Human
auuucaaauuggagcuu

SEQ ID NO: 1268734 - RNA, 18 nt, Human
auuucauuucaacuguuu

SEQ ID NO: 1268735 - RNA, 22 nt, Human
auuucauuugugccagaaugcu

SEQ ID NO: 1268736 - RNA, 20 nt, Human
auuuccagugaaaucaguua

SEQ ID NO: 1268737 - RNA, 13 nt, Human
auuuccacugugc

SEQ ID NO: 1268738 - RNA, 18 nt, Human
auuucccaugauuucaug

SEQ ID NO: 1268739 - RNA, 22 nt, Human
auuuccauauaaauauuagaaa

SEQ ID NO: 1268740 - RNA, 13 nt, Human
auuuauuccuuug

SEQ ID NO: 1268741 - RNA, 17 nt, Human
auuuauucauauuuucu

SEQ ID NO: 1268742 - RNA, 23 nt, Human
auuuauaaaaauaaaaaacacug

SEQ ID NO: 1268743 - RNA, 12 nt, Human
auuuauuaauau

SEQ ID NO: 1268744 - RNA, 20 nt, Human
auuuauuaauauauauuauc

SEQ ID NO: 1268745 - RNA, 22 nt, Human
auuuauaaaaauaaaaaacacu

SEQ ID NO: 1268746 - RNA, 17 nt, Human
auuuauaaaaauaaaaa

SEQ ID NO: 1268747 - RNA, 15 nt, Human
auuuaguguauccau

SEQ ID NO: 1268748 - RNA, 12 nt, Human
auuuaguuucag

SEQ ID NO: 1268749 - RNA, 14 nt, Human
auuuaguuucagua

SEQ ID NO: 1268750 - RNA, 20 nt, Human
auuuaguuucaguagauugc

SEQ ID NO: 1268751 - RNA, 15 nt, Human
auuuaguuugauuau

SEQ ID NO: 1268752 - RNA, 22 nt, Human
auuuaguuugauuauucagugu

SEQ ID NO: 1268753 - RNA, 23 nt, Human
auuuaguuucaguagauugcaga

SEQ ID NO: 1268754 - RNA, 16 nt, Human
auuuauaaaaaggugu

SEQ ID NO: 1268755 - RNA, 13 nt, Human
auuuagauguaua

SEQ ID NO: 1268756 - RNA, 19 nt, Human
auuuagacuuggauucuuu

SEQ ID NO: 1268757 - RNA, 23 nt, Human
auuuagacuuggauucuuuccau

SEQ ID NO: 1268758 - RNA, 17 nt, Human
auuuagaugauaaagag

SEQ ID NO: 1268759 - RNA, 14 nt, Human
auuuagauuugugu

SEQ ID NO: 1268760 - RNA, 13 nt, Human
auuuaguguucau

SEQ ID NO: 1268761 - RNA, 14 nt, Human
auuuagucauguga

SEQ ID NO: 1268762 - RNA, 13 nt, Human
auuuagugagcau

SEQ ID NO: 1268763 - RNA, 21 nt, Human
auuuagugaucaaauugugca

SEQ ID NO: 1268764 - RNA, 20 nt, Human
auuuaguaucuuuuuauuca

SEQ ID NO: 1268765 - RNA, 18 nt, Human
auuuaguauuuuguuuca

SEQ ID NO: 1268766 - RNA, 16 nt, Human
auuuagucaugugacc

SEQ ID NO: 1268767 - RNA, 23 nt, Human
auuuaaauguuaugacuauguaa

SEQ ID NO: 1268768 - RNA, 17 nt, Human
auuuaaauuuuuuuccu

SEQ ID NO: 1268769 - RNA, 13 nt, Human
auuuaacaagauc

SEQ ID NO: 1268770 - RNA, 13 nt, Human
auuuaacagaaau

SEQ ID NO: 1268771 - RNA, 13 nt, Human
auuuaaaaaacua

SEQ ID NO: 1268772 - RNA, 17 nt, Human
auuuaaaaaacuaaaaa

SEQ ID NO: 1268773 - RNA, 22 nt, Human
auuuaaaaaacuaaaaacuaga

SEQ ID NO: 1268774 - RNA, 12 nt, Human
auuuaaaaauaa

SEQ ID NO: 1268775 - RNA, 18 nt, Human
auuuaaaaauaagucaac

SEQ ID NO: 1268776 - RNA, 19 nt, Human
auuuaaaaauaagucaaca

SEQ ID NO: 1268777 - RNA, 22 nt, Human
auuuaaaaauaagucaacagua

SEQ ID NO: 1268778 - RNA, 23 nt, Human
auuuaaaaauaagucaacaguaa

SEQ ID NO: 1268779 - RNA, 18 nt, Human
auuuagaaaacuuuaaag

SEQ ID NO: 1268780 - RNA, 12 nt, Human
auuuagaagcca

SEQ ID NO: 1268781 - RNA, 13 nt, Human
auuuagaagccaa

SEQ ID NO: 1268782 - RNA, 21 nt, Human
auuuagaagccaacuaugauu

SEQ ID NO: 1268783 - RNA, 22 nt, Human
auuuagaagccaacuaugauua

SEQ ID NO: 1268784 - RNA, 23 nt, Human
auuuagaagccaacuaugauuau

SEQ ID NO: 1268785 - RNA, 21 nt, Human
auuuuauuuuuuucugaauua

SEQ ID NO: 1268786 - RNA, 15 nt, Human
auuuucaaaaccagg

SEQ ID NO: 1268787 - RNA, 17 nt, Human
auuuucaaaaccagguc

SEQ ID NO: 1268788 - RNA, 16 nt, Human
auuuucaaaaccaggu

SEQ ID NO: 1268789 - RNA, 15 nt, Human
auuuucaaagacuua

SEQ ID NO: 1268790 - RNA, 13 nt, Human
auuuuagcagaga

SEQ ID NO: 1268791 - RNA, 17 nt, Human
auuuuagccuucucugu

SEQ ID NO: 1268792 - RNA, 18 nt, Human
auuuuagccuucucuguu

SEQ ID NO: 1268793 - RNA, 21 nt, Human
auuuuagccuucucuguucau

SEQ ID NO: 1268794 - RNA, 18 nt, Human
auuuucaacgcagcccug

SEQ ID NO: 1268795 - RNA, 16 nt, Human
auuuucaaagacuuaa

SEQ ID NO: 1268796 - RNA, 17 nt, Human
auuuucaaagacuuaag

SEQ ID NO: 1268797 - RNA, 22 nt, Human
auuuucaaagcuuuuuccagag

SEQ ID NO: 1268798 - RNA, 20 nt, Human
auuuucaacgcagcccugcu

SEQ ID NO: 1268799 - RNA, 13 nt, Human
auuuucaagaaac

SEQ ID NO: 1268800 - RNA, 14 nt, Human
auuuucaagaaacu

SEQ ID NO: 1268801 - RNA, 16 nt, Human
auuuucaagaaacuga

SEQ ID NO: 1268802 - RNA, 17 nt, Human
auuuucaagaaacugag

SEQ ID NO: 1268803 - RNA, 22 nt, Human
auuuucaagaaacugaggaauu

SEQ ID NO: 1268804 - RNA, 23 nt, Human
auuuucaagaaacugaggaauuu

SEQ ID NO: 1268805 - RNA, 24 nt, Human
auuuucaagaauaaucacgcuuuc

SEQ ID NO: 1268806 - RNA, 17 nt, Human
auuuucaacauuucaaa

SEQ ID NO: 1268807 - RNA, 21 nt, Human
auuuucaacauuucaaaauga

SEQ ID NO: 1268808 - RNA, 14 nt, Human
auuuucacuguguc

SEQ ID NO: 1268809 - RNA, 13 nt, Human
auuuucacuguag

SEQ ID NO: 1268810 - RNA, 16 nt, Human
auuuucaauagccacu

SEQ ID NO: 1268811 - RNA, 20 nt, Human
auuuucaauagccacuaacc

SEQ ID NO: 1268812 - RNA, 17 nt, Human
auuuucaauagccacua

SEQ ID NO: 1268813 - RNA, 17 nt, Human
auuuuccaaauguaaua

SEQ ID NO: 1268814 - RNA, 19 nt, Human
auuuuccaggacuguuuca

SEQ ID NO: 1268815 - RNA, 15 nt, Human
auuuuccaggcuucu

SEQ ID NO: 1268816 - RNA, 21 nt, Human
auuuuccaggcuucugcuggg

SEQ ID NO: 1268817 - RNA, 21 nt, Human
auuuuccuaauaaaguucugu

SEQ ID NO: 1268818 - RNA, 20 nt, Human
auuuuccuauauuacgguuu

SEQ ID NO: 1268819 - RNA, 17 nt, Human
auuuucauccuugucuu

SEQ ID NO: 1268820 - RNA, 15 nt, Human
auuuucauuauuccu

SEQ ID NO: 1268821 - RNA, 14 nt, Human
auuuuccaaagagu

SEQ ID NO: 1268822 - RNA, 14 nt, Human
auuuuccaaaugua

SEQ ID NO: 1268823 - RNA, 22 nt, Human
auuuucaguuauuauauuuaca

SEQ ID NO: 1268824 - RNA, 20 nt, Human
auuuucauaaguauuucaaa

SEQ ID NO: 1268825 - RNA, 21 nt, Human
auuuucauaaguauuucaaau

SEQ ID NO: 1268826 - RNA, 22 nt, Human
auuuucauaaguauuucaaauu

SEQ ID NO: 1268827 - RNA, 13 nt, Human
auuuucacugugu

SEQ ID NO: 1268828 - RNA, 17 nt, Human
auuuucagcaaacucuu

SEQ ID NO: 1268829 - RNA, 18 nt, Human
auuuucagcaaacucuuu

SEQ ID NO: 1268830 - RNA, 19 nt, Human
auuuucagcaaacucuuuu

SEQ ID NO: 1268831 - RNA, 17 nt, Human
auuuuaaaaaaugguca

SEQ ID NO: 1268832 - RNA, 16 nt, Human
auuuuaaaaaaugguc

SEQ ID NO: 1268833 - RNA, 13 nt, Human
auuuuaaaauuug

SEQ ID NO: 1268834 - RNA, 14 nt, Human
auuuuaaaauuugu

SEQ ID NO: 1268835 - RNA, 17 nt, Human
auuuuaaaauuuguucu

SEQ ID NO: 1268836 - RNA, 18 nt, Human
auuuuaaaagaaugauua

SEQ ID NO: 1268837 - RNA, 22 nt, Human
auuuuaaaagaaugauuaugaa

SEQ ID NO: 1268838 - RNA, 13 nt, Human
auuuuaaacaaag

SEQ ID NO: 1268839 - RNA, 22 nt, Human
auuuuaaacaaagguugagaug

SEQ ID NO: 1268840 - RNA, 15 nt, Human
auuuuaaaauuuguu

SEQ ID NO: 1268841 - RNA, 13 nt, Human
auuuuaaacacau

SEQ ID NO: 1268842 - RNA, 14 nt, Human
auuuuaaacacauu

SEQ ID NO: 1268843 - RNA, 23 nt, Human
auuuuaaacacauuaggaaaagu

SEQ ID NO: 1268844 - RNA, 15 nt, Human
auuuuaaacagagga

SEQ ID NO: 1268845 - RNA, 12 nt, Human
auuuuaaagaau

SEQ ID NO: 1268846 - RNA, 13 nt, Human
auuuuaaagaauu

SEQ ID NO: 1268847 - RNA, 17 nt, Human
auuuuaaagaauugugu

SEQ ID NO: 1268848 - RNA, 12 nt, Human
auuuuaaagaca

SEQ ID NO: 1268849 - RNA, 22 nt, Human
auuuuaauguacuaauauuucu

SEQ ID NO: 1268850 - RNA, 13 nt, Human
auuuuaauuauua

SEQ ID NO: 1268851 - RNA, 19 nt, Human
auuuuaauuauuauucuuc

SEQ ID NO: 1268852 - RNA, 17 nt, Human
auuuuaccuuugacaaa

SEQ ID NO: 1268853 - RNA, 15 nt, Human
auuuuacauuaaauu

SEQ ID NO: 1268854 - RNA, 12 nt, Human
auuuuacauuaa

SEQ ID NO: 1268855 - RNA, 14 nt, Human
auuuuacaugaagu

SEQ ID NO: 1268856 - RNA, 19 nt, Human
auuuuacaugaaguauuuu

SEQ ID NO: 1268857 - RNA, 13 nt, Human
auuuuacaugaag

SEQ ID NO: 1268858 - RNA, 16 nt, Human
auuuuacauaaauuua

SEQ ID NO: 1268859 - RNA, 17 nt, Human
auuuuacauaaauuuag

SEQ ID NO: 1268860 - RNA, 23 nt, Human
auuuuaauuauuauucuucauaa

SEQ ID NO: 1268861 - RNA, 18 nt, Human
auuuguauaaaauaauuu

SEQ ID NO: 1268862 - RNA, 19 nt, Human
auuuguauaaaauaauuuu

SEQ ID NO: 1268863 - RNA, 21 nt, Human
auuuguauaaaauaauuuuua

SEQ ID NO: 1268864 - RNA, 13 nt, Human
auuugaaguguaa

SEQ ID NO: 1268865 - RNA, 14 nt, Human
auuugaaucagccu

SEQ ID NO: 1268866 - RNA, 23 nt, Human
auuugaaucagccuacaggccuc

SEQ ID NO: 1268867 - RNA, 17 nt, Human
auuuuaaaagaaugauu

SEQ ID NO: 1268868 - RNA, 18 nt, Human
auuuguuuuuaaacugua

SEQ ID NO: 1268869 - RNA, 20 nt, Human
auuuguuuuuaaacuguaca

SEQ ID NO: 1268870 - RNA, 22 nt, Human
auuuguuuuuaaacuguacagu

SEQ ID NO: 1268871 - RNA, 21 nt, Human
auuuguuuuuaaacuguacag

SEQ ID NO: 1268872 - RNA, 15 nt, Human
auuuguuuuggauau

SEQ ID NO: 1268873 - RNA, 16 nt, Human
auuuguuuuggauaua

SEQ ID NO: 1268874 - RNA, 15 nt, Human
auuuguuuuguuuac

SEQ ID NO: 1268875 - RNA, 16 nt, Human
auuuguuuuguuuaca

SEQ ID NO: 1268876 - RNA, 18 nt, Human
auuuguuuuguuuacaga

SEQ ID NO: 1268877 - RNA, 16 nt, Human
auuuguuuuuaaacug

SEQ ID NO: 1268878 - RNA, 17 nt, Human
auuuguuuuuaaacugu

SEQ ID NO: 1268879 - RNA, 14 nt, Human
auuugugacaaaaa

SEQ ID NO: 1268880 - RNA, 15 nt, Human
auuugugacaaaaaa

SEQ ID NO: 1268881 - RNA, 17 nt, Human
auuugugacaaaaaauu

SEQ ID NO: 1268882 - RNA, 15 nt, Human
auuuuaaagaccccu

SEQ ID NO: 1268883 - RNA, 18 nt, Human
auuuugguccaaguugug

SEQ ID NO: 1268884 - RNA, 23 nt, Human
auguguguuuuaaaaugagaaau

SEQ ID NO: 1268885 - RNA, 16 nt, Human
auguguguguguguau

SEQ ID NO: 1268886 - RNA, 16 nt, Human
auguguguuuugcuaa

SEQ ID NO: 1268887 - RNA, 12 nt, Human
augugugugugc

SEQ ID NO: 1268888 - RNA, 20 nt, Human
auguggccccugaacaagaa

SEQ ID NO: 1268889 - RNA, 22 nt, Human
auguggccccugaacaagaauu

SEQ ID NO: 1268890 - RNA, 13 nt, Human
auguggcuggaag

SEQ ID NO: 1268891 - RNA, 14 nt, Human
auguggcuggaaga

SEQ ID NO: 1268892 - RNA, 20 nt, Human
auguggcuggaagauccugc

SEQ ID NO: 1268893 - RNA, 20 nt, Human
augugcuaguaauuggaaag

SEQ ID NO: 1268894 - RNA, 18 nt, Human
auguggaccuuagaauac

SEQ ID NO: 1268895 - RNA, 18 nt, Human
auguggcaaggaaaaaca

SEQ ID NO: 1268896 - RNA, 13 nt, Human
auguggcaggggu

SEQ ID NO: 1268897 - RNA, 18 nt, Human
auguggccccugaacaag

SEQ ID NO: 1268898 - RNA, 19 nt, Human
augugcuaguaauuggaaa

SEQ ID NO: 1268899 - RNA, 11 nt, Human
augugccuauu

SEQ ID NO: 1268900 - RNA, 19 nt, Human
augugccuauugcuagagc

SEQ ID NO: 1268901 - RNA, 23 nt, Human
augugccuauugcuagagcuccu

SEQ ID NO: 1268902 - RNA, 20 nt, Human
augugccuauugcuagagcu

SEQ ID NO: 1268903 - RNA, 20 nt, Human
uuuuaauaauguuucaaaca

SEQ ID NO: 1268904 - RNA, 19 nt, Human
augugcccaguuaaucuug

SEQ ID NO: 1268905 - RNA, 16 nt, Human
uuuuaauaauguuuca

SEQ ID NO: 1268906 - RNA, 12 nt, Human
uuuuaauaaugu

SEQ ID NO: 1268907 - RNA, 19 nt, Human
uuuuaauaaaaauaauuuu

SEQ ID NO: 1268908 - RNA, 15 nt, Human
uuuuaauaaaagaaa

SEQ ID NO: 1268909 - RNA, 12 nt, Human
uuuuaauaaauu

SEQ ID NO: 1268910 - RNA, 14 nt, Human
uuuuaauaaauuuc

SEQ ID NO: 1268911 - RNA, 13 nt, Human
uuuuaauaauguu

SEQ ID NO: 1268912 - RNA, 14 nt, Human
uuuuaauaauguuu

SEQ ID NO: 1268913 - RNA, 14 nt, Human
uuuuaauaaacacu

SEQ ID NO: 1268914 - RNA, 19 nt, Human
uuuuaaguuucucugcaga

SEQ ID NO: 1268915 - RNA, 20 nt, Human
uuuuaaguuucucugcagaa

SEQ ID NO: 1268916 - RNA, 16 nt, Human
auguucagauuauugg

SEQ ID NO: 1268917 - RNA, 23 nt, Human
auguucagaagguugcucuagau

SEQ ID NO: 1268918 - RNA, 22 nt, Human
auguucacuuuugacaaaggca

SEQ ID NO: 1268919 - RNA, 12 nt, Human
auguuagccagg

SEQ ID NO: 1268920 - RNA, 20 nt, Human
auguuaagggaagaauucca

SEQ ID NO: 1268921 - RNA, 15 nt, Human
auguuaauauugauu

SEQ ID NO: 1268922 - RNA, 14 nt, Human
auguuaaguuauau

SEQ ID NO: 1268923 - RNA, 17 nt, Human
auguuacuacaugcacu

SEQ ID NO: 1268924 - RNA, 16 nt, Human
auguuaaaauguguug

SEQ ID NO: 1268925 - RNA, 23 nt, Human
auguguguuuugcuaaaggaaaa

SEQ ID NO: 1268926 - RNA, 22 nt, Human
auguguuggggaagggccugcc

SEQ ID NO: 1268927 - RNA, 17 nt, Human
auguguuuacuuuaugu

SEQ ID NO: 1268928 - RNA, 19 nt, Human
auguuaaaaaaauaagaag

SEQ ID NO: 1268929 - RNA, 22 nt, Human
auguuaaaaaaauaagaagaau

SEQ ID NO: 1268930 - RNA, 12 nt, Human
auguuaaaaugu

SEQ ID NO: 1268931 - RNA, 21 nt, Human
auguuaaaaaaauaagaagaa

SEQ ID NO: 1268932 - RNA, 14 nt, Human
auguuaaaaugugu

SEQ ID NO: 1268933 - RNA, 15 nt, Human
auguuaaaauguguu

SEQ ID NO: 1268934 - RNA, 20 nt, Human
auguugcccuguugcugccu

SEQ ID NO: 1268935 - RNA, 17 nt, Human
uuuuacuuuuaaacugu

SEQ ID NO: 1268936 - RNA, 18 nt, Human
uuuuacuuuuaaacugug

SEQ ID NO: 1268937 - RNA, 20 nt, Human
uuuuacuuuuaaacugugua

SEQ ID NO: 1268938 - RNA, 12 nt, Human
uuuuacuuuugu

SEQ ID NO: 1268939 - RNA, 13 nt, Human
uuuuagcuuuugu

SEQ ID NO: 1268940 - RNA, 12 nt, Human
uuuuaggaaaug

SEQ ID NO: 1268941 - RNA, 11 nt, Human
uuuuaggaaau

SEQ ID NO: 1268942 - RNA, 18 nt, Human
uuuuaggaagcaagcuua

SEQ ID NO: 1268943 - RNA, 20 nt, Human
uuuuaggagcuaaggcucua

SEQ ID NO: 1268944 - RNA, 23 nt, Human
uuuuaggagcuaaggcucuauga

SEQ ID NO: 1268945 - RNA, 18 nt, Human
auguugcauagaauaaaa

SEQ ID NO: 1268946 - RNA, 17 nt, Human
auguugcauagaauaaa

SEQ ID NO: 1268947 - RNA, 18 nt, Human
auguucaucaaugaauga

SEQ ID NO: 1268948 - RNA, 16 nt, Human
auguucagcacugucc

SEQ ID NO: 1268949 - RNA, 19 nt, Human
auguucagcacugucccuu

SEQ ID NO: 1268950 - RNA, 22 nt, Human
auguucagcacugucccuugcc

SEQ ID NO: 1268951 - RNA, 22 nt, Human
auguugccauccuaccgucuuu

SEQ ID NO: 1268952 - RNA, 20 nt, Human
uuuucuggccaguguuuaaa

SEQ ID NO: 1268953 - RNA, 14 nt, Human
uuuucucuaggaaa

SEQ ID NO: 1268954 - RNA, 13 nt, Human
uuuucuccuccca

SEQ ID NO: 1268955 - RNA, 14 nt, Human
uuuucuccucccag

SEQ ID NO: 1268956 - RNA, 19 nt, Human
uuuucuccucccaggaacu

SEQ ID NO: 1268957 - RNA, 21 nt, Human
uuuucucgcuguccuuucuag

SEQ ID NO: 1268958 - RNA, 16 nt, Human
uuuucucuaggaaaua

SEQ ID NO: 1268959 - RNA, 23 nt, Human
uuuucucccuggauuuuuaccag

SEQ ID NO: 1268960 - RNA, 19 nt, Human
uuuucaucuucaguugucu

SEQ ID NO: 1268961 - RNA, 21 nt, Human
uuuucaugauuuugaaaccau

SEQ ID NO: 1268962 - RNA, 21 nt, Human
uuuucaugauuuugaaaucau

SEQ ID NO: 1268963 - RNA, 17 nt, Human
uuuucaugcaaacucuu

SEQ ID NO: 1268964 - RNA, 18 nt, Human
uuuucauccauaacugaa

SEQ ID NO: 1268965 - RNA, 20 nt, Human
uuuucauccauaacugaaca

SEQ ID NO: 1268966 - RNA, 13 nt, Human
uuuucauccuaaa

SEQ ID NO: 1268967 - RNA, 14 nt, Human
uuuucaucuucagu

SEQ ID NO: 1268968 - RNA, 16 nt, Human
uuuucaucuucaguug

SEQ ID NO: 1268969 - RNA, 21 nt, Human
uuuucaucuucaguugucucu

SEQ ID NO: 1268970 - RNA, 13 nt, Human
uuuucauuuaucu

SEQ ID NO: 1268971 - RNA, 22 nt, Human
uuuucucccuggauuuuuacca

SEQ ID NO: 1268972 - RNA, 21 nt, Human
uuuucuccucacuguauccag

SEQ ID NO: 1268973 - RNA, 12 nt, Human
uuuuauuaugaa

SEQ ID NO: 1268974 - RNA, 19 nt, Human
uuuuauuaaugcacuuucu

SEQ ID NO: 1268975 - RNA, 19 nt, Human
uuuuauuaauuuuaguuuu

SEQ ID NO: 1268976 - RNA, 15 nt, Human
uuuuauuaguauugu

SEQ ID NO: 1268977 - RNA, 14 nt, Human
uuuuagguucuaaa

SEQ ID NO: 1268978 - RNA, 15 nt, Human
uuuuagguucuaaag

SEQ ID NO: 1268979 - RNA, 16 nt, Human
uuuuagguucuaaagu

SEQ ID NO: 1268980 - RNA, 18 nt, Human
uuuuagguucuaaaguuc

SEQ ID NO: 1268981 - RNA, 23 nt, Human
uuuuagguucuaaaguucuaaga

SEQ ID NO: 1268982 - RNA, 14 nt, Human
uuuuauuaaugcac

SEQ ID NO: 1268983 - RNA, 12 nt, Human
uuuuagguucua

SEQ ID NO: 1268984 - RNA, 13 nt, Human
uuuuagguucuaa

SEQ ID NO: 1268985 - RNA, 20 nt, Human
uuuuauuaguauuguugucc

SEQ ID NO: 1268986 - RNA, 22 nt, Human
uuuuauuaguauuguuguccuu

SEQ ID NO: 1268987 - RNA, 23 nt, Human
uuuuauuaguauuguuguccuuu

SEQ ID NO: 1268988 - RNA, 14 nt, Human
uuuuauuaugcauu

SEQ ID NO: 1268989 - RNA, 13 nt, Human
uuuuauuuaaaaa

SEQ ID NO: 1268990 - RNA, 22 nt, Human
uuuucaguuuauuugaaccaau

SEQ ID NO: 1268991 - RNA, 12 nt, Human
uuuucaguuguu

SEQ ID NO: 1268992 - RNA, 16 nt, Human
uuuucauacauuuucu

SEQ ID NO: 1268993 - RNA, 18 nt, Human
uuuucauacauuuucuaa

SEQ ID NO: 1268994 - RNA, 21 nt, Human
uuuucauacauuuucuaagaa

SEQ ID NO: 1268995 - RNA, 15 nt, Human
uuuucauaggucuga

SEQ ID NO: 1268996 - RNA, 17 nt, Human
uuuucauaggucugaaa

SEQ ID NO: 1268997 - RNA, 16 nt, Human
uuuucauaggucugaa

SEQ ID NO: 1268998 - RNA, 16 nt, Human
uuuuauuuccuaugau

SEQ ID NO: 1268999 - RNA, 18 nt, Human
uuuuauuuccuaugaugu

SEQ ID NO: 1269000 - RNA, 11 nt, Human
uuuuauuuccu

SEQ ID NO: 1269001 - RNA, 15 nt, Human
uuuuauuugcaugug

SEQ ID NO: 1269002 - RNA, 17 nt, Human
uuuuauuuucaaaacca

SEQ ID NO: 1269003 - RNA, 13 nt, Human
uuuucaguuacuu

SEQ ID NO: 1269004 - RNA, 15 nt, Human
uuuucaguuguucuu

SEQ ID NO: 1269005 - RNA, 17 nt, Human
auguuuucaggcuagau

SEQ ID NO: 1269006 - RNA, 21 nt, Human
auguuuucaggcuagauguau

SEQ ID NO: 1269007 - RNA, 23 nt, Human
auguuuuggccaaugcaccuaaa

SEQ ID NO: 1269008 - RNA, 14 nt, Human
auguuuaucugcuu

SEQ ID NO: 1269009 - RNA, 14 nt, Human
uuuucugguucuaa

SEQ ID NO: 1269010 - RNA, 15 nt, Human
uuuucugguucuaac

SEQ ID NO: 1269011 - RNA, 17 nt, Human
uuuucugguucuaacau

SEQ ID NO: 1269012 - RNA, 14 nt, Human
uuuucuguaauuca

SEQ ID NO: 1269013 - RNA, 14 nt, Human
uuuucuguaccagu

SEQ ID NO: 1269014 - RNA, 21 nt, Human
uuuucuguaccaguuaauuuu

SEQ ID NO: 1269015 - RNA, 17 nt, Human
uuuucuguauaaauguc

SEQ ID NO: 1269016 - RNA, 17 nt, Human
uuuucugugccugaaua

SEQ ID NO: 1269017 - RNA, 18 nt, Human
uuuucugugccugaauau

SEQ ID NO: 1269018 - RNA, 15 nt, Human
auguuguguuuuuaa

SEQ ID NO: 1269019 - RNA, 12 nt, Human
auguuguuauuu

SEQ ID NO: 1269020 - RNA, 13 nt, Human
auguuguuauuua

SEQ ID NO: 1269021 - RNA, 14 nt, Human
auguuguuauuuaa

SEQ ID NO: 1269022 - RNA, 15 nt, Human
auguuguuauuuaaa

SEQ ID NO: 1269023 - RNA, 17 nt, Human
auguuguuauuuaaaga

SEQ ID NO: 1269024 - RNA, 14 nt, Human
auguuguugaaagg

SEQ ID NO: 1269025 - RNA, 17 nt, Human
auguuuaguaaucauau

SEQ ID NO: 1269026 - RNA, 17 nt, Human
auuaaaccggaccaucu

SEQ ID NO: 1269027 - RNA, 14 nt, Human
auuaaacgauuuuu

SEQ ID NO: 1269028 - RNA, 15 nt, Human
auuaaacgauuuuua

SEQ ID NO: 1269029 - RNA, 22 nt, Human
auuaaacgauuuuuaaaaugua

SEQ ID NO: 1269030 - RNA, 21 nt, Human
auuaaacgauuuuuaaaaugu

SEQ ID NO: 1269031 - RNA, 18 nt, Human
auuaaacuuuuaauucau

SEQ ID NO: 1269032 - RNA, 19 nt, Human
auuaaacuuuuaauucauu

SEQ ID NO: 1269033 - RNA, 23 nt, Human
auuaaacaugacuccauagaccu

SEQ ID NO: 1269034 - RNA, 16 nt, Human
auuaaaagaauaucug

SEQ ID NO: 1269035 - RNA, 14 nt, Human
auuaaaagaauauc

SEQ ID NO: 1269036 - RNA, 14 nt, Human
auuaaaccaucucc

SEQ ID NO: 1269037 - RNA, 16 nt, Human
auuaaaccaucucccu

SEQ ID NO: 1269038 - RNA, 17 nt, Human
auuaaaccaucucccug

SEQ ID NO: 1269039 - RNA, 18 nt, Human
auuaaaccaucucccugg

SEQ ID NO: 1269040 - RNA, 22 nt, Human
auuaaaccaucucccuggugcu

SEQ ID NO: 1269041 - RNA, 13 nt, Human
uuuuguuuccuuu

SEQ ID NO: 1269042 - RNA, 18 nt, Human
uuuuguuucaaugaggug

SEQ ID NO: 1269043 - RNA, 16 nt, Human
uuuuguuuaccagaga

SEQ ID NO: 1269044 - RNA, 16 nt, Human
uuuuguucaaagccag

SEQ ID NO: 1269045 - RNA, 15 nt, Human
uuuuguuauuaaaca

SEQ ID NO: 1269046 - RNA, 19 nt, Human
uuuugugauggagugcugu

SEQ ID NO: 1269047 - RNA, 21 nt, Human
uuuugugaugucccaacuugu

SEQ ID NO: 1269048 - RNA, 13 nt, Human
uuuugcugagacu

SEQ ID NO: 1269049 - RNA, 22 nt, Human
uuuugcuguaauguuaauauug

SEQ ID NO: 1269050 - RNA, 17 nt, Human
uuuugcccauuuugaau

SEQ ID NO: 1269051 - RNA, 15 nt, Human
uuuugccuuuugcaa

SEQ ID NO: 1269052 - RNA, 21 nt, Human
uuuugcgguucaggaaaauug

SEQ ID NO: 1269053 - RNA, 19 nt, Human
uuuugcugagacuaaucuu

SEQ ID NO: 1269054 - RNA, 13 nt, Human
uuuugcuggaaua

SEQ ID NO: 1269055 - RNA, 12 nt, Human
uuuuuaucaugu

SEQ ID NO: 1269056 - RNA, 17 nt, Human
uuuuuaucaugcauguc

SEQ ID NO: 1269057 - RNA, 19 nt, Human
uuuuuauauuugaaauauu

SEQ ID NO: 1269058 - RNA, 12 nt, Human
uuuuuaggaaau

SEQ ID NO: 1269059 - RNA, 13 nt, Human
uuuuuaggaaaug

SEQ ID NO: 1269060 - RNA, 20 nt, Human
uuuuuaggaagcaagcuuaa

SEQ ID NO: 1269061 - RNA, 12 nt, Human
uuuuuaguugaa

SEQ ID NO: 1269062 - RNA, 15 nt, Human
uuuuuaguugaauuu

SEQ ID NO: 1269063 - RNA, 22 nt, Human
uuuuguuugcuucauguguccc

SEQ ID NO: 1269064 - RNA, 20 nt, Human
uuuuuacccauuuguucaua

SEQ ID NO: 1269065 - RNA, 15 nt, Human
uuuuuacugcucuga

SEQ ID NO: 1269066 - RNA, 12 nt, Human
uuuugcagcuuu

SEQ ID NO: 1269067 - RNA, 9 nt, Human
uuuugcagu

SEQ ID NO: 1269068 - RNA, 13 nt, Human
uuuugcaguaacu

SEQ ID NO: 1269069 - RNA, 14 nt, Human
uuuugcaguaacug

SEQ ID NO: 1269070 - RNA, 16 nt, Human
uuuugcaguaacuguu

SEQ ID NO: 1269071 - RNA, 15 nt, Human
uuuugcaguaacugu

SEQ ID NO: 1269072 - RNA, 18 nt, Human
uuuugcauuuaaaacaga

SEQ ID NO: 1269073 - RNA, 15 nt, Human
uuuugccauuaaacu

SEQ ID NO: 1269074 - RNA, 19 nt, Human
uuuugcccauuuugaauca

SEQ ID NO: 1269075 - RNA, 13 nt, Human
uuuugcccuuuga

SEQ ID NO: 1269076 - RNA, 14 nt, Human
uuuugccacagcuu

SEQ ID NO: 1269077 - RNA, 16 nt, Human
uuuugccacagcuuuu

SEQ ID NO: 1269078 - RNA, 20 nt, Human
uuuugccacagcuuuugcaa

SEQ ID NO: 1269079 - RNA, 16 nt, Human
uuuugauauuucuagc

SEQ ID NO: 1269080 - RNA, 16 nt, Human
uuuugaugaguuguga

SEQ ID NO: 1269081 - RNA, 23 nt, Human
uuuugaugaacaaaauuuccuaa

SEQ ID NO: 1269082 - RNA, 16 nt, Human
uuuugauguaaagaug

SEQ ID NO: 1269083 - RNA, 18 nt, Human
uuuugauguaaagauguu

SEQ ID NO: 1269084 - RNA, 20 nt, Human
uuuugauuuaauguuuucag

SEQ ID NO: 1269085 - RNA, 20 nt, Human
uuuugauuuguacugaaaaa

SEQ ID NO: 1269086 - RNA, 21 nt, Human
uuuugauuuguacugaaaaau

SEQ ID NO: 1269087 - RNA, 13 nt, Human
uuuugcaaagaaa

SEQ ID NO: 1269088 - RNA, 19 nt, Human
uuuugcaaagauuuaaucu

SEQ ID NO: 1269089 - RNA, 17 nt, Human
uuuugcaaagauuuaau

SEQ ID NO: 1269090 - RNA, 21 nt, Human
uuuugcaaccaggaacagcaa

SEQ ID NO: 1269091 - RNA, 17 nt, Human
uuuugcaaccucgcugg

SEQ ID NO: 1269092 - RNA, 21 nt, Human
uuuugcaaccucgcuggacuc

SEQ ID NO: 1269093 - RNA, 18 nt, Human
uuuugcaaucccuuaaua

SEQ ID NO: 1269094 - RNA, 20 nt, Human
uuuugcacauguuuccucua

SEQ ID NO: 1269095 - RNA, 17 nt, Human
uuuugcacagccaaauu

SEQ ID NO: 1269096 - RNA, 14 nt, Human
auuaagcaucagaa

SEQ ID NO: 1269097 - RNA, 17 nt, Human
auuaagcaucagaaacu

SEQ ID NO: 1269098 - RNA, 17 nt, Human
auuaagccacuuaaaau

SEQ ID NO: 1269099 - RNA, 20 nt, Human
auuaagccacuuaaaauguu

SEQ ID NO: 1269100 - RNA, 11 nt, Human
auuaagcaaau

SEQ ID NO: 1269101 - RNA, 12 nt, Human
auuaaagaauau

SEQ ID NO: 1269102 - RNA, 15 nt, Human
auuaaagcauuuaga

SEQ ID NO: 1269103 - RNA, 15 nt, Human
auuaaagaauaugaa

SEQ ID NO: 1269104 - RNA, 15 nt, Human
auuaaagacuccagu

SEQ ID NO: 1269105 - RNA, 16 nt, Human
auuaaagaaaaaaaug

SEQ ID NO: 1269106 - RNA, 17 nt, Human
auuaaagaaaaaaaugu

SEQ ID NO: 1269107 - RNA, 18 nt, Human
auuaaagaaaaaaaugua

SEQ ID NO: 1269108 - RNA, 19 nt, Human
auuaaagaaaaaaauguau

SEQ ID NO: 1269109 - RNA, 22 nt, Human
auuaaagaaaaaaauguauuuu

SEQ ID NO: 1269110 - RNA, 21 nt, Human
auuaaagaaaaaaauguauuu

SEQ ID NO: 1269111 - RNA, 14 nt, Human
auuaaagaagaccu

SEQ ID NO: 1269112 - RNA, 15 nt, Human
auuaaagaagaccug

SEQ ID NO: 1269113 - RNA, 16 nt, Human
auuaaagaagaccuga

SEQ ID NO: 1269114 - RNA, 21 nt, Human
auuaaagaagaccugagaaug

SEQ ID NO: 1269115 - RNA, 22 nt, Human
auuaaagaagaccugagaaugu

SEQ ID NO: 1269116 - RNA, 20 nt, Human
auuaaagaaggguugagcug

SEQ ID NO: 1269117 - RNA, 21 nt, Human
auuaaagaaggguugagcugg

SEQ ID NO: 1269118 - RNA, 13 nt, Human
uuuugaggcaaaa

SEQ ID NO: 1269119 - RNA, 18 nt, Human
uuuugaggcaaaagaagg

SEQ ID NO: 1269120 - RNA, 12 nt, Human
uuuugagauauu

SEQ ID NO: 1269121 - RNA, 13 nt, Human
uuuugagauauua

SEQ ID NO: 1269122 - RNA, 23 nt, Human
uuuugagauauuaaugcccagac

SEQ ID NO: 1269123 - RNA, 15 nt, Human
uuuugaggagcccca

SEQ ID NO: 1269124 - RNA, 19 nt, Human
uuuugauaugcauauuugu

SEQ ID NO: 1269125 - RNA, 18 nt, Human
uuuugauacuaagcauug

SEQ ID NO: 1269126 - RNA, 17 nt, Human
auuacauuuguauaaaa

SEQ ID NO: 1269127 - RNA, 21 nt, Human
auuacauuacugaaaacuuca

SEQ ID NO: 1269128 - RNA, 22 nt, Human
auuacauuacugaaaacuucau

SEQ ID NO: 1269129 - RNA, 18 nt, Human
auuacauuuguauaaaau

SEQ ID NO: 1269130 - RNA, 20 nt, Human
auuacauuuguauaaaauaa

SEQ ID NO: 1269131 - RNA, 15 nt, Human
auuaccauguaaugg

SEQ ID NO: 1269132 - RNA, 14 nt, Human
auuaccauguaaug

SEQ ID NO: 1269133 - RNA, 21 nt, Human
auuacaguggggaaugaagau

SEQ ID NO: 1269134 - RNA, 18 nt, Human
auuaauagcagccuuucu

SEQ ID NO: 1269135 - RNA, 17 nt, Human
auuaauagcagccuuuc

SEQ ID NO: 1269136 - RNA, 22 nt, Human
auuacaguguuuauccuuucau

SEQ ID NO: 1269137 - RNA, 14 nt, Human
auuacaguguuuau

SEQ ID NO: 1269138 - RNA, 17 nt, Human
uuuuuguguguauuugc

SEQ ID NO: 1269139 - RNA, 16 nt, Human
uuuuuguuauuaaaca

SEQ ID NO: 1269140 - RNA, 18 nt, Human
uuuuuguguguauuugcu

SEQ ID NO: 1269141 - RNA, 15 nt, Human
uuuuuguguguauuu

SEQ ID NO: 1269142 - RNA, 23 nt, Human
auuaaguaaugauaacuggaaac

SEQ ID NO: 1269143 - RNA, 19 nt, Human
uuuuugugaaaagcuccau

SEQ ID NO: 1269144 - RNA, 14 nt, Human
uuuuuaucuuuaua

SEQ ID NO: 1269145 - RNA, 14 nt, Human
uuuuuaucuuuuua

SEQ ID NO: 1269146 - RNA, 13 nt, Human
uuuuuauguuaua

SEQ ID NO: 1269147 - RNA, 23 nt, Human
uuuuuauuaauuuuaguuuuuca

SEQ ID NO: 1269148 - RNA, 17 nt, Human
uuuuuauuaguauuguu

SEQ ID NO: 1269149 - RNA, 14 nt, Human
uuuuuauuaugcau

SEQ ID NO: 1269150 - RNA, 15 nt, Human
uuuuuauuaugcauu

SEQ ID NO: 1269151 - RNA, 18 nt, Human
uuuuuauuaguauuguug

SEQ ID NO: 1269152 - RNA, 13 nt, Human
uuuuuauuuaaaa

SEQ ID NO: 1269153 - RNA, 12 nt, Human
uuuuuguaccaa

SEQ ID NO: 1269154 - RNA, 23 nt, Human
uuuuuguaccauuuuaaaguuag

SEQ ID NO: 1269155 - RNA, 14 nt, Human
uuuuuguaccauuu

SEQ ID NO: 1269156 - RNA, 13 nt, Human
auuacgugcucug

SEQ ID NO: 1269157 - RNA, 21 nt, Human
auuacguaugucugguucuca

SEQ ID NO: 1269158 - RNA, 15 nt, Human
auuacguaugucugg

SEQ ID NO: 1269159 - RNA, 22 nt, Human
auuacuuaguauugcaaaguca

SEQ ID NO: 1269160 - RNA, 18 nt, Human
auuacuuaguauugcaaa

SEQ ID NO: 1269161 - RNA, 15 nt, Human
auuacuuaguauugc

SEQ ID NO: 1269162 - RNA, 15 nt, Human
auuacuuauuuuuga

SEQ ID NO: 1269163 - RNA, 16 nt, Human
auuacuuauuuuugac

SEQ ID NO: 1269164 - RNA, 17 nt, Human
auuacuuauuuuugaca

SEQ ID NO: 1269165 - RNA, 18 nt, Human
auuacuuauuuuugacag

SEQ ID NO: 1269166 - RNA, 19 nt, Human
auuacuuauuuuugacagu

SEQ ID NO: 1269167 - RNA, 17 nt, Human
auuacucaguaauuugu

SEQ ID NO: 1269168 - RNA, 15 nt, Human
auuacucugaaauug

SEQ ID NO: 1269169 - RNA, 13 nt, Human
auuaguauuguug

SEQ ID NO: 1269170 - RNA, 14 nt, Human
auuaguauuguugu

SEQ ID NO: 1269171 - RNA, 15 nt, Human
auuaguauuguuguc

SEQ ID NO: 1269172 - RNA, 23 nt, Human
auuaguauuguuguccuuuucau

SEQ ID NO: 1269173 - RNA, 17 nt, Human
auuaguauuguuguccu

SEQ ID NO: 1269174 - RNA, 15 nt, Human
auuagucauguuuau

SEQ ID NO: 1269175 - RNA, 20 nt, Human
auuagucucagugaagacua

SEQ ID NO: 1269176 - RNA, 16 nt, Human
auuagugccacuuaau

SEQ ID NO: 1269177 - RNA, 18 nt, Human
auuagugccacuuaaugu

SEQ ID NO: 1269178 - RNA, 19 nt, Human
auuagugccacuuaaugua

SEQ ID NO: 1269179 - RNA, 20 nt, Human
auuagugccacuuaauguau

SEQ ID NO: 1269180 - RNA, 21 nt, Human
auuagugccacuuaauguaug

SEQ ID NO: 1269181 - RNA, 22 nt, Human
auuagugccacuuaauguaugu

SEQ ID NO: 1269182 - RNA, 16 nt, Human
auuauaguuucugagg

SEQ ID NO: 1269183 - RNA, 19 nt, Human
auuauaguuucugaggcuu

SEQ ID NO: 1269184 - RNA, 15 nt, Human
auuauauaacuguau

SEQ ID NO: 1269185 - RNA, 17 nt, Human
auuauauaacuguauuu

SEQ ID NO: 1269186 - RNA, 19 nt, Human
auuauauaacuguauuuga

SEQ ID NO: 1269187 - RNA, 20 nt, Human
auucagauaugauucaaaug

SEQ ID NO: 1269188 - RNA, 18 nt, Human
auucagauaugauucaaa

SEQ ID NO: 1269189 - RNA, 12 nt, Human
auucagguuuuu

SEQ ID NO: 1269190 - RNA, 14 nt, Human
auucagguuuuucc

SEQ ID NO: 1269191 - RNA, 15 nt, Human
auucagguuuuuccu

SEQ ID NO: 1269192 - RNA, 16 nt, Human
auucagguuuuuccuu

SEQ ID NO: 1269193 - RNA, 23 nt, Human
auucagguuuuuccuuuuuuugu

SEQ ID NO: 1269194 - RNA, 16 nt, Human
auuccaaagucucuaa

SEQ ID NO: 1269195 - RNA, 17 nt, Human
auucagaguugaugguu

SEQ ID NO: 1269196 - RNA, 13 nt, Human
auucagacaggca

SEQ ID NO: 1269197 - RNA, 14 nt, Human
auucagacaggcaa

SEQ ID NO: 1269198 - RNA, 15 nt, Human
auucagacaucugag

SEQ ID NO: 1269199 - RNA, 11 nt, Human
auucagacauc

SEQ ID NO: 1269200 - RNA, 11 nt, Human
auuccauccuu

SEQ ID NO: 1269201 - RNA, 13 nt, Human
auuccagcugucc

SEQ ID NO: 1269202 - RNA, 19 nt, Human
auuccaaagucucuaauuc

SEQ ID NO: 1269203 - RNA, 18 nt, Human
auuccaaagucucuaauu

SEQ ID NO: 1269204 - RNA, 14 nt, Human
auuccaacaguuua

SEQ ID NO: 1269205 - RNA, 16 nt, Human
auuccaacaguuuaau

SEQ ID NO: 1269206 - RNA, 17 nt, Human
auuccaacaguuuaaug

SEQ ID NO: 1269207 - RNA, 18 nt, Human
auuccaacaguuuaauga

SEQ ID NO: 1269208 - RNA, 20 nt, Human
auuccaacaguuuaaugaag

SEQ ID NO: 1269209 - RNA, 19 nt, Human
auuccaacaguuuaaugaa

SEQ ID NO: 1269210 - RNA, 23 nt, Human
auuccaacucguauagcaugcau

SEQ ID NO: 1269211 - RNA, 19 nt, Human
auuccaacucguauagcau

SEQ ID NO: 1269212 - RNA, 22 nt, Human
auuccaagacaugucuguucua

SEQ ID NO: 1269213 - RNA, 11 nt, Human
auucccucacu

SEQ ID NO: 1269214 - RNA, 17 nt, Human
auucccucacucgucuc

SEQ ID NO: 1269215 - RNA, 20 nt, Human
auucccucacucgucucccc

SEQ ID NO: 1269216 - RNA, 12 nt, Human
auucccucccca

SEQ ID NO: 1269217 - RNA, 14 nt, Human
auucccucucccag

SEQ ID NO: 1269218 - RNA, 15 nt, Human
auucccucucccagg

SEQ ID NO: 1269219 - RNA, 18 nt, Human
auucccucucccaggccc

SEQ ID NO: 1269220 - RNA, 16 nt, Human
auucccucucccaggc

SEQ ID NO: 1269221 - RNA, 14 nt, Human
auucuaaaaugauu

SEQ ID NO: 1269222 - RNA, 16 nt, Human
auucuaaaaugauugu

SEQ ID NO: 1269223 - RNA, 20 nt, Human
auucuccugccucagccucc

SEQ ID NO: 1269224 - RNA, 11 nt, Human
auucuccugga

SEQ ID NO: 1269225 - RNA, 21 nt, Human
auucucaugccucagccuccu

SEQ ID NO: 1269226 - RNA, 23 nt, Human
auucuccagccaucaagagacug

SEQ ID NO: 1269227 - RNA, 12 nt, Human
auucuccugccu

SEQ ID NO: 1269228 - RNA, 15 nt, Human
auucucccuugcucu

SEQ ID NO: 1269229 - RNA, 11 nt, Human
auucuccuccu

SEQ ID NO: 1269230 - RNA, 12 nt, Human
auucuccuccuc

SEQ ID NO: 1269231 - RNA, 17 nt, Human
auucuccuccucccucc

SEQ ID NO: 1269232 - RNA, 13 nt, Human
auucuccugccuc

SEQ ID NO: 1269233 - RNA, 14 nt, Human
auucuccugccuca

SEQ ID NO: 1269234 - RNA, 14 nt, Human
auucucaugccuca

SEQ ID NO: 1269235 - RNA, 15 nt, Human
auucucaugccucag

SEQ ID NO: 1269236 - RNA, 22 nt, Human
auucuauuuauauguacaugag

SEQ ID NO: 1269237 - RNA, 17 nt, Human
auucucaaaggagcgag

SEQ ID NO: 1269238 - RNA, 20 nt, Human
auucuaaaaugauuguagua

SEQ ID NO: 1269239 - RNA, 14 nt, Human
auucuaaaaugccu

SEQ ID NO: 1269240 - RNA, 15 nt, Human
auucuaaaaugccuu

SEQ ID NO: 1269241 - RNA, 20 nt, Human
auucuaaaaugugauguucu

SEQ ID NO: 1269242 - RNA, 23 nt, Human
auucuaaaaugugauguucuaag

SEQ ID NO: 1269243 - RNA, 22 nt, Human
auucuaaaaugugauguucuaa

SEQ ID NO: 1269244 - RNA, 14 nt, Human
auucuaaagauucu

SEQ ID NO: 1269245 - RNA, 15 nt, Human
auucuaaagauucua

SEQ ID NO: 1269246 - RNA, 17 nt, Human
auucuaaagauucuaua

SEQ ID NO: 1269247 - RNA, 18 nt, Human
auucuaaagauucuauag

SEQ ID NO: 1269248 - RNA, 19 nt, Human
auucuaaagauucuauagu

SEQ ID NO: 1269249 - RNA, 20 nt, Human
auucuaaagauucuauaguu

SEQ ID NO: 1269250 - RNA, 22 nt, Human
auucuaaagauucuauaguucu

SEQ ID NO: 1269251 - RNA, 14 nt, Human
auucuaaaggucca

SEQ ID NO: 1269252 - RNA, 15 nt, Human
auucuaaaugaaugu

SEQ ID NO: 1269253 - RNA, 17 nt, Human
auucuaaaugaauguuu

SEQ ID NO: 1269254 - RNA, 18 nt, Human
auucuaaaugaauguuua

SEQ ID NO: 1269255 - RNA, 15 nt, Human
auucuauaaggccau

SEQ ID NO: 1269256 - RNA, 18 nt, Human
auucuauaaguuuuaugu

SEQ ID NO: 1269257 - RNA, 13 nt, Human
auucuauaguucu

SEQ ID NO: 1269258 - RNA, 14 nt, Human
auucuauaguucua

SEQ ID NO: 1269259 - RNA, 15 nt, Human
auucuauaguucuag

SEQ ID NO: 1269260 - RNA, 16 nt, Human
auucuauaguucuaga

SEQ ID NO: 1269261 - RNA, 17 nt, Human
auucuauaguucuagac

SEQ ID NO: 1269262 - RNA, 15 nt, Human
auucuaucuauuccu

SEQ ID NO: 1269263 - RNA, 15 nt, Human
auucuauuaaagugc

SEQ ID NO: 1269264 - RNA, 20 nt, Human
auucuauuacauuuucagug

SEQ ID NO: 1269265 - RNA, 18 nt, Human
auucuauuacauuuucag

SEQ ID NO: 1269266 - RNA, 20 nt, Human
auucuauuuauauguacaug

SEQ ID NO: 1269267 - RNA, 11 nt, Human
uugcucaugga

SEQ ID NO: 1269268 - RNA, 12 nt, Human
uugcucauggaa

SEQ ID NO: 1269269 - RNA, 19 nt, Human
uugcugaaauuuuauaugc

SEQ ID NO: 1269270 - RNA, 16 nt, Human
uugcuccgccuggccu

SEQ ID NO: 1269271 - RNA, 17 nt, Human
uugcuccgccuggccug

SEQ ID NO: 1269272 - RNA, 17 nt, Human
uugcuccuaauguugaa

SEQ ID NO: 1269273 - RNA, 11 nt, Human
uugcugaaauu

SEQ ID NO: 1269274 - RNA, 16 nt, Human
uugcugaaauuuuaua

SEQ ID NO: 1269275 - RNA, 18 nt, Human
aucuaaguuaauuuaaag

SEQ ID NO: 1269276 - RNA, 13 nt, Human
aucuaaguuauaa

SEQ ID NO: 1269277 - RNA, 19 nt, Human
aucuaaguuauaagacucu

SEQ ID NO: 1269278 - RNA, 15 nt, Human
uugcuaauuuuuauu

SEQ ID NO: 1269279 - RNA, 17 nt, Human
uugcuaauuuuuauuaa

SEQ ID NO: 1269280 - RNA, 16 nt, Human
uugcuacauaauuauc

SEQ ID NO: 1269281 - RNA, 12 nt, Human
uugcuaccagua

SEQ ID NO: 1269282 - RNA, 15 nt, Human
uugcuaccaguauuu

SEQ ID NO: 1269283 - RNA, 16 nt, Human
uugcuaccaguauuua

SEQ ID NO: 1269284 - RNA, 20 nt, Human
uugcuaccaguauuuagaag

SEQ ID NO: 1269285 - RNA, 22 nt, Human
uugcuaccaguauuuagaagcc

SEQ ID NO: 1269286 - RNA, 23 nt, Human
uugcuaccaguauuuagaagcca

SEQ ID NO: 1269287 - RNA, 13 nt, Human
uugcuacauaauu

SEQ ID NO: 1269288 - RNA, 14 nt, Human
uugcuagagcuccu

SEQ ID NO: 1269289 - RNA, 15 nt, Human
uugcuagagcuccuc

SEQ ID NO: 1269290 - RNA, 16 nt, Human
uugcuagagcuccucc

SEQ ID NO: 1269291 - RNA, 18 nt, Human
uugcuagagcuccucccu

SEQ ID NO: 1269292 - RNA, 21 nt, Human
uugcuagagcuccucccucuc

SEQ ID NO: 1269293 - RNA, 11 nt, Human
uugcugagccu

SEQ ID NO: 1269294 - RNA, 11 nt, Human
uugcugagacu

SEQ ID NO: 1269295 - RNA, 21 nt, Human
uugcugacuguagcuuuggaa

SEQ ID NO: 1269296 - RNA, 15 nt, Human
uugcugaaugcaaga

SEQ ID NO: 1269297 - RNA, 14 nt, Human
uugcugacccuccc

SEQ ID NO: 1269298 - RNA, 15 nt, Human
uugcugacccucccc

SEQ ID NO: 1269299 - RNA, 14 nt, Human
uugcuuuaauauaa

SEQ ID NO: 1269300 - RNA, 16 nt, Human
uugcuuuaauauaaau

SEQ ID NO: 1269301 - RNA, 17 nt, Human
uugcuuuaauauaaaug

SEQ ID NO: 1269302 - RNA, 17 nt, Human
uugcuuuuuuuuccuuc

SEQ ID NO: 1269303 - RNA, 20 nt, Human
uugcuuuuggcaaaacucua

SEQ ID NO: 1269304 - RNA, 15 nt, Human
uugcuuuuucaccag

SEQ ID NO: 1269305 - RNA, 15 nt, Human
uugcuuuuugugaua

SEQ ID NO: 1269306 - RNA, 21 nt, Human
uugcuuuuugugauaugcaca

SEQ ID NO: 1269307 - RNA, 18 nt, Human
uugcuuuaauauaaaugc

SEQ ID NO: 1269308 - RNA, 19 nt, Human
uugcuuuaauauaaaugca

SEQ ID NO: 1269309 - RNA, 21 nt, Human
uugcuuuaauauaaaugcaaa

SEQ ID NO: 1269310 - RNA, 22 nt, Human
uugcuuuaauauaaaugcaaau

SEQ ID NO: 1269311 - RNA, 23 nt, Human
uugcuuuaauauaaaugcaaaua

SEQ ID NO: 1269312 - RNA, 15 nt, Human
uugcuuuucacaaau

SEQ ID NO: 1269313 - RNA, 12 nt, Human
uugcuuuucaug

SEQ ID NO: 1269314 - RNA, 13 nt, Human
uugcuuuucaugc

SEQ ID NO: 1269315 - RNA, 16 nt, Human
uugcuuuucaugcaaa

SEQ ID NO: 1269316 - RNA, 17 nt, Human
uugcuuuucaugcaaac

SEQ ID NO: 1269317 - RNA, 18 nt, Human
uugcuuuucaugcaaacu

SEQ ID NO: 1269318 - RNA, 22 nt, Human
uugcuuuucaugcaaacucuuu

SEQ ID NO: 1269319 - RNA, 21 nt, Human
augaaauauuauguuaaaacu

SEQ ID NO: 1269320 - RNA, 14 nt, Human
aucuuuuauuuugc

SEQ ID NO: 1269321 - RNA, 19 nt, Human
augaaagauggcugugccu

SEQ ID NO: 1269322 - RNA, 20 nt, Human
augaaagauggcugugccuc

SEQ ID NO: 1269323 - RNA, 23 nt, Human
augaaagauggcugugccucugc

SEQ ID NO: 1269324 - RNA, 12 nt, Human
aucuuucccucc

SEQ ID NO: 1269325 - RNA, 13 nt, Human
aucuuucccuccu

SEQ ID NO: 1269326 - RNA, 14 nt, Human
aucuuucccuccuu

SEQ ID NO: 1269327 - RNA, 16 nt, Human
aucuuucccuccuugg

SEQ ID NO: 1269328 - RNA, 19 nt, Human
aucuuucccuccuugguga

SEQ ID NO: 1269329 - RNA, 17 nt, Human
aucuuucccuccuuggu

SEQ ID NO: 1269330 - RNA, 22 nt, Human
aucuuuuacaacugccucgaaa

SEQ ID NO: 1269331 - RNA, 13 nt, Human
uuggacccuucca

SEQ ID NO: 1269332 - RNA, 14 nt, Human
uuggacccuuccau

SEQ ID NO: 1269333 - RNA, 16 nt, Human
uuggacccuuccaugg

SEQ ID NO: 1269334 - RNA, 19 nt, Human
uuggaccuaaauggccuca

SEQ ID NO: 1269335 - RNA, 21 nt, Human
uuggaccuaaauggccucaug

SEQ ID NO: 1269336 - RNA, 23 nt, Human
uuggaccuaaauggccucaugug

SEQ ID NO: 1269337 - RNA, 17 nt, Human
uuggaccuaauccaagc

SEQ ID NO: 1269338 - RNA, 12 nt, Human
uuggacuaugga

SEQ ID NO: 1269339 - RNA, 19 nt, Human
uuggccugaucagaccacg

SEQ ID NO: 1269340 - RNA, 21 nt, Human
uuggccugcuaaggucuugga

SEQ ID NO: 1269341 - RNA, 14 nt, Human
uuggccuggagcac

SEQ ID NO: 1269342 - RNA, 16 nt, Human
uuggccuggagcacaa

SEQ ID NO: 1269343 - RNA, 19 nt, Human
uuggccuguagaguugcug

SEQ ID NO: 1269344 - RNA, 17 nt, Human
uuggcgaugccagccaa

SEQ ID NO: 1269345 - RNA, 13 nt, Human
uuguauaaaauaa

SEQ ID NO: 1269346 - RNA, 13 nt, Human
uuguaguuccacu

SEQ ID NO: 1269347 - RNA, 13 nt, Human
uuguaguugaaua

SEQ ID NO: 1269348 - RNA, 16 nt, Human
uuguaguugaauauug

SEQ ID NO: 1269349 - RNA, 15 nt, Human
uuguauaaaauaauu

SEQ ID NO: 1269350 - RNA, 12 nt, Human
uuguauaaaaua

SEQ ID NO: 1269351 - RNA, 14 nt, Human
uuguauaaaauaga

SEQ ID NO: 1269352 - RNA, 11 nt, Human
uuguauaauug

SEQ ID NO: 1269353 - RNA, 12 nt, Human
uuguauaauugg

SEQ ID NO: 1269354 - RNA, 20 nt, Human
uuguauaauuggauuuccua

SEQ ID NO: 1269355 - RNA, 21 nt, Human
uuguauaauuggauuuccuaa

SEQ ID NO: 1269356 - RNA, 15 nt, Human
uuguaaugucuugag

SEQ ID NO: 1269357 - RNA, 20 nt, Human
uuguaaugucuugagcucua

SEQ ID NO: 1269358 - RNA, 19 nt, Human
uuguaaugucuugagcucu

SEQ ID NO: 1269359 - RNA, 15 nt, Human
uuguaauuauggagu

SEQ ID NO: 1269360 - RNA, 23 nt, Human
uuguaauuaaaagcaaaucauuu

SEQ ID NO: 1269361 - RNA, 11 nt, Human
uuguaauuaug

SEQ ID NO: 1269362 - RNA, 17 nt, Human
uuguaauuaaaagcaaa

SEQ ID NO: 1269363 - RNA, 14 nt, Human
uuguaauuauggag

SEQ ID NO: 1269364 - RNA, 19 nt, Human
uuguaguuccacuuauagc

SEQ ID NO: 1269365 - RNA, 13 nt, Human
uuguaaugaaaac

SEQ ID NO: 1269366 - RNA, 19 nt, Human
uuguaagugaaaaacauga

SEQ ID NO: 1269367 - RNA, 16 nt, Human
uuguauauuacaauga

SEQ ID NO: 1269368 - RNA, 15 nt, Human
uuguauauuacaaug

SEQ ID NO: 1269369 - RNA, 14 nt, Human
uuguauauuacaau

SEQ ID NO: 1269370 - RNA, 13 nt, Human
uuguauauuacaa

SEQ ID NO: 1269371 - RNA, 19 nt, Human
uuguauauauuauuauaau

SEQ ID NO: 1269372 - RNA, 21 nt, Human
uuguauauauuauuauaaucu

SEQ ID NO: 1269373 - RNA, 21 nt, Human
augaauuaguuuuauaugcuu

SEQ ID NO: 1269374 - RNA, 23 nt, Human
augaauuaguuuuauaugcuucu

SEQ ID NO: 1269375 - RNA, 15 nt, Human
augaauuauuacagu

SEQ ID NO: 1269376 - RNA, 17 nt, Human
augaauuauuacagugu

SEQ ID NO: 1269377 - RNA, 20 nt, Human
augacaaagcagauucagaa

SEQ ID NO: 1269378 - RNA, 14 nt, Human
augacaacuucuaa

SEQ ID NO: 1269379 - RNA, 16 nt, Human
augacaacuucuaauu

SEQ ID NO: 1269380 - RNA, 21 nt, Human
augacaagaaaggcugcugua

SEQ ID NO: 1269381 - RNA, 18 nt, Human
augacaacuucuaauugc

SEQ ID NO: 1269382 - RNA, 19 nt, Human
augacaacuucuaauugcc

SEQ ID NO: 1269383 - RNA, 20 nt, Human
augacaacuucuaauugcca

SEQ ID NO: 1269384 - RNA, 15 nt, Human
augacaaucaugugu

SEQ ID NO: 1269385 - RNA, 23 nt, Human
augacacucauauaauuauaugu

SEQ ID NO: 1269386 - RNA, 21 nt, Human
augacaguaauuguguuuaca

SEQ ID NO: 1269387 - RNA, 19 nt, Human
augacaguccgucaaaaca

SEQ ID NO: 1269388 - RNA, 22 nt, Human
augacaguaauuguguuuacau

SEQ ID NO: 1269389 - RNA, 20 nt, Human
augacaguaauuguguuuac

SEQ ID NO: 1269390 - RNA, 12 nt, Human
augacaguaauu

SEQ ID NO: 1269391 - RNA, 17 nt, Human
augacaggauguuugcu

SEQ ID NO: 1269392 - RNA, 15 nt, Human
augacaggccugucc

SEQ ID NO: 1269393 - RNA, 16 nt, Human
augacacuguucagga

SEQ ID NO: 1269394 - RNA, 19 nt, Human
uugggcagcaauuuaaaug

SEQ ID NO: 1269395 - RNA, 23 nt, Human
uugggcagccagaccagcaggcu

SEQ ID NO: 1269396 - RNA, 14 nt, Human
uugggccagaagua

SEQ ID NO: 1269397 - RNA, 13 nt, Human
uugggccagacau

SEQ ID NO: 1269398 - RNA, 14 nt, Human
uugggccagacaug

SEQ ID NO: 1269399 - RNA, 18 nt, Human
uugggcagcaauuuaaau

SEQ ID NO: 1269400 - RNA, 22 nt, Human
uugggcagagcuggcucugagc

SEQ ID NO: 1269401 - RNA, 17 nt, Human
uugggcagagcuggcuc

SEQ ID NO: 1269402 - RNA, 21 nt, Human
uugggcagagcuggcucugag

SEQ ID NO: 1269403 - RNA, 23 nt, Human
uugggcacccccagccugggccu

SEQ ID NO: 1269404 - RNA, 12 nt, Human
uugggcagagcu

SEQ ID NO: 1269405 - RNA, 21 nt, Human
uugggccagaaguaccagacu

SEQ ID NO: 1269406 - RNA, 12 nt, Human
uugggcucugau

SEQ ID NO: 1269407 - RNA, 14 nt, Human
uugggcucugauga

SEQ ID NO: 1269408 - RNA, 13 nt, Human
uugggcucugaug

SEQ ID NO: 1269409 - RNA, 18 nt, Human
uugggcuucagcugccag

SEQ ID NO: 1269410 - RNA, 18 nt, Human
augaauuacauuuguaua

SEQ ID NO: 1269411 - RNA, 19 nt, Human
augaauuacauuuguauaa

SEQ ID NO: 1269412 - RNA, 22 nt, Human
augaauuacauuuguauaaaau

SEQ ID NO: 1269413 - RNA, 14 nt, Human
augaacaucccuuu

SEQ ID NO: 1269414 - RNA, 18 nt, Human
uugggcacccccagccug

SEQ ID NO: 1269415 - RNA, 19 nt, Human
uugggcacccccagccugg

SEQ ID NO: 1269416 - RNA, 20 nt, Human
uugggcacccccagccuggg

SEQ ID NO: 1269417 - RNA, 21 nt, Human
uugggcacccccagccugggc

SEQ ID NO: 1269418 - RNA, 22 nt, Human
uugggcacccccagccugggcc

SEQ ID NO: 1269419 - RNA, 21 nt, Human
augaacauauuguugaaaggu

SEQ ID NO: 1269420 - RNA, 22 nt, Human
uuguaacuaaaauaauuuugua

SEQ ID NO: 1269421 - RNA, 23 nt, Human
uuguaacuaaaauaauuuuguaa

SEQ ID NO: 1269422 - RNA, 22 nt, Human
uuguaaaaauuaaaaguuaugg

SEQ ID NO: 1269423 - RNA, 17 nt, Human
uuguaacuaaaauaauu

SEQ ID NO: 1269424 - RNA, 18 nt, Human
uuguaacuaaaauaauuu

SEQ ID NO: 1269425 - RNA, 21 nt, Human
uuguaacuaaaauaauuuugu

SEQ ID NO: 1269426 - RNA, 18 nt, Human
uugguuuuuaaaacccag

SEQ ID NO: 1269427 - RNA, 17 nt, Human
uugguuuuuaaagauuu

SEQ ID NO: 1269428 - RNA, 22 nt, Human
uugguuuuuacugcucugagaa

SEQ ID NO: 1269429 - RNA, 11 nt, Human
uuggggaagag

SEQ ID NO: 1269430 - RNA, 19 nt, Human
uugggcuucagcugccagu

SEQ ID NO: 1269431 - RNA, 17 nt, Human
uugggcuugcuauucug

SEQ ID NO: 1269432 - RNA, 18 nt, Human
uugggcuugcuauucugu

SEQ ID NO: 1269433 - RNA, 23 nt, Human
uugggcuugcuauucugucccua

SEQ ID NO: 1269434 - RNA, 19 nt, Human
uuggggaaacagcaucucc

SEQ ID NO: 1269435 - RNA, 23 nt, Human
uuggggaaacagcaucuccaagc

SEQ ID NO: 1269436 - RNA, 14 nt, Human
uuggggaagaccca

SEQ ID NO: 1269437 - RNA, 14 nt, Human
uuggggucugaccc

SEQ ID NO: 1269438 - RNA, 15 nt, Human
uuggggucugacccc

SEQ ID NO: 1269439 - RNA, 17 nt, Human
uuggggucuggcagccu

SEQ ID NO: 1269440 - RNA, 14 nt, Human
uugguucauuaauu

SEQ ID NO: 1269441 - RNA, 20 nt, Human
uugguucauuaauucuauaa

SEQ ID NO: 1269442 - RNA, 18 nt, Human
uugguucccccacugauc

SEQ ID NO: 1269443 - RNA, 21 nt, Human
uugguuuugcuacauaauuau

SEQ ID NO: 1269444 - RNA, 18 nt, Human
uugugaagguggaaauaa

SEQ ID NO: 1269445 - RNA, 17 nt, Human
uugugaagguggaaaua

SEQ ID NO: 1269446 - RNA, 22 nt, Human
uugugaaguacccguucacauu

SEQ ID NO: 1269447 - RNA, 13 nt, Human
uuguguguaugca

SEQ ID NO: 1269448 - RNA, 14 nt, Human
uuguguguaugcac

SEQ ID NO: 1269449 - RNA, 18 nt, Human
uugugaagcaaaauuuuu

SEQ ID NO: 1269450 - RNA, 11 nt, Human
uugugaagagg

SEQ ID NO: 1269451 - RNA, 22 nt, Human
uugugaagccaugaguuccaga

SEQ ID NO: 1269452 - RNA, 13 nt, Human
uugugaaggcagg

SEQ ID NO: 1269453 - RNA, 19 nt, Human
uugugugucuuaauuauua

SEQ ID NO: 1269454 - RNA, 18 nt, Human
uuguuccccacuggagca

SEQ ID NO: 1269455 - RNA, 22 nt, Human
uuguguguaugcacaugaacuu

SEQ ID NO: 1269456 - RNA, 16 nt, Human
uuguguguauuugcua

SEQ ID NO: 1269457 - RNA, 14 nt, Human
uuguguguauuugc

SEQ ID NO: 1269458 - RNA, 13 nt, Human
uugugugucuuaa

SEQ ID NO: 1269459 - RNA, 16 nt, Human
uuguucucagaauccc

SEQ ID NO: 1269460 - RNA, 23 nt, Human
uuguucucagaaucccuuaacag

SEQ ID NO: 1269461 - RNA, 18 nt, Human
augaucaccgacugaaaa

SEQ ID NO: 1269462 - RNA, 20 nt, Human
augaucaauuauaguuucug

SEQ ID NO: 1269463 - RNA, 18 nt, Human
augaucccuguguugucu

SEQ ID NO: 1269464 - RNA, 20 nt, Human
augaucccuguguugucucu

SEQ ID NO: 1269465 - RNA, 20 nt, Human
augauccuguauucagacag

SEQ ID NO: 1269466 - RNA, 15 nt, Human
augauccuaaugaau

SEQ ID NO: 1269467 - RNA, 17 nt, Human
augaucggcaggacacc

SEQ ID NO: 1269468 - RNA, 13 nt, Human
augaucugauuga

SEQ ID NO: 1269469 - RNA, 20 nt, Human
augaucaaauguuuaaucau

SEQ ID NO: 1269470 - RNA, 19 nt, Human
augaucaaauguuuaauca

SEQ ID NO: 1269471 - RNA, 17 nt, Human
augaucaaauguuuaau

SEQ ID NO: 1269472 - RNA, 16 nt, Human
augaucaaauguuuaa

SEQ ID NO: 1269473 - RNA, 15 nt, Human
augaucaaauguuua

SEQ ID NO: 1269474 - RNA, 14 nt, Human
augaucaaauguuu

SEQ ID NO: 1269475 - RNA, 13 nt, Human
augaucaaauguu

SEQ ID NO: 1269476 - RNA, 12 nt, Human
augaucaaaugu

SEQ ID NO: 1269477 - RNA, 13 nt, Human
uuguuggaaugaa

SEQ ID NO: 1269478 - RNA, 23 nt, Human
uuguuggagucaaaaagaaccac

SEQ ID NO: 1269479 - RNA, 16 nt, Human
uuguugcguuccuuuc

SEQ ID NO: 1269480 - RNA, 22 nt, Human
augcaaacuuuauuuuguguuu

SEQ ID NO: 1269481 - RNA, 15 nt, Human
augaucugucugugg

SEQ ID NO: 1269482 - RNA, 14 nt, Human
augcaaaccauagc

SEQ ID NO: 1269483 - RNA, 12 nt, Human
augcaaacucuu

SEQ ID NO: 1269484 - RNA, 13 nt, Human
augcaaacucuuu

SEQ ID NO: 1269485 - RNA, 16 nt, Human
augcaaacucuuuggu

SEQ ID NO: 1269486 - RNA, 22 nt, Human
augcaaacucuuuggucguuuu

SEQ ID NO: 1269487 - RNA, 16 nt, Human
uuuaaaaaauggucac

SEQ ID NO: 1269488 - RNA, 21 nt, Human
uuuaaaaaauuaaucugggcc

SEQ ID NO: 1269489 - RNA, 19 nt, Human
uuuaaacuguguacauaac

SEQ ID NO: 1269490 - RNA, 21 nt, Human
uuuaaacuguguacauaacug

SEQ ID NO: 1269491 - RNA, 22 nt, Human
uuuaaacuguguacauaacuga

SEQ ID NO: 1269492 - RNA, 19 nt, Human
uuuaaaaaauagcagcuuu

SEQ ID NO: 1269493 - RNA, 23 nt, Human
uuuaaaaaagcuuaaaacuuuga

SEQ ID NO: 1269494 - RNA, 17 nt, Human
uuuaaaaaauuaaucug

SEQ ID NO: 1269495 - RNA, 21 nt, Human
uuuaaaaaagcuuaaaacuuu

SEQ ID NO: 1269496 - RNA, 19 nt, Human
uuguuuuuuuuuuccacuu

SEQ ID NO: 1269497 - RNA, 13 nt, Human
uuuaaaaaagcuu

SEQ ID NO: 1269498 - RNA, 14 nt, Human
uuuaaaaaagcuua

SEQ ID NO: 1269499 - RNA, 17 nt, Human
uuuaaaaaagcuuaaaa

SEQ ID NO: 1269500 - RNA, 20 nt, Human
uuuaaaaaagcuuaaaacuu

SEQ ID NO: 1269501 - RNA, 16 nt, Human
uuguuuugugcagaga

SEQ ID NO: 1269502 - RNA, 19 nt, Human
uuguuuugugucucuuaug

SEQ ID NO: 1269503 - RNA, 14 nt, Human
uuguuuuuaaacug

SEQ ID NO: 1269504 - RNA, 16 nt, Human
uuguuuuuaaacugua

SEQ ID NO: 1269505 - RNA, 18 nt, Human
uuguuuuuaaacuguaca

SEQ ID NO: 1269506 - RNA, 18 nt, Human
uuguuuuuuuuuuccacu

SEQ ID NO: 1269507 - RNA, 19 nt, Human
uuguuuuuaaacuguacag

SEQ ID NO: 1269508 - RNA, 19 nt, Human
uuguuuuucauucagucuu

SEQ ID NO: 1269509 - RNA, 14 nt, Human
augauaacuggaaa

SEQ ID NO: 1269510 - RNA, 14 nt, Human
augauaaagagaca

SEQ ID NO: 1269511 - RNA, 17 nt, Human
augauaaagagacagug

SEQ ID NO: 1269512 - RNA, 20 nt, Human
augauaaagagacagugaua

SEQ ID NO: 1269513 - RNA, 15 nt, Human
augauaacacuauuu

SEQ ID NO: 1269514 - RNA, 12 nt, Human
augagucuagau

SEQ ID NO: 1269515 - RNA, 13 nt, Human
augagucuagaug

SEQ ID NO: 1269516 - RNA, 17 nt, Human
augagucuagauguuua

SEQ ID NO: 1269517 - RNA, 15 nt, Human
augagugaauaaaug

SEQ ID NO: 1269518 - RNA, 16 nt, Human
augagugaauaaaugu

SEQ ID NO: 1269519 - RNA, 17 nt, Human
augagugaauaaauguc

SEQ ID NO: 1269520 - RNA, 22 nt, Human
augagugcguggugcgagugcg

SEQ ID NO: 1269521 - RNA, 19 nt, Human
augagugcguggugcgagu

SEQ ID NO: 1269522 - RNA, 21 nt, Human
augaguggaaauuaagacuuu

SEQ ID NO: 1269523 - RNA, 13 nt, Human
uugucacgccaga

SEQ ID NO: 1269524 - RNA, 20 nt, Human
uugucacgccagacuuccca

SEQ ID NO: 1269525 - RNA, 14 nt, Human
uugucaccagaucu

SEQ ID NO: 1269526 - RNA, 16 nt, Human
uugucaccagaucuga

SEQ ID NO: 1269527 - RNA, 17 nt, Human
uugucaccagaucugau

SEQ ID NO: 1269528 - RNA, 13 nt, Human
uugucauguguau

SEQ ID NO: 1269529 - RNA, 22 nt, Human
uugucauguguauaaaaauaaa

SEQ ID NO: 1269530 - RNA, 14 nt, Human
uugucauguguaua

SEQ ID NO: 1269531 - RNA, 18 nt, Human
uugucccgauuguaacuc

SEQ ID NO: 1269532 - RNA, 22 nt, Human
uuguccucagccccgcguggaa

SEQ ID NO: 1269533 - RNA, 23 nt, Human
uuguccuagcacagauggccagc

SEQ ID NO: 1269534 - RNA, 15 nt, Human
uuguccuagcacaga

SEQ ID NO: 1269535 - RNA, 16 nt, Human
uuguccgcuggguggu

SEQ ID NO: 1269536 - RNA, 16 nt, Human
uuguccuuagccugga

SEQ ID NO: 1269537 - RNA, 15 nt, Human
uuguccuuucccuuc

SEQ ID NO: 1269538 - RNA, 17 nt, Human
uuguccuuucccuucag

SEQ ID NO: 1269539 - RNA, 19 nt, Human
uuguccuuuugcaaagaaa

SEQ ID NO: 1269540 - RNA, 14 nt, Human
uuguccuuuucaua

SEQ ID NO: 1269541 - RNA, 14 nt, Human
uugucgcucaugug

SEQ ID NO: 1269542 - RNA, 15 nt, Human
augacaugaauuuua

SEQ ID NO: 1269543 - RNA, 21 nt, Human
augacaugaauuuuagcuuuu

SEQ ID NO: 1269544 - RNA, 22 nt, Human
augacauuaaagaaggguugag

SEQ ID NO: 1269545 - RNA, 20 nt, Human
augacaguccgucaaaacag

SEQ ID NO: 1269546 - RNA, 21 nt, Human
augacaguccgucaaaacaga

SEQ ID NO: 1269547 - RNA, 22 nt, Human
augacaguccgucaaaacagau

SEQ ID NO: 1269548 - RNA, 17 nt, Human
augacaguguuccccga

SEQ ID NO: 1269549 - RNA, 18 nt, Human
augacaucaccacaguuu

SEQ ID NO: 1269550 - RNA, 14 nt, Human
augacaucacuugu

SEQ ID NO: 1269551 - RNA, 18 nt, Human
augacaucacuuguacaa

SEQ ID NO: 1269552 - RNA, 19 nt, Human
augacaucacuuguacaaa

SEQ ID NO: 1269553 - RNA, 20 nt, Human
augacaucacuuguacaaaa

SEQ ID NO: 1269554 - RNA, 12 nt, Human
augacaugaauu

SEQ ID NO: 1269555 - RNA, 22 nt, Human
augacaugaauuuuagcuuuug

SEQ ID NO: 1269556 - RNA, 16 nt, Human
augagauauuaaacca

SEQ ID NO: 1269557 - RNA, 23 nt, Human
augagaugauacauccaaagcag

SEQ ID NO: 1269558 - RNA, 24 nt, Human
augagaugauacauccaaagcaga

SEQ ID NO: 1269559 - RNA, 14 nt, Human
augagaugcuggcu

SEQ ID NO: 1269560 - RNA, 15 nt, Human
augagaugcuggcuu

SEQ ID NO: 1269561 - RNA, 22 nt, Human
augagaugcuggcuugggcagc

SEQ ID NO: 1269562 - RNA, 19 nt, Human
augagaugcuggcuugggc

SEQ ID NO: 1269563 - RNA, 13 nt, Human
augagauugaauu

SEQ ID NO: 1269564 - RNA, 14 nt, Human
augagcauguuuag

SEQ ID NO: 1269565 - RNA, 21 nt, Human
augagcauguuuagacuuuaa

SEQ ID NO: 1269566 - RNA, 16 nt, Human
uuuaaagcuuccauug

SEQ ID NO: 1269567 - RNA, 16 nt, Human
uuuaaagcagguucuu

SEQ ID NO: 1269568 - RNA, 19 nt, Human
uuuaaagaaaaaaauugaa

SEQ ID NO: 1269569 - RNA, 22 nt, Human
uuuaaagaaaaaaauugaaaug

SEQ ID NO: 1269570 - RNA, 21 nt, Human
uuuaaagaaaaaaauugaaau

SEQ ID NO: 1269571 - RNA, 12 nt, Human
uuuaaagaaagu

SEQ ID NO: 1269572 - RNA, 13 nt, Human
uuuaaagaaagug

SEQ ID NO: 1269573 - RNA, 15 nt, Human
uuuaaagcagguucu

SEQ ID NO: 1269574 - RNA, 19 nt, Human
uuuaaagcagguucuuguu

SEQ ID NO: 1269575 - RNA, 17 nt, Human
uuuaaagcguuugcaca

SEQ ID NO: 1269576 - RNA, 13 nt, Human
augcgcccccucc

SEQ ID NO: 1269577 - RNA, 18 nt, Human
augcgcccccuccgcccu

SEQ ID NO: 1269578 - RNA, 22 nt, Human
augcgcccccuccgcccugcca

SEQ ID NO: 1269579 - RNA, 15 nt, Human
augcgcucagggcca

SEQ ID NO: 1269580 - RNA, 23 nt, Human
augcgcucagggccaugcugagg

SEQ ID NO: 1269581 - RNA, 23 nt, Human
augcgcaggcuggcccugcccug

SEQ ID NO: 1269582 - RNA, 23 nt, Human
augccucagccacuugccugugc

SEQ ID NO: 1269583 - RNA, 23 nt, Human
augccucagaagugcaucuggag

SEQ ID NO: 1269584 - RNA, 16 nt, Human
augccuaugguggauc

SEQ ID NO: 1269585 - RNA, 19 nt, Human
augccuaugguggauccaa

SEQ ID NO: 1269586 - RNA, 21 nt, Human
augccuaugguggauccaaac

SEQ ID NO: 1269587 - RNA, 15 nt, Human
augccucagaagugc

SEQ ID NO: 1269588 - RNA, 16 nt, Human
augccucagaagugca

SEQ ID NO: 1269589 - RNA, 22 nt, Human
augccguggauugcacguggcc

SEQ ID NO: 1269590 - RNA, 13 nt, Human
uuuacgcuuugau

SEQ ID NO: 1269591 - RNA, 18 nt, Human
uuuacgcuuugauucaua

SEQ ID NO: 1269592 - RNA, 18 nt, Human
augcuacaggauuugaaa

SEQ ID NO: 1269593 - RNA, 21 nt, Human
augcuaauucucagaaaggca

SEQ ID NO: 1269594 - RNA, 13 nt, Human
uuuaccuuguaua

SEQ ID NO: 1269595 - RNA, 17 nt, Human
uuuauaugcuucuguuu

SEQ ID NO: 1269596 - RNA, 14 nt, Human
uuuauaugaagaaa

SEQ ID NO: 1269597 - RNA, 21 nt, Human
uuuauaugaagaaaaucacuu

SEQ ID NO: 1269598 - RNA, 19 nt, Human
uuuauaugcuucuguuuua

SEQ ID NO: 1269599 - RNA, 20 nt, Human
uuuauaugcuuacugauaua

SEQ ID NO: 1269600 - RNA, 14 nt, Human
uuuauguaauuuca

SEQ ID NO: 1269601 - RNA, 19 nt, Human
uuuauguaguaauugacau

SEQ ID NO: 1269602 - RNA, 13 nt, Human
uuuauauauauau

SEQ ID NO: 1269603 - RNA, 20 nt, Human
uuuauauauauauauaaaga

SEQ ID NO: 1269604 - RNA, 19 nt, Human
uuuauauauauauauaaag

SEQ ID NO: 1269605 - RNA, 13 nt, Human
uuuauauauguau

SEQ ID NO: 1269606 - RNA, 14 nt, Human
uuuauauauuauau

SEQ ID NO: 1269607 - RNA, 15 nt, Human
uuuauauauuauaug

SEQ ID NO: 1269608 - RNA, 18 nt, Human
uuuauauauuauauggaa

SEQ ID NO: 1269609 - RNA, 21 nt, Human
uuuauauauuuaaaaguguca

SEQ ID NO: 1269610 - RNA, 15 nt, Human
uuuauaucacauguu

SEQ ID NO: 1269611 - RNA, 17 nt, Human
uuuauauauuauaugga

SEQ ID NO: 1269612 - RNA, 15 nt, Human
uuuaugugaaacaug

SEQ ID NO: 1269613 - RNA, 11 nt, Human
uuuaugucugg

SEQ ID NO: 1269614 - RNA, 19 nt, Human
uuuaugucuguggauuuuu

SEQ ID NO: 1269615 - RNA, 11 nt, Human
uuuauuaaaga

SEQ ID NO: 1269616 - RNA, 12 nt, Human
uuuauuaaagaa

SEQ ID NO: 1269617 - RNA, 13 nt, Human
uuuauuaaagaaa

SEQ ID NO: 1269618 - RNA, 14 nt, Human
uuuauuaaagaaaa

SEQ ID NO: 1269619 - RNA, 14 nt, Human
uuuaugugaaacau

SEQ ID NO: 1269620 - RNA, 11 nt, Human
uuuauguauug

SEQ ID NO: 1269621 - RNA, 19 nt, Human
uuuauguauugugcaaugu

SEQ ID NO: 1269622 - RNA, 16 nt, Human
uuuauuaaagaaaaaa

SEQ ID NO: 1269623 - RNA, 20 nt, Human
uuuagcuggaaaaguauguu

SEQ ID NO: 1269624 - RNA, 15 nt, Human
uuuagcugacaaaau

SEQ ID NO: 1269625 - RNA, 12 nt, Human
uuuagcucugag

SEQ ID NO: 1269626 - RNA, 13 nt, Human
uuuagcucugaga

SEQ ID NO: 1269627 - RNA, 14 nt, Human
uuuagcucugagaa

SEQ ID NO: 1269628 - RNA, 15 nt, Human
uuuagguaagaaguu

SEQ ID NO: 1269629 - RNA, 12 nt, Human
uuuagcauugua

SEQ ID NO: 1269630 - RNA, 14 nt, Human
uuuagccuguccug

SEQ ID NO: 1269631 - RNA, 16 nt, Human
uuuagccuucucuguu

SEQ ID NO: 1269632 - RNA, 11 nt, Human
uuuagcucuga

SEQ ID NO: 1269633 - RNA, 22 nt, Human
uuuaguaaaccaauccuaugca

SEQ ID NO: 1269634 - RNA, 11 nt, Human
uuuagguucua

SEQ ID NO: 1269635 - RNA, 12 nt, Human
uuuagguucuaa

SEQ ID NO: 1269636 - RNA, 13 nt, Human
uuuagguucuaaa

SEQ ID NO: 1269637 - RNA, 14 nt, Human
uuuagguucuaaag

SEQ ID NO: 1269638 - RNA, 15 nt, Human
uuuagguucuaaagu

SEQ ID NO: 1269639 - RNA, 16 nt, Human
uuuagguucuaaaguu

SEQ ID NO: 1269640 - RNA, 18 nt, Human
uuuagguucuaaaguucu

SEQ ID NO: 1269641 - RNA, 23 nt, Human
uuuagguucuaaaguucuaagau

SEQ ID NO: 1269642 - RNA, 22 nt, Human
uuuagguuuuuguuuguuuccu

SEQ ID NO: 1269643 - RNA, 23 nt, Human
uuuagguucuuugcugcauucug

SEQ ID NO: 1269644 - RNA, 13 nt, Human
uuuaguaaaccaa

SEQ ID NO: 1269645 - RNA, 23 nt, Human
uuuacuagggaucccucaucugu

SEQ ID NO: 1269646 - RNA, 18 nt, Human
uuuacuagggaucccuca

SEQ ID NO: 1269647 - RNA, 13 nt, Human
uuuagauagcccu

SEQ ID NO: 1269648 - RNA, 14 nt, Human
uuuagauagcccug

SEQ ID NO: 1269649 - RNA, 18 nt, Human
uuuagauagcccuguccu

SEQ ID NO: 1269650 - RNA, 20 nt, Human
uuuagauagcccuguccugg

SEQ ID NO: 1269651 - RNA, 23 nt, Human
uuuagauagcccuguccuggugg

SEQ ID NO: 1269652 - RNA, 22 nt, Human
uuuagauagcccuguccuggug

SEQ ID NO: 1269653 - RNA, 15 nt, Human
uuuagaucucugaag

SEQ ID NO: 1269654 - RNA, 14 nt, Human
uuuagcauguuguu

SEQ ID NO: 1269655 - RNA, 20 nt, Human
uuuagcauuguagugcuuug

SEQ ID NO: 1269656 - RNA, 23 nt, Human
auggaauuggagcucgugggaca

SEQ ID NO: 1269657 - RNA, 14 nt, Human
uuucccaugauuuc

SEQ ID NO: 1269658 - RNA, 22 nt, Human
uuucccaggcccacugugccuc

SEQ ID NO: 1269659 - RNA, 16 nt, Human
uuucccacuccaagcc

SEQ ID NO: 1269660 - RNA, 21 nt, Human
uuucccacuguuuaaggaguu

SEQ ID NO: 1269661 - RNA, 11 nt, Human
uuucccaggac

SEQ ID NO: 1269662 - RNA, 14 nt, Human
uuucccaggacccu

SEQ ID NO: 1269663 - RNA, 16 nt, Human
uuucccaggacccuga

SEQ ID NO: 1269664 - RNA, 18 nt, Human
uuucccaggacccugaag

SEQ ID NO: 1269665 - RNA, 21 nt, Human
uuucccaccccaaccugcucu

SEQ ID NO: 1269666 - RNA, 23 nt, Human
uuucccaccccaaccugcucucc

SEQ ID NO: 1269667 - RNA, 22 nt, Human
uuucccaccccaaccugcucuc

SEQ ID NO: 1269668 - RNA, 12 nt, Human
uuucccacucca

SEQ ID NO: 1269669 - RNA, 21 nt, Human
uuucaguuuauuugaaccaau

SEQ ID NO: 1269670 - RNA, 15 nt, Human
uuucauaaaaggaga

SEQ ID NO: 1269671 - RNA, 14 nt, Human
uuucauaaauuuga

SEQ ID NO: 1269672 - RNA, 14 nt, Human
uuucauaaguauuu

SEQ ID NO: 1269673 - RNA, 17 nt, Human
uuucauaaguauuucaa

SEQ ID NO: 1269674 - RNA, 18 nt, Human
uuucauaaguauuucaaa

SEQ ID NO: 1269675 - RNA, 19 nt, Human
uuucauaaguauuucaaau

SEQ ID NO: 1269676 - RNA, 14 nt, Human
uuucauacacuuau

SEQ ID NO: 1269677 - RNA, 16 nt, Human
uuucauacauuuucua

SEQ ID NO: 1269678 - RNA, 20 nt, Human
uuucauacauuuucuaagaa

SEQ ID NO: 1269679 - RNA, 18 nt, Human
uuucauauaaauggaauu

SEQ ID NO: 1269680 - RNA, 15 nt, Human
uuucauaguucagaa

SEQ ID NO: 1269681 - RNA, 16 nt, Human
uuucauaggucugaaa

SEQ ID NO: 1269682 - RNA, 17 nt, Human
uuucauaggucugaaau

SEQ ID NO: 1269683 - RNA, 14 nt, Human
uuucauaguucaga

SEQ ID NO: 1269684 - RNA, 15 nt, Human
uuucauagcuaaaaa

SEQ ID NO: 1269685 - RNA, 14 nt, Human
uuucauagcuaaaa

SEQ ID NO: 1269686 - RNA, 13 nt, Human
uuucauauaaagu

SEQ ID NO: 1269687 - RNA, 15 nt, Human
uuucauauaguuagc

SEQ ID NO: 1269688 - RNA, 12 nt, Human
uuucauaaagca

SEQ ID NO: 1269689 - RNA, 17 nt, Human
uuucacuguagcucuaa

SEQ ID NO: 1269690 - RNA, 21 nt, Human
uuucacugucuuuaauucugu

SEQ ID NO: 1269691 - RNA, 16 nt, Human
uuucaccuagauuuuu

SEQ ID NO: 1269692 - RNA, 23 nt, Human
uuucacugcuguuauauuucauc

SEQ ID NO: 1269693 - RNA, 15 nt, Human
uuucacuggagcaca

SEQ ID NO: 1269694 - RNA, 16 nt, Human
uuucacuggagcacaa

SEQ ID NO: 1269695 - RNA, 24 nt, Human
uuucacuguagaaugauuucaugc

SEQ ID NO: 1269696 - RNA, 17 nt, Human
uuuauuuuuuucugaau

SEQ ID NO: 1269697 - RNA, 16 nt, Human
uuuauuuuuugggaaa

SEQ ID NO: 1269698 - RNA, 13 nt, Human
uuucacauuuucc

SEQ ID NO: 1269699 - RNA, 14 nt, Human
uuucacauuuuccu

SEQ ID NO: 1269700 - RNA, 17 nt, Human
uuucaccagauuugcua

SEQ ID NO: 1269701 - RNA, 22 nt, Human
uuucaccauuugauuauguagc

SEQ ID NO: 1269702 - RNA, 16 nt, Human
uuuauuuuguguuuag

SEQ ID NO: 1269703 - RNA, 13 nt, Human
uuuauuuuuuggg

SEQ ID NO: 1269704 - RNA, 14 nt, Human
uuuauuuugacaua

SEQ ID NO: 1269705 - RNA, 16 nt, Human
uuuauuuuaauaaugu

SEQ ID NO: 1269706 - RNA, 20 nt, Human
augcuuauauuguucacuuc

SEQ ID NO: 1269707 - RNA, 23 nt, Human
augcuuagucccucaugcaaauc

SEQ ID NO: 1269708 - RNA, 13 nt, Human
augcuuauuccau

SEQ ID NO: 1269709 - RNA, 15 nt, Human
augcuuagucccuca

SEQ ID NO: 1269710 - RNA, 21 nt, Human
augcuuagucccucaugcaaa

SEQ ID NO: 1269711 - RNA, 15 nt, Human
augcuuauuccauga

SEQ ID NO: 1269712 - RNA, 17 nt, Human
augcuuauuccaugacu

SEQ ID NO: 1269713 - RNA, 23 nt, Human
augcuuauuccaugacugcuugc

SEQ ID NO: 1269714 - RNA, 22 nt, Human
augcuuauuccaugacugcuug

SEQ ID NO: 1269715 - RNA, 14 nt, Human
auggaacacuucga

SEQ ID NO: 1269716 - RNA, 19 nt, Human
uuuauuacuguaagaaaau

SEQ ID NO: 1269717 - RNA, 20 nt, Human
uuuauuaguauuguuguccu

SEQ ID NO: 1269718 - RNA, 15 nt, Human
uuuauuaugaagaag

SEQ ID NO: 1269719 - RNA, 9 nt, Human
augcuggga

SEQ ID NO: 1269720 - RNA, 10 nt, Human
augcugggac

SEQ ID NO: 1269721 - RNA, 15 nt, Human
augcugggacucagc

SEQ ID NO: 1269722 - RNA, 16 nt, Human
augcugggacucagcc

SEQ ID NO: 1269723 - RNA, 21 nt, Human
augcuggguccauaucacaca

SEQ ID NO: 1269724 - RNA, 14 nt, Human
augcuggugagcca

SEQ ID NO: 1269725 - RNA, 23 nt, Human
augcuguacaucuauuuuggauu

SEQ ID NO: 1269726 - RNA, 14 nt, Human
augcuguauuuuaa

SEQ ID NO: 1269727 - RNA, 14 nt, Human
augcuguauauguu

SEQ ID NO: 1269728 - RNA, 19 nt, Human
augcuguauuuuaaaagaa

SEQ ID NO: 1269729 - RNA, 13 nt, Human
augcuguacccag

SEQ ID NO: 1269730 - RNA, 16 nt, Human
augcuguacccaguuu

SEQ ID NO: 1269731 - RNA, 23 nt, Human
augcugugacacauggccccucc

SEQ ID NO: 1269732 - RNA, 21 nt, Human
augcugugagucuuugguucu

SEQ ID NO: 1269733 - RNA, 22 nt, Human
augcugugagucuuugguucua

SEQ ID NO: 1269734 - RNA, 13 nt, Human
augcuuacugaua

SEQ ID NO: 1269735 - RNA, 22 nt, Human
augcuuacugauauauuuuaca

SEQ ID NO: 1269736 - RNA, 23 nt, Human
augcuuacugauauauuuuacaa

SEQ ID NO: 1269737 - RNA, 17 nt, Human
augcuuagauguuccag

SEQ ID NO: 1269738 - RNA, 18 nt, Human
uuucuauagccaaaaaua

SEQ ID NO: 1269739 - RNA, 21 nt, Human
uuucuaguguaucaaaaugcu

SEQ ID NO: 1269740 - RNA, 20 nt, Human
uuucuaguguaucaaaaugc

SEQ ID NO: 1269741 - RNA, 19 nt, Human
uuucuaguguaucaaaaug

SEQ ID NO: 1269742 - RNA, 13 nt, Human
uuucuaguugaaa

SEQ ID NO: 1269743 - RNA, 16 nt, Human
uuucuaguguaucaaa

SEQ ID NO: 1269744 - RNA, 21 nt, Human
uuucuaggacugaauuaugaa

SEQ ID NO: 1269745 - RNA, 17 nt, Human
uuucuaggacugaauua

SEQ ID NO: 1269746 - RNA, 14 nt, Human
uuucuaaacuggag

SEQ ID NO: 1269747 - RNA, 15 nt, Human
uuucuaaacuggaga

SEQ ID NO: 1269748 - RNA, 16 nt, Human
uuucuaaacuggagac

SEQ ID NO: 1269749 - RNA, 17 nt, Human
uuucuaaacuggagacu

SEQ ID NO: 1269750 - RNA, 19 nt, Human
uuucuaaacuggagacugu

SEQ ID NO: 1269751 - RNA, 20 nt, Human
uuucuaaacuggagacugug

SEQ ID NO: 1269752 - RNA, 22 nt, Human
uuucuaggacugaauuaugaaa

SEQ ID NO: 1269753 - RNA, 17 nt, Human
uuucuagguaggaaaug

SEQ ID NO: 1269754 - RNA, 21 nt, Human
uuucuagguaggaaauguggu

SEQ ID NO: 1269755 - RNA, 13 nt, Human
uuucuaugaaaua

SEQ ID NO: 1269756 - RNA, 22 nt, Human
uuucuauagccaaaaauagcua

SEQ ID NO: 1269757 - RNA, 15 nt, Human
uuucuauccucugua

SEQ ID NO: 1269758 - RNA, 17 nt, Human
uuucuaucguucucucu

SEQ ID NO: 1269759 - RNA, 19 nt, Human
uuucuaucguucucucuuu

SEQ ID NO: 1269760 - RNA, 20 nt, Human
uuucuaucguucucucuuug

SEQ ID NO: 1269761 - RNA, 14 nt, Human
uuucuaugaaauau

SEQ ID NO: 1269762 - RNA, 20 nt, Human
uuucuaugaaauauuauguu

SEQ ID NO: 1269763 - RNA, 23 nt, Human
uuucuauggguguuaucaccuag

SEQ ID NO: 1269764 - RNA, 14 nt, Human
uuucuauuaaaaga

SEQ ID NO: 1269765 - RNA, 15 nt, Human
uuucuauuaaaagac

SEQ ID NO: 1269766 - RNA, 16 nt, Human
uuucuauuaaaagacu

SEQ ID NO: 1269767 - RNA, 17 nt, Human
uuucuauuaaaagacuc

SEQ ID NO: 1269768 - RNA, 18 nt, Human
uuucuauuaaaagacuca

SEQ ID NO: 1269769 - RNA, 19 nt, Human
uuucuauuaaaagacucau

SEQ ID NO: 1269770 - RNA, 23 nt, Human
uuucuauuaaaagacucauccgu

SEQ ID NO: 1269771 - RNA, 15 nt, Human
uuucugcaucuccac

SEQ ID NO: 1269772 - RNA, 16 nt, Human
uuucugcaucuccacu

SEQ ID NO: 1269773 - RNA, 12 nt, Human
uuucugcccugc

SEQ ID NO: 1269774 - RNA, 13 nt, Human
uuucugcaucucc

SEQ ID NO: 1269775 - RNA, 17 nt, Human
uuucugcauauguugaa

SEQ ID NO: 1269776 - RNA, 13 nt, Human
uuucugcauaugu

SEQ ID NO: 1269777 - RNA, 22 nt, Human
uuucucauuugccaauaauaau

SEQ ID NO: 1269778 - RNA, 19 nt, Human
uuucucauugcucugaaua

SEQ ID NO: 1269779 - RNA, 21 nt, Human
uuucuccaagagcuacauaau

SEQ ID NO: 1269780 - RNA, 15 nt, Human
uuucuccaagagcua

SEQ ID NO: 1269781 - RNA, 11 nt, Human
uuucuccagcu

SEQ ID NO: 1269782 - RNA, 12 nt, Human
uuucuccagcug

SEQ ID NO: 1269783 - RNA, 16 nt, Human
uuucuauuucacugga

SEQ ID NO: 1269784 - RNA, 17 nt, Human
uuucuauuucacuggag

SEQ ID NO: 1269785 - RNA, 17 nt, Human
uuucuauuucuccucca

SEQ ID NO: 1269786 - RNA, 19 nt, Human
uuucuauuucacuggagca

SEQ ID NO: 1269787 - RNA, 15 nt, Human
uuucuauuuuuaucu

SEQ ID NO: 1269788 - RNA, 13 nt, Human
uuucuauuuuuau

SEQ ID NO: 1269789 - RNA, 16 nt, Human
uuucucacuaaaucuu

SEQ ID NO: 1269790 - RNA, 16 nt, Human
uuucucaguuuucaua

SEQ ID NO: 1269791 - RNA, 20 nt, Human
uuucucauccacauacccug

SEQ ID NO: 1269792 - RNA, 19 nt, Human
uuugaaacacuuugcauaa

SEQ ID NO: 1269793 - RNA, 17 nt, Human
uuugaaacacuuugcau

SEQ ID NO: 1269794 - RNA, 11 nt, Human
uuugaaaaugg

SEQ ID NO: 1269795 - RNA, 22 nt, Human
uuugaaaccccuguaggccuca

SEQ ID NO: 1269796 - RNA, 21 nt, Human
uuugaaagaauagaacacagu

SEQ ID NO: 1269797 - RNA, 21 nt, Human
uuugaaaggagaugucuugga

SEQ ID NO: 1269798 - RNA, 16 nt, Human
uuugaaagucuguccu

SEQ ID NO: 1269799 - RNA, 17 nt, Human
uuugaaagucuguccuu

SEQ ID NO: 1269800 - RNA, 19 nt, Human
uuugaaagucuguccuuga

SEQ ID NO: 1269801 - RNA, 12 nt, Human
uuugaaauaagc

SEQ ID NO: 1269802 - RNA, 14 nt, Human
uuugaaauaagcua

SEQ ID NO: 1269803 - RNA, 19 nt, Human
uuugaaauaagcuauuuga

SEQ ID NO: 1269804 - RNA, 14 nt, Human
uuugaaauauugac

SEQ ID NO: 1269805 - RNA, 15 nt, Human
uuugaaauauugacu

SEQ ID NO: 1269806 - RNA, 16 nt, Human
uuugaaauaagcuauu

SEQ ID NO: 1269807 - RNA, 16 nt, Human
uuugaaauauggucuu

SEQ ID NO: 1269808 - RNA, 14 nt, Human
auggggaccagcag

SEQ ID NO: 1269809 - RNA, 13 nt, Human
auggggaggacaa

SEQ ID NO: 1269810 - RNA, 17 nt, Human
auggggaggacaaaaug

SEQ ID NO: 1269811 - RNA, 14 nt, Human
auggggaggaggag

SEQ ID NO: 1269812 - RNA, 11 nt, Human
auggggaggga

SEQ ID NO: 1269813 - RNA, 18 nt, Human
uuugaaaagcagacauuu

SEQ ID NO: 1269814 - RNA, 16 nt, Human
uuugaaaagcagacau

SEQ ID NO: 1269815 - RNA, 13 nt, Human
uuugaaaagcaga

SEQ ID NO: 1269816 - RNA, 16 nt, Human
uuucuuuucucuggua

SEQ ID NO: 1269817 - RNA, 22 nt, Human
uuucuuuucuggaauguaauca

SEQ ID NO: 1269818 - RNA, 13 nt, Human
uuucuuuucuuug

SEQ ID NO: 1269819 - RNA, 23 nt, Human
uuucuuuugguaaagacuggcuu

SEQ ID NO: 1269820 - RNA, 15 nt, Human
uuucuuuguguagcu

SEQ ID NO: 1269821 - RNA, 18 nt, Human
uuucuuuguuucuuucuu

SEQ ID NO: 1269822 - RNA, 19 nt, Human
uuucuuuguuucuuucuuu

SEQ ID NO: 1269823 - RNA, 9 nt, Human
uuucuuuuc

SEQ ID NO: 1269824 - RNA, 21 nt, Human
uuucuuuucccccauuaauca

SEQ ID NO: 1269825 - RNA, 15 nt, Human
uuucuuuacaaaaca

SEQ ID NO: 1269826 - RNA, 14 nt, Human
uuucuuucaaaauu

SEQ ID NO: 1269827 - RNA, 13 nt, Human
uuucugcccugcc

SEQ ID NO: 1269828 - RNA, 14 nt, Human
uuucugccuggagu

SEQ ID NO: 1269829 - RNA, 22 nt, Human
uuucugccuggaguguaugacu

SEQ ID NO: 1269830 - RNA, 17 nt, Human
uuucugcuuuaaaaaug

SEQ ID NO: 1269831 - RNA, 18 nt, Human
uuucugcuuuaaaaaugu

SEQ ID NO: 1269832 - RNA, 18 nt, Human
uuucuggaauacaugaaa

SEQ ID NO: 1269833 - RNA, 20 nt, Human
uuucuggaauacaugaaaua

SEQ ID NO: 1269834 - RNA, 21 nt, Human
uuucuggaauacaugaaauau

SEQ ID NO: 1269835 - RNA, 18 nt, Human
uuucuggaauguaaucaa

SEQ ID NO: 1269836 - RNA, 15 nt, Human
uuucuggauuucaua

SEQ ID NO: 1269837 - RNA, 23 nt, Human
uuucuggauuccccaucucaggc

SEQ ID NO: 1269838 - RNA, 11 nt, Human
uuucuggccag

SEQ ID NO: 1269839 - RNA, 19 nt, Human
uuucuggccaguguuuaaa

SEQ ID NO: 1269840 - RNA, 15 nt, Human
uuucuuuaaaaaaca

SEQ ID NO: 1269841 - RNA, 12 nt, Human
uuucuuuaacug

SEQ ID NO: 1269842 - RNA, 13 nt, Human
uuucuuuaacugc

SEQ ID NO: 1269843 - RNA, 22 nt, Human
augggacauuugcucauggaau

SEQ ID NO: 1269844 - RNA, 21 nt, Human
augggacauuugcucauggaa

SEQ ID NO: 1269845 - RNA, 17 nt, Human
auggccucauguggcug

SEQ ID NO: 1269846 - RNA, 18 nt, Human
auggccucauguggcugg

SEQ ID NO: 1269847 - RNA, 19 nt, Human
auggccucauguggcugga

SEQ ID NO: 1269848 - RNA, 20 nt, Human
auggccucauguggcuggaa

SEQ ID NO: 1269849 - RNA, 13 nt, Human
auggaccggagag

SEQ ID NO: 1269850 - RNA, 16 nt, Human
auggaccggagagugg

SEQ ID NO: 1269851 - RNA, 20 nt, Human
auggaccggagagugggggu

SEQ ID NO: 1269852 - RNA, 18 nt, Human
auggaccugccugcauag

SEQ ID NO: 1269853 - RNA, 13 nt, Human
auggccucaugug

SEQ ID NO: 1269854 - RNA, 18 nt, Human
auggaauugauuugcauu

SEQ ID NO: 1269855 - RNA, 19 nt, Human
auggaauugauuugcauug

SEQ ID NO: 1269856 - RNA, 17 nt, Human
auggaauuuugcaaaga

SEQ ID NO: 1269857 - RNA, 17 nt, Human
augggagccgggucugc

SEQ ID NO: 1269858 - RNA, 20 nt, Human
augggagccgggucugccuc

SEQ ID NO: 1269859 - RNA, 15 nt, Human
augggacuggccucu

SEQ ID NO: 1269860 - RNA, 17 nt, Human
auggccugcaaacuggg

SEQ ID NO: 1269861 - RNA, 13 nt, Human
augggacauuuuu

SEQ ID NO: 1269862 - RNA, 12 nt, Human
augggaccacaa

SEQ ID NO: 1269863 - RNA, 23 nt, Human
augggagcugaggccacacucag

SEQ ID NO: 1269864 - RNA, 14 nt, Human
augggcagagccca

SEQ ID NO: 1269865 - RNA, 14 nt, Human
augggcccaggccu

SEQ ID NO: 1269866 - RNA, 16 nt, Human
augggcaucuuuugua

SEQ ID NO: 1269867 - RNA, 17 nt, Human
augggcaucuuuuguau

SEQ ID NO: 1269868 - RNA, 21 nt, Human
augggcaucuuuuguauuaag

SEQ ID NO: 1269869 - RNA, 20 nt, Human
augggcaucuuuuguauuaa

SEQ ID NO: 1269870 - RNA, 13 nt, Human
augggcauggugu

SEQ ID NO: 1269871 - RNA, 18 nt, Human
uuucggacaguuuauuug

SEQ ID NO: 1269872 - RNA, 17 nt, Human
uuucggauuuuuuccaa

SEQ ID NO: 1269873 - RNA, 16 nt, Human
uuucguaacacagcau

SEQ ID NO: 1269874 - RNA, 21 nt, Human
uuucgucuguuuauaaacauu

SEQ ID NO: 1269875 - RNA, 13 nt, Human
uuucguggggagg

SEQ ID NO: 1269876 - RNA, 14 nt, Human
uuucguuuguuugu

SEQ ID NO: 1269877 - RNA, 12 nt, Human
uuucguuuguuu

SEQ ID NO: 1269878 - RNA, 12 nt, Human
uuucuaaaaucu

SEQ ID NO: 1269879 - RNA, 21 nt, Human
uuucuaaaaucuuauaguucu

SEQ ID NO: 1269880 - RNA, 21 nt, Human
uuuccuuuuaaaacacuucca

SEQ ID NO: 1269881 - RNA, 13 nt, Human
uuuccuuuuuaau

SEQ ID NO: 1269882 - RNA, 19 nt, Human
uuuccuuuuuaauaugcuu

SEQ ID NO: 1269883 - RNA, 22 nt, Human
uuuccuuuuuaauaugcuuaaa

SEQ ID NO: 1269884 - RNA, 16 nt, Human
uuuccuuuuuuguuau

SEQ ID NO: 1269885 - RNA, 17 nt, Human
uuuccuuuuuuguuauu

SEQ ID NO: 1269886 - RNA, 14 nt, Human
uuucgaaaaucaaa

SEQ ID NO: 1269887 - RNA, 21 nt, Human
uuuccuuuaacugacaagcca

SEQ ID NO: 1269888 - RNA, 20 nt, Human
uuuccuguccucuuucagcu

SEQ ID NO: 1269889 - RNA, 21 nt, Human
uuuccuguccucuuucagcuc

SEQ ID NO: 1269890 - RNA, 18 nt, Human
uuuccuucaaaguuuaau

SEQ ID NO: 1269891 - RNA, 21 nt, Human
uuuccuuccaaugucuggaga

SEQ ID NO: 1269892 - RNA, 12 nt, Human
uuuccuuccaau

SEQ ID NO: 1269893 - RNA, 14 nt, Human
uuuccuucccuuuu

SEQ ID NO: 1269894 - RNA, 18 nt, Human
uuuccuucccuuuucugu

SEQ ID NO: 1269895 - RNA, 19 nt, Human
uuuccuucccuuuucuguu

SEQ ID NO: 1269896 - RNA, 20 nt, Human
uuuccuucccuuuucuguuc

SEQ ID NO: 1269897 - RNA, 16 nt, Human
uucagauaugauucaa

SEQ ID NO: 1269898 - RNA, 17 nt, Human
uucagauaugauucaaa

SEQ ID NO: 1269899 - RNA, 18 nt, Human
uucagauaugauucaaau

SEQ ID NO: 1269900 - RNA, 14 nt, Human
uucagaagaaaaag

SEQ ID NO: 1269901 - RNA, 12 nt, Human
uucagaagaaaa

SEQ ID NO: 1269902 - RNA, 19 nt, Human
uucagauaugauucaaaug

SEQ ID NO: 1269903 - RNA, 22 nt, Human
uucagauaucuuggacaaauca

SEQ ID NO: 1269904 - RNA, 14 nt, Human
uucagauucccaga

SEQ ID NO: 1269905 - RNA, 21 nt, Human
uucagauucccagagcaaaau

SEQ ID NO: 1269906 - RNA, 22 nt, Human
uucagauucccagagcaaaaua

SEQ ID NO: 1269907 - RNA, 17 nt, Human
uucacuuuugacaaagg

SEQ ID NO: 1269908 - RNA, 20 nt, Human
uucacuuuugacaaaggcaa

SEQ ID NO: 1269909 - RNA, 22 nt, Human
uucagaaccccaacuacugugu

SEQ ID NO: 1269910 - RNA, 23 nt, Human
uucagaaccccaacuacuguguu

SEQ ID NO: 1269911 - RNA, 16 nt, Human
uucacuucacugugcu

SEQ ID NO: 1269912 - RNA, 18 nt, Human
uuaucauucaaguguaaa

SEQ ID NO: 1269913 - RNA, 19 nt, Human
uucacuucauaauccagua

SEQ ID NO: 1269914 - RNA, 23 nt, Human
uuaucauguuaguaauaccucua

SEQ ID NO: 1269915 - RNA, 22 nt, Human
uuaucauguuaguaauaccucu

SEQ ID NO: 1269916 - RNA, 18 nt, Human
uuaucauguuaguaauac

SEQ ID NO: 1269917 - RNA, 17 nt, Human
uuaucauguuaguaaua

SEQ ID NO: 1269918 - RNA, 11 nt, Human
uuaucauguua

SEQ ID NO: 1269919 - RNA, 23 nt, Human
uucagcacuuuagaauaugccuu

SEQ ID NO: 1269920 - RNA, 22 nt, Human
uucagcacuuuagaauaugccu

SEQ ID NO: 1269921 - RNA, 20 nt, Human
uucagcacugucccuugccu

SEQ ID NO: 1269922 - RNA, 17 nt, Human
uucagcaggcccaagua

SEQ ID NO: 1269923 - RNA, 23 nt, Human
uucagcauccgcaggugcugguc

SEQ ID NO: 1269924 - RNA, 19 nt, Human
uucagcauccgcaggugcu

SEQ ID NO: 1269925 - RNA, 12 nt, Human
uucagauuuggc

SEQ ID NO: 1269926 - RNA, 14 nt, Human
uucagcacuguccc

SEQ ID NO: 1269927 - RNA, 15 nt, Human
uucagcacugucccu

SEQ ID NO: 1269928 - RNA, 16 nt, Human
uucagcacugucccuu

SEQ ID NO: 1269929 - RNA, 21 nt, Human
uucagcacugucccuugccuc

SEQ ID NO: 1269930 - RNA, 17 nt, Human
uucagcgguuuauauaa

SEQ ID NO: 1269931 - RNA, 14 nt, Human
uucagcuaagcuag

SEQ ID NO: 1269932 - RNA, 20 nt, Human
uucagcuaagcuaggaauga

SEQ ID NO: 1269933 - RNA, 12 nt, Human
uucagcaugcaa

SEQ ID NO: 1269934 - RNA, 10 nt, Human
uucagccaag

SEQ ID NO: 1269935 - RNA, 11 nt, Human
uucagcauuug

SEQ ID NO: 1269936 - RNA, 14 nt, Human
uucagcucacugca

SEQ ID NO: 1269937 - RNA, 13 nt, Human
auauaugcuaagu

SEQ ID NO: 1269938 - RNA, 15 nt, Human
uucaucaaugaauga

SEQ ID NO: 1269939 - RNA, 20 nt, Human
auauauggggaugguaguuu

SEQ ID NO: 1269940 - RNA, 22 nt, Human
auauauggggaugguaguuuuu

SEQ ID NO: 1269941 - RNA, 21 nt, Human
auauauggggaugguaguuuu

SEQ ID NO: 1269942 - RNA, 16 nt, Human
auauauuuuacaauuu

SEQ ID NO: 1269943 - RNA, 21 nt, Human
uucauauuuuucauagcuaaa

SEQ ID NO: 1269944 - RNA, 12 nt, Human
uucauaugcaua

SEQ ID NO: 1269945 - RNA, 19 nt, Human
uucauaguucagaauuuag

SEQ ID NO: 1269946 - RNA, 20 nt, Human
uucauaguucagaauuuagu

SEQ ID NO: 1269947 - RNA, 14 nt, Human
uucauauaaaguau

SEQ ID NO: 1269948 - RNA, 16 nt, Human
uucauauaaaguauca

SEQ ID NO: 1269949 - RNA, 18 nt, Human
uucauauaugaggacuug

SEQ ID NO: 1269950 - RNA, 21 nt, Human
uucauauaugaggacuugugu

SEQ ID NO: 1269951 - RNA, 21 nt, Human
uucauauaguuagcuaauaaa

SEQ ID NO: 1269952 - RNA, 15 nt, Human
uucauaucauccaca

SEQ ID NO: 1269953 - RNA, 24 nt, Human
uucagucucuauaccaauaaagug

SEQ ID NO: 1269954 - RNA, 23 nt, Human
uucagucucuauaccaauaaagu

SEQ ID NO: 1269955 - RNA, 22 nt, Human
uucagucucuauaccaauaaag

SEQ ID NO: 1269956 - RNA, 21 nt, Human
uucagucucuauaccaauaaa

SEQ ID NO: 1269957 - RNA, 18 nt, Human
uucagucucuauaccaau

SEQ ID NO: 1269958 - RNA, 13 nt, Human
uucauaggucuga

SEQ ID NO: 1269959 - RNA, 15 nt, Human
uucauaggucugaaa

SEQ ID NO: 1269960 - RNA, 17 nt, Human
uucauaggucugaaauu

SEQ ID NO: 1269961 - RNA, 22 nt, Human
uucauaggucugaaauuuuucu

SEQ ID NO: 1269962 - RNA, 17 nt, Human
uucauaguaacuucuua

SEQ ID NO: 1269963 - RNA, 14 nt, Human
uucauaguucagaa

SEQ ID NO: 1269964 - RNA, 16 nt, Human
uucauaguucagaauu

SEQ ID NO: 1269965 - RNA, 17 nt, Human
uucauaguucagaauuu

SEQ ID NO: 1269966 - RNA, 14 nt, Human
uucagguccaggcu

SEQ ID NO: 1269967 - RNA, 16 nt, Human
uucagguuuuuccuuu

SEQ ID NO: 1269968 - RNA, 13 nt, Human
uucagguuuuucc

SEQ ID NO: 1269969 - RNA, 16 nt, Human
auauauuuuguuuaca

SEQ ID NO: 1269970 - RNA, 17 nt, Human
auaugaaagcugauuuu

SEQ ID NO: 1269971 - RNA, 18 nt, Human
auauauuuuacaauuuuu

SEQ ID NO: 1269972 - RNA, 15 nt, Human
auauauuuucuguuu

SEQ ID NO: 1269973 - RNA, 15 nt, Human
auaugaacauauugu

SEQ ID NO: 1269974 - RNA, 20 nt, Human
auaugaacauauuguugaaa

SEQ ID NO: 1269975 - RNA, 19 nt, Human
auaugaacauauuguugaa

SEQ ID NO: 1269976 - RNA, 14 nt, Human
auaugaagacauaa

SEQ ID NO: 1269977 - RNA, 15 nt, Human
auaugaagacauaaa

SEQ ID NO: 1269978 - RNA, 16 nt, Human
auaugaagacauaaac

SEQ ID NO: 1269979 - RNA, 20 nt, Human
auaugcaaacaggguaacua

SEQ ID NO: 1269980 - RNA, 23 nt, Human
auauggccacaguagucuugaug

SEQ ID NO: 1269981 - RNA, 15 nt, Human
auaugggacauuuuu

SEQ ID NO: 1269982 - RNA, 21 nt, Human
auaugacuguuuuucggacag

SEQ ID NO: 1269983 - RNA, 22 nt, Human
auaugacuguuuuucggacagu

SEQ ID NO: 1269984 - RNA, 12 nt, Human
uucauuaaauaa

SEQ ID NO: 1269985 - RNA, 14 nt, Human
uucauuaaauaaau

SEQ ID NO: 1269986 - RNA, 16 nt, Human
uucauuaacaaaaugu

SEQ ID NO: 1269987 - RNA, 22 nt, Human
auauguguaugcacaguaaaaa

SEQ ID NO: 1269988 - RNA, 15 nt, Human
auauguauaacuuua

SEQ ID NO: 1269989 - RNA, 16 nt, Human
auauguauaacuuuaa

SEQ ID NO: 1269990 - RNA, 22 nt, Human
uucaugcuguucaugaaagauu

SEQ ID NO: 1269991 - RNA, 23 nt, Human
auauguaccuaacgaaguauccu

SEQ ID NO: 1269992 - RNA, 21 nt, Human
auauguacccucugaaauaca

SEQ ID NO: 1269993 - RNA, 17 nt, Human
auaugggacauuuuuga

SEQ ID NO: 1269994 - RNA, 20 nt, Human
auauggggaugguaguuuuu

SEQ ID NO: 1269995 - RNA, 19 nt, Human
auauggggaugguaguuuu

SEQ ID NO: 1269996 - RNA, 22 nt, Human
uucauugaguugguuacuucau

SEQ ID NO: 1269997 - RNA, 16 nt, Human
uucauuaauucuauaa

SEQ ID NO: 1269998 - RNA, 13 nt, Human
uucauuaaauaaa

SEQ ID NO: 1269999 - RNA, 20 nt, Human
uucauuagaaauauuuuaaa

SEQ ID NO: 1270000 - RNA, 16 nt, Human
uucauuagucauguuu

SEQ ID NO: 1270001 - RNA, 15 nt, Human
uucauuagucauguu

SEQ ID NO: 1270002 - RNA, 15 nt, Human
uuccaagacucuaga

SEQ ID NO: 1270003 - RNA, 16 nt, Human
uuccaagacucuagag

SEQ ID NO: 1270004 - RNA, 17 nt, Human
uuccaagacucuagagu

SEQ ID NO: 1270005 - RNA, 17 nt, Human
uuccaauuuaguuguug

SEQ ID NO: 1270006 - RNA, 18 nt, Human
uuccaaugucuggagacc

SEQ ID NO: 1270007 - RNA, 21 nt, Human
uuccaagacucuagaguccaa

SEQ ID NO: 1270008 - RNA, 22 nt, Human
uuccaagacucuagaguccaag

SEQ ID NO: 1270009 - RNA, 16 nt, Human
uuccaaugucuggaga

SEQ ID NO: 1270010 - RNA, 17 nt, Human
uuccaaugucuggagac

SEQ ID NO: 1270011 - RNA, 21 nt, Human
uuccaauuuucuggaauacau

SEQ ID NO: 1270012 - RNA, 19 nt, Human
uucauugcacuuugauuag

SEQ ID NO: 1270013 - RNA, 18 nt, Human
uucauugaguugguuacu

SEQ ID NO: 1270014 - RNA, 22 nt, Human
uuccaacucguauagcaugcau

SEQ ID NO: 1270015 - RNA, 19 nt, Human
uuccaacucguauagcaug

SEQ ID NO: 1270016 - RNA, 17 nt, Human
uuccaacuuggcugcag

SEQ ID NO: 1270017 - RNA, 22 nt, Human
uuccaacuuggcugcaggaauc

SEQ ID NO: 1270018 - RNA, 16 nt, Human
uuccaagacaugucug

SEQ ID NO: 1270019 - RNA, 21 nt, Human
uuccaagacaugucuguucua

SEQ ID NO: 1270020 - RNA, 22 nt, Human
uuccaccacagccagcaccugg

SEQ ID NO: 1270021 - RNA, 17 nt, Human
uuccaccaaaugugcuu

SEQ ID NO: 1270022 - RNA, 15 nt, Human
uuccaccuucccaug

SEQ ID NO: 1270023 - RNA, 15 nt, Human
uuccacggagccacu

SEQ ID NO: 1270024 - RNA, 21 nt, Human
uuccacggagccacuccucug

SEQ ID NO: 1270025 - RNA, 22 nt, Human
uuccacggagccacuccucuga

SEQ ID NO: 1270026 - RNA, 14 nt, Human
uuccacagaggaca

SEQ ID NO: 1270027 - RNA, 22 nt, Human
uuccacagaggacacagagaag

SEQ ID NO: 1270028 - RNA, 21 nt, Human
uuccacagccugcaagucagu

SEQ ID NO: 1270029 - RNA, 17 nt, Human
uuccacagggucccaca

SEQ ID NO: 1270030 - RNA, 22 nt, Human
uuccacagggucccacagccac

SEQ ID NO: 1270031 - RNA, 18 nt, Human
uuccacagggucccacag

SEQ ID NO: 1270032 - RNA, 15 nt, Human
uuccaccacagccag

SEQ ID NO: 1270033 - RNA, 16 nt, Human
uuccaccacagccagc

SEQ ID NO: 1270034 - RNA, 21 nt, Human
uuccaccacagccagcaccug

SEQ ID NO: 1270035 - RNA, 24 nt, Human
uuccacggagccacuccucugacu

SEQ ID NO: 1270036 - RNA, 19 nt, Human
uuccacguacugcagccuc

SEQ ID NO: 1270037 - RNA, 14 nt, Human
uuccaggcuucugc

SEQ ID NO: 1270038 - RNA, 15 nt, Human
uuccaggcuucugcu

SEQ ID NO: 1270039 - RNA, 16 nt, Human
uuccaggcuucugcug

SEQ ID NO: 1270040 - RNA, 17 nt, Human
uuccaggcuucugcugg

SEQ ID NO: 1270041 - RNA, 18 nt, Human
uuccaggcuucugcuggg

SEQ ID NO: 1270042 - RNA, 20 nt, Human
uuccaggcuucugcuggggc

SEQ ID NO: 1270043 - RNA, 22 nt, Human
uuccaggcuucugcuggggccu

SEQ ID NO: 1270044 - RNA, 18 nt, Human
auauucucacagcuccaa

SEQ ID NO: 1270045 - RNA, 13 nt, Human
auauucuaagacu

SEQ ID NO: 1270046 - RNA, 14 nt, Human
auauucuaagacuu

SEQ ID NO: 1270047 - RNA, 23 nt, Human
auauucuaagacuuacucuaaga

SEQ ID NO: 1270048 - RNA, 22 nt, Human
auauucuauuacauuuucagug

SEQ ID NO: 1270049 - RNA, 21 nt, Human
auauuccugcauuugugaaau

SEQ ID NO: 1270050 - RNA, 15 nt, Human
auauuacacuacaca

SEQ ID NO: 1270051 - RNA, 23 nt, Human
auauuacagauaaaauguaaacu

SEQ ID NO: 1270052 - RNA, 21 nt, Human
auauucucacagcuccaagaa

SEQ ID NO: 1270053 - RNA, 14 nt, Human
auauugacuuguau

SEQ ID NO: 1270054 - RNA, 15 nt, Human
auauugacuuguaua

SEQ ID NO: 1270055 - RNA, 16 nt, Human
auauugacuuguauau

SEQ ID NO: 1270056 - RNA, 19 nt, Human
auauugauaagaucuuuua

SEQ ID NO: 1270057 - RNA, 17 nt, Human
auauugagucaaauggu

SEQ ID NO: 1270058 - RNA, 18 nt, Human
auauugauaagaucuuuu

SEQ ID NO: 1270059 - RNA, 12 nt, Human
auauuggaacuu

SEQ ID NO: 1270060 - RNA, 19 nt, Human
auauuggacaaagaaccuu

SEQ ID NO: 1270061 - RNA, 21 nt, Human
auauuggccaaggaaaggcac

SEQ ID NO: 1270062 - RNA, 17 nt, Human
auauuggccaaggaaag

SEQ ID NO: 1270063 - RNA, 16 nt, Human
auauuguaaaacaggu

SEQ ID NO: 1270064 - RNA, 17 nt, Human
auauuguaaaacaggua

SEQ ID NO: 1270065 - RNA, 12 nt, Human
auauuguaaaua

SEQ ID NO: 1270066 - RNA, 19 nt, Human
auauuguuuuacaauaguu

SEQ ID NO: 1270067 - RNA, 19 nt, Human
auauuuaaauguaaagaca

SEQ ID NO: 1270068 - RNA, 21 nt, Human
auauuuaaauguaaagacaaa

SEQ ID NO: 1270069 - RNA, 19 nt, Human
auauuuaacucucuuuaug

SEQ ID NO: 1270070 - RNA, 13 nt, Human
auauuuacaaaug

SEQ ID NO: 1270071 - RNA, 14 nt, Human
auauuguuugcuaa

SEQ ID NO: 1270072 - RNA, 19 nt, Human
auauuguggguguuaauuu

SEQ ID NO: 1270073 - RNA, 14 nt, Human
auauugugauucug

SEQ ID NO: 1270074 - RNA, 17 nt, Human
auauugugauucugccu

SEQ ID NO: 1270075 - RNA, 19 nt, Human
auauugugauucugccuuu

SEQ ID NO: 1270076 - RNA, 12 nt, Human
auauuacaauga

SEQ ID NO: 1270077 - RNA, 16 nt, Human
auauuacaaugaucac

SEQ ID NO: 1270078 - RNA, 15 nt, Human
auauuacaaugauca

SEQ ID NO: 1270079 - RNA, 13 nt, Human
auauuacaaugau

SEQ ID NO: 1270080 - RNA, 15 nt, Human
auauguugaauacuu

SEQ ID NO: 1270081 - RNA, 16 nt, Human
auauguugaauacuuu

SEQ ID NO: 1270082 - RNA, 17 nt, Human
auauguugaauacuuuu

SEQ ID NO: 1270083 - RNA, 18 nt, Human
auauguugaauacuuuuu

SEQ ID NO: 1270084 - RNA, 16 nt, Human
auauguuguaauauuu

SEQ ID NO: 1270085 - RNA, 21 nt, Human
auauguuguaauauuucuuca

SEQ ID NO: 1270086 - RNA, 13 nt, Human
auauguuguucuu

SEQ ID NO: 1270087 - RNA, 14 nt, Human
auauguuguucuua

SEQ ID NO: 1270088 - RNA, 21 nt, Human
auauguuguucuuacaaacca

SEQ ID NO: 1270089 - RNA, 16 nt, Human
auauguucugacauaa

SEQ ID NO: 1270090 - RNA, 14 nt, Human
auauguugaauacu

SEQ ID NO: 1270091 - RNA, 18 nt, Human
uucccaguuggagcucca

SEQ ID NO: 1270092 - RNA, 12 nt, Human
uucccaggccca

SEQ ID NO: 1270093 - RNA, 22 nt, Human
uucccaggcccacugugccuca

SEQ ID NO: 1270094 - RNA, 19 nt, Human
uucccaggcccacugugcc

SEQ ID NO: 1270095 - RNA, 21 nt, Human
uucccagguaggccaaggugu

SEQ ID NO: 1270096 - RNA, 12 nt, Human
uucccaggugcu

SEQ ID NO: 1270097 - RNA, 16 nt, Human
uucccaggugcuacac

SEQ ID NO: 1270098 - RNA, 15 nt, Human
uucccagucugucga

SEQ ID NO: 1270099 - RNA, 15 nt, Human
uucccaguuggagcu

SEQ ID NO: 1270100 - RNA, 16 nt, Human
uucccaguuggagcuc

SEQ ID NO: 1270101 - RNA, 22 nt, Human
uuccagugaaaucaguuacucu

SEQ ID NO: 1270102 - RNA, 17 nt, Human
uuccagucuuccugaca

SEQ ID NO: 1270103 - RNA, 20 nt, Human
uuccagucuuccugacacuu

SEQ ID NO: 1270104 - RNA, 11 nt, Human
uucccaggacc

SEQ ID NO: 1270105 - RNA, 12 nt, Human
uucccaggaccc

SEQ ID NO: 1270106 - RNA, 13 nt, Human
uucccaggacccu

SEQ ID NO: 1270107 - RNA, 19 nt, Human
uucccaggacccugaaggg

SEQ ID NO: 1270108 - RNA, 20 nt, Human
uucccaggacccugaagggg

SEQ ID NO: 1270109 - RNA, 15 nt, Human
uucccuuuuuuuaag

SEQ ID NO: 1270110 - RNA, 17 nt, Human
uucccuacugaagcccu

SEQ ID NO: 1270111 - RNA, 15 nt, Human
uuccgccacuggggc

SEQ ID NO: 1270112 - RNA, 18 nt, Human
uuccgccacuggggcuca

SEQ ID NO: 1270113 - RNA, 13 nt, Human
uuccgcuuggagc

SEQ ID NO: 1270114 - RNA, 19 nt, Human
uuccgcuuggagcagaggg

SEQ ID NO: 1270115 - RNA, 13 nt, Human
uucccuacuuccu

SEQ ID NO: 1270116 - RNA, 20 nt, Human
uucccuacccucuagagaaa

SEQ ID NO: 1270117 - RNA, 19 nt, Human
uucccuacauuaaacauga

SEQ ID NO: 1270118 - RNA, 14 nt, Human
uucccuacccucua

SEQ ID NO: 1270119 - RNA, 16 nt, Human
uucccuacccucuaga

SEQ ID NO: 1270120 - RNA, 17 nt, Human
uucccuacccucuagag

SEQ ID NO: 1270121 - RNA, 14 nt, Human
uucccuacauuaaa

SEQ ID NO: 1270122 - RNA, 16 nt, Human
uucccuaaucuauggu

SEQ ID NO: 1270123 - RNA, 14 nt, Human
uucccguuucucca

SEQ ID NO: 1270124 - RNA, 15 nt, Human
uucccguuucuccac

SEQ ID NO: 1270125 - RNA, 17 nt, Human
uucccguuucuccaccu

SEQ ID NO: 1270126 - RNA, 12 nt, Human
uucccuaagcca

SEQ ID NO: 1270127 - RNA, 12 nt, Human
uucccgcucagc

SEQ ID NO: 1270128 - RNA, 20 nt, Human
uucccgcagugggagcaaac

SEQ ID NO: 1270129 - RNA, 14 nt, Human
uucccgcucagccc

SEQ ID NO: 1270130 - RNA, 15 nt, Human
uucccgcucagcccu

SEQ ID NO: 1270131 - RNA, 21 nt, Human
uuccuaaauauauuuuaagac

SEQ ID NO: 1270132 - RNA, 18 nt, Human
uuccuaaauauuaugaga

SEQ ID NO: 1270133 - RNA, 16 nt, Human
uuccuaaauauuauga

SEQ ID NO: 1270134 - RNA, 12 nt, Human
uuccuaaauuuu

SEQ ID NO: 1270135 - RNA, 18 nt, Human
uuccuaaauuuuccuguc

SEQ ID NO: 1270136 - RNA, 20 nt, Human
uuccuaaauuuuccuguccu

SEQ ID NO: 1270137 - RNA, 21 nt, Human
uuccuaaauuuuccuguccuc

SEQ ID NO: 1270138 - RNA, 18 nt, Human
uuccucuccacugccuuc

SEQ ID NO: 1270139 - RNA, 13 nt, Human
uuccuaagugauu

SEQ ID NO: 1270140 - RNA, 19 nt, Human
uuccucuccacugccuucg

SEQ ID NO: 1270141 - RNA, 16 nt, Human
uuccucucgcggcccu

SEQ ID NO: 1270142 - RNA, 20 nt, Human
uuccucucgcggcccucagu

SEQ ID NO: 1270143 - RNA, 13 nt, Human
uuccucugagccu

SEQ ID NO: 1270144 - RNA, 21 nt, Human
uuccucucgcggcccucagua

SEQ ID NO: 1270145 - RNA, 12 nt, Human
uuccugaacagg

SEQ ID NO: 1270146 - RNA, 14 nt, Human
uuccugaacaggau

SEQ ID NO: 1270147 - RNA, 19 nt, Human
uuccucuuuuccuucccaa

SEQ ID NO: 1270148 - RNA, 18 nt, Human
uuccugaaacaacuugga

SEQ ID NO: 1270149 - RNA, 17 nt, Human
uuccugggaaauauucc

SEQ ID NO: 1270150 - RNA, 21 nt, Human
uuccugggaaauauucccuag

SEQ ID NO: 1270151 - RNA, 21 nt, Human
aucaaggguacacugccuucu

SEQ ID NO: 1270152 - RNA, 15 nt, Human
aucaagggucaggcc

SEQ ID NO: 1270153 - RNA, 17 nt, Human
aucaagggucaggccuu

SEQ ID NO: 1270154 - RNA, 16 nt, Human
aucaagggucaggccu

SEQ ID NO: 1270155 - RNA, 14 nt, Human
aucaaggucguuuu

SEQ ID NO: 1270156 - RNA, 15 nt, Human
aucaaggucguuuuu

SEQ ID NO: 1270157 - RNA, 14 nt, Human
aucaaguaauacaa

SEQ ID NO: 1270158 - RNA, 15 nt, Human
aucaaguaauacaaa

SEQ ID NO: 1270159 - RNA, 16 nt, Human
aucaaguaauacaaac

SEQ ID NO: 1270160 - RNA, 17 nt, Human
aucaaguaauacaaacu

SEQ ID NO: 1270161 - RNA, 13 nt, Human
aucaauuuaaaaa

SEQ ID NO: 1270162 - RNA, 18 nt, Human
aucaauuauaguuucuga

SEQ ID NO: 1270163 - RNA, 19 nt, Human
aucaauguuucuucuaggu

SEQ ID NO: 1270164 - RNA, 16 nt, Human
aucaauuauaguuucu

SEQ ID NO: 1270165 - RNA, 17 nt, Human
aucaauuauaguuucug

SEQ ID NO: 1270166 - RNA, 19 nt, Human
aucacucuguucauuccuc

SEQ ID NO: 1270167 - RNA, 18 nt, Human
aucacucuagguuuuaca

SEQ ID NO: 1270168 - RNA, 20 nt, Human
aucacucuaauuaauuguaa

SEQ ID NO: 1270169 - RNA, 13 nt, Human
aucacgcuuuccu

SEQ ID NO: 1270170 - RNA, 12 nt, Human
aucacucaccau

SEQ ID NO: 1270171 - RNA, 18 nt, Human
uuccuuacagaacuacuu

SEQ ID NO: 1270172 - RNA, 19 nt, Human
uuccuuaagucagaacagc

SEQ ID NO: 1270173 - RNA, 20 nt, Human
uuccuuaagucagaacagca

SEQ ID NO: 1270174 - RNA, 19 nt, Human
uuccuguuuuucacauuuu

SEQ ID NO: 1270175 - RNA, 23 nt, Human
uuccuguuuuucacauuuuccuu

SEQ ID NO: 1270176 - RNA, 13 nt, Human
uuccuuaccuuuu

SEQ ID NO: 1270177 - RNA, 20 nt, Human
uuccuuacuuuuuauauaua

SEQ ID NO: 1270178 - RNA, 21 nt, Human
auauuuuucaugauuuugaaa

SEQ ID NO: 1270179 - RNA, 11 nt, Human
aucaacugaau

SEQ ID NO: 1270180 - RNA, 13 nt, Human
aucaacugaauga

SEQ ID NO: 1270181 - RNA, 14 nt, Human
aucaacugaaugag

SEQ ID NO: 1270182 - RNA, 21 nt, Human
aucaacuuaccaggcaccaaa

SEQ ID NO: 1270183 - RNA, 15 nt, Human
aucaacuugcuuauc

SEQ ID NO: 1270184 - RNA, 21 nt, Human
aucacugaacuuugcugagcc

SEQ ID NO: 1270185 - RNA, 14 nt, Human
aucacugaacuuug

SEQ ID NO: 1270186 - RNA, 23 nt, Human
aucacucuguucauuccuccagg

SEQ ID NO: 1270187 - RNA, 22 nt, Human
aucacucuguucauuccuccag

SEQ ID NO: 1270188 - RNA, 21 nt, Human
aucacucuguucauuccucca

SEQ ID NO: 1270189 - RNA, 14 nt, Human
aucacuuaaacuug

SEQ ID NO: 1270190 - RNA, 20 nt, Human
aucacuuaggaaauggcuuu

SEQ ID NO: 1270191 - RNA, 17 nt, Human
aucacuuaaacuugcau

SEQ ID NO: 1270192 - RNA, 23 nt, Human
aucacuuaacggaccaaagcaag

SEQ ID NO: 1270193 - RNA, 23 nt, Human
aucacuugaacccgggaggcaga

SEQ ID NO: 1270194 - RNA, 18 nt, Human
aucaguuaacuauugcau

SEQ ID NO: 1270195 - RNA, 18 nt, Human
aucaguuaagaaauuuca

SEQ ID NO: 1270196 - RNA, 22 nt, Human
aucaguuaagaaauuucacaua

SEQ ID NO: 1270197 - RNA, 12 nt, Human
aucaguuaacua

SEQ ID NO: 1270198 - RNA, 21 nt, Human
aucaguuacacaugaucauaa

SEQ ID NO: 1270199 - RNA, 17 nt, Human
aucaguucauuagaaau

SEQ ID NO: 1270200 - RNA, 16 nt, Human
aucagucucagaaugu

SEQ ID NO: 1270201 - RNA, 13 nt, Human
aucagugcccucc

SEQ ID NO: 1270202 - RNA, 15 nt, Human
aucagugcccuccag

SEQ ID NO: 1270203 - RNA, 17 nt, Human
aucagugcccuccagga

SEQ ID NO: 1270204 - RNA, 15 nt, Human
aucagugcucccuca

SEQ ID NO: 1270205 - RNA, 18 nt, Human
aucaguucauuagaaaua

SEQ ID NO: 1270206 - RNA, 19 nt, Human
aucaguucauuagaaauau

SEQ ID NO: 1270207 - RNA, 21 nt, Human
aucaguucauuagaaauauuu

SEQ ID NO: 1270208 - RNA, 16 nt, Human
aucaguuuaaaagcac

SEQ ID NO: 1270209 - RNA, 22 nt, Human
aucaguuuaaaagcacgacagu

SEQ ID NO: 1270210 - RNA, 20 nt, Human
aucaguuuaaaagcacgaca

SEQ ID NO: 1270211 - RNA, 21 nt, Human
aucaguuuuuucaccuggaag

SEQ ID NO: 1270212 - RNA, 17 nt, Human
aucauaagauauuuuuc

SEQ ID NO: 1270213 - RNA, 24 nt, Human
aucauauaaauagaauguaaaugu

SEQ ID NO: 1270214 - RNA, 16 nt, Human
aucauauaauaaaugu

SEQ ID NO: 1270215 - RNA, 20 nt, Human
aucauauaauaaauguacau

SEQ ID NO: 1270216 - RNA, 20 nt, Human
aucauauauauacauacaug

SEQ ID NO: 1270217 - RNA, 15 nt, Human
aucaucaguguagaa

SEQ ID NO: 1270218 - RNA, 16 nt, Human
aucaucaguguagaac

SEQ ID NO: 1270219 - RNA, 23 nt, Human
aucauauaaauagaauguaaaug

SEQ ID NO: 1270220 - RNA, 22 nt, Human
aucauauaaauagaauguaaau

SEQ ID NO: 1270221 - RNA, 21 nt, Human
aucauauaaauagaauguaaa

SEQ ID NO: 1270222 - RNA, 19 nt, Human
aucauauaaauagaaugua

SEQ ID NO: 1270223 - RNA, 18 nt, Human
aucauauaaauagaaugu

SEQ ID NO: 1270224 - RNA, 14 nt, Human
aucauauaaauaga

SEQ ID NO: 1270225 - RNA, 18 nt, Human
aucaucauguguguccac

SEQ ID NO: 1270226 - RNA, 13 nt, Human
aucaucauggcca

SEQ ID NO: 1270227 - RNA, 14 nt, Human
aucaucauggccag

SEQ ID NO: 1270228 - RNA, 13 nt, Human
aucauccacacau

SEQ ID NO: 1270229 - RNA, 14 nt, Human
aucauccacacaug

SEQ ID NO: 1270230 - RNA, 16 nt, Human
aucauccacacaugaa

SEQ ID NO: 1270231 - RNA, 13 nt, Human
aucauuacuauaa

SEQ ID NO: 1270232 - RNA, 12 nt, Human
aucauucucugu

SEQ ID NO: 1270233 - RNA, 14 nt, Human
aucauucucugucu

SEQ ID NO: 1270234 - RNA, 16 nt, Human
aucauucucugucuca

SEQ ID NO: 1270235 - RNA, 21 nt, Human
aucauucucugucucauccau

SEQ ID NO: 1270236 - RNA, 19 nt, Human
aucauugugaaauuauuca

SEQ ID NO: 1270237 - RNA, 18 nt, Human
uucuccccugcacuguaa

SEQ ID NO: 1270238 - RNA, 19 nt, Human
uucuccccugcacuguaaa

SEQ ID NO: 1270239 - RNA, 20 nt, Human
uucuccccugcacuguaaaa

SEQ ID NO: 1270240 - RNA, 15 nt, Human
aucauugugaaauua

SEQ ID NO: 1270241 - RNA, 13 nt, Human
aucauugugaaau

SEQ ID NO: 1270242 - RNA, 24 nt, Human
aucauucucugucucauccaucau

SEQ ID NO: 1270243 - RNA, 19 nt, Human
aucauucuuauuucaugaa

SEQ ID NO: 1270244 - RNA, 20 nt, Human
aucauucuuauuucaugaaa

SEQ ID NO: 1270245 - RNA, 23 nt, Human
aucauucuuauuucaugaaaauu

SEQ ID NO: 1270246 - RNA, 13 nt, Human
aucauuguaugug

SEQ ID NO: 1270247 - RNA, 21 nt, Human
uucuccccugcacuguaaaau

SEQ ID NO: 1270248 - RNA, 19 nt, Human
uucucccuggauuuuuacc

SEQ ID NO: 1270249 - RNA, 10 nt, Human
uucucccugu

SEQ ID NO: 1270250 - RNA, 20 nt, Human
uucucccuggauuuuuacca

SEQ ID NO: 1270251 - RNA, 16 nt, Human
uucuccguuagcuccu

SEQ ID NO: 1270252 - RNA, 17 nt, Human
uucuccguuagcuccug

SEQ ID NO: 1270253 - RNA, 18 nt, Human
uucuccguuagcuccugu

SEQ ID NO: 1270254 - RNA, 19 nt, Human
uucuccguuagcuccugug

SEQ ID NO: 1270255 - RNA, 20 nt, Human
uucuccguuagcuccugugg

SEQ ID NO: 1270256 - RNA, 22 nt, Human
uucuccguuagcuccuguggcc

SEQ ID NO: 1270257 - RNA, 14 nt, Human
uucuccuauguuug

SEQ ID NO: 1270258 - RNA, 18 nt, Human
uucuccucacuguaucca

SEQ ID NO: 1270259 - RNA, 13 nt, Human
uucuccucccagg

SEQ ID NO: 1270260 - RNA, 17 nt, Human
uucugaauaaagcaauu

SEQ ID NO: 1270261 - RNA, 16 nt, Human
uucugaauaaagcaau

SEQ ID NO: 1270262 - RNA, 15 nt, Human
uucugaauaaagcaa

SEQ ID NO: 1270263 - RNA, 14 nt, Human
uucugaauaaagca

SEQ ID NO: 1270264 - RNA, 15 nt, Human
uucugaaugcuucua

SEQ ID NO: 1270265 - RNA, 23 nt, Human
uucugaaugcuucuaaguaaaua

SEQ ID NO: 1270266 - RNA, 18 nt, Human
uucugaaugcuucuaagu

SEQ ID NO: 1270267 - RNA, 15 nt, Human
uucugcaguaaaucu

SEQ ID NO: 1270268 - RNA, 18 nt, Human
uucugcaguaaaucuuuu

SEQ ID NO: 1270269 - RNA, 22 nt, Human
uucugcaguaaaucuuuuacaa

SEQ ID NO: 1270270 - RNA, 17 nt, Human
uucugcauauguugaau

SEQ ID NO: 1270271 - RNA, 21 nt, Human
uucugcauauguugaauacuu

SEQ ID NO: 1270272 - RNA, 22 nt, Human
uucugcauauguugaauacuuu

SEQ ID NO: 1270273 - RNA, 23 nt, Human
uucugcauauguugaauacuuuu

SEQ ID NO: 1270274 - RNA, 16 nt, Human
uucugccugccagcug

SEQ ID NO: 1270275 - RNA, 17 nt, Human
uucugccugccagcugc

SEQ ID NO: 1270276 - RNA, 20 nt, Human
uucucucaacaccaugauuc

SEQ ID NO: 1270277 - RNA, 15 nt, Human
uucucucaacaccau

SEQ ID NO: 1270278 - RNA, 18 nt, Human
uucuccuuucacaaccuu

SEQ ID NO: 1270279 - RNA, 22 nt, Human
uucuccuuucacaaccuucugu

SEQ ID NO: 1270280 - RNA, 23 nt, Human
uucuccuccaugggagaaaauag

SEQ ID NO: 1270281 - RNA, 13 nt, Human
uucuccuuuuccu

SEQ ID NO: 1270282 - RNA, 18 nt, Human
uucuccuuuuccucucuc

SEQ ID NO: 1270283 - RNA, 19 nt, Human
uucucgcuguccuuucuag

SEQ ID NO: 1270284 - RNA, 19 nt, Human
uucucguccucguuugugu

SEQ ID NO: 1270285 - RNA, 16 nt, Human
auccaagcaaauguga

SEQ ID NO: 1270286 - RNA, 16 nt, Human
auccaacuaaugccuu

SEQ ID NO: 1270287 - RNA, 18 nt, Human
auccaacuaaugccuuac

SEQ ID NO: 1270288 - RNA, 20 nt, Human
auccaacuaaugccuuacuc

SEQ ID NO: 1270289 - RNA, 18 nt, Human
auccaagcaaaugugaau

SEQ ID NO: 1270290 - RNA, 19 nt, Human
auccaagauauuuuaaaau

SEQ ID NO: 1270291 - RNA, 22 nt, Human
auccaauuagcuuauguuaacu

SEQ ID NO: 1270292 - RNA, 20 nt, Human
auccaauggguuuuucccug

SEQ ID NO: 1270293 - RNA, 18 nt, Human
uucugccugccagcugca

SEQ ID NO: 1270294 - RNA, 19 nt, Human
uucugccugccagcugcac

SEQ ID NO: 1270295 - RNA, 22 nt, Human
uucugccugccagcugcacuga

SEQ ID NO: 1270296 - RNA, 15 nt, Human
auccaguaaaauaau

SEQ ID NO: 1270297 - RNA, 16 nt, Human
auccaguaggauccag

SEQ ID NO: 1270298 - RNA, 15 nt, Human
auccagguucccucc

SEQ ID NO: 1270299 - RNA, 19 nt, Human
auccagguucccucccaga

SEQ ID NO: 1270300 - RNA, 13 nt, Human
auccaguauaaga

SEQ ID NO: 1270301 - RNA, 18 nt, Human
auccaucaucaugugugu

SEQ ID NO: 1270302 - RNA, 20 nt, Human
auccauccuugccaauagug

SEQ ID NO: 1270303 - RNA, 18 nt, Human
auccaugaccuaguuuuc

SEQ ID NO: 1270304 - RNA, 20 nt, Human
auccaugaccuaguuuucca

SEQ ID NO: 1270305 - RNA, 22 nt, Human
auccacauacccugaccuggcc

SEQ ID NO: 1270306 - RNA, 20 nt, Human
auccaauuagcuuauguuaa

SEQ ID NO: 1270307 - RNA, 14 nt, Human
auccacacaugaau

SEQ ID NO: 1270308 - RNA, 15 nt, Human
aucccugaggacuga

SEQ ID NO: 1270309 - RNA, 18 nt, Human
aucccugaggacugauuu

SEQ ID NO: 1270310 - RNA, 22 nt, Human
aucccugaggacugauuucaga

SEQ ID NO: 1270311 - RNA, 13 nt, Human
auccauggccagc

SEQ ID NO: 1270312 - RNA, 14 nt, Human
auccauggccagca

SEQ ID NO: 1270313 - RNA, 16 nt, Human
auccauggccagcagc

SEQ ID NO: 1270314 - RNA, 17 nt, Human
auccauggccagcagca

SEQ ID NO: 1270315 - RNA, 21 nt, Human
auccaugaccuaguuuuccau

SEQ ID NO: 1270316 - RNA, 22 nt, Human
auccaugaccuaguuuuccaug

SEQ ID NO: 1270317 - RNA, 12 nt, Human
auccaugccuca

SEQ ID NO: 1270318 - RNA, 12 nt, Human
auccauggccag

SEQ ID NO: 1270319 - RNA, 21 nt, Human
auccauggccagcagcaccug

SEQ ID NO: 1270320 - RNA, 23 nt, Human
auccauggccagcagcaccugcc

SEQ ID NO: 1270321 - RNA, 18 nt, Human
aucccacucacaacagcu

SEQ ID NO: 1270322 - RNA, 18 nt, Human
aucccagaaaaaguaacu

SEQ ID NO: 1270323 - RNA, 18 nt, Human
aucccagagagcccgagg

SEQ ID NO: 1270324 - RNA, 14 nt, Human
uucuuacugcuuaa

SEQ ID NO: 1270325 - RNA, 14 nt, Human
uucuuacugcuugg

SEQ ID NO: 1270326 - RNA, 13 nt, Human
uucuuacugcuug

SEQ ID NO: 1270327 - RNA, 15 nt, Human
uucuuaccuguaugu

SEQ ID NO: 1270328 - RNA, 23 nt, Human
uucuuaaccagaucauugugaaa

SEQ ID NO: 1270329 - RNA, 22 nt, Human
uucuuaaccagaucauugugaa

SEQ ID NO: 1270330 - RNA, 11 nt, Human
uucuuaaauaa

SEQ ID NO: 1270331 - RNA, 18 nt, Human
uucuuaaauaagaaacuu

SEQ ID NO: 1270332 - RNA, 19 nt, Human
uucuuaaauaagaaacuuu

SEQ ID NO: 1270333 - RNA, 16 nt, Human
uucuguuuuauaauuu

SEQ ID NO: 1270334 - RNA, 12 nt, Human
uucuguuucaag

SEQ ID NO: 1270335 - RNA, 23 nt, Human
uucuguuucaaggcacucuagau

SEQ ID NO: 1270336 - RNA, 17 nt, Human
uucuguuuuauaauuuu

SEQ ID NO: 1270337 - RNA, 13 nt, Human
uucuguuugcugu

SEQ ID NO: 1270338 - RNA, 12 nt, Human
uucuuagcucaa

SEQ ID NO: 1270339 - RNA, 22 nt, Human
uucuucuacaacucauacacuc

SEQ ID NO: 1270340 - RNA, 11 nt, Human
uucuucuagag

SEQ ID NO: 1270341 - RNA, 14 nt, Human
uucuucuagaguuc

SEQ ID NO: 1270342 - RNA, 18 nt, Human
uucuucuagguucuaaaa

SEQ ID NO: 1270343 - RNA, 21 nt, Human
uucuucuagguucuaaaaauu

SEQ ID NO: 1270344 - RNA, 15 nt, Human
uucuucuagaguuca

SEQ ID NO: 1270345 - RNA, 18 nt, Human
uucuucuauugccucuga

SEQ ID NO: 1270346 - RNA, 20 nt, Human
uucuucuauugccucugaga

SEQ ID NO: 1270347 - RNA, 12 nt, Human
uucuugccucau

SEQ ID NO: 1270348 - RNA, 15 nt, Human
uucuugccucugugc

SEQ ID NO: 1270349 - RNA, 16 nt, Human
uucuugccucugugcu

SEQ ID NO: 1270350 - RNA, 17 nt, Human
uucuugccucugugcug

SEQ ID NO: 1270351 - RNA, 22 nt, Human
uucuugccucugugcugugugu

SEQ ID NO: 1270352 - RNA, 18 nt, Human
uucuugccugaacuccug

SEQ ID NO: 1270353 - RNA, 15 nt, Human
uucuuucucacuaaa

SEQ ID NO: 1270354 - RNA, 13 nt, Human
uucuuugaauaaa

SEQ ID NO: 1270355 - RNA, 14 nt, Human
uucuuugaauaaau

SEQ ID NO: 1270356 - RNA, 17 nt, Human
uucuuugaauaaauguc

SEQ ID NO: 1270357 - RNA, 18 nt, Human
uucuuugaauaaauguca

SEQ ID NO: 1270358 - RNA, 19 nt, Human
uucuuugaauaaaugucac

SEQ ID NO: 1270359 - RNA, 17 nt, Human
aucguaaaauuaagaaa

SEQ ID NO: 1270360 - RNA, 14 nt, Human
aucguaaaauuaag

SEQ ID NO: 1270361 - RNA, 13 nt, Human
aucguaaaauuaa

SEQ ID NO: 1270362 - RNA, 12 nt, Human
aucguaaaauua

SEQ ID NO: 1270363 - RNA, 18 nt, Human
aucggggagccgggagcc

SEQ ID NO: 1270364 - RNA, 16 nt, Human
aucggggagccgggag

SEQ ID NO: 1270365 - RNA, 21 nt, Human
auccuguaggaagguacugua

SEQ ID NO: 1270366 - RNA, 16 nt, Human
auccuguauucagaca

SEQ ID NO: 1270367 - RNA, 18 nt, Human
auccuguauucagacaga

SEQ ID NO: 1270368 - RNA, 20 nt, Human
auccuguauucagacagaug

SEQ ID NO: 1270369 - RNA, 22 nt, Human
auccuguaggaagguacuguau

SEQ ID NO: 1270370 - RNA, 20 nt, Human
auccuguaggaagguacugu

SEQ ID NO: 1270371 - RNA, 19 nt, Human
auccuguaggaagguacug

SEQ ID NO: 1270372 - RNA, 21 nt, Human
auccuguauucagacagauga

SEQ ID NO: 1270373 - RNA, 21 nt, Human
auccugucgauuagacuggac

SEQ ID NO: 1270374 - RNA, 19 nt, Human
auccugucgauuagacugg

SEQ ID NO: 1270375 - RNA, 17 nt, Human
auccuguggucacugac

SEQ ID NO: 1270376 - RNA, 14 nt, Human
auccuguguggaga

SEQ ID NO: 1270377 - RNA, 16 nt, Human
auccuguguggagagg

SEQ ID NO: 1270378 - RNA, 18 nt, Human
auccuguguggagaggga

SEQ ID NO: 1270379 - RNA, 19 nt, Human
auccuguguggagagggaa

SEQ ID NO: 1270380 - RNA, 21 nt, Human
auccuguguggagagggaaug

SEQ ID NO: 1270381 - RNA, 23 nt, Human
auccuguguggagagggaaugug

SEQ ID NO: 1270382 - RNA, 22 nt, Human
auccuguguggagagggaaugu

SEQ ID NO: 1270383 - RNA, 11 nt, Human
auccugugugu

SEQ ID NO: 1270384 - RNA, 12 nt, Human
auccuguguguu

SEQ ID NO: 1270385 - RNA, 13 nt, Human
auccuguguguua

SEQ ID NO: 1270386 - RNA, 21 nt, Human
auccuguguguuaagcucugc

SEQ ID NO: 1270387 - RNA, 19 nt, Human
auccuguguguuaagcucu

SEQ ID NO: 1270388 - RNA, 14 nt, Human
auccuggaggccca

SEQ ID NO: 1270389 - RNA, 15 nt, Human
auccuggaggcccag

SEQ ID NO: 1270390 - RNA, 16 nt, Human
auccuggaggcccagu

SEQ ID NO: 1270391 - RNA, 17 nt, Human
auccuggaggcccaguu

SEQ ID NO: 1270392 - RNA, 14 nt, Human
auccugcuucagug

SEQ ID NO: 1270393 - RNA, 12 nt, Human
auccugcuugau

SEQ ID NO: 1270394 - RNA, 22 nt, Human
auccuggacaugaagauucuuu

SEQ ID NO: 1270395 - RNA, 19 nt, Human
auccuggaggcccaguuca

SEQ ID NO: 1270396 - RNA, 20 nt, Human
auccuggaggcccaguucac

SEQ ID NO: 1270397 - RNA, 22 nt, Human
auccucuuccauauggauccac

SEQ ID NO: 1270398 - RNA, 13 nt, Human
uucuuuugguaaa

SEQ ID NO: 1270399 - RNA, 22 nt, Human
uucuuuugguaaagacuggcuu

SEQ ID NO: 1270400 - RNA, 23 nt, Human
uucuuuugguaaagacuggcuuu

SEQ ID NO: 1270401 - RNA, 21 nt, Human
uucuuuucuggaauguaauca

SEQ ID NO: 1270402 - RNA, 14 nt, Human
uucuuuugccauga

SEQ ID NO: 1270403 - RNA, 14 nt, Human
auccucuuuuucca

SEQ ID NO: 1270404 - RNA, 15 nt, Human
auccucuuuuuccaa

SEQ ID NO: 1270405 - RNA, 14 nt, Human
auccugaaauuuca

SEQ ID NO: 1270406 - RNA, 16 nt, Human
auccugaaauuucaga

SEQ ID NO: 1270407 - RNA, 17 nt, Human
auccugaaauuucagau

SEQ ID NO: 1270408 - RNA, 23 nt, Human
auccugacaagauuauaauauuu

SEQ ID NO: 1270409 - RNA, 24 nt, Human
auccugaccagcugcuccgaggac

SEQ ID NO: 1270410 - RNA, 18 nt, Human
auccugaggcuccacuug

SEQ ID NO: 1270411 - RNA, 16 nt, Human
auccugaggcuccacu

SEQ ID NO: 1270412 - RNA, 13 nt, Human
auccugaggcucc

SEQ ID NO: 1270413 - RNA, 11 nt, Human
auccugaggcu

SEQ ID NO: 1270414 - RNA, 13 nt, Human
auccugccccuga

SEQ ID NO: 1270415 - RNA, 12 nt, Human
auccugccugcc

SEQ ID NO: 1270416 - RNA, 16 nt, Human
auccugcggguggggc

SEQ ID NO: 1270417 - RNA, 13 nt, Human
auccugcuaaguu

SEQ ID NO: 1270418 - RNA, 16 nt, Human
auccugcaauuccacu

SEQ ID NO: 1270419 - RNA, 19 nt, Human
auccugaugagguuucuac

SEQ ID NO: 1270420 - RNA, 22 nt, Human
auccugaggcuccacuuggucu

SEQ ID NO: 1270421 - RNA, 15 nt, Human
uugacauaaaguuga

SEQ ID NO: 1270422 - RNA, 23 nt, Human
uugacacugcucuaacagcccuc

SEQ ID NO: 1270423 - RNA, 19 nt, Human
uugacaguguugaaaaugu

SEQ ID NO: 1270424 - RNA, 14 nt, Human
uugacaguguuuuu

SEQ ID NO: 1270425 - RNA, 19 nt, Human
uugacacuuaaaaaugguu

SEQ ID NO: 1270426 - RNA, 19 nt, Human
uugacauaaaguugauaaa

SEQ ID NO: 1270427 - RNA, 14 nt, Human
uugacccacaagaa

SEQ ID NO: 1270428 - RNA, 21 nt, Human
uugagaaauauggacacuuaa

SEQ ID NO: 1270429 - RNA, 17 nt, Human
uugagaaagucagauuc

SEQ ID NO: 1270430 - RNA, 16 nt, Human
uugagaagcugcucaa

SEQ ID NO: 1270431 - RNA, 19 nt, Human
uugagaaggaaaauuuuag

SEQ ID NO: 1270432 - RNA, 20 nt, Human
uugagaaggaaaauuuuagc

SEQ ID NO: 1270433 - RNA, 15 nt, Human
uugagaagcugcuca

SEQ ID NO: 1270434 - RNA, 13 nt, Human
uugagaagcugcu

SEQ ID NO: 1270435 - RNA, 17 nt, Human
uugagagaagagacaaa

SEQ ID NO: 1270436 - RNA, 16 nt, Human
uugagagaauuugugc

SEQ ID NO: 1270437 - RNA, 15 nt, Human
uugagagugugacca

SEQ ID NO: 1270438 - RNA, 13 nt, Human
uugagagugugac

SEQ ID NO: 1270439 - RNA, 17 nt, Human
uugagauaguuuucauc

SEQ ID NO: 1270440 - RNA, 22 nt, Human
uugagauaguuuucauccauaa

SEQ ID NO: 1270441 - RNA, 20 nt, Human
uugagauauuaaugcccaga

SEQ ID NO: 1270442 - RNA, 21 nt, Human
uugagauauuaaugcccagac

SEQ ID NO: 1270443 - RNA, 17 nt, Human
uugauaaagauuuuuua

SEQ ID NO: 1270444 - RNA, 20 nt, Human
uugauaaagauuuuuuaaua

SEQ ID NO: 1270445 - RNA, 22 nt, Human
uugauaaagauuuuuuaauaau

SEQ ID NO: 1270446 - RNA, 12 nt, Human
uugaguaauggu

SEQ ID NO: 1270447 - RNA, 21 nt, Human
uugaguaaugguguagaacac

SEQ ID NO: 1270448 - RNA, 16 nt, Human
uugaguaaugguguag

SEQ ID NO: 1270449 - RNA, 20 nt, Human
uugaguagagagcaagggaa

SEQ ID NO: 1270450 - RNA, 18 nt, Human
uugaguuuugacugcuug

SEQ ID NO: 1270451 - RNA, 17 nt, Human
uugaguuuugacugcuu

SEQ ID NO: 1270452 - RNA, 14 nt, Human
uugauaaagauuuu

SEQ ID NO: 1270453 - RNA, 18 nt, Human
uugauaaaucauuuuaug

SEQ ID NO: 1270454 - RNA, 21 nt, Human
uugauaaaucauuuuauguca

SEQ ID NO: 1270455 - RNA, 15 nt, Human
uugauaaaucauuuu

SEQ ID NO: 1270456 - RNA, 18 nt, Human
uugauaaccuugaaaaaa

SEQ ID NO: 1270457 - RNA, 18 nt, Human
uugauaagaucuuuuauu

SEQ ID NO: 1270458 - RNA, 16 nt, Human
uugauaagaucuuuua

SEQ ID NO: 1270459 - RNA, 13 nt, Human
aucuaagugauau

SEQ ID NO: 1270460 - RNA, 14 nt, Human
aucuaagugauaua

SEQ ID NO: 1270461 - RNA, 15 nt, Human
aucuaagugauauaa

SEQ ID NO: 1270462 - RNA, 17 nt, Human
aucuaagugauauaaau

SEQ ID NO: 1270463 - RNA, 16 nt, Human
aucuaaguuaauuuaa

SEQ ID NO: 1270464 - RNA, 17 nt, Human
aucuaaguuaauuuaaa

SEQ ID NO: 1270465 - RNA, 13 nt, Human
aucuaaccucauc

SEQ ID NO: 1270466 - RNA, 14 nt, Human
aucuaaccucaucu

SEQ ID NO: 1270467 - RNA, 15 nt, Human
aucuaaccucaucuu

SEQ ID NO: 1270468 - RNA, 18 nt, Human
aucuaaccucaucuucuu

SEQ ID NO: 1270469 - RNA, 15 nt, Human
aucuaaacugccccc

SEQ ID NO: 1270470 - RNA, 22 nt, Human
aucuaaacuggauucacagcuc

SEQ ID NO: 1270471 - RNA, 20 nt, Human
aucuaaaauauuauuuuauu

SEQ ID NO: 1270472 - RNA, 17 nt, Human
aucuaaauaaaaugcua

SEQ ID NO: 1270473 - RNA, 22 nt, Human
aucuaaauauggacugcucagg

SEQ ID NO: 1270474 - RNA, 16 nt, Human
aucuaaauaaaaugcu

SEQ ID NO: 1270475 - RNA, 19 nt, Human
aucguccagcgaccuuccu

SEQ ID NO: 1270476 - RNA, 17 nt, Human
aucgucaugcacaguau

SEQ ID NO: 1270477 - RNA, 23 nt, Human
aucuaaaaauagacuuaaaucuc

SEQ ID NO: 1270478 - RNA, 17 nt, Human
uugacacuuaaaaaugg

SEQ ID NO: 1270479 - RNA, 14 nt, Human
uugacacugcucua

SEQ ID NO: 1270480 - RNA, 15 nt, Human
uugacacugcucuaa

SEQ ID NO: 1270481 - RNA, 16 nt, Human
uugacacugcucuaac

SEQ ID NO: 1270482 - RNA, 22 nt, Human
uugacacugcucuaacagcccu

SEQ ID NO: 1270483 - RNA, 20 nt, Human
uugaauacuuugaauguguu

SEQ ID NO: 1270484 - RNA, 19 nt, Human
uugaaguuagcuuuaacuu

SEQ ID NO: 1270485 - RNA, 23 nt, Human
uugaaguuagcuuuaacuuaaau

SEQ ID NO: 1270486 - RNA, 19 nt, Human
uugaauacuuugaaugugu

SEQ ID NO: 1270487 - RNA, 12 nt, Human
uugaauacuuuu

SEQ ID NO: 1270488 - RNA, 13 nt, Human
uugaauacuuuuu

SEQ ID NO: 1270489 - RNA, 21 nt, Human
uugaaggacuaauagaaaagu

SEQ ID NO: 1270490 - RNA, 14 nt, Human
uugaaggacuaaua

SEQ ID NO: 1270491 - RNA, 15 nt, Human
uugaagggaggggcu

SEQ ID NO: 1270492 - RNA, 20 nt, Human
uugaagggaggggcuguguu

SEQ ID NO: 1270493 - RNA, 15 nt, Human
uugaagggccagagc

SEQ ID NO: 1270494 - RNA, 17 nt, Human
uugaagggccagagcca

SEQ ID NO: 1270495 - RNA, 19 nt, Human
uugaagggccagagccagg

SEQ ID NO: 1270496 - RNA, 20 nt, Human
uugaagggccagagccaggg

SEQ ID NO: 1270497 - RNA, 23 nt, Human
uugaaggugcugacggccaggga

SEQ ID NO: 1270498 - RNA, 15 nt, Human
uugaaguaaacuuuu

SEQ ID NO: 1270499 - RNA, 16 nt, Human
uugaaguaaacuuuuu

SEQ ID NO: 1270500 - RNA, 16 nt, Human
uugaaguagcucuuuu

SEQ ID NO: 1270501 - RNA, 12 nt, Human
uugaaguauuua

SEQ ID NO: 1270502 - RNA, 18 nt, Human
uugaaguauuuugcugga

SEQ ID NO: 1270503 - RNA, 17 nt, Human
uguuguagagaaaacau

SEQ ID NO: 1270504 - RNA, 14 nt, Human
uguuguagagaaaa

SEQ ID NO: 1270505 - RNA, 18 nt, Human
uguuguaaccugcuguga

SEQ ID NO: 1270506 - RNA, 17 nt, Human
uguuguaagcaacaggc

SEQ ID NO: 1270507 - RNA, 14 nt, Human
uguuguaaccugcu

SEQ ID NO: 1270508 - RNA, 14 nt, Human
uguuguaagcaaca

SEQ ID NO: 1270509 - RNA, 11 nt, Human
uguugucaaga

SEQ ID NO: 1270510 - RNA, 16 nt, Human
uguugucaagaauagc

SEQ ID NO: 1270511 - RNA, 20 nt, Human
uguugucaagaauagcauug

SEQ ID NO: 1270512 - RNA, 13 nt, Human
uguugucaccaga

SEQ ID NO: 1270513 - RNA, 23 nt, Human
uguuguagagaaaacaugcagaa

SEQ ID NO: 1270514 - RNA, 22 nt, Human
uguuguagauugauuguauugu

SEQ ID NO: 1270515 - RNA, 14 nt, Human
uguuguauucauug

SEQ ID NO: 1270516 - RNA, 21 nt, Human
uguuguagauugauuguauug

SEQ ID NO: 1270517 - RNA, 20 nt, Human
uguugggagagggcgcaggc

SEQ ID NO: 1270518 - RNA, 20 nt, Human
uguuggggaagggccugccc

SEQ ID NO: 1270519 - RNA, 17 nt, Human
uguugggagagggcgca

SEQ ID NO: 1270520 - RNA, 19 nt, Human
uguugggagagggcgcagg

SEQ ID NO: 1270521 - RNA, 13 nt, Human
aguucgucuguug

SEQ ID NO: 1270522 - RNA, 18 nt, Human
aguucuaagacucaaaug

SEQ ID NO: 1270523 - RNA, 23 nt, Human
aguucuaagacucaaauguucua

SEQ ID NO: 1270524 - RNA, 13 nt, Human
aguucuaagauuc

SEQ ID NO: 1270525 - RNA, 14 nt, Human
aguucuaagauucu

SEQ ID NO: 1270526 - RNA, 15 nt, Human
aguucuaagauucua

SEQ ID NO: 1270527 - RNA, 16 nt, Human
aguucuaagauucuaa

SEQ ID NO: 1270528 - RNA, 17 nt, Human
aguucuaagauucuaau

SEQ ID NO: 1270529 - RNA, 18 nt, Human
aguucuaagauucuaaug

SEQ ID NO: 1270530 - RNA, 19 nt, Human
aguucuaagauucuaauga

SEQ ID NO: 1270531 - RNA, 15 nt, Human
aguucuaagauucug

SEQ ID NO: 1270532 - RNA, 16 nt, Human
aguucuaagauucuga

SEQ ID NO: 1270533 - RNA, 17 nt, Human
aguucuaagauucugau

SEQ ID NO: 1270534 - RNA, 16 nt, Human
aguucuaauaauuucu

SEQ ID NO: 1270535 - RNA, 17 nt, Human
aguucuaauaauuucua

SEQ ID NO: 1270536 - RNA, 18 nt, Human
aguucuaauaauuucuaa

SEQ ID NO: 1270537 - RNA, 19 nt, Human
aguucuaauaauuucuaau

SEQ ID NO: 1270538 - RNA, 20 nt, Human
aguucuaauaauuucuaaug

SEQ ID NO: 1270539 - RNA, 14 nt, Human
aguucaaacucaca

SEQ ID NO: 1270540 - RNA, 12 nt, Human
aguuauuuaaau

SEQ ID NO: 1270541 - RNA, 21 nt, Human
aguuauuuauuuauuggagau

SEQ ID NO: 1270542 - RNA, 18 nt, Human
aguucaaauucuucugaa

SEQ ID NO: 1270543 - RNA, 13 nt, Human
aguucaacauguu

SEQ ID NO: 1270544 - RNA, 19 nt, Human
aguucaagaaauaaguuuu

SEQ ID NO: 1270545 - RNA, 13 nt, Human
aguucaagaaaua

SEQ ID NO: 1270546 - RNA, 13 nt, Human
aguuccugggaac

SEQ ID NO: 1270547 - RNA, 17 nt, Human
aguucccuacuuccugu

SEQ ID NO: 1270548 - RNA, 17 nt, Human
aguuccugugcacagcc

SEQ ID NO: 1270549 - RNA, 16 nt, Human
aguuccugugcacagc

SEQ ID NO: 1270550 - RNA, 14 nt, Human
aguuccugugcaca

SEQ ID NO: 1270551 - RNA, 17 nt, Human
aguuccuguggcucccu

SEQ ID NO: 1270552 - RNA, 15 nt, Human
aguuccuguggcucc

SEQ ID NO: 1270553 - RNA, 13 nt, Human
aguuccuuucaaa

SEQ ID NO: 1270554 - RNA, 22 nt, Human
aguucgacucugugcuggccag

SEQ ID NO: 1270555 - RNA, 20 nt, Human
aguuauuauauuuacaaaug

SEQ ID NO: 1270556 - RNA, 21 nt, Human
aguuauaaguagcaggccaag

SEQ ID NO: 1270557 - RNA, 15 nt, Human
aguuaguuuguauau

SEQ ID NO: 1270558 - RNA, 20 nt, Human
aguuauacuuauuuguauau

SEQ ID NO: 1270559 - RNA, 15 nt, Human
aguuaucuaaguuaa

SEQ ID NO: 1270560 - RNA, 22 nt, Human
aguuaucuaaguuaauuuaaag

SEQ ID NO: 1270561 - RNA, 14 nt, Human
aguuaugaaauauu

SEQ ID NO: 1270562 - RNA, 20 nt, Human
aguuaugauuuuuuuuucau

SEQ ID NO: 1270563 - RNA, 19 nt, Human
aguuaugccgcuagauaca

SEQ ID NO: 1270564 - RNA, 20 nt, Human
aguuauuaacuuuaauguuu

SEQ ID NO: 1270565 - RNA, 14 nt, Human
aguuauuaacuuua

SEQ ID NO: 1270566 - RNA, 18 nt, Human
aguuauuaaguucuuuaa

SEQ ID NO: 1270567 - RNA, 19 nt, Human
aguuauucacaaaaauuga

SEQ ID NO: 1270568 - RNA, 19 nt, Human
aguuauuaaguucuuuaaa

SEQ ID NO: 1270569 - RNA, 17 nt, Human
aguuauuaauuucuuca

SEQ ID NO: 1270570 - RNA, 13 nt, Human
aguuauugcaguu

SEQ ID NO: 1270571 - RNA, 16 nt, Human
aguuauugcaguuuau

SEQ ID NO: 1270572 - RNA, 18 nt, Human
aguuauugcaguuuauca

SEQ ID NO: 1270573 - RNA, 19 nt, Human
aguuauugcaguuuaucau

SEQ ID NO: 1270574 - RNA, 22 nt, Human
aguuauugcaguuuaucauuca

SEQ ID NO: 1270575 - RNA, 17 nt, Human
aguuacccaaauuaaga

SEQ ID NO: 1270576 - RNA, 15 nt, Human
aguuaccagugccuu

SEQ ID NO: 1270577 - RNA, 16 nt, Human
aguuaccagugccuua

SEQ ID NO: 1270578 - RNA, 18 nt, Human
aguuacccaaauuaagag

SEQ ID NO: 1270579 - RNA, 17 nt, Human
aguuaccauuaaaccau

SEQ ID NO: 1270580 - RNA, 19 nt, Human
aguuaccauuaaaccaucu

SEQ ID NO: 1270581 - RNA, 23 nt, Human
aguuaccugagagauuuaacauu

SEQ ID NO: 1270582 - RNA, 15 nt, Human
aguguuuaaaacuuc

SEQ ID NO: 1270583 - RNA, 14 nt, Human
aguguuuaaaacuu

SEQ ID NO: 1270584 - RNA, 16 nt, Human
aguguuuauccuuuca

SEQ ID NO: 1270585 - RNA, 18 nt, Human
aguguuuauccuuucaua

SEQ ID NO: 1270586 - RNA, 20 nt, Human
aguguuuauccuuucauaua

SEQ ID NO: 1270587 - RNA, 16 nt, Human
aguuaccuuauaguua

SEQ ID NO: 1270588 - RNA, 17 nt, Human
aguuaccuuauaguuac

SEQ ID NO: 1270589 - RNA, 20 nt, Human
aguuaccuuauaguuacugu

SEQ ID NO: 1270590 - RNA, 21 nt, Human
aguuaccuuauaguuacugug

SEQ ID NO: 1270591 - RNA, 22 nt, Human
aguuaccuuauaguuacugugu

SEQ ID NO: 1270592 - RNA, 20 nt, Human
aguuaguaucuuuugauaug

SEQ ID NO: 1270593 - RNA, 17 nt, Human
aguuaguggauuacugc

SEQ ID NO: 1270594 - RNA, 20 nt, Human
aguuaguggauuacugccau

SEQ ID NO: 1270595 - RNA, 15 nt, Human
aguuaguuccacuga

SEQ ID NO: 1270596 - RNA, 17 nt, Human
aguuaguuccacugaga

SEQ ID NO: 1270597 - RNA, 19 nt, Human
aguuaguuccacugagacc

SEQ ID NO: 1270598 - RNA, 14 nt, Human
aguuaguuuguaua

SEQ ID NO: 1270599 - RNA, 22 nt, Human
aguuaguuuguauauauuauua

SEQ ID NO: 1270600 - RNA, 15 nt, Human
aguggcaucaucuca

SEQ ID NO: 1270601 - RNA, 18 nt, Human
aguggcaggggacaggag

SEQ ID NO: 1270602 - RNA, 11 nt, Human
aguggcagggg

SEQ ID NO: 1270603 - RNA, 21 nt, Human
agugggguuaucucuguguua

SEQ ID NO: 1270604 - RNA, 17 nt, Human
aguggguacccccagga

SEQ ID NO: 1270605 - RNA, 22 nt, Human
aguggguacccccaggaccaga

SEQ ID NO: 1270606 - RNA, 20 nt, Human
aguggcaggcagaggcccag

SEQ ID NO: 1270607 - RNA, 23 nt, Human
aguggcaggcagaggcccaggcu

SEQ ID NO: 1270608 - RNA, 20 nt, Human
ugugcaacaggguauggacu

SEQ ID NO: 1270609 - RNA, 18 nt, Human
ugugcaacaggguaugga

SEQ ID NO: 1270610 - RNA, 14 nt, Human
aguguaauugagaa

SEQ ID NO: 1270611 - RNA, 22 nt, Human
aguguaaugaauaccuuagugc

SEQ ID NO: 1270612 - RNA, 16 nt, Human
aguguaaugaauaccu

SEQ ID NO: 1270613 - RNA, 14 nt, Human
aguguaaugaauac

SEQ ID NO: 1270614 - RNA, 23 nt, Human
agugguuuaggcuauuuguaaau

SEQ ID NO: 1270615 - RNA, 11 nt, Human
agugggugggg

SEQ ID NO: 1270616 - RNA, 14 nt, Human
aguggguggggagu

SEQ ID NO: 1270617 - RNA, 12 nt, Human
aguggguuuuuu

SEQ ID NO: 1270618 - RNA, 15 nt, Human
aguggguuuuuuagu

SEQ ID NO: 1270619 - RNA, 22 nt, Human
aguggguuuuuuaguugaauuu

SEQ ID NO: 1270620 - RNA, 21 nt, Human
aguggguuuuuuaguugaauu

SEQ ID NO: 1270621 - RNA, 14 nt, Human
uguuauuaaacaaa

SEQ ID NO: 1270622 - RNA, 20 nt, Human
uguuauguuuucgaaaauca

SEQ ID NO: 1270623 - RNA, 21 nt, Human
uguuauguuuucgaaaaucaa

SEQ ID NO: 1270624 - RNA, 17 nt, Human
uguuauuuguaauagau

SEQ ID NO: 1270625 - RNA, 15 nt, Human
uguuaugcugugaca

SEQ ID NO: 1270626 - RNA, 17 nt, Human
uguuaugcaaaagcaag

SEQ ID NO: 1270627 - RNA, 17 nt, Human
uguuauguagauaacaa

SEQ ID NO: 1270628 - RNA, 16 nt, Human
uguucccauucuugca

SEQ ID NO: 1270629 - RNA, 16 nt, Human
uguucccauuucagcu

SEQ ID NO: 1270630 - RNA, 17 nt, Human
uguucccauuucagcug

SEQ ID NO: 1270631 - RNA, 21 nt, Human
uguucaaagccagcguccucc

SEQ ID NO: 1270632 - RNA, 22 nt, Human
uguucaaagccagcguccuccu

SEQ ID NO: 1270633 - RNA, 15 nt, Human
uguucaaagcugccu

SEQ ID NO: 1270634 - RNA, 14 nt, Human
uguuauuuugcaac

SEQ ID NO: 1270635 - RNA, 18 nt, Human
uguuauuuuuuaauuauu

SEQ ID NO: 1270636 - RNA, 16 nt, Human
aguguaccauuugccu

SEQ ID NO: 1270637 - RNA, 22 nt, Human
uguuaugaugugcuuaacaggg

SEQ ID NO: 1270638 - RNA, 19 nt, Human
uguuaugaugugcuuaaca

SEQ ID NO: 1270639 - RNA, 17 nt, Human
uguuaugaugugcuuaa

SEQ ID NO: 1270640 - RNA, 16 nt, Human
uguuaugaugugcuua

SEQ ID NO: 1270641 - RNA, 14 nt, Human
uguuaugaugugcu

SEQ ID NO: 1270642 - RNA, 12 nt, Human
uguuaugaugug

SEQ ID NO: 1270643 - RNA, 16 nt, Human
uguucccccugugcag

SEQ ID NO: 1270644 - RNA, 13 nt, Human
uguuccccacugg

SEQ ID NO: 1270645 - RNA, 14 nt, Human
uguuccccacugga

SEQ ID NO: 1270646 - RNA, 15 nt, Human
uguuccccacuggag

SEQ ID NO: 1270647 - RNA, 16 nt, Human
uguuccccacuggagc

SEQ ID NO: 1270648 - RNA, 13 nt, Human
uguuccccagaga

SEQ ID NO: 1270649 - RNA, 14 nt, Human
uguuccccagagaa

SEQ ID NO: 1270650 - RNA, 17 nt, Human
uguuccccacuggagca

SEQ ID NO: 1270651 - RNA, 15 nt, Human
uguucccccugugca

SEQ ID NO: 1270652 - RNA, 17 nt, Human
uguucuuaccuguaugu

SEQ ID NO: 1270653 - RNA, 22 nt, Human
uguucuuaccuguaugucucca

SEQ ID NO: 1270654 - RNA, 18 nt, Human
uguucuuagcucaaugag

SEQ ID NO: 1270655 - RNA, 20 nt, Human
uguucuuagcucaaugagca

SEQ ID NO: 1270656 - RNA, 22 nt, Human
uguucuuagcucaaugagcaug

SEQ ID NO: 1270657 - RNA, 13 nt, Human
uguuuuauaauuu

SEQ ID NO: 1270658 - RNA, 20 nt, Human
uguuuuauaauuuugugaag

SEQ ID NO: 1270659 - RNA, 21 nt, Human
uguuuuauuuucaaaaccagg

SEQ ID NO: 1270660 - RNA, 19 nt, Human
uguuuucuaguguaucaaa

SEQ ID NO: 1270661 - RNA, 18 nt, Human
uguuuucuaguguaucaa

SEQ ID NO: 1270662 - RNA, 16 nt, Human
uguuuucuaguguauc

SEQ ID NO: 1270663 - RNA, 15 nt, Human
uguuuucuaguguau

SEQ ID NO: 1270664 - RNA, 14 nt, Human
uguuuucuagugua

SEQ ID NO: 1270665 - RNA, 13 nt, Human
uguuuucuagugu

SEQ ID NO: 1270666 - RNA, 21 nt, Human
uguuuucuaguguaucaaaau

SEQ ID NO: 1270667 - RNA, 20 nt, Human
uguuuucuaguguaucaaaa

SEQ ID NO: 1270668 - RNA, 12 nt, Human
uguuuucucuga

SEQ ID NO: 1270669 - RNA, 17 nt, Human
uguuuucucugaacaca

SEQ ID NO: 1270670 - RNA, 21 nt, Human
uguuuucucuggaguauucua

SEQ ID NO: 1270671 - RNA, 19 nt, Human
uguuugcuaagcauuccaa

SEQ ID NO: 1270672 - RNA, 20 nt, Human
uguuugccuucuacuuuuaa

SEQ ID NO: 1270673 - RNA, 20 nt, Human
uguuugcucagcuucuccaa

SEQ ID NO: 1270674 - RNA, 11 nt, Human
uguuuggcugg

SEQ ID NO: 1270675 - RNA, 21 nt, Human
uguuuuacaauaguucugugg

SEQ ID NO: 1270676 - RNA, 20 nt, Human
uguuuuacaaguuggaguca

SEQ ID NO: 1270677 - RNA, 22 nt, Human
uguuuuacaauaguucuguggg

SEQ ID NO: 1270678 - RNA, 17 nt, Human
uguuuuacaauaguucu

SEQ ID NO: 1270679 - RNA, 13 nt, Human
uguuuuacaauag

SEQ ID NO: 1270680 - RNA, 12 nt, Human
uguuuggcuggg

SEQ ID NO: 1270681 - RNA, 13 nt, Human
uguuuggcuuuca

SEQ ID NO: 1270682 - RNA, 14 nt, Human
uguuuggcuuucag

SEQ ID NO: 1270683 - RNA, 15 nt, Human
uguuugcuaagcauu

SEQ ID NO: 1270684 - RNA, 15 nt, Human
uguuugcaucugaaa

SEQ ID NO: 1270685 - RNA, 14 nt, Human
uguuugcauauaag

SEQ ID NO: 1270686 - RNA, 13 nt, Human
uguuugcauauaa

SEQ ID NO: 1270687 - RNA, 17 nt, Human
uguugucuaagaaauug

SEQ ID NO: 1270688 - RNA, 22 nt, Human
uguugucuaagaaauugaauac

SEQ ID NO: 1270689 - RNA, 22 nt, Human
uguuguccuuuucauaggucug

SEQ ID NO: 1270690 - RNA, 18 nt, Human
uguugucguaaagauuug

SEQ ID NO: 1270691 - RNA, 20 nt, Human
uguugucguaaagauuuggg

SEQ ID NO: 1270692 - RNA, 14 nt, Human
uguugucuaagaaa

SEQ ID NO: 1270693 - RNA, 14 nt, Human
uguuguccuuuuca

SEQ ID NO: 1270694 - RNA, 16 nt, Human
uguuguccuuuucaua

SEQ ID NO: 1270695 - RNA, 17 nt, Human
uguuguccuuuucauag

SEQ ID NO: 1270696 - RNA, 19 nt, Human
aguugcaacuuuguauaaa

SEQ ID NO: 1270697 - RNA, 16 nt, Human
aguugauuuucuggau

SEQ ID NO: 1270698 - RNA, 23 nt, Human
aguugauuuuuuuuuuuuuuucc

SEQ ID NO: 1270699 - RNA, 21 nt, Human
aguugauaugccuuuucccaa

SEQ ID NO: 1270700 - RNA, 18 nt, Human
aguucuuugggccagaca

SEQ ID NO: 1270701 - RNA, 19 nt, Human
aguucuuugggccagacau

SEQ ID NO: 1270702 - RNA, 21 nt, Human
aguugaucgccuuucccaggu

SEQ ID NO: 1270703 - RNA, 23 nt, Human
aguugaucuggaacccagacuca

SEQ ID NO: 1270704 - RNA, 13 nt, Human
aguugauuagaaa

SEQ ID NO: 1270705 - RNA, 13 nt, Human
aguugaucuggaa

SEQ ID NO: 1270706 - RNA, 15 nt, Human
aguugaucuggaacc

SEQ ID NO: 1270707 - RNA, 17 nt, Human
aguugaucuggaaccca

SEQ ID NO: 1270708 - RNA, 18 nt, Human
aguugaucuggaacccag

SEQ ID NO: 1270709 - RNA, 19 nt, Human
aguugaucuggaacccaga

SEQ ID NO: 1270710 - RNA, 20 nt, Human
aguugaucuggaacccagac

SEQ ID NO: 1270711 - RNA, 21 nt, Human
aguugaucuggaacccagacu

SEQ ID NO: 1270712 - RNA, 13 nt, Human
aguucugaagaag

SEQ ID NO: 1270713 - RNA, 14 nt, Human
aguucugaagaaga

SEQ ID NO: 1270714 - RNA, 15 nt, Human
aguucugaagaagau

SEQ ID NO: 1270715 - RNA, 16 nt, Human
aguucugaagaagaug

SEQ ID NO: 1270716 - RNA, 16 nt, Human
aguucugugguuucau

SEQ ID NO: 1270717 - RNA, 19 nt, Human
aguucugugguuucauguu

SEQ ID NO: 1270718 - RNA, 22 nt, Human
aguucugugguuucauguuagu

SEQ ID NO: 1270719 - RNA, 23 nt, Human
aguucugugguuucauguuaguu

SEQ ID NO: 1270720 - RNA, 17 nt, Human
aguucuuuaaaauguaa

SEQ ID NO: 1270721 - RNA, 17 nt, Human
aguucuuuggcugaaag

SEQ ID NO: 1270722 - RNA, 15 nt, Human
aguucuuugggccag

SEQ ID NO: 1270723 - RNA, 16 nt, Human
aguucuuugggccaga

SEQ ID NO: 1270724 - RNA, 17 nt, Human
aguucuuugggccagac

SEQ ID NO: 1270725 - RNA, 20 nt, Human
aguuuuaucauuuucaaaau

SEQ ID NO: 1270726 - RNA, 17 nt, Human
aguuugucgcucaugug

SEQ ID NO: 1270727 - RNA, 19 nt, Human
aguuugucgcucaugugug

SEQ ID NO: 1270728 - RNA, 21 nt, Human
aguuugucgcucaugugugca

SEQ ID NO: 1270729 - RNA, 16 nt, Human
aguuucuaaacuggag

SEQ ID NO: 1270730 - RNA, 13 nt, Human
aguuuggguaaaa

SEQ ID NO: 1270731 - RNA, 20 nt, Human
aguuuggguaaaauacuuuu

SEQ ID NO: 1270732 - RNA, 18 nt, Human
aguuuggguaaaauacuu

SEQ ID NO: 1270733 - RNA, 15 nt, Human
aguuuuaucauuuuc

SEQ ID NO: 1270734 - RNA, 23 nt, Human
aguuuuauuaauaaacauucuau

SEQ ID NO: 1270735 - RNA, 12 nt, Human
aguuuucagugg

SEQ ID NO: 1270736 - RNA, 21 nt, Human
aguuuucauccauaacugaac

SEQ ID NO: 1270737 - RNA, 20 nt, Human
aguuuucauccauaacugaa

SEQ ID NO: 1270738 - RNA, 20 nt, Human
aguuuuccauggcaggaagg

SEQ ID NO: 1270739 - RNA, 22 nt, Human
aguuuuccauggcaggaaggcu

SEQ ID NO: 1270740 - RNA, 16 nt, Human
aguuucguuuucaaaa

SEQ ID NO: 1270741 - RNA, 12 nt, Human
aguuuccuuuuu

SEQ ID NO: 1270742 - RNA, 16 nt, Human
aguuuccuuuuuaaua

SEQ ID NO: 1270743 - RNA, 18 nt, Human
aguuuccuuuuuaauaug

SEQ ID NO: 1270744 - RNA, 17 nt, Human
aguuucuaaacuggaga

SEQ ID NO: 1270745 - RNA, 15 nt, Human
aguuucguuuucaaa

SEQ ID NO: 1270746 - RNA, 12 nt, Human
aguuuccugaaa

SEQ ID NO: 1270747 - RNA, 16 nt, Human
aguuucucagcuccca

SEQ ID NO: 1270748 - RNA, 19 nt, Human
uuaaauucccguuuuguca

SEQ ID NO: 1270749 - RNA, 22 nt, Human
uuaaauucccguuuugucacuu

SEQ ID NO: 1270750 - RNA, 23 nt, Human
uuaaauucucucucuugcaggaa

SEQ ID NO: 1270751 - RNA, 18 nt, Human
aguuuauuuguugagagu

SEQ ID NO: 1270752 - RNA, 19 nt, Human
aguuuauuuguugagagug

SEQ ID NO: 1270753 - RNA, 23 nt, Human
aguuuauuuguugagagugugac

SEQ ID NO: 1270754 - RNA, 20 nt, Human
aguuuauuuguugagagugu

SEQ ID NO: 1270755 - RNA, 19 nt, Human
uuaaaaaagaaacauuugg

SEQ ID NO: 1270756 - RNA, 13 nt, Human
uuaaaaaacuaaa

SEQ ID NO: 1270757 - RNA, 20 nt, Human
uuaaaaaguuauaaccaacu

SEQ ID NO: 1270758 - RNA, 15 nt, Human
uuaaaaauaagucaa

SEQ ID NO: 1270759 - RNA, 22 nt, Human
uuaaaaauaagucaacaguaaa

SEQ ID NO: 1270760 - RNA, 21 nt, Human
uuaaaaauaagucaacaguaa

SEQ ID NO: 1270761 - RNA, 18 nt, Human
uuaaaaaugucuuauugu

SEQ ID NO: 1270762 - RNA, 17 nt, Human
uuaaaaauucagcaaag

SEQ ID NO: 1270763 - RNA, 15 nt, Human
uuaaaaaagaaacau

SEQ ID NO: 1270764 - RNA, 18 nt, Human
uuaaaaaagaaacauuug

SEQ ID NO: 1270765 - RNA, 22 nt, Human
aguugcauguaguaacacuaau

SEQ ID NO: 1270766 - RNA, 21 nt, Human
aguugcauguaguaacacuaa

SEQ ID NO: 1270767 - RNA, 20 nt, Human
aguugcacagcaucucagcu

SEQ ID NO: 1270768 - RNA, 13 nt, Human
aguugcauguagu

SEQ ID NO: 1270769 - RNA, 15 nt, Human
aguugcauguaguaa

SEQ ID NO: 1270770 - RNA, 17 nt, Human
aguugcauguaguaaca

SEQ ID NO: 1270771 - RNA, 18 nt, Human
aguugcauguaguaacac

SEQ ID NO: 1270772 - RNA, 19 nt, Human
aguugcauguaguaacacu

SEQ ID NO: 1270773 - RNA, 17 nt, Human
aguugcacagcuaugaa

SEQ ID NO: 1270774 - RNA, 17 nt, Human
aguugcacagcaucuca

SEQ ID NO: 1270775 - RNA, 16 nt, Human
aguugcacagcaucuc

SEQ ID NO: 1270776 - RNA, 16 nt, Human
aguugcacagcuauga

SEQ ID NO: 1270777 - RNA, 15 nt, Human
aguugcacagcaucu

SEQ ID NO: 1270778 - RNA, 14 nt, Human
aguugcacagcauc

SEQ ID NO: 1270779 - RNA, 13 nt, Human
aguugcacagcau

SEQ ID NO: 1270780 - RNA, 12 nt, Human
aguugcacagca

SEQ ID NO: 1270781 - RNA, 11 nt, Human
aguugcacagc

SEQ ID NO: 1270782 - RNA, 16 nt, Human
uuaaaaucagcuauuu

SEQ ID NO: 1270783 - RNA, 16 nt, Human
uuaaaccgcuaaaaga

SEQ ID NO: 1270784 - RNA, 17 nt, Human
uuaaaccuauacucacu

SEQ ID NO: 1270785 - RNA, 14 nt, Human
uuaaaccuauacuc

SEQ ID NO: 1270786 - RNA, 14 nt, Human
uuaaaccuuuuuug

SEQ ID NO: 1270787 - RNA, 19 nt, Human
uuaaaccgcuaaaagaaac

SEQ ID NO: 1270788 - RNA, 15 nt, Human
uuaaacgauuuuuaa

SEQ ID NO: 1270789 - RNA, 18 nt, Human
uuaaacgauuuuuaaaau

SEQ ID NO: 1270790 - RNA, 22 nt, Human
uuaaacgauuuuuaaaauguac

SEQ ID NO: 1270791 - RNA, 23 nt, Human
uuaaacgcucuagguacgaugac

SEQ ID NO: 1270792 - RNA, 16 nt, Human
uuaaaauauuccugca

SEQ ID NO: 1270793 - RNA, 19 nt, Human
uuaaaauauuccugcauuu

SEQ ID NO: 1270794 - RNA, 23 nt, Human
uuaaaauagcguucuuguaauuu

SEQ ID NO: 1270795 - RNA, 12 nt, Human
uuaaaauauaau

SEQ ID NO: 1270796 - RNA, 22 nt, Human
uuaucaugugaaaucauucauu

SEQ ID NO: 1270797 - RNA, 20 nt, Human
uuaucaugugaaaucauuca

SEQ ID NO: 1270798 - RNA, 18 nt, Human
uuaucaugugaaaucauu

SEQ ID NO: 1270799 - RNA, 17 nt, Human
uuaucaugugaaaucau

SEQ ID NO: 1270800 - RNA, 14 nt, Human
uuaucagucaauau

SEQ ID NO: 1270801 - RNA, 15 nt, Human
uuaucagucaauauu

SEQ ID NO: 1270802 - RNA, 23 nt, Human
uuaucagucaauauuuuuagaua

SEQ ID NO: 1270803 - RNA, 21 nt, Human
uuaucagucauaacuaaauaa

SEQ ID NO: 1270804 - RNA, 23 nt, Human
uuaucagucauaacuaaauaaag

SEQ ID NO: 1270805 - RNA, 14 nt, Human
uuaucagugcuucc

SEQ ID NO: 1270806 - RNA, 15 nt, Human
uuaucaacuuccuaa

SEQ ID NO: 1270807 - RNA, 21 nt, Human
uuaucaacuuccuaaauauua

SEQ ID NO: 1270808 - RNA, 21 nt, Human
uuaucaccgugggcucccuga

SEQ ID NO: 1270809 - RNA, 23 nt, Human
uuaucaccuagcugaauguuuuu

SEQ ID NO: 1270810 - RNA, 19 nt, Human
uuaucaccuagcugaaugu

SEQ ID NO: 1270811 - RNA, 22 nt, Human
uuaucagacucggaaucuauuu

SEQ ID NO: 1270812 - RNA, 16 nt, Human
uuaucaguaaauaacu

SEQ ID NO: 1270813 - RNA, 23 nt, Human
auacucaagagugguaucuugca

SEQ ID NO: 1270814 - RNA, 20 nt, Human
auacucaaaugaguaacauu

SEQ ID NO: 1270815 - RNA, 16 nt, Human
uuaucaaaacuuucuu

SEQ ID NO: 1270816 - RNA, 18 nt, Human
uuaucaaacccuagccuu

SEQ ID NO: 1270817 - RNA, 21 nt, Human
uuaucaaacccuagccuugcu

SEQ ID NO: 1270818 - RNA, 19 nt, Human
uuaucaaacccuagccuug

SEQ ID NO: 1270819 - RNA, 15 nt, Human
uuaucaacaauagug

SEQ ID NO: 1270820 - RNA, 21 nt, Human
auaccaauaaagugacccugc

SEQ ID NO: 1270821 - RNA, 19 nt, Human
auaccaaugaaaaaaugua

SEQ ID NO: 1270822 - RNA, 15 nt, Human
auaccaauaaaguga

SEQ ID NO: 1270823 - RNA, 14 nt, Human
auaccaauaaagug

SEQ ID NO: 1270824 - RNA, 22 nt, Human
auaccacaggaaccacaagacu

SEQ ID NO: 1270825 - RNA, 21 nt, Human
auaccaaugaaaaaauguaua

SEQ ID NO: 1270826 - RNA, 17 nt, Human
auacuaagcauugaaug

SEQ ID NO: 1270827 - RNA, 21 nt, Human
auacuaagcauugaauggcua

SEQ ID NO: 1270828 - RNA, 18 nt, Human
auacuaauaaacuaauaa

SEQ ID NO: 1270829 - RNA, 22 nt, Human
auacuaauaaacuaauaauugc

SEQ ID NO: 1270830 - RNA, 21 nt, Human
auacuaaugaaaacagaaugu

SEQ ID NO: 1270831 - RNA, 16 nt, Human
auaccagcgaggaggc

SEQ ID NO: 1270832 - RNA, 22 nt, Human
auaccagcgaggaggcuccaga

SEQ ID NO: 1270833 - RNA, 14 nt, Human
auacuaccuugaaa

SEQ ID NO: 1270834 - RNA, 15 nt, Human
auacuaccuugaaaa

SEQ ID NO: 1270835 - RNA, 17 nt, Human
auacuaccuugaaaaua

SEQ ID NO: 1270836 - RNA, 12 nt, Human
auacuacuuaug

SEQ ID NO: 1270837 - RNA, 19 nt, Human
auacuacuuaugaaaugug

SEQ ID NO: 1270838 - RNA, 20 nt, Human
auacuagggagccauuugag

SEQ ID NO: 1270839 - RNA, 21 nt, Human
auacuauuuaaagccuccuca

SEQ ID NO: 1270840 - RNA, 22 nt, Human
auacuauuuaaagccuccucau

SEQ ID NO: 1270841 - RNA, 16 nt, Human
auacuagggagccauu

SEQ ID NO: 1270842 - RNA, 19 nt, Human
auacucaaaugaguaacau

SEQ ID NO: 1270843 - RNA, 20 nt, Human
auacaucccuuaccugggaa

SEQ ID NO: 1270844 - RNA, 20 nt, Human
auacauucuucaagauccca

SEQ ID NO: 1270845 - RNA, 15 nt, Human
auacauuauauuucu

SEQ ID NO: 1270846 - RNA, 17 nt, Human
auacauuauauuucuau

SEQ ID NO: 1270847 - RNA, 22 nt, Human
auacauuauauuucuauuuuau

SEQ ID NO: 1270848 - RNA, 21 nt, Human
auacaguucugcucugguugu

SEQ ID NO: 1270849 - RNA, 20 nt, Human
auacauuguauauaugugua

SEQ ID NO: 1270850 - RNA, 16 nt, Human
auacauuuaaaacauu

SEQ ID NO: 1270851 - RNA, 21 nt, Human
auacauuuaaaacauuaaaau

SEQ ID NO: 1270852 - RNA, 13 nt, Human
auaccaauaaagu

SEQ ID NO: 1270853 - RNA, 12 nt, Human
auaccaauaaag

SEQ ID NO: 1270854 - RNA, 20 nt, Human
auaccaaaauguugcugaaa

SEQ ID NO: 1270855 - RNA, 17 nt, Human
auaccaaagcacauuuu

SEQ ID NO: 1270856 - RNA, 18 nt, Human
auaccaaagcacauuuua

SEQ ID NO: 1270857 - RNA, 16 nt, Human
auacauuuuguaccaa

SEQ ID NO: 1270858 - RNA, 15 nt, Human
auaccaaaauguugc

SEQ ID NO: 1270859 - RNA, 16 nt, Human
auaccaaaauguugcu

SEQ ID NO: 1270860 - RNA, 16 nt, Human
auacauuuucuaagaa

SEQ ID NO: 1270861 - RNA, 16 nt, Human
auacagcuuuuggauu

SEQ ID NO: 1270862 - RNA, 20 nt, Human
auacagcuguauugucugaa

SEQ ID NO: 1270863 - RNA, 21 nt, Human
auacaguucggugagcuacaa

SEQ ID NO: 1270864 - RNA, 18 nt, Human
auacaaaaauacucagau

SEQ ID NO: 1270865 - RNA, 11 nt, Human
auacaaagcau

SEQ ID NO: 1270866 - RNA, 19 nt, Human
auacaaaggcuuauuaauu

SEQ ID NO: 1270867 - RNA, 13 nt, Human
auacaaauggauu

SEQ ID NO: 1270868 - RNA, 14 nt, Human
auacaaauggauuu

SEQ ID NO: 1270869 - RNA, 20 nt, Human
auacaaauggauuuugggag

SEQ ID NO: 1270870 - RNA, 17 nt, Human
auacaaauggauuuugg

SEQ ID NO: 1270871 - RNA, 16 nt, Human
auacagcaacaauuua

SEQ ID NO: 1270872 - RNA, 22 nt, Human
auacagcagagcuagguggaaa

SEQ ID NO: 1270873 - RNA, 13 nt, Human
auacagcucagaa

SEQ ID NO: 1270874 - RNA, 12 nt, Human
auacagcuguau

SEQ ID NO: 1270875 - RNA, 17 nt, Human
uuauaguacaugauaaa

SEQ ID NO: 1270876 - RNA, 16 nt, Human
uuauaguacaugauaa

SEQ ID NO: 1270877 - RNA, 13 nt, Human
uuauaguacauga

SEQ ID NO: 1270878 - RNA, 24 nt, Human
uuauaggauuuauuuaaaauagca

SEQ ID NO: 1270879 - RNA, 15 nt, Human
uuauagugaauacug

SEQ ID NO: 1270880 - RNA, 21 nt, Human
uuauagugaauacugcuacag

SEQ ID NO: 1270881 - RNA, 21 nt, Human
uuauagugauguaaucuugaa

SEQ ID NO: 1270882 - RNA, 20 nt, Human
uuauagcucuaauguuugca

SEQ ID NO: 1270883 - RNA, 18 nt, Human
uuauaggauuuauuuaaa

SEQ ID NO: 1270884 - RNA, 16 nt, Human
uuauaggaucauuugu

SEQ ID NO: 1270885 - RNA, 18 nt, Human
uuauagcucuaauguuug

SEQ ID NO: 1270886 - RNA, 17 nt, Human
uuauagcucuaauguuu

SEQ ID NO: 1270887 - RNA, 16 nt, Human
uuauagcucuaauguu

SEQ ID NO: 1270888 - RNA, 15 nt, Human
uuauagcucuaaugu

SEQ ID NO: 1270889 - RNA, 12 nt, Human
uuauagcucuaa

SEQ ID NO: 1270890 - RNA, 19 nt, Human
uuauagccucugucuggca

SEQ ID NO: 1270891 - RNA, 15 nt, Human
uuauagccucugucu

SEQ ID NO: 1270892 - RNA, 16 nt, Human
uuauagccucugucug

SEQ ID NO: 1270893 - RNA, 17 nt, Human
uuauagccucugucugg

SEQ ID NO: 1270894 - RNA, 12 nt, Human
uuauagauucua

SEQ ID NO: 1270895 - RNA, 13 nt, Human
uuauagauucuaa

SEQ ID NO: 1270896 - RNA, 14 nt, Human
uuauagauucuaaa

SEQ ID NO: 1270897 - RNA, 15 nt, Human
uuauagauucuaaag

SEQ ID NO: 1270898 - RNA, 16 nt, Human
uuauagauucuaaaga

SEQ ID NO: 1270899 - RNA, 19 nt, Human
uuauagauucuaaagauuc

SEQ ID NO: 1270900 - RNA, 20 nt, Human
uuauagauucuaaagauucu

SEQ ID NO: 1270901 - RNA, 21 nt, Human
uuauagauucuaaagauucua

SEQ ID NO: 1270902 - RNA, 21 nt, Human
uuauaccucaauuuucacugu

SEQ ID NO: 1270903 - RNA, 22 nt, Human
uuauaccucaauuuucacugug

SEQ ID NO: 1270904 - RNA, 14 nt, Human
uuauaccucaauuu

SEQ ID NO: 1270905 - RNA, 22 nt, Human
uuauaccaaaauguugcugaaa

SEQ ID NO: 1270906 - RNA, 14 nt, Human
uuauacgaaauaau

SEQ ID NO: 1270907 - RNA, 16 nt, Human
uuauacgaaauaauug

SEQ ID NO: 1270908 - RNA, 17 nt, Human
uuauacgaaauaauugu

SEQ ID NO: 1270909 - RNA, 20 nt, Human
uuauacgaguaauaugccug

SEQ ID NO: 1270910 - RNA, 21 nt, Human
uuauacgcuggcaacacagag

SEQ ID NO: 1270911 - RNA, 22 nt, Human
uuauacgcuggcaacacagagg

SEQ ID NO: 1270912 - RNA, 16 nt, Human
uuauacucuuucugua

SEQ ID NO: 1270913 - RNA, 15 nt, Human
uuauacuuguaauua

SEQ ID NO: 1270914 - RNA, 19 nt, Human
uuauacuuguaauuaugga

SEQ ID NO: 1270915 - RNA, 18 nt, Human
uuauacuuucccuacccu

SEQ ID NO: 1270916 - RNA, 23 nt, Human
uuauacuuucccuacccucuaga

SEQ ID NO: 1270917 - RNA, 16 nt, Human
uuauagaaguuuagau

SEQ ID NO: 1270918 - RNA, 16 nt, Human
uuagcaguuugcuuug

SEQ ID NO: 1270919 - RNA, 14 nt, Human
uuagccccauaauu

SEQ ID NO: 1270920 - RNA, 21 nt, Human
uuagccaguaauccuguagga

SEQ ID NO: 1270921 - RNA, 15 nt, Human
uuagccccugaaagc

SEQ ID NO: 1270922 - RNA, 16 nt, Human
uuagccccugaaagcc

SEQ ID NO: 1270923 - RNA, 20 nt, Human
uuagccucaauuucugaaca

SEQ ID NO: 1270924 - RNA, 17 nt, Human
uuagccuggaccucuga

SEQ ID NO: 1270925 - RNA, 18 nt, Human
uuagccuggaccucugac

SEQ ID NO: 1270926 - RNA, 23 nt, Human
uuauaaauguaccagagagaguu

SEQ ID NO: 1270927 - RNA, 18 nt, Human
uuauacccccugcaaagc

SEQ ID NO: 1270928 - RNA, 16 nt, Human
uuauaccaaaauguug

SEQ ID NO: 1270929 - RNA, 17 nt, Human
uuauaaauuucuauuuu

SEQ ID NO: 1270930 - RNA, 16 nt, Human
uuauaaccuuaauuua

SEQ ID NO: 1270931 - RNA, 19 nt, Human
uuauaaccuuaauuuauua

SEQ ID NO: 1270932 - RNA, 21 nt, Human
uuauaaccuuaauuuauuauu

SEQ ID NO: 1270933 - RNA, 15 nt, Human
uuauaacuaacaugu

SEQ ID NO: 1270934 - RNA, 19 nt, Human
uuauaacuaacauguccug

SEQ ID NO: 1270935 - RNA, 16 nt, Human
uuauaacuggaaagaa

SEQ ID NO: 1270936 - RNA, 17 nt, Human
uuauaacuggaaagaag

SEQ ID NO: 1270937 - RNA, 17 nt, Human
uuauaacuguaaagaug

SEQ ID NO: 1270938 - RNA, 18 nt, Human
uuauaacuguaaagaugu

SEQ ID NO: 1270939 - RNA, 18 nt, Human
uuauauaagcuuguauuc

SEQ ID NO: 1270940 - RNA, 15 nt, Human
uuauaguuucugagg

SEQ ID NO: 1270941 - RNA, 13 nt, Human
uuauaguuucuga

SEQ ID NO: 1270942 - RNA, 13 nt, Human
uuauaguuacugu

SEQ ID NO: 1270943 - RNA, 14 nt, Human
uuauaguuacugug

SEQ ID NO: 1270944 - RNA, 15 nt, Human
uuauaguuacugugu

SEQ ID NO: 1270945 - RNA, 19 nt, Human
uuauaguuacuguguaauu

SEQ ID NO: 1270946 - RNA, 15 nt, Human
uuauaguuguaacua

SEQ ID NO: 1270947 - RNA, 12 nt, Human
uuauaguuucug

SEQ ID NO: 1270948 - RNA, 12 nt, Human
uuauauaacugu

SEQ ID NO: 1270949 - RNA, 16 nt, Human
uuauauaacuguauuu

SEQ ID NO: 1270950 - RNA, 18 nt, Human
uuauauaacuguauuuga

SEQ ID NO: 1270951 - RNA, 22 nt, Human
uuauauaacuguauuugaaaua

SEQ ID NO: 1270952 - RNA, 20 nt, Human
uuauauaaucauuauuacuu

SEQ ID NO: 1270953 - RNA, 16 nt, Human
uuauauaaucauuauu

SEQ ID NO: 1270954 - RNA, 20 nt, Human
uuauauaauugccaaaaagu

SEQ ID NO: 1270955 - RNA, 22 nt, Human
uuauauaauugccaaaaaguga

SEQ ID NO: 1270956 - RNA, 22 nt, Human
uuauauauauuuuuuucugaaa

SEQ ID NO: 1270957 - RNA, 14 nt, Human
uuauauauguauuu

SEQ ID NO: 1270958 - RNA, 15 nt, Human
uuauauauaaauaua

SEQ ID NO: 1270959 - RNA, 23 nt, Human
uuauauauaaauauauuauuacu

SEQ ID NO: 1270960 - RNA, 18 nt, Human
uuauauauaaauauauua

SEQ ID NO: 1270961 - RNA, 14 nt, Human
uuauauauauauau

SEQ ID NO: 1270962 - RNA, 17 nt, Human
uuauauauguauuuaua

SEQ ID NO: 1270963 - RNA, 21 nt, Human
uuauauauggggaugguaguu

SEQ ID NO: 1270964 - RNA, 13 nt, Human
auaauuuugugaa

SEQ ID NO: 1270965 - RNA, 14 nt, Human
auaauuuugugaag

SEQ ID NO: 1270966 - RNA, 15 nt, Human
auaauuuugugaagc

SEQ ID NO: 1270967 - RNA, 20 nt, Human
auaauuuugugaagcaaaau

SEQ ID NO: 1270968 - RNA, 14 nt, Human
auaauuuuuauauu

SEQ ID NO: 1270969 - RNA, 12 nt, Human
auaauuuuguaa

SEQ ID NO: 1270970 - RNA, 13 nt, Human
auaauuuuguaau

SEQ ID NO: 1270971 - RNA, 23 nt, Human
auaauuuuguaauguaucaaaua

SEQ ID NO: 1270972 - RNA, 16 nt, Human
auaauuuuuauauuug

SEQ ID NO: 1270973 - RNA, 19 nt, Human
auaauuuuuauauuugaaa

SEQ ID NO: 1270974 - RNA, 21 nt, Human
auaauuuuuauauuugaaaua

SEQ ID NO: 1270975 - RNA, 22 nt, Human
auaauuuuuauauuugaaauau

SEQ ID NO: 1270976 - RNA, 14 nt, Human
auaauuuuuauaug

SEQ ID NO: 1270977 - RNA, 22 nt, Human
auacaaaaaaaaaaaaaaauua

SEQ ID NO: 1270978 - RNA, 23 nt, Human
auaaacacucuugaaaaaugcau

SEQ ID NO: 1270979 - RNA, 17 nt, Human
aguuuucuccucccagg

SEQ ID NO: 1270980 - RNA, 22 nt, Human
aguuuuccuaagugauuguaug

SEQ ID NO: 1270981 - RNA, 16 nt, Human
aguuuuccuaugcuuu

SEQ ID NO: 1270982 - RNA, 18 nt, Human
aguuuuccuaugcuuuga

SEQ ID NO: 1270983 - RNA, 16 nt, Human
auaaaccgaacugaug

SEQ ID NO: 1270984 - RNA, 21 nt, Human
auaaacccaguugccaucugc

SEQ ID NO: 1270985 - RNA, 23 nt, Human
auaaaccccaccccaaaauuagc

SEQ ID NO: 1270986 - RNA, 22 nt, Human
auaaaccccaccccaaaauuag

SEQ ID NO: 1270987 - RNA, 13 nt, Human
auaaacauuguau

SEQ ID NO: 1270988 - RNA, 19 nt, Human
auaaacaggucaaugaaug

SEQ ID NO: 1270989 - RNA, 15 nt, Human
auaaacgucuuaaau

SEQ ID NO: 1270990 - RNA, 16 nt, Human
auaaacgucuuaaaua

SEQ ID NO: 1270991 - RNA, 18 nt, Human
auaaacgucuuaaauauu

SEQ ID NO: 1270992 - RNA, 17 nt, Human
auaaacguggauguuac

SEQ ID NO: 1270993 - RNA, 18 nt, Human
auaaacguggauguuacu

SEQ ID NO: 1270994 - RNA, 14 nt, Human
auaaacuaauaauu

SEQ ID NO: 1270995 - RNA, 15 nt, Human
auaaacuaauaauug

SEQ ID NO: 1270996 - RNA, 17 nt, Human
auaaacuaauaauugca

SEQ ID NO: 1270997 - RNA, 16 nt, Human
auaaacuuuaauauaa

SEQ ID NO: 1270998 - RNA, 20 nt, Human
auaaacuuuaauauaaagua

SEQ ID NO: 1270999 - RNA, 22 nt, Human
auaaacuuuaauauaaaguagu

SEQ ID NO: 1271000 - RNA, 20 nt, Human
auaaagugacccugcucuca

SEQ ID NO: 1271001 - RNA, 18 nt, Human
auaaagugacccugcucu

SEQ ID NO: 1271002 - RNA, 16 nt, Human
auaaaguaguccugug

SEQ ID NO: 1271003 - RNA, 17 nt, Human
auaaaguaguccuguga

SEQ ID NO: 1271004 - RNA, 14 nt, Human
auaaaguaucauca

SEQ ID NO: 1271005 - RNA, 15 nt, Human
auaaaguaucaucag

SEQ ID NO: 1271006 - RNA, 19 nt, Human
auaaauaaaguuuguugaa

SEQ ID NO: 1271007 - RNA, 13 nt, Human
auaaauaaaguuu

SEQ ID NO: 1271008 - RNA, 19 nt, Human
auaacaugugaaaagaaua

SEQ ID NO: 1271009 - RNA, 12 nt, Human
auaacuggaaac

SEQ ID NO: 1271010 - RNA, 15 nt, Human
auaacuggaaagaag

SEQ ID NO: 1271011 - RNA, 22 nt, Human
auaacuggaaaacagaacacuu

SEQ ID NO: 1271012 - RNA, 23 nt, Human
auaacuggaaaacagaacacuua

SEQ ID NO: 1271013 - RNA, 15 nt, Human
auaacuggaaaacag

SEQ ID NO: 1271014 - RNA, 17 nt, Human
auaacuggaaaacagaa

SEQ ID NO: 1271015 - RNA, 21 nt, Human
auaacuggaaaacagaacacu

SEQ ID NO: 1271016 - RNA, 14 nt, Human
auaaccacugcuuc

SEQ ID NO: 1271017 - RNA, 14 nt, Human
auaaccaaaugaaa

SEQ ID NO: 1271018 - RNA, 12 nt, Human
auaaccacugcu

SEQ ID NO: 1271019 - RNA, 13 nt, Human
auaacugaaaaug

SEQ ID NO: 1271020 - RNA, 15 nt, Human
auaacugaaaaugug

SEQ ID NO: 1271021 - RNA, 14 nt, Human
auaacugaaaauua

SEQ ID NO: 1271022 - RNA, 17 nt, Human
auaacugaaaauuauuu

SEQ ID NO: 1271023 - RNA, 20 nt, Human
auaacugaaaauuauuuaaa

SEQ ID NO: 1271024 - RNA, 21 nt, Human
auaacugaaaauuauuuaaac

SEQ ID NO: 1271025 - RNA, 14 nt, Human
auaacugaacaucc

SEQ ID NO: 1271026 - RNA, 20 nt, Human
auaacuguaaaugugacauu

SEQ ID NO: 1271027 - RNA, 15 nt, Human
auaacuguauuugaa

SEQ ID NO: 1271028 - RNA, 18 nt, Human
auaacuguauuugaaaua

SEQ ID NO: 1271029 - RNA, 13 nt, Human
uuacaugaaguau

SEQ ID NO: 1271030 - RNA, 14 nt, Human
uuacaugaaguauu

SEQ ID NO: 1271031 - RNA, 15 nt, Human
uuacaugaaguauuu

SEQ ID NO: 1271032 - RNA, 16 nt, Human
uuacaugaaguauuuu

SEQ ID NO: 1271033 - RNA, 20 nt, Human
uuacaugaaguauuuuuuca

SEQ ID NO: 1271034 - RNA, 16 nt, Human
uuacaugauucauuuu

SEQ ID NO: 1271035 - RNA, 17 nt, Human
uuacaugauucauuuua

SEQ ID NO: 1271036 - RNA, 14 nt, Human
uuacaugcuuauuc

SEQ ID NO: 1271037 - RNA, 19 nt, Human
uuacaugcuuauuccauga

SEQ ID NO: 1271038 - RNA, 20 nt, Human
uuacaugcuuauuccaugac

SEQ ID NO: 1271039 - RNA, 23 nt, Human
uuaccauuaaaccaucucccugg

SEQ ID NO: 1271040 - RNA, 22 nt, Human
uuaccauuaaaccaucucccug

SEQ ID NO: 1271041 - RNA, 22 nt, Human
uuacaugaggacucuauucuuu

SEQ ID NO: 1271042 - RNA, 22 nt, Human
uuacaugcauuacugcaugcac

SEQ ID NO: 1271043 - RNA, 12 nt, Human
uuacaugcuuau

SEQ ID NO: 1271044 - RNA, 13 nt, Human
uuacaugcuuauu

SEQ ID NO: 1271045 - RNA, 14 nt, Human
uuaccauuuacaug

SEQ ID NO: 1271046 - RNA, 13 nt, Human
uuacccuggcccc

SEQ ID NO: 1271047 - RNA, 17 nt, Human
uuacccuggccccucuc

SEQ ID NO: 1271048 - RNA, 20 nt, Human
uuacccuggccccucucccu

SEQ ID NO: 1271049 - RNA, 18 nt, Human
uuacccuggccccucucc

SEQ ID NO: 1271050 - RNA, 13 nt, Human
auaaguuuuaugu

SEQ ID NO: 1271051 - RNA, 12 nt, Human
auaaguuuauuu

SEQ ID NO: 1271052 - RNA, 14 nt, Human
auaaguuuauuucu

SEQ ID NO: 1271053 - RNA, 18 nt, Human
auaaguuuauuucuuaaa

SEQ ID NO: 1271054 - RNA, 22 nt, Human
auaaguuuauuucuuaaaucua

SEQ ID NO: 1271055 - RNA, 21 nt, Human
auaaguuucugggaccucagu

SEQ ID NO: 1271056 - RNA, 14 nt, Human
auaauaauuaguaa

SEQ ID NO: 1271057 - RNA, 13 nt, Human
auaaguuauugca

SEQ ID NO: 1271058 - RNA, 14 nt, Human
auaaguuauugcag

SEQ ID NO: 1271059 - RNA, 16 nt, Human
auaaguuauugcaguu

SEQ ID NO: 1271060 - RNA, 20 nt, Human
auaaguuauugcaguuuauc

SEQ ID NO: 1271061 - RNA, 21 nt, Human
auaaguuauugcaguuuauca

SEQ ID NO: 1271062 - RNA, 24 nt, Human
auaaguuauugcaguuuaucauuc

SEQ ID NO: 1271063 - RNA, 18 nt, Human
auaaguucaaauucuucu

SEQ ID NO: 1271064 - RNA, 20 nt, Human
auaaguucaaauucuucuga

SEQ ID NO: 1271065 - RNA, 21 nt, Human
auaaguucaaauucuucugaa

SEQ ID NO: 1271066 - RNA, 24 nt, Human
auaaguucaaauucuucugaacuc

SEQ ID NO: 1271067 - RNA, 13 nt, Human
auaagcaggugga

SEQ ID NO: 1271068 - RNA, 20 nt, Human
auaagcaaaaacaaaaagaa

SEQ ID NO: 1271069 - RNA, 20 nt, Human
auaagaagaaugcuuaauca

SEQ ID NO: 1271070 - RNA, 19 nt, Human
auaagaagaaugcuuaauc

SEQ ID NO: 1271071 - RNA, 13 nt, Human
auaagauucuaac

SEQ ID NO: 1271072 - RNA, 16 nt, Human
auaagaacuuugagcu

SEQ ID NO: 1271073 - RNA, 11 nt, Human
auaagaagaau

SEQ ID NO: 1271074 - RNA, 13 nt, Human
auaagaagaaugc

SEQ ID NO: 1271075 - RNA, 15 nt, Human
auaagaagaaugcuu

SEQ ID NO: 1271076 - RNA, 16 nt, Human
auaagcagguggaucu

SEQ ID NO: 1271077 - RNA, 17 nt, Human
auaagauucuaacgguc

SEQ ID NO: 1271078 - RNA, 16 nt, Human
auaagcaagaaggcaa

SEQ ID NO: 1271079 - RNA, 21 nt, Human
auaagcaagaaggcaaaaaua

SEQ ID NO: 1271080 - RNA, 23 nt, Human
auaagcaagaaggcaaaaauagu

SEQ ID NO: 1271081 - RNA, 12 nt, Human
uuaccugggaaa

SEQ ID NO: 1271082 - RNA, 18 nt, Human
uuaccugaaaacacugug

SEQ ID NO: 1271083 - RNA, 20 nt, Human
uuaccugaaaacacugugca

SEQ ID NO: 1271084 - RNA, 22 nt, Human
uuaccugaaaacacugugcaca

SEQ ID NO: 1271085 - RNA, 14 nt, Human
uuaccuaagauuac

SEQ ID NO: 1271086 - RNA, 18 nt, Human
uuaccuaagauuacaaau

SEQ ID NO: 1271087 - RNA, 23 nt, Human
uuagaugcaguucugaagaagau

SEQ ID NO: 1271088 - RNA, 21 nt, Human
auaauugugauuagacagaac

SEQ ID NO: 1271089 - RNA, 16 nt, Human
auaauuggauuuccua

SEQ ID NO: 1271090 - RNA, 17 nt, Human
auaauuggauuuccuaa

SEQ ID NO: 1271091 - RNA, 18 nt, Human
auaauuggauuuccuaau

SEQ ID NO: 1271092 - RNA, 20 nt, Human
auaauuggauuuccuaauac

SEQ ID NO: 1271093 - RNA, 22 nt, Human
auaauugccaaaaagugaaaua

SEQ ID NO: 1271094 - RNA, 14 nt, Human
auaauucucauuaa

SEQ ID NO: 1271095 - RNA, 15 nt, Human
auaauucucauuaaa

SEQ ID NO: 1271096 - RNA, 22 nt, Human
auaauucucauuaaaagaauau

SEQ ID NO: 1271097 - RNA, 23 nt, Human
auaauucucauuaaaagaauauc

SEQ ID NO: 1271098 - RNA, 20 nt, Human
auaauucugaguuuuguguu

SEQ ID NO: 1271099 - RNA, 23 nt, Human
auaauucugaguuuuguguuugu

SEQ ID NO: 1271100 - RNA, 19 nt, Human
auaauugaguuuucagugg

SEQ ID NO: 1271101 - RNA, 14 nt, Human
auaauugcauugac

SEQ ID NO: 1271102 - RNA, 16 nt, Human
auaauugcauugacuu

SEQ ID NO: 1271103 - RNA, 22 nt, Human
auaauugcauugacuuucccca

SEQ ID NO: 1271104 - RNA, 17 nt, Human
auaauugccaaaaagug

SEQ ID NO: 1271105 - RNA, 21 nt, Human
auaauugccaaaaagugaaau

SEQ ID NO: 1271106 - RNA, 23 nt, Human
auaauugccaaaaagugaaauaa

SEQ ID NO: 1271107 - RNA, 20 nt, Human
auaauugugauuagacagaa

SEQ ID NO: 1271108 - RNA, 16 nt, Human
uuagauguaauuuugu

SEQ ID NO: 1271109 - RNA, 19 nt, Human
uuagauucucugugucuaa

SEQ ID NO: 1271110 - RNA, 20 nt, Human
uuagauucucugugucuaag

SEQ ID NO: 1271111 - RNA, 22 nt, Human
uuagauucucugugucuaagau

SEQ ID NO: 1271112 - RNA, 10 nt, Human
uuagauuuca

SEQ ID NO: 1271113 - RNA, 14 nt, Human
uuagauuucauagu

SEQ ID NO: 1271114 - RNA, 18 nt, Human
uuagauuucauaguucag

SEQ ID NO: 1271115 - RNA, 20 nt, Human
uuagauuucauaguucagaa

SEQ ID NO: 1271116 - RNA, 22 nt, Human
uuagauuucauaguucagaauu

SEQ ID NO: 1271117 - RNA, 13 nt, Human
uuagauuugugug

SEQ ID NO: 1271118 - RNA, 13 nt, Human
uuagauuuuaauc

SEQ ID NO: 1271119 - RNA, 12 nt, Human
uuagauuuuaca

SEQ ID NO: 1271120 - RNA, 14 nt, Human
uuagauuuuacaug

SEQ ID NO: 1271121 - RNA, 15 nt, Human
uuagauuuuacauga

SEQ ID NO: 1271122 - RNA, 19 nt, Human
uuagauuuuacaugaagua

SEQ ID NO: 1271123 - RNA, 20 nt, Human
uuagauuuuacaugaaguau

SEQ ID NO: 1271124 - RNA, 21 nt, Human
uuagauuuuacaugaaguauu

SEQ ID NO: 1271125 - RNA, 23 nt, Human
uuagauuuuacaugaaguauuuu

SEQ ID NO: 1271126 - RNA, 18 nt, Human
uuagauuuucugguucua

SEQ ID NO: 1271127 - RNA, 19 nt, Human
uuagauuuucugguucuaa

SEQ ID NO: 1271128 - RNA, 20 nt, Human
uuagauuuucugguucuaac

SEQ ID NO: 1271129 - RNA, 21 nt, Human
uuagauuuucugguucuaaca

SEQ ID NO: 1271130 - RNA, 12 nt, Human
uuagcagacagg

SEQ ID NO: 1271131 - RNA, 15 nt, Human
uuagcagcuuccaga

SEQ ID NO: 1271132 - RNA, 17 nt, Human
auaauccaguaaaauaa

SEQ ID NO: 1271133 - RNA, 17 nt, Human
auaaugaacagaacaua

SEQ ID NO: 1271134 - RNA, 19 nt, Human
auaaucaucaaguaauaca

SEQ ID NO: 1271135 - RNA, 21 nt, Human
auaaucauuauuacuuuugcu

SEQ ID NO: 1271136 - RNA, 22 nt, Human
auaaucauuauuacuuuugcug

SEQ ID NO: 1271137 - RNA, 16 nt, Human
auaaucacgcuuuccu

SEQ ID NO: 1271138 - RNA, 18 nt, Human
auaaucacgcuuuccuga

SEQ ID NO: 1271139 - RNA, 22 nt, Human
auaaucacucuaauuaauugua

SEQ ID NO: 1271140 - RNA, 14 nt, Human
auaaugaauacuuu

SEQ ID NO: 1271141 - RNA, 15 nt, Human
auaauuauauaacug

SEQ ID NO: 1271142 - RNA, 17 nt, Human
auaauuauauaacugua

SEQ ID NO: 1271143 - RNA, 19 nt, Human
auaauuauauaacuguauu

SEQ ID NO: 1271144 - RNA, 13 nt, Human
auaaugaacagaa

SEQ ID NO: 1271145 - RNA, 14 nt, Human
auaauuauauguug

SEQ ID NO: 1271146 - RNA, 13 nt, Human
auaauuauauguu

SEQ ID NO: 1271147 - RNA, 21 nt, Human
aggggcuuauaauaaaggacu

SEQ ID NO: 1271148 - RNA, 12 nt, Human
aggggcuucagg

SEQ ID NO: 1271149 - RNA, 15 nt, Human
aggggcuucaggucc

SEQ ID NO: 1271150 - RNA, 18 nt, Human
aggggcuggggacuugug

SEQ ID NO: 1271151 - RNA, 21 nt, Human
aggggcuggggacuugugucu

SEQ ID NO: 1271152 - RNA, 16 nt, Human
aggggcuucaggucca

SEQ ID NO: 1271153 - RNA, 14 nt, Human
aggggcuuccuggu

SEQ ID NO: 1271154 - RNA, 16 nt, Human
aggggcuuccuggugc

SEQ ID NO: 1271155 - RNA, 23 nt, Human
aggggcuugacuuuuucaacuuc

SEQ ID NO: 1271156 - RNA, 15 nt, Human
agggggaaggcaggg

SEQ ID NO: 1271157 - RNA, 13 nt, Human
aggggcugggaac

SEQ ID NO: 1271158 - RNA, 14 nt, Human
aggggcugggaaca

SEQ ID NO: 1271159 - RNA, 14 nt, Human
aggggcuggggacu

SEQ ID NO: 1271160 - RNA, 17 nt, Human
aggggaggggcuccuuu

SEQ ID NO: 1271161 - RNA, 18 nt, Human
aggggaggggcuccuuuc

SEQ ID NO: 1271162 - RNA, 18 nt, Human
aggggagggggauccgac

SEQ ID NO: 1271163 - RNA, 20 nt, Human
aggggaggggcuccuuucca

SEQ ID NO: 1271164 - RNA, 12 nt, Human
aggggaccagga

SEQ ID NO: 1271165 - RNA, 13 nt, Human
aggggaccaggag

SEQ ID NO: 1271166 - RNA, 14 nt, Human
aggggaccaggagu

SEQ ID NO: 1271167 - RNA, 15 nt, Human
aggggaccaggagug

SEQ ID NO: 1271168 - RNA, 16 nt, Human
aggggaccaggagugg

SEQ ID NO: 1271169 - RNA, 22 nt, Human
aggggaccaggagugggugggg

SEQ ID NO: 1271170 - RNA, 17 nt, Human
aggggaccaggaguggg

SEQ ID NO: 1271171 - RNA, 20 nt, Human
aggggaccaggagugggugg

SEQ ID NO: 1271172 - RNA, 19 nt, Human
aggggacccuccgcucugu

SEQ ID NO: 1271173 - RNA, 13 nt, Human
aggggaccuggaa

SEQ ID NO: 1271174 - RNA, 23 nt, Human
aggggaccuggaagggagguggg

SEQ ID NO: 1271175 - RNA, 17 nt, Human
aggggaggcaucagugu

SEQ ID NO: 1271176 - RNA, 23 nt, Human
aggguagaauucuggcugguaga

SEQ ID NO: 1271177 - RNA, 20 nt, Human
aggguaggagggugggaagg

SEQ ID NO: 1271178 - RNA, 14 nt, Human
aggguacauggugc

SEQ ID NO: 1271179 - RNA, 17 nt, Human
aggguacauggugcugg

SEQ ID NO: 1271180 - RNA, 18 nt, Human
aggguacauggugcuggg

SEQ ID NO: 1271181 - RNA, 15 nt, Human
aggguaccagcagaa

SEQ ID NO: 1271182 - RNA, 14 nt, Human
aggguaccagcaga

SEQ ID NO: 1271183 - RNA, 12 nt, Human
aggguagggugg

SEQ ID NO: 1271184 - RNA, 13 nt, Human
aggguaggcagga

SEQ ID NO: 1271185 - RNA, 15 nt, Human
aggguaggcaggauu

SEQ ID NO: 1271186 - RNA, 16 nt, Human
aggguaggcaggauug

SEQ ID NO: 1271187 - RNA, 18 nt, Human
aggguaggcaggauuggg

SEQ ID NO: 1271188 - RNA, 16 nt, Human
aggguaggcuggaguu

SEQ ID NO: 1271189 - RNA, 17 nt, Human
aggguauauuuuccuau

SEQ ID NO: 1271190 - RNA, 21 nt, Human
aggguauauuuuccuauauua

SEQ ID NO: 1271191 - RNA, 19 nt, Human
agggggaaaaagugucaac

SEQ ID NO: 1271192 - RNA, 17 nt, Human
agggggcuggugggugc

SEQ ID NO: 1271193 - RNA, 13 nt, Human
aggggggagggaa

SEQ ID NO: 1271194 - RNA, 23 nt, Human
agggggggguauuucaauuaccu

SEQ ID NO: 1271195 - RNA, 16 nt, Human
agggggggcucccugg

SEQ ID NO: 1271196 - RNA, 15 nt, Human
agggggucguggaga

SEQ ID NO: 1271197 - RNA, 16 nt, Human
agggggucguggagag

SEQ ID NO: 1271198 - RNA, 17 nt, Human
agggggucguggagagc

SEQ ID NO: 1271199 - RNA, 18 nt, Human
agggggucguggagagcu

SEQ ID NO: 1271200 - RNA, 15 nt, Human
aggggucggcugacc

SEQ ID NO: 1271201 - RNA, 21 nt, Human
aggggucggcugaccaugcuc

SEQ ID NO: 1271202 - RNA, 12 nt, Human
aggguaaguauu

SEQ ID NO: 1271203 - RNA, 19 nt, Human
uggucacguuuggugcuuc

SEQ ID NO: 1271204 - RNA, 16 nt, Human
uggucaccuaggaagc

SEQ ID NO: 1271205 - RNA, 21 nt, Human
uggucaccuaggaagccucag

SEQ ID NO: 1271206 - RNA, 22 nt, Human
uggucaccuaggaagccucaga

SEQ ID NO: 1271207 - RNA, 23 nt, Human
uggucaccuaggaagccucagau

SEQ ID NO: 1271208 - RNA, 18 nt, Human
uggucauuuuauguuaag

SEQ ID NO: 1271209 - RNA, 21 nt, Human
ugguccaaaagauugcugaaa

SEQ ID NO: 1271210 - RNA, 23 nt, Human
ugguccaaaagauugcugaaauu

SEQ ID NO: 1271211 - RNA, 19 nt, Human
uggucacggauuugugucu

SEQ ID NO: 1271212 - RNA, 15 nt, Human
ugguccaagauuccg

SEQ ID NO: 1271213 - RNA, 15 nt, Human
ugguccaauuaguuu

SEQ ID NO: 1271214 - RNA, 18 nt, Human
ugguccaauuaguuuccu

SEQ ID NO: 1271215 - RNA, 19 nt, Human
ugguccaauuaguuuccuu

SEQ ID NO: 1271216 - RNA, 23 nt, Human
ugguccaauuaguuuccuuuuua

SEQ ID NO: 1271217 - RNA, 21 nt, Human
ugguccaauuaguuuccuuuu

SEQ ID NO: 1271218 - RNA, 12 nt, Human
ugguccaggaga

SEQ ID NO: 1271219 - RNA, 16 nt, Human
ugguccaggagaaggc

SEQ ID NO: 1271220 - RNA, 13 nt, Human
ugguccagggcua

SEQ ID NO: 1271221 - RNA, 21 nt, Human
ugguccagggcuagugacuug

SEQ ID NO: 1271222 - RNA, 20 nt, Human
ugguacagagaagccagcuu

SEQ ID NO: 1271223 - RNA, 21 nt, Human
ugguacagagaagccagcuug

SEQ ID NO: 1271224 - RNA, 22 nt, Human
ugguacaguauggggguuguaa

SEQ ID NO: 1271225 - RNA, 22 nt, Human
ugguacagagaagccagcuugu

SEQ ID NO: 1271226 - RNA, 15 nt, Human
ugguacaugguguuu

SEQ ID NO: 1271227 - RNA, 18 nt, Human
ugguacaugguguuugug

SEQ ID NO: 1271228 - RNA, 22 nt, Human
ugguaauuuaagauuccagaga

SEQ ID NO: 1271229 - RNA, 17 nt, Human
ugguaaagacuggcuuu

SEQ ID NO: 1271230 - RNA, 14 nt, Human
ugguaauuguacua

SEQ ID NO: 1271231 - RNA, 16 nt, Human
ugguaaagacuggcuu

SEQ ID NO: 1271232 - RNA, 13 nt, Human
ugguaauuguugc

SEQ ID NO: 1271233 - RNA, 11 nt, Human
ugguacagaga

SEQ ID NO: 1271234 - RNA, 12 nt, Human
ugguacagagaa

SEQ ID NO: 1271235 - RNA, 13 nt, Human
ugguacagagaag

SEQ ID NO: 1271236 - RNA, 14 nt, Human
ugguacagagaagc

SEQ ID NO: 1271237 - RNA, 15 nt, Human
ugguacagagaagcc

SEQ ID NO: 1271238 - RNA, 16 nt, Human
ugguacagagaagcca

SEQ ID NO: 1271239 - RNA, 17 nt, Human
ugguacagagaagccag

SEQ ID NO: 1271240 - RNA, 18 nt, Human
ugguacagagaagccagc

SEQ ID NO: 1271241 - RNA, 19 nt, Human
ugguacagagaagccagcu

SEQ ID NO: 1271242 - RNA, 22 nt, Human
ugggucuuguuuuuuuuuucca

SEQ ID NO: 1271243 - RNA, 22 nt, Human
uggguuuuuauuuccuaugaug

SEQ ID NO: 1271244 - RNA, 14 nt, Human
uggguuuuucccug

SEQ ID NO: 1271245 - RNA, 19 nt, Human
uggguuuuguauucucuga

SEQ ID NO: 1271246 - RNA, 21 nt, Human
uggguuuuguauucucugagc

SEQ ID NO: 1271247 - RNA, 17 nt, Human
uggguuuuuggacuucu

SEQ ID NO: 1271248 - RNA, 17 nt, Human
uggguuuuuuuccuuua

SEQ ID NO: 1271249 - RNA, 14 nt, Human
ugguaaaaagaaaa

SEQ ID NO: 1271250 - RNA, 14 nt, Human
ugguaaaacacuug

SEQ ID NO: 1271251 - RNA, 20 nt, Human
agggugaguuggcuuaccug

SEQ ID NO: 1271252 - RNA, 20 nt, Human
agggugcaguaucaugcccu

SEQ ID NO: 1271253 - RNA, 14 nt, Human
agggugcugacugg

SEQ ID NO: 1271254 - RNA, 19 nt, Human
agggugaguuggcuuaccu

SEQ ID NO: 1271255 - RNA, 22 nt, Human
agggugaguuggcuuaccuggc

SEQ ID NO: 1271256 - RNA, 22 nt, Human
ugguccaugggccauaugaaaa

SEQ ID NO: 1271257 - RNA, 13 nt, Human
uggucccacaucc

SEQ ID NO: 1271258 - RNA, 15 nt, Human
uggucccacaucccu

SEQ ID NO: 1271259 - RNA, 16 nt, Human
uggucccacaucccug

SEQ ID NO: 1271260 - RNA, 17 nt, Human
uggucccacaucccugg

SEQ ID NO: 1271261 - RNA, 19 nt, Human
uggucccacaucccugggc

SEQ ID NO: 1271262 - RNA, 20 nt, Human
uggucccacaucccugggcc

SEQ ID NO: 1271263 - RNA, 21 nt, Human
uggucccacaucccugggccu

SEQ ID NO: 1271264 - RNA, 19 nt, Human
uggucucgaacuccugacc

SEQ ID NO: 1271265 - RNA, 20 nt, Human
uggucucgaacuccugaccu

SEQ ID NO: 1271266 - RNA, 21 nt, Human
uggucucgaacuccugaccuu

SEQ ID NO: 1271267 - RNA, 22 nt, Human
uggucccacaucccugggccug

SEQ ID NO: 1271268 - RNA, 23 nt, Human
uggucccacaucccugggccugc

SEQ ID NO: 1271269 - RNA, 16 nt, Human
uggucugguugggcag

SEQ ID NO: 1271270 - RNA, 17 nt, Human
uggucugguugggcagc

SEQ ID NO: 1271271 - RNA, 14 nt, Human
uggucuguuggcag

SEQ ID NO: 1271272 - RNA, 18 nt, Human
uggucuguuggcaggcug

SEQ ID NO: 1271273 - RNA, 22 nt, Human
uggucugugagaugcuagaacu

SEQ ID NO: 1271274 - RNA, 11 nt, Human
uggucugcugu

SEQ ID NO: 1271275 - RNA, 18 nt, Human
uggucugcccucugcauc

SEQ ID NO: 1271276 - RNA, 21 nt, Human
uggucucucuaugccucucua

SEQ ID NO: 1271277 - RNA, 13 nt, Human
uggucucuugcuu

SEQ ID NO: 1271278 - RNA, 23 nt, Human
uggugaaaagcagguugauaaau

SEQ ID NO: 1271279 - RNA, 22 nt, Human
uggugaaaagcagguugauaaa

SEQ ID NO: 1271280 - RNA, 14 nt, Human
uggucuuuugguua

SEQ ID NO: 1271281 - RNA, 20 nt, Human
uggucuuacagcaggcagua

SEQ ID NO: 1271282 - RNA, 15 nt, Human
uggucuuacagcagg

SEQ ID NO: 1271283 - RNA, 16 nt, Human
uggucuuuuauaauuc

SEQ ID NO: 1271284 - RNA, 16 nt, Human
aggguugaccccagag

SEQ ID NO: 1271285 - RNA, 17 nt, Human
aggguugaccccagagg

SEQ ID NO: 1271286 - RNA, 18 nt, Human
aggguugaccccagagga

SEQ ID NO: 1271287 - RNA, 15 nt, Human
aggucagugcaaaua

SEQ ID NO: 1271288 - RNA, 17 nt, Human
agguccacaacacacag

SEQ ID NO: 1271289 - RNA, 17 nt, Human
agguccaaugagcuuuc

SEQ ID NO: 1271290 - RNA, 19 nt, Human
agguccaaugagcuuucug

SEQ ID NO: 1271291 - RNA, 20 nt, Human
agguccaaugagcuuucuga

SEQ ID NO: 1271292 - RNA, 15 nt, Human
agguccaaugagcuu

SEQ ID NO: 1271293 - RNA, 16 nt, Human
agguccaaugagcuuu

SEQ ID NO: 1271294 - RNA, 19 nt, Human
agguccacaacacacagau

SEQ ID NO: 1271295 - RNA, 16 nt, Human
aggugaaacauuuucu

SEQ ID NO: 1271296 - RNA, 19 nt, Human
aggugaaacuccagaugcc

SEQ ID NO: 1271297 - RNA, 20 nt, Human
aggugaaacuccagaugcca

SEQ ID NO: 1271298 - RNA, 21 nt, Human
aggugaaacuccagaugccac

SEQ ID NO: 1271299 - RNA, 22 nt, Human
aggugaaacuccagaugccaca

SEQ ID NO: 1271300 - RNA, 15 nt, Human
aggugaaaggaaauu

SEQ ID NO: 1271301 - RNA, 19 nt, Human
aggugaaaguuaauccacu

SEQ ID NO: 1271302 - RNA, 20 nt, Human
aggguuuauguuuaggaugu

SEQ ID NO: 1271303 - RNA, 15 nt, Human
aggguuucaccaugu

SEQ ID NO: 1271304 - RNA, 15 nt, Human
aggguuucauugucu

SEQ ID NO: 1271305 - RNA, 22 nt, Human
aggguuucccuacugaagcccu

SEQ ID NO: 1271306 - RNA, 21 nt, Human
aggguuucccuacugaagccc

SEQ ID NO: 1271307 - RNA, 18 nt, Human
aggguuugugacagggcg

SEQ ID NO: 1271308 - RNA, 15 nt, Human
aggguuugugacagg

SEQ ID NO: 1271309 - RNA, 19 nt, Human
agguauuuuucuuuaacca

SEQ ID NO: 1271310 - RNA, 20 nt, Human
aggucaaaauagugccacua

SEQ ID NO: 1271311 - RNA, 14 nt, Human
agguaggccaaggu

SEQ ID NO: 1271312 - RNA, 19 nt, Human
agguagcugaaaggggaag

SEQ ID NO: 1271313 - RNA, 22 nt, Human
agguauaucuagguuuaugaca

SEQ ID NO: 1271314 - RNA, 19 nt, Human
agguauaucuagguuuaug

SEQ ID NO: 1271315 - RNA, 23 nt, Human
agguaggccaagguguccuacag

SEQ ID NO: 1271316 - RNA, 17 nt, Human
agguaggggccccucuc

SEQ ID NO: 1271317 - RNA, 22 nt, Human
agguaggggccccucucagccc

SEQ ID NO: 1271318 - RNA, 14 nt, Human
agguauauacuuug

SEQ ID NO: 1271319 - RNA, 18 nt, Human
ugguuuuaguugcaacuu

SEQ ID NO: 1271320 - RNA, 13 nt, Human
ugguuuuagauuu

SEQ ID NO: 1271321 - RNA, 14 nt, Human
ugguuuuagauuuu

SEQ ID NO: 1271322 - RNA, 19 nt, Human
ugguuuucuccaagagcua

SEQ ID NO: 1271323 - RNA, 20 nt, Human
ugguuuucuccaagagcuac

SEQ ID NO: 1271324 - RNA, 22 nt, Human
ugguuucuugugcacuggcacc

SEQ ID NO: 1271325 - RNA, 23 nt, Human
ugguuugaagaauguuaagacuu

SEQ ID NO: 1271326 - RNA, 21 nt, Human
ugguuuaaagaaaguguauuu

SEQ ID NO: 1271327 - RNA, 17 nt, Human
ugguuuauauauuuaaa

SEQ ID NO: 1271328 - RNA, 13 nt, Human
ugguuucagcacu

SEQ ID NO: 1271329 - RNA, 20 nt, Human
ugguuucagcacuagccaaa

SEQ ID NO: 1271330 - RNA, 23 nt, Human
ugguuucagcacuagccaaaccu

SEQ ID NO: 1271331 - RNA, 12 nt, Human
ugguuucauguu

SEQ ID NO: 1271332 - RNA, 15 nt, Human
ugguuucauguuagu

SEQ ID NO: 1271333 - RNA, 15 nt, Human
ugguuucgaacuccu

SEQ ID NO: 1271334 - RNA, 16 nt, Human
uguaaaggaauuuaaa

SEQ ID NO: 1271335 - RNA, 13 nt, Human
uguaaagccaugc

SEQ ID NO: 1271336 - RNA, 12 nt, Human
uguaaagcuaaa

SEQ ID NO: 1271337 - RNA, 16 nt, Human
uguaaagcuaaaauaa

SEQ ID NO: 1271338 - RNA, 17 nt, Human
uguaaagcuaaaauaaa

SEQ ID NO: 1271339 - RNA, 20 nt, Human
uguaaagcuaaaauaaagaa

SEQ ID NO: 1271340 - RNA, 21 nt, Human
uguaaagcuaaaauaaagaaa

SEQ ID NO: 1271341 - RNA, 18 nt, Human
uguaaagauauuuuuauc

SEQ ID NO: 1271342 - RNA, 11 nt, Human
uguaaagaugu

SEQ ID NO: 1271343 - RNA, 13 nt, Human
uguaaagcuuguc

SEQ ID NO: 1271344 - RNA, 21 nt, Human
uguaaauacuguuuuuaacaa

SEQ ID NO: 1271345 - RNA, 14 nt, Human
uguaaauauaaaga

SEQ ID NO: 1271346 - RNA, 15 nt, Human
uguaaauacccauau

SEQ ID NO: 1271347 - RNA, 16 nt, Human
uguaaauauaaagacg

SEQ ID NO: 1271348 - RNA, 17 nt, Human
uguaaauauaaagacgu

SEQ ID NO: 1271349 - RNA, 18 nt, Human
uguaaauauuuuaaagaa

SEQ ID NO: 1271350 - RNA, 20 nt, Human
uguaaauauuuuaaagaauu

SEQ ID NO: 1271351 - RNA, 22 nt, Human
uguaaauauuuuaaagaauugu

SEQ ID NO: 1271352 - RNA, 14 nt, Human
uguaaauauugugu

SEQ ID NO: 1271353 - RNA, 15 nt, Human
uguaaauauugugug

SEQ ID NO: 1271354 - RNA, 14 nt, Human
uguaaauauuuuaa

SEQ ID NO: 1271355 - RNA, 17 nt, Human
uguaaauauuuuaaaga

SEQ ID NO: 1271356 - RNA, 17 nt, Human
ugguuguuucuguucca

SEQ ID NO: 1271357 - RNA, 16 nt, Human
ugguucagcuaagcua

SEQ ID NO: 1271358 - RNA, 21 nt, Human
ugguucagaauuaaacuuuua

SEQ ID NO: 1271359 - RNA, 23 nt, Human
ugguuuaaaagacacacuugucc

SEQ ID NO: 1271360 - RNA, 15 nt, Human
ugguuuaaagaaagu

SEQ ID NO: 1271361 - RNA, 16 nt, Human
ugguuuaaagaaagug

SEQ ID NO: 1271362 - RNA, 17 nt, Human
ugguuuaaagaaagugu

SEQ ID NO: 1271363 - RNA, 19 nt, Human
ugguuuaaagaaaguguau

SEQ ID NO: 1271364 - RNA, 15 nt, Human
ugguucacacugacc

SEQ ID NO: 1271365 - RNA, 20 nt, Human
ugguucagaauuaaacuuuu

SEQ ID NO: 1271366 - RNA, 22 nt, Human
ugguguucuccugcugcucccu

SEQ ID NO: 1271367 - RNA, 20 nt, Human
ugguguugccaguuguccuc

SEQ ID NO: 1271368 - RNA, 22 nt, Human
ugguguugccaguuguccuccu

SEQ ID NO: 1271369 - RNA, 20 nt, Human
ugguguuggacaagcuucug

SEQ ID NO: 1271370 - RNA, 22 nt, Human
ugguguuuuuuucuaugggugu

SEQ ID NO: 1271371 - RNA, 19 nt, Human
ugguuaaauaaggcagggu

SEQ ID NO: 1271372 - RNA, 13 nt, Human
ugguuaagagucc

SEQ ID NO: 1271373 - RNA, 14 nt, Human
ugguuaagagucca

SEQ ID NO: 1271374 - RNA, 16 nt, Human
ugguuaagaguccaag

SEQ ID NO: 1271375 - RNA, 17 nt, Human
ugguuaagaguccaaga

SEQ ID NO: 1271376 - RNA, 17 nt, Human
aggugaaacauuuucuc

SEQ ID NO: 1271377 - RNA, 14 nt, Human
aggugaacauuggu

SEQ ID NO: 1271378 - RNA, 21 nt, Human
aggugaacauugguucuuuca

SEQ ID NO: 1271379 - RNA, 18 nt, Human
uggugugaucgucugacu

SEQ ID NO: 1271380 - RNA, 16 nt, Human
uggugugaucgucuga

SEQ ID NO: 1271381 - RNA, 14 nt, Human
uggugugguacaga

SEQ ID NO: 1271382 - RNA, 14 nt, Human
ugguguucuccugc

SEQ ID NO: 1271383 - RNA, 17 nt, Human
ugguguucuccugcugc

SEQ ID NO: 1271384 - RNA, 23 nt, Human
ugguguucuccugcugcucccuc

SEQ ID NO: 1271385 - RNA, 11 nt, Human
ugguguuaaca

SEQ ID NO: 1271386 - RNA, 14 nt, Human
ugguguuaacagaa

SEQ ID NO: 1271387 - RNA, 20 nt, Human
ugguguuaacagaagggagg

SEQ ID NO: 1271388 - RNA, 15 nt, Human
ugguguguguaugcg

SEQ ID NO: 1271389 - RNA, 19 nt, Human
uggugugucccccucuguc

SEQ ID NO: 1271390 - RNA, 15 nt, Human
uggugugguacagag

SEQ ID NO: 1271391 - RNA, 16 nt, Human
uggugugguacagaga

SEQ ID NO: 1271392 - RNA, 17 nt, Human
uggugugguacagagaa

SEQ ID NO: 1271393 - RNA, 18 nt, Human
uggugugguacagagaag

SEQ ID NO: 1271394 - RNA, 19 nt, Human
uggugugguacagagaagc

SEQ ID NO: 1271395 - RNA, 20 nt, Human
uggugugguacagagaagcc

SEQ ID NO: 1271396 - RNA, 21 nt, Human
uggugugguacagagaagcca

SEQ ID NO: 1271397 - RNA, 23 nt, Human
uggugugguacagagaagccagc

SEQ ID NO: 1271398 - RNA, 19 nt, Human
uguacuugcucuugaugcc

SEQ ID NO: 1271399 - RNA, 19 nt, Human
uguagaacacuaauucaua

SEQ ID NO: 1271400 - RNA, 20 nt, Human
uguagaacacuaauucauaa

SEQ ID NO: 1271401 - RNA, 17 nt, Human
uguagaaccuaauucaa

SEQ ID NO: 1271402 - RNA, 15 nt, Human
uguacuugcucuuga

SEQ ID NO: 1271403 - RNA, 21 nt, Human
uguagaagucacauuccugaa

SEQ ID NO: 1271404 - RNA, 16 nt, Human
uguagaaugauuucau

SEQ ID NO: 1271405 - RNA, 17 nt, Human
uguagagaaaacaugca

SEQ ID NO: 1271406 - RNA, 17 nt, Human
uguagaaugauuucaug

SEQ ID NO: 1271407 - RNA, 18 nt, Human
uguagaaugauuucaugc

SEQ ID NO: 1271408 - RNA, 18 nt, Human
uguacaucuauuuuggau

SEQ ID NO: 1271409 - RNA, 14 nt, Human
uguacauuaauuac

SEQ ID NO: 1271410 - RNA, 16 nt, Human
uguacauuugggaguu

SEQ ID NO: 1271411 - RNA, 15 nt, Human
uguacauaugugcug

SEQ ID NO: 1271412 - RNA, 17 nt, Human
uguacauaugugcugga

SEQ ID NO: 1271413 - RNA, 20 nt, Human
uguacauaugugcuggaauu

SEQ ID NO: 1271414 - RNA, 14 nt, Human
uguacaucuauuuu

SEQ ID NO: 1271415 - RNA, 15 nt, Human
uguaaggcaaucaug

SEQ ID NO: 1271416 - RNA, 19 nt, Human
uguaaggauccggaaagaa

SEQ ID NO: 1271417 - RNA, 21 nt, Human
uguaaggauccggaaagaaga

SEQ ID NO: 1271418 - RNA, 23 nt, Human
uguaauuuuacacgcuuuuguga

SEQ ID NO: 1271419 - RNA, 17 nt, Human
uguaaggaugggcaugg

SEQ ID NO: 1271420 - RNA, 18 nt, Human
uguaagaaaauaucacuu

SEQ ID NO: 1271421 - RNA, 19 nt, Human
agguuuaaaugaacaagag

SEQ ID NO: 1271422 - RNA, 12 nt, Human
uguaagaaaccu

SEQ ID NO: 1271423 - RNA, 15 nt, Human
uguaagaaauacaga

SEQ ID NO: 1271424 - RNA, 17 nt, Human
uguaagaaauacagacu

SEQ ID NO: 1271425 - RNA, 21 nt, Human
uguaagaacaacuaccugagc

SEQ ID NO: 1271426 - RNA, 14 nt, Human
uguaagcugaaaau

SEQ ID NO: 1271427 - RNA, 16 nt, Human
uguaagcugaaaauau

SEQ ID NO: 1271428 - RNA, 16 nt, Human
agguugucugaaguca

SEQ ID NO: 1271429 - RNA, 20 nt, Human
agguugucugaagucacugc

SEQ ID NO: 1271430 - RNA, 12 nt, Human
agguugucugug

SEQ ID NO: 1271431 - RNA, 22 nt, Human
agguuguggccuuugcgcuccu

SEQ ID NO: 1271432 - RNA, 13 nt, Human
agguuuaaagagu

SEQ ID NO: 1271433 - RNA, 14 nt, Human
agguuuaaagaguc

SEQ ID NO: 1271434 - RNA, 15 nt, Human
agguuuaaagagucu

SEQ ID NO: 1271435 - RNA, 16 nt, Human
agguuuaaagagucua

SEQ ID NO: 1271436 - RNA, 20 nt, Human
agguuuaaagagucuagauu

SEQ ID NO: 1271437 - RNA, 13 nt, Human
agguuuaaaugaa

SEQ ID NO: 1271438 - RNA, 14 nt, Human
agguuuaaaugaac

SEQ ID NO: 1271439 - RNA, 15 nt, Human
agguuuaaaugaaca

SEQ ID NO: 1271440 - RNA, 22 nt, Human
agguuuaaaugaacaagagaag

SEQ ID NO: 1271441 - RNA, 21 nt, Human
aggugugaaggugauuuaagg

SEQ ID NO: 1271442 - RNA, 14 nt, Human
aggugugagacugg

SEQ ID NO: 1271443 - RNA, 15 nt, Human
aggugugagacuggg

SEQ ID NO: 1271444 - RNA, 18 nt, Human
agguguuaacauuccaag

SEQ ID NO: 1271445 - RNA, 23 nt, Human
agguguuaacauuccaagacucu

SEQ ID NO: 1271446 - RNA, 15 nt, Human
agguguuacuguaau

SEQ ID NO: 1271447 - RNA, 16 nt, Human
agguguuacuguaauu

SEQ ID NO: 1271448 - RNA, 23 nt, Human
agguguuauuuggaaccuuguuu

SEQ ID NO: 1271449 - RNA, 12 nt, Human
agguguuauuug

SEQ ID NO: 1271450 - RNA, 12 nt, Human
agguguugccaa

SEQ ID NO: 1271451 - RNA, 21 nt, Human
agguguugccaaauauguccu

SEQ ID NO: 1271452 - RNA, 22 nt, Human
agguguugccaaauauguccug

SEQ ID NO: 1271453 - RNA, 23 nt, Human
agguguugccaaauauguccugg

SEQ ID NO: 1271454 - RNA, 17 nt, Human
agguguuggcugcacgu

SEQ ID NO: 1271455 - RNA, 19 nt, Human
agguggggagacugggcug

SEQ ID NO: 1271456 - RNA, 21 nt, Human
agguggggagacugggcugag

SEQ ID NO: 1271457 - RNA, 22 nt, Human
aggugauccacucgccuucauc

SEQ ID NO: 1271458 - RNA, 15 nt, Human
aggugauccauguaa

SEQ ID NO: 1271459 - RNA, 18 nt, Human
aggugauccauguaacug

SEQ ID NO: 1271460 - RNA, 21 nt, Human
aggugauccauguaacugccu

SEQ ID NO: 1271461 - RNA, 19 nt, Human
aggugauccauguaacugc

SEQ ID NO: 1271462 - RNA, 22 nt, Human
aggugcaacaagguccucuguc

SEQ ID NO: 1271463 - RNA, 18 nt, Human
agguggguugaaagccaa

SEQ ID NO: 1271464 - RNA, 20 nt, Human
aggugugagccaccacgccc

SEQ ID NO: 1271465 - RNA, 21 nt, Human
agugagcagucaggaaagaga

SEQ ID NO: 1271466 - RNA, 17 nt, Human
agugagcaguguuagcu

SEQ ID NO: 1271467 - RNA, 22 nt, Human
agugagagacauuaacucauua

SEQ ID NO: 1271468 - RNA, 13 nt, Human
agugagagacauu

SEQ ID NO: 1271469 - RNA, 21 nt, Human
agugagagacauuaacucauu

SEQ ID NO: 1271470 - RNA, 21 nt, Human
agugagagaguggcuggggca

SEQ ID NO: 1271471 - RNA, 16 nt, Human
agugagccgagauugu

SEQ ID NO: 1271472 - RNA, 22 nt, Human
agugagcauggaacacuucgag

SEQ ID NO: 1271473 - RNA, 21 nt, Human
agugagcauggaacacuucga

SEQ ID NO: 1271474 - RNA, 15 nt, Human
ugugauggagugcug

SEQ ID NO: 1271475 - RNA, 17 nt, Human
ugugauggagugcuguu

SEQ ID NO: 1271476 - RNA, 18 nt, Human
ugugaugucauacagaga

SEQ ID NO: 1271477 - RNA, 19 nt, Human
ugugaugucauacagagaa

SEQ ID NO: 1271478 - RNA, 20 nt, Human
ugugaugucauacagagaag

SEQ ID NO: 1271479 - RNA, 22 nt, Human
ugugaugucauacagagaaguc

SEQ ID NO: 1271480 - RNA, 23 nt, Human
ugugaugucauacagagaaguca

SEQ ID NO: 1271481 - RNA, 15 nt, Human
ugugaugugaagcca

SEQ ID NO: 1271482 - RNA, 13 nt, Human
ugugauguucuaa

SEQ ID NO: 1271483 - RNA, 14 nt, Human
ugugauguucuaag

SEQ ID NO: 1271484 - RNA, 15 nt, Human
ugugauguucuaagg

SEQ ID NO: 1271485 - RNA, 16 nt, Human
ugugauguucuaaggc

SEQ ID NO: 1271486 - RNA, 17 nt, Human
ugugauguucuaaggcu

SEQ ID NO: 1271487 - RNA, 18 nt, Human
ugugauguucuaaggcuc

SEQ ID NO: 1271488 - RNA, 22 nt, Human
ugugauuagacagaacaccuau

SEQ ID NO: 1271489 - RNA, 16 nt, Human
ugugauuagacagaac

SEQ ID NO: 1271490 - RNA, 14 nt, Human
ugugauucaaucug

SEQ ID NO: 1271491 - RNA, 15 nt, Human
ugugauucaaucugu

SEQ ID NO: 1271492 - RNA, 20 nt, Human
agugaaacucguuaauuugu

SEQ ID NO: 1271493 - RNA, 14 nt, Human
agugaaaauauagc

SEQ ID NO: 1271494 - RNA, 17 nt, Human
agucuuuuguucgcaug

SEQ ID NO: 1271495 - RNA, 22 nt, Human
agucuuuugcuuuugcccauuu

SEQ ID NO: 1271496 - RNA, 15 nt, Human
agugaaaacuuugua

SEQ ID NO: 1271497 - RNA, 16 nt, Human
agugaaaacuuuguag

SEQ ID NO: 1271498 - RNA, 14 nt, Human
agugagacagcucu

SEQ ID NO: 1271499 - RNA, 13 nt, Human
agugagacagacu

SEQ ID NO: 1271500 - RNA, 21 nt, Human
agugagacccagcccucaucc

SEQ ID NO: 1271501 - RNA, 20 nt, Human
agugagaccuuccuuuuacu

SEQ ID NO: 1271502 - RNA, 18 nt, Human
agucuuacucuguugcca

SEQ ID NO: 1271503 - RNA, 16 nt, Human
agucuuacgaauacuu

SEQ ID NO: 1271504 - RNA, 14 nt, Human
agucuuaacugguc

SEQ ID NO: 1271505 - RNA, 22 nt, Human
agucuuaauauauauauccaga

SEQ ID NO: 1271506 - RNA, 15 nt, Human
agucuuccauuugca

SEQ ID NO: 1271507 - RNA, 16 nt, Human
agucuuccauuugcaa

SEQ ID NO: 1271508 - RNA, 17 nt, Human
agucuuccauuugcaag

SEQ ID NO: 1271509 - RNA, 19 nt, Human
agucuuccauuugcaaggg

SEQ ID NO: 1271510 - RNA, 12 nt, Human
agucuuccugac

SEQ ID NO: 1271511 - RNA, 15 nt, Human
agucuuccugacacu

SEQ ID NO: 1271512 - RNA, 16 nt, Human
agucuuccugacacuu

SEQ ID NO: 1271513 - RNA, 17 nt, Human
agucuuccugacacuuu

SEQ ID NO: 1271514 - RNA, 18 nt, Human
agucuuccugacacuuua

SEQ ID NO: 1271515 - RNA, 19 nt, Human
agucuuccugacacuuuaa

SEQ ID NO: 1271516 - RNA, 12 nt, Human
agucuuuugcuu

SEQ ID NO: 1271517 - RNA, 13 nt, Human
agucuuuugcuuu

SEQ ID NO: 1271518 - RNA, 14 nt, Human
agucuuuugcuuuu

SEQ ID NO: 1271519 - RNA, 18 nt, Human
agucuuuugcuuuuggca

SEQ ID NO: 1271520 - RNA, 19 nt, Human
agucuuuugcuuuuggcaa

SEQ ID NO: 1271521 - RNA, 20 nt, Human
agucuuuugcuuuuggcaaa

SEQ ID NO: 1271522 - RNA, 22 nt, Human
agucuuuuguucgcauggucac

SEQ ID NO: 1271523 - RNA, 19 nt, Human
agucuccaaagucucugga

SEQ ID NO: 1271524 - RNA, 14 nt, Human
ugugagcccagcug

SEQ ID NO: 1271525 - RNA, 15 nt, Human
ugugagcccagcugg

SEQ ID NO: 1271526 - RNA, 18 nt, Human
ugugagcccagcuggguc

SEQ ID NO: 1271527 - RNA, 23 nt, Human
agucucugaggggcuaccaggaa

SEQ ID NO: 1271528 - RNA, 22 nt, Human
agucucugaggggcuaccagga

SEQ ID NO: 1271529 - RNA, 16 nt, Human
agucucugaggggcua

SEQ ID NO: 1271530 - RNA, 11 nt, Human
agucucugagc

SEQ ID NO: 1271531 - RNA, 13 nt, Human
agucucugagcag

SEQ ID NO: 1271532 - RNA, 16 nt, Human
agucucugagcaguga

SEQ ID NO: 1271533 - RNA, 14 nt, Human
agucucccucccuu

SEQ ID NO: 1271534 - RNA, 18 nt, Human
agucucccucccuugggg

SEQ ID NO: 1271535 - RNA, 23 nt, Human
agucucucuucucuccagcugac

SEQ ID NO: 1271536 - RNA, 14 nt, Human
ugugaagcaaaauu

SEQ ID NO: 1271537 - RNA, 20 nt, Human
ugugaagcaaacucuaaaau

SEQ ID NO: 1271538 - RNA, 14 nt, Human
ugugaacugaacuc

SEQ ID NO: 1271539 - RNA, 23 nt, Human
ugugaacugaacucugacaacag

SEQ ID NO: 1271540 - RNA, 23 nt, Human
ugugaagccaugaguuccagaaa

SEQ ID NO: 1271541 - RNA, 10 nt, Human
ugugaagcca

SEQ ID NO: 1271542 - RNA, 20 nt, Human
ugugaagccaauucagacag

SEQ ID NO: 1271543 - RNA, 21 nt, Human
ugugaagccaauucagacagg

SEQ ID NO: 1271544 - RNA, 22 nt, Human
ugucucuggauuauauuaugaa

SEQ ID NO: 1271545 - RNA, 18 nt, Human
ugucucucagggccaggc

SEQ ID NO: 1271546 - RNA, 13 nt, Human
ugucucuccugcc

SEQ ID NO: 1271547 - RNA, 16 nt, Human
ugucucuccugccccu

SEQ ID NO: 1271548 - RNA, 13 nt, Human
ugucucugaugca

SEQ ID NO: 1271549 - RNA, 14 nt, Human
ugucucugaugcag

SEQ ID NO: 1271550 - RNA, 19 nt, Human
ugucucugaugcagcuuau

SEQ ID NO: 1271551 - RNA, 20 nt, Human
ugucucugaugcagcuuaua

SEQ ID NO: 1271552 - RNA, 12 nt, Human
ugucucucauga

SEQ ID NO: 1271553 - RNA, 17 nt, Human
ugucucuccugccccuu

SEQ ID NO: 1271554 - RNA, 17 nt, Human
ugucucuacuaaaaaua

SEQ ID NO: 1271555 - RNA, 20 nt, Human
ugucucgagcgcccugcaga

SEQ ID NO: 1271556 - RNA, 15 nt, Human
ugucucgagcgcccu

SEQ ID NO: 1271557 - RNA, 17 nt, Human
ugucucgagcgcccugc

SEQ ID NO: 1271558 - RNA, 18 nt, Human
ugucucgagcgcccugca

SEQ ID NO: 1271559 - RNA, 19 nt, Human
ugucucgagcgcccugcag

SEQ ID NO: 1271560 - RNA, 13 nt, Human
agucccugccugg

SEQ ID NO: 1271561 - RNA, 15 nt, Human
ugucucgaacuauuu

SEQ ID NO: 1271562 - RNA, 18 nt, Human
ugucucugcaaacugccu

SEQ ID NO: 1271563 - RNA, 15 nt, Human
ugucucuuauggaug

SEQ ID NO: 1271564 - RNA, 20 nt, Human
ugucucuuauggaugucccc

SEQ ID NO: 1271565 - RNA, 22 nt, Human
ugucucuuauggauguccccag

SEQ ID NO: 1271566 - RNA, 13 nt, Human
ugucucuucugag

SEQ ID NO: 1271567 - RNA, 16 nt, Human
ugucucuucugagcua

SEQ ID NO: 1271568 - RNA, 17 nt, Human
ugucucuucuuuagaac

SEQ ID NO: 1271569 - RNA, 14 nt, Human
ugucucuugaguuu

SEQ ID NO: 1271570 - RNA, 17 nt, Human
ugucucuugaguuuguc

SEQ ID NO: 1271571 - RNA, 23 nt, Human
ugucucuuuggcgaccuccuuuc

SEQ ID NO: 1271572 - RNA, 14 nt, Human
ugucuuaauuauua

SEQ ID NO: 1271573 - RNA, 15 nt, Human
ugucuuaauuauuau

SEQ ID NO: 1271574 - RNA, 18 nt, Human
ugucuuaauuuucuuuca

SEQ ID NO: 1271575 - RNA, 19 nt, Human
ugucuugagcucuauuaug

SEQ ID NO: 1271576 - RNA, 13 nt, Human
ugucuuggaacau

SEQ ID NO: 1271577 - RNA, 22 nt, Human
ugugaacaguuguguuugaagc

SEQ ID NO: 1271578 - RNA, 14 nt, Human
ugucuuuaaugcaa

SEQ ID NO: 1271579 - RNA, 15 nt, Human
ugucuuuaauucugu

SEQ ID NO: 1271580 - RNA, 15 nt, Human
ugucuuuaaugcaau

SEQ ID NO: 1271581 - RNA, 15 nt, Human
ugucuuuagauagcc

SEQ ID NO: 1271582 - RNA, 18 nt, Human
ugucuuuagauagcccug

SEQ ID NO: 1271583 - RNA, 17 nt, Human
ugucuuuagauagcccu

SEQ ID NO: 1271584 - RNA, 13 nt, Human
ugugaacccagga

SEQ ID NO: 1271585 - RNA, 14 nt, Human
ugugaacccaggac

SEQ ID NO: 1271586 - RNA, 21 nt, Human
ugugaaccccacgaaggagcc

SEQ ID NO: 1271587 - RNA, 15 nt, Human
ugugaacccaggaca

SEQ ID NO: 1271588 - RNA, 16 nt, Human
ugugaacccaggacaa

SEQ ID NO: 1271589 - RNA, 21 nt, Human
ugugaacccaggacaagcaug

SEQ ID NO: 1271590 - RNA, 14 nt, Human
ugucuugagcucua

SEQ ID NO: 1271591 - RNA, 16 nt, Human
ugucuugagcucuauu

SEQ ID NO: 1271592 - RNA, 22 nt, Human
ugucuugaugcaugcacuguuc

SEQ ID NO: 1271593 - RNA, 12 nt, Human
ugucuucucccu

SEQ ID NO: 1271594 - RNA, 13 nt, Human
ugucuucucccug

SEQ ID NO: 1271595 - RNA, 23 nt, Human
agguuuggacaaaauggaauacu

SEQ ID NO: 1271596 - RNA, 18 nt, Human
agguuugcagucccaagc

SEQ ID NO: 1271597 - RNA, 14 nt, Human
agguuuggaaggag

SEQ ID NO: 1271598 - RNA, 22 nt, Human
agguuuggaaggagcagaaaac

SEQ ID NO: 1271599 - RNA, 19 nt, Human
uguagagaaaacaugcaga

SEQ ID NO: 1271600 - RNA, 20 nt, Human
uguauuaagaaaggaagcau

SEQ ID NO: 1271601 - RNA, 22 nt, Human
aguagcguuuuuuaaauguaua

SEQ ID NO: 1271602 - RNA, 21 nt, Human
aguagcguuuuuuaaauguau

SEQ ID NO: 1271603 - RNA, 11 nt, Human
aguagcugagc

SEQ ID NO: 1271604 - RNA, 15 nt, Human
ugucaacucuuuguu

SEQ ID NO: 1271605 - RNA, 19 nt, Human
ugucaaauauuuagaugua

SEQ ID NO: 1271606 - RNA, 11 nt, Human
uguauuaugug

SEQ ID NO: 1271607 - RNA, 15 nt, Human
uguauuagucacaga

SEQ ID NO: 1271608 - RNA, 16 nt, Human
uguauuaagaaaggaa

SEQ ID NO: 1271609 - RNA, 14 nt, Human
uguauuaagccacu

SEQ ID NO: 1271610 - RNA, 21 nt, Human
aguauuuaauucauguugccu

SEQ ID NO: 1271611 - RNA, 22 nt, Human
agucacagagauaauucuagcu

SEQ ID NO: 1271612 - RNA, 17 nt, Human
aguauuuaacuucugag

SEQ ID NO: 1271613 - RNA, 15 nt, Human
aguauuguccagguc

SEQ ID NO: 1271614 - RNA, 16 nt, Human
aguauuguccaggucu

SEQ ID NO: 1271615 - RNA, 22 nt, Human
aguauugcucacccagugcccu

SEQ ID NO: 1271616 - RNA, 12 nt, Human
aguauuguuguc

SEQ ID NO: 1271617 - RNA, 13 nt, Human
aguauuguugucc

SEQ ID NO: 1271618 - RNA, 15 nt, Human
aguauuguuguccuu

SEQ ID NO: 1271619 - RNA, 16 nt, Human
aguauuguuguccuuu

SEQ ID NO: 1271620 - RNA, 19 nt, Human
aguauuguuguccuuuuca

SEQ ID NO: 1271621 - RNA, 20 nt, Human
aguauuguuguccuuuucau

SEQ ID NO: 1271622 - RNA, 24 nt, Human
aguauuguuguccuuuucauaggu

SEQ ID NO: 1271623 - RNA, 21 nt, Human
aguauuguuguccuuuucaua

SEQ ID NO: 1271624 - RNA, 22 nt, Human
aguauuguuguccuuuucauag

SEQ ID NO: 1271625 - RNA, 12 nt, Human
aguauuuaacua

SEQ ID NO: 1271626 - RNA, 17 nt, Human
aguauuuaacuaauuau

SEQ ID NO: 1271627 - RNA, 18 nt, Human
agucacauuccugaacag

SEQ ID NO: 1271628 - RNA, 14 nt, Human
agucacagggcagu

SEQ ID NO: 1271629 - RNA, 20 nt, Human
agucacucgauaauaaagua

SEQ ID NO: 1271630 - RNA, 17 nt, Human
agucacucuagucaaug

SEQ ID NO: 1271631 - RNA, 20 nt, Human
agucacucuagucaaugaca

SEQ ID NO: 1271632 - RNA, 22 nt, Human
agucacucuagucaaugacaug

SEQ ID NO: 1271633 - RNA, 20 nt, Human
agucacauuccaagccucau

SEQ ID NO: 1271634 - RNA, 15 nt, Human
aguauuuagaagcca

SEQ ID NO: 1271635 - RNA, 13 nt, Human
agucacagccacc

SEQ ID NO: 1271636 - RNA, 13 nt, Human
agucacagggcag

SEQ ID NO: 1271637 - RNA, 17 nt, Human
agucacagggcaguacc

SEQ ID NO: 1271638 - RNA, 18 nt, Human
aguauguuagugcaaauu

SEQ ID NO: 1271639 - RNA, 21 nt, Human
aguauguuagugcaaauuguc

SEQ ID NO: 1271640 - RNA, 13 nt, Human
aguagcugagcuc

SEQ ID NO: 1271641 - RNA, 14 nt, Human
aguagcugagcuca

SEQ ID NO: 1271642 - RNA, 22 nt, Human
aguagcugagcucacaaggcag

SEQ ID NO: 1271643 - RNA, 14 nt, Human
aguauguucaaagu

SEQ ID NO: 1271644 - RNA, 23 nt, Human
aguagcugagcucacaaggcagc

SEQ ID NO: 1271645 - RNA, 18 nt, Human
aguauuggggucugaccc

SEQ ID NO: 1271646 - RNA, 12 nt, Human
aguauugcaaag

SEQ ID NO: 1271647 - RNA, 16 nt, Human
aguauugcaaagucag

SEQ ID NO: 1271648 - RNA, 22 nt, Human
aguauugacaaaauguuauuuc

SEQ ID NO: 1271649 - RNA, 12 nt, Human
aguauuauaugu

SEQ ID NO: 1271650 - RNA, 13 nt, Human
aguauuauaugua

SEQ ID NO: 1271651 - RNA, 14 nt, Human
aguauuauauguac

SEQ ID NO: 1271652 - RNA, 18 nt, Human
aguauguucuaaccuuua

SEQ ID NO: 1271653 - RNA, 21 nt, Human
aguauguucuaaccuuuacau

SEQ ID NO: 1271654 - RNA, 22 nt, Human
aguauguucuaaccuuuacaug

SEQ ID NO: 1271655 - RNA, 17 nt, Human
ugucuaagauucuagau

SEQ ID NO: 1271656 - RNA, 23 nt, Human
ugucuaagaaauugaauacuuug

SEQ ID NO: 1271657 - RNA, 18 nt, Human
ugucuaagaaauugaaua

SEQ ID NO: 1271658 - RNA, 13 nt, Human
ugucuaagauucu

SEQ ID NO: 1271659 - RNA, 20 nt, Human
uguccuugaaggacuaauag

SEQ ID NO: 1271660 - RNA, 19 nt, Human
uguccuuuaccaaagauga

SEQ ID NO: 1271661 - RNA, 21 nt, Human
uguccuuuaccaaagaugaau

SEQ ID NO: 1271662 - RNA, 14 nt, Human
ugucuaagauucua

SEQ ID NO: 1271663 - RNA, 15 nt, Human
ugucuaagauucuag

SEQ ID NO: 1271664 - RNA, 20 nt, Human
agucagauggaaaauucauu

SEQ ID NO: 1271665 - RNA, 22 nt, Human
agucagauggaaaauucauuuu

SEQ ID NO: 1271666 - RNA, 23 nt, Human
agucagauggaaaauucauuuuu

SEQ ID NO: 1271667 - RNA, 16 nt, Human
agucagauucuugcau

SEQ ID NO: 1271668 - RNA, 16 nt, Human
ugucuaagauucuaga

SEQ ID NO: 1271669 - RNA, 17 nt, Human
agucagauucuugcauc

SEQ ID NO: 1271670 - RNA, 15 nt, Human
agucagucauucaga

SEQ ID NO: 1271671 - RNA, 21 nt, Human
agucagucauucagauaugau

SEQ ID NO: 1271672 - RNA, 13 nt, Human
agucauccagucu

SEQ ID NO: 1271673 - RNA, 18 nt, Human
agucccaucccugcguga

SEQ ID NO: 1271674 - RNA, 22 nt, Human
agucccagguuggcucugccag

SEQ ID NO: 1271675 - RNA, 22 nt, Human
aguccccacagauaacugaaaa

SEQ ID NO: 1271676 - RNA, 17 nt, Human
agucccaucugcuucag

SEQ ID NO: 1271677 - RNA, 18 nt, Human
agucccagguuggcucug

SEQ ID NO: 1271678 - RNA, 19 nt, Human
agucccagguuggcucugc

SEQ ID NO: 1271679 - RNA, 20 nt, Human
agucccagguuggcucugcc

SEQ ID NO: 1271680 - RNA, 21 nt, Human
agucccagguuggcucugcca

SEQ ID NO: 1271681 - RNA, 23 nt, Human
agucccagguuggcucugccagu

SEQ ID NO: 1271682 - RNA, 16 nt, Human
aguccaucagccucca

SEQ ID NO: 1271683 - RNA, 17 nt, Human
aguccaguccuaucugg

SEQ ID NO: 1271684 - RNA, 13 nt, Human
aguccaucagccu

SEQ ID NO: 1271685 - RNA, 14 nt, Human
aguccaucagccuc

SEQ ID NO: 1271686 - RNA, 11 nt, Human
agucaucuugc

SEQ ID NO: 1271687 - RNA, 13 nt, Human
agucaucuugcua

SEQ ID NO: 1271688 - RNA, 19 nt, Human
agucaucuugcuaccagua

SEQ ID NO: 1271689 - RNA, 23 nt, Human
agucaucuugcuaccaguauuua

SEQ ID NO: 1271690 - RNA, 13 nt, Human
aguccagguccug

SEQ ID NO: 1271691 - RNA, 14 nt, Human
aguccagguccugg

SEQ ID NO: 1271692 - RNA, 15 nt, Human
aguccagguccuggu

SEQ ID NO: 1271693 - RNA, 16 nt, Human
aguccagguccuggug

SEQ ID NO: 1271694 - RNA, 17 nt, Human
aguccagguccuggugg

SEQ ID NO: 1271695 - RNA, 19 nt, Human
aguccagguccuggugggg

SEQ ID NO: 1271696 - RNA, 18 nt, Human
aguccagguccugguggg

SEQ ID NO: 1271697 - RNA, 17 nt, Human
aguccaguccaguccua

SEQ ID NO: 1271698 - RNA, 21 nt, Human
aguccaguccuaucugggcuu

SEQ ID NO: 1271699 - RNA, 17 nt, Human
agucacucuuaugcugu

SEQ ID NO: 1271700 - RNA, 12 nt, Human
ugucagcaugaa

SEQ ID NO: 1271701 - RNA, 14 nt, Human
ugucagcaugaauu

SEQ ID NO: 1271702 - RNA, 16 nt, Human
ugucagcaugaauuug

SEQ ID NO: 1271703 - RNA, 20 nt, Human
ugucagcaugaauuuguaau

SEQ ID NO: 1271704 - RNA, 16 nt, Human
uguccacaggcuucug

SEQ ID NO: 1271705 - RNA, 17 nt, Human
uguccacauagguuuag

SEQ ID NO: 1271706 - RNA, 19 nt, Human
uguccaggcacugcugccc

SEQ ID NO: 1271707 - RNA, 17 nt, Human
uguccagcugagcgcca

SEQ ID NO: 1271708 - RNA, 21 nt, Human
uguccagcugagcgccaggau

SEQ ID NO: 1271709 - RNA, 20 nt, Human
uguccaggcacugcugccca

SEQ ID NO: 1271710 - RNA, 21 nt, Human
uguccaggcacugcugcccag

SEQ ID NO: 1271711 - RNA, 20 nt, Human
ugucccuaccgagucucuuc

SEQ ID NO: 1271712 - RNA, 21 nt, Human
ugucccuaccgagucucuucu

SEQ ID NO: 1271713 - RNA, 22 nt, Human
ugucccuaccgagucucuucuc

SEQ ID NO: 1271714 - RNA, 18 nt, Human
uguccacaggcuucugag

SEQ ID NO: 1271715 - RNA, 11 nt, Human
uguccaccccc

SEQ ID NO: 1271716 - RNA, 13 nt, Human
uguccacccccau

SEQ ID NO: 1271717 - RNA, 12 nt, Human
uguccaccccca

SEQ ID NO: 1271718 - RNA, 16 nt, Human
uguccacgacugucuc

SEQ ID NO: 1271719 - RNA, 17 nt, Human
uguccacgacugucucc

SEQ ID NO: 1271720 - RNA, 18 nt, Human
uguccacgacugucucca

SEQ ID NO: 1271721 - RNA, 19 nt, Human
uguccacgacugucuccau

SEQ ID NO: 1271722 - RNA, 12 nt, Human
uguccagcucca

SEQ ID NO: 1271723 - RNA, 16 nt, Human
uguccagcuccaaccu

SEQ ID NO: 1271724 - RNA, 20 nt, Human
uguccagcuccaaccugcaa

SEQ ID NO: 1271725 - RNA, 23 nt, Human
uguccagcuccaaccugcaaaga

SEQ ID NO: 1271726 - RNA, 18 nt, Human
ugucccuugccccccugg

SEQ ID NO: 1271727 - RNA, 21 nt, Human
ugucccuugccccccuggccu

SEQ ID NO: 1271728 - RNA, 22 nt, Human
ugucccuugccucaaugccagu

SEQ ID NO: 1271729 - RNA, 13 nt, Human
ugucccuaggugu

SEQ ID NO: 1271730 - RNA, 14 nt, Human
ugucccucccccuu

SEQ ID NO: 1271731 - RNA, 12 nt, Human
ugucccuccggg

SEQ ID NO: 1271732 - RNA, 17 nt, Human
uguccuggugguauuuu

SEQ ID NO: 1271733 - RNA, 18 nt, Human
uguccuggugguauuuuc

SEQ ID NO: 1271734 - RNA, 19 nt, Human
uguccuggugguauuuuca

SEQ ID NO: 1271735 - RNA, 20 nt, Human
uguccuggugguauuuucaa

SEQ ID NO: 1271736 - RNA, 15 nt, Human
uguccugguucccgu

SEQ ID NO: 1271737 - RNA, 15 nt, Human
uguccuguaaagguu

SEQ ID NO: 1271738 - RNA, 22 nt, Human
uguccuguaaagguuacaagcc

SEQ ID NO: 1271739 - RNA, 16 nt, Human
uguccuguacauugug

SEQ ID NO: 1271740 - RNA, 19 nt, Human
uguccugucaucaucaugg

SEQ ID NO: 1271741 - RNA, 15 nt, Human
uguccugucaucauc

SEQ ID NO: 1271742 - RNA, 14 nt, Human
uguccuuagccugg

SEQ ID NO: 1271743 - RNA, 15 nt, Human
uguccuuagccugga

SEQ ID NO: 1271744 - RNA, 16 nt, Human
uguccuuagccuggac

SEQ ID NO: 1271745 - RNA, 17 nt, Human
uguccuuagccuggacc

SEQ ID NO: 1271746 - RNA, 22 nt, Human
uguccuuagccuggaccucuga

SEQ ID NO: 1271747 - RNA, 23 nt, Human
uguccuuagccuggaccucugac

SEQ ID NO: 1271748 - RNA, 23 nt, Human
agcuggagaugaggccagaccau

SEQ ID NO: 1271749 - RNA, 22 nt, Human
agcuggagaugaggccagacca

SEQ ID NO: 1271750 - RNA, 21 nt, Human
agcuggagaugaggccagacc

SEQ ID NO: 1271751 - RNA, 20 nt, Human
agcuggagaugaggccagac

SEQ ID NO: 1271752 - RNA, 19 nt, Human
agcuggagaugaggccaga

SEQ ID NO: 1271753 - RNA, 14 nt, Human
agcuggagugcagu

SEQ ID NO: 1271754 - RNA, 21 nt, Human
agcuggaggcaggggcuuccu

SEQ ID NO: 1271755 - RNA, 22 nt, Human
agcuggaggcaggggcuuccug

SEQ ID NO: 1271756 - RNA, 13 nt, Human
agcuggaggcagg

SEQ ID NO: 1271757 - RNA, 17 nt, Human
agcuggaggcaggggcu

SEQ ID NO: 1271758 - RNA, 22 nt, Human
agcuggaucuccauucucucag

SEQ ID NO: 1271759 - RNA, 18 nt, Human
agcuggagaugaggccag

SEQ ID NO: 1271760 - RNA, 13 nt, Human
agcuggaaaagua

SEQ ID NO: 1271761 - RNA, 23 nt, Human
agcugccugucccuaccccaugg

SEQ ID NO: 1271762 - RNA, 22 nt, Human
ugccugcuuggggggugaugag

SEQ ID NO: 1271763 - RNA, 23 nt, Human
ugccucucugcaggucccuaaua

SEQ ID NO: 1271764 - RNA, 15 nt, Human
ugccucucugcaggu

SEQ ID NO: 1271765 - RNA, 11 nt, Human
ugccucugccu

SEQ ID NO: 1271766 - RNA, 23 nt, Human
ugccucugaggccagccuggccu

SEQ ID NO: 1271767 - RNA, 21 nt, Human
ugccucugccaaaggauguga

SEQ ID NO: 1271768 - RNA, 22 nt, Human
ugccucugccaaaggaugugau

SEQ ID NO: 1271769 - RNA, 12 nt, Human
ugccucugaggc

SEQ ID NO: 1271770 - RNA, 13 nt, Human
ugccucugaggcc

SEQ ID NO: 1271771 - RNA, 15 nt, Human
ugccucugaggccag

SEQ ID NO: 1271772 - RNA, 16 nt, Human
ugccucugaggccagc

SEQ ID NO: 1271773 - RNA, 17 nt, Human
ugccucugaggccagcc

SEQ ID NO: 1271774 - RNA, 18 nt, Human
ugccucugaggccagccu

SEQ ID NO: 1271775 - RNA, 19 nt, Human
ugccucugaggccagccug

SEQ ID NO: 1271776 - RNA, 20 nt, Human
ugccucugaggccagccugg

SEQ ID NO: 1271777 - RNA, 21 nt, Human
ugccucugaggccagccuggc

SEQ ID NO: 1271778 - RNA, 22 nt, Human
ugccucugaggccagccuggcc

SEQ ID NO: 1271779 - RNA, 14 nt, Human
ugccugccuuucca

SEQ ID NO: 1271780 - RNA, 15 nt, Human
ugccugccuuuccau

SEQ ID NO: 1271781 - RNA, 22 nt, Human
ugccugccuuuccauccauggc

SEQ ID NO: 1271782 - RNA, 19 nt, Human
ugccugcgugggugugugc

SEQ ID NO: 1271783 - RNA, 17 nt, Human
ugccugcuauuugaagu

SEQ ID NO: 1271784 - RNA, 14 nt, Human
ugccugcucccauc

SEQ ID NO: 1271785 - RNA, 15 nt, Human
ugccugcucccaucc

SEQ ID NO: 1271786 - RNA, 18 nt, Human
ugccugcucccauccugu

SEQ ID NO: 1271787 - RNA, 20 nt, Human
ugccugcucccauccugugu

SEQ ID NO: 1271788 - RNA, 22 nt, Human
ugccugcucccauccugugugu

SEQ ID NO: 1271789 - RNA, 16 nt, Human
ugccugcucgcucccu

SEQ ID NO: 1271790 - RNA, 21 nt, Human
ugccugcucgcucccugcaga

SEQ ID NO: 1271791 - RNA, 12 nt, Human
ugccucucugca

SEQ ID NO: 1271792 - RNA, 11 nt, Human
ugccucucugc

SEQ ID NO: 1271793 - RNA, 18 nt, Human
ugccucagaaaacaagga

SEQ ID NO: 1271794 - RNA, 14 nt, Human
ugccucacuucagg

SEQ ID NO: 1271795 - RNA, 14 nt, Human
ugccucagagacca

SEQ ID NO: 1271796 - RNA, 15 nt, Human
ugccucagagaccag

SEQ ID NO: 1271797 - RNA, 16 nt, Human
ugccucagagaccagg

SEQ ID NO: 1271798 - RNA, 18 nt, Human
ugccucagagaccagggc

SEQ ID NO: 1271799 - RNA, 23 nt, Human
ugccucagccacuugccugugcu

SEQ ID NO: 1271800 - RNA, 15 nt, Human
ugccucagccucccg

SEQ ID NO: 1271801 - RNA, 19 nt, Human
ugccucagagaccagggcu

SEQ ID NO: 1271802 - RNA, 15 nt, Human
ugccucagccuccug

SEQ ID NO: 1271803 - RNA, 18 nt, Human
ugccucaggaggcaggac

SEQ ID NO: 1271804 - RNA, 21 nt, Human
ugccucaggaggcaggaccuu

SEQ ID NO: 1271805 - RNA, 21 nt, Human
agcucuuccuuacucccaggc

SEQ ID NO: 1271806 - RNA, 22 nt, Human
agcucuuccuuacucccaggca

SEQ ID NO: 1271807 - RNA, 12 nt, Human
ugcccugugcaa

SEQ ID NO: 1271808 - RNA, 14 nt, Human
ugcccuucuccuua

SEQ ID NO: 1271809 - RNA, 13 nt, Human
ugcccuucuuucu

SEQ ID NO: 1271810 - RNA, 14 nt, Human
ugcccuucuuucua

SEQ ID NO: 1271811 - RNA, 21 nt, Human
ugcccuucuuucuacccugcu

SEQ ID NO: 1271812 - RNA, 15 nt, Human
ugcccuucacuguca

SEQ ID NO: 1271813 - RNA, 15 nt, Human
ugccucaccccuugc

SEQ ID NO: 1271814 - RNA, 16 nt, Human
ugcccuucuuucuacc

SEQ ID NO: 1271815 - RNA, 22 nt, Human
ugcccugccaccugucugucug

SEQ ID NO: 1271816 - RNA, 21 nt, Human
ugcccugccaccugucugucu

SEQ ID NO: 1271817 - RNA, 20 nt, Human
ugcccugccaccugucuguc

SEQ ID NO: 1271818 - RNA, 15 nt, Human
agcuccacccuggcc

SEQ ID NO: 1271819 - RNA, 17 nt, Human
agcuccacccuggccga

SEQ ID NO: 1271820 - RNA, 11 nt, Human
agcuccacucu

SEQ ID NO: 1271821 - RNA, 12 nt, Human
agcuccacucug

SEQ ID NO: 1271822 - RNA, 13 nt, Human
agcuccacucugc

SEQ ID NO: 1271823 - RNA, 14 nt, Human
agcuccacucugcu

SEQ ID NO: 1271824 - RNA, 16 nt, Human
agcuccacucugcuuc

SEQ ID NO: 1271825 - RNA, 17 nt, Human
agcuccacucugcuucu

SEQ ID NO: 1271826 - RNA, 18 nt, Human
agcuccacucugcuucuc

SEQ ID NO: 1271827 - RNA, 19 nt, Human
agcuccacucugcuucucu

SEQ ID NO: 1271828 - RNA, 22 nt, Human
agcuccacucugcuucucugac

SEQ ID NO: 1271829 - RNA, 23 nt, Human
agcuccacucugcuucucugacu

SEQ ID NO: 1271830 - RNA, 24 nt, Human
agcuccacucugcuucucugacuu

SEQ ID NO: 1271831 - RNA, 19 nt, Human
ugcccugccaccugucugu

SEQ ID NO: 1271832 - RNA, 17 nt, Human
ugcccugccaccugucu

SEQ ID NO: 1271833 - RNA, 16 nt, Human
ugcccugccaccuguc

SEQ ID NO: 1271834 - RNA, 15 nt, Human
ugcccugccaccugu

SEQ ID NO: 1271835 - RNA, 14 nt, Human
ugcccugccaccug

SEQ ID NO: 1271836 - RNA, 15 nt, Human
ugcccugaucccaga

SEQ ID NO: 1271837 - RNA, 22 nt, Human
ugcccugagccagggucuccag

SEQ ID NO: 1271838 - RNA, 19 nt, Human
ugcccucugggcucugagu

SEQ ID NO: 1271839 - RNA, 16 nt, Human
ugcccucugggcucug

SEQ ID NO: 1271840 - RNA, 17 nt, Human
ugcccucugggcucuga

SEQ ID NO: 1271841 - RNA, 18 nt, Human
ugcccucugggcucugag

SEQ ID NO: 1271842 - RNA, 20 nt, Human
ugcccuaaugcgcaggcugg

SEQ ID NO: 1271843 - RNA, 18 nt, Human
ugcccuaagcagaaagug

SEQ ID NO: 1271844 - RNA, 20 nt, Human
ugcccuaagcagaaagugcc

SEQ ID NO: 1271845 - RNA, 22 nt, Human
ugcccuaagcagaaagugccuu

SEQ ID NO: 1271846 - RNA, 17 nt, Human
ugccccggccccucccc

SEQ ID NO: 1271847 - RNA, 13 nt, Human
ugcccuaagcaga

SEQ ID NO: 1271848 - RNA, 15 nt, Human
ugcccuaagcagaaa

SEQ ID NO: 1271849 - RNA, 17 nt, Human
ugcccuaagcagaaagu

SEQ ID NO: 1271850 - RNA, 23 nt, Human
ugcccuaaugcgcaggcuggccc

SEQ ID NO: 1271851 - RNA, 22 nt, Human
ugcccuacagcacccugugguc

SEQ ID NO: 1271852 - RNA, 22 nt, Human
ugcccucccccuccucuccacc

SEQ ID NO: 1271853 - RNA, 14 nt, Human
ugcccuccugugcu

SEQ ID NO: 1271854 - RNA, 20 nt, Human
ugcccuccugugcucagccc

SEQ ID NO: 1271855 - RNA, 23 nt, Human
ugcccuccugugcucagcccuga

SEQ ID NO: 1271856 - RNA, 21 nt, Human
ugcccuccugugcucagcccu

SEQ ID NO: 1271857 - RNA, 16 nt, Human
ugcccucuccccucag

SEQ ID NO: 1271858 - RNA, 12 nt, Human
ugcccucuccca

SEQ ID NO: 1271859 - RNA, 13 nt, Human
ugcccucucccac

SEQ ID NO: 1271860 - RNA, 15 nt, Human
ugcccucucccaccc

SEQ ID NO: 1271861 - RNA, 16 nt, Human
ugcccucucccacccu

SEQ ID NO: 1271862 - RNA, 17 nt, Human
ugcccucucccacccuc

SEQ ID NO: 1271863 - RNA, 20 nt, Human
ugcccucugcauccucugga

SEQ ID NO: 1271864 - RNA, 12 nt, Human
ugcccucugggc

SEQ ID NO: 1271865 - RNA, 13 nt, Human
ugcccucugggcu

SEQ ID NO: 1271866 - RNA, 14 nt, Human
ugcccucugggcuc

SEQ ID NO: 1271867 - RNA, 15 nt, Human
ugcccucugggcucu

SEQ ID NO: 1271868 - RNA, 13 nt, Human
agcuccagccuga

SEQ ID NO: 1271869 - RNA, 14 nt, Human
agcuccagccugac

SEQ ID NO: 1271870 - RNA, 15 nt, Human
agcuccagccugaca

SEQ ID NO: 1271871 - RNA, 19 nt, Human
agcuccagcuccuuugggc

SEQ ID NO: 1271872 - RNA, 16 nt, Human
agcuccagccugacau

SEQ ID NO: 1271873 - RNA, 21 nt, Human
agcuccauuuaaacagauguc

SEQ ID NO: 1271874 - RNA, 16 nt, Human
agcucccacaagccuc

SEQ ID NO: 1271875 - RNA, 17 nt, Human
agcucccacaagccucu

SEQ ID NO: 1271876 - RNA, 18 nt, Human
agcuccauuuaaacagau

SEQ ID NO: 1271877 - RNA, 15 nt, Human
agcuccauuuaaaca

SEQ ID NO: 1271878 - RNA, 14 nt, Human
agcuccauuuaaac

SEQ ID NO: 1271879 - RNA, 21 nt, Human
agcuccaucuccacuccagau

SEQ ID NO: 1271880 - RNA, 18 nt, Human
agcucccacaagccucug

SEQ ID NO: 1271881 - RNA, 20 nt, Human
agcucccacaagccucugcc

SEQ ID NO: 1271882 - RNA, 16 nt, Human
agcucccacaagccug

SEQ ID NO: 1271883 - RNA, 17 nt, Human
agcucccacaagccuga

SEQ ID NO: 1271884 - RNA, 19 nt, Human
agcucccacaagccugagg

SEQ ID NO: 1271885 - RNA, 11 nt, Human
agcucccaccu

SEQ ID NO: 1271886 - RNA, 14 nt, Human
agcucccaccuccc

SEQ ID NO: 1271887 - RNA, 19 nt, Human
agcucccaccuccccuugg

SEQ ID NO: 1271888 - RNA, 21 nt, Human
agcucccaccuccccuugggc

SEQ ID NO: 1271889 - RNA, 21 nt, Human
agcuccuugagggcaagagcc

SEQ ID NO: 1271890 - RNA, 22 nt, Human
agcuccuugagggcaagagcca

SEQ ID NO: 1271891 - RNA, 19 nt, Human
agcucccccagcaaagccc

SEQ ID NO: 1271892 - RNA, 23 nt, Human
agcucccccagcaaagcccccag

SEQ ID NO: 1271893 - RNA, 15 nt, Human
agcucccccucccuc

SEQ ID NO: 1271894 - RNA, 23 nt, Human
agcucugcccauccugccccuga

SEQ ID NO: 1271895 - RNA, 18 nt, Human
agcucuggacagccccac

SEQ ID NO: 1271896 - RNA, 21 nt, Human
agcucuggacagccccacccu

SEQ ID NO: 1271897 - RNA, 21 nt, Human
agcucugcagagcaggaaaca

SEQ ID NO: 1271898 - RNA, 12 nt, Human
agcucugagcug

SEQ ID NO: 1271899 - RNA, 13 nt, Human
agcucugagcugu

SEQ ID NO: 1271900 - RNA, 14 nt, Human
agcucugagcuguc

SEQ ID NO: 1271901 - RNA, 15 nt, Human
agcucugagcuguca

SEQ ID NO: 1271902 - RNA, 16 nt, Human
agcucugagcugucaa

SEQ ID NO: 1271903 - RNA, 12 nt, Human
agcucugaggga

SEQ ID NO: 1271904 - RNA, 15 nt, Human
agcucugagggaaag

SEQ ID NO: 1271905 - RNA, 17 nt, Human
agcucuaucaccaagga

SEQ ID NO: 1271906 - RNA, 23 nt, Human
agcucugagaggcccuggaucag

SEQ ID NO: 1271907 - RNA, 10 nt, Human
agcucugagc

SEQ ID NO: 1271908 - RNA, 21 nt, Human
agcucuaauguuugcauauaa

SEQ ID NO: 1271909 - RNA, 17 nt, Human
agcucuacugccucaac

SEQ ID NO: 1271910 - RNA, 13 nt, Human
agcucuagaaucu

SEQ ID NO: 1271911 - RNA, 14 nt, Human
agcucuagaaucug

SEQ ID NO: 1271912 - RNA, 15 nt, Human
agcucuagaaucugc

SEQ ID NO: 1271913 - RNA, 22 nt, Human
agcucuaauguuugcauauaag

SEQ ID NO: 1271914 - RNA, 20 nt, Human
agcucuaauguuugcauaua

SEQ ID NO: 1271915 - RNA, 18 nt, Human
agcucuaauguuugcaua

SEQ ID NO: 1271916 - RNA, 17 nt, Human
agcucuaauguuugcau

SEQ ID NO: 1271917 - RNA, 14 nt, Human
agcucuaauguuug

SEQ ID NO: 1271918 - RNA, 14 nt, Human
agcucuaaaaucug

SEQ ID NO: 1271919 - RNA, 17 nt, Human
agcucuaaaaucugcuu

SEQ ID NO: 1271920 - RNA, 12 nt, Human
agcucuggaggg

SEQ ID NO: 1271921 - RNA, 16 nt, Human
agcucuggaggggagg

SEQ ID NO: 1271922 - RNA, 17 nt, Human
agcucuggaggggaggg

SEQ ID NO: 1271923 - RNA, 18 nt, Human
agcucuggaggggagggg

SEQ ID NO: 1271924 - RNA, 19 nt, Human
agcucuggaggggaggggg

SEQ ID NO: 1271925 - RNA, 20 nt, Human
agcucuggaggggaggggga

SEQ ID NO: 1271926 - RNA, 15 nt, Human
agcucuguucuuccu

SEQ ID NO: 1271927 - RNA, 17 nt, Human
agcucuguucuuccuca

SEQ ID NO: 1271928 - RNA, 18 nt, Human
agcucuguucuuccucag

SEQ ID NO: 1271929 - RNA, 19 nt, Human
agcucuguucuuccucagc

SEQ ID NO: 1271930 - RNA, 20 nt, Human
agcucuguucuuccucagcc

SEQ ID NO: 1271931 - RNA, 21 nt, Human
agcucuguucuuccucagcca

SEQ ID NO: 1271932 - RNA, 22 nt, Human
agcucuguucuuccucagccag

SEQ ID NO: 1271933 - RNA, 23 nt, Human
agcucuguucuuccucagccagc

SEQ ID NO: 1271934 - RNA, 16 nt, Human
agcucuuaacuacagu

SEQ ID NO: 1271935 - RNA, 13 nt, Human
agcucuucauguu

SEQ ID NO: 1271936 - RNA, 16 nt, Human
agcucuucauguuuca

SEQ ID NO: 1271937 - RNA, 16 nt, Human
ugcauuuauauguacc

SEQ ID NO: 1271938 - RNA, 19 nt, Human
ugcauuuaugagcucuuca

SEQ ID NO: 1271939 - RNA, 14 nt, Human
ugcauuuauaugua

SEQ ID NO: 1271940 - RNA, 13 nt, Human
ugcauuuauaugu

SEQ ID NO: 1271941 - RNA, 16 nt, Human
ugcauuuaaauacagu

SEQ ID NO: 1271942 - RNA, 22 nt, Human
ugcauuuaaauacagucuucca

SEQ ID NO: 1271943 - RNA, 24 nt, Human
ugcauuuaaauacagucuuccauu

SEQ ID NO: 1271944 - RNA, 13 nt, Human
ugcauuuccugac

SEQ ID NO: 1271945 - RNA, 14 nt, Human
ugcauucugccucu

SEQ ID NO: 1271946 - RNA, 15 nt, Human
ugcauucugccucuc

SEQ ID NO: 1271947 - RNA, 19 nt, Human
ugcauucugccucucuagg

SEQ ID NO: 1271948 - RNA, 20 nt, Human
ugcauucugccucucuagga

SEQ ID NO: 1271949 - RNA, 23 nt, Human
ugcauuauuugagaagcugcuca

SEQ ID NO: 1271950 - RNA, 17 nt, Human
ugcauuauuuuccagau

SEQ ID NO: 1271951 - RNA, 12 nt, Human
ugcauucuagua

SEQ ID NO: 1271952 - RNA, 14 nt, Human
agcgcaguuuuuuu

SEQ ID NO: 1271953 - RNA, 23 nt, Human
agcgcaguuuuuuuuuucuuguc

SEQ ID NO: 1271954 - RNA, 14 nt, Human
agcgcacucuucau

SEQ ID NO: 1271955 - RNA, 21 nt, Human
agcgcugucaggauugcgaga

SEQ ID NO: 1271956 - RNA, 16 nt, Human
agcgcugucaggauug

SEQ ID NO: 1271957 - RNA, 16 nt, Human
ugcauuauuugagaag

SEQ ID NO: 1271958 - RNA, 15 nt, Human
ugcauuauuugagaa

SEQ ID NO: 1271959 - RNA, 17 nt, Human
agcggaacaaggaguca

SEQ ID NO: 1271960 - RNA, 22 nt, Human
agcggaacaaggagucagacau

SEQ ID NO: 1271961 - RNA, 12 nt, Human
agccuucucugu

SEQ ID NO: 1271962 - RNA, 16 nt, Human
agccuuccccuacccc

SEQ ID NO: 1271963 - RNA, 20 nt, Human
agccuuccccuaccccuugu

SEQ ID NO: 1271964 - RNA, 21 nt, Human
agccuuccccuuauccucccu

SEQ ID NO: 1271965 - RNA, 23 nt, Human
agccuuccccuuauccucccugu

SEQ ID NO: 1271966 - RNA, 14 nt, Human
agccuucucuguuc

SEQ ID NO: 1271967 - RNA, 19 nt, Human
agccuugauugguguugcc

SEQ ID NO: 1271968 - RNA, 20 nt, Human
agccuugauugguguugcca

SEQ ID NO: 1271969 - RNA, 13 nt, Human
agccuugccagag

SEQ ID NO: 1271970 - RNA, 14 nt, Human
agccuugccagaga

SEQ ID NO: 1271971 - RNA, 15 nt, Human
agccuugccagagau

SEQ ID NO: 1271972 - RNA, 17 nt, Human
agccuugccagagaucc

SEQ ID NO: 1271973 - RNA, 19 nt, Human
agccuugccagagauccaa

SEQ ID NO: 1271974 - RNA, 13 nt, Human
ugccacugccucu

SEQ ID NO: 1271975 - RNA, 17 nt, Human
ugccacugccucuuccu

SEQ ID NO: 1271976 - RNA, 20 nt, Human
ugcauuuaugagcucuucau

SEQ ID NO: 1271977 - RNA, 18 nt, Human
ugccacugccucuuccuc

SEQ ID NO: 1271978 - RNA, 19 nt, Human
ugccacugccucuuccucc

SEQ ID NO: 1271979 - RNA, 20 nt, Human
ugccacugccucuuccuccc

SEQ ID NO: 1271980 - RNA, 14 nt, Human
ugccagagauccaa

SEQ ID NO: 1271981 - RNA, 11 nt, Human
ugccagagccu

SEQ ID NO: 1271982 - RNA, 12 nt, Human
ugccagagccug

SEQ ID NO: 1271983 - RNA, 13 nt, Human
ugccagagccugg

SEQ ID NO: 1271984 - RNA, 14 nt, Human
ugccagagccuggg

SEQ ID NO: 1271985 - RNA, 15 nt, Human
ugccagagccugggg

SEQ ID NO: 1271986 - RNA, 16 nt, Human
ugccagagccuggggc

SEQ ID NO: 1271987 - RNA, 17 nt, Human
ugccagagccuggggcu

SEQ ID NO: 1271988 - RNA, 18 nt, Human
ugccagagccuggggcuc

SEQ ID NO: 1271989 - RNA, 19 nt, Human
ugccagagccuggggcucu

SEQ ID NO: 1271990 - RNA, 20 nt, Human
ugccagagccuggggcucua

SEQ ID NO: 1271991 - RNA, 22 nt, Human
ugccagaggcugaugucaagca

SEQ ID NO: 1271992 - RNA, 21 nt, Human
ugccagccaagcucugcaguc

SEQ ID NO: 1271993 - RNA, 23 nt, Human
ugccagcucuguaucaggaccca

SEQ ID NO: 1271994 - RNA, 13 nt, Human
ugccagccaagcu

SEQ ID NO: 1271995 - RNA, 15 nt, Human
ugccagcugcacuga

SEQ ID NO: 1271996 - RNA, 19 nt, Human
ugccaggaacccuuaaaca

SEQ ID NO: 1271997 - RNA, 13 nt, Human
ugccaguccuguc

SEQ ID NO: 1271998 - RNA, 15 nt, Human
ugccaguccuguccu

SEQ ID NO: 1271999 - RNA, 14 nt, Human
ugccaguccugucc

SEQ ID NO: 1272000 - RNA, 16 nt, Human
ugccagugacagacag

SEQ ID NO: 1272001 - RNA, 17 nt, Human
ugccagugacagacagg

SEQ ID NO: 1272002 - RNA, 19 nt, Human
ugccagugacagacaggcu

SEQ ID NO: 1272003 - RNA, 20 nt, Human
ugccagugacagacaggcuc

SEQ ID NO: 1272004 - RNA, 22 nt, Human
ugccagugacagacaggcucuu

SEQ ID NO: 1272005 - RNA, 15 nt, Human
agcguccuccucugu

SEQ ID NO: 1272006 - RNA, 16 nt, Human
agcguccuccucugug

SEQ ID NO: 1272007 - RNA, 17 nt, Human
agcguccuccucuguga

SEQ ID NO: 1272008 - RNA, 20 nt, Human
agcggcuugccugccugcuc

SEQ ID NO: 1272009 - RNA, 15 nt, Human
agcuccaagaauuuc

SEQ ID NO: 1272010 - RNA, 22 nt, Human
agcuccaaccugcaaagaucug

SEQ ID NO: 1272011 - RNA, 18 nt, Human
agcuccaagaauuucuag

SEQ ID NO: 1272012 - RNA, 15 nt, Human
agcuccaagccccau

SEQ ID NO: 1272013 - RNA, 20 nt, Human
ugccauuguagcgucuuucu

SEQ ID NO: 1272014 - RNA, 15 nt, Human
ugccauuuguacuga

SEQ ID NO: 1272015 - RNA, 18 nt, Human
agcucaggaugagggaaa

SEQ ID NO: 1272016 - RNA, 22 nt, Human
agcucaggaugagggaaaagaa

SEQ ID NO: 1272017 - RNA, 17 nt, Human
agcuaucguaaaauuaa

SEQ ID NO: 1272018 - RNA, 18 nt, Human
agcuauguuauauugaaa

SEQ ID NO: 1272019 - RNA, 22 nt, Human
agcuauguuauauugaaaaaau

SEQ ID NO: 1272020 - RNA, 20 nt, Human
agcuauguuauauugaaaaa

SEQ ID NO: 1272021 - RNA, 20 nt, Human
agcuaugucccaggaaucag

SEQ ID NO: 1272022 - RNA, 19 nt, Human
agcuagucuuuugcuuuug

SEQ ID NO: 1272023 - RNA, 23 nt, Human
agcuagucuuuugcuuuugccca

SEQ ID NO: 1272024 - RNA, 17 nt, Human
agcuagugacccacaug

SEQ ID NO: 1272025 - RNA, 18 nt, Human
agcuagugacccacaugc

SEQ ID NO: 1272026 - RNA, 21 nt, Human
agcuagugacccacaugccau

SEQ ID NO: 1272027 - RNA, 20 nt, Human
agcuagugacccacaugcca

SEQ ID NO: 1272028 - RNA, 20 nt, Human
agcuaucauugcuuccuccu

SEQ ID NO: 1272029 - RNA, 18 nt, Human
agcuauccggacagagca

SEQ ID NO: 1272030 - RNA, 16 nt, Human
agcuacagagaaacca

SEQ ID NO: 1272031 - RNA, 19 nt, Human
agcguccuccucugugacc

SEQ ID NO: 1272032 - RNA, 15 nt, Human
agcgucggucugugc

SEQ ID NO: 1272033 - RNA, 18 nt, Human
agcgucuuucuuuuuugg

SEQ ID NO: 1272034 - RNA, 16 nt, Human
agcgucggucugugcc

SEQ ID NO: 1272035 - RNA, 17 nt, Human
agcuacagagaaaccag

SEQ ID NO: 1272036 - RNA, 18 nt, Human
agcuacagagaaaccagc
